United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 40

SEQ ID NO: 1430884 - RNA, 23 nt, Pseudomonas aeruginosa PA01
cuucggcgcucuucagcacgccc

SEQ ID NO: 1430885 - RNA, 12 nt, Pseudomonas aeruginosa PA01
cuucggcgcgac

SEQ ID NO: 1430886 - RNA, 19 nt, Pseudomonas aeruginosa PA01
cuucggcggauaacgcuac

SEQ ID NO: 1430887 - RNA, 14 nt, Pseudomonas aeruginosa PA01
cuucggcggccagc

SEQ ID NO: 1430888 - RNA, 15 nt, Pseudomonas aeruginosa PA01
cugcgcgccaccacc

SEQ ID NO: 1430889 - RNA, 13 nt, Pseudomonas aeruginosa PA01
cugcgcggcgacg

SEQ ID NO: 1430890 - RNA, 16 nt, Pseudomonas aeruginosa PA01
cugcgcggcgacgauc

SEQ ID NO: 1430891 - RNA, 20 nt, Pseudomonas aeruginosa PA01
cugcgcggcguucgcccugc

SEQ ID NO: 1430892 - RNA, 13 nt, Pseudomonas aeruginosa PA01
cugcgcgggucgu

SEQ ID NO: 1430893 - RNA, 23 nt, Pseudomonas aeruginosa PA01
cugcgcgggugucgcgacgguga

SEQ ID NO: 1430894 - RNA, 14 nt, Pseudomonas aeruginosa PA01
cugcgcguugcagc

SEQ ID NO: 1430895 - RNA, 18 nt, Pseudomonas aeruginosa PA01
cugcgcguugcagcgccu

SEQ ID NO: 1430896 - RNA, 19 nt, Pseudomonas aeruginosa PA01
cugcgcguugcagcgccug

SEQ ID NO: 1430897 - RNA, 19 nt, Pseudomonas aeruginosa PA01
cugcgcuucguuggcgacg

SEQ ID NO: 1430898 - RNA, 20 nt, Pseudomonas aeruginosa PA01
cugcgcuucguuggcgacga

SEQ ID NO: 1430899 - RNA, 13 nt, Pseudomonas aeruginosa PA01
cugcgcuguucgg

SEQ ID NO: 1430900 - RNA, 22 nt, Pseudomonas aeruginosa PA01
cugcggaucaacuccgccaggc

SEQ ID NO: 1430901 - RNA, 12 nt, Pseudomonas aeruginosa PA01
cugcggaagagg

SEQ ID NO: 1430902 - RNA, 18 nt, Pseudomonas aeruginosa PA01
cugcgcuguucgggucgc

SEQ ID NO: 1430903 - RNA, 18 nt, Pseudomonas aeruginosa PA01
cugcgcuuccggcagcca

SEQ ID NO: 1430904 - RNA, 20 nt, Pseudomonas aeruginosa PA01
cugcgcuuccggcagccagc

SEQ ID NO: 1430905 - RNA, 12 nt, Pseudomonas aeruginosa PA01
cugcgcucggcg

SEQ ID NO: 1430906 - RNA, 14 nt, Pseudomonas aeruginosa PA01
cugcgcucggcgcu

SEQ ID NO: 1430907 - RNA, 15 nt, Pseudomonas aeruginosa PA01
cugcgcuccaggcgg

SEQ ID NO: 1430908 - RNA, 18 nt, Pseudomonas aeruginosa PA01
cugcgcuccaggcgguag

SEQ ID NO: 1430909 - RNA, 15 nt, Pseudomonas aeruginosa PA01
cugcgcugagcagga

SEQ ID NO: 1430910 - RNA, 15 nt, Pseudomonas aeruginosa PA01
cugcgcuggccgagc

SEQ ID NO: 1430911 - RNA, 12 nt, Pseudomonas aeruginosa PA01
cugcgcugggcg

SEQ ID NO: 1430912 - RNA, 16 nt, Pseudomonas aeruginosa PA01
cugcgcugggcgccga

SEQ ID NO: 1430913 - RNA, 13 nt, Pseudomonas aeruginosa PA01
cugcggcuggcga

SEQ ID NO: 1430914 - RNA, 18 nt, Pseudomonas aeruginosa PA01
cugcgggaacuuggcgcg

SEQ ID NO: 1430915 - RNA, 19 nt, Pseudomonas aeruginosa PA01
cugcggcuugcccugcucg

SEQ ID NO: 1430916 - RNA, 12 nt, Pseudomonas aeruginosa PA01
cugcggcgccgg

SEQ ID NO: 1430917 - RNA, 13 nt, Pseudomonas aeruginosa PA01
cugcggcucgccg

SEQ ID NO: 1430918 - RNA, 22 nt, Pseudomonas aeruginosa PA01
cugcggcggcaccacgugcagc

SEQ ID NO: 1430919 - RNA, 17 nt, Pseudomonas aeruginosa PA01
cugcggcggcaggucgg

SEQ ID NO: 1430920 - RNA, 21 nt, Pseudomonas aeruginosa PA01
cugcggcggucccagaccagc

SEQ ID NO: 1430921 - RNA, 22 nt, Pseudomonas aeruginosa PA01
cugcggcggucccagaccagca

SEQ ID NO: 1430922 - RNA, 14 nt, Pseudomonas aeruginosa PA01
cugcggccagcgcc

SEQ ID NO: 1430923 - RNA, 15 nt, Pseudomonas aeruginosa PA01
cugcggccagcgcca

SEQ ID NO: 1430924 - RNA, 20 nt, Pseudomonas aeruginosa PA01
cugcggcaggcgccaaccgg

SEQ ID NO: 1430925 - RNA, 19 nt, Pseudomonas aeruginosa PA01
cugcggcaggguggcgcau

SEQ ID NO: 1430926 - RNA, 18 nt, Pseudomonas aeruginosa PA01
cugcggcccgagggcggc

SEQ ID NO: 1430927 - RNA, 21 nt, Pseudomonas aeruginosa PA01
cugcggcccgagggcggcagg

SEQ ID NO: 1430928 - RNA, 12 nt, Pseudomonas aeruginosa PA01
cugcggccggcg

SEQ ID NO: 1430929 - RNA, 15 nt, Pseudomonas aeruginosa PA01
cugcggccggcgcgu

SEQ ID NO: 1430930 - RNA, 19 nt, Pseudomonas aeruginosa PA01
cugcggauucaucggcggc

SEQ ID NO: 1430931 - RNA, 20 nt, Pseudomonas aeruginosa PA01
cugcggauucaucggcggca

SEQ ID NO: 1430932 - RNA, 23 nt, Pseudomonas aeruginosa PA01
cugcggauucaucggcggcaggc

SEQ ID NO: 1430933 - RNA, 13 nt, Pseudomonas aeruginosa PA01
cugcggaucgagg

SEQ ID NO: 1430934 - RNA, 15 nt, Pseudomonas aeruginosa PA01
cugcggaucgaucag

SEQ ID NO: 1430935 - RNA, 14 nt, Pseudomonas aeruginosa PA01
cugcggauggcgcg

SEQ ID NO: 1430936 - RNA, 18 nt, Pseudomonas aeruginosa PA01
cugcggaugggcgacgac

SEQ ID NO: 1430937 - RNA, 12 nt, Pseudomonas aeruginosa PA01
cugcgccaggcg

SEQ ID NO: 1430938 - RNA, 21 nt, Pseudomonas aeruginosa PA01
cugcgccaggcuuuccgccga

SEQ ID NO: 1430939 - RNA, 21 nt, Pseudomonas aeruginosa PA01
cugcgccaguuccuucgccga

SEQ ID NO: 1430940 - RNA, 14 nt, Pseudomonas aeruginosa PA01
cugcgcccccagcg

SEQ ID NO: 1430941 - RNA, 16 nt, Pseudomonas aeruginosa PA01
cugcgcccccagcgcc

SEQ ID NO: 1430942 - RNA, 17 nt, Pseudomonas aeruginosa PA01
cugcgcccccagcgccc

SEQ ID NO: 1430943 - RNA, 19 nt, Pseudomonas aeruginosa PA01
cugcgcccccagcgcccgc

SEQ ID NO: 1430944 - RNA, 20 nt, Pseudomonas aeruginosa PA01
cugcgcccccagcgcccgca

SEQ ID NO: 1430945 - RNA, 13 nt, Pseudomonas aeruginosa PA01
cugcgccaugccg

SEQ ID NO: 1430946 - RNA, 19 nt, Pseudomonas aeruginosa PA01
cugcgccauucacuucccc

SEQ ID NO: 1430947 - RNA, 14 nt, Pseudomonas aeruginosa PA01
cugcgccccggucu

SEQ ID NO: 1430948 - RNA, 22 nt, Pseudomonas aeruginosa PA01
cugcgccccggucucgcgcagc

SEQ ID NO: 1430949 - RNA, 18 nt, Pseudomonas aeruginosa PA01
cugcgccgaaggcgucag

SEQ ID NO: 1430950 - RNA, 18 nt, Pseudomonas aeruginosa PA01
cugcgcccuagucgaggg

SEQ ID NO: 1430951 - RNA, 23 nt, Pseudomonas aeruginosa PA01
cugcgcccucaagucuccagcga

SEQ ID NO: 1430952 - RNA, 17 nt, Pseudomonas aeruginosa PA01
cugcgcauuguucgggg

SEQ ID NO: 1430953 - RNA, 16 nt, Pseudomonas aeruginosa PA01
cugcgccagcaucgca

SEQ ID NO: 1430954 - RNA, 19 nt, Pseudomonas aeruginosa PA01
cugcgcaucgccugggccg

SEQ ID NO: 1430955 - RNA, 14 nt, Pseudomonas aeruginosa PA01
cugcgcaggccgag

SEQ ID NO: 1430956 - RNA, 15 nt, Pseudomonas aeruginosa PA01
cugcgcaggccgaga

SEQ ID NO: 1430957 - RNA, 18 nt, Pseudomonas aeruginosa PA01
cugcgcagggcgccgucg

SEQ ID NO: 1430958 - RNA, 18 nt, Pseudomonas aeruginosa PA01
cugcgcaccucggccagg

SEQ ID NO: 1430959 - RNA, 13 nt, Pseudomonas aeruginosa PA01
cugcgcaccaugc

SEQ ID NO: 1430960 - RNA, 19 nt, Pseudomonas aeruginosa PA01
cugcgcaccaugcccgcug

SEQ ID NO: 1430961 - RNA, 21 nt, Pseudomonas aeruginosa PA01
cugcgcgaagccaggaagcgg

SEQ ID NO: 1430962 - RNA, 21 nt, Pseudomonas aeruginosa PA01
cugcgccucggcccuggcggc

SEQ ID NO: 1430963 - RNA, 16 nt, Pseudomonas aeruginosa PA01
cugcgccuggccgcgc

SEQ ID NO: 1430964 - RNA, 13 nt, Pseudomonas aeruginosa PA01
cugcgcgcaucga

SEQ ID NO: 1430965 - RNA, 22 nt, Pseudomonas aeruginosa PA01
cugcgcgccucuuccuggaccu

SEQ ID NO: 1430966 - RNA, 21 nt, Pseudomonas aeruginosa PA01
cugcgcgccaucuccucgcug

SEQ ID NO: 1430967 - RNA, 23 nt, Pseudomonas aeruginosa PA01
cugcgccgccuuucugcccggcu

SEQ ID NO: 1430968 - RNA, 14 nt, Pseudomonas aeruginosa PA01
cugcgccggcgcug

SEQ ID NO: 1430969 - RNA, 13 nt, Pseudomonas aeruginosa PA01
cugcgccgccguc

SEQ ID NO: 1430970 - RNA, 18 nt, Pseudomonas aeruginosa PA01
cugcgccgcagcggccag

SEQ ID NO: 1430971 - RNA, 19 nt, Pseudomonas aeruginosa PA01
cugcgccguuucgacgaug

SEQ ID NO: 1430972 - RNA, 20 nt, Pseudomonas aeruginosa PA01
cugcgccguuucgacgaugc

SEQ ID NO: 1430973 - RNA, 17 nt, Pseudomonas aeruginosa PA01
cugcgccugcagcucgg

SEQ ID NO: 1430974 - RNA, 19 nt, Pseudomonas aeruginosa PA01
cugcgccugcagcucggug

SEQ ID NO: 1430975 - RNA, 18 nt, Pseudomonas aeruginosa PA01
cugcgccucacggucgca

SEQ ID NO: 1430976 - RNA, 22 nt, Pseudomonas aeruginosa PA01
cugcgccuccucggcggccuuu

SEQ ID NO: 1430977 - RNA, 13 nt, Pseudomonas aeruginosa PA01
cugcgccucgacc

SEQ ID NO: 1430978 - RNA, 19 nt, Pseudomonas aeruginosa PA01
cugcgccucgaccuggcca

SEQ ID NO: 1430979 - RNA, 22 nt, Pseudomonas aeruginosa PA01
cugcgccucgaccuggccacgc

SEQ ID NO: 1430980 - RNA, 23 nt, Pseudomonas aeruginosa PA01
cugcgccucgaccuggccacgcc

SEQ ID NO: 1430981 - RNA, 13 nt, Pseudomonas aeruginosa PA01
cugcgccggcucg

SEQ ID NO: 1430982 - RNA, 23 nt, Pseudomonas aeruginosa PA01
cugccguagugguugcgcacgcu

SEQ ID NO: 1430983 - RNA, 20 nt, Pseudomonas aeruginosa PA01
cugccguauccgcggcaggg

SEQ ID NO: 1430984 - RNA, 15 nt, Pseudomonas aeruginosa PA01
cugccgucggcgccc

SEQ ID NO: 1430985 - RNA, 15 nt, Pseudomonas aeruginosa PA01
cugccguccaggcgc

SEQ ID NO: 1430986 - RNA, 16 nt, Pseudomonas aeruginosa PA01
cugccguccaggcgcg

SEQ ID NO: 1430987 - RNA, 17 nt, Pseudomonas aeruginosa PA01
cugccguccaggcgcga

SEQ ID NO: 1430988 - RNA, 22 nt, Pseudomonas aeruginosa PA01
cugccguucgucaccggcgcca

SEQ ID NO: 1430989 - RNA, 22 nt, Pseudomonas aeruginosa PA01
cugccguacagcccccgccggc

SEQ ID NO: 1430990 - RNA, 21 nt, Pseudomonas aeruginosa PA01
cugccggucggaacgaccacg

SEQ ID NO: 1430991 - RNA, 18 nt, Pseudomonas aeruginosa PA01
cugccgguaggucaccag

SEQ ID NO: 1430992 - RNA, 18 nt, Pseudomonas aeruginosa PA01
cugccggucaggcuggug

SEQ ID NO: 1430993 - RNA, 19 nt, Pseudomonas aeruginosa PA01
cugccucgguuuccggcca

SEQ ID NO: 1430994 - RNA, 21 nt, Pseudomonas aeruginosa PA01
cugccucgguuuccggccagg

SEQ ID NO: 1430995 - RNA, 22 nt, Pseudomonas aeruginosa PA01
cugccucgguuuccggccaggc

SEQ ID NO: 1430996 - RNA, 14 nt, Pseudomonas aeruginosa PA01
cugccguucgcccg

SEQ ID NO: 1430997 - RNA, 21 nt, Pseudomonas aeruginosa PA01
cugccguucgcccgcggcggc

SEQ ID NO: 1430998 - RNA, 19 nt, Pseudomonas aeruginosa PA01
cugccguugcaggcccagc

SEQ ID NO: 1430999 - RNA, 13 nt, Pseudomonas aeruginosa PA01
cugccucgacgcu

SEQ ID NO: 1431000 - RNA, 15 nt, Pseudomonas aeruginosa PA01
cugccucgccgaggc

SEQ ID NO: 1431001 - RNA, 14 nt, Pseudomonas aeruginosa PA01
cugccugcaccggg

SEQ ID NO: 1431002 - RNA, 16 nt, Pseudomonas aeruginosa PA01
cugccugcaccgggcc

SEQ ID NO: 1431003 - RNA, 19 nt, Pseudomonas aeruginosa PA01
cugccugcagguagcgcug

SEQ ID NO: 1431004 - RNA, 18 nt, Pseudomonas aeruginosa PA01
cugccuucgaagccggca

SEQ ID NO: 1431005 - RNA, 20 nt, Pseudomonas aeruginosa PA01
cugccuucgacguagaccug

SEQ ID NO: 1431006 - RNA, 15 nt, Pseudomonas aeruginosa PA01
cugccuuccagcagg

SEQ ID NO: 1431007 - RNA, 12 nt, Pseudomonas aeruginosa PA01
cugccuggcagg

SEQ ID NO: 1431008 - RNA, 15 nt, Pseudomonas aeruginosa PA01
cugccugucgcagcg

SEQ ID NO: 1431009 - RNA, 23 nt, Pseudomonas aeruginosa PA01
cugcgaaccgagacccuggcgcu

SEQ ID NO: 1431010 - RNA, 20 nt, Pseudomonas aeruginosa PA01
cugcgaaaaagaacgccccg

SEQ ID NO: 1431011 - RNA, 17 nt, Pseudomonas aeruginosa PA01
cugcgacaucuccaggc

SEQ ID NO: 1431012 - RNA, 23 nt, Pseudomonas aeruginosa PA01
cugcgacaucuccaggccgcuca

SEQ ID NO: 1431013 - RNA, 14 nt, Pseudomonas aeruginosa PA01
cugcgauggaacga

SEQ ID NO: 1431014 - RNA, 14 nt, Pseudomonas aeruginosa PA01
cugcgagcgcuuca

SEQ ID NO: 1431015 - RNA, 18 nt, Pseudomonas aeruginosa PA01
cugcgaggcggugcagcg

SEQ ID NO: 1431016 - RNA, 14 nt, Pseudomonas aeruginosa PA01
cugcgaggcgucga

SEQ ID NO: 1431017 - RNA, 15 nt, Pseudomonas aeruginosa PA01
cugcgaggcgucgau

SEQ ID NO: 1431018 - RNA, 16 nt, Pseudomonas aeruginosa PA01
cugcgaggcgucgauc

SEQ ID NO: 1431019 - RNA, 13 nt, Pseudomonas aeruginosa PA01
cugcgagccgacu

SEQ ID NO: 1431020 - RNA, 14 nt, Pseudomonas aeruginosa PA01
cugcgagccgcgcg

SEQ ID NO: 1431021 - RNA, 21 nt, Pseudomonas aeruginosa PA01
cugcgagcgcacaacgccuuc

SEQ ID NO: 1431022 - RNA, 15 nt, Pseudomonas aeruginosa PA01
cugcgauauggccga

SEQ ID NO: 1431023 - RNA, 16 nt, Pseudomonas aeruginosa PA01
cugcgacugacggugg

SEQ ID NO: 1431024 - RNA, 14 nt, Pseudomonas aeruginosa PA01
cugcgacuggaugc

SEQ ID NO: 1431025 - RNA, 15 nt, Pseudomonas aeruginosa PA01
cugcgacuggaugca

SEQ ID NO: 1431026 - RNA, 16 nt, Pseudomonas aeruginosa PA01
cugcgagaacaggcgg

SEQ ID NO: 1431027 - RNA, 16 nt, Pseudomonas aeruginosa PA01
cugcgagcagguccug

SEQ ID NO: 1431028 - RNA, 14 nt, Pseudomonas aeruginosa PA01
cugcgaccgugagg

SEQ ID NO: 1431029 - RNA, 18 nt, Pseudomonas aeruginosa PA01
cugcgaccgugaggcgca

SEQ ID NO: 1431030 - RNA, 13 nt, Pseudomonas aeruginosa PA01
cugcgaccuggcg

SEQ ID NO: 1431031 - RNA, 23 nt, Pseudomonas aeruginosa PA01
cucuugaucccggaggcggcgag

SEQ ID NO: 1431032 - RNA, 14 nt, Pseudomonas aeruginosa PA01
cugaaaccccacca

SEQ ID NO: 1431033 - RNA, 20 nt, Pseudomonas aeruginosa PA01
cucuugaaaacugucggcgg

SEQ ID NO: 1431034 - RNA, 21 nt, Pseudomonas aeruginosa PA01
cucuugaaaacugucggcgga

SEQ ID NO: 1431035 - RNA, 21 nt, Pseudomonas aeruginosa PA01
cugccgagaaucugcccggcc

SEQ ID NO: 1431036 - RNA, 21 nt, Pseudomonas aeruginosa PA01
cugccgagcagggucacgccg

SEQ ID NO: 1431037 - RNA, 16 nt, Pseudomonas aeruginosa PA01
cugccgauccuugucg

SEQ ID NO: 1431038 - RNA, 18 nt, Pseudomonas aeruginosa PA01
cugccgaucgccgcgcgg

SEQ ID NO: 1431039 - RNA, 21 nt, Pseudomonas aeruginosa PA01
cugccgaggaacucgcggucc

SEQ ID NO: 1431040 - RNA, 14 nt, Pseudomonas aeruginosa PA01
cugccgaggccgag

SEQ ID NO: 1431041 - RNA, 18 nt, Pseudomonas aeruginosa PA01
cugccgaugcugaucacc

SEQ ID NO: 1431042 - RNA, 21 nt, Pseudomonas aeruginosa PA01
cugccgauggugauacgcagg

SEQ ID NO: 1431043 - RNA, 22 nt, Pseudomonas aeruginosa PA01
cugccgauggugauacgcagga

SEQ ID NO: 1431044 - RNA, 22 nt, Pseudomonas aeruginosa PA01
cugccgccgcagagccagccgc

SEQ ID NO: 1431045 - RNA, 23 nt, Pseudomonas aeruginosa PA01
cugccgccgcagagccagccgca

SEQ ID NO: 1431046 - RNA, 12 nt, Pseudomonas aeruginosa PA01
cugccgccgccg

SEQ ID NO: 1431047 - RNA, 20 nt, Pseudomonas aeruginosa PA01
cugccgccgucuccgccgcu

SEQ ID NO: 1431048 - RNA, 20 nt, Pseudomonas aeruginosa PA01
cugccgccgccgucgacacc

SEQ ID NO: 1431049 - RNA, 18 nt, Pseudomonas aeruginosa PA01
cugccgccgcgcaggcgg

SEQ ID NO: 1431050 - RNA, 13 nt, Pseudomonas aeruginosa PA01
cugccgccgcgcc

SEQ ID NO: 1431051 - RNA, 14 nt, Pseudomonas aeruginosa PA01
cugccgccgcgccc

SEQ ID NO: 1431052 - RNA, 15 nt, Pseudomonas aeruginosa PA01
cugccgccgcgcugc

SEQ ID NO: 1431053 - RNA, 19 nt, Pseudomonas aeruginosa PA01
cugccgcccggccaggcca

SEQ ID NO: 1431054 - RNA, 13 nt, Pseudomonas aeruginosa PA01
cugccgcccucgg

SEQ ID NO: 1431055 - RNA, 19 nt, Pseudomonas aeruginosa PA01
cugccgcaguagaugccgc

SEQ ID NO: 1431056 - RNA, 21 nt, Pseudomonas aeruginosa PA01
cugccggcacgcucaggcgca

SEQ ID NO: 1431057 - RNA, 13 nt, Pseudomonas aeruginosa PA01
cugccggcccucg

SEQ ID NO: 1431058 - RNA, 23 nt, Pseudomonas aeruginosa PA01
cugccggccaccaucacgucgcg

SEQ ID NO: 1431059 - RNA, 22 nt, Pseudomonas aeruginosa PA01
cugccggccagggucgccagca

SEQ ID NO: 1431060 - RNA, 16 nt, Pseudomonas aeruginosa PA01
cugccggccagguagc

SEQ ID NO: 1431061 - RNA, 18 nt, Pseudomonas aeruginosa PA01
cugccggccagguagcgg

SEQ ID NO: 1431062 - RNA, 13 nt, Pseudomonas aeruginosa PA01
cugccggcgcaga

SEQ ID NO: 1431063 - RNA, 20 nt, Pseudomonas aeruginosa PA01
cugccggcgcagaucgcggc

SEQ ID NO: 1431064 - RNA, 22 nt, Pseudomonas aeruginosa PA01
cugccggcgcagaucgcggcgc

SEQ ID NO: 1431065 - RNA, 23 nt, Pseudomonas aeruginosa PA01
cugccggcgcgcacggaggcgcu

SEQ ID NO: 1431066 - RNA, 22 nt, Pseudomonas aeruginosa PA01
cugccggcgucguccugcgcgg

SEQ ID NO: 1431067 - RNA, 17 nt, Pseudomonas aeruginosa PA01
cugccgguacgcaccag

SEQ ID NO: 1431068 - RNA, 19 nt, Pseudomonas aeruginosa PA01
cugccgguacgcaccagcg

SEQ ID NO: 1431069 - RNA, 13 nt, Pseudomonas aeruginosa PA01
cugccgggcucug

SEQ ID NO: 1431070 - RNA, 22 nt, Pseudomonas aeruginosa PA01
cugccgggcuuuuucaugggcg

SEQ ID NO: 1431071 - RNA, 12 nt, Pseudomonas aeruginosa PA01
cugccgcgccgg

SEQ ID NO: 1431072 - RNA, 14 nt, Pseudomonas aeruginosa PA01
cugccgccuucgcg

SEQ ID NO: 1431073 - RNA, 15 nt, Pseudomonas aeruginosa PA01
cugccgccuucgcgg

SEQ ID NO: 1431074 - RNA, 18 nt, Pseudomonas aeruginosa PA01
cugccgccuucgcgggcc

SEQ ID NO: 1431075 - RNA, 16 nt, Pseudomonas aeruginosa PA01
cugccgcucguuggcg

SEQ ID NO: 1431076 - RNA, 13 nt, Pseudomonas aeruginosa PA01
cugccgcucuggc

SEQ ID NO: 1431077 - RNA, 21 nt, Pseudomonas aeruginosa PA01
cugccgcucuggcugcuggcg

SEQ ID NO: 1431078 - RNA, 22 nt, Pseudomonas aeruginosa PA01
cugccgcucuggcugcuggcga

SEQ ID NO: 1431079 - RNA, 22 nt, Pseudomonas aeruginosa PA01
cugccgcguuccuugugcacga

SEQ ID NO: 1431080 - RNA, 18 nt, Pseudomonas aeruginosa PA01
cugccgcuaucgcuggcg

SEQ ID NO: 1431081 - RNA, 14 nt, Pseudomonas aeruginosa PA01
cugccgcuggcggc

SEQ ID NO: 1431082 - RNA, 15 nt, Pseudomonas aeruginosa PA01
cugccgcuucggcug

SEQ ID NO: 1431083 - RNA, 24 nt, Pseudomonas aeruginosa PA01
cugccgcuucggcugcugcugcgg

SEQ ID NO: 1431084 - RNA, 17 nt, Pseudomonas aeruginosa PA01
cugcguggaaccgcggc

SEQ ID NO: 1431085 - RNA, 19 nt, Pseudomonas aeruginosa PA01
cugcguggaaccgcggcgc

SEQ ID NO: 1431086 - RNA, 21 nt, Pseudomonas aeruginosa PA01
cugcguggaaccgcggcgccc

SEQ ID NO: 1431087 - RNA, 13 nt, Pseudomonas aeruginosa PA01
cugcgugccagca

SEQ ID NO: 1431088 - RNA, 13 nt, Pseudomonas aeruginosa PA01
cugcgugcgccgc

SEQ ID NO: 1431089 - RNA, 20 nt, Pseudomonas aeruginosa PA01
cugcgugcgccgcucgcgca

SEQ ID NO: 1431090 - RNA, 18 nt, Pseudomonas aeruginosa PA01
cugcgugcgccguagcaa

SEQ ID NO: 1431091 - RNA, 18 nt, Pseudomonas aeruginosa PA01
cugcuaggcuggaagccg

SEQ ID NO: 1431092 - RNA, 22 nt, Pseudomonas aeruginosa PA01
cugcuaggcuggaagccgcgcu

SEQ ID NO: 1431093 - RNA, 17 nt, Pseudomonas aeruginosa PA01
cugcuccggacugccga

SEQ ID NO: 1431094 - RNA, 16 nt, Pseudomonas aeruginosa PA01
cugcuccggaucgcgc

SEQ ID NO: 1431095 - RNA, 20 nt, Pseudomonas aeruginosa PA01
cugcucagcggcccagcgcc

SEQ ID NO: 1431096 - RNA, 21 nt, Pseudomonas aeruginosa PA01
cugcucagcggcccagcgccc

SEQ ID NO: 1431097 - RNA, 14 nt, Pseudomonas aeruginosa PA01
cugcucccuggcgg

SEQ ID NO: 1431098 - RNA, 15 nt, Pseudomonas aeruginosa PA01
cugcucccuggcgga

SEQ ID NO: 1431099 - RNA, 16 nt, Pseudomonas aeruginosa PA01
cugcucccuggcggau

SEQ ID NO: 1431100 - RNA, 21 nt, Pseudomonas aeruginosa PA01
cugcuccucggcagcgcuggc

SEQ ID NO: 1431101 - RNA, 13 nt, Pseudomonas aeruginosa PA01
cugcuccucgccg

SEQ ID NO: 1431102 - RNA, 17 nt, Pseudomonas aeruginosa PA01
cugcucagcgcgcucgg

SEQ ID NO: 1431103 - RNA, 21 nt, Pseudomonas aeruginosa PA01
cugcucgaacaucagcagcgc

SEQ ID NO: 1431104 - RNA, 18 nt, Pseudomonas aeruginosa PA01
aaccgcguugcgguuauu

SEQ ID NO: 1431105 - RNA, 23 nt, Pseudomonas aeruginosa PA01
cugcuccagcaaugccagcgcca

SEQ ID NO: 1431106 - RNA, 22 nt, Pseudomonas aeruginosa PA01
cugcuccagcagggccagcgcc

SEQ ID NO: 1431107 - RNA, 23 nt, Pseudomonas aeruginosa PA01
cugcuccagcagggccagcgccu

SEQ ID NO: 1431108 - RNA, 14 nt, Pseudomonas aeruginosa PA01
cugcucacggccga

SEQ ID NO: 1431109 - RNA, 21 nt, Pseudomonas aeruginosa PA01
cugcucagggccgcgccgagc

SEQ ID NO: 1431110 - RNA, 19 nt, Pseudomonas aeruginosa PA01
cugcggguucagucggcca

SEQ ID NO: 1431111 - RNA, 21 nt, Pseudomonas aeruginosa PA01
cugcggguucagucggccagg

SEQ ID NO: 1431112 - RNA, 15 nt, Pseudomonas aeruginosa PA01
cugcgguaggugaug

SEQ ID NO: 1431113 - RNA, 17 nt, Pseudomonas aeruginosa PA01
cugcgggucauagucgg

SEQ ID NO: 1431114 - RNA, 16 nt, Pseudomonas aeruginosa PA01
cugcgggucauuggcg

SEQ ID NO: 1431115 - RNA, 16 nt, Pseudomonas aeruginosa PA01
cugcggggccggacgc

SEQ ID NO: 1431116 - RNA, 22 nt, Pseudomonas aeruginosa PA01
cugcggggccggacgcgacugc

SEQ ID NO: 1431117 - RNA, 14 nt, Pseudomonas aeruginosa PA01
cugcggggugagca

SEQ ID NO: 1431118 - RNA, 19 nt, Pseudomonas aeruginosa PA01
cugcgggcgauguugaaca

SEQ ID NO: 1431119 - RNA, 14 nt, Pseudomonas aeruginosa PA01
cugcgggcgccgcc

SEQ ID NO: 1431120 - RNA, 15 nt, Pseudomonas aeruginosa PA01
cugcgggcgccgccg

SEQ ID NO: 1431121 - RNA, 23 nt, Pseudomonas aeruginosa PA01
cugcgggcgccgccgcuggcgag

SEQ ID NO: 1431122 - RNA, 22 nt, Pseudomonas aeruginosa PA01
cugcgucguuggccggcugcuc

SEQ ID NO: 1431123 - RNA, 15 nt, Pseudomonas aeruginosa PA01
cugcguccuggucgc

SEQ ID NO: 1431124 - RNA, 19 nt, Pseudomonas aeruginosa PA01
cugcgucgcauccaccagc

SEQ ID NO: 1431125 - RNA, 18 nt, Pseudomonas aeruginosa PA01
cugcgguccggcgaaguc

SEQ ID NO: 1431126 - RNA, 23 nt, Pseudomonas aeruginosa PA01
cugcguaguugagccccagguag

SEQ ID NO: 1431127 - RNA, 14 nt, Pseudomonas aeruginosa PA01
cugcugcucgccau

SEQ ID NO: 1431128 - RNA, 16 nt, Pseudomonas aeruginosa PA01
cugcugcucgccaugg

SEQ ID NO: 1431129 - RNA, 15 nt, Pseudomonas aeruginosa PA01
cugcugcggcgguug

SEQ ID NO: 1431130 - RNA, 18 nt, Pseudomonas aeruginosa PA01
cugcugcggcuucgcgug

SEQ ID NO: 1431131 - RNA, 18 nt, Pseudomonas aeruginosa PA01
cugcugcgggcgcugcau

SEQ ID NO: 1431132 - RNA, 14 nt, Pseudomonas aeruginosa PA01
cugcugcggggccu

SEQ ID NO: 1431133 - RNA, 23 nt, Pseudomonas aeruginosa PA01
cugcugcgccuggccgcgcagga

SEQ ID NO: 1431134 - RNA, 14 nt, Pseudomonas aeruginosa PA01
cugcugcgccuggc

SEQ ID NO: 1431135 - RNA, 15 nt, Pseudomonas aeruginosa PA01
cugcugcgccuggcc

SEQ ID NO: 1431136 - RNA, 14 nt, Pseudomonas aeruginosa PA01
cugcugcccggcau

SEQ ID NO: 1431137 - RNA, 13 nt, Pseudomonas aeruginosa PA01
cugcugccggcuu

SEQ ID NO: 1431138 - RNA, 13 nt, Pseudomonas aeruginosa PA01
cugcugcgccugg

SEQ ID NO: 1431139 - RNA, 16 nt, Pseudomonas aeruginosa PA01
cugcugccauccgcgc

SEQ ID NO: 1431140 - RNA, 20 nt, Pseudomonas aeruginosa PA01
cugcugcagcaucaggcgcu

SEQ ID NO: 1431141 - RNA, 16 nt, Pseudomonas aeruginosa PA01
cugcucggcucgcggu

SEQ ID NO: 1431142 - RNA, 22 nt, Pseudomonas aeruginosa PA01
cugcucgguauggcugcugugc

SEQ ID NO: 1431143 - RNA, 17 nt, Pseudomonas aeruginosa PA01
cugcucguccaggccgc

SEQ ID NO: 1431144 - RNA, 19 nt, Pseudomonas aeruginosa PA01
cugcucguccaggccgcag

SEQ ID NO: 1431145 - RNA, 23 nt, Pseudomonas aeruginosa PA01
cugcugaucaggaggaucgccag

SEQ ID NO: 1431146 - RNA, 17 nt, Pseudomonas aeruginosa PA01
cugcugcaacauggcgu

SEQ ID NO: 1431147 - RNA, 20 nt, Pseudomonas aeruginosa PA01
cugcugaaaaacgccugggc

SEQ ID NO: 1431148 - RNA, 17 nt, Pseudomonas aeruginosa PA01
cugcucuucggcggcca

SEQ ID NO: 1431149 - RNA, 22 nt, Pseudomonas aeruginosa PA01
cugcucuucggcggccagcgga

SEQ ID NO: 1431150 - RNA, 18 nt, Pseudomonas aeruginosa PA01
cugcucggccugcugcgc

SEQ ID NO: 1431151 - RNA, 22 nt, Pseudomonas aeruginosa PA01
cugcucggccugcugcgccggc

SEQ ID NO: 1431152 - RNA, 21 nt, Pseudomonas aeruginosa PA01
cugcucggccuuguccgcgcg

SEQ ID NO: 1431153 - RNA, 16 nt, Pseudomonas aeruginosa PA01
cugcucggccagcgcc

SEQ ID NO: 1431154 - RNA, 23 nt, Pseudomonas aeruginosa PA01
cugcucggcauucgacccgccga

SEQ ID NO: 1431155 - RNA, 24 nt, Pseudomonas aeruginosa PA01
cugcucggcauucgacccgccgac

SEQ ID NO: 1431156 - RNA, 23 nt, Pseudomonas aeruginosa PA01
cugcucggcgguggggaagcgau

SEQ ID NO: 1431157 - RNA, 18 nt, Pseudomonas aeruginosa PA01
cugcucgaucaaccccug

SEQ ID NO: 1431158 - RNA, 23 nt, Pseudomonas aeruginosa PA01
cugcucgauggcggccugguagu

SEQ ID NO: 1431159 - RNA, 17 nt, Pseudomonas aeruginosa PA01
cugcucgccgccggcga

SEQ ID NO: 1431160 - RNA, 18 nt, Pseudomonas aeruginosa PA01
cugcucgccggcgcgggc

SEQ ID NO: 1431161 - RNA, 20 nt, Pseudomonas aeruginosa PA01
cugcucgcgcaccgcggcca

SEQ ID NO: 1431162 - RNA, 15 nt, Pseudomonas aeruginosa PA01
cugcucgcgcagcca

SEQ ID NO: 1431163 - RNA, 16 nt, Pseudomonas aeruginosa PA01
cugcucgcgcagccag

SEQ ID NO: 1431164 - RNA, 17 nt, Pseudomonas aeruginosa PA01
cugcucgcgcagccagg

SEQ ID NO: 1431165 - RNA, 19 nt, Pseudomonas aeruginosa PA01
cugcucgccaugggcgcgu

SEQ ID NO: 1431166 - RNA, 15 nt, Pseudomonas aeruginosa PA01
cugcucgccucgggc

SEQ ID NO: 1431167 - RNA, 17 nt, Pseudomonas aeruginosa PA01
cugcucgcgggucacca

SEQ ID NO: 1431168 - RNA, 22 nt, Pseudomonas aeruginosa PA01
cugcucggaaaccucgccgguc

SEQ ID NO: 1431169 - RNA, 19 nt, Pseudomonas aeruginosa PA01
cugcucgcugcccgacggc

SEQ ID NO: 1431170 - RNA, 13 nt, Pseudomonas aeruginosa PA01
aaccgcucgcggu

SEQ ID NO: 1431171 - RNA, 15 nt, Pseudomonas aeruginosa PA01
aaccgcugccgccgu

SEQ ID NO: 1431172 - RNA, 12 nt, Pseudomonas aeruginosa PA01
aaccgcugcgcg

SEQ ID NO: 1431173 - RNA, 15 nt, Pseudomonas aeruginosa PA01
aaccgcugcgcgguu

SEQ ID NO: 1431174 - RNA, 18 nt, Pseudomonas aeruginosa PA01
cugcucgauccagccggc

SEQ ID NO: 1431175 - RNA, 19 nt, Pseudomonas aeruginosa PA01
cugcucgauccagccggca

SEQ ID NO: 1431176 - RNA, 22 nt, Pseudomonas aeruginosa PA01
cugcucgauccagccggcaucc

SEQ ID NO: 1431177 - RNA, 16 nt, Pseudomonas aeruginosa PA01
cugcucgaggauggca

SEQ ID NO: 1431178 - RNA, 20 nt, Pseudomonas aeruginosa PA01
cugcucgaggauggcacggg

SEQ ID NO: 1431179 - RNA, 19 nt, Pseudomonas aeruginosa PA01
cugcucgagauugucgcga

SEQ ID NO: 1431180 - RNA, 18 nt, Pseudomonas aeruginosa PA01
aaccggcaagcuccgcga

SEQ ID NO: 1431181 - RNA, 20 nt, Pseudomonas aeruginosa PA01
aaccggacauaucgaucacu

SEQ ID NO: 1431182 - RNA, 16 nt, Pseudomonas aeruginosa PA01
cugcucgaacggcgga

SEQ ID NO: 1431183 - RNA, 17 nt, Pseudomonas aeruginosa PA01
cugcucgaacggcggau

SEQ ID NO: 1431184 - RNA, 23 nt, Pseudomonas aeruginosa PA01
cugcucgaccgccugcucgcggc

SEQ ID NO: 1431185 - RNA, 20 nt, Pseudomonas aeruginosa PA01
cuggcaggugccgcucgucc

SEQ ID NO: 1431186 - RNA, 22 nt, Pseudomonas aeruginosa PA01
cuggcagguugcacggccggua

SEQ ID NO: 1431187 - RNA, 23 nt, Pseudomonas aeruginosa PA01
cuggcagguugcacggccgguag

SEQ ID NO: 1431188 - RNA, 18 nt, Pseudomonas aeruginosa PA01
cuggcagguugcgggagc

SEQ ID NO: 1431189 - RNA, 17 nt, Pseudomonas aeruginosa PA01
cuggcaguccagggcgg

SEQ ID NO: 1431190 - RNA, 23 nt, Pseudomonas aeruginosa PA01
cuggcagacgcugcucgacggca

SEQ ID NO: 1431191 - RNA, 17 nt, Pseudomonas aeruginosa PA01
cuggauggucacgccga

SEQ ID NO: 1431192 - RNA, 20 nt, Pseudomonas aeruginosa PA01
cuggauggucacgccgaggc

SEQ ID NO: 1431193 - RNA, 17 nt, Pseudomonas aeruginosa PA01
cuggauucggccugccg

SEQ ID NO: 1431194 - RNA, 23 nt, Pseudomonas aeruginosa PA01
cuggauguggcuauccuccaggc

SEQ ID NO: 1431195 - RNA, 19 nt, Pseudomonas aeruginosa PA01
cuggaugucgcuggccagc

SEQ ID NO: 1431196 - RNA, 14 nt, Pseudomonas aeruginosa PA01
cuggaugucggcga

SEQ ID NO: 1431197 - RNA, 22 nt, Pseudomonas aeruginosa PA01
cuggaugaugguauccaggcgg

SEQ ID NO: 1431198 - RNA, 23 nt, Pseudomonas aeruginosa PA01
cuggaugaucgcgugggccacca

SEQ ID NO: 1431199 - RNA, 14 nt, Pseudomonas aeruginosa PA01
cuggauccucgccu

SEQ ID NO: 1431200 - RNA, 21 nt, Pseudomonas aeruginosa PA01
cuggagaaacucgcgggcgcg

SEQ ID NO: 1431201 - RNA, 23 nt, Pseudomonas aeruginosa PA01
cuggagaaacucgcgggcgcgca

SEQ ID NO: 1431202 - RNA, 18 nt, Pseudomonas aeruginosa PA01
cuggaucgaucucgucgg

SEQ ID NO: 1431203 - RNA, 15 nt, Pseudomonas aeruginosa PA01
cuggaucgccaggcu

SEQ ID NO: 1431204 - RNA, 23 nt, Pseudomonas aeruginosa PA01
cuggaucgccuugcgcgugcugg

SEQ ID NO: 1431205 - RNA, 12 nt, Pseudomonas aeruginosa PA01
cuggaucggccc

SEQ ID NO: 1431206 - RNA, 19 nt, Pseudomonas aeruginosa PA01
cuggacggcggacugcucg

SEQ ID NO: 1431207 - RNA, 14 nt, Pseudomonas aeruginosa PA01
cuggacucgcgcca

SEQ ID NO: 1431208 - RNA, 16 nt, Pseudomonas aeruginosa PA01
cuggacuucccggcgu

SEQ ID NO: 1431209 - RNA, 22 nt, Pseudomonas aeruginosa PA01
cuggacgugcaggaucaccugc

SEQ ID NO: 1431210 - RNA, 19 nt, Pseudomonas aeruginosa PA01
cuggacccguugccgaccg

SEQ ID NO: 1431211 - RNA, 20 nt, Pseudomonas aeruginosa PA01
cuggaccaccguggcgccgg

SEQ ID NO: 1431212 - RNA, 18 nt, Pseudomonas aeruginosa PA01
cuggaccaggcggccggu

SEQ ID NO: 1431213 - RNA, 22 nt, Pseudomonas aeruginosa PA01
cuggaccaggcggccggugccu

SEQ ID NO: 1431214 - RNA, 13 nt, Pseudomonas aeruginosa PA01
cuggaccaggucg

SEQ ID NO: 1431215 - RNA, 14 nt, Pseudomonas aeruginosa PA01
cuggaccauggccg

SEQ ID NO: 1431216 - RNA, 12 nt, Pseudomonas aeruginosa PA01
cuggacccgggc

SEQ ID NO: 1431217 - RNA, 18 nt, Pseudomonas aeruginosa PA01
cuggacccgggccuccug

SEQ ID NO: 1431218 - RNA, 21 nt, Pseudomonas aeruginosa PA01
cuggacccgggccuccuggcg

SEQ ID NO: 1431219 - RNA, 22 nt, Pseudomonas aeruginosa PA01
cuggacccgggccuccuggcgg

SEQ ID NO: 1431220 - RNA, 14 nt, Pseudomonas aeruginosa PA01
cuggacgaaggccu

SEQ ID NO: 1431221 - RNA, 20 nt, Pseudomonas aeruginosa PA01
cuggacgaaugcccgugcgc

SEQ ID NO: 1431222 - RNA, 14 nt, Pseudomonas aeruginosa PA01
cuggacgacgcugg

SEQ ID NO: 1431223 - RNA, 21 nt, Pseudomonas aeruginosa PA01
cuggacgacgcuggccugccg

SEQ ID NO: 1431224 - RNA, 14 nt, Pseudomonas aeruginosa PA01
cuggaccuccgcca

SEQ ID NO: 1431225 - RNA, 16 nt, Pseudomonas aeruginosa PA01
cuggaccuccgccagg

SEQ ID NO: 1431226 - RNA, 17 nt, Pseudomonas aeruginosa PA01
cuggaccuccuggcgcg

SEQ ID NO: 1431227 - RNA, 18 nt, Pseudomonas aeruginosa PA01
cuggaccuccuggcgcgu

SEQ ID NO: 1431228 - RNA, 22 nt, Pseudomonas aeruginosa PA01
cuggaccucggguuuggcgccc

SEQ ID NO: 1431229 - RNA, 21 nt, Pseudomonas aeruginosa PA01
cuggccgagcugccgcaccgc

SEQ ID NO: 1431230 - RNA, 15 nt, Pseudomonas aeruginosa PA01
cuggccgacgcugag

SEQ ID NO: 1431231 - RNA, 16 nt, Pseudomonas aeruginosa PA01
cuggccgagaucgguc

SEQ ID NO: 1431232 - RNA, 18 nt, Pseudomonas aeruginosa PA01
cuggccgagaucggucac

SEQ ID NO: 1431233 - RNA, 23 nt, Pseudomonas aeruginosa PA01
cuggccgagcgacuccgggaaca

SEQ ID NO: 1431234 - RNA, 15 nt, Pseudomonas aeruginosa PA01
cuggccgagcgccgc

SEQ ID NO: 1431235 - RNA, 15 nt, Pseudomonas aeruginosa PA01
cuggccgaauaggcg

SEQ ID NO: 1431236 - RNA, 12 nt, Pseudomonas aeruginosa PA01
cuggccgaccag

SEQ ID NO: 1431237 - RNA, 19 nt, Pseudomonas aeruginosa PA01
cuggccauucgcuucggcc

SEQ ID NO: 1431238 - RNA, 14 nt, Pseudomonas aeruginosa PA01
cuggcccaacagcg

SEQ ID NO: 1431239 - RNA, 11 nt, Pseudomonas aeruginosa PA01
cuggccgaugc

SEQ ID NO: 1431240 - RNA, 19 nt, Pseudomonas aeruginosa PA01
cuggccgagggcgcgcagu

SEQ ID NO: 1431241 - RNA, 14 nt, Pseudomonas aeruginosa PA01
cuggccgcccaggu

SEQ ID NO: 1431242 - RNA, 17 nt, Pseudomonas aeruginosa PA01
cuggccggugacauucg

SEQ ID NO: 1431243 - RNA, 22 nt, Pseudomonas aeruginosa PA01
cuggccggugacauucgacagc

SEQ ID NO: 1431244 - RNA, 18 nt, Pseudomonas aeruginosa PA01
cuggccgccucgcgccgc

SEQ ID NO: 1431245 - RNA, 20 nt, Pseudomonas aeruginosa PA01
cuggccgccucgcgccgcgc

SEQ ID NO: 1431246 - RNA, 20 nt, Pseudomonas aeruginosa PA01
cuggccgggggucgcggcga

SEQ ID NO: 1431247 - RNA, 23 nt, Pseudomonas aeruginosa PA01
cuggccgggggucgcggcgaccu

SEQ ID NO: 1431248 - RNA, 20 nt, Pseudomonas aeruginosa PA01
cuggccagcgucgccugcca

SEQ ID NO: 1431249 - RNA, 20 nt, Pseudomonas aeruginosa PA01
cuggcagguaucgcugggcg

SEQ ID NO: 1431250 - RNA, 23 nt, Pseudomonas aeruginosa PA01
cuggcagguaucgcugggcgccu

SEQ ID NO: 1431251 - RNA, 22 nt, Pseudomonas aeruginosa PA01
cuggcauacacaugcaggcucg

SEQ ID NO: 1431252 - RNA, 17 nt, Pseudomonas aeruginosa PA01
cuggcaucggugaccug

SEQ ID NO: 1431253 - RNA, 12 nt, Pseudomonas aeruginosa PA01
cuggccagcgcu

SEQ ID NO: 1431254 - RNA, 22 nt, Pseudomonas aeruginosa PA01
cuggccagguccgaacagagga

SEQ ID NO: 1431255 - RNA, 21 nt, Pseudomonas aeruginosa PA01
cuggccagggcaugucgaucu

SEQ ID NO: 1431256 - RNA, 20 nt, Pseudomonas aeruginosa PA01
cuggccauccauaucggcca

SEQ ID NO: 1431257 - RNA, 21 nt, Pseudomonas aeruginosa PA01
cuggccaguuccaugucgcug

SEQ ID NO: 1431258 - RNA, 22 nt, Pseudomonas aeruginosa PA01
cuggccaguuccaugucgcugg

SEQ ID NO: 1431259 - RNA, 21 nt, Pseudomonas aeruginosa PA01
cugcuuucccugcugcggcaa

SEQ ID NO: 1431260 - RNA, 17 nt, Pseudomonas aeruginosa PA01
cugcuugccgcucaggc

SEQ ID NO: 1431261 - RNA, 16 nt, Pseudomonas aeruginosa PA01
cugcuugcgccguggc

SEQ ID NO: 1431262 - RNA, 17 nt, Pseudomonas aeruginosa PA01
cugcuugcgccguggca

SEQ ID NO: 1431263 - RNA, 22 nt, Pseudomonas aeruginosa PA01
cugcuugcgccguggcaccagg

SEQ ID NO: 1431264 - RNA, 14 nt, Pseudomonas aeruginosa PA01
cugcuugcgcgccg

SEQ ID NO: 1431265 - RNA, 15 nt, Pseudomonas aeruginosa PA01
cugcuugcgcgcggc

SEQ ID NO: 1431266 - RNA, 15 nt, Pseudomonas aeruginosa PA01
cugcuuggcggcggu

SEQ ID NO: 1431267 - RNA, 16 nt, Pseudomonas aeruginosa PA01
cugcuuggcggcggug

SEQ ID NO: 1431268 - RNA, 18 nt, Pseudomonas aeruginosa PA01
cugcuuggccagcgcggu

SEQ ID NO: 1431269 - RNA, 14 nt, Pseudomonas aeruginosa PA01
cugcuuggccaggc

SEQ ID NO: 1431270 - RNA, 17 nt, Pseudomonas aeruginosa PA01
cugcuuggccaggcgcu

SEQ ID NO: 1431271 - RNA, 18 nt, Pseudomonas aeruginosa PA01
cugcuuggccaggcgcuu

SEQ ID NO: 1431272 - RNA, 19 nt, Pseudomonas aeruginosa PA01
cugcuuggccaggcgcuug

SEQ ID NO: 1431273 - RNA, 23 nt, Pseudomonas aeruginosa PA01
cugcuuggccaggucgcgcaggg

SEQ ID NO: 1431274 - RNA, 18 nt, Pseudomonas aeruginosa PA01
cuggaaagaccggcgccc

SEQ ID NO: 1431275 - RNA, 22 nt, Pseudomonas aeruginosa PA01
cuggaaauggcggucgccgacc

SEQ ID NO: 1431276 - RNA, 15 nt, Pseudomonas aeruginosa PA01
cuggaacaccaggcc

SEQ ID NO: 1431277 - RNA, 17 nt, Pseudomonas aeruginosa PA01
cuggaacaccaggccgc

SEQ ID NO: 1431278 - RNA, 14 nt, Pseudomonas aeruginosa PA01
cuggaacuggucgg

SEQ ID NO: 1431279 - RNA, 20 nt, Pseudomonas aeruginosa PA01
cuggaacuagcccucgaccu

SEQ ID NO: 1431280 - RNA, 22 nt, Pseudomonas aeruginosa PA01
cuggaacuagcccucgaccugg

SEQ ID NO: 1431281 - RNA, 21 nt, Pseudomonas aeruginosa PA01
cuggaagaaggcgaucaucgc

SEQ ID NO: 1431282 - RNA, 15 nt, Pseudomonas aeruginosa PA01
cuggaaccggccggc

SEQ ID NO: 1431283 - RNA, 16 nt, Pseudomonas aeruginosa PA01
cuggaaccggccggca

SEQ ID NO: 1431284 - RNA, 14 nt, Pseudomonas aeruginosa PA01
cuggaacggccagg

SEQ ID NO: 1431285 - RNA, 18 nt, Pseudomonas aeruginosa PA01
cuggaacggccaggucuu

SEQ ID NO: 1431286 - RNA, 15 nt, Pseudomonas aeruginosa PA01
cuggacaccgaugcc

SEQ ID NO: 1431287 - RNA, 19 nt, Pseudomonas aeruginosa PA01
cuggacaccgaugccgaag

SEQ ID NO: 1431288 - RNA, 16 nt, Pseudomonas aeruginosa PA01
cuggaauucgccgcgc

SEQ ID NO: 1431289 - RNA, 20 nt, Pseudomonas aeruginosa PA01
cuggaauucgccgcgcgcca

SEQ ID NO: 1431290 - RNA, 23 nt, Pseudomonas aeruginosa PA01
cuggaaguauucggcgggaacgc

SEQ ID NO: 1431291 - RNA, 16 nt, Pseudomonas aeruginosa PA01
cuggaagucguccagc

SEQ ID NO: 1431292 - RNA, 19 nt, Pseudomonas aeruginosa PA01
cuggaagucguccagcagg

SEQ ID NO: 1431293 - RNA, 21 nt, Pseudomonas aeruginosa PA01
cuggaaguuguacagcgaggc

SEQ ID NO: 1431294 - RNA, 16 nt, Pseudomonas aeruginosa PA01
cuggaaggcgcugggc

SEQ ID NO: 1431295 - RNA, 17 nt, Pseudomonas aeruginosa PA01
cuggaaugccggccggg

SEQ ID NO: 1431296 - RNA, 19 nt, Pseudomonas aeruginosa PA01
cugcuggauccucgccucg

SEQ ID NO: 1431297 - RNA, 22 nt, Pseudomonas aeruginosa PA01
cugcuggauccucgccucgcgc

SEQ ID NO: 1431298 - RNA, 16 nt, Pseudomonas aeruginosa PA01
cugcuggccaccgcgg

SEQ ID NO: 1431299 - RNA, 17 nt, Pseudomonas aeruginosa PA01
cugcuggccaccgcggc

SEQ ID NO: 1431300 - RNA, 19 nt, Pseudomonas aeruginosa PA01
cugcuggccaccgcggcgu

SEQ ID NO: 1431301 - RNA, 16 nt, Pseudomonas aeruginosa PA01
cugcuggcaucgguga

SEQ ID NO: 1431302 - RNA, 14 nt, Pseudomonas aeruginosa PA01
cugcuggccgcgca

SEQ ID NO: 1431303 - RNA, 13 nt, Pseudomonas aeruginosa PA01
cugcuggcuguag

SEQ ID NO: 1431304 - RNA, 13 nt, Pseudomonas aeruginosa PA01
cugcugggccagc

SEQ ID NO: 1431305 - RNA, 21 nt, Pseudomonas aeruginosa PA01
cugcuggggaacugggcgagc

SEQ ID NO: 1431306 - RNA, 19 nt, Pseudomonas aeruginosa PA01
cugcuggguacgguuggcc

SEQ ID NO: 1431307 - RNA, 23 nt, Pseudomonas aeruginosa PA01
cugcugggucaucgaggccaucc

SEQ ID NO: 1431308 - RNA, 19 nt, Pseudomonas aeruginosa PA01
cugcuggccugggacggcg

SEQ ID NO: 1431309 - RNA, 22 nt, Pseudomonas aeruginosa PA01
cugcuggcgaauuuccugcugg

SEQ ID NO: 1431310 - RNA, 24 nt, Pseudomonas aeruginosa PA01
cugcuggcgaauuuccugcuggcg

SEQ ID NO: 1431311 - RNA, 18 nt, Pseudomonas aeruginosa PA01
cugcuggcgagcgucgag

SEQ ID NO: 1431312 - RNA, 15 nt, Pseudomonas aeruginosa PA01
cugcuggcgcagcca

SEQ ID NO: 1431313 - RNA, 14 nt, Pseudomonas aeruginosa PA01
cugcuggcgccgcu

SEQ ID NO: 1431314 - RNA, 17 nt, Pseudomonas aeruginosa PA01
cugcugguugaccaggc

SEQ ID NO: 1431315 - RNA, 15 nt, Pseudomonas aeruginosa PA01
cugcugguugaggcc

SEQ ID NO: 1431316 - RNA, 16 nt, Pseudomonas aeruginosa PA01
cugcugguagcugcug

SEQ ID NO: 1431317 - RNA, 20 nt, Pseudomonas aeruginosa PA01
cugcugguagugcuggcgca

SEQ ID NO: 1431318 - RNA, 14 nt, Pseudomonas aeruginosa PA01
cugcugggcggcga

SEQ ID NO: 1431319 - RNA, 15 nt, Pseudomonas aeruginosa PA01
cugcugggcggcgag

SEQ ID NO: 1431320 - RNA, 15 nt, Pseudomonas aeruginosa PA01
cugcugugcguuucg

SEQ ID NO: 1431321 - RNA, 16 nt, Pseudomonas aeruginosa PA01
cugcuuaccuugccgg

SEQ ID NO: 1431322 - RNA, 23 nt, Pseudomonas aeruginosa PA01
cugcuucaggaguuucaucucgg

SEQ ID NO: 1431323 - RNA, 17 nt, Pseudomonas aeruginosa PA01
cugcuucaggcgcgcgg

SEQ ID NO: 1431324 - RNA, 18 nt, Pseudomonas aeruginosa PA01
cugcuucaggcgcgcggc

SEQ ID NO: 1431325 - RNA, 19 nt, Pseudomonas aeruginosa PA01
cugcuucaggcgcgcggcc

SEQ ID NO: 1431326 - RNA, 17 nt, Pseudomonas aeruginosa PA01
cugcuucgaccagggca

SEQ ID NO: 1431327 - RNA, 14 nt, Pseudomonas aeruginosa PA01
cugcuucggcagcc

SEQ ID NO: 1431328 - RNA, 23 nt, Pseudomonas aeruginosa PA01
aacggcggauaacaccguuggcg

SEQ ID NO: 1431329 - RNA, 18 nt, Pseudomonas aeruginosa PA01
aacggcggaucgaucagc

SEQ ID NO: 1431330 - RNA, 19 nt, Pseudomonas aeruginosa PA01
aacggcgaccgcuggacca

SEQ ID NO: 1431331 - RNA, 17 nt, Pseudomonas aeruginosa PA01
gaccggcuccagggcga

SEQ ID NO: 1431332 - RNA, 18 nt, Pseudomonas aeruginosa PA01
gaccggcucucuucggcc

SEQ ID NO: 1431333 - RNA, 16 nt, Pseudomonas aeruginosa PA01
gaccggcucgucggcg

SEQ ID NO: 1431334 - RNA, 16 nt, Pseudomonas aeruginosa PA01
gaccggguccugcaga

SEQ ID NO: 1431335 - RNA, 17 nt, Pseudomonas aeruginosa PA01
gaccggguugaugccga

SEQ ID NO: 1431336 - RNA, 18 nt, Pseudomonas aeruginosa PA01
gaccgggcgggucuggcg

SEQ ID NO: 1431337 - RNA, 14 nt, Pseudomonas aeruginosa PA01
gaccgggcggcagg

SEQ ID NO: 1431338 - RNA, 16 nt, Pseudomonas aeruginosa PA01
gaccgggcggcaggcg

SEQ ID NO: 1431339 - RNA, 15 nt, Pseudomonas aeruginosa PA01
gaccgggcggcgcgg

SEQ ID NO: 1431340 - RNA, 15 nt, Pseudomonas aeruginosa PA01
gaccgggcgccucgu

SEQ ID NO: 1431341 - RNA, 16 nt, Pseudomonas aeruginosa PA01
gaccggcuuggucacg

SEQ ID NO: 1431342 - RNA, 22 nt, Pseudomonas aeruginosa PA01
gaccggcuuggucacgccguuc

SEQ ID NO: 1431343 - RNA, 16 nt, Pseudomonas aeruginosa PA01
gaccggcugcuuggcc

SEQ ID NO: 1431344 - RNA, 20 nt, Pseudomonas aeruginosa PA01
gaccggcugcuuggccaggu

SEQ ID NO: 1431345 - RNA, 13 nt, Pseudomonas aeruginosa PA01
gaccggcaggucg

SEQ ID NO: 1431346 - RNA, 19 nt, Pseudomonas aeruginosa PA01
gaccggcagucccugccag

SEQ ID NO: 1431347 - RNA, 14 nt, Pseudomonas aeruginosa PA01
gaccggcagccggg

SEQ ID NO: 1431348 - RNA, 13 nt, Pseudomonas aeruginosa PA01
gaccggcagcgcc

SEQ ID NO: 1431349 - RNA, 14 nt, Pseudomonas aeruginosa PA01
gaccggcagcgccg

SEQ ID NO: 1431350 - RNA, 15 nt, Pseudomonas aeruginosa PA01
gaccggcagcgccgc

SEQ ID NO: 1431351 - RNA, 17 nt, Pseudomonas aeruginosa PA01
gaccggcagcgccgcca

SEQ ID NO: 1431352 - RNA, 20 nt, Pseudomonas aeruginosa PA01
gaccggcagcgccgccagca

SEQ ID NO: 1431353 - RNA, 17 nt, Pseudomonas aeruginosa PA01
gaccggaugcuccaggu

SEQ ID NO: 1431354 - RNA, 20 nt, Pseudomonas aeruginosa PA01
gaccggaagguugucgaagc

SEQ ID NO: 1431355 - RNA, 22 nt, Pseudomonas aeruginosa PA01
gaccggaaucacgucgaucugc

SEQ ID NO: 1431356 - RNA, 18 nt, Pseudomonas aeruginosa PA01
gaccgcucgucaggcgcu

SEQ ID NO: 1431357 - RNA, 19 nt, Pseudomonas aeruginosa PA01
gaccgcucgucaggcgcuc

SEQ ID NO: 1431358 - RNA, 22 nt, Pseudomonas aeruginosa PA01
gaccgcuggaccaguucagcgc

SEQ ID NO: 1431359 - RNA, 16 nt, Pseudomonas aeruginosa PA01
gaccgccugccagacc

SEQ ID NO: 1431360 - RNA, 17 nt, Pseudomonas aeruginosa PA01
gaccgccugcucgcggc

SEQ ID NO: 1431361 - RNA, 19 nt, Pseudomonas aeruginosa PA01
gaccgccugcucgcggcug

SEQ ID NO: 1431362 - RNA, 20 nt, Pseudomonas aeruginosa PA01
gaccgccugcucgcggcugg

SEQ ID NO: 1431363 - RNA, 22 nt, Pseudomonas aeruginosa PA01
gaccgccugcucgcggcuggcc

SEQ ID NO: 1431364 - RNA, 23 nt, Pseudomonas aeruginosa PA01
gaccgccugcucgcggcuggccg

SEQ ID NO: 1431365 - RNA, 14 nt, Pseudomonas aeruginosa PA01
gaccgcucccaggc

SEQ ID NO: 1431366 - RNA, 16 nt, Pseudomonas aeruginosa PA01
gaccgcucccaggcaa

SEQ ID NO: 1431367 - RNA, 23 nt, Pseudomonas aeruginosa PA01
gaccgaagccgcgcagcacuucc

SEQ ID NO: 1431368 - RNA, 18 nt, Pseudomonas aeruginosa PA01
gaccgaacaucagcagca

SEQ ID NO: 1431369 - RNA, 17 nt, Pseudomonas aeruginosa PA01
aacgcuuccagcaccuc

SEQ ID NO: 1431370 - RNA, 21 nt, Pseudomonas aeruginosa PA01
aacgcuucgaagcucucgccg

SEQ ID NO: 1431371 - RNA, 16 nt, Pseudomonas aeruginosa PA01
gacccgguuaccggcg

SEQ ID NO: 1431372 - RNA, 17 nt, Pseudomonas aeruginosa PA01
gacccgguuaccggcga

SEQ ID NO: 1431373 - RNA, 16 nt, Pseudomonas aeruginosa PA01
gacccgugcgccgcgg

SEQ ID NO: 1431374 - RNA, 17 nt, Pseudomonas aeruginosa PA01
gacccgugcgccgcggg

SEQ ID NO: 1431375 - RNA, 18 nt, Pseudomonas aeruginosa PA01
gaccgccagacaggccag

SEQ ID NO: 1431376 - RNA, 19 nt, Pseudomonas aeruginosa PA01
gaccgccagacaggccagc

SEQ ID NO: 1431377 - RNA, 16 nt, Pseudomonas aeruginosa PA01
gaccgccaggcggccg

SEQ ID NO: 1431378 - RNA, 18 nt, Pseudomonas aeruginosa PA01
gaccgccaggcggccgcu

SEQ ID NO: 1431379 - RNA, 19 nt, Pseudomonas aeruginosa PA01
gaccgccaggcggccgcug

SEQ ID NO: 1431380 - RNA, 20 nt, Pseudomonas aeruginosa PA01
gaccgccaggcggccgcugg

SEQ ID NO: 1431381 - RNA, 20 nt, Pseudomonas aeruginosa PA01
gaccgcccgccucaggccgg

SEQ ID NO: 1431382 - RNA, 15 nt, Pseudomonas aeruginosa PA01
gaccgccauggcgcu

SEQ ID NO: 1431383 - RNA, 14 nt, Pseudomonas aeruginosa PA01
gaccgcccaggcug

SEQ ID NO: 1431384 - RNA, 15 nt, Pseudomonas aeruginosa PA01
gaccgcccaggcugc

SEQ ID NO: 1431385 - RNA, 20 nt, Pseudomonas aeruginosa PA01
gaccgccccggcagccacca

SEQ ID NO: 1431386 - RNA, 22 nt, Pseudomonas aeruginosa PA01
gaccgccccggcagccaccagg

SEQ ID NO: 1431387 - RNA, 23 nt, Pseudomonas aeruginosa PA01
gaccgccccggcagccaccaggu

SEQ ID NO: 1431388 - RNA, 22 nt, Pseudomonas aeruginosa PA01
gaccgcaucguuggcgccgucc

SEQ ID NO: 1431389 - RNA, 21 nt, Pseudomonas aeruginosa PA01
gaccgcaaccgguccucgccc

SEQ ID NO: 1431390 - RNA, 19 nt, Pseudomonas aeruginosa PA01
gaccgagcagcggacgcag

SEQ ID NO: 1431391 - RNA, 14 nt, Pseudomonas aeruginosa PA01
gaccgagaugcucg

SEQ ID NO: 1431392 - RNA, 22 nt, Pseudomonas aeruginosa PA01
gaccgagaugcucgcgcagcga

SEQ ID NO: 1431393 - RNA, 19 nt, Pseudomonas aeruginosa PA01
gaccgagauucugcaggcg

SEQ ID NO: 1431394 - RNA, 17 nt, Pseudomonas aeruginosa PA01
gaccgagauuggccgcc

SEQ ID NO: 1431395 - RNA, 19 nt, Pseudomonas aeruginosa PA01
gaccgagauuggccgccug

SEQ ID NO: 1431396 - RNA, 23 nt, Pseudomonas aeruginosa PA01
gaccgagauuggccgccugcucg

SEQ ID NO: 1431397 - RNA, 15 nt, Pseudomonas aeruginosa PA01
gaccgcaccgccagc

SEQ ID NO: 1431398 - RNA, 16 nt, Pseudomonas aeruginosa PA01
gaccgcaccgccagcg

SEQ ID NO: 1431399 - RNA, 17 nt, Pseudomonas aeruginosa PA01
gaccgcaccgccagcgu

SEQ ID NO: 1431400 - RNA, 21 nt, Pseudomonas aeruginosa PA01
gaccgcaccgccagcgucgcc

SEQ ID NO: 1431401 - RNA, 15 nt, Pseudomonas aeruginosa PA01
gaccgaccaguacca

SEQ ID NO: 1431402 - RNA, 19 nt, Pseudomonas aeruginosa PA01
gaccgaccaguaccagcaa

SEQ ID NO: 1431403 - RNA, 20 nt, Pseudomonas aeruginosa PA01
gaccgaccaguaccagcaau

SEQ ID NO: 1431404 - RNA, 13 nt, Pseudomonas aeruginosa PA01
gaccgacuggccg

SEQ ID NO: 1431405 - RNA, 20 nt, Pseudomonas aeruginosa PA01
gaccgacuuggcagucgccg

SEQ ID NO: 1431406 - RNA, 18 nt, Pseudomonas aeruginosa PA01
gaccgagaccgacgcucg

SEQ ID NO: 1431407 - RNA, 16 nt, Pseudomonas aeruginosa PA01
gaccgacgcucgcggc

SEQ ID NO: 1431408 - RNA, 24 nt, Pseudomonas aeruginosa PA01
gaccgacgcucgcggcaucccgcc

SEQ ID NO: 1431409 - RNA, 16 nt, Pseudomonas aeruginosa PA01
gaccgacggcaacuga

SEQ ID NO: 1431410 - RNA, 17 nt, Pseudomonas aeruginosa PA01
aacgggcgcucuggccg

SEQ ID NO: 1431411 - RNA, 12 nt, Pseudomonas aeruginosa PA01
aacgggcggcgg

SEQ ID NO: 1431412 - RNA, 18 nt, Pseudomonas aeruginosa PA01
aacggggccuucgggccc

SEQ ID NO: 1431413 - RNA, 14 nt, Pseudomonas aeruginosa PA01
aacgguccagggcc

SEQ ID NO: 1431414 - RNA, 16 nt, Pseudomonas aeruginosa PA01
aacgguccagggccgc

SEQ ID NO: 1431415 - RNA, 15 nt, Pseudomonas aeruginosa PA01
aacggguccuuggca

SEQ ID NO: 1431416 - RNA, 15 nt, Pseudomonas aeruginosa PA01
aacgguagcccgcgg

SEQ ID NO: 1431417 - RNA, 19 nt, Pseudomonas aeruginosa PA01
aacgguagguagcguugcg

SEQ ID NO: 1431418 - RNA, 23 nt, Pseudomonas aeruginosa PA01
aacgguagguagcguugcgccag

SEQ ID NO: 1431419 - RNA, 17 nt, Pseudomonas aeruginosa PA01
gaccguuucgccgccgg

SEQ ID NO: 1431420 - RNA, 18 nt, Pseudomonas aeruginosa PA01
gaccguuucgccgccggc

SEQ ID NO: 1431421 - RNA, 22 nt, Pseudomonas aeruginosa PA01
gaccguuucgccgccggccagc

SEQ ID NO: 1431422 - RNA, 23 nt, Pseudomonas aeruginosa PA01
gaccguggugacgguccgcgcca

SEQ ID NO: 1431423 - RNA, 18 nt, Pseudomonas aeruginosa PA01
gaccguggauuucagcag

SEQ ID NO: 1431424 - RNA, 22 nt, Pseudomonas aeruginosa PA01
gaccguggauuucagcaggccg

SEQ ID NO: 1431425 - RNA, 23 nt, Pseudomonas aeruginosa PA01
gaccguggauuucagcaggccga

SEQ ID NO: 1431426 - RNA, 19 nt, Pseudomonas aeruginosa PA01
gaccguggcgcuacgcucg

SEQ ID NO: 1431427 - RNA, 23 nt, Pseudomonas aeruginosa PA01
gaccguggcgcuacgcucgccga

SEQ ID NO: 1431428 - RNA, 13 nt, Pseudomonas aeruginosa PA01
gaccuccaggccg

SEQ ID NO: 1431429 - RNA, 14 nt, Pseudomonas aeruginosa PA01
gaccuccaggccga

SEQ ID NO: 1431430 - RNA, 20 nt, Pseudomonas aeruginosa PA01
gaccuccaggccgaagccgc

SEQ ID NO: 1431431 - RNA, 14 nt, Pseudomonas aeruginosa PA01
gaccuccagggcca

SEQ ID NO: 1431432 - RNA, 13 nt, Pseudomonas aeruginosa PA01
gaccuccagguag

SEQ ID NO: 1431433 - RNA, 22 nt, Pseudomonas aeruginosa PA01
gaccuccagccggccauccagc

SEQ ID NO: 1431434 - RNA, 17 nt, Pseudomonas aeruginosa PA01
gaccuccgccaggucga

SEQ ID NO: 1431435 - RNA, 21 nt, Pseudomonas aeruginosa PA01
gaccuccgccaggucgauccc

SEQ ID NO: 1431436 - RNA, 18 nt, Pseudomonas aeruginosa PA01
gaccgugaugcccagcgg

SEQ ID NO: 1431437 - RNA, 23 nt, Pseudomonas aeruginosa PA01
gaccgugaugcccagcggcgcca

SEQ ID NO: 1431438 - RNA, 20 nt, Pseudomonas aeruginosa PA01
gaccgugcgggucgaggccg

SEQ ID NO: 1431439 - RNA, 21 nt, Pseudomonas aeruginosa PA01
gaccgugcgggucgaggccga

SEQ ID NO: 1431440 - RNA, 21 nt, Pseudomonas aeruginosa PA01
aacggcgugagggucgcgccg

SEQ ID NO: 1431441 - RNA, 21 nt, Pseudomonas aeruginosa PA01
gaccguccagcgcgccgcgca

SEQ ID NO: 1431442 - RNA, 15 nt, Pseudomonas aeruginosa PA01
gaccgucagccaggc

SEQ ID NO: 1431443 - RNA, 17 nt, Pseudomonas aeruginosa PA01
gaccguccacaccgaga

SEQ ID NO: 1431444 - RNA, 20 nt, Pseudomonas aeruginosa PA01
gaccgguuaauggcgcucca

SEQ ID NO: 1431445 - RNA, 14 nt, Pseudomonas aeruginosa PA01
gaccgguuccagcg

SEQ ID NO: 1431446 - RNA, 17 nt, Pseudomonas aeruginosa PA01
gaccgguuccagcggcc

SEQ ID NO: 1431447 - RNA, 18 nt, Pseudomonas aeruginosa PA01
gaccgguuccagcggccg

SEQ ID NO: 1431448 - RNA, 19 nt, Pseudomonas aeruginosa PA01
gaccgguuccagcggccgc

SEQ ID NO: 1431449 - RNA, 22 nt, Pseudomonas aeruginosa PA01
gaccgguuccgcgucgccuucg

SEQ ID NO: 1431450 - RNA, 14 nt, Pseudomonas aeruginosa PA01
gaccgucggccggg

SEQ ID NO: 1431451 - RNA, 23 nt, Pseudomonas aeruginosa PA01
gaccgucgggcaguuccgccaga

SEQ ID NO: 1431452 - RNA, 13 nt, Pseudomonas aeruginosa PA01
gaccgucgccacg

SEQ ID NO: 1431453 - RNA, 14 nt, Pseudomonas aeruginosa PA01
gaccgucgccacgc

SEQ ID NO: 1431454 - RNA, 20 nt, Pseudomonas aeruginosa PA01
gaccgucgcgauagacgccg

SEQ ID NO: 1431455 - RNA, 21 nt, Pseudomonas aeruginosa PA01
gaccgucgcgauagacgccgg

SEQ ID NO: 1431456 - RNA, 23 nt, Pseudomonas aeruginosa PA01
gaccguccacggcgcgucggcgg

SEQ ID NO: 1431457 - RNA, 14 nt, Pseudomonas aeruginosa PA01
gaccuggccgccgu

SEQ ID NO: 1431458 - RNA, 13 nt, Pseudomonas aeruginosa PA01
gaccuggccgcgu

SEQ ID NO: 1431459 - RNA, 14 nt, Pseudomonas aeruginosa PA01
gaccuggccgcugu

SEQ ID NO: 1431460 - RNA, 14 nt, Pseudomonas aeruginosa PA01
gaccuggcgccgaa

SEQ ID NO: 1431461 - RNA, 11 nt, Pseudomonas aeruginosa PA01
gaccuggccgu

SEQ ID NO: 1431462 - RNA, 20 nt, Pseudomonas aeruginosa PA01
gaccuggccgucccugacca

SEQ ID NO: 1431463 - RNA, 23 nt, Pseudomonas aeruginosa PA01
gaccuggccgucccugaccagca

SEQ ID NO: 1431464 - RNA, 12 nt, Pseudomonas aeruginosa PA01
gaccuggccacg

SEQ ID NO: 1431465 - RNA, 16 nt, Pseudomonas aeruginosa PA01
gaccugcugggccagc

SEQ ID NO: 1431466 - RNA, 20 nt, Pseudomonas aeruginosa PA01
gaccugcugggccagcgccg

SEQ ID NO: 1431467 - RNA, 19 nt, Pseudomonas aeruginosa PA01
gacgaaacgguagcccgcg

SEQ ID NO: 1431468 - RNA, 19 nt, Pseudomonas aeruginosa PA01
gacgaaacucaucaggcug

SEQ ID NO: 1431469 - RNA, 20 nt, Pseudomonas aeruginosa PA01
gacgaaacucaucaggcugc

SEQ ID NO: 1431470 - RNA, 23 nt, Pseudomonas aeruginosa PA01
gacgaaacucaucaggcugccga

SEQ ID NO: 1431471 - RNA, 19 nt, Pseudomonas aeruginosa PA01
gaccugggaacccuugcgc

SEQ ID NO: 1431472 - RNA, 16 nt, Pseudomonas aeruginosa PA01
gaccuuguccaggcgc

SEQ ID NO: 1431473 - RNA, 17 nt, Pseudomonas aeruginosa PA01
gaccuuguccaggcgcu

SEQ ID NO: 1431474 - RNA, 17 nt, Pseudomonas aeruginosa PA01
gaccuuguccuggccgg

SEQ ID NO: 1431475 - RNA, 17 nt, Pseudomonas aeruginosa PA01
gaccuugucgcgcacca

SEQ ID NO: 1431476 - RNA, 20 nt, Pseudomonas aeruginosa PA01
gaccuugucgcgguugccga

SEQ ID NO: 1431477 - RNA, 13 nt, Pseudomonas aeruginosa PA01
gaccuugucggcc

SEQ ID NO: 1431478 - RNA, 17 nt, Pseudomonas aeruginosa PA01
gaccuggcuccacugcu

SEQ ID NO: 1431479 - RNA, 17 nt, Pseudomonas aeruginosa PA01
gaccugggcgucgcugu

SEQ ID NO: 1431480 - RNA, 15 nt, Pseudomonas aeruginosa PA01
gaccuggggcggccu

SEQ ID NO: 1431481 - RNA, 17 nt, Pseudomonas aeruginosa PA01
gaccuggggcggccuca

SEQ ID NO: 1431482 - RNA, 16 nt, Pseudomonas aeruginosa PA01
gacgaacgagaagccg

SEQ ID NO: 1431483 - RNA, 21 nt, Pseudomonas aeruginosa PA01
gacgaacucaacgaagugaag

SEQ ID NO: 1431484 - RNA, 15 nt, Pseudomonas aeruginosa PA01
gacgaacgccuuggu

SEQ ID NO: 1431485 - RNA, 14 nt, Pseudomonas aeruginosa PA01
gacgaacgaagcgc

SEQ ID NO: 1431486 - RNA, 18 nt, Pseudomonas aeruginosa PA01
gacgaaauaaugcggcgc

SEQ ID NO: 1431487 - RNA, 19 nt, Pseudomonas aeruginosa PA01
gacgaaauacucgucgacg

SEQ ID NO: 1431488 - RNA, 23 nt, Pseudomonas aeruginosa PA01
gacgaaauacucgucgacggccu

SEQ ID NO: 1431489 - RNA, 14 nt, Pseudomonas aeruginosa PA01
gacgaaagaagccg

SEQ ID NO: 1431490 - RNA, 16 nt, Pseudomonas aeruginosa PA01
gacgaaagaagccgca

SEQ ID NO: 1431491 - RNA, 17 nt, Pseudomonas aeruginosa PA01
gacgaaagaagccgcac

SEQ ID NO: 1431492 - RNA, 16 nt, Pseudomonas aeruginosa PA01
gacgaaaggccgcgcc

SEQ ID NO: 1431493 - RNA, 22 nt, Pseudomonas aeruginosa PA01
gacgaaauagucgcgggccugg

SEQ ID NO: 1431494 - RNA, 13 nt, Pseudomonas aeruginosa PA01
gaccucgauggcg

SEQ ID NO: 1431495 - RNA, 17 nt, Pseudomonas aeruginosa PA01
gaccucgagcuggacgc

SEQ ID NO: 1431496 - RNA, 20 nt, Pseudomonas aeruginosa PA01
gaccucgagcuggacgcgcu

SEQ ID NO: 1431497 - RNA, 17 nt, Pseudomonas aeruginosa PA01
gaccuccggcgccaggc

SEQ ID NO: 1431498 - RNA, 16 nt, Pseudomonas aeruginosa PA01
gaccucgagcaggccg

SEQ ID NO: 1431499 - RNA, 18 nt, Pseudomonas aeruginosa PA01
gaccucgaaguccugcag

SEQ ID NO: 1431500 - RNA, 20 nt, Pseudomonas aeruginosa PA01
gaccucgaaguccugcagga

SEQ ID NO: 1431501 - RNA, 14 nt, Pseudomonas aeruginosa PA01
gaccucccgcgcca

SEQ ID NO: 1431502 - RNA, 19 nt, Pseudomonas aeruginosa PA01
gaccucccgcgccagcucg

SEQ ID NO: 1431503 - RNA, 17 nt, Pseudomonas aeruginosa PA01
gaccucgacgccgagcc

SEQ ID NO: 1431504 - RNA, 18 nt, Pseudomonas aeruginosa PA01
gaccucgacgccgagcca

SEQ ID NO: 1431505 - RNA, 20 nt, Pseudomonas aeruginosa PA01
gaccucgauggcgauauggc

SEQ ID NO: 1431506 - RNA, 14 nt, Pseudomonas aeruginosa PA01
gaccucgauguccg

SEQ ID NO: 1431507 - RNA, 14 nt, Pseudomonas aeruginosa PA01
gaccucgcccaucg

SEQ ID NO: 1431508 - RNA, 17 nt, Pseudomonas aeruginosa PA01
gaccucgcccaucgcca

SEQ ID NO: 1431509 - RNA, 20 nt, Pseudomonas aeruginosa PA01
gaccucgcccaucgccaggg

SEQ ID NO: 1431510 - RNA, 18 nt, Pseudomonas aeruginosa PA01
gaccucgcugacuuccau

SEQ ID NO: 1431511 - RNA, 11 nt, Pseudomonas aeruginosa PA01
gaccucgcggg

SEQ ID NO: 1431512 - RNA, 19 nt, Pseudomonas aeruginosa PA01
gaccucgcgggcgacgugg

SEQ ID NO: 1431513 - RNA, 17 nt, Pseudomonas aeruginosa PA01
gaccucguugcaggcac

SEQ ID NO: 1431514 - RNA, 19 nt, Pseudomonas aeruginosa PA01
gaccucggguuuggcgccc

SEQ ID NO: 1431515 - RNA, 23 nt, Pseudomonas aeruginosa PA01
gaccucgggcagcuuggcgguca

SEQ ID NO: 1431516 - RNA, 18 nt, Pseudomonas aeruginosa PA01
gaccugagaucagcgccc

SEQ ID NO: 1431517 - RNA, 17 nt, Pseudomonas aeruginosa PA01
gaccagcucgaagccgc

SEQ ID NO: 1431518 - RNA, 23 nt, Pseudomonas aeruginosa PA01
gaccagcucgaagccgccguuga

SEQ ID NO: 1431519 - RNA, 23 nt, Pseudomonas aeruginosa PA01
gaccagcuucaaccguggcucga

SEQ ID NO: 1431520 - RNA, 14 nt, Pseudomonas aeruginosa PA01
gaccagcuugggca

SEQ ID NO: 1431521 - RNA, 17 nt, Pseudomonas aeruginosa PA01
gaccagcggcaccgaga

SEQ ID NO: 1431522 - RNA, 13 nt, Pseudomonas aeruginosa PA01
gaccaggaucacc

SEQ ID NO: 1431523 - RNA, 16 nt, Pseudomonas aeruginosa PA01
gaccaggaucgacccc

SEQ ID NO: 1431524 - RNA, 19 nt, Pseudomonas aeruginosa PA01
gaccaggaucgaccccgcc

SEQ ID NO: 1431525 - RNA, 19 nt, Pseudomonas aeruginosa PA01
gaccaggguggcggcggcg

SEQ ID NO: 1431526 - RNA, 19 nt, Pseudomonas aeruginosa PA01
gaccaggguggggaugcgc

SEQ ID NO: 1431527 - RNA, 22 nt, Pseudomonas aeruginosa PA01
gaccaggguggggaugcgcgag

SEQ ID NO: 1431528 - RNA, 23 nt, Pseudomonas aeruginosa PA01
gaccaggguggggaugcgcgagg

SEQ ID NO: 1431529 - RNA, 21 nt, Pseudomonas aeruginosa PA01
gaccagguccggcagcgccuu

SEQ ID NO: 1431530 - RNA, 15 nt, Pseudomonas aeruginosa PA01
gaccaggucgcuggc

SEQ ID NO: 1431531 - RNA, 23 nt, Pseudomonas aeruginosa PA01
gaccaggucgcuggcaccggcca

SEQ ID NO: 1431532 - RNA, 13 nt, Pseudomonas aeruginosa PA01
aacgcgaggucuc

SEQ ID NO: 1431533 - RNA, 16 nt, Pseudomonas aeruginosa PA01
gaccagcccgcgcgac

SEQ ID NO: 1431534 - RNA, 15 nt, Pseudomonas aeruginosa PA01
gaccagcccuggcgc

SEQ ID NO: 1431535 - RNA, 18 nt, Pseudomonas aeruginosa PA01
gaccagcccuggcgcggc

SEQ ID NO: 1431536 - RNA, 15 nt, Pseudomonas aeruginosa PA01
gaccagcccggcggc

SEQ ID NO: 1431537 - RNA, 18 nt, Pseudomonas aeruginosa PA01
gaccagcccggcggcggc

SEQ ID NO: 1431538 - RNA, 19 nt, Pseudomonas aeruginosa PA01
gaccagccagucggcgguc

SEQ ID NO: 1431539 - RNA, 16 nt, Pseudomonas aeruginosa PA01
aacgcgccuccggcag

SEQ ID NO: 1431540 - RNA, 19 nt, Pseudomonas aeruginosa PA01
gaccccggugugcgcugca

SEQ ID NO: 1431541 - RNA, 13 nt, Pseudomonas aeruginosa PA01
gaccccggcggcg

SEQ ID NO: 1431542 - RNA, 15 nt, Pseudomonas aeruginosa PA01
gaccccggcggcgcg

SEQ ID NO: 1431543 - RNA, 14 nt, Pseudomonas aeruginosa PA01
gaccccggaaaggu

SEQ ID NO: 1431544 - RNA, 14 nt, Pseudomonas aeruginosa PA01
gaccccggccuggc

SEQ ID NO: 1431545 - RNA, 17 nt, Pseudomonas aeruginosa PA01
gaccccggccuggcugg

SEQ ID NO: 1431546 - RNA, 12 nt, Pseudomonas aeruginosa PA01
gaccccgccggg

SEQ ID NO: 1431547 - RNA, 15 nt, Pseudomonas aeruginosa PA01
gaccccgcggccgag

SEQ ID NO: 1431548 - RNA, 15 nt, Pseudomonas aeruginosa PA01
gaccccgaggucggc

SEQ ID NO: 1431549 - RNA, 17 nt, Pseudomonas aeruginosa PA01
gaccccgaucaccggau

SEQ ID NO: 1431550 - RNA, 16 nt, Pseudomonas aeruginosa PA01
gacccccugcggcccg

SEQ ID NO: 1431551 - RNA, 23 nt, Pseudomonas aeruginosa PA01
gaccccaccggucuuggcgcgcg

SEQ ID NO: 1431552 - RNA, 15 nt, Pseudomonas aeruginosa PA01
gaccccacgccggcc

SEQ ID NO: 1431553 - RNA, 22 nt, Pseudomonas aeruginosa PA01
gacccaugccgcuagcccugcu

SEQ ID NO: 1431554 - RNA, 16 nt, Pseudomonas aeruginosa PA01
gaccaucggcggcggc

SEQ ID NO: 1431555 - RNA, 17 nt, Pseudomonas aeruginosa PA01
gaccaucgccggcgagc

SEQ ID NO: 1431556 - RNA, 23 nt, Pseudomonas aeruginosa PA01
gaccaucgccggcgagccgcugg

SEQ ID NO: 1431557 - RNA, 16 nt, Pseudomonas aeruginosa PA01
gaccaguuucuucgcg

SEQ ID NO: 1431558 - RNA, 19 nt, Pseudomonas aeruginosa PA01
gaccauaggcuugcgccga

SEQ ID NO: 1431559 - RNA, 21 nt, Pseudomonas aeruginosa PA01
gaccauaggcuugcgccgaag

SEQ ID NO: 1431560 - RNA, 17 nt, Pseudomonas aeruginosa PA01
gaccaucaccagcgccg

SEQ ID NO: 1431561 - RNA, 17 nt, Pseudomonas aeruginosa PA01
gaccaucagcuggaucu

SEQ ID NO: 1431562 - RNA, 20 nt, Pseudomonas aeruginosa PA01
gaccauccagccugcgcugu

SEQ ID NO: 1431563 - RNA, 23 nt, Pseudomonas aeruginosa PA01
gaccauccagccugcgcuguucg

SEQ ID NO: 1431564 - RNA, 15 nt, Pseudomonas aeruginosa PA01
gaccaguucagcgcg

SEQ ID NO: 1431565 - RNA, 19 nt, Pseudomonas aeruginosa PA01
gaccaguucagcgcgcucg

SEQ ID NO: 1431566 - RNA, 14 nt, Pseudomonas aeruginosa PA01
gaccaguucgccgc

SEQ ID NO: 1431567 - RNA, 15 nt, Pseudomonas aeruginosa PA01
gaccaguucgccgcc

SEQ ID NO: 1431568 - RNA, 17 nt, Pseudomonas aeruginosa PA01
gaccaguucgccgccgc

SEQ ID NO: 1431569 - RNA, 21 nt, Pseudomonas aeruginosa PA01
gaccaguugcccgagugccgg

SEQ ID NO: 1431570 - RNA, 23 nt, Pseudomonas aeruginosa PA01
gaccacgcucaggucggucgaac

SEQ ID NO: 1431571 - RNA, 13 nt, Pseudomonas aeruginosa PA01
aacgccgcaggcg

SEQ ID NO: 1431572 - RNA, 11 nt, Pseudomonas aeruginosa PA01
aacgcccggcu

SEQ ID NO: 1431573 - RNA, 22 nt, Pseudomonas aeruginosa PA01
aacgcccggcuuuccucggcca

SEQ ID NO: 1431574 - RNA, 15 nt, Pseudomonas aeruginosa PA01
aacgcccgcgagccg

SEQ ID NO: 1431575 - RNA, 15 nt, Pseudomonas aeruginosa PA01
aacgcccgcggcagc

SEQ ID NO: 1431576 - RNA, 15 nt, Pseudomonas aeruginosa PA01
aacgccacaggcguu

SEQ ID NO: 1431577 - RNA, 15 nt, Pseudomonas aeruginosa PA01
aacgccaccagggcc

SEQ ID NO: 1431578 - RNA, 19 nt, Pseudomonas aeruginosa PA01
gaccacggccuucggcagg

SEQ ID NO: 1431579 - RNA, 13 nt, Pseudomonas aeruginosa PA01
gaccacggcgagg

SEQ ID NO: 1431580 - RNA, 17 nt, Pseudomonas aeruginosa PA01
gaccacgcuggucaccg

SEQ ID NO: 1431581 - RNA, 17 nt, Pseudomonas aeruginosa PA01
aacgccggcgaucgccg

SEQ ID NO: 1431582 - RNA, 23 nt, Pseudomonas aeruginosa PA01
aacgccuggugcaggucgcgcgg

SEQ ID NO: 1431583 - RNA, 22 nt, Pseudomonas aeruginosa PA01
gaccagaucggcauggccgacc

SEQ ID NO: 1431584 - RNA, 15 nt, Pseudomonas aeruginosa PA01
gaccagaucggcgcg

SEQ ID NO: 1431585 - RNA, 15 nt, Pseudomonas aeruginosa PA01
aacgccgguggcguu

SEQ ID NO: 1431586 - RNA, 21 nt, Pseudomonas aeruginosa PA01
aacgccgggcaacgccaggcc

SEQ ID NO: 1431587 - RNA, 14 nt, Pseudomonas aeruginosa PA01
gaccacgcccugcg

SEQ ID NO: 1431588 - RNA, 20 nt, Pseudomonas aeruginosa PA01
gaccacgcccugcgccagca

SEQ ID NO: 1431589 - RNA, 17 nt, Pseudomonas aeruginosa PA01
gaccacgcagagcggca

SEQ ID NO: 1431590 - RNA, 20 nt, Pseudomonas aeruginosa PA01
gaccacgcagagcggcaggc

SEQ ID NO: 1431591 - RNA, 21 nt, Pseudomonas aeruginosa PA01
gaccacgcagagcggcaggcc

SEQ ID NO: 1431592 - RNA, 13 nt, Pseudomonas aeruginosa PA01
gaccacgcaggcc

SEQ ID NO: 1431593 - RNA, 15 nt, Pseudomonas aeruginosa PA01
gaccacgcaggccag

SEQ ID NO: 1431594 - RNA, 17 nt, Pseudomonas aeruginosa PA01
gaccacgcaggccagcg

SEQ ID NO: 1431595 - RNA, 23 nt, Pseudomonas aeruginosa PA01
gaccacgcaggccagcgccaggg

SEQ ID NO: 1431596 - RNA, 20 nt, Pseudomonas aeruginosa PA01
aacgcaggggcaccggcgga

SEQ ID NO: 1431597 - RNA, 21 nt, Pseudomonas aeruginosa PA01
gaccacgaagcgaccgaucau

SEQ ID NO: 1431598 - RNA, 22 nt, Pseudomonas aeruginosa PA01
gaccacgaagcgaccgaucaug

SEQ ID NO: 1431599 - RNA, 14 nt, Pseudomonas aeruginosa PA01
gaccaccuucaggc

SEQ ID NO: 1431600 - RNA, 18 nt, Pseudomonas aeruginosa PA01
gaccaccuucaggcugcu

SEQ ID NO: 1431601 - RNA, 17 nt, Pseudomonas aeruginosa PA01
gaccaccuucuacaccg

SEQ ID NO: 1431602 - RNA, 17 nt, Pseudomonas aeruginosa PA01
gaccaccccggucaugg

SEQ ID NO: 1431603 - RNA, 17 nt, Pseudomonas aeruginosa PA01
gaccaccucggcgucgg

SEQ ID NO: 1431604 - RNA, 22 nt, Pseudomonas aeruginosa PA01
gaccaccucggcgucggcaugg

SEQ ID NO: 1431605 - RNA, 23 nt, Pseudomonas aeruginosa PA01
gaccaccucggcgucggcauggc

SEQ ID NO: 1431606 - RNA, 18 nt, Pseudomonas aeruginosa PA01
gaccaccaccaggucggc

SEQ ID NO: 1431607 - RNA, 13 nt, Pseudomonas aeruginosa PA01
gaccaccagcagc

SEQ ID NO: 1431608 - RNA, 15 nt, Pseudomonas aeruginosa PA01
gaccaccaucaccgc

SEQ ID NO: 1431609 - RNA, 19 nt, Pseudomonas aeruginosa PA01
gaccaacugcgcccccagc

SEQ ID NO: 1431610 - RNA, 20 nt, Pseudomonas aeruginosa PA01
gaccaacagggcgucgucga

SEQ ID NO: 1431611 - RNA, 14 nt, Pseudomonas aeruginosa PA01
gaccacaucggcca

SEQ ID NO: 1431612 - RNA, 15 nt, Pseudomonas aeruginosa PA01
gaccacaucggccag

SEQ ID NO: 1431613 - RNA, 16 nt, Pseudomonas aeruginosa PA01
gaccacaugggcgacc

SEQ ID NO: 1431614 - RNA, 18 nt, Pseudomonas aeruginosa PA01
gaccacacaugcaggucg

SEQ ID NO: 1431615 - RNA, 19 nt, Pseudomonas aeruginosa PA01
aacgaguugggcgaccugc

SEQ ID NO: 1431616 - RNA, 20 nt, Pseudomonas aeruginosa PA01
gaccaaggcauugcgcuugc

SEQ ID NO: 1431617 - RNA, 17 nt, Pseudomonas aeruginosa PA01
gacaggucgguguugcg

SEQ ID NO: 1431618 - RNA, 15 nt, Pseudomonas aeruginosa PA01
gacaggucgacggcc

SEQ ID NO: 1431619 - RNA, 17 nt, Pseudomonas aeruginosa PA01
gacaggucgacggcccu

SEQ ID NO: 1431620 - RNA, 19 nt, Pseudomonas aeruginosa PA01
gacagguucaggacgcucc

SEQ ID NO: 1431621 - RNA, 18 nt, Pseudomonas aeruginosa PA01
gacaggucggccggcagc

SEQ ID NO: 1431622 - RNA, 22 nt, Pseudomonas aeruginosa PA01
gacaggucggccggcagcuccg

SEQ ID NO: 1431623 - RNA, 16 nt, Pseudomonas aeruginosa PA01
gacagguacucggccc

SEQ ID NO: 1431624 - RNA, 22 nt, Pseudomonas aeruginosa PA01
gacagguacucggcccgggccu

SEQ ID NO: 1431625 - RNA, 13 nt, Pseudomonas aeruginosa PA01
gacaguucgccgc

SEQ ID NO: 1431626 - RNA, 16 nt, Pseudomonas aeruginosa PA01
gacaguucgccgcccg

SEQ ID NO: 1431627 - RNA, 20 nt, Pseudomonas aeruginosa PA01
gacaugccgguucccgcagc

SEQ ID NO: 1431628 - RNA, 21 nt, Pseudomonas aeruginosa PA01
gacaugccgguucccgcagcg

SEQ ID NO: 1431629 - RNA, 19 nt, Pseudomonas aeruginosa PA01
gacagguccuggaacagga

SEQ ID NO: 1431630 - RNA, 14 nt, Pseudomonas aeruginosa PA01
gacagguuggcgcc

SEQ ID NO: 1431631 - RNA, 18 nt, Pseudomonas aeruginosa PA01
gacagguuggcgccgggc

SEQ ID NO: 1431632 - RNA, 13 nt, Pseudomonas aeruginosa PA01
gacauggcgcucg

SEQ ID NO: 1431633 - RNA, 21 nt, Pseudomonas aeruginosa PA01
gacauguugcagggucgccgg

SEQ ID NO: 1431634 - RNA, 21 nt, Pseudomonas aeruginosa PA01
gacauggaucaccgccaaggc

SEQ ID NO: 1431635 - RNA, 14 nt, Pseudomonas aeruginosa PA01
gacauggaugacca

SEQ ID NO: 1431636 - RNA, 21 nt, Pseudomonas aeruginosa PA01
gacagcccgcgcucggccgcc

SEQ ID NO: 1431637 - RNA, 13 nt, Pseudomonas aeruginosa PA01
gacagcauggccu

SEQ ID NO: 1431638 - RNA, 19 nt, Pseudomonas aeruginosa PA01
gacagcauggccuugccgg

SEQ ID NO: 1431639 - RNA, 14 nt, Pseudomonas aeruginosa PA01
gacagccccggccc

SEQ ID NO: 1431640 - RNA, 16 nt, Pseudomonas aeruginosa PA01
gacagccccggcccgg

SEQ ID NO: 1431641 - RNA, 17 nt, Pseudomonas aeruginosa PA01
gacagccccggcccggu

SEQ ID NO: 1431642 - RNA, 19 nt, Pseudomonas aeruginosa PA01
gacagcaucugcugguccu

SEQ ID NO: 1431643 - RNA, 14 nt, Pseudomonas aeruginosa PA01
gacagcagggucgc

SEQ ID NO: 1431644 - RNA, 17 nt, Pseudomonas aeruginosa PA01
gacagcagggucgcgcc

SEQ ID NO: 1431645 - RNA, 13 nt, Pseudomonas aeruginosa PA01
gacagcaggucgu

SEQ ID NO: 1431646 - RNA, 16 nt, Pseudomonas aeruginosa PA01
gacagcagguggcugg

SEQ ID NO: 1431647 - RNA, 17 nt, Pseudomonas aeruginosa PA01
gaauuccagcaggucgg

SEQ ID NO: 1431648 - RNA, 14 nt, Pseudomonas aeruginosa PA01
gaauuccggcagcg

SEQ ID NO: 1431649 - RNA, 21 nt, Pseudomonas aeruginosa PA01
gaauggcuugaucgagucgcc

SEQ ID NO: 1431650 - RNA, 18 nt, Pseudomonas aeruginosa PA01
gaauggcggauaaccgca

SEQ ID NO: 1431651 - RNA, 13 nt, Pseudomonas aeruginosa PA01
aacgacagccccg

SEQ ID NO: 1431652 - RNA, 18 nt, Pseudomonas aeruginosa PA01
aacgacagccccggcccg

SEQ ID NO: 1431653 - RNA, 22 nt, Pseudomonas aeruginosa PA01
aacgacagccccggcccgguca

SEQ ID NO: 1431654 - RNA, 22 nt, Pseudomonas aeruginosa PA01
aacgaagacccccugcggcccg

SEQ ID NO: 1431655 - RNA, 19 nt, Pseudomonas aeruginosa PA01
gacaggaugcgcuuuuccu

SEQ ID NO: 1431656 - RNA, 19 nt, Pseudomonas aeruginosa PA01
gacagggcggcagcgugcu

SEQ ID NO: 1431657 - RNA, 19 nt, Pseudomonas aeruginosa PA01
gacaggcaucgcucgcaac

SEQ ID NO: 1431658 - RNA, 16 nt, Pseudomonas aeruginosa PA01
gacaggcuggugccgu

SEQ ID NO: 1431659 - RNA, 17 nt, Pseudomonas aeruginosa PA01
gacaggcgucccuggag

SEQ ID NO: 1431660 - RNA, 18 nt, Pseudomonas aeruginosa PA01
gacaggcgucccuggagc

SEQ ID NO: 1431661 - RNA, 19 nt, Pseudomonas aeruginosa PA01
gacaggcgucccuggagca

SEQ ID NO: 1431662 - RNA, 22 nt, Pseudomonas aeruginosa PA01
gacaggcgucccuggagcaggg

SEQ ID NO: 1431663 - RNA, 22 nt, Pseudomonas aeruginosa PA01
gacaggcuaggaauaucuugcg

SEQ ID NO: 1431664 - RNA, 14 nt, Pseudomonas aeruginosa PA01
gacagccugggcgg

SEQ ID NO: 1431665 - RNA, 15 nt, Pseudomonas aeruginosa PA01
gacagccuucgagcc

SEQ ID NO: 1431666 - RNA, 19 nt, Pseudomonas aeruginosa PA01
gacagcgaaugcuugccgg

SEQ ID NO: 1431667 - RNA, 18 nt, Pseudomonas aeruginosa PA01
gacagcgcggaucaguca

SEQ ID NO: 1431668 - RNA, 12 nt, Pseudomonas aeruginosa PA01
gacaggcagccg

SEQ ID NO: 1431669 - RNA, 13 nt, Pseudomonas aeruginosa PA01
gacaggcagccgg

SEQ ID NO: 1431670 - RNA, 17 nt, Pseudomonas aeruginosa PA01
gacaggcagccggccau

SEQ ID NO: 1431671 - RNA, 14 nt, Pseudomonas aeruginosa PA01
gacaggcagcgccg

SEQ ID NO: 1431672 - RNA, 15 nt, Pseudomonas aeruginosa PA01
gacaggcagcgccgc

SEQ ID NO: 1431673 - RNA, 17 nt, Pseudomonas aeruginosa PA01
gaagcccugcuggcgca

SEQ ID NO: 1431674 - RNA, 21 nt, Pseudomonas aeruginosa PA01
gaagcccugcuggcgcagcca

SEQ ID NO: 1431675 - RNA, 20 nt, Pseudomonas aeruginosa PA01
gaagccgaccacucgcgaga

SEQ ID NO: 1431676 - RNA, 16 nt, Pseudomonas aeruginosa PA01
gaagccgaccggcgcc

SEQ ID NO: 1431677 - RNA, 18 nt, Pseudomonas aeruginosa PA01
gaagccgaccggcgccgg

SEQ ID NO: 1431678 - RNA, 15 nt, Pseudomonas aeruginosa PA01
gaagccgcacuucca

SEQ ID NO: 1431679 - RNA, 20 nt, Pseudomonas aeruginosa PA01
gaagccgcacuuccaggugc

SEQ ID NO: 1431680 - RNA, 22 nt, Pseudomonas aeruginosa PA01
gaagccgcacuuccaggugcca

SEQ ID NO: 1431681 - RNA, 17 nt, Pseudomonas aeruginosa PA01
gaagccgaucaggucgc

SEQ ID NO: 1431682 - RNA, 22 nt, Pseudomonas aeruginosa PA01
gaagccgaucaggucgcgcgcc

SEQ ID NO: 1431683 - RNA, 20 nt, Pseudomonas aeruginosa PA01
gaagccgcccacgggcggcu

SEQ ID NO: 1431684 - RNA, 21 nt, Pseudomonas aeruginosa PA01
gaagccgaucaccaccagcau

SEQ ID NO: 1431685 - RNA, 14 nt, Pseudomonas aeruginosa PA01
gaagccgagcugcc

SEQ ID NO: 1431686 - RNA, 22 nt, Pseudomonas aeruginosa PA01
gaagccgagcugccgggcgagc

SEQ ID NO: 1431687 - RNA, 17 nt, Pseudomonas aeruginosa PA01
gaagccggauucgcgca

SEQ ID NO: 1431688 - RNA, 20 nt, Pseudomonas aeruginosa PA01
gaagccggauucgcgcagca

SEQ ID NO: 1431689 - RNA, 21 nt, Pseudomonas aeruginosa PA01
gaagccggcacgguagccgcc

SEQ ID NO: 1431690 - RNA, 22 nt, Pseudomonas aeruginosa PA01
gaagccggcgauguucgccccc

SEQ ID NO: 1431691 - RNA, 17 nt, Pseudomonas aeruginosa PA01
gaagccgggaagccgcu

SEQ ID NO: 1431692 - RNA, 13 nt, Pseudomonas aeruginosa PA01
gaagccggccccu

SEQ ID NO: 1431693 - RNA, 15 nt, Pseudomonas aeruginosa PA01
gaagccgcgcaaggc

SEQ ID NO: 1431694 - RNA, 21 nt, Pseudomonas aeruginosa PA01
gaagccgccguugaugacgaa

SEQ ID NO: 1431695 - RNA, 13 nt, Pseudomonas aeruginosa PA01
gaagccgccgccg

SEQ ID NO: 1431696 - RNA, 11 nt, Pseudomonas aeruginosa PA01
gaagccgcgcc

SEQ ID NO: 1431697 - RNA, 18 nt, Pseudomonas aeruginosa PA01
gaagccgcgccccagcgg

SEQ ID NO: 1431698 - RNA, 21 nt, Pseudomonas aeruginosa PA01
gaagccgcgccccagcggcag

SEQ ID NO: 1431699 - RNA, 22 nt, Pseudomonas aeruginosa PA01
gaagccgcgccccagcggcagg

SEQ ID NO: 1431700 - RNA, 13 nt, Pseudomonas aeruginosa PA01
gaagccgcgcucg

SEQ ID NO: 1431701 - RNA, 18 nt, Pseudomonas aeruginosa PA01
gaagccgcucggcguagc

SEQ ID NO: 1431702 - RNA, 14 nt, Pseudomonas aeruginosa PA01
gaagccgcugaccu

SEQ ID NO: 1431703 - RNA, 17 nt, Pseudomonas aeruginosa PA01
gaagccgcugaccucgg

SEQ ID NO: 1431704 - RNA, 18 nt, Pseudomonas aeruginosa PA01
gaagccccagagcccgcc

SEQ ID NO: 1431705 - RNA, 23 nt, Pseudomonas aeruginosa PA01
gaagccccagagcccgccgaaca

SEQ ID NO: 1431706 - RNA, 15 nt, Pseudomonas aeruginosa PA01
gaagccccuggcgcu

SEQ ID NO: 1431707 - RNA, 14 nt, Pseudomonas aeruginosa PA01
gaagccaggcaccg

SEQ ID NO: 1431708 - RNA, 21 nt, Pseudomonas aeruginosa PA01
gaagcccgccuugauggcggg

SEQ ID NO: 1431709 - RNA, 17 nt, Pseudomonas aeruginosa PA01
gaagccagccaggucgg

SEQ ID NO: 1431710 - RNA, 13 nt, Pseudomonas aeruginosa PA01
gaagcccaggcgc

SEQ ID NO: 1431711 - RNA, 21 nt, Pseudomonas aeruginosa PA01
gaagcccaggcgcucggcggc

SEQ ID NO: 1431712 - RNA, 19 nt, Pseudomonas aeruginosa PA01
gaagcccaggcgucgcgcc

SEQ ID NO: 1431713 - RNA, 15 nt, Pseudomonas aeruginosa PA01
gaagcccaggcugac

SEQ ID NO: 1431714 - RNA, 13 nt, Pseudomonas aeruginosa PA01
gaagcccagcagg

SEQ ID NO: 1431715 - RNA, 16 nt, Pseudomonas aeruginosa PA01
gaagcccagcaggucg

SEQ ID NO: 1431716 - RNA, 23 nt, Pseudomonas aeruginosa PA01
gaagcccagcaggucgaucucga

SEQ ID NO: 1431717 - RNA, 14 nt, Pseudomonas aeruginosa PA01
gaagcccagcgagc

SEQ ID NO: 1431718 - RNA, 20 nt, Pseudomonas aeruginosa PA01
gaagcccagcgagccgauca

SEQ ID NO: 1431719 - RNA, 13 nt, Pseudomonas aeruginosa PA01
gaagcccagcgcc

SEQ ID NO: 1431720 - RNA, 14 nt, Pseudomonas aeruginosa PA01
gaagcccagcgccg

SEQ ID NO: 1431721 - RNA, 14 nt, Pseudomonas aeruginosa PA01
gaagcccagcgccu

SEQ ID NO: 1431722 - RNA, 15 nt, Pseudomonas aeruginosa PA01
gaagcccagcgccug

SEQ ID NO: 1431723 - RNA, 14 nt, Pseudomonas aeruginosa PA01
gaagagcgccgcgg

SEQ ID NO: 1431724 - RNA, 18 nt, Pseudomonas aeruginosa PA01
gaagagcgccgcggcggc

SEQ ID NO: 1431725 - RNA, 18 nt, Pseudomonas aeruginosa PA01
gaagagcagcgcggcggc

SEQ ID NO: 1431726 - RNA, 17 nt, Pseudomonas aeruginosa PA01
gaagagcccgccacgcu

SEQ ID NO: 1431727 - RNA, 22 nt, Pseudomonas aeruginosa PA01
gaagacguacagcgggucggcg

SEQ ID NO: 1431728 - RNA, 23 nt, Pseudomonas aeruginosa PA01
gaagaggcccucggcgccgagca

SEQ ID NO: 1431729 - RNA, 18 nt, Pseudomonas aeruginosa PA01
gaagagguacggccuuca

SEQ ID NO: 1431730 - RNA, 16 nt, Pseudomonas aeruginosa PA01
gaagagcuggcggccg

SEQ ID NO: 1431731 - RNA, 19 nt, Pseudomonas aeruginosa PA01
gaagaucgacaggccgccg

SEQ ID NO: 1431732 - RNA, 14 nt, Pseudomonas aeruginosa PA01
gaagaucagcgcgg

SEQ ID NO: 1431733 - RNA, 13 nt, Pseudomonas aeruginosa PA01
gaagcagagggcg

SEQ ID NO: 1431734 - RNA, 12 nt, Pseudomonas aeruginosa PA01
gaagcagcccag

SEQ ID NO: 1431735 - RNA, 17 nt, Pseudomonas aeruginosa PA01
gaagcaccgacucgccc

SEQ ID NO: 1431736 - RNA, 22 nt, Pseudomonas aeruginosa PA01
gaagcaggcggaguagccggcg

SEQ ID NO: 1431737 - RNA, 16 nt, Pseudomonas aeruginosa PA01
gaagcgucagccgcgg

SEQ ID NO: 1431738 - RNA, 17 nt, Pseudomonas aeruginosa PA01
gaagcgucgugcgccgg

SEQ ID NO: 1431739 - RNA, 19 nt, Pseudomonas aeruginosa PA01
gaagcgucgugcgccggcc

SEQ ID NO: 1431740 - RNA, 17 nt, Pseudomonas aeruginosa PA01
gaagcgugggcggccgg

SEQ ID NO: 1431741 - RNA, 23 nt, Pseudomonas aeruginosa PA01
gaagcgugggcggccggccaggu

SEQ ID NO: 1431742 - RNA, 17 nt, Pseudomonas aeruginosa PA01
gaagcgguagugggcga

SEQ ID NO: 1431743 - RNA, 16 nt, Pseudomonas aeruginosa PA01
gaagcguugcagcguc

SEQ ID NO: 1431744 - RNA, 19 nt, Pseudomonas aeruginosa PA01
gaagcguugcucgagccgu

SEQ ID NO: 1431745 - RNA, 17 nt, Pseudomonas aeruginosa PA01
gaagcuggagcagcagc

SEQ ID NO: 1431746 - RNA, 15 nt, Pseudomonas aeruginosa PA01
gaagcugccuuccag

SEQ ID NO: 1431747 - RNA, 16 nt, Pseudomonas aeruginosa PA01
gaagcugccggcauug

SEQ ID NO: 1431748 - RNA, 21 nt, Pseudomonas aeruginosa PA01
gaagcuggcgcaacugcgcca

SEQ ID NO: 1431749 - RNA, 22 nt, Pseudomonas aeruginosa PA01
gaagcuccagcgugcccgcugc

SEQ ID NO: 1431750 - RNA, 17 nt, Pseudomonas aeruginosa PA01
gaagcucggcagcacgc

SEQ ID NO: 1431751 - RNA, 16 nt, Pseudomonas aeruginosa PA01
gaagcucggccgcucg

SEQ ID NO: 1431752 - RNA, 17 nt, Pseudomonas aeruginosa PA01
gaagcucucgccgcgcu

SEQ ID NO: 1431753 - RNA, 16 nt, Pseudomonas aeruginosa PA01
gaaggccacgccgccg

SEQ ID NO: 1431754 - RNA, 14 nt, Pseudomonas aeruginosa PA01
gaaggaccagcuug

SEQ ID NO: 1431755 - RNA, 17 nt, Pseudomonas aeruginosa PA01
gaaggcaaugccgcccu

SEQ ID NO: 1431756 - RNA, 23 nt, Pseudomonas aeruginosa PA01
gaaggccgaacgguagguagcgu

SEQ ID NO: 1431757 - RNA, 17 nt, Pseudomonas aeruginosa PA01
gaaggccgacaccucga

SEQ ID NO: 1431758 - RNA, 22 nt, Pseudomonas aeruginosa PA01
gaaggccgacaccucgaucagc

SEQ ID NO: 1431759 - RNA, 18 nt, Pseudomonas aeruginosa PA01
gaaggccagcucgucgcc

SEQ ID NO: 1431760 - RNA, 19 nt, Pseudomonas aeruginosa PA01
gaaggccagcuugucggcc

SEQ ID NO: 1431761 - RNA, 14 nt, Pseudomonas aeruginosa PA01
gaaggccaggaccg

SEQ ID NO: 1431762 - RNA, 12 nt, Pseudomonas aeruginosa PA01
gaaggccaggcc

SEQ ID NO: 1431763 - RNA, 16 nt, Pseudomonas aeruginosa PA01
gaaggccaggccggcg

SEQ ID NO: 1431764 - RNA, 19 nt, Pseudomonas aeruginosa PA01
gaaggccaggccggcgccu

SEQ ID NO: 1431765 - RNA, 12 nt, Pseudomonas aeruginosa PA01
gaaggccagguc

SEQ ID NO: 1431766 - RNA, 14 nt, Pseudomonas aeruginosa PA01
gaaggccaggucgc

SEQ ID NO: 1431767 - RNA, 18 nt, Pseudomonas aeruginosa PA01
gaaggccaggucgcccac

SEQ ID NO: 1431768 - RNA, 20 nt, Pseudomonas aeruginosa PA01
gaaggccaggucgcccaccu

SEQ ID NO: 1431769 - RNA, 18 nt, Pseudomonas aeruginosa PA01
gaaggcaacagcccgcgc

SEQ ID NO: 1431770 - RNA, 19 nt, Pseudomonas aeruginosa PA01
gaaggcaacagcccgcgcc

SEQ ID NO: 1431771 - RNA, 14 nt, Pseudomonas aeruginosa PA01
gaagcuuccagcuu

SEQ ID NO: 1431772 - RNA, 14 nt, Pseudomonas aeruginosa PA01
gaaggaaaccggcc

SEQ ID NO: 1431773 - RNA, 16 nt, Pseudomonas aeruginosa PA01
gaaggaaaccggccag

SEQ ID NO: 1431774 - RNA, 19 nt, Pseudomonas aeruginosa PA01
gaaggaaaccggccagcgc

SEQ ID NO: 1431775 - RNA, 16 nt, Pseudomonas aeruginosa PA01
gaagcugucgcccucg

SEQ ID NO: 1431776 - RNA, 14 nt, Pseudomonas aeruginosa PA01
gaagcugucggccc

SEQ ID NO: 1431777 - RNA, 20 nt, Pseudomonas aeruginosa PA01
gaagcugucguaguccuggg

SEQ ID NO: 1431778 - RNA, 17 nt, Pseudomonas aeruginosa PA01
gaagcuuuuccagcgca

SEQ ID NO: 1431779 - RNA, 15 nt, Pseudomonas aeruginosa PA01
gaagccuucgcccag

SEQ ID NO: 1431780 - RNA, 14 nt, Pseudomonas aeruginosa PA01
gaagccuucgcccg

SEQ ID NO: 1431781 - RNA, 17 nt, Pseudomonas aeruginosa PA01
gaagccuucgcccggcu

SEQ ID NO: 1431782 - RNA, 19 nt, Pseudomonas aeruginosa PA01
gaagccgugcaacuggguu

SEQ ID NO: 1431783 - RNA, 23 nt, Pseudomonas aeruginosa PA01
gaagccguuguagaucggcagca

SEQ ID NO: 1431784 - RNA, 16 nt, Pseudomonas aeruginosa PA01
gaagcgaaccaggcaa

SEQ ID NO: 1431785 - RNA, 17 nt, Pseudomonas aeruginosa PA01
gaagcgaaccaggcaau

SEQ ID NO: 1431786 - RNA, 20 nt, Pseudomonas aeruginosa PA01
gaagcgaucuccugccgcgg

SEQ ID NO: 1431787 - RNA, 21 nt, Pseudomonas aeruginosa PA01
gaagcgaucuccugccgcggc

SEQ ID NO: 1431788 - RNA, 13 nt, Pseudomonas aeruginosa PA01
gaagcgcagccau

SEQ ID NO: 1431789 - RNA, 14 nt, Pseudomonas aeruginosa PA01
gaagcgcagcuccg

SEQ ID NO: 1431790 - RNA, 15 nt, Pseudomonas aeruginosa PA01
gaagcgcaggccgcc

SEQ ID NO: 1431791 - RNA, 16 nt, Pseudomonas aeruginosa PA01
gaagcgcaggccgccg

SEQ ID NO: 1431792 - RNA, 13 nt, Pseudomonas aeruginosa PA01
gaagcgcaggcgg

SEQ ID NO: 1431793 - RNA, 14 nt, Pseudomonas aeruginosa PA01
gaagcgcaggcggc

SEQ ID NO: 1431794 - RNA, 15 nt, Pseudomonas aeruginosa PA01
gaagcgcaggcggcu

SEQ ID NO: 1431795 - RNA, 16 nt, Pseudomonas aeruginosa PA01
gaagcgcaggcggcug

SEQ ID NO: 1431796 - RNA, 23 nt, Pseudomonas aeruginosa PA01
gaagcgcaggugcaccgcgcugg

SEQ ID NO: 1431797 - RNA, 22 nt, Pseudomonas aeruginosa PA01
gaagcgcaguacccggccgccu

SEQ ID NO: 1431798 - RNA, 23 nt, Pseudomonas aeruginosa PA01
gaagcgcaguacccggccgccuu

SEQ ID NO: 1431799 - RNA, 18 nt, Pseudomonas aeruginosa PA01
gaagcgcagcacgaugca

SEQ ID NO: 1431800 - RNA, 15 nt, Pseudomonas aeruginosa PA01
gaagcggaagccggg

SEQ ID NO: 1431801 - RNA, 23 nt, Pseudomonas aeruginosa PA01
gaagcggaucucgucgccgaccc

SEQ ID NO: 1431802 - RNA, 20 nt, Pseudomonas aeruginosa PA01
gaagcggcaauguccgagca

SEQ ID NO: 1431803 - RNA, 23 nt, Pseudomonas aeruginosa PA01
gaagcggcccuugucgccgcugg

SEQ ID NO: 1431804 - RNA, 14 nt, Pseudomonas aeruginosa PA01
gaagcggccgacca

SEQ ID NO: 1431805 - RNA, 18 nt, Pseudomonas aeruginosa PA01
gaagcggccgaccaggcc

SEQ ID NO: 1431806 - RNA, 21 nt, Pseudomonas aeruginosa PA01
gaagcggccgagcaccacgcg

SEQ ID NO: 1431807 - RNA, 24 nt, Pseudomonas aeruginosa PA01
gaagcggccgagcaccacgcgcaa

SEQ ID NO: 1431808 - RNA, 19 nt, Pseudomonas aeruginosa PA01
gaagcggcuggccgcggug

SEQ ID NO: 1431809 - RNA, 18 nt, Pseudomonas aeruginosa PA01
gaagcgcugcucgaccac

SEQ ID NO: 1431810 - RNA, 22 nt, Pseudomonas aeruginosa PA01
gaagcgcugcucgaccaccucg

SEQ ID NO: 1431811 - RNA, 17 nt, Pseudomonas aeruginosa PA01
gaagcgcugcugggcgg

SEQ ID NO: 1431812 - RNA, 16 nt, Pseudomonas aeruginosa PA01
gaagcgcuucugcagg

SEQ ID NO: 1431813 - RNA, 18 nt, Pseudomonas aeruginosa PA01
gaagcgcuucugcaggcc

SEQ ID NO: 1431814 - RNA, 17 nt, Pseudomonas aeruginosa PA01
gaagcgcuugcccaggu

SEQ ID NO: 1431815 - RNA, 15 nt, Pseudomonas aeruginosa PA01
gaagcgcgcgccagu

SEQ ID NO: 1431816 - RNA, 20 nt, Pseudomonas aeruginosa PA01
gaagcgcucccagaccucga

SEQ ID NO: 1431817 - RNA, 19 nt, Pseudomonas aeruginosa PA01
gaagcgcucgcgcuuccgg

SEQ ID NO: 1431818 - RNA, 15 nt, Pseudomonas aeruginosa PA01
gaagcgcgccugcuc

SEQ ID NO: 1431819 - RNA, 13 nt, Pseudomonas aeruginosa PA01
gaagcgccgcggc

SEQ ID NO: 1431820 - RNA, 12 nt, Pseudomonas aeruginosa PA01
gaagcgccggcg

SEQ ID NO: 1431821 - RNA, 14 nt, Pseudomonas aeruginosa PA01
gaagcgccggcggc

SEQ ID NO: 1431822 - RNA, 15 nt, Pseudomonas aeruginosa PA01
gaagcgccggcggcc

SEQ ID NO: 1431823 - RNA, 17 nt, Pseudomonas aeruginosa PA01
gaagcgccggcggccug

SEQ ID NO: 1431824 - RNA, 13 nt, Pseudomonas aeruginosa PA01
gaagcgccgggcc

SEQ ID NO: 1431825 - RNA, 18 nt, Pseudomonas aeruginosa PA01
gaagcgccgggccgcauc

SEQ ID NO: 1431826 - RNA, 20 nt, Pseudomonas aeruginosa PA01
gaagcgccucgccuucgucc

SEQ ID NO: 1431827 - RNA, 18 nt, Pseudomonas aeruginosa PA01
gaaggcuuccggcuccag

SEQ ID NO: 1431828 - RNA, 22 nt, Pseudomonas aeruginosa PA01
gaaggcuuccuggaagcgaugg

SEQ ID NO: 1431829 - RNA, 18 nt, Pseudomonas aeruginosa PA01
gaaggcuuccugguggaa

SEQ ID NO: 1431830 - RNA, 23 nt, Pseudomonas aeruginosa PA01
gaaggcuuccugguggaacagcc

SEQ ID NO: 1431831 - RNA, 16 nt, Pseudomonas aeruginosa PA01
gaaggcuugccacugc

SEQ ID NO: 1431832 - RNA, 22 nt, Pseudomonas aeruginosa PA01
gaaggcuugccacugcgcgcca

SEQ ID NO: 1431833 - RNA, 13 nt, Pseudomonas aeruginosa PA01
gaaggcuuguccu

SEQ ID NO: 1431834 - RNA, 16 nt, Pseudomonas aeruginosa PA01
gaaggcuggagcgcug

SEQ ID NO: 1431835 - RNA, 17 nt, Pseudomonas aeruginosa PA01
gaaggcuggagcgcugc

SEQ ID NO: 1431836 - RNA, 16 nt, Pseudomonas aeruginosa PA01
gaaggcggucagcagu

SEQ ID NO: 1431837 - RNA, 22 nt, Pseudomonas aeruginosa PA01
gaaggcggucagcaguugccgg

SEQ ID NO: 1431838 - RNA, 21 nt, Pseudomonas aeruginosa PA01
gaaggcgguguagaccaccag

SEQ ID NO: 1431839 - RNA, 16 nt, Pseudomonas aeruginosa PA01
gaaggcgucauccgcc

SEQ ID NO: 1431840 - RNA, 16 nt, Pseudomonas aeruginosa PA01
gaaggcguccaccggc

SEQ ID NO: 1431841 - RNA, 15 nt, Pseudomonas aeruginosa PA01
gaaggcgucgccguc

SEQ ID NO: 1431842 - RNA, 17 nt, Pseudomonas aeruginosa PA01
gaaggcgugggcgccgg

SEQ ID NO: 1431843 - RNA, 15 nt, Pseudomonas aeruginosa PA01
gaaggcgugccgcug

SEQ ID NO: 1431844 - RNA, 16 nt, Pseudomonas aeruginosa PA01
gaaggcgugccgcugg

SEQ ID NO: 1431845 - RNA, 17 nt, Pseudomonas aeruginosa PA01
gaaggcgugccgcuggc

SEQ ID NO: 1431846 - RNA, 23 nt, Pseudomonas aeruginosa PA01
gaaggucagcacgccuuccagau

SEQ ID NO: 1431847 - RNA, 22 nt, Pseudomonas aeruginosa PA01
gaaggucagguagguggaggcc

SEQ ID NO: 1431848 - RNA, 16 nt, Pseudomonas aeruginosa PA01
gaaggggagccgaggc

SEQ ID NO: 1431849 - RNA, 15 nt, Pseudomonas aeruginosa PA01
gaagggaaacaccag

SEQ ID NO: 1431850 - RNA, 23 nt, Pseudomonas aeruginosa PA01
gaagggaacccgcggcgcgccuu

SEQ ID NO: 1431851 - RNA, 18 nt, Pseudomonas aeruginosa PA01
gaagggcucagcccaggc

SEQ ID NO: 1431852 - RNA, 17 nt, Pseudomonas aeruginosa PA01
gaagggcaggccgauca

SEQ ID NO: 1431853 - RNA, 14 nt, Pseudomonas aeruginosa PA01
gaagggccgcaggu

SEQ ID NO: 1431854 - RNA, 19 nt, Pseudomonas aeruginosa PA01
gaaggcgaaccacaccagg

SEQ ID NO: 1431855 - RNA, 20 nt, Pseudomonas aeruginosa PA01
gaaggcgaaccacaccaggu

SEQ ID NO: 1431856 - RNA, 20 nt, Pseudomonas aeruginosa PA01
gaaggccucggucaggcgcu

SEQ ID NO: 1431857 - RNA, 22 nt, Pseudomonas aeruginosa PA01
gaaggccucggucaggcgcugg

SEQ ID NO: 1431858 - RNA, 23 nt, Pseudomonas aeruginosa PA01
gaaggccucgguggcccacucca

SEQ ID NO: 1431859 - RNA, 18 nt, Pseudomonas aeruginosa PA01
gaaggccugcgcuuccgg

SEQ ID NO: 1431860 - RNA, 21 nt, Pseudomonas aeruginosa PA01
gaaggccugcgcuuccggcag

SEQ ID NO: 1431861 - RNA, 17 nt, Pseudomonas aeruginosa PA01
gaaggccuggaacacca

SEQ ID NO: 1431862 - RNA, 20 nt, Pseudomonas aeruginosa PA01
gaaggccuggaacaccaggc

SEQ ID NO: 1431863 - RNA, 14 nt, Pseudomonas aeruginosa PA01
gaaggccuggccgu

SEQ ID NO: 1431864 - RNA, 23 nt, Pseudomonas aeruginosa PA01
gaaggccuggucgaaagccugcc

SEQ ID NO: 1431865 - RNA, 19 nt, Pseudomonas aeruginosa PA01
gaaggccccuuucacaugc

SEQ ID NO: 1431866 - RNA, 17 nt, Pseudomonas aeruginosa PA01
gaaggccgcggucgggc

SEQ ID NO: 1431867 - RNA, 23 nt, Pseudomonas aeruginosa PA01
gaaggccgcuuggccauggcgcu

SEQ ID NO: 1431868 - RNA, 15 nt, Pseudomonas aeruginosa PA01
gaaggcgcuggcgcu

SEQ ID NO: 1431869 - RNA, 18 nt, Pseudomonas aeruginosa PA01
gaaggcgcugggcggcug

SEQ ID NO: 1431870 - RNA, 11 nt, Pseudomonas aeruginosa PA01
gaaggcgcuuu

SEQ ID NO: 1431871 - RNA, 18 nt, Pseudomonas aeruginosa PA01
gaaggcggauggcguuug

SEQ ID NO: 1431872 - RNA, 18 nt, Pseudomonas aeruginosa PA01
gaaggcgggcagccuggc

SEQ ID NO: 1431873 - RNA, 24 nt, Pseudomonas aeruginosa PA01
gaaggcggcgucgucgcugcgcgg

SEQ ID NO: 1431874 - RNA, 15 nt, Pseudomonas aeruginosa PA01
gaaggcgaucaucgc

SEQ ID NO: 1431875 - RNA, 19 nt, Pseudomonas aeruginosa PA01
gaaggcgaucaucgccacc

SEQ ID NO: 1431876 - RNA, 23 nt, Pseudomonas aeruginosa PA01
gaaggcgagggugaacuggccgu

SEQ ID NO: 1431877 - RNA, 15 nt, Pseudomonas aeruginosa PA01
gaaggcgcggggcga

SEQ ID NO: 1431878 - RNA, 22 nt, Pseudomonas aeruginosa PA01
gaaggcgcggggcgaggucggc

SEQ ID NO: 1431879 - RNA, 13 nt, Pseudomonas aeruginosa PA01
gaaggcgcuccgg

SEQ ID NO: 1431880 - RNA, 15 nt, Pseudomonas aeruginosa PA01
gaaggcgccuuccag

SEQ ID NO: 1431881 - RNA, 16 nt, Pseudomonas aeruginosa PA01
gaaggcgcgcaccagc

SEQ ID NO: 1431882 - RNA, 23 nt, Pseudomonas aeruginosa PA01
gaaguaucggcguuuagcgcccg

SEQ ID NO: 1431883 - RNA, 15 nt, Pseudomonas aeruginosa PA01
gaaguaggccuggcc

SEQ ID NO: 1431884 - RNA, 13 nt, Pseudomonas aeruginosa PA01
gaaguagccgccg

SEQ ID NO: 1431885 - RNA, 14 nt, Pseudomonas aeruginosa PA01
gaaguagccggcgu

SEQ ID NO: 1431886 - RNA, 14 nt, Pseudomonas aeruginosa PA01
gaaguccaccaggc

SEQ ID NO: 1431887 - RNA, 18 nt, Pseudomonas aeruginosa PA01
gaaguccaccaggcgccg

SEQ ID NO: 1431888 - RNA, 17 nt, Pseudomonas aeruginosa PA01
gaaguccuggccgagca

SEQ ID NO: 1431889 - RNA, 16 nt, Pseudomonas aeruginosa PA01
gaagucgcccgccggc

SEQ ID NO: 1431890 - RNA, 17 nt, Pseudomonas aeruginosa PA01
gaagucgcccgccggcg

SEQ ID NO: 1431891 - RNA, 18 nt, Pseudomonas aeruginosa PA01
gaagucgcccgccggcgu

SEQ ID NO: 1431892 - RNA, 13 nt, Pseudomonas aeruginosa PA01
gaagucgccgucg

SEQ ID NO: 1431893 - RNA, 19 nt, Pseudomonas aeruginosa PA01
gaaguccugcaacagggca

SEQ ID NO: 1431894 - RNA, 13 nt, Pseudomonas aeruginosa PA01
gaaguagaagcgc

SEQ ID NO: 1431895 - RNA, 16 nt, Pseudomonas aeruginosa PA01
gaagguugucgaagcg

SEQ ID NO: 1431896 - RNA, 13 nt, Pseudomonas aeruginosa PA01
gaagguggcgacc

SEQ ID NO: 1431897 - RNA, 14 nt, Pseudomonas aeruginosa PA01
gaaggugccuucgu

SEQ ID NO: 1431898 - RNA, 17 nt, Pseudomonas aeruginosa PA01
gaaggugcaggccgcgc

SEQ ID NO: 1431899 - RNA, 18 nt, Pseudomonas aeruginosa PA01
gaaggugcccagcggcgc

SEQ ID NO: 1431900 - RNA, 16 nt, Pseudomonas aeruginosa PA01
gaaggugaagcugccg

SEQ ID NO: 1431901 - RNA, 14 nt, Pseudomonas aeruginosa PA01
gaaggucggcagca

SEQ ID NO: 1431902 - RNA, 23 nt, Pseudomonas aeruginosa PA01
gaagguccgcgccaugccggcgc

SEQ ID NO: 1431903 - RNA, 14 nt, Pseudomonas aeruginosa PA01
gaaggucgccgcgc

SEQ ID NO: 1431904 - RNA, 15 nt, Pseudomonas aeruginosa PA01
gaaggucgccgcgcu

SEQ ID NO: 1431905 - RNA, 15 nt, Pseudomonas aeruginosa PA01
gaaggucgccguccu

SEQ ID NO: 1431906 - RNA, 16 nt, Pseudomonas aeruginosa PA01
gaaggucgccguccug

SEQ ID NO: 1431907 - RNA, 18 nt, Pseudomonas aeruginosa PA01
gaaucccuuggcugcucg

SEQ ID NO: 1431908 - RNA, 21 nt, Pseudomonas aeruginosa PA01
gaaucgccuaccagaccgcag

SEQ ID NO: 1431909 - RNA, 22 nt, Pseudomonas aeruginosa PA01
gaaucgucgccggaggggcggc

SEQ ID NO: 1431910 - RNA, 14 nt, Pseudomonas aeruginosa PA01
gaaucgucacggcg

SEQ ID NO: 1431911 - RNA, 14 nt, Pseudomonas aeruginosa PA01
gaaucggacgaucg

SEQ ID NO: 1431912 - RNA, 22 nt, Pseudomonas aeruginosa PA01
gaaucggacagguuggcgccgg

SEQ ID NO: 1431913 - RNA, 17 nt, Pseudomonas aeruginosa PA01
gaaugacgagccgcagg

SEQ ID NO: 1431914 - RNA, 15 nt, Pseudomonas aeruginosa PA01
gaaugaaaaagggau

SEQ ID NO: 1431915 - RNA, 20 nt, Pseudomonas aeruginosa PA01
gaauggcauucagcucgauc

SEQ ID NO: 1431916 - RNA, 20 nt, Pseudomonas aeruginosa PA01
gaaugcccgugcgcugcguu

SEQ ID NO: 1431917 - RNA, 16 nt, Pseudomonas aeruginosa PA01
gaaugcccggcagcgc

SEQ ID NO: 1431918 - RNA, 18 nt, Pseudomonas aeruginosa PA01
gaaugcccggcagcgccg

SEQ ID NO: 1431919 - RNA, 19 nt, Pseudomonas aeruginosa PA01
gaaucacgucgaucugcuc

SEQ ID NO: 1431920 - RNA, 14 nt, Pseudomonas aeruginosa PA01
gaagugcgccgguu

SEQ ID NO: 1431921 - RNA, 18 nt, Pseudomonas aeruginosa PA01
gaauaccacguggccggc

SEQ ID NO: 1431922 - RNA, 19 nt, Pseudomonas aeruginosa PA01
gaauaccacguggccggcg

SEQ ID NO: 1431923 - RNA, 15 nt, Pseudomonas aeruginosa PA01
gaauaccgcugcgcg

SEQ ID NO: 1431924 - RNA, 14 nt, Pseudomonas aeruginosa PA01
gaauaccggccugu

SEQ ID NO: 1431925 - RNA, 15 nt, Pseudomonas aeruginosa PA01
gaauaccggccuguc

SEQ ID NO: 1431926 - RNA, 20 nt, Pseudomonas aeruginosa PA01
gaagugauggaagagcgccg

SEQ ID NO: 1431927 - RNA, 19 nt, Pseudomonas aeruginosa PA01
gaagucguucccggccugg

SEQ ID NO: 1431928 - RNA, 23 nt, Pseudomonas aeruginosa PA01
gaagucguucccggccuggcgcg

SEQ ID NO: 1431929 - RNA, 16 nt, Pseudomonas aeruginosa PA01
gaagucguugaagcgg

SEQ ID NO: 1431930 - RNA, 18 nt, Pseudomonas aeruginosa PA01
gaagucguagucguagcg

SEQ ID NO: 1431931 - RNA, 16 nt, Pseudomonas aeruginosa PA01
gaagucguccagcagg

SEQ ID NO: 1431932 - RNA, 13 nt, Pseudomonas aeruginosa PA01
gaagucggcgagc

SEQ ID NO: 1431933 - RNA, 15 nt, Pseudomonas aeruginosa PA01
gaagucggcgcgcca

SEQ ID NO: 1431934 - RNA, 16 nt, Pseudomonas aeruginosa PA01
gaagucggcgcgccag

SEQ ID NO: 1431935 - RNA, 13 nt, Pseudomonas aeruginosa PA01
gaagucggcggcc

SEQ ID NO: 1431936 - RNA, 14 nt, Pseudomonas aeruginosa PA01
gaagucggcggccg

SEQ ID NO: 1431937 - RNA, 14 nt, Pseudomonas aeruginosa PA01
gaacggcaucucga

SEQ ID NO: 1431938 - RNA, 23 nt, Pseudomonas aeruginosa PA01
gaacggcaucuucaaucgcgcgu

SEQ ID NO: 1431939 - RNA, 16 nt, Pseudomonas aeruginosa PA01
gaacgcggcgagaacu

SEQ ID NO: 1431940 - RNA, 21 nt, Pseudomonas aeruginosa PA01
gaacucgaucagcgcggccac

SEQ ID NO: 1431941 - RNA, 21 nt, Pseudomonas aeruginosa PA01
gaacgggaaguaggccuggcc

SEQ ID NO: 1431942 - RNA, 23 nt, Pseudomonas aeruginosa PA01
gaacgggaaguaggccuggccgc

SEQ ID NO: 1431943 - RNA, 21 nt, Pseudomonas aeruginosa PA01
gaacgggacgccuggcguccc

SEQ ID NO: 1431944 - RNA, 14 nt, Pseudomonas aeruginosa PA01
gaacggcuggucgg

SEQ ID NO: 1431945 - RNA, 20 nt, Pseudomonas aeruginosa PA01
gaacggcucaauccggcugg

SEQ ID NO: 1431946 - RNA, 18 nt, Pseudomonas aeruginosa PA01
gaacggcucgcgaccgag

SEQ ID NO: 1431947 - RNA, 15 nt, Pseudomonas aeruginosa PA01
gaacugaccaccagg

SEQ ID NO: 1431948 - RNA, 17 nt, Pseudomonas aeruginosa PA01
gaacugggcgagcaucu

SEQ ID NO: 1431949 - RNA, 14 nt, Pseudomonas aeruginosa PA01
gaacucuggcggcg

SEQ ID NO: 1431950 - RNA, 15 nt, Pseudomonas aeruginosa PA01
gaacuggucgauccg

SEQ ID NO: 1431951 - RNA, 16 nt, Pseudomonas aeruginosa PA01
gaacuggucgauccgc

SEQ ID NO: 1431952 - RNA, 21 nt, Pseudomonas aeruginosa PA01
gaacuggucgauccgcgccug

SEQ ID NO: 1431953 - RNA, 22 nt, Pseudomonas aeruginosa PA01
gaacuggucgauccgcgccugc

SEQ ID NO: 1431954 - RNA, 23 nt, Pseudomonas aeruginosa PA01
gaacuggucgauccgcgccugcu

SEQ ID NO: 1431955 - RNA, 21 nt, Pseudomonas aeruginosa PA01
gaacuggucgcuccagcccca

SEQ ID NO: 1431956 - RNA, 11 nt, Pseudomonas aeruginosa PA01
gaacucgccgu

SEQ ID NO: 1431957 - RNA, 14 nt, Pseudomonas aeruginosa PA01
gaacucgcccggcu

SEQ ID NO: 1431958 - RNA, 20 nt, Pseudomonas aeruginosa PA01
gaacucggcgcugccggcca

SEQ ID NO: 1431959 - RNA, 16 nt, Pseudomonas aeruginosa PA01
gaacucguccggucgc

SEQ ID NO: 1431960 - RNA, 20 nt, Pseudomonas aeruginosa PA01
gaacucguccggucgcaccg

SEQ ID NO: 1431961 - RNA, 18 nt, Pseudomonas aeruginosa PA01
gaagaaggcguccagggc

SEQ ID NO: 1431962 - RNA, 12 nt, Pseudomonas aeruginosa PA01
gaagaagcugcc

SEQ ID NO: 1431963 - RNA, 17 nt, Pseudomonas aeruginosa PA01
gaagacccccugccgcc

SEQ ID NO: 1431964 - RNA, 20 nt, Pseudomonas aeruginosa PA01
gaagaccagcggagcgucgg

SEQ ID NO: 1431965 - RNA, 14 nt, Pseudomonas aeruginosa PA01
gaagacccugcaca

SEQ ID NO: 1431966 - RNA, 14 nt, Pseudomonas aeruginosa PA01
gaagacccggcguu

SEQ ID NO: 1431967 - RNA, 14 nt, Pseudomonas aeruginosa PA01
gaagaccggccggc

SEQ ID NO: 1431968 - RNA, 23 nt, Pseudomonas aeruginosa PA01
gaagaccuguugcagagcggcca

SEQ ID NO: 1431969 - RNA, 21 nt, Pseudomonas aeruginosa PA01
gaagaccuugaacucgcccgg

SEQ ID NO: 1431970 - RNA, 18 nt, Pseudomonas aeruginosa PA01
gaagacgccugucggcac

SEQ ID NO: 1431971 - RNA, 22 nt, Pseudomonas aeruginosa PA01
gaagacgaaguugagcaccggc

SEQ ID NO: 1431972 - RNA, 20 nt, Pseudomonas aeruginosa PA01
gaagacgaaguuggcggccg

SEQ ID NO: 1431973 - RNA, 16 nt, Pseudomonas aeruginosa PA01
gaagaacgccagccca

SEQ ID NO: 1431974 - RNA, 21 nt, Pseudomonas aeruginosa PA01
gaagaacuccaucucgcggcg

SEQ ID NO: 1431975 - RNA, 17 nt, Pseudomonas aeruginosa PA01
gaagaacucggcgcugc

SEQ ID NO: 1431976 - RNA, 20 nt, Pseudomonas aeruginosa PA01
gaagaacucggcgcugccgg

SEQ ID NO: 1431977 - RNA, 23 nt, Pseudomonas aeruginosa PA01
gaagaacucggcgcugccggcca

SEQ ID NO: 1431978 - RNA, 23 nt, Pseudomonas aeruginosa PA01
gaagaacagcgggucgcggcugg

SEQ ID NO: 1431979 - RNA, 16 nt, Pseudomonas aeruginosa PA01
gaagaacaucgccugc

SEQ ID NO: 1431980 - RNA, 15 nt, Pseudomonas aeruginosa PA01
gaacuucaggccggc

SEQ ID NO: 1431981 - RNA, 16 nt, Pseudomonas aeruginosa PA01
gaacuucaugaugcgc

SEQ ID NO: 1431982 - RNA, 15 nt, Pseudomonas aeruginosa PA01
gaacuuccgccgaau

SEQ ID NO: 1431983 - RNA, 13 nt, Pseudomonas aeruginosa PA01
gaacuugcgcacc

SEQ ID NO: 1431984 - RNA, 14 nt, Pseudomonas aeruginosa PA01
gaacuugcgcaccg

SEQ ID NO: 1431985 - RNA, 22 nt, Pseudomonas aeruginosa PA01
gaacuuggcgcgcagggcaucg

SEQ ID NO: 1431986 - RNA, 17 nt, Pseudomonas aeruginosa PA01
gaacuugucgccgcugg

SEQ ID NO: 1431987 - RNA, 20 nt, Pseudomonas aeruginosa PA01
gaacgaagcgcccucgcuga

SEQ ID NO: 1431988 - RNA, 18 nt, Pseudomonas aeruginosa PA01
gaacgaaaaaggcgcgcc

SEQ ID NO: 1431989 - RNA, 21 nt, Pseudomonas aeruginosa PA01
gaacgaaaaaggcgcgccggu

SEQ ID NO: 1431990 - RNA, 21 nt, Pseudomonas aeruginosa PA01
gaaccuguccgaacagggcga

SEQ ID NO: 1431991 - RNA, 23 nt, Pseudomonas aeruginosa PA01
gaaccuguccgaacagggcgaag

SEQ ID NO: 1431992 - RNA, 19 nt, Pseudomonas aeruginosa PA01
gaaccgcgucaugcucucg

SEQ ID NO: 1431993 - RNA, 21 nt, Pseudomonas aeruginosa PA01
gaaccggaaaagaagccgcgc

SEQ ID NO: 1431994 - RNA, 22 nt, Pseudomonas aeruginosa PA01
gaaccggaaaagaagccgcgca

SEQ ID NO: 1431995 - RNA, 23 nt, Pseudomonas aeruginosa PA01
gaaccggaaaagaagccgcgcaa

SEQ ID NO: 1431996 - RNA, 19 nt, Pseudomonas aeruginosa PA01
gaaccguggcggccgccgc

SEQ ID NO: 1431997 - RNA, 23 nt, Pseudomonas aeruginosa PA01
gaaccgugguucucggucgggcg

SEQ ID NO: 1431998 - RNA, 14 nt, Pseudomonas aeruginosa PA01
gaacaugccgaaga

SEQ ID NO: 1431999 - RNA, 17 nt, Pseudomonas aeruginosa PA01
gaaccacaccaggucgc

SEQ ID NO: 1432000 - RNA, 23 nt, Pseudomonas aeruginosa PA01
gaaccacaccaggucgccgcaca

SEQ ID NO: 1432001 - RNA, 14 nt, Pseudomonas aeruginosa PA01
gaaccgccagcagu

SEQ ID NO: 1432002 - RNA, 22 nt, Pseudomonas aeruginosa PA01
gaaccgcggcgcccucugccgg

SEQ ID NO: 1432003 - RNA, 12 nt, Pseudomonas aeruginosa PA01
gaaccgccagca

SEQ ID NO: 1432004 - RNA, 21 nt, Pseudomonas aeruginosa PA01
gaaccgcgagaccccggcggc

SEQ ID NO: 1432005 - RNA, 18 nt, Pseudomonas aeruginosa PA01
gaacgccgggcaacgcca

SEQ ID NO: 1432006 - RNA, 18 nt, Pseudomonas aeruginosa PA01
gaacgcgcggaccuucga

SEQ ID NO: 1432007 - RNA, 17 nt, Pseudomonas aeruginosa PA01
gaacgccaccagggccu

SEQ ID NO: 1432008 - RNA, 21 nt, Pseudomonas aeruginosa PA01
gaacgcaggggcaccggcgga

SEQ ID NO: 1432009 - RNA, 17 nt, Pseudomonas aeruginosa PA01
gaacgccgacaggccgg

SEQ ID NO: 1432010 - RNA, 18 nt, Pseudomonas aeruginosa PA01
gaacgccgacaggccggu

SEQ ID NO: 1432011 - RNA, 23 nt, Pseudomonas aeruginosa PA01
gaacgccgacccuagggucggcg

SEQ ID NO: 1432012 - RNA, 14 nt, Pseudomonas aeruginosa PA01
gaacgcccgcggca

SEQ ID NO: 1432013 - RNA, 16 nt, Pseudomonas aeruginosa PA01
gaacgcccgcggcagc

SEQ ID NO: 1432014 - RNA, 19 nt, Pseudomonas aeruginosa PA01
gaacgcccgcggcagcagc

SEQ ID NO: 1432015 - RNA, 13 nt, Pseudomonas aeruginosa PA01
gaacgccagccca

SEQ ID NO: 1432016 - RNA, 17 nt, Pseudomonas aeruginosa PA01
gaaauccggcuggcgcc

SEQ ID NO: 1432017 - RNA, 16 nt, Pseudomonas aeruginosa PA01
gaaauccgccgcgcac

SEQ ID NO: 1432018 - RNA, 17 nt, Pseudomonas aeruginosa PA01
gaaauccucgcgcaccg

SEQ ID NO: 1432019 - RNA, 19 nt, Pseudomonas aeruginosa PA01
gaaaucgccguugccuucg

SEQ ID NO: 1432020 - RNA, 13 nt, Pseudomonas aeruginosa PA01
gaaaucggagaag

SEQ ID NO: 1432021 - RNA, 16 nt, Pseudomonas aeruginosa PA01
gaaaucggcaggcugc

SEQ ID NO: 1432022 - RNA, 21 nt, Pseudomonas aeruginosa PA01
gaaaucggccacuccagcccc

SEQ ID NO: 1432023 - RNA, 17 nt, Pseudomonas aeruginosa PA01
gaaaugaaaaaggccgg

SEQ ID NO: 1432024 - RNA, 20 nt, Pseudomonas aeruginosa PA01
gaaaucgaugucgcggcgcu

SEQ ID NO: 1432025 - RNA, 21 nt, Pseudomonas aeruginosa PA01
gaacagcaccuuggccauggg

SEQ ID NO: 1432026 - RNA, 16 nt, Pseudomonas aeruginosa PA01
gaacaccgggccgccg

SEQ ID NO: 1432027 - RNA, 19 nt, Pseudomonas aeruginosa PA01
gaacaccgggccgccggcg

SEQ ID NO: 1432028 - RNA, 20 nt, Pseudomonas aeruginosa PA01
gaacacccagaagccgaccu

SEQ ID NO: 1432029 - RNA, 16 nt, Pseudomonas aeruginosa PA01
gaacaccggcgccgcc

SEQ ID NO: 1432030 - RNA, 19 nt, Pseudomonas aeruginosa PA01
gaacaccggcgccgccugg

SEQ ID NO: 1432031 - RNA, 20 nt, Pseudomonas aeruginosa PA01
gaacaccggcgccgccuggc

SEQ ID NO: 1432032 - RNA, 21 nt, Pseudomonas aeruginosa PA01
gaacagggcgagcagggcgcu

SEQ ID NO: 1432033 - RNA, 20 nt, Pseudomonas aeruginosa PA01
gaacaggucgacgccauggc

SEQ ID NO: 1432034 - RNA, 18 nt, Pseudomonas aeruginosa PA01
gaacagguucggcaggcc

SEQ ID NO: 1432035 - RNA, 23 nt, Pseudomonas aeruginosa PA01
gaacagguucggcuugacgaugc

SEQ ID NO: 1432036 - RNA, 20 nt, Pseudomonas aeruginosa PA01
gaacagguaguugaggucgg

SEQ ID NO: 1432037 - RNA, 23 nt, Pseudomonas aeruginosa PA01
gaacaguucggcgguggagcaga

SEQ ID NO: 1432038 - RNA, 17 nt, Pseudomonas aeruginosa PA01
gaacaucagcagcgcca

SEQ ID NO: 1432039 - RNA, 21 nt, Pseudomonas aeruginosa PA01
gaacaucauccacagcgugca

SEQ ID NO: 1432040 - RNA, 17 nt, Pseudomonas aeruginosa PA01
gaacaucgccagcgcca

SEQ ID NO: 1432041 - RNA, 23 nt, Pseudomonas aeruginosa PA01
gaacaggcugugcgccaggccgg

SEQ ID NO: 1432042 - RNA, 15 nt, Pseudomonas aeruginosa PA01
gaacagggcgaaggc

SEQ ID NO: 1432043 - RNA, 20 nt, Pseudomonas aeruginosa PA01
gaacaggcgauagccgacca

SEQ ID NO: 1432044 - RNA, 17 nt, Pseudomonas aeruginosa PA01
gaacaggcgcuucagcu

SEQ ID NO: 1432045 - RNA, 14 nt, Pseudomonas aeruginosa PA01
gaacaggcagcggg

SEQ ID NO: 1432046 - RNA, 21 nt, Pseudomonas aeruginosa PA01
gaacaggcagcgggccaggcg

SEQ ID NO: 1432047 - RNA, 21 nt, Pseudomonas aeruginosa PA01
gaacaggaucuccucggccaa

SEQ ID NO: 1432048 - RNA, 16 nt, Pseudomonas aeruginosa PA01
gaacaggaagcgcggg

SEQ ID NO: 1432049 - RNA, 20 nt, Pseudomonas aeruginosa PA01
gaacaggagccaucgcucca

SEQ ID NO: 1432050 - RNA, 17 nt, Pseudomonas aeruginosa PA01
gaacagcagggaggcgc

SEQ ID NO: 1432051 - RNA, 11 nt, Pseudomonas aeruginosa PA01
gaacagcauca

SEQ ID NO: 1432052 - RNA, 14 nt, Pseudomonas aeruginosa PA01
gaacagcagcggca

SEQ ID NO: 1432053 - RNA, 14 nt, Pseudomonas aeruginosa PA01
gaacagcagcucgc

SEQ ID NO: 1432054 - RNA, 18 nt, Pseudomonas aeruginosa PA01
gaacagcaacaccgcgca

SEQ ID NO: 1432055 - RNA, 20 nt, Pseudomonas aeruginosa PA01
gaacagcagcaagccgauga

SEQ ID NO: 1432056 - RNA, 17 nt, Pseudomonas aeruginosa PA01
gaacagcuugccgcugc

SEQ ID NO: 1432057 - RNA, 15 nt, Pseudomonas aeruginosa PA01
gaacagccgcagcgg

SEQ ID NO: 1432058 - RNA, 21 nt, Pseudomonas aeruginosa PA01
gaacagccgccccaccaccau

SEQ ID NO: 1432059 - RNA, 23 nt, Pseudomonas aeruginosa PA01
gaacagcucggucucgaucggcc

SEQ ID NO: 1432060 - RNA, 20 nt, Pseudomonas aeruginosa PA01
gaaaccuucgguggcgacca

SEQ ID NO: 1432061 - RNA, 19 nt, Pseudomonas aeruginosa PA01
gaaacgacaggcuggaggc

SEQ ID NO: 1432062 - RNA, 19 nt, Pseudomonas aeruginosa PA01
gaaacgaaaaagcccggcg

SEQ ID NO: 1432063 - RNA, 17 nt, Pseudomonas aeruginosa PA01
gaaaccguggucgccgc

SEQ ID NO: 1432064 - RNA, 18 nt, Pseudomonas aeruginosa PA01
gaaaccguggucgccgcu

SEQ ID NO: 1432065 - RNA, 19 nt, Pseudomonas aeruginosa PA01
gaaaccguggucgccgcuc

SEQ ID NO: 1432066 - RNA, 18 nt, Pseudomonas aeruginosa PA01
gaaacugcgcaggcuggu

SEQ ID NO: 1432067 - RNA, 15 nt, Pseudomonas aeruginosa PA01
gaaacuccagcaggu

SEQ ID NO: 1432068 - RNA, 15 nt, Pseudomonas aeruginosa PA01
cuuguguccgccgag

SEQ ID NO: 1432069 - RNA, 22 nt, Pseudomonas aeruginosa PA01
cuuguaguagcgcccgacgaaa

SEQ ID NO: 1432070 - RNA, 17 nt, Pseudomonas aeruginosa PA01
cuuguauaccagcggcu

SEQ ID NO: 1432071 - RNA, 23 nt, Pseudomonas aeruginosa PA01
cuuguauaccagcggcuggcuga

SEQ ID NO: 1432072 - RNA, 16 nt, Pseudomonas aeruginosa PA01
gaaaccggccagcgca

SEQ ID NO: 1432073 - RNA, 14 nt, Pseudomonas aeruginosa PA01
gaaaccggccucga

SEQ ID NO: 1432074 - RNA, 17 nt, Pseudomonas aeruginosa PA01
cuuguuuuccuggcccu

SEQ ID NO: 1432075 - RNA, 23 nt, Pseudomonas aeruginosa PA01
cuuguucgcggcgaugcgcaugc

SEQ ID NO: 1432076 - RNA, 16 nt, Pseudomonas aeruginosa PA01
cuuguucgggucgcgg

SEQ ID NO: 1432077 - RNA, 17 nt, Pseudomonas aeruginosa PA01
cuuguucaggguggcga

SEQ ID NO: 1432078 - RNA, 22 nt, Pseudomonas aeruginosa PA01
cuuguugacguucugcccgccg

SEQ ID NO: 1432079 - RNA, 16 nt, Pseudomonas aeruginosa PA01
gaaaggcgucguugcc

SEQ ID NO: 1432080 - RNA, 14 nt, Pseudomonas aeruginosa PA01
gaaaggccgcgccg

SEQ ID NO: 1432081 - RNA, 15 nt, Pseudomonas aeruginosa PA01
gaaaggccucggcga

SEQ ID NO: 1432082 - RNA, 19 nt, Pseudomonas aeruginosa PA01
gaaagcgguaccgggccag

SEQ ID NO: 1432083 - RNA, 22 nt, Pseudomonas aeruginosa PA01
gaaagcguucuucagcacuucg

SEQ ID NO: 1432084 - RNA, 16 nt, Pseudomonas aeruginosa PA01
gaaagcgucagcgcgc

SEQ ID NO: 1432085 - RNA, 17 nt, Pseudomonas aeruginosa PA01
gaaagggcggcagcacg

SEQ ID NO: 1432086 - RNA, 17 nt, Pseudomonas aeruginosa PA01
gaaaggcugcuucggca

SEQ ID NO: 1432087 - RNA, 22 nt, Pseudomonas aeruginosa PA01
gaaaggcugcuucggcagccuu

SEQ ID NO: 1432088 - RNA, 13 nt, Pseudomonas aeruginosa PA01
gaaagucggcgcg

SEQ ID NO: 1432089 - RNA, 17 nt, Pseudomonas aeruginosa PA01
gaaagccuggccggcga

SEQ ID NO: 1432090 - RNA, 16 nt, Pseudomonas aeruginosa PA01
gaaagccucgacgaca

SEQ ID NO: 1432091 - RNA, 16 nt, Pseudomonas aeruginosa PA01
gaaagccugccgggca

SEQ ID NO: 1432092 - RNA, 18 nt, Pseudomonas aeruginosa PA01
gaaagccccugccgcgga

SEQ ID NO: 1432093 - RNA, 13 nt, Pseudomonas aeruginosa PA01
gaaagcgacgccg

SEQ ID NO: 1432094 - RNA, 16 nt, Pseudomonas aeruginosa PA01
gaaagcgacgccgcga

SEQ ID NO: 1432095 - RNA, 22 nt, Pseudomonas aeruginosa PA01
gaaagcgacgccgcgauggcuc

SEQ ID NO: 1432096 - RNA, 20 nt, Pseudomonas aeruginosa PA01
gaaagcgauagccggggccg

SEQ ID NO: 1432097 - RNA, 17 nt, Pseudomonas aeruginosa PA01
gaaagcaguucgcccgg

SEQ ID NO: 1432098 - RNA, 15 nt, Pseudomonas aeruginosa PA01
gaaagccaugcccag

SEQ ID NO: 1432099 - RNA, 14 nt, Pseudomonas aeruginosa PA01
gaaagccgaagcgc

SEQ ID NO: 1432100 - RNA, 14 nt, Pseudomonas aeruginosa PA01
gaaagccgccgccg

SEQ ID NO: 1432101 - RNA, 18 nt, Pseudomonas aeruginosa PA01
gaaagcacugcggcgguc

SEQ ID NO: 1432102 - RNA, 19 nt, Pseudomonas aeruginosa PA01
gaaagaccggcgccccugc

SEQ ID NO: 1432103 - RNA, 14 nt, Pseudomonas aeruginosa PA01
gccaaacgccgucu

SEQ ID NO: 1432104 - RNA, 22 nt, Pseudomonas aeruginosa PA01
gccaaaccgggaaagucuguga

SEQ ID NO: 1432105 - RNA, 12 nt, Pseudomonas aeruginosa PA01
gccaaagccgca

SEQ ID NO: 1432106 - RNA, 15 nt, Pseudomonas aeruginosa PA01
gccaaccaccggcgc

SEQ ID NO: 1432107 - RNA, 22 nt, Pseudomonas aeruginosa PA01
gccaaccaugguuuccgccgga

SEQ ID NO: 1432108 - RNA, 12 nt, Pseudomonas aeruginosa PA01
gcauuuccucga

SEQ ID NO: 1432109 - RNA, 14 nt, Pseudomonas aeruginosa PA01
gcauuuccuggacg

SEQ ID NO: 1432110 - RNA, 14 nt, Pseudomonas aeruginosa PA01
gcauuggugcugcc

SEQ ID NO: 1432111 - RNA, 16 nt, Pseudomonas aeruginosa PA01
gcauuggugcugccga

SEQ ID NO: 1432112 - RNA, 14 nt, Pseudomonas aeruginosa PA01
gcauugucgggcgu

SEQ ID NO: 1432113 - RNA, 18 nt, Pseudomonas aeruginosa PA01
gcauucguccagccgccg

SEQ ID NO: 1432114 - RNA, 14 nt, Pseudomonas aeruginosa PA01
gcauucgccgggcu

SEQ ID NO: 1432115 - RNA, 22 nt, Pseudomonas aeruginosa PA01
gcauucucgcgacccuggccgc

SEQ ID NO: 1432116 - RNA, 16 nt, Pseudomonas aeruginosa PA01
gcauucgucgccgcug

SEQ ID NO: 1432117 - RNA, 21 nt, Pseudomonas aeruginosa PA01
gcauucuggaugcagccgggg

SEQ ID NO: 1432118 - RNA, 16 nt, Pseudomonas aeruginosa PA01
gcauugagcgccagca

SEQ ID NO: 1432119 - RNA, 17 nt, Pseudomonas aeruginosa PA01
gcauugagcgccagcag

SEQ ID NO: 1432120 - RNA, 14 nt, Pseudomonas aeruginosa PA01
gcauuggcacccug

SEQ ID NO: 1432121 - RNA, 16 nt, Pseudomonas aeruginosa PA01
gcauuggcacccugga

SEQ ID NO: 1432122 - RNA, 14 nt, Pseudomonas aeruginosa PA01
gcauuggccaggcc

SEQ ID NO: 1432123 - RNA, 16 nt, Pseudomonas aeruginosa PA01
gcauuggccaggcccc

SEQ ID NO: 1432124 - RNA, 22 nt, Pseudomonas aeruginosa PA01
gcauuggccaucagcgccgccu

SEQ ID NO: 1432125 - RNA, 23 nt, Pseudomonas aeruginosa PA01
gcauuggccaucagcgccgccuc

SEQ ID NO: 1432126 - RNA, 16 nt, Pseudomonas aeruginosa PA01
gccaaccgucgcccug

SEQ ID NO: 1432127 - RNA, 21 nt, Pseudomonas aeruginosa PA01
gccaaccgucgcccuggugca

SEQ ID NO: 1432128 - RNA, 14 nt, Pseudomonas aeruginosa PA01
gccaacgccaccgc

SEQ ID NO: 1432129 - RNA, 14 nt, Pseudomonas aeruginosa PA01
gccaaccgcgcucg

SEQ ID NO: 1432130 - RNA, 18 nt, Pseudomonas aeruginosa PA01
gccaaccgcgcucggcgg

SEQ ID NO: 1432131 - RNA, 14 nt, Pseudomonas aeruginosa PA01
gccaaccgggcagc

SEQ ID NO: 1432132 - RNA, 22 nt, Pseudomonas aeruginosa PA01
gccaacgguagcggaucagccg

SEQ ID NO: 1432133 - RNA, 14 nt, Pseudomonas aeruginosa PA01
gccaacgcgccguc

SEQ ID NO: 1432134 - RNA, 18 nt, Pseudomonas aeruginosa PA01
gccaaugcccggaccugg

SEQ ID NO: 1432135 - RNA, 22 nt, Pseudomonas aeruginosa PA01
gccacacauccaguguggcggc

SEQ ID NO: 1432136 - RNA, 20 nt, Pseudomonas aeruginosa PA01
gccacacggcuaucagguga

SEQ ID NO: 1432137 - RNA, 18 nt, Pseudomonas aeruginosa PA01
gccaaggcccugcugcag

SEQ ID NO: 1432138 - RNA, 13 nt, Pseudomonas aeruginosa PA01
gccaaggccgcca

SEQ ID NO: 1432139 - RNA, 16 nt, Pseudomonas aeruginosa PA01
gccaaggccgccaggc

SEQ ID NO: 1432140 - RNA, 21 nt, Pseudomonas aeruginosa PA01
gccaaggccgccaggccucgg

SEQ ID NO: 1432141 - RNA, 18 nt, Pseudomonas aeruginosa PA01
gccaaggaugcgccagcg

SEQ ID NO: 1432142 - RNA, 18 nt, Pseudomonas aeruginosa PA01
gccaagcuuguugcgcag

SEQ ID NO: 1432143 - RNA, 23 nt, Pseudomonas aeruginosa PA01
gccaagcuuguugcgcaggcgau

SEQ ID NO: 1432144 - RNA, 15 nt, Pseudomonas aeruginosa PA01
gccaagcuggcgauc

SEQ ID NO: 1432145 - RNA, 23 nt, Pseudomonas aeruginosa PA01
gccaagcuggcgaucgaccugcc

SEQ ID NO: 1432146 - RNA, 13 nt, Pseudomonas aeruginosa PA01
gccaauccgggcg

SEQ ID NO: 1432147 - RNA, 22 nt, Pseudomonas aeruginosa PA01
gcauggcgaccugguggcgccg

SEQ ID NO: 1432148 - RNA, 16 nt, Pseudomonas aeruginosa PA01
gcauggccgggccgau

SEQ ID NO: 1432149 - RNA, 21 nt, Pseudomonas aeruginosa PA01
gcauggcgaucuccgggagca

SEQ ID NO: 1432150 - RNA, 24 nt, Pseudomonas aeruginosa PA01
gcauggcgaagcucggccgcucga

SEQ ID NO: 1432151 - RNA, 12 nt, Pseudomonas aeruginosa PA01
gcauggcggcga

SEQ ID NO: 1432152 - RNA, 16 nt, Pseudomonas aeruginosa PA01
gcauggcggcgaccgc

SEQ ID NO: 1432153 - RNA, 18 nt, Pseudomonas aeruginosa PA01
gcaugcugcucggcauuc

SEQ ID NO: 1432154 - RNA, 16 nt, Pseudomonas aeruginosa PA01
gcaugcucggccaggu

SEQ ID NO: 1432155 - RNA, 18 nt, Pseudomonas aeruginosa PA01
gcaugcucggccagguau

SEQ ID NO: 1432156 - RNA, 21 nt, Pseudomonas aeruginosa PA01
gcaugcucacugcgagcacca

SEQ ID NO: 1432157 - RNA, 19 nt, Pseudomonas aeruginosa PA01
gcauggacaggucgacggc

SEQ ID NO: 1432158 - RNA, 15 nt, Pseudomonas aeruginosa PA01
gcaugguggaucgac

SEQ ID NO: 1432159 - RNA, 17 nt, Pseudomonas aeruginosa PA01
gcaugguccguucggcg

SEQ ID NO: 1432160 - RNA, 17 nt, Pseudomonas aeruginosa PA01
gcaugggucagcgccag

SEQ ID NO: 1432161 - RNA, 22 nt, Pseudomonas aeruginosa PA01
gcauggcuggcgcuaccgcgca

SEQ ID NO: 1432162 - RNA, 18 nt, Pseudomonas aeruginosa PA01
gcauggcuucgggaucgu

SEQ ID NO: 1432163 - RNA, 18 nt, Pseudomonas aeruginosa PA01
gcauggcuuuccaggcgc

SEQ ID NO: 1432164 - RNA, 18 nt, Pseudomonas aeruginosa PA01
gcaugggcauccugccgc

SEQ ID NO: 1432165 - RNA, 23 nt, Pseudomonas aeruginosa PA01
gcaugggauggcgcgguccgcgg

SEQ ID NO: 1432166 - RNA, 16 nt, Pseudomonas aeruginosa PA01
gcauuccagaaacggc

SEQ ID NO: 1432167 - RNA, 18 nt, Pseudomonas aeruginosa PA01
gcauuccagaaacggcug

SEQ ID NO: 1432168 - RNA, 21 nt, Pseudomonas aeruginosa PA01
gcauucgcagcggccccgagc

SEQ ID NO: 1432169 - RNA, 19 nt, Pseudomonas aeruginosa PA01
gcauucgacccgccgacca

SEQ ID NO: 1432170 - RNA, 15 nt, Pseudomonas aeruginosa PA01
gcauguucaugcgcu

SEQ ID NO: 1432171 - RNA, 17 nt, Pseudomonas aeruginosa PA01
gcauguucaugcgcugg

SEQ ID NO: 1432172 - RNA, 22 nt, Pseudomonas aeruginosa PA01
gcauguuggcgccuucggcgac

SEQ ID NO: 1432173 - RNA, 22 nt, Pseudomonas aeruginosa PA01
gcauuaccccgaccaggucgcu

SEQ ID NO: 1432174 - RNA, 17 nt, Pseudomonas aeruginosa PA01
gcaugguguccggcggc

SEQ ID NO: 1432175 - RNA, 19 nt, Pseudomonas aeruginosa PA01
gcaugguuaccucguugcg

SEQ ID NO: 1432176 - RNA, 20 nt, Pseudomonas aeruginosa PA01
gcauguaggggagcacggca

SEQ ID NO: 1432177 - RNA, 15 nt, Pseudomonas aeruginosa PA01
gcauguagcgcuccu

SEQ ID NO: 1432178 - RNA, 23 nt, Pseudomonas aeruginosa PA01
gcauguagcgcuccucgcgcugc

SEQ ID NO: 1432179 - RNA, 15 nt, Pseudomonas aeruginosa PA01
gcauguccucggcgc

SEQ ID NO: 1432180 - RNA, 18 nt, Pseudomonas aeruginosa PA01
gcauguccugcaggcuca

SEQ ID NO: 1432181 - RNA, 23 nt, Pseudomonas aeruginosa PA01
gcauguccugcaggcucagcacc

SEQ ID NO: 1432182 - RNA, 18 nt, Pseudomonas aeruginosa PA01
gcauguccaccgccgcca

SEQ ID NO: 1432183 - RNA, 19 nt, Pseudomonas aeruginosa PA01
gcauguccaccgccgccag

SEQ ID NO: 1432184 - RNA, 21 nt, Pseudomonas aeruginosa PA01
gcauguccaccgccgccagca

SEQ ID NO: 1432185 - RNA, 23 nt, Pseudomonas aeruginosa PA01
gcauguccaccgccgccagcaac

SEQ ID NO: 1432186 - RNA, 14 nt, Pseudomonas aeruginosa PA01
gcauguccagccag

SEQ ID NO: 1432187 - RNA, 16 nt, Pseudomonas aeruginosa PA01
gcauguccgcaggcag

SEQ ID NO: 1432188 - RNA, 15 nt, Pseudomonas aeruginosa PA01
gcaugugccaggccu

SEQ ID NO: 1432189 - RNA, 12 nt, Pseudomonas aeruginosa PA01
gcaugugggcga

SEQ ID NO: 1432190 - RNA, 15 nt, Pseudomonas aeruginosa PA01
gcaugucguccaggc

SEQ ID NO: 1432191 - RNA, 19 nt, Pseudomonas aeruginosa PA01
gcaugucgcugagcggcug

SEQ ID NO: 1432192 - RNA, 19 nt, Pseudomonas aeruginosa PA01
gcaugucgagauugucgcg

SEQ ID NO: 1432193 - RNA, 12 nt, Pseudomonas aeruginosa PA01
gcaugccgcucu

SEQ ID NO: 1432194 - RNA, 14 nt, Pseudomonas aeruginosa PA01
gcaugcccugccgg

SEQ ID NO: 1432195 - RNA, 16 nt, Pseudomonas aeruginosa PA01
gcaugcccugccggcg

SEQ ID NO: 1432196 - RNA, 23 nt, Pseudomonas aeruginosa PA01
gcaugccaucuuccugugcgagg

SEQ ID NO: 1432197 - RNA, 18 nt, Pseudomonas aeruginosa PA01
gcaugcccagcguggcca

SEQ ID NO: 1432198 - RNA, 20 nt, Pseudomonas aeruginosa PA01
gcaugcccagcguggccagc

SEQ ID NO: 1432199 - RNA, 13 nt, Pseudomonas aeruginosa PA01
gcaugcccaggcu

SEQ ID NO: 1432200 - RNA, 19 nt, Pseudomonas aeruginosa PA01
gcaugauuucguuggccca

SEQ ID NO: 1432201 - RNA, 14 nt, Pseudomonas aeruginosa PA01
gcaugaugcgcccg

SEQ ID NO: 1432202 - RNA, 18 nt, Pseudomonas aeruginosa PA01
gcaugcagguggcgcuca

SEQ ID NO: 1432203 - RNA, 21 nt, Pseudomonas aeruginosa PA01
gcaugccgugggcgccgccgg

SEQ ID NO: 1432204 - RNA, 14 nt, Pseudomonas aeruginosa PA01
gcaugcgcagcgcg

SEQ ID NO: 1432205 - RNA, 12 nt, Pseudomonas aeruginosa PA01
gcaugccggccg

SEQ ID NO: 1432206 - RNA, 18 nt, Pseudomonas aeruginosa PA01
gcaugccggccgucgcgc

SEQ ID NO: 1432207 - RNA, 20 nt, Pseudomonas aeruginosa PA01
gcaugccggggaaccacacc

SEQ ID NO: 1432208 - RNA, 13 nt, Pseudomonas aeruginosa PA01
gcaugcgggcgau

SEQ ID NO: 1432209 - RNA, 16 nt, Pseudomonas aeruginosa PA01
gcaugcggccccggcg

SEQ ID NO: 1432210 - RNA, 17 nt, Pseudomonas aeruginosa PA01
gcaugcggccccggcgc

SEQ ID NO: 1432211 - RNA, 16 nt, Pseudomonas aeruginosa PA01
gcaugaggccuggucc

SEQ ID NO: 1432212 - RNA, 15 nt, Pseudomonas aeruginosa PA01
gcaugaaggcgcuga

SEQ ID NO: 1432213 - RNA, 14 nt, Pseudomonas aeruginosa PA01
gcaugaccgagcau

SEQ ID NO: 1432214 - RNA, 14 nt, Pseudomonas aeruginosa PA01
gcaugaccgauggc

SEQ ID NO: 1432215 - RNA, 17 nt, Pseudomonas aeruginosa PA01
gcaugaccgauggcgcc

SEQ ID NO: 1432216 - RNA, 18 nt, Pseudomonas aeruginosa PA01
gcaugaccgauggcgccg

SEQ ID NO: 1432217 - RNA, 19 nt, Pseudomonas aeruginosa PA01
gcaugaccgauggcgccgc

SEQ ID NO: 1432218 - RNA, 21 nt, Pseudomonas aeruginosa PA01
gcaugaccgauggcgccgcga

SEQ ID NO: 1432219 - RNA, 18 nt, Pseudomonas aeruginosa PA01
gcaugaccuucagcaccu

SEQ ID NO: 1432220 - RNA, 22 nt, Pseudomonas aeruginosa PA01
gcaugaccuucagcaccugcgc

SEQ ID NO: 1432221 - RNA, 20 nt, Pseudomonas aeruginosa PA01
gcaugacgauaucggcgccg

SEQ ID NO: 1432222 - RNA, 21 nt, Pseudomonas aeruginosa PA01
gcaugacgauaucggcgccgg

SEQ ID NO: 1432223 - RNA, 23 nt, Pseudomonas aeruginosa PA01
gcaucugcucgaggauggcacgg

SEQ ID NO: 1432224 - RNA, 21 nt, Pseudomonas aeruginosa PA01
gcaucugcgacaugccgguuc

SEQ ID NO: 1432225 - RNA, 14 nt, Pseudomonas aeruginosa PA01
gcaucugcgccggg

SEQ ID NO: 1432226 - RNA, 14 nt, Pseudomonas aeruginosa PA01
gcaucuggugcgcg

SEQ ID NO: 1432227 - RNA, 16 nt, Pseudomonas aeruginosa PA01
gcaucuggcugcgcgc

SEQ ID NO: 1432228 - RNA, 12 nt, Pseudomonas aeruginosa PA01
gcaucuucugcg

SEQ ID NO: 1432229 - RNA, 17 nt, Pseudomonas aeruginosa PA01
gcaucuugcccagccga

SEQ ID NO: 1432230 - RNA, 21 nt, Pseudomonas aeruginosa PA01
gcaugaagcuuuuccagcgca

SEQ ID NO: 1432231 - RNA, 18 nt, Pseudomonas aeruginosa PA01
gcaugaaaaagcccggcc

SEQ ID NO: 1432232 - RNA, 13 nt, Pseudomonas aeruginosa PA01
gcaguuccaggcg

SEQ ID NO: 1432233 - RNA, 17 nt, Pseudomonas aeruginosa PA01
gcaguuccaggcgugcu

SEQ ID NO: 1432234 - RNA, 18 nt, Pseudomonas aeruginosa PA01
gcaguucccccagcaccu

SEQ ID NO: 1432235 - RNA, 17 nt, Pseudomonas aeruginosa PA01
gcaguucgcgggccgcg

SEQ ID NO: 1432236 - RNA, 13 nt, Pseudomonas aeruginosa PA01
gcaguucgcgggu

SEQ ID NO: 1432237 - RNA, 13 nt, Pseudomonas aeruginosa PA01
gcaguucgcccgg

SEQ ID NO: 1432238 - RNA, 12 nt, Pseudomonas aeruginosa PA01
gcaguucgucgc

SEQ ID NO: 1432239 - RNA, 23 nt, Pseudomonas aeruginosa PA01
gcaguucgucgccacgcccgccg

SEQ ID NO: 1432240 - RNA, 15 nt, Pseudomonas aeruginosa PA01
gcaguugcgggcgca

SEQ ID NO: 1432241 - RNA, 14 nt, Pseudomonas aeruginosa PA01
gcaguugcaacagc

SEQ ID NO: 1432242 - RNA, 21 nt, Pseudomonas aeruginosa PA01
gcaguugcaacagcgcggcgg

SEQ ID NO: 1432243 - RNA, 19 nt, Pseudomonas aeruginosa PA01
gcaguugcaguaccugcuc

SEQ ID NO: 1432244 - RNA, 12 nt, Pseudomonas aeruginosa PA01
gcauaaccgcuc

SEQ ID NO: 1432245 - RNA, 16 nt, Pseudomonas aeruginosa PA01
gcauaaccgcucgcgg

SEQ ID NO: 1432246 - RNA, 17 nt, Pseudomonas aeruginosa PA01
gcauaaccgcuugcggu

SEQ ID NO: 1432247 - RNA, 14 nt, Pseudomonas aeruginosa PA01
gcagugcggggcgc

SEQ ID NO: 1432248 - RNA, 17 nt, Pseudomonas aeruginosa PA01
gcagugcgcccucgaac

SEQ ID NO: 1432249 - RNA, 24 nt, Pseudomonas aeruginosa PA01
gcagugcgccgcagcgcaagucgg

SEQ ID NO: 1432250 - RNA, 14 nt, Pseudomonas aeruginosa PA01
gcagugcgccggca

SEQ ID NO: 1432251 - RNA, 15 nt, Pseudomonas aeruginosa PA01
gcaguggcgccagcc

SEQ ID NO: 1432252 - RNA, 23 nt, Pseudomonas aeruginosa PA01
gcaguggcgccagccagcccggc

SEQ ID NO: 1432253 - RNA, 15 nt, Pseudomonas aeruginosa PA01
gcagugugcaccgag

SEQ ID NO: 1432254 - RNA, 16 nt, Pseudomonas aeruginosa PA01
gcagugugccgcccug

SEQ ID NO: 1432255 - RNA, 12 nt, Pseudomonas aeruginosa PA01
gcagcgccuccc

SEQ ID NO: 1432256 - RNA, 13 nt, Pseudomonas aeruginosa PA01
gcagcgccuccuc

SEQ ID NO: 1432257 - RNA, 22 nt, Pseudomonas aeruginosa PA01
gcagcgccuccucuaccaggcg

SEQ ID NO: 1432258 - RNA, 11 nt, Pseudomonas aeruginosa PA01
gcagcgccucg

SEQ ID NO: 1432259 - RNA, 16 nt, Pseudomonas aeruginosa PA01
gcagcgccucguggaa

SEQ ID NO: 1432260 - RNA, 23 nt, Pseudomonas aeruginosa PA01
gcagcgccucggcaucgaccagg

SEQ ID NO: 1432261 - RNA, 14 nt, Pseudomonas aeruginosa PA01
gcagcgccuguucc

SEQ ID NO: 1432262 - RNA, 15 nt, Pseudomonas aeruginosa PA01
gcagcgccuguucca

SEQ ID NO: 1432263 - RNA, 23 nt, Pseudomonas aeruginosa PA01
gcagcgccuguuccagggccugc

SEQ ID NO: 1432264 - RNA, 21 nt, Pseudomonas aeruginosa PA01
gcagcgccuucaccguuccca

SEQ ID NO: 1432265 - RNA, 14 nt, Pseudomonas aeruginosa PA01
gcagcgccuuuucg

SEQ ID NO: 1432266 - RNA, 19 nt, Pseudomonas aeruginosa PA01
gcauacgcucuaucgacgg

SEQ ID NO: 1432267 - RNA, 19 nt, Pseudomonas aeruginosa PA01
gcauacgaaaacggcccuc

SEQ ID NO: 1432268 - RNA, 17 nt, Pseudomonas aeruginosa PA01
gcauacacaugcaggcu

SEQ ID NO: 1432269 - RNA, 20 nt, Pseudomonas aeruginosa PA01
gcauacacaugcaggcucga

SEQ ID NO: 1432270 - RNA, 16 nt, Pseudomonas aeruginosa PA01
gcauaggucaugccca

SEQ ID NO: 1432271 - RNA, 15 nt, Pseudomonas aeruginosa PA01
gcauaggccugggcg

SEQ ID NO: 1432272 - RNA, 16 nt, Pseudomonas aeruginosa PA01
gcauaggccugggcgu

SEQ ID NO: 1432273 - RNA, 19 nt, Pseudomonas aeruginosa PA01
gcauagcugaucucggcga

SEQ ID NO: 1432274 - RNA, 14 nt, Pseudomonas aeruginosa PA01
gcauaggcccggcg

SEQ ID NO: 1432275 - RNA, 22 nt, Pseudomonas aeruginosa PA01
gcauagcgcgcuguagccggcg

SEQ ID NO: 1432276 - RNA, 16 nt, Pseudomonas aeruginosa PA01
gcauagaugucgaagu

SEQ ID NO: 1432277 - RNA, 17 nt, Pseudomonas aeruginosa PA01
gcauagaugucgaaguc

SEQ ID NO: 1432278 - RNA, 16 nt, Pseudomonas aeruginosa PA01
gcauagccaccgccga

SEQ ID NO: 1432279 - RNA, 15 nt, Pseudomonas aeruginosa PA01
gcaucaccaggcugc

SEQ ID NO: 1432280 - RNA, 21 nt, Pseudomonas aeruginosa PA01
gcaucaccaggcugccgccgu

SEQ ID NO: 1432281 - RNA, 17 nt, Pseudomonas aeruginosa PA01
gcaucaccccgcaaccg

SEQ ID NO: 1432282 - RNA, 12 nt, Pseudomonas aeruginosa PA01
gcaucaccaccg

SEQ ID NO: 1432283 - RNA, 13 nt, Pseudomonas aeruginosa PA01
gcaucagccgcga

SEQ ID NO: 1432284 - RNA, 22 nt, Pseudomonas aeruginosa PA01
gcaucaccggcagcagcggauc

SEQ ID NO: 1432285 - RNA, 14 nt, Pseudomonas aeruginosa PA01
gcaucaccggcggg

SEQ ID NO: 1432286 - RNA, 23 nt, Pseudomonas aeruginosa PA01
gcaucaccggcgggauguacgcc

SEQ ID NO: 1432287 - RNA, 21 nt, Pseudomonas aeruginosa PA01
gcaucaccgcgguggaggcgg

SEQ ID NO: 1432288 - RNA, 23 nt, Pseudomonas aeruginosa PA01
gcaucaccuugcggaacccgcgc

SEQ ID NO: 1432289 - RNA, 19 nt, Pseudomonas aeruginosa PA01
gcauccguuugggaucggu

SEQ ID NO: 1432290 - RNA, 20 nt, Pseudomonas aeruginosa PA01
gcauccggcucgacgccgac

SEQ ID NO: 1432291 - RNA, 22 nt, Pseudomonas aeruginosa PA01
gcauccucguuccacgggucgc

SEQ ID NO: 1432292 - RNA, 13 nt, Pseudomonas aeruginosa PA01
gcauccugccgcc

SEQ ID NO: 1432293 - RNA, 18 nt, Pseudomonas aeruginosa PA01
gcauccuguggcugcagg

SEQ ID NO: 1432294 - RNA, 19 nt, Pseudomonas aeruginosa PA01
gcauccuguggcugcaggu

SEQ ID NO: 1432295 - RNA, 19 nt, Pseudomonas aeruginosa PA01
gcauccuuuuuccgaccuu

SEQ ID NO: 1432296 - RNA, 13 nt, Pseudomonas aeruginosa PA01
gcaucgaaggcgc

SEQ ID NO: 1432297 - RNA, 14 nt, Pseudomonas aeruginosa PA01
gcaucgaaggcgcc

SEQ ID NO: 1432298 - RNA, 14 nt, Pseudomonas aeruginosa PA01
gcaucgauccgcac

SEQ ID NO: 1432299 - RNA, 21 nt, Pseudomonas aeruginosa PA01
gcaucgauccgcacccgggca

SEQ ID NO: 1432300 - RNA, 21 nt, Pseudomonas aeruginosa PA01
gcaucgaugaccuucgaggug

SEQ ID NO: 1432301 - RNA, 15 nt, Pseudomonas aeruginosa PA01
gcaucgaggccgccc

SEQ ID NO: 1432302 - RNA, 20 nt, Pseudomonas aeruginosa PA01
gcaucgaggccgcccagcgc

SEQ ID NO: 1432303 - RNA, 21 nt, Pseudomonas aeruginosa PA01
gcaucgaggccgcccagcgca

SEQ ID NO: 1432304 - RNA, 23 nt, Pseudomonas aeruginosa PA01
gcaucgaggccgcccagcgcagc

SEQ ID NO: 1432305 - RNA, 15 nt, Pseudomonas aeruginosa PA01
gcaucgaggccggca

SEQ ID NO: 1432306 - RNA, 16 nt, Pseudomonas aeruginosa PA01
gcaucgaggccggcau

SEQ ID NO: 1432307 - RNA, 15 nt, Pseudomonas aeruginosa PA01
gcaucgacggggcgu

SEQ ID NO: 1432308 - RNA, 14 nt, Pseudomonas aeruginosa PA01
gcaucgacgccagc

SEQ ID NO: 1432309 - RNA, 19 nt, Pseudomonas aeruginosa PA01
gcaucgacgccagcggcga

SEQ ID NO: 1432310 - RNA, 23 nt, Pseudomonas aeruginosa PA01
gcaucgacgccagcggcgaucgc

SEQ ID NO: 1432311 - RNA, 15 nt, Pseudomonas aeruginosa PA01
gcaucgaccagcagc

SEQ ID NO: 1432312 - RNA, 13 nt, Pseudomonas aeruginosa PA01
gcauccgccgcag

SEQ ID NO: 1432313 - RNA, 14 nt, Pseudomonas aeruginosa PA01
gcauccgccgcaga

SEQ ID NO: 1432314 - RNA, 20 nt, Pseudomonas aeruginosa PA01
gcaucccuuuuucauucucc

SEQ ID NO: 1432315 - RNA, 22 nt, Pseudomonas aeruginosa PA01
gcaucaugccgagcaucagcga

SEQ ID NO: 1432316 - RNA, 15 nt, Pseudomonas aeruginosa PA01
gcauccacagggucg

SEQ ID NO: 1432317 - RNA, 20 nt, Pseudomonas aeruginosa PA01
gcauccacagggucggcagg

SEQ ID NO: 1432318 - RNA, 24 nt, Pseudomonas aeruginosa PA01
gcaucaguagcgggcauccagcgg

SEQ ID NO: 1432319 - RNA, 19 nt, Pseudomonas aeruginosa PA01
gcaucaggucggucuggcg

SEQ ID NO: 1432320 - RNA, 21 nt, Pseudomonas aeruginosa PA01
gcaucaggucggucuggcggc

SEQ ID NO: 1432321 - RNA, 12 nt, Pseudomonas aeruginosa PA01
gcaucaggcgcu

SEQ ID NO: 1432322 - RNA, 13 nt, Pseudomonas aeruginosa PA01
gcaucaggcgcuc

SEQ ID NO: 1432323 - RNA, 13 nt, Pseudomonas aeruginosa PA01
gcaucggcgccuc

SEQ ID NO: 1432324 - RNA, 21 nt, Pseudomonas aeruginosa PA01
gcaucggcgccucccaggguc

SEQ ID NO: 1432325 - RNA, 14 nt, Pseudomonas aeruginosa PA01
gcaucggcgcgccg

SEQ ID NO: 1432326 - RNA, 15 nt, Pseudomonas aeruginosa PA01
gcaucggcgcgccga

SEQ ID NO: 1432327 - RNA, 15 nt, Pseudomonas aeruginosa PA01
gcaucggcgcggccu

SEQ ID NO: 1432328 - RNA, 17 nt, Pseudomonas aeruginosa PA01
gcaucggcgcggccuuc

SEQ ID NO: 1432329 - RNA, 17 nt, Pseudomonas aeruginosa PA01
gcaucggcucggcaagc

SEQ ID NO: 1432330 - RNA, 15 nt, Pseudomonas aeruginosa PA01
gcaucggcgccgcgc

SEQ ID NO: 1432331 - RNA, 15 nt, Pseudomonas aeruginosa PA01
gcaucggugccggca

SEQ ID NO: 1432332 - RNA, 16 nt, Pseudomonas aeruginosa PA01
gcaucggugccggcag

SEQ ID NO: 1432333 - RNA, 17 nt, Pseudomonas aeruginosa PA01
gcaucggugccggcagg

SEQ ID NO: 1432334 - RNA, 18 nt, Pseudomonas aeruginosa PA01
gcaucggugccggcaggc

SEQ ID NO: 1432335 - RNA, 20 nt, Pseudomonas aeruginosa PA01
gcaucgucgaaacgcuggcg

SEQ ID NO: 1432336 - RNA, 15 nt, Pseudomonas aeruginosa PA01
gcaucucgccggcac

SEQ ID NO: 1432337 - RNA, 18 nt, Pseudomonas aeruginosa PA01
gcaucucuuccucgcugc

SEQ ID NO: 1432338 - RNA, 19 nt, Pseudomonas aeruginosa PA01
gcaucucggccaccugcuc

SEQ ID NO: 1432339 - RNA, 23 nt, Pseudomonas aeruginosa PA01
gcaucucggccaccugcuccggc

SEQ ID NO: 1432340 - RNA, 21 nt, Pseudomonas aeruginosa PA01
gcaucuccccaccaacucagu

SEQ ID NO: 1432341 - RNA, 13 nt, Pseudomonas aeruginosa PA01
gcaucgugccgcg

SEQ ID NO: 1432342 - RNA, 16 nt, Pseudomonas aeruginosa PA01
gcaucguuggcgccgu

SEQ ID NO: 1432343 - RNA, 17 nt, Pseudomonas aeruginosa PA01
gcaucgccauggcgcug

SEQ ID NO: 1432344 - RNA, 23 nt, Pseudomonas aeruginosa PA01
gcaucgccaccgcggauccacgc

SEQ ID NO: 1432345 - RNA, 18 nt, Pseudomonas aeruginosa PA01
gcaucgcaucggcgaccu

SEQ ID NO: 1432346 - RNA, 20 nt, Pseudomonas aeruginosa PA01
gcaucgcgaaaacucccggc

SEQ ID NO: 1432347 - RNA, 21 nt, Pseudomonas aeruginosa PA01
gcaucgcgaaaacucccggcc

SEQ ID NO: 1432348 - RNA, 17 nt, Pseudomonas aeruginosa PA01
gcaucgccgcccaguug

SEQ ID NO: 1432349 - RNA, 19 nt, Pseudomonas aeruginosa PA01
gcaucgccggcagcgccgc

SEQ ID NO: 1432350 - RNA, 22 nt, Pseudomonas aeruginosa PA01
gcaucgccggcagcgccgcgcg

SEQ ID NO: 1432351 - RNA, 23 nt, Pseudomonas aeruginosa PA01
gcaucggccgacagagcggccgg

SEQ ID NO: 1432352 - RNA, 13 nt, Pseudomonas aeruginosa PA01
gcaucggccgcca

SEQ ID NO: 1432353 - RNA, 16 nt, Pseudomonas aeruginosa PA01
gcaucggccgccaggc

SEQ ID NO: 1432354 - RNA, 13 nt, Pseudomonas aeruginosa PA01
gcaucggccggga

SEQ ID NO: 1432355 - RNA, 15 nt, Pseudomonas aeruginosa PA01
gcaucggagaccacg

SEQ ID NO: 1432356 - RNA, 20 nt, Pseudomonas aeruginosa PA01
gcaucggccaccuucgcccg

SEQ ID NO: 1432357 - RNA, 15 nt, Pseudomonas aeruginosa PA01
gcaucgcgacagggc

SEQ ID NO: 1432358 - RNA, 18 nt, Pseudomonas aeruginosa PA01
gcaucgcucgcaacgcug

SEQ ID NO: 1432359 - RNA, 16 nt, Pseudomonas aeruginosa PA01
gcaucgcgggcgugcu

SEQ ID NO: 1432360 - RNA, 20 nt, Pseudomonas aeruginosa PA01
gcaucgcgggcgugcuccag

SEQ ID NO: 1432361 - RNA, 22 nt, Pseudomonas aeruginosa PA01
gccagcggaacgaaggacaggu

SEQ ID NO: 1432362 - RNA, 18 nt, Pseudomonas aeruginosa PA01
gccagcgcuuccaccgcc

SEQ ID NO: 1432363 - RNA, 20 nt, Pseudomonas aeruginosa PA01
gccagcgcuucgcgaucggc

SEQ ID NO: 1432364 - RNA, 14 nt, Pseudomonas aeruginosa PA01
gccagcggcagcgg

SEQ ID NO: 1432365 - RNA, 14 nt, Pseudomonas aeruginosa PA01
gccagcgcgucggc

SEQ ID NO: 1432366 - RNA, 17 nt, Pseudomonas aeruginosa PA01
gccagcgcgucggcacg

SEQ ID NO: 1432367 - RNA, 21 nt, Pseudomonas aeruginosa PA01
gccagcgcgucggcacgccga

SEQ ID NO: 1432368 - RNA, 22 nt, Pseudomonas aeruginosa PA01
gccagcgcgucggcacgccgaa

SEQ ID NO: 1432369 - RNA, 15 nt, Pseudomonas aeruginosa PA01
gccagcgcggugcgc

SEQ ID NO: 1432370 - RNA, 19 nt, Pseudomonas aeruginosa PA01
gccagcgcggugcgcgcca

SEQ ID NO: 1432371 - RNA, 12 nt, Pseudomonas aeruginosa PA01
gccagcgcggcu

SEQ ID NO: 1432372 - RNA, 17 nt, Pseudomonas aeruginosa PA01
gccagcgcggcucgggc

SEQ ID NO: 1432373 - RNA, 20 nt, Pseudomonas aeruginosa PA01
gccagcgcggcucgggcggc

SEQ ID NO: 1432374 - RNA, 21 nt, Pseudomonas aeruginosa PA01
gccagcgcggcucgggcggca

SEQ ID NO: 1432375 - RNA, 14 nt, Pseudomonas aeruginosa PA01
gccagcgcaucgag

SEQ ID NO: 1432376 - RNA, 22 nt, Pseudomonas aeruginosa PA01
gccagcgcaccuacuaccgcug

SEQ ID NO: 1432377 - RNA, 15 nt, Pseudomonas aeruginosa PA01
gccagcgccaccagc

SEQ ID NO: 1432378 - RNA, 22 nt, Pseudomonas aeruginosa PA01
gccagcgccaccagcagggcca

SEQ ID NO: 1432379 - RNA, 17 nt, Pseudomonas aeruginosa PA01
gccagcgccacggcgau

SEQ ID NO: 1432380 - RNA, 16 nt, Pseudomonas aeruginosa PA01
gccagcgccaggagca

SEQ ID NO: 1432381 - RNA, 14 nt, Pseudomonas aeruginosa PA01
gccagcccggcggu

SEQ ID NO: 1432382 - RNA, 12 nt, Pseudomonas aeruginosa PA01
gccagcccggcg

SEQ ID NO: 1432383 - RNA, 16 nt, Pseudomonas aeruginosa PA01
gccagcccgccaccga

SEQ ID NO: 1432384 - RNA, 15 nt, Pseudomonas aeruginosa PA01
gccagcccgcaaucc

SEQ ID NO: 1432385 - RNA, 12 nt, Pseudomonas aeruginosa PA01
gccagcccgcca

SEQ ID NO: 1432386 - RNA, 15 nt, Pseudomonas aeruginosa PA01
gccagcccggagccg

SEQ ID NO: 1432387 - RNA, 14 nt, Pseudomonas aeruginosa PA01
gccagcccggcagg

SEQ ID NO: 1432388 - RNA, 17 nt, Pseudomonas aeruginosa PA01
gccagcccggcaggucg

SEQ ID NO: 1432389 - RNA, 20 nt, Pseudomonas aeruginosa PA01
gccagcccggcaggucgagg

SEQ ID NO: 1432390 - RNA, 14 nt, Pseudomonas aeruginosa PA01
gccagccgcuagcg

SEQ ID NO: 1432391 - RNA, 17 nt, Pseudomonas aeruginosa PA01
gccagcccgguucagcg

SEQ ID NO: 1432392 - RNA, 15 nt, Pseudomonas aeruginosa PA01
gccagccgcgcgccg

SEQ ID NO: 1432393 - RNA, 16 nt, Pseudomonas aeruginosa PA01
gccagccgcgcgccgc

SEQ ID NO: 1432394 - RNA, 17 nt, Pseudomonas aeruginosa PA01
gccagccgcgcgccgca

SEQ ID NO: 1432395 - RNA, 18 nt, Pseudomonas aeruginosa PA01
gccagccgcgcgccgcau

SEQ ID NO: 1432396 - RNA, 16 nt, Pseudomonas aeruginosa PA01
gccagccggccuugcu

SEQ ID NO: 1432397 - RNA, 13 nt, Pseudomonas aeruginosa PA01
gccagccggcgaa

SEQ ID NO: 1432398 - RNA, 14 nt, Pseudomonas aeruginosa PA01
gccagccggcgaag

SEQ ID NO: 1432399 - RNA, 17 nt, Pseudomonas aeruginosa PA01
gccagccggcgaagggc

SEQ ID NO: 1432400 - RNA, 14 nt, Pseudomonas aeruginosa PA01
gccagccggcgccg

SEQ ID NO: 1432401 - RNA, 15 nt, Pseudomonas aeruginosa PA01
gccagccggcgccgc

SEQ ID NO: 1432402 - RNA, 18 nt, Pseudomonas aeruginosa PA01
gccagccgcuuccggcgc

SEQ ID NO: 1432403 - RNA, 19 nt, Pseudomonas aeruginosa PA01
gccagccgcuuccggcgcu

SEQ ID NO: 1432404 - RNA, 16 nt, Pseudomonas aeruginosa PA01
gccagcccagaacagc

SEQ ID NO: 1432405 - RNA, 17 nt, Pseudomonas aeruginosa PA01
gccagcccagaacagca

SEQ ID NO: 1432406 - RNA, 15 nt, Pseudomonas aeruginosa PA01
gccagcccagcggcg

SEQ ID NO: 1432407 - RNA, 14 nt, Pseudomonas aeruginosa PA01
gccagcccagugcu

SEQ ID NO: 1432408 - RNA, 16 nt, Pseudomonas aeruginosa PA01
gccagcccagugcugg

SEQ ID NO: 1432409 - RNA, 19 nt, Pseudomonas aeruginosa PA01
gccagcccagugcuggcgu

SEQ ID NO: 1432410 - RNA, 22 nt, Pseudomonas aeruginosa PA01
gccagccaugugcuccuugacc

SEQ ID NO: 1432411 - RNA, 15 nt, Pseudomonas aeruginosa PA01
gccagccagggcagc

SEQ ID NO: 1432412 - RNA, 14 nt, Pseudomonas aeruginosa PA01
gccagccaggucgg

SEQ ID NO: 1432413 - RNA, 17 nt, Pseudomonas aeruginosa PA01
gccagcccccucgcccu

SEQ ID NO: 1432414 - RNA, 15 nt, Pseudomonas aeruginosa PA01
gccagccccaggccg

SEQ ID NO: 1432415 - RNA, 14 nt, Pseudomonas aeruginosa PA01
gccagccccaggcg

SEQ ID NO: 1432416 - RNA, 15 nt, Pseudomonas aeruginosa PA01
gccagccccaggcgc

SEQ ID NO: 1432417 - RNA, 17 nt, Pseudomonas aeruginosa PA01
gccagccccaggcgcgg

SEQ ID NO: 1432418 - RNA, 22 nt, Pseudomonas aeruginosa PA01
gccagccccaggcgcggcgucg

SEQ ID NO: 1432419 - RNA, 13 nt, Pseudomonas aeruginosa PA01
gccagccagagcc

SEQ ID NO: 1432420 - RNA, 14 nt, Pseudomonas aeruginosa PA01
gccagccagccgcg

SEQ ID NO: 1432421 - RNA, 15 nt, Pseudomonas aeruginosa PA01
gccagccagccgcgc

SEQ ID NO: 1432422 - RNA, 15 nt, Pseudomonas aeruginosa PA01
gccagcagcggcggc

SEQ ID NO: 1432423 - RNA, 17 nt, Pseudomonas aeruginosa PA01
gccagcagcggcggcgc

SEQ ID NO: 1432424 - RNA, 13 nt, Pseudomonas aeruginosa PA01
gccagcagcggcg

SEQ ID NO: 1432425 - RNA, 13 nt, Pseudomonas aeruginosa PA01
gccagcagcgcug

SEQ ID NO: 1432426 - RNA, 20 nt, Pseudomonas aeruginosa PA01
gccagcagggucucgcugcu

SEQ ID NO: 1432427 - RNA, 13 nt, Pseudomonas aeruginosa PA01
gccagcagguagc

SEQ ID NO: 1432428 - RNA, 14 nt, Pseudomonas aeruginosa PA01
gccagcagguagcc

SEQ ID NO: 1432429 - RNA, 22 nt, Pseudomonas aeruginosa PA01
gccagcagguagccugcggcca

SEQ ID NO: 1432430 - RNA, 19 nt, Pseudomonas aeruginosa PA01
gccagcaguugcaacagcg

SEQ ID NO: 1432431 - RNA, 20 nt, Pseudomonas aeruginosa PA01
gccagcaguugcaacagcgc

SEQ ID NO: 1432432 - RNA, 19 nt, Pseudomonas aeruginosa PA01
gccagcaguggcuccgcgc

SEQ ID NO: 1432433 - RNA, 12 nt, Pseudomonas aeruginosa PA01
gccagcaggugg

SEQ ID NO: 1432434 - RNA, 14 nt, Pseudomonas aeruginosa PA01
gccagcaggucgcg

SEQ ID NO: 1432435 - RNA, 16 nt, Pseudomonas aeruginosa PA01
gccagcaggucgcgcu

SEQ ID NO: 1432436 - RNA, 18 nt, Pseudomonas aeruginosa PA01
gccagcaggucgcgcugg

SEQ ID NO: 1432437 - RNA, 20 nt, Pseudomonas aeruginosa PA01
gccagcaggucgcgcugggc

SEQ ID NO: 1432438 - RNA, 22 nt, Pseudomonas aeruginosa PA01
gccagcaggucgcgcugggcga

SEQ ID NO: 1432439 - RNA, 14 nt, Pseudomonas aeruginosa PA01
gccagcaggucggc

SEQ ID NO: 1432440 - RNA, 22 nt, Pseudomonas aeruginosa PA01
gccagcaggucggccugcugcu

SEQ ID NO: 1432441 - RNA, 19 nt, Pseudomonas aeruginosa PA01
gccagcagcccggccugga

SEQ ID NO: 1432442 - RNA, 20 nt, Pseudomonas aeruginosa PA01
gccagcagcccggccuggau

SEQ ID NO: 1432443 - RNA, 21 nt, Pseudomonas aeruginosa PA01
gccagcagcccggccuggauc

SEQ ID NO: 1432444 - RNA, 13 nt, Pseudomonas aeruginosa PA01
gccagcagcgccu

SEQ ID NO: 1432445 - RNA, 18 nt, Pseudomonas aeruginosa PA01
gccagcacggcgcagggc

SEQ ID NO: 1432446 - RNA, 15 nt, Pseudomonas aeruginosa PA01
gccagcaccacccgg

SEQ ID NO: 1432447 - RNA, 19 nt, Pseudomonas aeruginosa PA01
gccagcaccacccggccgc

SEQ ID NO: 1432448 - RNA, 20 nt, Pseudomonas aeruginosa PA01
gccagcaccacccggccgcg

SEQ ID NO: 1432449 - RNA, 22 nt, Pseudomonas aeruginosa PA01
gccagcaccacccggccgcgcu

SEQ ID NO: 1432450 - RNA, 12 nt, Pseudomonas aeruginosa PA01
gccagcaccagc

SEQ ID NO: 1432451 - RNA, 16 nt, Pseudomonas aeruginosa PA01
gccagcaccuucaccg

SEQ ID NO: 1432452 - RNA, 17 nt, Pseudomonas aeruginosa PA01
gccagcaccuucaccgu

SEQ ID NO: 1432453 - RNA, 18 nt, Pseudomonas aeruginosa PA01
gccagcaccuucaucacc

SEQ ID NO: 1432454 - RNA, 22 nt, Pseudomonas aeruginosa PA01
gccagcaccuucaucaccaggu

SEQ ID NO: 1432455 - RNA, 22 nt, Pseudomonas aeruginosa PA01
gccagcaccucguaggccgacu

SEQ ID NO: 1432456 - RNA, 15 nt, Pseudomonas aeruginosa PA01
gccagcaccucgacg

SEQ ID NO: 1432457 - RNA, 17 nt, Pseudomonas aeruginosa PA01
gccagcaccucgacgcc

SEQ ID NO: 1432458 - RNA, 19 nt, Pseudomonas aeruginosa PA01
gccagcaccucgacgcccg

SEQ ID NO: 1432459 - RNA, 19 nt, Pseudomonas aeruginosa PA01
gccagaugcgcgucgccga

SEQ ID NO: 1432460 - RNA, 16 nt, Pseudomonas aeruginosa PA01
gccagaugacgauggc

SEQ ID NO: 1432461 - RNA, 21 nt, Pseudomonas aeruginosa PA01
gccagaugacgauggccgccg

SEQ ID NO: 1432462 - RNA, 22 nt, Pseudomonas aeruginosa PA01
gccagaugacgauggccgccgc

SEQ ID NO: 1432463 - RNA, 18 nt, Pseudomonas aeruginosa PA01
gccagcaauugccgcugc

SEQ ID NO: 1432464 - RNA, 19 nt, Pseudomonas aeruginosa PA01
gccagcaauugccgcugca

SEQ ID NO: 1432465 - RNA, 20 nt, Pseudomonas aeruginosa PA01
gccagcaauugccgcugcac

SEQ ID NO: 1432466 - RNA, 20 nt, Pseudomonas aeruginosa PA01
gccagaggcugcgcuccagg

SEQ ID NO: 1432467 - RNA, 16 nt, Pseudomonas aeruginosa PA01
gccacgacccugcugg

SEQ ID NO: 1432468 - RNA, 19 nt, Pseudomonas aeruginosa PA01
gccacgacccugcuggccg

SEQ ID NO: 1432469 - RNA, 21 nt, Pseudomonas aeruginosa PA01
gccacgacccugcuggccggu

SEQ ID NO: 1432470 - RNA, 23 nt, Pseudomonas aeruginosa PA01
gccacaguuucauggugcccagc

SEQ ID NO: 1432471 - RNA, 20 nt, Pseudomonas aeruginosa PA01
gccacagguggaucgcggcg

SEQ ID NO: 1432472 - RNA, 22 nt, Pseudomonas aeruginosa PA01
gccacaggcguuauccgccgau

SEQ ID NO: 1432473 - RNA, 22 nt, Pseudomonas aeruginosa PA01
gccacaggcguuauccgccgcc

SEQ ID NO: 1432474 - RNA, 17 nt, Pseudomonas aeruginosa PA01
gccacgcaccaccaggu

SEQ ID NO: 1432475 - RNA, 16 nt, Pseudomonas aeruginosa PA01
gccacgcaauccucgg

SEQ ID NO: 1432476 - RNA, 14 nt, Pseudomonas aeruginosa PA01
gccacgcaggaaca

SEQ ID NO: 1432477 - RNA, 19 nt, Pseudomonas aeruginosa PA01
gccacgcaggaacagcucc

SEQ ID NO: 1432478 - RNA, 20 nt, Pseudomonas aeruginosa PA01
gccacgacguaauucgcuga

SEQ ID NO: 1432479 - RNA, 23 nt, Pseudomonas aeruginosa PA01
gccacgacguaauucgcugacga

SEQ ID NO: 1432480 - RNA, 19 nt, Pseudomonas aeruginosa PA01
gccacgccgauaccggccu

SEQ ID NO: 1432481 - RNA, 13 nt, Pseudomonas aeruginosa PA01
gccacggccgcug

SEQ ID NO: 1432482 - RNA, 15 nt, Pseudomonas aeruginosa PA01
gccacggccgcugcg

SEQ ID NO: 1432483 - RNA, 13 nt, Pseudomonas aeruginosa PA01
gccacggccggcg

SEQ ID NO: 1432484 - RNA, 14 nt, Pseudomonas aeruginosa PA01
gccacggccggcga

SEQ ID NO: 1432485 - RNA, 12 nt, Pseudomonas aeruginosa PA01
gccacgcccgcc

SEQ ID NO: 1432486 - RNA, 21 nt, Pseudomonas aeruginosa PA01
gccacgcccgccguggcggua

SEQ ID NO: 1432487 - RNA, 13 nt, Pseudomonas aeruginosa PA01
gccacgcccggug

SEQ ID NO: 1432488 - RNA, 16 nt, Pseudomonas aeruginosa PA01
gccacgccgacgccga

SEQ ID NO: 1432489 - RNA, 22 nt, Pseudomonas aeruginosa PA01
gccacgccauucgaauggcgcc

SEQ ID NO: 1432490 - RNA, 22 nt, Pseudomonas aeruginosa PA01
gccacggcgguuucgucgaagc

SEQ ID NO: 1432491 - RNA, 13 nt, Pseudomonas aeruginosa PA01
gccacggcgagag

SEQ ID NO: 1432492 - RNA, 22 nt, Pseudomonas aeruginosa PA01
gccacggcgagagcgccgacca

SEQ ID NO: 1432493 - RNA, 16 nt, Pseudomonas aeruginosa PA01
gccacggcgaucgccg

SEQ ID NO: 1432494 - RNA, 17 nt, Pseudomonas aeruginosa PA01
gccacggcgaucgccgg

SEQ ID NO: 1432495 - RNA, 18 nt, Pseudomonas aeruginosa PA01
gccacggcgaucgccggg

SEQ ID NO: 1432496 - RNA, 19 nt, Pseudomonas aeruginosa PA01
gccacggcgaucgccgggu

SEQ ID NO: 1432497 - RNA, 20 nt, Pseudomonas aeruginosa PA01
gccacggcgcgcuccggcgc

SEQ ID NO: 1432498 - RNA, 12 nt, Pseudomonas aeruginosa PA01
gccacggcgcgg

SEQ ID NO: 1432499 - RNA, 22 nt, Pseudomonas aeruginosa PA01
gccacggcgcggaacaucgccc

SEQ ID NO: 1432500 - RNA, 23 nt, Pseudomonas aeruginosa PA01
gccacggcgcggaacaucgcccg

SEQ ID NO: 1432501 - RNA, 18 nt, Pseudomonas aeruginosa PA01
gccacgggcagaccuucg

SEQ ID NO: 1432502 - RNA, 15 nt, Pseudomonas aeruginosa PA01
gccacgggcgccagc

SEQ ID NO: 1432503 - RNA, 17 nt, Pseudomonas aeruginosa PA01
gccacgggcgccagcgg

SEQ ID NO: 1432504 - RNA, 20 nt, Pseudomonas aeruginosa PA01
gccacgggcgccagcgguuc

SEQ ID NO: 1432505 - RNA, 16 nt, Pseudomonas aeruginosa PA01
gccacggcggauugac

SEQ ID NO: 1432506 - RNA, 19 nt, Pseudomonas aeruginosa PA01
gccacggggccccucgccg

SEQ ID NO: 1432507 - RNA, 20 nt, Pseudomonas aeruginosa PA01
gccacggggccccucgccgu

SEQ ID NO: 1432508 - RNA, 22 nt, Pseudomonas aeruginosa PA01
gccacggggccccucgccguga

SEQ ID NO: 1432509 - RNA, 18 nt, Pseudomonas aeruginosa PA01
gccacucggccaggcgcc

SEQ ID NO: 1432510 - RNA, 21 nt, Pseudomonas aeruginosa PA01
gccacucggccaggcgccagg

SEQ ID NO: 1432511 - RNA, 22 nt, Pseudomonas aeruginosa PA01
gccacucggccaggcgccaggg

SEQ ID NO: 1432512 - RNA, 12 nt, Pseudomonas aeruginosa PA01
gccacucggcgu

SEQ ID NO: 1432513 - RNA, 14 nt, Pseudomonas aeruginosa PA01
gccacucggcgugc

SEQ ID NO: 1432514 - RNA, 19 nt, Pseudomonas aeruginosa PA01
gccacucggcgugccgggc

SEQ ID NO: 1432515 - RNA, 13 nt, Pseudomonas aeruginosa PA01
gccacugcgcgcc

SEQ ID NO: 1432516 - RNA, 23 nt, Pseudomonas aeruginosa PA01
gccacugaacuggaucggcccca

SEQ ID NO: 1432517 - RNA, 20 nt, Pseudomonas aeruginosa PA01
gccacugacgcgcagcgccg

SEQ ID NO: 1432518 - RNA, 20 nt, Pseudomonas aeruginosa PA01
gccacugauaccgcuggcca

SEQ ID NO: 1432519 - RNA, 23 nt, Pseudomonas aeruginosa PA01
gccacugauaccgcuggccaggu

SEQ ID NO: 1432520 - RNA, 19 nt, Pseudomonas aeruginosa PA01
gccagaagcgacuguccaa

SEQ ID NO: 1432521 - RNA, 15 nt, Pseudomonas aeruginosa PA01
gccagaagcggccga

SEQ ID NO: 1432522 - RNA, 18 nt, Pseudomonas aeruginosa PA01
gccagaagcggccgacca

SEQ ID NO: 1432523 - RNA, 21 nt, Pseudomonas aeruginosa PA01
gccagaagcggccgaccaggc

SEQ ID NO: 1432524 - RNA, 15 nt, Pseudomonas aeruginosa PA01
gccagaccagcccca

SEQ ID NO: 1432525 - RNA, 24 nt, Pseudomonas aeruginosa PA01
gccagaccgagauuggccgccugc

SEQ ID NO: 1432526 - RNA, 23 nt, Pseudomonas aeruginosa PA01
gccagaagguaucggccauggcc

SEQ ID NO: 1432527 - RNA, 14 nt, Pseudomonas aeruginosa PA01
gccagaaggucggg

SEQ ID NO: 1432528 - RNA, 16 nt, Pseudomonas aeruginosa PA01
gccagaaggucgggga

SEQ ID NO: 1432529 - RNA, 17 nt, Pseudomonas aeruginosa PA01
gccagaaugugccggua

SEQ ID NO: 1432530 - RNA, 22 nt, Pseudomonas aeruginosa PA01
gccagaaugugccgguagcugg

SEQ ID NO: 1432531 - RNA, 17 nt, Pseudomonas aeruginosa PA01
gccagaauuccagcagg

SEQ ID NO: 1432532 - RNA, 19 nt, Pseudomonas aeruginosa PA01
gccagaauuccagcagguc

SEQ ID NO: 1432533 - RNA, 22 nt, Pseudomonas aeruginosa PA01
gccagaauuccagcaggucggc

SEQ ID NO: 1432534 - RNA, 23 nt, Pseudomonas aeruginosa PA01
gccagaauuccagcaggucggca

SEQ ID NO: 1432535 - RNA, 19 nt, Pseudomonas aeruginosa PA01
gccagaguugccuguccag

SEQ ID NO: 1432536 - RNA, 20 nt, Pseudomonas aeruginosa PA01
gccagaguugccuguccagc

SEQ ID NO: 1432537 - RNA, 16 nt, Pseudomonas aeruginosa PA01
gccagagcuccagggc

SEQ ID NO: 1432538 - RNA, 16 nt, Pseudomonas aeruginosa PA01
gccagaggaucggcca

SEQ ID NO: 1432539 - RNA, 23 nt, Pseudomonas aeruginosa PA01
gccagagcgcgcuacucagguga

SEQ ID NO: 1432540 - RNA, 14 nt, Pseudomonas aeruginosa PA01
gccagagaucgccc

SEQ ID NO: 1432541 - RNA, 18 nt, Pseudomonas aeruginosa PA01
gccagagaucgcccagcg

SEQ ID NO: 1432542 - RNA, 16 nt, Pseudomonas aeruginosa PA01
gccagagcacgaaagc

SEQ ID NO: 1432543 - RNA, 14 nt, Pseudomonas aeruginosa PA01
gccagagcagcguc

SEQ ID NO: 1432544 - RNA, 15 nt, Pseudomonas aeruginosa PA01
gccagacguccggca

SEQ ID NO: 1432545 - RNA, 13 nt, Pseudomonas aeruginosa PA01
gccagacgcucgg

SEQ ID NO: 1432546 - RNA, 16 nt, Pseudomonas aeruginosa PA01
gccagacgcucggcuu

SEQ ID NO: 1432547 - RNA, 18 nt, Pseudomonas aeruginosa PA01
gccagaccggcagcgccg

SEQ ID NO: 1432548 - RNA, 21 nt, Pseudomonas aeruginosa PA01
gccagaccggcagcgccgcca

SEQ ID NO: 1432549 - RNA, 15 nt, Pseudomonas aeruginosa PA01
gccagacgaucagcg

SEQ ID NO: 1432550 - RNA, 16 nt, Pseudomonas aeruginosa PA01
gccagacgaucagcgg

SEQ ID NO: 1432551 - RNA, 16 nt, Pseudomonas aeruginosa PA01
gccagaccguggcgcu

SEQ ID NO: 1432552 - RNA, 22 nt, Pseudomonas aeruginosa PA01
gccauaauggccgcuacgcggc

SEQ ID NO: 1432553 - RNA, 13 nt, Pseudomonas aeruginosa PA01
gccaguugcgcuc

SEQ ID NO: 1432554 - RNA, 16 nt, Pseudomonas aeruginosa PA01
gccaguugcgcuccgg

SEQ ID NO: 1432555 - RNA, 23 nt, Pseudomonas aeruginosa PA01
gccaguugcgcuccgguggcgga

SEQ ID NO: 1432556 - RNA, 18 nt, Pseudomonas aeruginosa PA01
gccaguuggaaguugccg

SEQ ID NO: 1432557 - RNA, 20 nt, Pseudomonas aeruginosa PA01
gccaguuggacgcggccugg

SEQ ID NO: 1432558 - RNA, 16 nt, Pseudomonas aeruginosa PA01
gccaguuggcccuuga

SEQ ID NO: 1432559 - RNA, 20 nt, Pseudomonas aeruginosa PA01
gccaguuggugcacgcgccg

SEQ ID NO: 1432560 - RNA, 22 nt, Pseudomonas aeruginosa PA01
gccaguuggugcacgcgccggg

SEQ ID NO: 1432561 - RNA, 19 nt, Pseudomonas aeruginosa PA01
gccaguuguuccggcugga

SEQ ID NO: 1432562 - RNA, 23 nt, Pseudomonas aeruginosa PA01
gccauaggcauauucuucaacag

SEQ ID NO: 1432563 - RNA, 16 nt, Pseudomonas aeruginosa PA01
gccauagugcugggcg

SEQ ID NO: 1432564 - RNA, 22 nt, Pseudomonas aeruginosa PA01
gccauagugcugggcgaccuuc

SEQ ID NO: 1432565 - RNA, 12 nt, Pseudomonas aeruginosa PA01
gccauaggcggc

SEQ ID NO: 1432566 - RNA, 16 nt, Pseudomonas aeruginosa PA01
gccauaggcggcgcag

SEQ ID NO: 1432567 - RNA, 21 nt, Pseudomonas aeruginosa PA01
gccauaggcuggaucgaucuc

SEQ ID NO: 1432568 - RNA, 20 nt, Pseudomonas aeruginosa PA01
gccauagagugcccaggcgc

SEQ ID NO: 1432569 - RNA, 15 nt, Pseudomonas aeruginosa PA01
gccauagcgccggca

SEQ ID NO: 1432570 - RNA, 19 nt, Pseudomonas aeruginosa PA01
gccauaccggcaaggcggc

SEQ ID NO: 1432571 - RNA, 15 nt, Pseudomonas aeruginosa PA01
gccauacagcgccca

SEQ ID NO: 1432572 - RNA, 17 nt, Pseudomonas aeruginosa PA01
gccaucaccagcggcga

SEQ ID NO: 1432573 - RNA, 17 nt, Pseudomonas aeruginosa PA01
gccauauuucgaagggu

SEQ ID NO: 1432574 - RNA, 19 nt, Pseudomonas aeruginosa PA01
gccaucagcacgaaagcca

SEQ ID NO: 1432575 - RNA, 22 nt, Pseudomonas aeruginosa PA01
gccaucagcacgucguccagcg

SEQ ID NO: 1432576 - RNA, 13 nt, Pseudomonas aeruginosa PA01
gccaucagcacca

SEQ ID NO: 1432577 - RNA, 15 nt, Pseudomonas aeruginosa PA01
gccaucagcaccagg

SEQ ID NO: 1432578 - RNA, 21 nt, Pseudomonas aeruginosa PA01
gccaucagcaccaggaagccc

SEQ ID NO: 1432579 - RNA, 13 nt, Pseudomonas aeruginosa PA01
gccaucagcgccg

SEQ ID NO: 1432580 - RNA, 14 nt, Pseudomonas aeruginosa PA01
gccaucagcgccgc

SEQ ID NO: 1432581 - RNA, 20 nt, Pseudomonas aeruginosa PA01
gccaucagcgccgccucgcu

SEQ ID NO: 1432582 - RNA, 13 nt, Pseudomonas aeruginosa PA01
gccaucaggcccu

SEQ ID NO: 1432583 - RNA, 12 nt, Pseudomonas aeruginosa PA01
gccaucaggccg

SEQ ID NO: 1432584 - RNA, 14 nt, Pseudomonas aeruginosa PA01
gccaucaggccgcg

SEQ ID NO: 1432585 - RNA, 15 nt, Pseudomonas aeruginosa PA01
gccaucaggcgcugu

SEQ ID NO: 1432586 - RNA, 19 nt, Pseudomonas aeruginosa PA01
gccauccgcagucuucucg

SEQ ID NO: 1432587 - RNA, 22 nt, Pseudomonas aeruginosa PA01
gccauccgcgccgaccagccgc

SEQ ID NO: 1432588 - RNA, 14 nt, Pseudomonas aeruginosa PA01
gccauccgcgccga

SEQ ID NO: 1432589 - RNA, 14 nt, Pseudomonas aeruginosa PA01
gccauccgcccugc

SEQ ID NO: 1432590 - RNA, 12 nt, Pseudomonas aeruginosa PA01
gccauccgccuu

SEQ ID NO: 1432591 - RNA, 13 nt, Pseudomonas aeruginosa PA01
gccauccgcgccg

SEQ ID NO: 1432592 - RNA, 16 nt, Pseudomonas aeruginosa PA01
gccaucagggucggcc

SEQ ID NO: 1432593 - RNA, 19 nt, Pseudomonas aeruginosa PA01
gccaucagggucggcccgg

SEQ ID NO: 1432594 - RNA, 17 nt, Pseudomonas aeruginosa PA01
gccaucagugccugcac

SEQ ID NO: 1432595 - RNA, 15 nt, Pseudomonas aeruginosa PA01
gccauccagccaggc

SEQ ID NO: 1432596 - RNA, 18 nt, Pseudomonas aeruginosa PA01
gccauccagccaggcgcu

SEQ ID NO: 1432597 - RNA, 19 nt, Pseudomonas aeruginosa PA01
gccauccagccaggcgcuc

SEQ ID NO: 1432598 - RNA, 14 nt, Pseudomonas aeruginosa PA01
gccaucuccucgcu

SEQ ID NO: 1432599 - RNA, 16 nt, Pseudomonas aeruginosa PA01
gccaucuccucgcuga

SEQ ID NO: 1432600 - RNA, 14 nt, Pseudomonas aeruginosa PA01
gccaucuuccugug

SEQ ID NO: 1432601 - RNA, 17 nt, Pseudomonas aeruginosa PA01
gccaucuucucgaagcg

SEQ ID NO: 1432602 - RNA, 18 nt, Pseudomonas aeruginosa PA01
gccaucuucucgaagcgc

SEQ ID NO: 1432603 - RNA, 16 nt, Pseudomonas aeruginosa PA01
gccaucuggcugccga

SEQ ID NO: 1432604 - RNA, 13 nt, Pseudomonas aeruginosa PA01
gccaugccggcgc

SEQ ID NO: 1432605 - RNA, 16 nt, Pseudomonas aeruginosa PA01
gccaugccggcgccga

SEQ ID NO: 1432606 - RNA, 18 nt, Pseudomonas aeruginosa PA01
gccaugccgccgacgccg

SEQ ID NO: 1432607 - RNA, 13 nt, Pseudomonas aeruginosa PA01
gccaugccgccga

SEQ ID NO: 1432608 - RNA, 14 nt, Pseudomonas aeruginosa PA01
gccaugccgccgac

SEQ ID NO: 1432609 - RNA, 13 nt, Pseudomonas aeruginosa PA01
gccaugcaggcca

SEQ ID NO: 1432610 - RNA, 16 nt, Pseudomonas aeruginosa PA01
gccaugcaggcugccg

SEQ ID NO: 1432611 - RNA, 18 nt, Pseudomonas aeruginosa PA01
gccaugcccggcuggcgu

SEQ ID NO: 1432612 - RNA, 23 nt, Pseudomonas aeruginosa PA01
gccaugcccgucgaccaucacca

SEQ ID NO: 1432613 - RNA, 16 nt, Pseudomonas aeruginosa PA01
gccaugcccagacgcc

SEQ ID NO: 1432614 - RNA, 20 nt, Pseudomonas aeruginosa PA01
gccaugcccagacgccgcuc

SEQ ID NO: 1432615 - RNA, 17 nt, Pseudomonas aeruginosa PA01
gccaugaccucggccag

SEQ ID NO: 1432616 - RNA, 18 nt, Pseudomonas aeruginosa PA01
gccaugaccucggccagc

SEQ ID NO: 1432617 - RNA, 16 nt, Pseudomonas aeruginosa PA01
gccaugacccgcggca

SEQ ID NO: 1432618 - RNA, 14 nt, Pseudomonas aeruginosa PA01
gccaugagccgggg

SEQ ID NO: 1432619 - RNA, 15 nt, Pseudomonas aeruginosa PA01
gccaugagccggggu

SEQ ID NO: 1432620 - RNA, 16 nt, Pseudomonas aeruginosa PA01
gccaucgccucgccgg

SEQ ID NO: 1432621 - RNA, 21 nt, Pseudomonas aeruginosa PA01
gccaucgccggcccgcgcggc

SEQ ID NO: 1432622 - RNA, 23 nt, Pseudomonas aeruginosa PA01
gccaucgccggcccgcgcggcaa

SEQ ID NO: 1432623 - RNA, 20 nt, Pseudomonas aeruginosa PA01
gccaucgauggucaggcugg

SEQ ID NO: 1432624 - RNA, 19 nt, Pseudomonas aeruginosa PA01
gccaucgcauagccggcgc

SEQ ID NO: 1432625 - RNA, 21 nt, Pseudomonas aeruginosa PA01
gccaucgcccgguugccuucg

SEQ ID NO: 1432626 - RNA, 18 nt, Pseudomonas aeruginosa PA01
gccaucggucgcgccccc

SEQ ID NO: 1432627 - RNA, 16 nt, Pseudomonas aeruginosa PA01
gccaucgcuuuccugg

SEQ ID NO: 1432628 - RNA, 18 nt, Pseudomonas aeruginosa PA01
gccaucgcuuuccuggcc

SEQ ID NO: 1432629 - RNA, 22 nt, Pseudomonas aeruginosa PA01
gccaucgcuuuccuggccgacc

SEQ ID NO: 1432630 - RNA, 16 nt, Pseudomonas aeruginosa PA01
gccauccuccagcgcc

SEQ ID NO: 1432631 - RNA, 17 nt, Pseudomonas aeruginosa PA01
gccauccuccagcgccg

SEQ ID NO: 1432632 - RNA, 18 nt, Pseudomonas aeruginosa PA01
gccauccuccagcgccgc

SEQ ID NO: 1432633 - RNA, 23 nt, Pseudomonas aeruginosa PA01
gccauccccgaggcgacgcccug

SEQ ID NO: 1432634 - RNA, 22 nt, Pseudomonas aeruginosa PA01
gccaucgaucagcagcgccacg

SEQ ID NO: 1432635 - RNA, 23 nt, Pseudomonas aeruginosa PA01
gccaucgaucagcagcgccacgc

SEQ ID NO: 1432636 - RNA, 17 nt, Pseudomonas aeruginosa PA01
gccaucgaggccaggcc

SEQ ID NO: 1432637 - RNA, 16 nt, Pseudomonas aeruginosa PA01
gccaucgaaaucgccc

SEQ ID NO: 1432638 - RNA, 14 nt, Pseudomonas aeruginosa PA01
gccauccuucggcg

SEQ ID NO: 1432639 - RNA, 14 nt, Pseudomonas aeruginosa PA01
gccauccuggucgc

SEQ ID NO: 1432640 - RNA, 14 nt, Pseudomonas aeruginosa PA01
gccagugccucgcg

SEQ ID NO: 1432641 - RNA, 15 nt, Pseudomonas aeruginosa PA01
gccagugccucgcgc

SEQ ID NO: 1432642 - RNA, 12 nt, Pseudomonas aeruginosa PA01
gccagugcucga

SEQ ID NO: 1432643 - RNA, 15 nt, Pseudomonas aeruginosa PA01
gccaguccggcagca

SEQ ID NO: 1432644 - RNA, 21 nt, Pseudomonas aeruginosa PA01
gccagucccgcaaagcccgcu

SEQ ID NO: 1432645 - RNA, 15 nt, Pseudomonas aeruginosa PA01
gccaguccacgacga

SEQ ID NO: 1432646 - RNA, 15 nt, Pseudomonas aeruginosa PA01
gccaguucggggucg

SEQ ID NO: 1432647 - RNA, 17 nt, Pseudomonas aeruginosa PA01
gccaguucggggucggc

SEQ ID NO: 1432648 - RNA, 21 nt, Pseudomonas aeruginosa PA01
gccaguucggggucggccugc

SEQ ID NO: 1432649 - RNA, 19 nt, Pseudomonas aeruginosa PA01
gccaguucgcggcgcaguu

SEQ ID NO: 1432650 - RNA, 14 nt, Pseudomonas aeruginosa PA01
gccaguucggccau

SEQ ID NO: 1432651 - RNA, 18 nt, Pseudomonas aeruginosa PA01
gccaguucgagcagucgc

SEQ ID NO: 1432652 - RNA, 15 nt, Pseudomonas aeruginosa PA01
gccaguucgucgagc

SEQ ID NO: 1432653 - RNA, 16 nt, Pseudomonas aeruginosa PA01
gccaguucucgcagca

SEQ ID NO: 1432654 - RNA, 20 nt, Pseudomonas aeruginosa PA01
gccaguucucgcagcaggcg

SEQ ID NO: 1432655 - RNA, 20 nt, Pseudomonas aeruginosa PA01
gccaguuccggggucagcgc

SEQ ID NO: 1432656 - RNA, 15 nt, Pseudomonas aeruginosa PA01
gccaguucgccggug

SEQ ID NO: 1432657 - RNA, 16 nt, Pseudomonas aeruginosa PA01
gccaguucgcgcaggu

SEQ ID NO: 1432658 - RNA, 21 nt, Pseudomonas aeruginosa PA01
gccaguuccgugucgagggcg

SEQ ID NO: 1432659 - RNA, 17 nt, Pseudomonas aeruginosa PA01
gccaguuccuucgccga

SEQ ID NO: 1432660 - RNA, 15 nt, Pseudomonas aeruginosa PA01
gccagguacuggcga

SEQ ID NO: 1432661 - RNA, 19 nt, Pseudomonas aeruginosa PA01
gccagguacuuggccacgc

SEQ ID NO: 1432662 - RNA, 23 nt, Pseudomonas aeruginosa PA01
gccagguacuuggccacgccuuc

SEQ ID NO: 1432663 - RNA, 14 nt, Pseudomonas aeruginosa PA01
gccagguagccugg

SEQ ID NO: 1432664 - RNA, 11 nt, Pseudomonas aeruginosa PA01
gccaggucggu

SEQ ID NO: 1432665 - RNA, 18 nt, Pseudomonas aeruginosa PA01
gccaggucgguccgccga

SEQ ID NO: 1432666 - RNA, 20 nt, Pseudomonas aeruginosa PA01
gccaggucgguccgccgaug

SEQ ID NO: 1432667 - RNA, 14 nt, Pseudomonas aeruginosa PA01
gccaggucgucgcg

SEQ ID NO: 1432668 - RNA, 15 nt, Pseudomonas aeruginosa PA01
gccaggucgucgcgc

SEQ ID NO: 1432669 - RNA, 16 nt, Pseudomonas aeruginosa PA01
gccaggucgucgcgcu

SEQ ID NO: 1432670 - RNA, 16 nt, Pseudomonas aeruginosa PA01
gccagguaauagccgu

SEQ ID NO: 1432671 - RNA, 24 nt, Pseudomonas aeruginosa PA01
gccagguaccggccaggcggucca

SEQ ID NO: 1432672 - RNA, 20 nt, Pseudomonas aeruginosa PA01
gccagguacggaugccgcga

SEQ ID NO: 1432673 - RNA, 20 nt, Pseudomonas aeruginosa PA01
gccaggguguuguucgccag

SEQ ID NO: 1432674 - RNA, 21 nt, Pseudomonas aeruginosa PA01
gccaggcguuccagcucggcg

SEQ ID NO: 1432675 - RNA, 16 nt, Pseudomonas aeruginosa PA01
gccagggucuugccga

SEQ ID NO: 1432676 - RNA, 18 nt, Pseudomonas aeruginosa PA01
gccagggugcugcccagg

SEQ ID NO: 1432677 - RNA, 21 nt, Pseudomonas aeruginosa PA01
gccagggugcugcccagggcc

SEQ ID NO: 1432678 - RNA, 23 nt, Pseudomonas aeruginosa PA01
gccaggguguacuugacggcgcc

SEQ ID NO: 1432679 - RNA, 13 nt, Pseudomonas aeruginosa PA01
gccagggucgcca

SEQ ID NO: 1432680 - RNA, 15 nt, Pseudomonas aeruginosa PA01
gccagggucgccagc

SEQ ID NO: 1432681 - RNA, 16 nt, Pseudomonas aeruginosa PA01
gccagggucgccagca

SEQ ID NO: 1432682 - RNA, 23 nt, Pseudomonas aeruginosa PA01
gccaggcucuucuucgaaccgca

SEQ ID NO: 1432683 - RNA, 22 nt, Pseudomonas aeruginosa PA01
gccagguggucguagcaggucc

SEQ ID NO: 1432684 - RNA, 18 nt, Pseudomonas aeruginosa PA01
gccagguggaagcgcgcg

SEQ ID NO: 1432685 - RNA, 17 nt, Pseudomonas aeruginosa PA01
gccaggucuucuggaaa

SEQ ID NO: 1432686 - RNA, 20 nt, Pseudomonas aeruginosa PA01
gccaggucuucuggaaaucg

SEQ ID NO: 1432687 - RNA, 15 nt, Pseudomonas aeruginosa PA01
gccaggugcaggaag

SEQ ID NO: 1432688 - RNA, 20 nt, Pseudomonas aeruginosa PA01
gccaggucguugcgccggcc

SEQ ID NO: 1432689 - RNA, 22 nt, Pseudomonas aeruginosa PA01
gccaggucguugcgccggccca

SEQ ID NO: 1432690 - RNA, 18 nt, Pseudomonas aeruginosa PA01
gccagguagugccgcccu

SEQ ID NO: 1432691 - RNA, 16 nt, Pseudomonas aeruginosa PA01
gccagguaggcgacga

SEQ ID NO: 1432692 - RNA, 21 nt, Pseudomonas aeruginosa PA01
gccagguaggcgacgaagcug

SEQ ID NO: 1432693 - RNA, 15 nt, Pseudomonas aeruginosa PA01
gccagguaggggucg

SEQ ID NO: 1432694 - RNA, 16 nt, Pseudomonas aeruginosa PA01
gccaggcaggccgggc

SEQ ID NO: 1432695 - RNA, 18 nt, Pseudomonas aeruginosa PA01
gccaggccacggccggcg

SEQ ID NO: 1432696 - RNA, 19 nt, Pseudomonas aeruginosa PA01
gccaggccacggccggcga

SEQ ID NO: 1432697 - RNA, 18 nt, Pseudomonas aeruginosa PA01
gccaggccacggcggaag

SEQ ID NO: 1432698 - RNA, 18 nt, Pseudomonas aeruginosa PA01
gccaggcagaccagcgca

SEQ ID NO: 1432699 - RNA, 20 nt, Pseudomonas aeruginosa PA01
gccaggcagaccagcgcaag

SEQ ID NO: 1432700 - RNA, 17 nt, Pseudomonas aeruginosa PA01
gccaggcagaccaggcc

SEQ ID NO: 1432701 - RNA, 19 nt, Pseudomonas aeruginosa PA01
gccaggcagaccaggccga

SEQ ID NO: 1432702 - RNA, 22 nt, Pseudomonas aeruginosa PA01
gccaggcagaccaggccgagca

SEQ ID NO: 1432703 - RNA, 21 nt, Pseudomonas aeruginosa PA01
gccaggcagaccugcagcagg

SEQ ID NO: 1432704 - RNA, 18 nt, Pseudomonas aeruginosa PA01
gccaggagcacgccgugc

SEQ ID NO: 1432705 - RNA, 17 nt, Pseudomonas aeruginosa PA01
gccaggagcagggcgcc

SEQ ID NO: 1432706 - RNA, 16 nt, Pseudomonas aeruginosa PA01
gccaggagcaucggcg

SEQ ID NO: 1432707 - RNA, 17 nt, Pseudomonas aeruginosa PA01
gccaggagcaucggcgc

SEQ ID NO: 1432708 - RNA, 21 nt, Pseudomonas aeruginosa PA01
gccaggacgccaccaggccgc

SEQ ID NO: 1432709 - RNA, 13 nt, Pseudomonas aeruginosa PA01
gccaggacgcucg

SEQ ID NO: 1432710 - RNA, 17 nt, Pseudomonas aeruginosa PA01
gccaggacgcucgggua

SEQ ID NO: 1432711 - RNA, 18 nt, Pseudomonas aeruginosa PA01
gccaggacggcaggguca

SEQ ID NO: 1432712 - RNA, 14 nt, Pseudomonas aeruginosa PA01
gccaggacucgcca

SEQ ID NO: 1432713 - RNA, 13 nt, Pseudomonas aeruginosa PA01
gccaggaccaggg

SEQ ID NO: 1432714 - RNA, 17 nt, Pseudomonas aeruginosa PA01
gccaggaccgcgauggu

SEQ ID NO: 1432715 - RNA, 14 nt, Pseudomonas aeruginosa PA01
gccaggaaggccgc

SEQ ID NO: 1432716 - RNA, 16 nt, Pseudomonas aeruginosa PA01
gccaggaaggccgcuu

SEQ ID NO: 1432717 - RNA, 18 nt, Pseudomonas aeruginosa PA01
gccaggaaggccgcuucg

SEQ ID NO: 1432718 - RNA, 21 nt, Pseudomonas aeruginosa PA01
gccaggaaggccgcuucgccg

SEQ ID NO: 1432719 - RNA, 15 nt, Pseudomonas aeruginosa PA01
gccaggaagccgcgc

SEQ ID NO: 1432720 - RNA, 17 nt, Pseudomonas aeruginosa PA01
gccaggaagccgcgccc

SEQ ID NO: 1432721 - RNA, 15 nt, Pseudomonas aeruginosa PA01
gccagcggcccggca

SEQ ID NO: 1432722 - RNA, 15 nt, Pseudomonas aeruginosa PA01
gccagcggccagggc

SEQ ID NO: 1432723 - RNA, 13 nt, Pseudomonas aeruginosa PA01
gccagcggcaucc

SEQ ID NO: 1432724 - RNA, 14 nt, Pseudomonas aeruginosa PA01
gccagcggcauccg

SEQ ID NO: 1432725 - RNA, 19 nt, Pseudomonas aeruginosa PA01
gccagcggcauccgccgcu

SEQ ID NO: 1432726 - RNA, 21 nt, Pseudomonas aeruginosa PA01
gccagcggcauccgccgcugg

SEQ ID NO: 1432727 - RNA, 13 nt, Pseudomonas aeruginosa PA01
gccagcggcauuc

SEQ ID NO: 1432728 - RNA, 20 nt, Pseudomonas aeruginosa PA01
gccagcggcauucgaacggc

SEQ ID NO: 1432729 - RNA, 14 nt, Pseudomonas aeruginosa PA01
gccagcggcgaucg

SEQ ID NO: 1432730 - RNA, 17 nt, Pseudomonas aeruginosa PA01
gccagcgguugagcagg

SEQ ID NO: 1432731 - RNA, 17 nt, Pseudomonas aeruginosa PA01
gccagcguccuucggcg

SEQ ID NO: 1432732 - RNA, 20 nt, Pseudomonas aeruginosa PA01
gccagcguccuucggcgcuc

SEQ ID NO: 1432733 - RNA, 16 nt, Pseudomonas aeruginosa PA01
gccagcgucgccgccg

SEQ ID NO: 1432734 - RNA, 17 nt, Pseudomonas aeruginosa PA01
gccagcgucgccgccgc

SEQ ID NO: 1432735 - RNA, 19 nt, Pseudomonas aeruginosa PA01
gccagcgucgccgccgcgg

SEQ ID NO: 1432736 - RNA, 16 nt, Pseudomonas aeruginosa PA01
gccaggaagagcccgc

SEQ ID NO: 1432737 - RNA, 21 nt, Pseudomonas aeruginosa PA01
gccaggaagagcccgccacgc

SEQ ID NO: 1432738 - RNA, 12 nt, Pseudomonas aeruginosa PA01
gccaggcccggu

SEQ ID NO: 1432739 - RNA, 17 nt, Pseudomonas aeruginosa PA01
gccaggcccucagcggc

SEQ ID NO: 1432740 - RNA, 16 nt, Pseudomonas aeruginosa PA01
gccaggcccucggcga

SEQ ID NO: 1432741 - RNA, 16 nt, Pseudomonas aeruginosa PA01
gccaggcccacgccga

SEQ ID NO: 1432742 - RNA, 13 nt, Pseudomonas aeruginosa PA01
gccaggcccggcg

SEQ ID NO: 1432743 - RNA, 17 nt, Pseudomonas aeruginosa PA01
gccaggcccggcgcugc

SEQ ID NO: 1432744 - RNA, 14 nt, Pseudomonas aeruginosa PA01
gccaggcccggcgc

SEQ ID NO: 1432745 - RNA, 17 nt, Pseudomonas aeruginosa PA01
gccaggcauuccuccag

SEQ ID NO: 1432746 - RNA, 23 nt, Pseudomonas aeruginosa PA01
gccaggccauugaaggccgacac

SEQ ID NO: 1432747 - RNA, 15 nt, Pseudomonas aeruginosa PA01
gccaggccccaggcc

SEQ ID NO: 1432748 - RNA, 20 nt, Pseudomonas aeruginosa PA01
gccaggccccaggccgccgc

SEQ ID NO: 1432749 - RNA, 16 nt, Pseudomonas aeruginosa PA01
gccaggccccagggcc

SEQ ID NO: 1432750 - RNA, 19 nt, Pseudomonas aeruginosa PA01
gccaggccccagggccggc

SEQ ID NO: 1432751 - RNA, 21 nt, Pseudomonas aeruginosa PA01
gccaggccccagggccggcgc

SEQ ID NO: 1432752 - RNA, 22 nt, Pseudomonas aeruginosa PA01
gccaggcgaauggagggaucgc

SEQ ID NO: 1432753 - RNA, 14 nt, Pseudomonas aeruginosa PA01
gccaggcgcaccag

SEQ ID NO: 1432754 - RNA, 15 nt, Pseudomonas aeruginosa PA01
gccaggcgcagccag

SEQ ID NO: 1432755 - RNA, 16 nt, Pseudomonas aeruginosa PA01
gccaggcgcagccagc

SEQ ID NO: 1432756 - RNA, 20 nt, Pseudomonas aeruginosa PA01
gccaggcgauggugcgcucg

SEQ ID NO: 1432757 - RNA, 22 nt, Pseudomonas aeruginosa PA01
gccaggcgauggugcgcucgcg

SEQ ID NO: 1432758 - RNA, 12 nt, Pseudomonas aeruginosa PA01
gccaggcgccga

SEQ ID NO: 1432759 - RNA, 15 nt, Pseudomonas aeruginosa PA01
gccaggcgccgauca

SEQ ID NO: 1432760 - RNA, 14 nt, Pseudomonas aeruginosa PA01
gccaggcgccaggu

SEQ ID NO: 1432761 - RNA, 15 nt, Pseudomonas aeruginosa PA01
gccaggcgaagcggc

SEQ ID NO: 1432762 - RNA, 18 nt, Pseudomonas aeruginosa PA01
gccaggcgaagcggcugg

SEQ ID NO: 1432763 - RNA, 18 nt, Pseudomonas aeruginosa PA01
gccaggcgaggaacagcg

SEQ ID NO: 1432764 - RNA, 12 nt, Pseudomonas aeruginosa PA01
gccaggccuggg

SEQ ID NO: 1432765 - RNA, 22 nt, Pseudomonas aeruginosa PA01
gccaggccuuccagaacgccgc

SEQ ID NO: 1432766 - RNA, 17 nt, Pseudomonas aeruginosa PA01
gccaggccuugugcgcc

SEQ ID NO: 1432767 - RNA, 14 nt, Pseudomonas aeruginosa PA01
gccaggccucggcg

SEQ ID NO: 1432768 - RNA, 15 nt, Pseudomonas aeruginosa PA01
gccaggccucggcgc

SEQ ID NO: 1432769 - RNA, 16 nt, Pseudomonas aeruginosa PA01
gccaggccucggcgcg

SEQ ID NO: 1432770 - RNA, 18 nt, Pseudomonas aeruginosa PA01
gccaggccucggcgcggg

SEQ ID NO: 1432771 - RNA, 13 nt, Pseudomonas aeruginosa PA01
gccaggcgcucca

SEQ ID NO: 1432772 - RNA, 15 nt, Pseudomonas aeruginosa PA01
gccaggcgcgggucu

SEQ ID NO: 1432773 - RNA, 22 nt, Pseudomonas aeruginosa PA01
gccaggcgcgguugccgcugcg

SEQ ID NO: 1432774 - RNA, 18 nt, Pseudomonas aeruginosa PA01
gccaggcgcgucgcggcc

SEQ ID NO: 1432775 - RNA, 13 nt, Pseudomonas aeruginosa PA01
gccaggcgcuugu

SEQ ID NO: 1432776 - RNA, 16 nt, Pseudomonas aeruginosa PA01
gccaggcgcuuguccg

SEQ ID NO: 1432777 - RNA, 21 nt, Pseudomonas aeruginosa PA01
gccaggcgcuccuccagcgcc

SEQ ID NO: 1432778 - RNA, 23 nt, Pseudomonas aeruginosa PA01
gccaggcgcuccuccagcgccgc

SEQ ID NO: 1432779 - RNA, 14 nt, Pseudomonas aeruginosa PA01
gccaggcgcucgcg

SEQ ID NO: 1432780 - RNA, 15 nt, Pseudomonas aeruginosa PA01
gccaggcgcucgcgc

SEQ ID NO: 1432781 - RNA, 20 nt, Pseudomonas aeruginosa PA01
gccaggcgcucgcgcugcaa

SEQ ID NO: 1432782 - RNA, 18 nt, Pseudomonas aeruginosa PA01
gccaggcgcgacagcucg

SEQ ID NO: 1432783 - RNA, 18 nt, Pseudomonas aeruginosa PA01
gccaggcgcucucgccgc

SEQ ID NO: 1432784 - RNA, 16 nt, Pseudomonas aeruginosa PA01
gccaggcggggauggc

SEQ ID NO: 1432785 - RNA, 20 nt, Pseudomonas aeruginosa PA01
gccaggcggcagccgcggcu

SEQ ID NO: 1432786 - RNA, 16 nt, Pseudomonas aeruginosa PA01
gccaggcggccgaaga

SEQ ID NO: 1432787 - RNA, 14 nt, Pseudomonas aeruginosa PA01
gccaggcggccgac

SEQ ID NO: 1432788 - RNA, 15 nt, Pseudomonas aeruginosa PA01
gccaggcggccgacg

SEQ ID NO: 1432789 - RNA, 16 nt, Pseudomonas aeruginosa PA01
gccaggcggccgacga

SEQ ID NO: 1432790 - RNA, 13 nt, Pseudomonas aeruginosa PA01
gccaggcggccgc

SEQ ID NO: 1432791 - RNA, 18 nt, Pseudomonas aeruginosa PA01
gccaggcggccgcuggcg

SEQ ID NO: 1432792 - RNA, 19 nt, Pseudomonas aeruginosa PA01
gccaggcggccgcuggcga

SEQ ID NO: 1432793 - RNA, 17 nt, Pseudomonas aeruginosa PA01
gccaggcgguccagcca

SEQ ID NO: 1432794 - RNA, 20 nt, Pseudomonas aeruginosa PA01
gccaggcguauucggcgacc

SEQ ID NO: 1432795 - RNA, 20 nt, Pseudomonas aeruginosa PA01
gccaggcgucccguuccgcu

SEQ ID NO: 1432796 - RNA, 16 nt, Pseudomonas aeruginosa PA01
gccaggcucgccgcca

SEQ ID NO: 1432797 - RNA, 18 nt, Pseudomonas aeruginosa PA01
gccaggcucgccgccagc

SEQ ID NO: 1432798 - RNA, 19 nt, Pseudomonas aeruginosa PA01
gccaggcucgccgccagca

SEQ ID NO: 1432799 - RNA, 23 nt, Pseudomonas aeruginosa PA01
gccaggcucgccgccagcaggau

SEQ ID NO: 1432800 - RNA, 13 nt, Pseudomonas aeruginosa PA01
gccaggcucgcga

SEQ ID NO: 1432801 - RNA, 15 nt, Pseudomonas aeruginosa PA01
gccaggcucgcgaug

SEQ ID NO: 1432802 - RNA, 16 nt, Pseudomonas aeruginosa PA01
gccaggcucgcgaugc

SEQ ID NO: 1432803 - RNA, 20 nt, Pseudomonas aeruginosa PA01
gccgcaaccagcccuggcgc

SEQ ID NO: 1432804 - RNA, 17 nt, Pseudomonas aeruginosa PA01
gccgauuuucugccgcg

SEQ ID NO: 1432805 - RNA, 20 nt, Pseudomonas aeruginosa PA01
gccgauuucgcagaacgcgg

SEQ ID NO: 1432806 - RNA, 17 nt, Pseudomonas aeruginosa PA01
gccgcaaacccccugcg

SEQ ID NO: 1432807 - RNA, 17 nt, Pseudomonas aeruginosa PA01
gccgauugugcagggcc

SEQ ID NO: 1432808 - RNA, 14 nt, Pseudomonas aeruginosa PA01
gccgaucugcaggu

SEQ ID NO: 1432809 - RNA, 16 nt, Pseudomonas aeruginosa PA01
gccgauuccugggcga

SEQ ID NO: 1432810 - RNA, 16 nt, Pseudomonas aeruginosa PA01
gccgaucucgcccagu

SEQ ID NO: 1432811 - RNA, 22 nt, Pseudomonas aeruginosa PA01
gccgaucucguggacccgugcg

SEQ ID NO: 1432812 - RNA, 14 nt, Pseudomonas aeruginosa PA01
gccgaucucgccca

SEQ ID NO: 1432813 - RNA, 15 nt, Pseudomonas aeruginosa PA01
gccgaucccggcggc

SEQ ID NO: 1432814 - RNA, 16 nt, Pseudomonas aeruginosa PA01
gccgaucccggcggcg

SEQ ID NO: 1432815 - RNA, 18 nt, Pseudomonas aeruginosa PA01
gccgaucccggcggcgac

SEQ ID NO: 1432816 - RNA, 16 nt, Pseudomonas aeruginosa PA01
gccgaucaugcucggc

SEQ ID NO: 1432817 - RNA, 14 nt, Pseudomonas aeruginosa PA01
gccgaucuccgcuu

SEQ ID NO: 1432818 - RNA, 16 nt, Pseudomonas aeruginosa PA01
gccgaucuccgcuucc

SEQ ID NO: 1432819 - RNA, 16 nt, Pseudomonas aeruginosa PA01
gccgaucuccuccgcc

SEQ ID NO: 1432820 - RNA, 18 nt, Pseudomonas aeruginosa PA01
gccgaucuccuggcgggu

SEQ ID NO: 1432821 - RNA, 19 nt, Pseudomonas aeruginosa PA01
gccgaucuccuggcgggug

SEQ ID NO: 1432822 - RNA, 16 nt, Pseudomonas aeruginosa PA01
gccgcagacaucgccg

SEQ ID NO: 1432823 - RNA, 20 nt, Pseudomonas aeruginosa PA01
gccgcagacaucgccgaggg

SEQ ID NO: 1432824 - RNA, 21 nt, Pseudomonas aeruginosa PA01
gccgcagacaucgccgagggc

SEQ ID NO: 1432825 - RNA, 17 nt, Pseudomonas aeruginosa PA01
gccgcagaccagcgaac

SEQ ID NO: 1432826 - RNA, 14 nt, Pseudomonas aeruginosa PA01
gccgcagacgcccu

SEQ ID NO: 1432827 - RNA, 22 nt, Pseudomonas aeruginosa PA01
gccgcacuuccaggcgccaauc

SEQ ID NO: 1432828 - RNA, 16 nt, Pseudomonas aeruginosa PA01
gccgcagaucaucgca

SEQ ID NO: 1432829 - RNA, 19 nt, Pseudomonas aeruginosa PA01
gccgcagaucaucgcacgg

SEQ ID NO: 1432830 - RNA, 20 nt, Pseudomonas aeruginosa PA01
gccgcagagcaucacccgcg

SEQ ID NO: 1432831 - RNA, 18 nt, Pseudomonas aeruginosa PA01
gccgcagagccagccgca

SEQ ID NO: 1432832 - RNA, 15 nt, Pseudomonas aeruginosa PA01
gccgcagacguggca

SEQ ID NO: 1432833 - RNA, 23 nt, Pseudomonas aeruginosa PA01
gccgcagacguggcauucgucgc

SEQ ID NO: 1432834 - RNA, 14 nt, Pseudomonas aeruginosa PA01
gccgcagcagcggc

SEQ ID NO: 1432835 - RNA, 15 nt, Pseudomonas aeruginosa PA01
gccgcagcagcggca

SEQ ID NO: 1432836 - RNA, 15 nt, Pseudomonas aeruginosa PA01
gccgcagcagcggcg

SEQ ID NO: 1432837 - RNA, 17 nt, Pseudomonas aeruginosa PA01
gccgcagcagcggcgac

SEQ ID NO: 1432838 - RNA, 12 nt, Pseudomonas aeruginosa PA01
gccgcagcagcg

SEQ ID NO: 1432839 - RNA, 21 nt, Pseudomonas aeruginosa PA01
gccgcagcaagucgaacaggc

SEQ ID NO: 1432840 - RNA, 20 nt, Pseudomonas aeruginosa PA01
gccgcagcagguucgaaugc

SEQ ID NO: 1432841 - RNA, 12 nt, Pseudomonas aeruginosa PA01
gccgcacaccgc

SEQ ID NO: 1432842 - RNA, 19 nt, Pseudomonas aeruginosa PA01
gccgcacaccgcgcgcgcc

SEQ ID NO: 1432843 - RNA, 20 nt, Pseudomonas aeruginosa PA01
gccgcacaccgcgcgcgccu

SEQ ID NO: 1432844 - RNA, 22 nt, Pseudomonas aeruginosa PA01
gccgcacaccgcgcgcgccugc

SEQ ID NO: 1432845 - RNA, 14 nt, Pseudomonas aeruginosa PA01
gccgcacaggcugg

SEQ ID NO: 1432846 - RNA, 16 nt, Pseudomonas aeruginosa PA01
gccgcacaggcuggcc

SEQ ID NO: 1432847 - RNA, 17 nt, Pseudomonas aeruginosa PA01
gccgcacaggcuggcca

SEQ ID NO: 1432848 - RNA, 21 nt, Pseudomonas aeruginosa PA01
gccgcaccccauccucgccgg

SEQ ID NO: 1432849 - RNA, 19 nt, Pseudomonas aeruginosa PA01
gccgcaccacguagccggc

SEQ ID NO: 1432850 - RNA, 13 nt, Pseudomonas aeruginosa PA01
gccgcaccaggau

SEQ ID NO: 1432851 - RNA, 20 nt, Pseudomonas aeruginosa PA01
gccgccaacuggcugucgag

SEQ ID NO: 1432852 - RNA, 20 nt, Pseudomonas aeruginosa PA01
gccgccaaccacuccgccac

SEQ ID NO: 1432853 - RNA, 16 nt, Pseudomonas aeruginosa PA01
gccgccaccacgauca

SEQ ID NO: 1432854 - RNA, 12 nt, Pseudomonas aeruginosa PA01
gccgccagcagg

SEQ ID NO: 1432855 - RNA, 13 nt, Pseudomonas aeruginosa PA01
gccgccagcagga

SEQ ID NO: 1432856 - RNA, 17 nt, Pseudomonas aeruginosa PA01
gccgccagcaggaucga

SEQ ID NO: 1432857 - RNA, 22 nt, Pseudomonas aeruginosa PA01
gccgccagcaggaucgacagca

SEQ ID NO: 1432858 - RNA, 14 nt, Pseudomonas aeruginosa PA01
gccgccagccgcca

SEQ ID NO: 1432859 - RNA, 17 nt, Pseudomonas aeruginosa PA01
gccgccagccgccagga

SEQ ID NO: 1432860 - RNA, 16 nt, Pseudomonas aeruginosa PA01
gccgccagcaggucgg

SEQ ID NO: 1432861 - RNA, 21 nt, Pseudomonas aeruginosa PA01
gccgccagcaggucggccugc

SEQ ID NO: 1432862 - RNA, 12 nt, Pseudomonas aeruginosa PA01
gccgccaggcag

SEQ ID NO: 1432863 - RNA, 13 nt, Pseudomonas aeruginosa PA01
gccgccaggcaga

SEQ ID NO: 1432864 - RNA, 18 nt, Pseudomonas aeruginosa PA01
gccgccaggcagaccagg

SEQ ID NO: 1432865 - RNA, 20 nt, Pseudomonas aeruginosa PA01
gccgccaggcagaccaggcc

SEQ ID NO: 1432866 - RNA, 22 nt, Pseudomonas aeruginosa PA01
gccgccaggcagaccaggccga

SEQ ID NO: 1432867 - RNA, 23 nt, Pseudomonas aeruginosa PA01
gccgccaggcagaccaggccgag

SEQ ID NO: 1432868 - RNA, 16 nt, Pseudomonas aeruginosa PA01
gccgccaggcagaccu

SEQ ID NO: 1432869 - RNA, 19 nt, Pseudomonas aeruginosa PA01
gccgccaggcagaccugca

SEQ ID NO: 1432870 - RNA, 17 nt, Pseudomonas aeruginosa PA01
gccgccaggcaggccgg

SEQ ID NO: 1432871 - RNA, 18 nt, Pseudomonas aeruginosa PA01
gccgccaggcaggccggg

SEQ ID NO: 1432872 - RNA, 19 nt, Pseudomonas aeruginosa PA01
gccgccaggcaggccgggc

SEQ ID NO: 1432873 - RNA, 23 nt, Pseudomonas aeruginosa PA01
gccgccagcgcggcgcuuggcga

SEQ ID NO: 1432874 - RNA, 15 nt, Pseudomonas aeruginosa PA01
gccgccagcuaccgg

SEQ ID NO: 1432875 - RNA, 21 nt, Pseudomonas aeruginosa PA01
gccgccagcuaccggcagggu

SEQ ID NO: 1432876 - RNA, 21 nt, Pseudomonas aeruginosa PA01
gccgcagguuggccccgccga

SEQ ID NO: 1432877 - RNA, 22 nt, Pseudomonas aeruginosa PA01
gccgcagguuggccccgccgag

SEQ ID NO: 1432878 - RNA, 12 nt, Pseudomonas aeruginosa PA01
gccgcagccgug

SEQ ID NO: 1432879 - RNA, 14 nt, Pseudomonas aeruginosa PA01
gccgcagccguggc

SEQ ID NO: 1432880 - RNA, 16 nt, Pseudomonas aeruginosa PA01
gccgcagccguggcgc

SEQ ID NO: 1432881 - RNA, 14 nt, Pseudomonas aeruginosa PA01
gccgcaguccgggu

SEQ ID NO: 1432882 - RNA, 18 nt, Pseudomonas aeruginosa PA01
gccgcaguuguuccucgc

SEQ ID NO: 1432883 - RNA, 23 nt, Pseudomonas aeruginosa PA01
gccgcaguuguuccucgcggcuc

SEQ ID NO: 1432884 - RNA, 11 nt, Pseudomonas aeruginosa PA01
gccgcaguccg

SEQ ID NO: 1432885 - RNA, 14 nt, Pseudomonas aeruginosa PA01
gccgcaguagaugc

SEQ ID NO: 1432886 - RNA, 21 nt, Pseudomonas aeruginosa PA01
gccgcaguagaugccgcgucg

SEQ ID NO: 1432887 - RNA, 22 nt, Pseudomonas aeruginosa PA01
gccgcagcccuaggcgacccgg

SEQ ID NO: 1432888 - RNA, 22 nt, Pseudomonas aeruginosa PA01
gccgcauuggccaggccccagg

SEQ ID NO: 1432889 - RNA, 20 nt, Pseudomonas aeruginosa PA01
gccgcccccagcgcgccgcc

SEQ ID NO: 1432890 - RNA, 21 nt, Pseudomonas aeruginosa PA01
gccgcccccagcgcgccgccg

SEQ ID NO: 1432891 - RNA, 15 nt, Pseudomonas aeruginosa PA01
gccgcccccagcgcg

SEQ ID NO: 1432892 - RNA, 18 nt, Pseudomonas aeruginosa PA01
gccgccccagccucggca

SEQ ID NO: 1432893 - RNA, 20 nt, Pseudomonas aeruginosa PA01
gccgcccaguucgcgcggag

SEQ ID NO: 1432894 - RNA, 14 nt, Pseudomonas aeruginosa PA01
gccgccccagcaac

SEQ ID NO: 1432895 - RNA, 15 nt, Pseudomonas aeruginosa PA01
gccgccccaccacca

SEQ ID NO: 1432896 - RNA, 20 nt, Pseudomonas aeruginosa PA01
gccgccccacgggucgucgc

SEQ ID NO: 1432897 - RNA, 22 nt, Pseudomonas aeruginosa PA01
gccgccccacgggucgucgccc

SEQ ID NO: 1432898 - RNA, 12 nt, Pseudomonas aeruginosa PA01
gccgcccagcac

SEQ ID NO: 1432899 - RNA, 17 nt, Pseudomonas aeruginosa PA01
gccgcccacgggcggcu

SEQ ID NO: 1432900 - RNA, 15 nt, Pseudomonas aeruginosa PA01
gccgccaucgccucg

SEQ ID NO: 1432901 - RNA, 17 nt, Pseudomonas aeruginosa PA01
gccgccaucgccucgcc

SEQ ID NO: 1432902 - RNA, 18 nt, Pseudomonas aeruginosa PA01
gccgccaucgccucgccg

SEQ ID NO: 1432903 - RNA, 20 nt, Pseudomonas aeruginosa PA01
gccgccaucgccucgccggc

SEQ ID NO: 1432904 - RNA, 22 nt, Pseudomonas aeruginosa PA01
gccgccaucgccucgccggcca

SEQ ID NO: 1432905 - RNA, 13 nt, Pseudomonas aeruginosa PA01
gccgccaucgccc

SEQ ID NO: 1432906 - RNA, 15 nt, Pseudomonas aeruginosa PA01
gccgccaugcucggc

SEQ ID NO: 1432907 - RNA, 17 nt, Pseudomonas aeruginosa PA01
gccgccagggcgucgga

SEQ ID NO: 1432908 - RNA, 14 nt, Pseudomonas aeruginosa PA01
gccgccagggucag

SEQ ID NO: 1432909 - RNA, 18 nt, Pseudomonas aeruginosa PA01
gccgccagggucagcucg

SEQ ID NO: 1432910 - RNA, 20 nt, Pseudomonas aeruginosa PA01
gccgccagggucagcucgac

SEQ ID NO: 1432911 - RNA, 15 nt, Pseudomonas aeruginosa PA01
gccgccagucggccu

SEQ ID NO: 1432912 - RNA, 17 nt, Pseudomonas aeruginosa PA01
gccgccagucggccugg

SEQ ID NO: 1432913 - RNA, 19 nt, Pseudomonas aeruginosa PA01
gccgccagucggccuggcu

SEQ ID NO: 1432914 - RNA, 16 nt, Pseudomonas aeruginosa PA01
gccgccaggacggcag

SEQ ID NO: 1432915 - RNA, 22 nt, Pseudomonas aeruginosa PA01
gccgccaggacggcagggucag

SEQ ID NO: 1432916 - RNA, 13 nt, Pseudomonas aeruginosa PA01
gccgccaggcugg

SEQ ID NO: 1432917 - RNA, 14 nt, Pseudomonas aeruginosa PA01
gccgccaggcggca

SEQ ID NO: 1432918 - RNA, 16 nt, Pseudomonas aeruginosa PA01
gccgccaggccucggc

SEQ ID NO: 1432919 - RNA, 18 nt, Pseudomonas aeruginosa PA01
gccgccaggccucggcgc

SEQ ID NO: 1432920 - RNA, 20 nt, Pseudomonas aeruginosa PA01
gccgccaggccucggcgcgg

SEQ ID NO: 1432921 - RNA, 23 nt, Pseudomonas aeruginosa PA01
gccgccaggccucggcgcgggcc

SEQ ID NO: 1432922 - RNA, 13 nt, Pseudomonas aeruginosa PA01
gccgccaggcgcg

SEQ ID NO: 1432923 - RNA, 17 nt, Pseudomonas aeruginosa PA01
gccgccaggcgcuggcg

SEQ ID NO: 1432924 - RNA, 18 nt, Pseudomonas aeruginosa PA01
gccgccaucaccagcggc

SEQ ID NO: 1432925 - RNA, 23 nt, Pseudomonas aeruginosa PA01
gccgccaucaccagcggcgagca

SEQ ID NO: 1432926 - RNA, 20 nt, Pseudomonas aeruginosa PA01
gccgccaggcccugggcggc

SEQ ID NO: 1432927 - RNA, 18 nt, Pseudomonas aeruginosa PA01
gccgccagguccgccugg

SEQ ID NO: 1432928 - RNA, 13 nt, Pseudomonas aeruginosa PA01
gccgccaguucgc

SEQ ID NO: 1432929 - RNA, 22 nt, Pseudomonas aeruginosa PA01
gccgccaguucgcgcaggugcu

SEQ ID NO: 1432930 - RNA, 17 nt, Pseudomonas aeruginosa PA01
gccgccaguucggccau

SEQ ID NO: 1432931 - RNA, 22 nt, Pseudomonas aeruginosa PA01
gccgccaguucggccaucagca

SEQ ID NO: 1432932 - RNA, 12 nt, Pseudomonas aeruginosa PA01
gccgcccgcuca

SEQ ID NO: 1432933 - RNA, 16 nt, Pseudomonas aeruginosa PA01
gccgcccgaggcgacc

SEQ ID NO: 1432934 - RNA, 19 nt, Pseudomonas aeruginosa PA01
gccgcccggcagcggcugg

SEQ ID NO: 1432935 - RNA, 22 nt, Pseudomonas aeruginosa PA01
gccgcccggcagcggcuggccg

SEQ ID NO: 1432936 - RNA, 16 nt, Pseudomonas aeruginosa PA01
gccgcccggccaggcc

SEQ ID NO: 1432937 - RNA, 17 nt, Pseudomonas aeruginosa PA01
gccgcccggccaggcca

SEQ ID NO: 1432938 - RNA, 20 nt, Pseudomonas aeruginosa PA01
gccgcccggccaggccacgg

SEQ ID NO: 1432939 - RNA, 15 nt, Pseudomonas aeruginosa PA01
gccgcccggccgcug

SEQ ID NO: 1432940 - RNA, 15 nt, Pseudomonas aeruginosa PA01
gccgcccgcgccucc

SEQ ID NO: 1432941 - RNA, 19 nt, Pseudomonas aeruginosa PA01
gccgcccgcgccuccaggc

SEQ ID NO: 1432942 - RNA, 22 nt, Pseudomonas aeruginosa PA01
gccgcccgcgccuccaggcgcg

SEQ ID NO: 1432943 - RNA, 14 nt, Pseudomonas aeruginosa PA01
gccgcccggucuag

SEQ ID NO: 1432944 - RNA, 23 nt, Pseudomonas aeruginosa PA01
gccgcccgguucguagaguucgc

SEQ ID NO: 1432945 - RNA, 14 nt, Pseudomonas aeruginosa PA01
gccgcccggcgcca

SEQ ID NO: 1432946 - RNA, 22 nt, Pseudomonas aeruginosa PA01
gccgcccggcucgccgccgggc

SEQ ID NO: 1432947 - RNA, 11 nt, Pseudomonas aeruginosa PA01
gccgcccuggg

SEQ ID NO: 1432948 - RNA, 18 nt, Pseudomonas aeruginosa PA01
gccgccgaaaugcugcag

SEQ ID NO: 1432949 - RNA, 11 nt, Pseudomonas aeruginosa PA01
gccgcccugga

SEQ ID NO: 1432950 - RNA, 13 nt, Pseudomonas aeruginosa PA01
gccgcccuggccg

SEQ ID NO: 1432951 - RNA, 14 nt, Pseudomonas aeruginosa PA01
gccgcccuggccga

SEQ ID NO: 1432952 - RNA, 16 nt, Pseudomonas aeruginosa PA01
gccgcccuggccgagc

SEQ ID NO: 1432953 - RNA, 23 nt, Pseudomonas aeruginosa PA01
gccgcccuggccgagcgggaagc

SEQ ID NO: 1432954 - RNA, 14 nt, Pseudomonas aeruginosa PA01
gccgcccuggccgc

SEQ ID NO: 1432955 - RNA, 22 nt, Pseudomonas aeruginosa PA01
gccgcccuguucgucuggcgcc

SEQ ID NO: 1432956 - RNA, 15 nt, Pseudomonas aeruginosa PA01
gccgcccgucgcgcc

SEQ ID NO: 1432957 - RNA, 17 nt, Pseudomonas aeruginosa PA01
gccgcccgucgcgccgg

SEQ ID NO: 1432958 - RNA, 18 nt, Pseudomonas aeruginosa PA01
gccgcccgucgcgccggc

SEQ ID NO: 1432959 - RNA, 21 nt, Pseudomonas aeruginosa PA01
gccgcccgucgcgccggccau

SEQ ID NO: 1432960 - RNA, 14 nt, Pseudomonas aeruginosa PA01
gccgcccucgggcc

SEQ ID NO: 1432961 - RNA, 17 nt, Pseudomonas aeruginosa PA01
gccgcccucgggccgca

SEQ ID NO: 1432962 - RNA, 20 nt, Pseudomonas aeruginosa PA01
gccgcccugcggcaggcgcc

SEQ ID NO: 1432963 - RNA, 17 nt, Pseudomonas aeruginosa PA01
gccgccgagaacccggc

SEQ ID NO: 1432964 - RNA, 20 nt, Pseudomonas aeruginosa PA01
gccgccgagaacccggccag

SEQ ID NO: 1432965 - RNA, 23 nt, Pseudomonas aeruginosa PA01
gccgccgagaacccggccaggcc

SEQ ID NO: 1432966 - RNA, 18 nt, Pseudomonas aeruginosa PA01
gccgccgagcaugcgggc

SEQ ID NO: 1432967 - RNA, 20 nt, Pseudomonas aeruginosa PA01
gccgccgagcaugcgggcga

SEQ ID NO: 1432968 - RNA, 21 nt, Pseudomonas aeruginosa PA01
gccgccgagcaugcgggcgau

SEQ ID NO: 1432969 - RNA, 23 nt, Pseudomonas aeruginosa PA01
gccgccgagcaugcgggcgaucu

SEQ ID NO: 1432970 - RNA, 11 nt, Pseudomonas aeruginosa PA01
gccgccgccca

SEQ ID NO: 1432971 - RNA, 14 nt, Pseudomonas aeruginosa PA01
gccgccgcccagca

SEQ ID NO: 1432972 - RNA, 15 nt, Pseudomonas aeruginosa PA01
gccgccgcccagcag

SEQ ID NO: 1432973 - RNA, 17 nt, Pseudomonas aeruginosa PA01
gccgccgagcaacugca

SEQ ID NO: 1432974 - RNA, 18 nt, Pseudomonas aeruginosa PA01
gccgccgcagccguggcg

SEQ ID NO: 1432975 - RNA, 14 nt, Pseudomonas aeruginosa PA01
gccgccgaccucgg

SEQ ID NO: 1432976 - RNA, 16 nt, Pseudomonas aeruginosa PA01
gccgccgacgccaugg

SEQ ID NO: 1432977 - RNA, 15 nt, Pseudomonas aeruginosa PA01
gccgccgacgccgga

SEQ ID NO: 1432978 - RNA, 13 nt, Pseudomonas aeruginosa PA01
gccgccgacgccg

SEQ ID NO: 1432979 - RNA, 22 nt, Pseudomonas aeruginosa PA01
gccgccgacgucguggauaggc

SEQ ID NO: 1432980 - RNA, 19 nt, Pseudomonas aeruginosa PA01
gccgccgaagccgacgccg

SEQ ID NO: 1432981 - RNA, 22 nt, Pseudomonas aeruginosa PA01
gccgccgaagccgacgccgagc

SEQ ID NO: 1432982 - RNA, 16 nt, Pseudomonas aeruginosa PA01
gccgccgacacccgcg

SEQ ID NO: 1432983 - RNA, 17 nt, Pseudomonas aeruginosa PA01
gccgccgacacccgcgc

SEQ ID NO: 1432984 - RNA, 18 nt, Pseudomonas aeruginosa PA01
gccgccgacacccgcgcc

SEQ ID NO: 1432985 - RNA, 19 nt, Pseudomonas aeruginosa PA01
gccgccgaacacgcacaau

SEQ ID NO: 1432986 - RNA, 23 nt, Pseudomonas aeruginosa PA01
gccgccgaagaacucggcgcugc

SEQ ID NO: 1432987 - RNA, 15 nt, Pseudomonas aeruginosa PA01
gccgagccggcaucc

SEQ ID NO: 1432988 - RNA, 15 nt, Pseudomonas aeruginosa PA01
gccgagcgacuccgg

SEQ ID NO: 1432989 - RNA, 22 nt, Pseudomonas aeruginosa PA01
gccgagcgacuccgggaacagc

SEQ ID NO: 1432990 - RNA, 20 nt, Pseudomonas aeruginosa PA01
gccgagcguugggccucgcu

SEQ ID NO: 1432991 - RNA, 23 nt, Pseudomonas aeruginosa PA01
gccgagcguugggccucgcugcg

SEQ ID NO: 1432992 - RNA, 14 nt, Pseudomonas aeruginosa PA01
gccgagcguggugc

SEQ ID NO: 1432993 - RNA, 21 nt, Pseudomonas aeruginosa PA01
gccgagcgugcgcaugcccgc

SEQ ID NO: 1432994 - RNA, 14 nt, Pseudomonas aeruginosa PA01
gccgagcgcagcgc

SEQ ID NO: 1432995 - RNA, 16 nt, Pseudomonas aeruginosa PA01
gccgagcgcagcgcca

SEQ ID NO: 1432996 - RNA, 21 nt, Pseudomonas aeruginosa PA01
gccgagcgcagcgccaccagg

SEQ ID NO: 1432997 - RNA, 13 nt, Pseudomonas aeruginosa PA01
gccgagcgccagg

SEQ ID NO: 1432998 - RNA, 16 nt, Pseudomonas aeruginosa PA01
gccgagcgccagggcc

SEQ ID NO: 1432999 - RNA, 18 nt, Pseudomonas aeruginosa PA01
gccgagcgccagggccag

SEQ ID NO: 1433000 - RNA, 20 nt, Pseudomonas aeruginosa PA01
gccgagcagggucacgccga

SEQ ID NO: 1433001 - RNA, 18 nt, Pseudomonas aeruginosa PA01
gccgagcaggugcaugua

SEQ ID NO: 1433002 - RNA, 13 nt, Pseudomonas aeruginosa PA01
gccgagcaggcca

SEQ ID NO: 1433003 - RNA, 19 nt, Pseudomonas aeruginosa PA01
gccgagcaggcgcgccagg

SEQ ID NO: 1433004 - RNA, 18 nt, Pseudomonas aeruginosa PA01
gccgagcaaccgcgaugg

SEQ ID NO: 1433005 - RNA, 17 nt, Pseudomonas aeruginosa PA01
gccgagcaccacgcgca

SEQ ID NO: 1433006 - RNA, 22 nt, Pseudomonas aeruginosa PA01
gccgagcagcgccagccagggu

SEQ ID NO: 1433007 - RNA, 17 nt, Pseudomonas aeruginosa PA01
gccgagcaacggcagca

SEQ ID NO: 1433008 - RNA, 16 nt, Pseudomonas aeruginosa PA01
gccgagcaacucggcg

SEQ ID NO: 1433009 - RNA, 17 nt, Pseudomonas aeruginosa PA01
gccgagcaacucggcgg

SEQ ID NO: 1433010 - RNA, 18 nt, Pseudomonas aeruginosa PA01
gccgagcaacucggcggc

SEQ ID NO: 1433011 - RNA, 20 nt, Pseudomonas aeruginosa PA01
gccgagcaacucggcggcga

SEQ ID NO: 1433012 - RNA, 17 nt, Pseudomonas aeruginosa PA01
gccgagcaagccuucca

SEQ ID NO: 1433013 - RNA, 16 nt, Pseudomonas aeruginosa PA01
gccgagcaauccggcg

SEQ ID NO: 1433014 - RNA, 19 nt, Pseudomonas aeruginosa PA01
gccgagcaauccggcgcug

SEQ ID NO: 1433015 - RNA, 14 nt, Pseudomonas aeruginosa PA01
gccgagcaucagcg

SEQ ID NO: 1433016 - RNA, 21 nt, Pseudomonas aeruginosa PA01
gccgagcauguaggcgcacca

SEQ ID NO: 1433017 - RNA, 23 nt, Pseudomonas aeruginosa PA01
gccgagcauguaggcgcaccagg

SEQ ID NO: 1433018 - RNA, 12 nt, Pseudomonas aeruginosa PA01
gccgagcccacc

SEQ ID NO: 1433019 - RNA, 16 nt, Pseudomonas aeruginosa PA01
gccgagcccagcggca

SEQ ID NO: 1433020 - RNA, 20 nt, Pseudomonas aeruginosa PA01
gccgagcccagcggcagggc

SEQ ID NO: 1433021 - RNA, 21 nt, Pseudomonas aeruginosa PA01
gccgagcccagcggcagggcg

SEQ ID NO: 1433022 - RNA, 20 nt, Pseudomonas aeruginosa PA01
gccgagcccccauaccgccu

SEQ ID NO: 1433023 - RNA, 22 nt, Pseudomonas aeruginosa PA01
gccgagcccccauaccgccucg

SEQ ID NO: 1433024 - RNA, 18 nt, Pseudomonas aeruginosa PA01
gccgagcccccggcgccc

SEQ ID NO: 1433025 - RNA, 19 nt, Pseudomonas aeruginosa PA01
gccgagcccccggcgccca

SEQ ID NO: 1433026 - RNA, 21 nt, Pseudomonas aeruginosa PA01
gccgagcccccggcgcccaga

SEQ ID NO: 1433027 - RNA, 20 nt, Pseudomonas aeruginosa PA01
gccgagcccgagugcgccca

SEQ ID NO: 1433028 - RNA, 12 nt, Pseudomonas aeruginosa PA01
gccgagccaggu

SEQ ID NO: 1433029 - RNA, 14 nt, Pseudomonas aeruginosa PA01
gccgagccagguac

SEQ ID NO: 1433030 - RNA, 16 nt, Pseudomonas aeruginosa PA01
gccgagccagccgcgg

SEQ ID NO: 1433031 - RNA, 19 nt, Pseudomonas aeruginosa PA01
gccgacuuccucgauggug

SEQ ID NO: 1433032 - RNA, 14 nt, Pseudomonas aeruginosa PA01
gccgacuucggcaa

SEQ ID NO: 1433033 - RNA, 15 nt, Pseudomonas aeruginosa PA01
gccgacuugcucauc

SEQ ID NO: 1433034 - RNA, 15 nt, Pseudomonas aeruginosa PA01
gccgagaaaccgcca

SEQ ID NO: 1433035 - RNA, 16 nt, Pseudomonas aeruginosa PA01
gccgagaacgcggcga

SEQ ID NO: 1433036 - RNA, 21 nt, Pseudomonas aeruginosa PA01
gccgagaacgcggcgaagggc

SEQ ID NO: 1433037 - RNA, 16 nt, Pseudomonas aeruginosa PA01
gccgagaagcagaacg

SEQ ID NO: 1433038 - RNA, 23 nt, Pseudomonas aeruginosa PA01
gccgagaagcagaacgccccgca

SEQ ID NO: 1433039 - RNA, 16 nt, Pseudomonas aeruginosa PA01
gccgagaacccggcca

SEQ ID NO: 1433040 - RNA, 19 nt, Pseudomonas aeruginosa PA01
gccgagauagcggcaacgc

SEQ ID NO: 1433041 - RNA, 15 nt, Pseudomonas aeruginosa PA01
gccgagaaucugccc

SEQ ID NO: 1433042 - RNA, 17 nt, Pseudomonas aeruginosa PA01
gccgagaaucugcccgg

SEQ ID NO: 1433043 - RNA, 21 nt, Pseudomonas aeruginosa PA01
gccgagaaucugcccggccau

SEQ ID NO: 1433044 - RNA, 19 nt, Pseudomonas aeruginosa PA01
gccgagacgaucagcagga

SEQ ID NO: 1433045 - RNA, 23 nt, Pseudomonas aeruginosa PA01
gccgacgucguggauaggcggcg

SEQ ID NO: 1433046 - RNA, 17 nt, Pseudomonas aeruginosa PA01
gccgacguccaucagcg

SEQ ID NO: 1433047 - RNA, 22 nt, Pseudomonas aeruginosa PA01
gccgacguccaucagcgucugc

SEQ ID NO: 1433048 - RNA, 22 nt, Pseudomonas aeruginosa PA01
gccgacgucacggauaggcggc

SEQ ID NO: 1433049 - RNA, 15 nt, Pseudomonas aeruginosa PA01
gccgacucgcgaucg

SEQ ID NO: 1433050 - RNA, 19 nt, Pseudomonas aeruginosa PA01
gccgacuuccaggcgcagg

SEQ ID NO: 1433051 - RNA, 16 nt, Pseudomonas aeruginosa PA01
gccgacugcaacuggc

SEQ ID NO: 1433052 - RNA, 21 nt, Pseudomonas aeruginosa PA01
gccgacugcaacuggccgaga

SEQ ID NO: 1433053 - RNA, 21 nt, Pseudomonas aeruginosa PA01
gccgacugcgguuuuccugcc

SEQ ID NO: 1433054 - RNA, 21 nt, Pseudomonas aeruginosa PA01
gccgacuggcgguacgcugca

SEQ ID NO: 1433055 - RNA, 18 nt, Pseudomonas aeruginosa PA01
gccgacuagaucgggauc

SEQ ID NO: 1433056 - RNA, 18 nt, Pseudomonas aeruginosa PA01
gccgauaccggccucgau

SEQ ID NO: 1433057 - RNA, 13 nt, Pseudomonas aeruginosa PA01
gccgauacccugg

SEQ ID NO: 1433058 - RNA, 23 nt, Pseudomonas aeruginosa PA01
gccgauacccugggagccgccgg

SEQ ID NO: 1433059 - RNA, 14 nt, Pseudomonas aeruginosa PA01
gccgaucaccuggc

SEQ ID NO: 1433060 - RNA, 20 nt, Pseudomonas aeruginosa PA01
gccgaucaccuucaccggca

SEQ ID NO: 1433061 - RNA, 23 nt, Pseudomonas aeruginosa PA01
gccgauauugaacgacucgucgc

SEQ ID NO: 1433062 - RNA, 16 nt, Pseudomonas aeruginosa PA01
gccgaucagcccgucg

SEQ ID NO: 1433063 - RNA, 17 nt, Pseudomonas aeruginosa PA01
gccgaucagcccgucgg

SEQ ID NO: 1433064 - RNA, 18 nt, Pseudomonas aeruginosa PA01
gccgaucagcccgucggc

SEQ ID NO: 1433065 - RNA, 16 nt, Pseudomonas aeruginosa PA01
gccgaucagcgcgccu

SEQ ID NO: 1433066 - RNA, 14 nt, Pseudomonas aeruginosa PA01
gccgaucagcggcg

SEQ ID NO: 1433067 - RNA, 13 nt, Pseudomonas aeruginosa PA01
gccgaucagcggc

SEQ ID NO: 1433068 - RNA, 22 nt, Pseudomonas aeruginosa PA01
gccgaucaggauguggccgucg

SEQ ID NO: 1433069 - RNA, 17 nt, Pseudomonas aeruginosa PA01
gccgaucagcggcgguc

SEQ ID NO: 1433070 - RNA, 19 nt, Pseudomonas aeruginosa PA01
gccgaucaucggcuggucg

SEQ ID NO: 1433071 - RNA, 19 nt, Pseudomonas aeruginosa PA01
gccgaucaucuucuggaca

SEQ ID NO: 1433072 - RNA, 21 nt, Pseudomonas aeruginosa PA01
gccgaucaguggucgcagcuc

SEQ ID NO: 1433073 - RNA, 13 nt, Pseudomonas aeruginosa PA01
gccgaucaggcgu

SEQ ID NO: 1433074 - RNA, 19 nt, Pseudomonas aeruginosa PA01
gccgaucaggcguaggccg

SEQ ID NO: 1433075 - RNA, 21 nt, Pseudomonas aeruginosa PA01
gccgaucaggcguaggccguc

SEQ ID NO: 1433076 - RNA, 23 nt, Pseudomonas aeruginosa PA01
gccgaucaggcugaagcggccgc

SEQ ID NO: 1433077 - RNA, 23 nt, Pseudomonas aeruginosa PA01
gccgaucccgacgcccuccagca

SEQ ID NO: 1433078 - RNA, 14 nt, Pseudomonas aeruginosa PA01
gccgauccaggcgu

SEQ ID NO: 1433079 - RNA, 16 nt, Pseudomonas aeruginosa PA01
gccgagggugaucagc

SEQ ID NO: 1433080 - RNA, 20 nt, Pseudomonas aeruginosa PA01
gccgagggugaucagccgag

SEQ ID NO: 1433081 - RNA, 15 nt, Pseudomonas aeruginosa PA01
gccgaggucgccgcc

SEQ ID NO: 1433082 - RNA, 18 nt, Pseudomonas aeruginosa PA01
gccgaggucgccgccagc

SEQ ID NO: 1433083 - RNA, 19 nt, Pseudomonas aeruginosa PA01
gccgagguaguaggucugg

SEQ ID NO: 1433084 - RNA, 21 nt, Pseudomonas aeruginosa PA01
gccgagcuugaccuugccgcc

SEQ ID NO: 1433085 - RNA, 22 nt, Pseudomonas aeruginosa PA01
gccgagcuugaccuugccgccg

SEQ ID NO: 1433086 - RNA, 13 nt, Pseudomonas aeruginosa PA01
gccgagcugacca

SEQ ID NO: 1433087 - RNA, 18 nt, Pseudomonas aeruginosa PA01
gccgagcugaccaccagg

SEQ ID NO: 1433088 - RNA, 20 nt, Pseudomonas aeruginosa PA01
gccgagcugaccaccagggc

SEQ ID NO: 1433089 - RNA, 21 nt, Pseudomonas aeruginosa PA01
gccgagcugaccaccagggcg

SEQ ID NO: 1433090 - RNA, 19 nt, Pseudomonas aeruginosa PA01
gccgagcugccgcaccgcc

SEQ ID NO: 1433091 - RNA, 15 nt, Pseudomonas aeruginosa PA01
gccgagcugcucgaa

SEQ ID NO: 1433092 - RNA, 22 nt, Pseudomonas aeruginosa PA01
gccgagcugcucgaagcaauac

SEQ ID NO: 1433093 - RNA, 12 nt, Pseudomonas aeruginosa PA01
gccgagggcgcg

SEQ ID NO: 1433094 - RNA, 16 nt, Pseudomonas aeruginosa PA01
gccgagggcgcgcagu

SEQ ID NO: 1433095 - RNA, 14 nt, Pseudomonas aeruginosa PA01
gccgagggcgcggc

SEQ ID NO: 1433096 - RNA, 18 nt, Pseudomonas aeruginosa PA01
gccgagggcgcggcgcca

SEQ ID NO: 1433097 - RNA, 19 nt, Pseudomonas aeruginosa PA01
gccgagggcgcggcgccag

SEQ ID NO: 1433098 - RNA, 14 nt, Pseudomonas aeruginosa PA01
gccgagggcugccg

SEQ ID NO: 1433099 - RNA, 18 nt, Pseudomonas aeruginosa PA01
gccgagggcugccgcccg

SEQ ID NO: 1433100 - RNA, 19 nt, Pseudomonas aeruginosa PA01
gccgagggcugccgcccgg

SEQ ID NO: 1433101 - RNA, 15 nt, Pseudomonas aeruginosa PA01
gccgauacagcgcgc

SEQ ID NO: 1433102 - RNA, 18 nt, Pseudomonas aeruginosa PA01
gccgauacagcgcgcgau

SEQ ID NO: 1433103 - RNA, 17 nt, Pseudomonas aeruginosa PA01
gccgaguggccgaaggc

SEQ ID NO: 1433104 - RNA, 15 nt, Pseudomonas aeruginosa PA01
gccgaguggccgcug

SEQ ID NO: 1433105 - RNA, 16 nt, Pseudomonas aeruginosa PA01
gccgaguggccgcuga

SEQ ID NO: 1433106 - RNA, 19 nt, Pseudomonas aeruginosa PA01
gccgaguggccgcugagca

SEQ ID NO: 1433107 - RNA, 23 nt, Pseudomonas aeruginosa PA01
gccgaguuggaaccaguugccga

SEQ ID NO: 1433108 - RNA, 16 nt, Pseudomonas aeruginosa PA01
gccgaggucgucgcug

SEQ ID NO: 1433109 - RNA, 16 nt, Pseudomonas aeruginosa PA01
gccgaggucgcgggcc

SEQ ID NO: 1433110 - RNA, 23 nt, Pseudomonas aeruginosa PA01
gccgaggucgcgggccaggcccu

SEQ ID NO: 1433111 - RNA, 13 nt, Pseudomonas aeruginosa PA01
gccgaggugcggc

SEQ ID NO: 1433112 - RNA, 14 nt, Pseudomonas aeruginosa PA01
gccgaggugcggcu

SEQ ID NO: 1433113 - RNA, 23 nt, Pseudomonas aeruginosa PA01
gccgaggugcggcuugcguucgc

SEQ ID NO: 1433114 - RNA, 23 nt, Pseudomonas aeruginosa PA01
gccgaggucuuggccagccgcgc

SEQ ID NO: 1433115 - RNA, 12 nt, Pseudomonas aeruginosa PA01
gccgaguucgcg

SEQ ID NO: 1433116 - RNA, 14 nt, Pseudomonas aeruginosa PA01
gccgaguucgcgca

SEQ ID NO: 1433117 - RNA, 16 nt, Pseudomonas aeruginosa PA01
gccgaguucgcgcagg

SEQ ID NO: 1433118 - RNA, 21 nt, Pseudomonas aeruginosa PA01
gccgaguucgcgcaggcgcug

SEQ ID NO: 1433119 - RNA, 22 nt, Pseudomonas aeruginosa PA01
gccgacgcgcugccccuggcuc

SEQ ID NO: 1433120 - RNA, 13 nt, Pseudomonas aeruginosa PA01
gccgacgcgcagc

SEQ ID NO: 1433121 - RNA, 21 nt, Pseudomonas aeruginosa PA01
gccgacguagggcaucgccga

SEQ ID NO: 1433122 - RNA, 15 nt, Pseudomonas aeruginosa PA01
gccgacguagccgcg

SEQ ID NO: 1433123 - RNA, 17 nt, Pseudomonas aeruginosa PA01
gccgacguccuccagga

SEQ ID NO: 1433124 - RNA, 18 nt, Pseudomonas aeruginosa PA01
gccgacguccuccaggac

SEQ ID NO: 1433125 - RNA, 19 nt, Pseudomonas aeruginosa PA01
gccgacguccuccaggacc

SEQ ID NO: 1433126 - RNA, 20 nt, Pseudomonas aeruginosa PA01
gccgacguccuccaggacca

SEQ ID NO: 1433127 - RNA, 21 nt, Pseudomonas aeruginosa PA01
gccgacguccuccaggaccag

SEQ ID NO: 1433128 - RNA, 22 nt, Pseudomonas aeruginosa PA01
gccgacguccuccaggaccagg

SEQ ID NO: 1433129 - RNA, 21 nt, Pseudomonas aeruginosa PA01
gccgaccgugagcuuguccag

SEQ ID NO: 1433130 - RNA, 20 nt, Pseudomonas aeruginosa PA01
gccgacgauccggccgaucu

SEQ ID NO: 1433131 - RNA, 18 nt, Pseudomonas aeruginosa PA01
gccgacgauguucgaggc

SEQ ID NO: 1433132 - RNA, 23 nt, Pseudomonas aeruginosa PA01
gccgacgauguucgaggcgccga

SEQ ID NO: 1433133 - RNA, 16 nt, Pseudomonas aeruginosa PA01
gccgacgccaccagcc

SEQ ID NO: 1433134 - RNA, 21 nt, Pseudomonas aeruginosa PA01
gccgacgccaccagccaggcg

SEQ ID NO: 1433135 - RNA, 21 nt, Pseudomonas aeruginosa PA01
gccgacgcccgcagccagccu

SEQ ID NO: 1433136 - RNA, 17 nt, Pseudomonas aeruginosa PA01
aagauccgcuccaggcu

SEQ ID NO: 1433137 - RNA, 18 nt, Pseudomonas aeruginosa PA01
aagaucgccugcuggccg

SEQ ID NO: 1433138 - RNA, 21 nt, Pseudomonas aeruginosa PA01
gccgaccaccuucaggcugcu

SEQ ID NO: 1433139 - RNA, 23 nt, Pseudomonas aeruginosa PA01
gccgaccaccuucaggcugcuca

SEQ ID NO: 1433140 - RNA, 20 nt, Pseudomonas aeruginosa PA01
gccgaccacgaccgcgucca

SEQ ID NO: 1433141 - RNA, 18 nt, Pseudomonas aeruginosa PA01
gccgacaagccuccagcg

SEQ ID NO: 1433142 - RNA, 22 nt, Pseudomonas aeruginosa PA01
gccgacaagccuccagcgccgc

SEQ ID NO: 1433143 - RNA, 17 nt, Pseudomonas aeruginosa PA01
gccgaccacaugggcga

SEQ ID NO: 1433144 - RNA, 19 nt, Pseudomonas aeruginosa PA01
gccgaccacaugggcgacc

SEQ ID NO: 1433145 - RNA, 20 nt, Pseudomonas aeruginosa PA01
gccgaccacaugggcgaccg

SEQ ID NO: 1433146 - RNA, 21 nt, Pseudomonas aeruginosa PA01
gccgaccacaugggcgaccgg

SEQ ID NO: 1433147 - RNA, 16 nt, Pseudomonas aeruginosa PA01
gccgaccagcgccgac

SEQ ID NO: 1433148 - RNA, 16 nt, Pseudomonas aeruginosa PA01
gccgacccgugcgccg

SEQ ID NO: 1433149 - RNA, 23 nt, Pseudomonas aeruginosa PA01
gccgaccagcagggccagcagcg

SEQ ID NO: 1433150 - RNA, 16 nt, Pseudomonas aeruginosa PA01
gccgaccagcacggcg

SEQ ID NO: 1433151 - RNA, 16 nt, Pseudomonas aeruginosa PA01
gccgaccgacuggccg

SEQ ID NO: 1433152 - RNA, 13 nt, Pseudomonas aeruginosa PA01
gccgaccgagcag

SEQ ID NO: 1433153 - RNA, 19 nt, Pseudomonas aeruginosa PA01
gccgaccgagcagcggacg

SEQ ID NO: 1433154 - RNA, 19 nt, Pseudomonas aeruginosa PA01
gccgacccuagggucggcg

SEQ ID NO: 1433155 - RNA, 20 nt, Pseudomonas aeruginosa PA01
gccgacccuagggucggcgu

SEQ ID NO: 1433156 - RNA, 19 nt, Pseudomonas aeruginosa PA01
gccgacccugcacccuugg

SEQ ID NO: 1433157 - RNA, 17 nt, Pseudomonas aeruginosa PA01
gccgaccguccgccugc

SEQ ID NO: 1433158 - RNA, 18 nt, Pseudomonas aeruginosa PA01
gccgaccguccgccugcg

SEQ ID NO: 1433159 - RNA, 17 nt, Pseudomonas aeruginosa PA01
gccgaccucggcgguca

SEQ ID NO: 1433160 - RNA, 14 nt, Pseudomonas aeruginosa PA01
gccgaccucggccg

SEQ ID NO: 1433161 - RNA, 15 nt, Pseudomonas aeruginosa PA01
gccgaccucggccgc

SEQ ID NO: 1433162 - RNA, 17 nt, Pseudomonas aeruginosa PA01
gccgaccucggccgcca

SEQ ID NO: 1433163 - RNA, 19 nt, Pseudomonas aeruginosa PA01
gccgaccucggccgccagg

SEQ ID NO: 1433164 - RNA, 15 nt, Pseudomonas aeruginosa PA01
gccgaccugcccgcu

SEQ ID NO: 1433165 - RNA, 16 nt, Pseudomonas aeruginosa PA01
gccgaagccuucgucg

SEQ ID NO: 1433166 - RNA, 18 nt, Pseudomonas aeruginosa PA01
gccgaagccuucgucgau

SEQ ID NO: 1433167 - RNA, 12 nt, Pseudomonas aeruginosa PA01
gccgaagcgcuc

SEQ ID NO: 1433168 - RNA, 22 nt, Pseudomonas aeruginosa PA01
gccgaagcgcucggucagcucc

SEQ ID NO: 1433169 - RNA, 13 nt, Pseudomonas aeruginosa PA01
gccgaagcggggc

SEQ ID NO: 1433170 - RNA, 15 nt, Pseudomonas aeruginosa PA01
gccgaauccgccggc

SEQ ID NO: 1433171 - RNA, 16 nt, Pseudomonas aeruginosa PA01
gccgaauccgccggcg

SEQ ID NO: 1433172 - RNA, 17 nt, Pseudomonas aeruginosa PA01
gccgaauccgccggcga

SEQ ID NO: 1433173 - RNA, 20 nt, Pseudomonas aeruginosa PA01
gccgaauccgccggcgaugc

SEQ ID NO: 1433174 - RNA, 14 nt, Pseudomonas aeruginosa PA01
gccgaagcgugggc

SEQ ID NO: 1433175 - RNA, 20 nt, Pseudomonas aeruginosa PA01
gccgaagcgugggcggccgg

SEQ ID NO: 1433176 - RNA, 16 nt, Pseudomonas aeruginosa PA01
gccgaauccuccagcc

SEQ ID NO: 1433177 - RNA, 20 nt, Pseudomonas aeruginosa PA01
gccgaauccuccagccggcg

SEQ ID NO: 1433178 - RNA, 15 nt, Pseudomonas aeruginosa PA01
gccgaaucgaacagg

SEQ ID NO: 1433179 - RNA, 16 nt, Pseudomonas aeruginosa PA01
gccgaaucgaacaggg

SEQ ID NO: 1433180 - RNA, 17 nt, Pseudomonas aeruginosa PA01
gccgaaucgaacagggc

SEQ ID NO: 1433181 - RNA, 18 nt, Pseudomonas aeruginosa PA01
gccgaaucgaacagggcg

SEQ ID NO: 1433182 - RNA, 20 nt, Pseudomonas aeruginosa PA01
gccgaacucacggaugccgg

SEQ ID NO: 1433183 - RNA, 15 nt, Pseudomonas aeruginosa PA01
gccgaacuccgccag

SEQ ID NO: 1433184 - RNA, 15 nt, Pseudomonas aeruginosa PA01
gccgaagccgacgcc

SEQ ID NO: 1433185 - RNA, 20 nt, Pseudomonas aeruginosa PA01
gccgaagccgacgccgagca

SEQ ID NO: 1433186 - RNA, 17 nt, Pseudomonas aeruginosa PA01
gccgaagcccgugucgc

SEQ ID NO: 1433187 - RNA, 14 nt, Pseudomonas aeruginosa PA01
gccgaagccgccgg

SEQ ID NO: 1433188 - RNA, 16 nt, Pseudomonas aeruginosa PA01
gccgaacgccaccagg

SEQ ID NO: 1433189 - RNA, 18 nt, Pseudomonas aeruginosa PA01
gccgaacgguagguagcg

SEQ ID NO: 1433190 - RNA, 19 nt, Pseudomonas aeruginosa PA01
gccgaacgguagguagcgu

SEQ ID NO: 1433191 - RNA, 23 nt, Pseudomonas aeruginosa PA01
gccgaacgguagguagcguugcg

SEQ ID NO: 1433192 - RNA, 16 nt, Pseudomonas aeruginosa PA01
gccgaacgggaaguag

SEQ ID NO: 1433193 - RNA, 23 nt, Pseudomonas aeruginosa PA01
gcccuccaaagaaaagcccggcc

SEQ ID NO: 1433194 - RNA, 12 nt, Pseudomonas aeruginosa PA01
gcccuccagcac

SEQ ID NO: 1433195 - RNA, 22 nt, Pseudomonas aeruginosa PA01
gcccuccagcaccgccuggcgc

SEQ ID NO: 1433196 - RNA, 19 nt, Pseudomonas aeruginosa PA01
gcccucagcggcggugcgc

SEQ ID NO: 1433197 - RNA, 15 nt, Pseudomonas aeruginosa PA01
gcccucagcagcgcc

SEQ ID NO: 1433198 - RNA, 12 nt, Pseudomonas aeruginosa PA01
gcccuccccugg

SEQ ID NO: 1433199 - RNA, 13 nt, Pseudomonas aeruginosa PA01
gccgaaagcacug

SEQ ID NO: 1433200 - RNA, 21 nt, Pseudomonas aeruginosa PA01
gccgaaagcacugcggcgguc

SEQ ID NO: 1433201 - RNA, 22 nt, Pseudomonas aeruginosa PA01
gccgaaagcacugcggcggucc

SEQ ID NO: 1433202 - RNA, 16 nt, Pseudomonas aeruginosa PA01
gccgaaccgccucaga

SEQ ID NO: 1433203 - RNA, 18 nt, Pseudomonas aeruginosa PA01
gccgaacaguucggcggu

SEQ ID NO: 1433204 - RNA, 19 nt, Pseudomonas aeruginosa PA01
gccgaacaguucggcggug

SEQ ID NO: 1433205 - RNA, 21 nt, Pseudomonas aeruginosa PA01
gccgaacaguucggcggugga

SEQ ID NO: 1433206 - RNA, 20 nt, Pseudomonas aeruginosa PA01
gccgaaaucgaugucgcggc

SEQ ID NO: 1433207 - RNA, 20 nt, Pseudomonas aeruginosa PA01
gccgaaaggccguuguagag

SEQ ID NO: 1433208 - RNA, 16 nt, Pseudomonas aeruginosa PA01
gccgaaauagcgcgcc

SEQ ID NO: 1433209 - RNA, 19 nt, Pseudomonas aeruginosa PA01
gccgaaaugcugcaggccg

SEQ ID NO: 1433210 - RNA, 24 nt, Pseudomonas aeruginosa PA01
gccgaaauggcgguggccgugggc

SEQ ID NO: 1433211 - RNA, 16 nt, Pseudomonas aeruginosa PA01
gccgaaauugaccagg

SEQ ID NO: 1433212 - RNA, 22 nt, Pseudomonas aeruginosa PA01
gcccguggcuggggccggccug

SEQ ID NO: 1433213 - RNA, 23 nt, Pseudomonas aeruginosa PA01
gcccguggcuggggccggccugg

SEQ ID NO: 1433214 - RNA, 22 nt, Pseudomonas aeruginosa PA01
gcccgugggaucgccacgccgg

SEQ ID NO: 1433215 - RNA, 21 nt, Pseudomonas aeruginosa PA01
gcccgugucgccuuccggcag

SEQ ID NO: 1433216 - RNA, 21 nt, Pseudomonas aeruginosa PA01
gcccgugggguauuccaggcg

SEQ ID NO: 1433217 - RNA, 20 nt, Pseudomonas aeruginosa PA01
gcccgugguagucgagccgg

SEQ ID NO: 1433218 - RNA, 21 nt, Pseudomonas aeruginosa PA01
gcccgugguagucgagccgga

SEQ ID NO: 1433219 - RNA, 19 nt, Pseudomonas aeruginosa PA01
gcccguguucggccagccg

SEQ ID NO: 1433220 - RNA, 24 nt, Pseudomonas aeruginosa PA01
gcccguguucggccagccggcgcc

SEQ ID NO: 1433221 - RNA, 20 nt, Pseudomonas aeruginosa PA01
gcccguuccaccgccuggac

SEQ ID NO: 1433222 - RNA, 15 nt, Pseudomonas aeruginosa PA01
gcccgugcccguccu

SEQ ID NO: 1433223 - RNA, 12 nt, Pseudomonas aeruginosa PA01
gcccgugccgac

SEQ ID NO: 1433224 - RNA, 13 nt, Pseudomonas aeruginosa PA01
gcccgugccgacu

SEQ ID NO: 1433225 - RNA, 13 nt, Pseudomonas aeruginosa PA01
gcccguggcaggu

SEQ ID NO: 1433226 - RNA, 15 nt, Pseudomonas aeruginosa PA01
gcccguggcagguga

SEQ ID NO: 1433227 - RNA, 14 nt, Pseudomonas aeruginosa PA01
gcccgugcggcacg

SEQ ID NO: 1433228 - RNA, 15 nt, Pseudomonas aeruginosa PA01
gcccgugcggcacgc

SEQ ID NO: 1433229 - RNA, 20 nt, Pseudomonas aeruginosa PA01
gcccuacagcccccccagca

SEQ ID NO: 1433230 - RNA, 18 nt, Pseudomonas aeruginosa PA01
gcccuacccgacaggcag

SEQ ID NO: 1433231 - RNA, 22 nt, Pseudomonas aeruginosa PA01
gcccuacccgacaggcagcgcc

SEQ ID NO: 1433232 - RNA, 19 nt, Pseudomonas aeruginosa PA01
gcccucaagucuccagcga

SEQ ID NO: 1433233 - RNA, 22 nt, Pseudomonas aeruginosa PA01
gcccuaccgcccacccugcgcg

SEQ ID NO: 1433234 - RNA, 19 nt, Pseudomonas aeruginosa PA01
gcccuacgaaagcggugcc

SEQ ID NO: 1433235 - RNA, 17 nt, Pseudomonas aeruginosa PA01
gcccuacgcaacccgcc

SEQ ID NO: 1433236 - RNA, 18 nt, Pseudomonas aeruginosa PA01
gcccuacgcaacccgccc

SEQ ID NO: 1433237 - RNA, 22 nt, Pseudomonas aeruginosa PA01
gcccuacggaccggugccccgc

SEQ ID NO: 1433238 - RNA, 18 nt, Pseudomonas aeruginosa PA01
gcccuacggccccaggcu

SEQ ID NO: 1433239 - RNA, 19 nt, Pseudomonas aeruginosa PA01
gcccuacggggcgugucga

SEQ ID NO: 1433240 - RNA, 15 nt, Pseudomonas aeruginosa PA01
gcccgucggccucgc

SEQ ID NO: 1433241 - RNA, 17 nt, Pseudomonas aeruginosa PA01
gcccgucggccucgccg

SEQ ID NO: 1433242 - RNA, 19 nt, Pseudomonas aeruginosa PA01
gcccgucgucguggcgaac

SEQ ID NO: 1433243 - RNA, 16 nt, Pseudomonas aeruginosa PA01
gcccgucuagcgcagg

SEQ ID NO: 1433244 - RNA, 18 nt, Pseudomonas aeruginosa PA01
gcccgucuagcgcaggcg

SEQ ID NO: 1433245 - RNA, 13 nt, Pseudomonas aeruginosa PA01
gcccgucggccuc

SEQ ID NO: 1433246 - RNA, 15 nt, Pseudomonas aeruginosa PA01
gcccgucgaccauca

SEQ ID NO: 1433247 - RNA, 22 nt, Pseudomonas aeruginosa PA01
gcccgucgaagaucaccggggc

SEQ ID NO: 1433248 - RNA, 19 nt, Pseudomonas aeruginosa PA01
gcccgucgaagccaggcac

SEQ ID NO: 1433249 - RNA, 20 nt, Pseudomonas aeruginosa PA01
gcccgucgaagccaggcacc

SEQ ID NO: 1433250 - RNA, 16 nt, Pseudomonas aeruginosa PA01
gcccgucgcgccggcc

SEQ ID NO: 1433251 - RNA, 17 nt, Pseudomonas aeruginosa PA01
gcccgucgcgccggcca

SEQ ID NO: 1433252 - RNA, 18 nt, Pseudomonas aeruginosa PA01
gcccgucgcgccggccau

SEQ ID NO: 1433253 - RNA, 14 nt, Pseudomonas aeruginosa PA01
gcccgucgcgcgcc

SEQ ID NO: 1433254 - RNA, 20 nt, Pseudomonas aeruginosa PA01
gcccguccgucccacaggcc

SEQ ID NO: 1433255 - RNA, 22 nt, Pseudomonas aeruginosa PA01
gcccguccgucccacaggccgg

SEQ ID NO: 1433256 - RNA, 12 nt, Pseudomonas aeruginosa PA01
gcccgucaggcc

SEQ ID NO: 1433257 - RNA, 22 nt, Pseudomonas aeruginosa PA01
gcccgucaugaccagagccgcc

SEQ ID NO: 1433258 - RNA, 15 nt, Pseudomonas aeruginosa PA01
gcccgguuggccagg

SEQ ID NO: 1433259 - RNA, 17 nt, Pseudomonas aeruginosa PA01
gcccgguuggccaggac

SEQ ID NO: 1433260 - RNA, 18 nt, Pseudomonas aeruginosa PA01
gcccgguuggccaggacc

SEQ ID NO: 1433261 - RNA, 20 nt, Pseudomonas aeruginosa PA01
gcccgguucguagaguucgc

SEQ ID NO: 1433262 - RNA, 21 nt, Pseudomonas aeruginosa PA01
gcccgguucguagaguucgcu

SEQ ID NO: 1433263 - RNA, 15 nt, Pseudomonas aeruginosa PA01
gcccgguugccuucg

SEQ ID NO: 1433264 - RNA, 21 nt, Pseudomonas aeruginosa PA01
gcccgguugccuucgucgcug

SEQ ID NO: 1433265 - RNA, 20 nt, Pseudomonas aeruginosa PA01
gcccgguugagauccuggcc

SEQ ID NO: 1433266 - RNA, 23 nt, Pseudomonas aeruginosa PA01
gcccgguugagauccuggccggc

SEQ ID NO: 1433267 - RNA, 19 nt, Pseudomonas aeruginosa PA01
gcccgguggaauaccgcug

SEQ ID NO: 1433268 - RNA, 21 nt, Pseudomonas aeruginosa PA01
gcccgguggaauaccgcugcg

SEQ ID NO: 1433269 - RNA, 22 nt, Pseudomonas aeruginosa PA01
gcccgguggaggucugccacca

SEQ ID NO: 1433270 - RNA, 22 nt, Pseudomonas aeruginosa PA01
gcccgguggccuccugcaacgc

SEQ ID NO: 1433271 - RNA, 17 nt, Pseudomonas aeruginosa PA01
gcccgguucagcgggac

SEQ ID NO: 1433272 - RNA, 17 nt, Pseudomonas aeruginosa PA01
gcccggugucgacgacg

SEQ ID NO: 1433273 - RNA, 19 nt, Pseudomonas aeruginosa PA01
gcccggugucgacgacgaa

SEQ ID NO: 1433274 - RNA, 18 nt, Pseudomonas aeruginosa PA01
gcccgguggggcgggcga

SEQ ID NO: 1433275 - RNA, 19 nt, Pseudomonas aeruginosa PA01
gcccgguggggcgggcgaa

SEQ ID NO: 1433276 - RNA, 21 nt, Pseudomonas aeruginosa PA01
gcccguaccaagcgagacgcc

SEQ ID NO: 1433277 - RNA, 14 nt, Pseudomonas aeruginosa PA01
gcccguagggcgaa

SEQ ID NO: 1433278 - RNA, 18 nt, Pseudomonas aeruginosa PA01
gcccguagggcgaacaac

SEQ ID NO: 1433279 - RNA, 21 nt, Pseudomonas aeruginosa PA01
gcccguagggcgaacaacgcc

SEQ ID NO: 1433280 - RNA, 14 nt, Pseudomonas aeruginosa PA01
gcccggucuagccg

SEQ ID NO: 1433281 - RNA, 15 nt, Pseudomonas aeruginosa PA01
gcccggucuagccgg

SEQ ID NO: 1433282 - RNA, 17 nt, Pseudomonas aeruginosa PA01
gcccggucuagccgggc

SEQ ID NO: 1433283 - RNA, 19 nt, Pseudomonas aeruginosa PA01
gcccggucuagcgccccgg

SEQ ID NO: 1433284 - RNA, 20 nt, Pseudomonas aeruginosa PA01
gcccggucucagccggcgcu

SEQ ID NO: 1433285 - RNA, 15 nt, Pseudomonas aeruginosa PA01
gcccggucaccaccc

SEQ ID NO: 1433286 - RNA, 17 nt, Pseudomonas aeruginosa PA01
gcccggucacgccggga

SEQ ID NO: 1433287 - RNA, 22 nt, Pseudomonas aeruginosa PA01
gcccggucagcuucgccgcccu

SEQ ID NO: 1433288 - RNA, 21 nt, Pseudomonas aeruginosa PA01
gcccggucagguuggacaggu

SEQ ID NO: 1433289 - RNA, 17 nt, Pseudomonas aeruginosa PA01
gcccggggcucugccgg

SEQ ID NO: 1433290 - RNA, 20 nt, Pseudomonas aeruginosa PA01
gcccggggcucugccggugu

SEQ ID NO: 1433291 - RNA, 23 nt, Pseudomonas aeruginosa PA01
gcccgggguauggccuucgcuga

SEQ ID NO: 1433292 - RNA, 17 nt, Pseudomonas aeruginosa PA01
gcccgggguuggcgcug

SEQ ID NO: 1433293 - RNA, 21 nt, Pseudomonas aeruginosa PA01
gcccgggguuggcgcugacca

SEQ ID NO: 1433294 - RNA, 20 nt, Pseudomonas aeruginosa PA01
gcccgggucgucggucggcc

SEQ ID NO: 1433295 - RNA, 22 nt, Pseudomonas aeruginosa PA01
gcccgggcgccaccgauagcgg

SEQ ID NO: 1433296 - RNA, 22 nt, Pseudomonas aeruginosa PA01
gcccgggaucgaugcgcgcccu

SEQ ID NO: 1433297 - RNA, 18 nt, Pseudomonas aeruginosa PA01
gcccggcugguugccagc

SEQ ID NO: 1433298 - RNA, 20 nt, Pseudomonas aeruginosa PA01
gcccggcugguugccagcag

SEQ ID NO: 1433299 - RNA, 23 nt, Pseudomonas aeruginosa PA01
gcccggcugguugccagcagcgc

SEQ ID NO: 1433300 - RNA, 16 nt, Pseudomonas aeruginosa PA01
gcccggcugugcucga

SEQ ID NO: 1433301 - RNA, 14 nt, Pseudomonas aeruginosa PA01
gcccgggcaacugc

SEQ ID NO: 1433302 - RNA, 18 nt, Pseudomonas aeruginosa PA01
gcccgggcaacugccgau

SEQ ID NO: 1433303 - RNA, 19 nt, Pseudomonas aeruginosa PA01
gcccgggcaacugccgaug

SEQ ID NO: 1433304 - RNA, 19 nt, Pseudomonas aeruginosa PA01
gcccggcgcuuguugaugg

SEQ ID NO: 1433305 - RNA, 19 nt, Pseudomonas aeruginosa PA01
gcccggcgcaugccgcagg

SEQ ID NO: 1433306 - RNA, 13 nt, Pseudomonas aeruginosa PA01
gcccggcgcugcu

SEQ ID NO: 1433307 - RNA, 18 nt, Pseudomonas aeruginosa PA01
gcccggcgcuccaacagc

SEQ ID NO: 1433308 - RNA, 19 nt, Pseudomonas aeruginosa PA01
gcccggcgcuccaacagca

SEQ ID NO: 1433309 - RNA, 14 nt, Pseudomonas aeruginosa PA01
gcccggcgcggcgg

SEQ ID NO: 1433310 - RNA, 20 nt, Pseudomonas aeruginosa PA01
gcccggcgcggcggccgccu

SEQ ID NO: 1433311 - RNA, 14 nt, Pseudomonas aeruginosa PA01
gcccggcggcggca

SEQ ID NO: 1433312 - RNA, 17 nt, Pseudomonas aeruginosa PA01
gcccggcggugaugccg

SEQ ID NO: 1433313 - RNA, 17 nt, Pseudomonas aeruginosa PA01
gcccggcguccucgcga

SEQ ID NO: 1433314 - RNA, 13 nt, Pseudomonas aeruginosa PA01
gcccggcucggcc

SEQ ID NO: 1433315 - RNA, 15 nt, Pseudomonas aeruginosa PA01
gcccggcucgccgcc

SEQ ID NO: 1433316 - RNA, 17 nt, Pseudomonas aeruginosa PA01
gcccggcucgccgccgg

SEQ ID NO: 1433317 - RNA, 21 nt, Pseudomonas aeruginosa PA01
gcccggcucgccgccgggcgc

SEQ ID NO: 1433318 - RNA, 22 nt, Pseudomonas aeruginosa PA01
gcccggcuccggguacuggcgc

SEQ ID NO: 1433319 - RNA, 19 nt, Pseudomonas aeruginosa PA01
gcccggcuccagccgggcu

SEQ ID NO: 1433320 - RNA, 16 nt, Pseudomonas aeruginosa PA01
gcccggcucgcccaug

SEQ ID NO: 1433321 - RNA, 19 nt, Pseudomonas aeruginosa PA01
gcccggcucgcccaugcgc

SEQ ID NO: 1433322 - RNA, 13 nt, Pseudomonas aeruginosa PA01
gcccggcucgccg

SEQ ID NO: 1433323 - RNA, 14 nt, Pseudomonas aeruginosa PA01
gcccggcugcacag

SEQ ID NO: 1433324 - RNA, 15 nt, Pseudomonas aeruginosa PA01
gcccggcugcacagg

SEQ ID NO: 1433325 - RNA, 16 nt, Pseudomonas aeruginosa PA01
gcccggcugcacaggu

SEQ ID NO: 1433326 - RNA, 13 nt, Pseudomonas aeruginosa PA01
gcccggcuggcca

SEQ ID NO: 1433327 - RNA, 13 nt, Pseudomonas aeruginosa PA01
gcccggcuggcgu

SEQ ID NO: 1433328 - RNA, 17 nt, Pseudomonas aeruginosa PA01
gcccggcuucgcuggug

SEQ ID NO: 1433329 - RNA, 14 nt, Pseudomonas aeruginosa PA01
gcccggcuucggcg

SEQ ID NO: 1433330 - RNA, 16 nt, Pseudomonas aeruginosa PA01
gcccggcuugccgucg

SEQ ID NO: 1433331 - RNA, 16 nt, Pseudomonas aeruginosa PA01
gcccggcuuuccucgg

SEQ ID NO: 1433332 - RNA, 18 nt, Pseudomonas aeruginosa PA01
gcccggcuuuccucggcc

SEQ ID NO: 1433333 - RNA, 22 nt, Pseudomonas aeruginosa PA01
gcccggcuuuccucggccaugc

SEQ ID NO: 1433334 - RNA, 17 nt, Pseudomonas aeruginosa PA01
gcccggcguuucgccgg

SEQ ID NO: 1433335 - RNA, 18 nt, Pseudomonas aeruginosa PA01
gcccggcguuucgccggg

SEQ ID NO: 1433336 - RNA, 19 nt, Pseudomonas aeruginosa PA01
gcccggcguuucgccgggc

SEQ ID NO: 1433337 - RNA, 21 nt, Pseudomonas aeruginosa PA01
gcccggcguuucgccgggccu

SEQ ID NO: 1433338 - RNA, 18 nt, Pseudomonas aeruginosa PA01
gcccggcgugggcggucg

SEQ ID NO: 1433339 - RNA, 13 nt, Pseudomonas aeruginosa PA01
gcccggcgugagc

SEQ ID NO: 1433340 - RNA, 15 nt, Pseudomonas aeruginosa PA01
gcccggcgugagcag

SEQ ID NO: 1433341 - RNA, 17 nt, Pseudomonas aeruginosa PA01
gcccggcgugagcaggg

SEQ ID NO: 1433342 - RNA, 19 nt, Pseudomonas aeruginosa PA01
gcccggcgugagcagggcc

SEQ ID NO: 1433343 - RNA, 21 nt, Pseudomonas aeruginosa PA01
gcccggcgugagcagggccga

SEQ ID NO: 1433344 - RNA, 15 nt, Pseudomonas aeruginosa PA01
gcccggcgugccgca

SEQ ID NO: 1433345 - RNA, 20 nt, Pseudomonas aeruginosa PA01
gcccggcguggacccacgca

SEQ ID NO: 1433346 - RNA, 16 nt, Pseudomonas aeruginosa PA01
gcccggcgaaugccgg

SEQ ID NO: 1433347 - RNA, 19 nt, Pseudomonas aeruginosa PA01
gcccggcgaaugccgggcu

SEQ ID NO: 1433348 - RNA, 17 nt, Pseudomonas aeruginosa PA01
gcccggcgagagcgucc

SEQ ID NO: 1433349 - RNA, 21 nt, Pseudomonas aeruginosa PA01
gcccggcgagagcguccggca

SEQ ID NO: 1433350 - RNA, 23 nt, Pseudomonas aeruginosa PA01
gcccggcgagagcguccggcagg

SEQ ID NO: 1433351 - RNA, 15 nt, Pseudomonas aeruginosa PA01
gcccggcgaacagcg

SEQ ID NO: 1433352 - RNA, 16 nt, Pseudomonas aeruginosa PA01
gcccggcgaacagcgc

SEQ ID NO: 1433353 - RNA, 12 nt, Pseudomonas aeruginosa PA01
gcccggcgaggu

SEQ ID NO: 1433354 - RNA, 15 nt, Pseudomonas aeruginosa PA01
gcccggcgaggucgg

SEQ ID NO: 1433355 - RNA, 16 nt, Pseudomonas aeruginosa PA01
gcccggcgaggucggg

SEQ ID NO: 1433356 - RNA, 18 nt, Pseudomonas aeruginosa PA01
gcccggcgaggucggggu

SEQ ID NO: 1433357 - RNA, 14 nt, Pseudomonas aeruginosa PA01
gcccggcgccaccg

SEQ ID NO: 1433358 - RNA, 22 nt, Pseudomonas aeruginosa PA01
gcccggcgcagaacugccgggc

SEQ ID NO: 1433359 - RNA, 12 nt, Pseudomonas aeruginosa PA01
gcccggcgcgac

SEQ ID NO: 1433360 - RNA, 13 nt, Pseudomonas aeruginosa PA01
gcccggcgcgacc

SEQ ID NO: 1433361 - RNA, 14 nt, Pseudomonas aeruginosa PA01
gcccggcgcgaccg

SEQ ID NO: 1433362 - RNA, 17 nt, Pseudomonas aeruginosa PA01
gcccggcgcgacgcucc

SEQ ID NO: 1433363 - RNA, 12 nt, Pseudomonas aeruginosa PA01
gcccggccaugc

SEQ ID NO: 1433364 - RNA, 15 nt, Pseudomonas aeruginosa PA01
gcccggccaugccgc

SEQ ID NO: 1433365 - RNA, 16 nt, Pseudomonas aeruginosa PA01
gcccggccaugccgcc

SEQ ID NO: 1433366 - RNA, 18 nt, Pseudomonas aeruginosa PA01
gcccggccaugccgccga

SEQ ID NO: 1433367 - RNA, 20 nt, Pseudomonas aeruginosa PA01
gcccggccaugccgccgacg

SEQ ID NO: 1433368 - RNA, 17 nt, Pseudomonas aeruginosa PA01
gcccggccggauuggcc

SEQ ID NO: 1433369 - RNA, 21 nt, Pseudomonas aeruginosa PA01
gcccggccggauuggccgagg

SEQ ID NO: 1433370 - RNA, 14 nt, Pseudomonas aeruginosa PA01
gcccggccgcugcc

SEQ ID NO: 1433371 - RNA, 16 nt, Pseudomonas aeruginosa PA01
gcccggccgcugccgg

SEQ ID NO: 1433372 - RNA, 19 nt, Pseudomonas aeruginosa PA01
gcccggccgcugccgggcu

SEQ ID NO: 1433373 - RNA, 12 nt, Pseudomonas aeruginosa PA01
gcccggccuggc

SEQ ID NO: 1433374 - RNA, 14 nt, Pseudomonas aeruginosa PA01
gcccggccuggcgu

SEQ ID NO: 1433375 - RNA, 17 nt, Pseudomonas aeruginosa PA01
gcccggccuggcguccc

SEQ ID NO: 1433376 - RNA, 19 nt, Pseudomonas aeruginosa PA01
gcccggccuggcgucccgg

SEQ ID NO: 1433377 - RNA, 16 nt, Pseudomonas aeruginosa PA01
gcccggccuccccggc

SEQ ID NO: 1433378 - RNA, 15 nt, Pseudomonas aeruginosa PA01
gcccggccucgccgg

SEQ ID NO: 1433379 - RNA, 19 nt, Pseudomonas aeruginosa PA01
gcccgccugaaggcgggcu

SEQ ID NO: 1433380 - RNA, 18 nt, Pseudomonas aeruginosa PA01
gcccgccuucaggcgggc

SEQ ID NO: 1433381 - RNA, 13 nt, Pseudomonas aeruginosa PA01
gcccgcgccgccg

SEQ ID NO: 1433382 - RNA, 13 nt, Pseudomonas aeruginosa PA01
gcccgcgccgcga

SEQ ID NO: 1433383 - RNA, 16 nt, Pseudomonas aeruginosa PA01
gcccgcgccgccggua

SEQ ID NO: 1433384 - RNA, 16 nt, Pseudomonas aeruginosa PA01
gcccgcgccgccucga

SEQ ID NO: 1433385 - RNA, 23 nt, Pseudomonas aeruginosa PA01
gcccgcgccgccucgauggcggc

SEQ ID NO: 1433386 - RNA, 11 nt, Pseudomonas aeruginosa PA01
gcccgcgccgc

SEQ ID NO: 1433387 - RNA, 14 nt, Pseudomonas aeruginosa PA01
gcccgcuucgccau

SEQ ID NO: 1433388 - RNA, 15 nt, Pseudomonas aeruginosa PA01
gcccgcuugcgccgc

SEQ ID NO: 1433389 - RNA, 14 nt, Pseudomonas aeruginosa PA01
gcccgcugggcagg

SEQ ID NO: 1433390 - RNA, 20 nt, Pseudomonas aeruginosa PA01
gcccgcugggcagguggugg

SEQ ID NO: 1433391 - RNA, 13 nt, Pseudomonas aeruginosa PA01
gcccgcugcgcug

SEQ ID NO: 1433392 - RNA, 16 nt, Pseudomonas aeruginosa PA01
gcccgcugcgcugcca

SEQ ID NO: 1433393 - RNA, 22 nt, Pseudomonas aeruginosa PA01
gcccgcugcgcugccagcgccg

SEQ ID NO: 1433394 - RNA, 23 nt, Pseudomonas aeruginosa PA01
gcccgcugcgcugccagcgccgc

SEQ ID NO: 1433395 - RNA, 18 nt, Pseudomonas aeruginosa PA01
gcccggccauccuggccg

SEQ ID NO: 1433396 - RNA, 19 nt, Pseudomonas aeruginosa PA01
gcccggccauccuggccgg

SEQ ID NO: 1433397 - RNA, 20 nt, Pseudomonas aeruginosa PA01
gcccggccauccuggccggu

SEQ ID NO: 1433398 - RNA, 13 nt, Pseudomonas aeruginosa PA01
gcccggccaggcc

SEQ ID NO: 1433399 - RNA, 14 nt, Pseudomonas aeruginosa PA01
gcccggccaggcca

SEQ ID NO: 1433400 - RNA, 22 nt, Pseudomonas aeruginosa PA01
gcccggccaggccacggcggaa

SEQ ID NO: 1433401 - RNA, 18 nt, Pseudomonas aeruginosa PA01
gcccggccaggccgccca

SEQ ID NO: 1433402 - RNA, 14 nt, Pseudomonas aeruginosa PA01
gcccggccaggcga

SEQ ID NO: 1433403 - RNA, 18 nt, Pseudomonas aeruginosa PA01
gcccggccaggcgcggcg

SEQ ID NO: 1433404 - RNA, 20 nt, Pseudomonas aeruginosa PA01
gcccggccaggcgcggcgcc

SEQ ID NO: 1433405 - RNA, 20 nt, Pseudomonas aeruginosa PA01
gcccggcaucgugccgcgga

SEQ ID NO: 1433406 - RNA, 17 nt, Pseudomonas aeruginosa PA01
gcccggcauucgccggg

SEQ ID NO: 1433407 - RNA, 18 nt, Pseudomonas aeruginosa PA01
gcccggcauucgccgggc

SEQ ID NO: 1433408 - RNA, 20 nt, Pseudomonas aeruginosa PA01
gcccggcagcaggccgccgc

SEQ ID NO: 1433409 - RNA, 19 nt, Pseudomonas aeruginosa PA01
gcccggcauaggcgccagc

SEQ ID NO: 1433410 - RNA, 21 nt, Pseudomonas aeruginosa PA01
gcccggcauaggcgccagccu

SEQ ID NO: 1433411 - RNA, 14 nt, Pseudomonas aeruginosa PA01
gcccggcaccaggc

SEQ ID NO: 1433412 - RNA, 16 nt, Pseudomonas aeruginosa PA01
gcccggcacucgccgg

SEQ ID NO: 1433413 - RNA, 16 nt, Pseudomonas aeruginosa PA01
gcccggcagaucuccc

SEQ ID NO: 1433414 - RNA, 17 nt, Pseudomonas aeruginosa PA01
gcccggcagaugccggg

SEQ ID NO: 1433415 - RNA, 11 nt, Pseudomonas aeruginosa PA01
gcccggcagcg

SEQ ID NO: 1433416 - RNA, 14 nt, Pseudomonas aeruginosa PA01
gcccggcagcgccg

SEQ ID NO: 1433417 - RNA, 15 nt, Pseudomonas aeruginosa PA01
gcccggcagcggcug

SEQ ID NO: 1433418 - RNA, 23 nt, Pseudomonas aeruginosa PA01
gcccggcagcggcuggccgucga

SEQ ID NO: 1433419 - RNA, 23 nt, Pseudomonas aeruginosa PA01
gcccggcaggcagugccgggcgu

SEQ ID NO: 1433420 - RNA, 21 nt, Pseudomonas aeruginosa PA01
gcccggagcuuugcagggcga

SEQ ID NO: 1433421 - RNA, 18 nt, Pseudomonas aeruginosa PA01
gcccggauagacgccguc

SEQ ID NO: 1433422 - RNA, 20 nt, Pseudomonas aeruginosa PA01
gcccggauagacgccgucca

SEQ ID NO: 1433423 - RNA, 18 nt, Pseudomonas aeruginosa PA01
gcccggagaccgugccgc

SEQ ID NO: 1433424 - RNA, 19 nt, Pseudomonas aeruginosa PA01
gcccggagaccgugccgcc

SEQ ID NO: 1433425 - RNA, 17 nt, Pseudomonas aeruginosa PA01
gcccggagaucgccgcg

SEQ ID NO: 1433426 - RNA, 20 nt, Pseudomonas aeruginosa PA01
gcccggagccaacgcccggg

SEQ ID NO: 1433427 - RNA, 18 nt, Pseudomonas aeruginosa PA01
gcccggagcggcugccga

SEQ ID NO: 1433428 - RNA, 19 nt, Pseudomonas aeruginosa PA01
gcccggagcggcugccgag

SEQ ID NO: 1433429 - RNA, 17 nt, Pseudomonas aeruginosa PA01
gcccggcacgcuccagg

SEQ ID NO: 1433430 - RNA, 14 nt, Pseudomonas aeruginosa PA01
gcccggcaccgggg

SEQ ID NO: 1433431 - RNA, 18 nt, Pseudomonas aeruginosa PA01
gcccggcaauagccgggc

SEQ ID NO: 1433432 - RNA, 19 nt, Pseudomonas aeruginosa PA01
gcccggcaauagccgggcu

SEQ ID NO: 1433433 - RNA, 15 nt, Pseudomonas aeruginosa PA01
gcccggcaaucaggc

SEQ ID NO: 1433434 - RNA, 17 nt, Pseudomonas aeruginosa PA01
gcccggcaaucaggcgc

SEQ ID NO: 1433435 - RNA, 16 nt, Pseudomonas aeruginosa PA01
gcccagggacgcgccg

SEQ ID NO: 1433436 - RNA, 17 nt, Pseudomonas aeruginosa PA01
gcccagggacgcgccgg

SEQ ID NO: 1433437 - RNA, 18 nt, Pseudomonas aeruginosa PA01
gcccagggcguggucggc

SEQ ID NO: 1433438 - RNA, 22 nt, Pseudomonas aeruginosa PA01
gcccagggcguggucggcggcc

SEQ ID NO: 1433439 - RNA, 23 nt, Pseudomonas aeruginosa PA01
gcccagggcguggucggcggccu

SEQ ID NO: 1433440 - RNA, 20 nt, Pseudomonas aeruginosa PA01
gcccaggguggcguucucga

SEQ ID NO: 1433441 - RNA, 16 nt, Pseudomonas aeruginosa PA01
gcccagguaggcgaug

SEQ ID NO: 1433442 - RNA, 17 nt, Pseudomonas aeruginosa PA01
gcccagguaggcgaugc

SEQ ID NO: 1433443 - RNA, 21 nt, Pseudomonas aeruginosa PA01
gcccagguaggcgaugcgcgu

SEQ ID NO: 1433444 - RNA, 16 nt, Pseudomonas aeruginosa PA01
gcccagguagucgccc

SEQ ID NO: 1433445 - RNA, 17 nt, Pseudomonas aeruginosa PA01
gcccagguagucgccca

SEQ ID NO: 1433446 - RNA, 22 nt, Pseudomonas aeruginosa PA01
gcccagguagucgcccagcgcc

SEQ ID NO: 1433447 - RNA, 24 nt, Pseudomonas aeruginosa PA01
gcccagguagucgcccagcgccug

SEQ ID NO: 1433448 - RNA, 12 nt, Pseudomonas aeruginosa PA01
gcccagguggca

SEQ ID NO: 1433449 - RNA, 17 nt, Pseudomonas aeruginosa PA01
gcccagguggcaggccu

SEQ ID NO: 1433450 - RNA, 20 nt, Pseudomonas aeruginosa PA01
gcccagguggcaggccugga

SEQ ID NO: 1433451 - RNA, 23 nt, Pseudomonas aeruginosa PA01
gcccaggugcgagucaccccgac

SEQ ID NO: 1433452 - RNA, 15 nt, Pseudomonas aeruginosa PA01
gcccaggugcgccga

SEQ ID NO: 1433453 - RNA, 14 nt, Pseudomonas aeruginosa PA01
gcccaguaccgcca

SEQ ID NO: 1433454 - RNA, 15 nt, Pseudomonas aeruginosa PA01
gcccaguaccgccac

SEQ ID NO: 1433455 - RNA, 14 nt, Pseudomonas aeruginosa PA01
gcccaugccgcccg

SEQ ID NO: 1433456 - RNA, 15 nt, Pseudomonas aeruginosa PA01
gcccaugccgcccgg

SEQ ID NO: 1433457 - RNA, 19 nt, Pseudomonas aeruginosa PA01
gcccaugccgcccggccgc

SEQ ID NO: 1433458 - RNA, 20 nt, Pseudomonas aeruginosa PA01
gcccaugccgcccggccgcu

SEQ ID NO: 1433459 - RNA, 16 nt, Pseudomonas aeruginosa PA01
gcccauggcacgcagg

SEQ ID NO: 1433460 - RNA, 17 nt, Pseudomonas aeruginosa PA01
gcccauggcacgcaggg

SEQ ID NO: 1433461 - RNA, 21 nt, Pseudomonas aeruginosa PA01
gcccauggcacgcagggcuau

SEQ ID NO: 1433462 - RNA, 17 nt, Pseudomonas aeruginosa PA01
gcccaugccuugcagcg

SEQ ID NO: 1433463 - RNA, 11 nt, Pseudomonas aeruginosa PA01
gcccaguucgc

SEQ ID NO: 1433464 - RNA, 18 nt, Pseudomonas aeruginosa PA01
gcccagugguuccaggag

SEQ ID NO: 1433465 - RNA, 14 nt, Pseudomonas aeruginosa PA01
gcccagugcuggcg

SEQ ID NO: 1433466 - RNA, 17 nt, Pseudomonas aeruginosa PA01
gcccaguucgccggcca

SEQ ID NO: 1433467 - RNA, 18 nt, Pseudomonas aeruginosa PA01
gcccaguucgccggccag

SEQ ID NO: 1433468 - RNA, 22 nt, Pseudomonas aeruginosa PA01
gcccaguucuucgccgcccgcg

SEQ ID NO: 1433469 - RNA, 15 nt, Pseudomonas aeruginosa PA01
gcccaguucgcugcc

SEQ ID NO: 1433470 - RNA, 19 nt, Pseudomonas aeruginosa PA01
gcccaguucgcugccgccg

SEQ ID NO: 1433471 - RNA, 14 nt, Pseudomonas aeruginosa PA01
gcccaggcuggcgg

SEQ ID NO: 1433472 - RNA, 17 nt, Pseudomonas aeruginosa PA01
gcccaggcuggcggcca

SEQ ID NO: 1433473 - RNA, 21 nt, Pseudomonas aeruginosa PA01
gcccaggcuggcggccagggc

SEQ ID NO: 1433474 - RNA, 18 nt, Pseudomonas aeruginosa PA01
gcccagggcgaucgucga

SEQ ID NO: 1433475 - RNA, 20 nt, Pseudomonas aeruginosa PA01
gcccagggcgaucgucgaga

SEQ ID NO: 1433476 - RNA, 17 nt, Pseudomonas aeruginosa PA01
gcccagggccagcagcg

SEQ ID NO: 1433477 - RNA, 23 nt, Pseudomonas aeruginosa PA01
gcccagggccagcagcggcggcg

SEQ ID NO: 1433478 - RNA, 15 nt, Pseudomonas aeruginosa PA01
gcccagggccagcgg

SEQ ID NO: 1433479 - RNA, 23 nt, Pseudomonas aeruginosa PA01
gcccaggcugaggucgcgggcga

SEQ ID NO: 1433480 - RNA, 16 nt, Pseudomonas aeruginosa PA01
gcccaggcugccgccg

SEQ ID NO: 1433481 - RNA, 17 nt, Pseudomonas aeruginosa PA01
gcccaggcugccgccgc

SEQ ID NO: 1433482 - RNA, 23 nt, Pseudomonas aeruginosa PA01
gcccaggcugccgccgccgucga

SEQ ID NO: 1433483 - RNA, 16 nt, Pseudomonas aeruginosa PA01
gcccaggcugccggcc

SEQ ID NO: 1433484 - RNA, 16 nt, Pseudomonas aeruginosa PA01
gcccaggcgcucggcg

SEQ ID NO: 1433485 - RNA, 17 nt, Pseudomonas aeruginosa PA01
gcccaggcgcucggcga

SEQ ID NO: 1433486 - RNA, 20 nt, Pseudomonas aeruginosa PA01
gcccaggcgcucggcgaccu

SEQ ID NO: 1433487 - RNA, 19 nt, Pseudomonas aeruginosa PA01
gcccaggcgcucggcggcg

SEQ ID NO: 1433488 - RNA, 19 nt, Pseudomonas aeruginosa PA01
gcccaggcgcuggcgccga

SEQ ID NO: 1433489 - RNA, 22 nt, Pseudomonas aeruginosa PA01
gcccaggcgcuggcgccgaugc

SEQ ID NO: 1433490 - RNA, 23 nt, Pseudomonas aeruginosa PA01
gcccaggcgcuggcgccgaugcu

SEQ ID NO: 1433491 - RNA, 14 nt, Pseudomonas aeruginosa PA01
gcccaggccgccga

SEQ ID NO: 1433492 - RNA, 20 nt, Pseudomonas aeruginosa PA01
gcccaggccgccgauccagg

SEQ ID NO: 1433493 - RNA, 12 nt, Pseudomonas aeruginosa PA01
gcccaggccgaa

SEQ ID NO: 1433494 - RNA, 14 nt, Pseudomonas aeruginosa PA01
gcccaggccgaagu

SEQ ID NO: 1433495 - RNA, 13 nt, Pseudomonas aeruginosa PA01
gccauguccacca

SEQ ID NO: 1433496 - RNA, 14 nt, Pseudomonas aeruginosa PA01
gcccaggcgcaccu

SEQ ID NO: 1433497 - RNA, 14 nt, Pseudomonas aeruginosa PA01
gcccaggccggguc

SEQ ID NO: 1433498 - RNA, 15 nt, Pseudomonas aeruginosa PA01
gcccaggccgggucg

SEQ ID NO: 1433499 - RNA, 19 nt, Pseudomonas aeruginosa PA01
gcccaggccgggucgcagc

SEQ ID NO: 1433500 - RNA, 14 nt, Pseudomonas aeruginosa PA01
gcccaggccggguu

SEQ ID NO: 1433501 - RNA, 19 nt, Pseudomonas aeruginosa PA01
gccaugguuuaccaggacc

SEQ ID NO: 1433502 - RNA, 17 nt, Pseudomonas aeruginosa PA01
gccaugggcacgccggu

SEQ ID NO: 1433503 - RNA, 18 nt, Pseudomonas aeruginosa PA01
gccaugggcacgccggug

SEQ ID NO: 1433504 - RNA, 15 nt, Pseudomonas aeruginosa PA01
gccauggcuggugcg

SEQ ID NO: 1433505 - RNA, 14 nt, Pseudomonas aeruginosa PA01
gccauggucucgcu

SEQ ID NO: 1433506 - RNA, 19 nt, Pseudomonas aeruginosa PA01
gccauggucucgcugaccc

SEQ ID NO: 1433507 - RNA, 15 nt, Pseudomonas aeruginosa PA01
gccaugggccggccg

SEQ ID NO: 1433508 - RNA, 16 nt, Pseudomonas aeruginosa PA01
gccaugggccggccga

SEQ ID NO: 1433509 - RNA, 19 nt, Pseudomonas aeruginosa PA01
gccaugggccggccgacga

SEQ ID NO: 1433510 - RNA, 17 nt, Pseudomonas aeruginosa PA01
gccaugggugucggcga

SEQ ID NO: 1433511 - RNA, 18 nt, Pseudomonas aeruginosa PA01
gccaugggugucggcgau

SEQ ID NO: 1433512 - RNA, 20 nt, Pseudomonas aeruginosa PA01
gccaugggugucggcgauca

SEQ ID NO: 1433513 - RNA, 13 nt, Pseudomonas aeruginosa PA01
gccauggcggcgg

SEQ ID NO: 1433514 - RNA, 20 nt, Pseudomonas aeruginosa PA01
gccauggcgcuugcgcagca

SEQ ID NO: 1433515 - RNA, 21 nt, Pseudomonas aeruginosa PA01
gccauggcggacauguugcag

SEQ ID NO: 1433516 - RNA, 20 nt, Pseudomonas aeruginosa PA01
gcccauguagaccaccagcg

SEQ ID NO: 1433517 - RNA, 22 nt, Pseudomonas aeruginosa PA01
gcccauguagaccaccagcgug

SEQ ID NO: 1433518 - RNA, 23 nt, Pseudomonas aeruginosa PA01
gcccaugugcagcuucuccaggg

SEQ ID NO: 1433519 - RNA, 18 nt, Pseudomonas aeruginosa PA01
gcccaugugcuugaccgc

SEQ ID NO: 1433520 - RNA, 15 nt, Pseudomonas aeruginosa PA01
gcccauggucagcgg

SEQ ID NO: 1433521 - RNA, 16 nt, Pseudomonas aeruginosa PA01
gcccauugccgggcuu

SEQ ID NO: 1433522 - RNA, 21 nt, Pseudomonas aeruginosa PA01
gccccagucccuucagcgcac

SEQ ID NO: 1433523 - RNA, 21 nt, Pseudomonas aeruginosa PA01
gccccaugccguucagcgucc

SEQ ID NO: 1433524 - RNA, 20 nt, Pseudomonas aeruginosa PA01
aagacgcugcgaccuggcgc

SEQ ID NO: 1433525 - RNA, 14 nt, Pseudomonas aeruginosa PA01
gccccgagaaaacc

SEQ ID NO: 1433526 - RNA, 20 nt, Pseudomonas aeruginosa PA01
gccccgagaaaacccuggga

SEQ ID NO: 1433527 - RNA, 15 nt, Pseudomonas aeruginosa PA01
gccccgagcgggccg

SEQ ID NO: 1433528 - RNA, 24 nt, Pseudomonas aeruginosa PA01
gccccgagcgggccgagggugauc

SEQ ID NO: 1433529 - RNA, 15 nt, Pseudomonas aeruginosa PA01
gccccgaucgccucg

SEQ ID NO: 1433530 - RNA, 19 nt, Pseudomonas aeruginosa PA01
gccccgaucgccucggcca

SEQ ID NO: 1433531 - RNA, 14 nt, Pseudomonas aeruginosa PA01
gccccgaggccagc

SEQ ID NO: 1433532 - RNA, 18 nt, Pseudomonas aeruginosa PA01
gccccgaggccagcaggc

SEQ ID NO: 1433533 - RNA, 19 nt, Pseudomonas aeruginosa PA01
gccccgcaaggugcgggcc

SEQ ID NO: 1433534 - RNA, 18 nt, Pseudomonas aeruginosa PA01
gccccgcauugcggggcg

SEQ ID NO: 1433535 - RNA, 15 nt, Pseudomonas aeruginosa PA01
gccccgcaucgcggg

SEQ ID NO: 1433536 - RNA, 14 nt, Pseudomonas aeruginosa PA01
gccccgcagccgcg

SEQ ID NO: 1433537 - RNA, 17 nt, Pseudomonas aeruginosa PA01
gccccgcaccagccagc

SEQ ID NO: 1433538 - RNA, 12 nt, Pseudomonas aeruginosa PA01
gccccgccgaag

SEQ ID NO: 1433539 - RNA, 12 nt, Pseudomonas aeruginosa PA01
gccccgccgacu

SEQ ID NO: 1433540 - RNA, 21 nt, Pseudomonas aeruginosa PA01
gccccgccgacuggcagcgau

SEQ ID NO: 1433541 - RNA, 13 nt, Pseudomonas aeruginosa PA01
gccccgccggcgc

SEQ ID NO: 1433542 - RNA, 13 nt, Pseudomonas aeruginosa PA01
aagagcagcgcgg

SEQ ID NO: 1433543 - RNA, 22 nt, Pseudomonas aeruginosa PA01
aagagcagcgcggcggcggcca

SEQ ID NO: 1433544 - RNA, 15 nt, Pseudomonas aeruginosa PA01
gccccgccgccaggc

SEQ ID NO: 1433545 - RNA, 12 nt, Pseudomonas aeruginosa PA01
gccccgccggga

SEQ ID NO: 1433546 - RNA, 15 nt, Pseudomonas aeruginosa PA01
gccccgccggggcgu

SEQ ID NO: 1433547 - RNA, 17 nt, Pseudomonas aeruginosa PA01
aagagcuggcggccgcg

SEQ ID NO: 1433548 - RNA, 14 nt, Pseudomonas aeruginosa PA01
gcccgccgcgagcg

SEQ ID NO: 1433549 - RNA, 13 nt, Pseudomonas aeruginosa PA01
gcccgccgcgagc

SEQ ID NO: 1433550 - RNA, 13 nt, Pseudomonas aeruginosa PA01
gcccgccguccuc

SEQ ID NO: 1433551 - RNA, 18 nt, Pseudomonas aeruginosa PA01
gcccgccguccuccagca

SEQ ID NO: 1433552 - RNA, 18 nt, Pseudomonas aeruginosa PA01
gcccgccgucauggcggg

SEQ ID NO: 1433553 - RNA, 18 nt, Pseudomonas aeruginosa PA01
gcccgccgugcgcuccgc

SEQ ID NO: 1433554 - RNA, 20 nt, Pseudomonas aeruginosa PA01
gcccgccgugcgcuccgcca

SEQ ID NO: 1433555 - RNA, 12 nt, Pseudomonas aeruginosa PA01
gcccgccucgcg

SEQ ID NO: 1433556 - RNA, 13 nt, Pseudomonas aeruginosa PA01
gcccgccucgcgc

SEQ ID NO: 1433557 - RNA, 21 nt, Pseudomonas aeruginosa PA01
gcccgccucggaaucggcgau

SEQ ID NO: 1433558 - RNA, 14 nt, Pseudomonas aeruginosa PA01
gcccgccucaggcc

SEQ ID NO: 1433559 - RNA, 19 nt, Pseudomonas aeruginosa PA01
gcccgccucaggccgggau

SEQ ID NO: 1433560 - RNA, 12 nt, Pseudomonas aeruginosa PA01
gcccgccgccug

SEQ ID NO: 1433561 - RNA, 13 nt, Pseudomonas aeruginosa PA01
gcccgccgccugg

SEQ ID NO: 1433562 - RNA, 16 nt, Pseudomonas aeruginosa PA01
gcccgccgccuggugc

SEQ ID NO: 1433563 - RNA, 21 nt, Pseudomonas aeruginosa PA01
gcccgccgccggggcgggccg

SEQ ID NO: 1433564 - RNA, 14 nt, Pseudomonas aeruginosa PA01
gcccgccccuuucc

SEQ ID NO: 1433565 - RNA, 15 nt, Pseudomonas aeruginosa PA01
gcccgcccggcacca

SEQ ID NO: 1433566 - RNA, 19 nt, Pseudomonas aeruginosa PA01
gcccgcccggcaccaccgg

SEQ ID NO: 1433567 - RNA, 19 nt, Pseudomonas aeruginosa PA01
gcccgcccggaaccaccgg

SEQ ID NO: 1433568 - RNA, 23 nt, Pseudomonas aeruginosa PA01
gcccgcccggaaccaccggucaa

SEQ ID NO: 1433569 - RNA, 15 nt, Pseudomonas aeruginosa PA01
gcccgcccucgucgc

SEQ ID NO: 1433570 - RNA, 21 nt, Pseudomonas aeruginosa PA01
gcccgcccucgucgcaccugu

SEQ ID NO: 1433571 - RNA, 15 nt, Pseudomonas aeruginosa PA01
gcccgccgaacagca

SEQ ID NO: 1433572 - RNA, 22 nt, Pseudomonas aeruginosa PA01
gcccgccgaacagcaacaccgc

SEQ ID NO: 1433573 - RNA, 19 nt, Pseudomonas aeruginosa PA01
gcccgcagccacaggcgcc

SEQ ID NO: 1433574 - RNA, 20 nt, Pseudomonas aeruginosa PA01
gcccgcagccacaggcgcca

SEQ ID NO: 1433575 - RNA, 21 nt, Pseudomonas aeruginosa PA01
gcccgcagccacaggcgccag

SEQ ID NO: 1433576 - RNA, 23 nt, Pseudomonas aeruginosa PA01
gcccgcagccacaggcgccaguc

SEQ ID NO: 1433577 - RNA, 17 nt, Pseudomonas aeruginosa PA01
gcccgcagccacggcac

SEQ ID NO: 1433578 - RNA, 15 nt, Pseudomonas aeruginosa PA01
gcccgcagccagccu

SEQ ID NO: 1433579 - RNA, 16 nt, Pseudomonas aeruginosa PA01
gcccgccacagaucgc

SEQ ID NO: 1433580 - RNA, 23 nt, Pseudomonas aeruginosa PA01
gcccgccacagaucgccagcucg

SEQ ID NO: 1433581 - RNA, 19 nt, Pseudomonas aeruginosa PA01
gcccgccaccuggcgggcu

SEQ ID NO: 1433582 - RNA, 19 nt, Pseudomonas aeruginosa PA01
gcccgccacggcgcgcucc

SEQ ID NO: 1433583 - RNA, 17 nt, Pseudomonas aeruginosa PA01
gcccgccagcaggcgcc

SEQ ID NO: 1433584 - RNA, 14 nt, Pseudomonas aeruginosa PA01
gcccgccagcaggc

SEQ ID NO: 1433585 - RNA, 18 nt, Pseudomonas aeruginosa PA01
gcccgagcuuugcgcagc

SEQ ID NO: 1433586 - RNA, 19 nt, Pseudomonas aeruginosa PA01
gcccgagcuuugcgcagcc

SEQ ID NO: 1433587 - RNA, 14 nt, Pseudomonas aeruginosa PA01
gcccgaggcgaccu

SEQ ID NO: 1433588 - RNA, 13 nt, Pseudomonas aeruginosa PA01
gcccgcacgaggc

SEQ ID NO: 1433589 - RNA, 18 nt, Pseudomonas aeruginosa PA01
gcccgcacgaggcgggcu

SEQ ID NO: 1433590 - RNA, 14 nt, Pseudomonas aeruginosa PA01
gcccgagcaggcug

SEQ ID NO: 1433591 - RNA, 19 nt, Pseudomonas aeruginosa PA01
gcccgagaggguggucgcg

SEQ ID NO: 1433592 - RNA, 15 nt, Pseudomonas aeruginosa PA01
gcccgagccgcugca

SEQ ID NO: 1433593 - RNA, 23 nt, Pseudomonas aeruginosa PA01
gcccgagcgacuggaugaacagc

SEQ ID NO: 1433594 - RNA, 13 nt, Pseudomonas aeruginosa PA01
gcccgaacgccga

SEQ ID NO: 1433595 - RNA, 20 nt, Pseudomonas aeruginosa PA01
gccccggccgcgccagccac

SEQ ID NO: 1433596 - RNA, 12 nt, Pseudomonas aeruginosa PA01
gccccggccgcg

SEQ ID NO: 1433597 - RNA, 14 nt, Pseudomonas aeruginosa PA01
gccccgcuucggcg

SEQ ID NO: 1433598 - RNA, 14 nt, Pseudomonas aeruginosa PA01
gccccuugcgcucu

SEQ ID NO: 1433599 - RNA, 13 nt, Pseudomonas aeruginosa PA01
gccccuugcgcug

SEQ ID NO: 1433600 - RNA, 20 nt, Pseudomonas aeruginosa PA01
gccccuuuuuuuugccugcc

SEQ ID NO: 1433601 - RNA, 14 nt, Pseudomonas aeruginosa PA01
gccccgcuggccca

SEQ ID NO: 1433602 - RNA, 17 nt, Pseudomonas aeruginosa PA01
gccccgcuugccgucga

SEQ ID NO: 1433603 - RNA, 20 nt, Pseudomonas aeruginosa PA01
gccccgcuugccgucgaccu

SEQ ID NO: 1433604 - RNA, 14 nt, Pseudomonas aeruginosa PA01
gccccggaggcggu

SEQ ID NO: 1433605 - RNA, 15 nt, Pseudomonas aeruginosa PA01
gccccggcaagggcc

SEQ ID NO: 1433606 - RNA, 22 nt, Pseudomonas aeruginosa PA01
gccccggcaagggccugcucag

SEQ ID NO: 1433607 - RNA, 12 nt, Pseudomonas aeruginosa PA01
gccccggcccgg

SEQ ID NO: 1433608 - RNA, 16 nt, Pseudomonas aeruginosa PA01
gccccggcccagccgc

SEQ ID NO: 1433609 - RNA, 12 nt, Pseudomonas aeruginosa PA01
gccccggcagcc

SEQ ID NO: 1433610 - RNA, 19 nt, Pseudomonas aeruginosa PA01
gccccggcagccaccaggu

SEQ ID NO: 1433611 - RNA, 12 nt, Pseudomonas aeruginosa PA01
gccccggcaggc

SEQ ID NO: 1433612 - RNA, 18 nt, Pseudomonas aeruginosa PA01
gccccggcaggcaggccu

SEQ ID NO: 1433613 - RNA, 20 nt, Pseudomonas aeruginosa PA01
gccccggcaggcaggccugg

SEQ ID NO: 1433614 - RNA, 22 nt, Pseudomonas aeruginosa PA01
gccccggcaggcaggccugggc

SEQ ID NO: 1433615 - RNA, 18 nt, Pseudomonas aeruginosa PA01
aagaggcgcucaacgccu

SEQ ID NO: 1433616 - RNA, 21 nt, Pseudomonas aeruginosa PA01
aagaggcccucggcgccgagc

SEQ ID NO: 1433617 - RNA, 23 nt, Pseudomonas aeruginosa PA01
aagaggcccucggcgccgagcau

SEQ ID NO: 1433618 - RNA, 19 nt, Pseudomonas aeruginosa PA01
gccccgcucgucauggcgc

SEQ ID NO: 1433619 - RNA, 15 nt, Pseudomonas aeruginosa PA01
gcccgacggcucgaa

SEQ ID NO: 1433620 - RNA, 19 nt, Pseudomonas aeruginosa PA01
gcccgacggcuugaucacg

SEQ ID NO: 1433621 - RNA, 16 nt, Pseudomonas aeruginosa PA01
gcccgacgccgcccgg

SEQ ID NO: 1433622 - RNA, 18 nt, Pseudomonas aeruginosa PA01
gcccgacgccgcccggca

SEQ ID NO: 1433623 - RNA, 22 nt, Pseudomonas aeruginosa PA01
gcccgacgaaauagucgcgggc

SEQ ID NO: 1433624 - RNA, 23 nt, Pseudomonas aeruginosa PA01
gcccgacgaaguugcaggccagc

SEQ ID NO: 1433625 - RNA, 21 nt, Pseudomonas aeruginosa PA01
gcccgaccggguugaugccga

SEQ ID NO: 1433626 - RNA, 23 nt, Pseudomonas aeruginosa PA01
gcccgaccggguugaugccgagg

SEQ ID NO: 1433627 - RNA, 16 nt, Pseudomonas aeruginosa PA01
gcccgaccccacgccg

SEQ ID NO: 1433628 - RNA, 19 nt, Pseudomonas aeruginosa PA01
gcccgaccccacgccggcc

SEQ ID NO: 1433629 - RNA, 22 nt, Pseudomonas aeruginosa PA01
gcccgaccccacgccggccggc

SEQ ID NO: 1433630 - RNA, 13 nt, Pseudomonas aeruginosa PA01
gagaugugcgcgg

SEQ ID NO: 1433631 - RNA, 13 nt, Pseudomonas aeruginosa PA01
gagaugcucaggc

SEQ ID NO: 1433632 - RNA, 16 nt, Pseudomonas aeruginosa PA01
gagaugcucaggcgcu

SEQ ID NO: 1433633 - RNA, 14 nt, Pseudomonas aeruginosa PA01
gagaugccgaacac

SEQ ID NO: 1433634 - RNA, 14 nt, Pseudomonas aeruginosa PA01
gagaugcaccggcc

SEQ ID NO: 1433635 - RNA, 22 nt, Pseudomonas aeruginosa PA01
gagaugcaccggccacucgcag

SEQ ID NO: 1433636 - RNA, 14 nt, Pseudomonas aeruginosa PA01
gagaugcagcaggu

SEQ ID NO: 1433637 - RNA, 21 nt, Pseudomonas aeruginosa PA01
gagcaccccgagcccggccgg

SEQ ID NO: 1433638 - RNA, 14 nt, Pseudomonas aeruginosa PA01
gagcacccgggcga

SEQ ID NO: 1433639 - RNA, 23 nt, Pseudomonas aeruginosa PA01
gagcacccgggcgaccugcucgc

SEQ ID NO: 1433640 - RNA, 19 nt, Pseudomonas aeruginosa PA01
gagcaccagcaggucggcg

SEQ ID NO: 1433641 - RNA, 14 nt, Pseudomonas aeruginosa PA01
gagcaccacgcgca

SEQ ID NO: 1433642 - RNA, 14 nt, Pseudomonas aeruginosa PA01
gagcaacucggcgg

SEQ ID NO: 1433643 - RNA, 15 nt, Pseudomonas aeruginosa PA01
gagcaacucggcggc

SEQ ID NO: 1433644 - RNA, 17 nt, Pseudomonas aeruginosa PA01
gagcaacucggcggcga

SEQ ID NO: 1433645 - RNA, 20 nt, Pseudomonas aeruginosa PA01
gagcaauccggcgcugccga

SEQ ID NO: 1433646 - RNA, 23 nt, Pseudomonas aeruginosa PA01
gagcaauccggcgcugccgaaca

SEQ ID NO: 1433647 - RNA, 15 nt, Pseudomonas aeruginosa PA01
gagcagagucgccgg

SEQ ID NO: 1433648 - RNA, 22 nt, Pseudomonas aeruginosa PA01
gagcagaguuuagccgccagug

SEQ ID NO: 1433649 - RNA, 14 nt, Pseudomonas aeruginosa PA01
gagcagaaccgcca

SEQ ID NO: 1433650 - RNA, 17 nt, Pseudomonas aeruginosa PA01
gagcagaaccgccagca

SEQ ID NO: 1433651 - RNA, 19 nt, Pseudomonas aeruginosa PA01
gagcagaaccgccagcagu

SEQ ID NO: 1433652 - RNA, 20 nt, Pseudomonas aeruginosa PA01
gagcacgucgccuucgcuga

SEQ ID NO: 1433653 - RNA, 14 nt, Pseudomonas aeruginosa PA01
gagcacuucccagg

SEQ ID NO: 1433654 - RNA, 20 nt, Pseudomonas aeruginosa PA01
gagcacgccgcgaccgaagc

SEQ ID NO: 1433655 - RNA, 17 nt, Pseudomonas aeruginosa PA01
gagcacgccguccgagg

SEQ ID NO: 1433656 - RNA, 14 nt, Pseudomonas aeruginosa PA01
gagcacgccgugca

SEQ ID NO: 1433657 - RNA, 16 nt, Pseudomonas aeruginosa PA01
gagcacgccgugcagg

SEQ ID NO: 1433658 - RNA, 19 nt, Pseudomonas aeruginosa PA01
gagcacgguccgcgaaccg

SEQ ID NO: 1433659 - RNA, 15 nt, Pseudomonas aeruginosa PA01
gagcacggccguccu

SEQ ID NO: 1433660 - RNA, 23 nt, Pseudomonas aeruginosa PA01
gagcacggcgaacaccgggccgc

SEQ ID NO: 1433661 - RNA, 16 nt, Pseudomonas aeruginosa PA01
gagcaccgcgccuucc

SEQ ID NO: 1433662 - RNA, 18 nt, Pseudomonas aeruginosa PA01
gagcaccgcgccuuccag

SEQ ID NO: 1433663 - RNA, 21 nt, Pseudomonas aeruginosa PA01
gagcaccucgaccugguagcc

SEQ ID NO: 1433664 - RNA, 20 nt, Pseudomonas aeruginosa PA01
gagcaccggaaaggcgucgu

SEQ ID NO: 1433665 - RNA, 15 nt, Pseudomonas aeruginosa PA01
gagaagcguucgccg

SEQ ID NO: 1433666 - RNA, 14 nt, Pseudomonas aeruginosa PA01
gagaaggcugccgg

SEQ ID NO: 1433667 - RNA, 23 nt, Pseudomonas aeruginosa PA01
gagaaguagucauugcgcuguga

SEQ ID NO: 1433668 - RNA, 20 nt, Pseudomonas aeruginosa PA01
gagaaucugcccggccaugc

SEQ ID NO: 1433669 - RNA, 22 nt, Pseudomonas aeruginosa PA01
gagacaggaaucgacccagccg

SEQ ID NO: 1433670 - RNA, 17 nt, Pseudomonas aeruginosa PA01
gagacgccagccgcccu

SEQ ID NO: 1433671 - RNA, 13 nt, Pseudomonas aeruginosa PA01
gagacgcccugga

SEQ ID NO: 1433672 - RNA, 18 nt, Pseudomonas aeruginosa PA01
gagacgcgggcccagcgg

SEQ ID NO: 1433673 - RNA, 19 nt, Pseudomonas aeruginosa PA01
gagacgcgggcccagcggu

SEQ ID NO: 1433674 - RNA, 15 nt, Pseudomonas aeruginosa PA01
gagaccgugccgccg

SEQ ID NO: 1433675 - RNA, 17 nt, Pseudomonas aeruginosa PA01
gagaccgugccgccggg

SEQ ID NO: 1433676 - RNA, 20 nt, Pseudomonas aeruginosa PA01
gagaccuuccugccagcgcg

SEQ ID NO: 1433677 - RNA, 16 nt, Pseudomonas aeruginosa PA01
gagaccucgcccaucg

SEQ ID NO: 1433678 - RNA, 22 nt, Pseudomonas aeruginosa PA01
gagaccucgcccaucgccaggg

SEQ ID NO: 1433679 - RNA, 14 nt, Pseudomonas aeruginosa PA01
gagaccggcagccg

SEQ ID NO: 1433680 - RNA, 20 nt, Pseudomonas aeruginosa PA01
gagacccgcaacaccuguac

SEQ ID NO: 1433681 - RNA, 17 nt, Pseudomonas aeruginosa PA01
gagacccgccagcggca

SEQ ID NO: 1433682 - RNA, 18 nt, Pseudomonas aeruginosa PA01
gagacuccggagaaccgg

SEQ ID NO: 1433683 - RNA, 13 nt, Pseudomonas aeruginosa PA01
gagacugaacucg

SEQ ID NO: 1433684 - RNA, 23 nt, Pseudomonas aeruginosa PA01
gagacguuggugauguugcgguc

SEQ ID NO: 1433685 - RNA, 14 nt, Pseudomonas aeruginosa PA01
gagacggcccgccc

SEQ ID NO: 1433686 - RNA, 20 nt, Pseudomonas aeruginosa PA01
gagacgggcgacgcccaugu

SEQ ID NO: 1433687 - RNA, 13 nt, Pseudomonas aeruginosa PA01
gagacgcugccgu

SEQ ID NO: 1433688 - RNA, 16 nt, Pseudomonas aeruginosa PA01
gagagauagucgccgu

SEQ ID NO: 1433689 - RNA, 16 nt, Pseudomonas aeruginosa PA01
gagagacccgccagcg

SEQ ID NO: 1433690 - RNA, 19 nt, Pseudomonas aeruginosa PA01
gagagacccgccagcggca

SEQ ID NO: 1433691 - RNA, 17 nt, Pseudomonas aeruginosa PA01
gagagcagggccuggcc

SEQ ID NO: 1433692 - RNA, 16 nt, Pseudomonas aeruginosa PA01
gagagcggcgccaggc

SEQ ID NO: 1433693 - RNA, 21 nt, Pseudomonas aeruginosa PA01
gagagcggcgccaggcguucc

SEQ ID NO: 1433694 - RNA, 18 nt, Pseudomonas aeruginosa PA01
gagagcggguagcgccgg

SEQ ID NO: 1433695 - RNA, 13 nt, Pseudomonas aeruginosa PA01
gagagcgccagcg

SEQ ID NO: 1433696 - RNA, 14 nt, Pseudomonas aeruginosa PA01
gagagcgccagcga

SEQ ID NO: 1433697 - RNA, 14 nt, Pseudomonas aeruginosa PA01
gagaggggcgcucg

SEQ ID NO: 1433698 - RNA, 19 nt, Pseudomonas aeruginosa PA01
gagaggggcgcucguugcg

SEQ ID NO: 1433699 - RNA, 22 nt, Pseudomonas aeruginosa PA01
gagaggggcgcucguugcgccg

SEQ ID NO: 1433700 - RNA, 21 nt, Pseudomonas aeruginosa PA01
gagaggggcucuuucauugcg

SEQ ID NO: 1433701 - RNA, 21 nt, Pseudomonas aeruginosa PA01
gagagggucagcaggcugccg

SEQ ID NO: 1433702 - RNA, 13 nt, Pseudomonas aeruginosa PA01
gagaucggcggcg

SEQ ID NO: 1433703 - RNA, 23 nt, Pseudomonas aeruginosa PA01
gagaucggcugcaacgccggccc

SEQ ID NO: 1433704 - RNA, 15 nt, Pseudomonas aeruginosa PA01
gagaucgcccagcgg

SEQ ID NO: 1433705 - RNA, 19 nt, Pseudomonas aeruginosa PA01
gagaucgcccagcggcugg

SEQ ID NO: 1433706 - RNA, 17 nt, Pseudomonas aeruginosa PA01
gagaucgagcgcgccca

SEQ ID NO: 1433707 - RNA, 16 nt, Pseudomonas aeruginosa PA01
gagauccuggccggcg

SEQ ID NO: 1433708 - RNA, 19 nt, Pseudomonas aeruginosa PA01
gagauccuggccggcggcg

SEQ ID NO: 1433709 - RNA, 13 nt, Pseudomonas aeruginosa PA01
gagaucagcgccc

SEQ ID NO: 1433710 - RNA, 23 nt, Pseudomonas aeruginosa PA01
gagauagagcuucucgucgccgc

SEQ ID NO: 1433711 - RNA, 17 nt, Pseudomonas aeruginosa PA01
gagcagggcgucgcccu

SEQ ID NO: 1433712 - RNA, 19 nt, Pseudomonas aeruginosa PA01
gagcagggcgucgcccucg

SEQ ID NO: 1433713 - RNA, 17 nt, Pseudomonas aeruginosa PA01
gagcagggucgcgagca

SEQ ID NO: 1433714 - RNA, 18 nt, Pseudomonas aeruginosa PA01
gagcagggucgcgagcag

SEQ ID NO: 1433715 - RNA, 13 nt, Pseudomonas aeruginosa PA01
gagcaggccgacg

SEQ ID NO: 1433716 - RNA, 15 nt, Pseudomonas aeruginosa PA01
gagcaggccgacggc

SEQ ID NO: 1433717 - RNA, 22 nt, Pseudomonas aeruginosa PA01
gagcagggcggauaaucgcagc

SEQ ID NO: 1433718 - RNA, 14 nt, Pseudomonas aeruginosa PA01
gagcagggcgccga

SEQ ID NO: 1433719 - RNA, 14 nt, Pseudomonas aeruginosa PA01
gagcagggcgcuga

SEQ ID NO: 1433720 - RNA, 14 nt, Pseudomonas aeruginosa PA01
gagcagggccgagc

SEQ ID NO: 1433721 - RNA, 22 nt, Pseudomonas aeruginosa PA01
gagcagggccgagcgcagcgcc

SEQ ID NO: 1433722 - RNA, 19 nt, Pseudomonas aeruginosa PA01
gagcaggcggaucgccgcc

SEQ ID NO: 1433723 - RNA, 14 nt, Pseudomonas aeruginosa PA01
gagcaggcggccgu

SEQ ID NO: 1433724 - RNA, 15 nt, Pseudomonas aeruginosa PA01
gagcaggcggccguc

SEQ ID NO: 1433725 - RNA, 19 nt, Pseudomonas aeruginosa PA01
gagcaggcguuccggggug

SEQ ID NO: 1433726 - RNA, 17 nt, Pseudomonas aeruginosa PA01
gagcaggcgccggacca

SEQ ID NO: 1433727 - RNA, 20 nt, Pseudomonas aeruginosa PA01
gagcaggcgcgccaggccca

SEQ ID NO: 1433728 - RNA, 15 nt, Pseudomonas aeruginosa PA01
gagcaguuccggcac

SEQ ID NO: 1433729 - RNA, 16 nt, Pseudomonas aeruginosa PA01
gagcagucgccuggcc

SEQ ID NO: 1433730 - RNA, 22 nt, Pseudomonas aeruginosa PA01
gagcagguccugucccagcgag

SEQ ID NO: 1433731 - RNA, 15 nt, Pseudomonas aeruginosa PA01
gagcagcaccagcac

SEQ ID NO: 1433732 - RNA, 23 nt, Pseudomonas aeruginosa PA01
gagcagcaccagcaccagcggga

SEQ ID NO: 1433733 - RNA, 14 nt, Pseudomonas aeruginosa PA01
gagcagcagcgccg

SEQ ID NO: 1433734 - RNA, 15 nt, Pseudomonas aeruginosa PA01
gagcagcagcgccgc

SEQ ID NO: 1433735 - RNA, 17 nt, Pseudomonas aeruginosa PA01
gagcagcagcgccgcga

SEQ ID NO: 1433736 - RNA, 14 nt, Pseudomonas aeruginosa PA01
gagcagcgccagcc

SEQ ID NO: 1433737 - RNA, 14 nt, Pseudomonas aeruginosa PA01
gagcagccaggcga

SEQ ID NO: 1433738 - RNA, 16 nt, Pseudomonas aeruginosa PA01
gagcagccaggcgaag

SEQ ID NO: 1433739 - RNA, 18 nt, Pseudomonas aeruginosa PA01
gagcagccaagccaccag

SEQ ID NO: 1433740 - RNA, 18 nt, Pseudomonas aeruginosa PA01
gagcagcucguucgccca

SEQ ID NO: 1433741 - RNA, 16 nt, Pseudomonas aeruginosa PA01
gagcagcucgccggcg

SEQ ID NO: 1433742 - RNA, 19 nt, Pseudomonas aeruginosa PA01
gagcagcucgccggcgucc

SEQ ID NO: 1433743 - RNA, 17 nt, Pseudomonas aeruginosa PA01
gagcagcuugcgcgagu

SEQ ID NO: 1433744 - RNA, 20 nt, Pseudomonas aeruginosa PA01
gagcagcuugcgcgaguagg

SEQ ID NO: 1433745 - RNA, 21 nt, Pseudomonas aeruginosa PA01
gagcaggaacucgaucagcgc

SEQ ID NO: 1433746 - RNA, 20 nt, Pseudomonas aeruginosa PA01
gagcaggacagcagggucgc

SEQ ID NO: 1433747 - RNA, 24 nt, Pseudomonas aeruginosa PA01
gagcaggacagcagggucgcgccg

SEQ ID NO: 1433748 - RNA, 16 nt, Pseudomonas aeruginosa PA01
gagcaggacugcccgc

SEQ ID NO: 1433749 - RNA, 21 nt, Pseudomonas aeruginosa PA01
gagcaggaggauacggcgcag

SEQ ID NO: 1433750 - RNA, 15 nt, Pseudomonas aeruginosa PA01
gagcaggcccaugau

SEQ ID NO: 1433751 - RNA, 14 nt, Pseudomonas aeruginosa PA01
gagcagcgccgcgg

SEQ ID NO: 1433752 - RNA, 15 nt, Pseudomonas aeruginosa PA01
gagcagcgccgcggu

SEQ ID NO: 1433753 - RNA, 15 nt, Pseudomonas aeruginosa PA01
gagcagcgcggcggc

SEQ ID NO: 1433754 - RNA, 23 nt, Pseudomonas aeruginosa PA01
gagcagcgcggcggcggccagca

SEQ ID NO: 1433755 - RNA, 15 nt, Pseudomonas aeruginosa PA01
gagcagcggcacgcu

SEQ ID NO: 1433756 - RNA, 13 nt, Pseudomonas aeruginosa PA01
gagcagcggcgcg

SEQ ID NO: 1433757 - RNA, 20 nt, Pseudomonas aeruginosa PA01
gagcagcggcgcuuuccacu

SEQ ID NO: 1433758 - RNA, 21 nt, Pseudomonas aeruginosa PA01
aacucgaaggccagcucgucg

SEQ ID NO: 1433759 - RNA, 18 nt, Pseudomonas aeruginosa PA01
gagcauuccucagcgccg

SEQ ID NO: 1433760 - RNA, 19 nt, Pseudomonas aeruginosa PA01
gagcauuccucagcgccgg

SEQ ID NO: 1433761 - RNA, 23 nt, Pseudomonas aeruginosa PA01
gagcauuccucagcgccgguagc

SEQ ID NO: 1433762 - RNA, 22 nt, Pseudomonas aeruginosa PA01
gagccacggauaugcgccgcca

SEQ ID NO: 1433763 - RNA, 16 nt, Pseudomonas aeruginosa PA01
aacuccgccaggcgcu

SEQ ID NO: 1433764 - RNA, 20 nt, Pseudomonas aeruginosa PA01
gagcaugauggugccgccgg

SEQ ID NO: 1433765 - RNA, 17 nt, Pseudomonas aeruginosa PA01
gagcaugaugcaggcag

SEQ ID NO: 1433766 - RNA, 20 nt, Pseudomonas aeruginosa PA01
aacucaugcccagcuuggcc

SEQ ID NO: 1433767 - RNA, 20 nt, Pseudomonas aeruginosa PA01
aacuccaccgguuucgccag

SEQ ID NO: 1433768 - RNA, 22 nt, Pseudomonas aeruginosa PA01
aacuccagagccaugggccggc

SEQ ID NO: 1433769 - RNA, 15 nt, Pseudomonas aeruginosa PA01
gagcaucacccgcga

SEQ ID NO: 1433770 - RNA, 14 nt, Pseudomonas aeruginosa PA01
gagcaucucgccgg

SEQ ID NO: 1433771 - RNA, 17 nt, Pseudomonas aeruginosa PA01
gagcaucucgccggcac

SEQ ID NO: 1433772 - RNA, 15 nt, Pseudomonas aeruginosa PA01
gagcaucucggccag

SEQ ID NO: 1433773 - RNA, 19 nt, Pseudomonas aeruginosa PA01
gagcaucucggccaggccc

SEQ ID NO: 1433774 - RNA, 15 nt, Pseudomonas aeruginosa PA01
gagcaucggcgcggc

SEQ ID NO: 1433775 - RNA, 16 nt, Pseudomonas aeruginosa PA01
gagcaucggcgcggcc

SEQ ID NO: 1433776 - RNA, 14 nt, Pseudomonas aeruginosa PA01
gagccgcagcggcu

SEQ ID NO: 1433777 - RNA, 15 nt, Pseudomonas aeruginosa PA01
gagccgaucaccagc

SEQ ID NO: 1433778 - RNA, 17 nt, Pseudomonas aeruginosa PA01
gagccgaucaccagcaa

SEQ ID NO: 1433779 - RNA, 20 nt, Pseudomonas aeruginosa PA01
gagccgagcaggccacgcac

SEQ ID NO: 1433780 - RNA, 21 nt, Pseudomonas aeruginosa PA01
gagccgagcaggccacgcacc

SEQ ID NO: 1433781 - RNA, 22 nt, Pseudomonas aeruginosa PA01
gagccgagcaggccacgcacca

SEQ ID NO: 1433782 - RNA, 23 nt, Pseudomonas aeruginosa PA01
gagcccggccgggauauggguga

SEQ ID NO: 1433783 - RNA, 17 nt, Pseudomonas aeruginosa PA01
gagcccgucgaagccag

SEQ ID NO: 1433784 - RNA, 22 nt, Pseudomonas aeruginosa PA01
gagccgaacuccggugucaggc

SEQ ID NO: 1433785 - RNA, 17 nt, Pseudomonas aeruginosa PA01
gagccagcccagcggcg

SEQ ID NO: 1433786 - RNA, 21 nt, Pseudomonas aeruginosa PA01
gagccagcccagcggcgcggc

SEQ ID NO: 1433787 - RNA, 18 nt, Pseudomonas aeruginosa PA01
gagccagccgcagcccgg

SEQ ID NO: 1433788 - RNA, 18 nt, Pseudomonas aeruginosa PA01
gagccagccguggcaggc

SEQ ID NO: 1433789 - RNA, 23 nt, Pseudomonas aeruginosa PA01
gagccagcgcucgaacgccgccc

SEQ ID NO: 1433790 - RNA, 12 nt, Pseudomonas aeruginosa PA01
gagccaggcgua

SEQ ID NO: 1433791 - RNA, 20 nt, Pseudomonas aeruginosa PA01
gagcccagcggcagggcggc

SEQ ID NO: 1433792 - RNA, 16 nt, Pseudomonas aeruginosa PA01
gagccaugggccggcc

SEQ ID NO: 1433793 - RNA, 13 nt, Pseudomonas aeruginosa PA01
gagccccggcagg

SEQ ID NO: 1433794 - RNA, 19 nt, Pseudomonas aeruginosa PA01
gagccccggcaggcaggcc

SEQ ID NO: 1433795 - RNA, 20 nt, Pseudomonas aeruginosa PA01
gagccccgguuacucgccgg

SEQ ID NO: 1433796 - RNA, 15 nt, Pseudomonas aeruginosa PA01
gagcccgagugcgcc

SEQ ID NO: 1433797 - RNA, 23 nt, Pseudomonas aeruginosa PA01
gagcccgagugcgcccagcagca

SEQ ID NO: 1433798 - RNA, 12 nt, Pseudomonas aeruginosa PA01
gagcccaggcag

SEQ ID NO: 1433799 - RNA, 13 nt, Pseudomonas aeruginosa PA01
gagccccaugccg

SEQ ID NO: 1433800 - RNA, 13 nt, Pseudomonas aeruginosa PA01
gagcccgccgaac

SEQ ID NO: 1433801 - RNA, 16 nt, Pseudomonas aeruginosa PA01
gagcccgccgaacagc

SEQ ID NO: 1433802 - RNA, 17 nt, Pseudomonas aeruginosa PA01
gagcccgccgaacagca

SEQ ID NO: 1433803 - RNA, 12 nt, Pseudomonas aeruginosa PA01
gagcccgccuga

SEQ ID NO: 1433804 - RNA, 16 nt, Pseudomonas aeruginosa PA01
gagcgccgcggcggcg

SEQ ID NO: 1433805 - RNA, 24 nt, Pseudomonas aeruginosa PA01
gagcgccgcggcggcgugcaggcc

SEQ ID NO: 1433806 - RNA, 16 nt, Pseudomonas aeruginosa PA01
gagcgauguccaggcc

SEQ ID NO: 1433807 - RNA, 23 nt, Pseudomonas aeruginosa PA01
gagcgauguccaggccgaucucg

SEQ ID NO: 1433808 - RNA, 11 nt, Pseudomonas aeruginosa PA01
gagcgccggcg

SEQ ID NO: 1433809 - RNA, 12 nt, Pseudomonas aeruginosa PA01
gagcgccggcgc

SEQ ID NO: 1433810 - RNA, 22 nt, Pseudomonas aeruginosa PA01
gagcgacuccgggaacagcccg

SEQ ID NO: 1433811 - RNA, 22 nt, Pseudomonas aeruginosa PA01
gagcgagaccaucuggaucagg

SEQ ID NO: 1433812 - RNA, 15 nt, Pseudomonas aeruginosa PA01
gagcgaucccagguc

SEQ ID NO: 1433813 - RNA, 15 nt, Pseudomonas aeruginosa PA01
gagcgaccggauggc

SEQ ID NO: 1433814 - RNA, 17 nt, Pseudomonas aeruginosa PA01
gagcgaauacaccgagc

SEQ ID NO: 1433815 - RNA, 18 nt, Pseudomonas aeruginosa PA01
gagcgaauacaccgagcg

SEQ ID NO: 1433816 - RNA, 16 nt, Pseudomonas aeruginosa PA01
gagccggugccggcgg

SEQ ID NO: 1433817 - RNA, 17 nt, Pseudomonas aeruginosa PA01
gagccggugccggcggc

SEQ ID NO: 1433818 - RNA, 18 nt, Pseudomonas aeruginosa PA01
gagccggugccggcggcg

SEQ ID NO: 1433819 - RNA, 16 nt, Pseudomonas aeruginosa PA01
gagccgucgccggcga

SEQ ID NO: 1433820 - RNA, 19 nt, Pseudomonas aeruginosa PA01
gagccgucggcuccgcuca

SEQ ID NO: 1433821 - RNA, 17 nt, Pseudomonas aeruginosa PA01
gagccguccugcggccg

SEQ ID NO: 1433822 - RNA, 14 nt, Pseudomonas aeruginosa PA01
gagcgaagcgucga

SEQ ID NO: 1433823 - RNA, 12 nt, Pseudomonas aeruginosa PA01
gagccgccgaac

SEQ ID NO: 1433824 - RNA, 19 nt, Pseudomonas aeruginosa PA01
gacguugcugcccuggcgc

SEQ ID NO: 1433825 - RNA, 17 nt, Pseudomonas aeruginosa PA01
gacuaccgaucggcugc

SEQ ID NO: 1433826 - RNA, 19 nt, Pseudomonas aeruginosa PA01
gacuccgggaacagcccgu

SEQ ID NO: 1433827 - RNA, 15 nt, Pseudomonas aeruginosa PA01
gacuccggaggcgca

SEQ ID NO: 1433828 - RNA, 20 nt, Pseudomonas aeruginosa PA01
gacuccggaggcgcacaggc

SEQ ID NO: 1433829 - RNA, 14 nt, Pseudomonas aeruginosa PA01
gacuccagccaggc

SEQ ID NO: 1433830 - RNA, 16 nt, Pseudomonas aeruginosa PA01
gacucagcgcgacagg

SEQ ID NO: 1433831 - RNA, 19 nt, Pseudomonas aeruginosa PA01
gacgugggaaaucaccgcc

SEQ ID NO: 1433832 - RNA, 23 nt, Pseudomonas aeruginosa PA01
gacgugggaaaucaccgccaccu

SEQ ID NO: 1433833 - RNA, 14 nt, Pseudomonas aeruginosa PA01
gacgugggccugcu

SEQ ID NO: 1433834 - RNA, 21 nt, Pseudomonas aeruginosa PA01
gacguggcauucgucgccgcu

SEQ ID NO: 1433835 - RNA, 22 nt, Pseudomonas aeruginosa PA01
gacguggcauucgucgccgcug

SEQ ID NO: 1433836 - RNA, 23 nt, Pseudomonas aeruginosa PA01
gacguggcauucgucgccgcugg

SEQ ID NO: 1433837 - RNA, 19 nt, Pseudomonas aeruginosa PA01
gacgugcugguagagccgg

SEQ ID NO: 1433838 - RNA, 20 nt, Pseudomonas aeruginosa PA01
gacgugcugguagagccggg

SEQ ID NO: 1433839 - RNA, 21 nt, Pseudomonas aeruginosa PA01
gacgugcugguagagccgggu

SEQ ID NO: 1433840 - RNA, 19 nt, Pseudomonas aeruginosa PA01
gacguugccgcgcgggccg

SEQ ID NO: 1433841 - RNA, 20 nt, Pseudomonas aeruginosa PA01
gacguugcgcaggggcgcgg

SEQ ID NO: 1433842 - RNA, 23 nt, Pseudomonas aeruginosa PA01
gacguuggccgggguauccgggc

SEQ ID NO: 1433843 - RNA, 22 nt, Pseudomonas aeruginosa PA01
gacguucugcccgccggcgccc

SEQ ID NO: 1433844 - RNA, 23 nt, Pseudomonas aeruginosa PA01
gacguucugcccgccggcgcccu

SEQ ID NO: 1433845 - RNA, 18 nt, Pseudomonas aeruginosa PA01
gacguucugcucgcugcc

SEQ ID NO: 1433846 - RNA, 16 nt, Pseudomonas aeruginosa PA01
gacgucgacgcagcgc

SEQ ID NO: 1433847 - RNA, 16 nt, Pseudomonas aeruginosa PA01
gacgucgacuucgucg

SEQ ID NO: 1433848 - RNA, 13 nt, Pseudomonas aeruginosa PA01
gacguccuggccg

SEQ ID NO: 1433849 - RNA, 16 nt, Pseudomonas aeruginosa PA01
gacguccugcggguca

SEQ ID NO: 1433850 - RNA, 19 nt, Pseudomonas aeruginosa PA01
gacgucgaaaccgaacggc

SEQ ID NO: 1433851 - RNA, 19 nt, Pseudomonas aeruginosa PA01
gacgucgaggaaggccagg

SEQ ID NO: 1433852 - RNA, 14 nt, Pseudomonas aeruginosa PA01
gacgucgaggucga

SEQ ID NO: 1433853 - RNA, 21 nt, Pseudomonas aeruginosa PA01
gacgucgaggucgacggcggc

SEQ ID NO: 1433854 - RNA, 18 nt, Pseudomonas aeruginosa PA01
gacgucgccccagccuug

SEQ ID NO: 1433855 - RNA, 16 nt, Pseudomonas aeruginosa PA01
gacgugaagccccugg

SEQ ID NO: 1433856 - RNA, 21 nt, Pseudomonas aeruginosa PA01
gacgucguggauaggcggcgg

SEQ ID NO: 1433857 - RNA, 18 nt, Pseudomonas aeruginosa PA01
gacgucguagccaggcac

SEQ ID NO: 1433858 - RNA, 22 nt, Pseudomonas aeruginosa PA01
gacgucgucggcgaccuugucg

SEQ ID NO: 1433859 - RNA, 14 nt, Pseudomonas aeruginosa PA01
gacgucggcggcgg

SEQ ID NO: 1433860 - RNA, 22 nt, Pseudomonas aeruginosa PA01
gacgacaucucguccucgggga

SEQ ID NO: 1433861 - RNA, 13 nt, Pseudomonas aeruginosa PA01
gacguacauggga

SEQ ID NO: 1433862 - RNA, 17 nt, Pseudomonas aeruginosa PA01
gacguaccgccugccau

SEQ ID NO: 1433863 - RNA, 15 nt, Pseudomonas aeruginosa PA01
gacguccaucagcgu

SEQ ID NO: 1433864 - RNA, 16 nt, Pseudomonas aeruginosa PA01
gacguccaucagcguc

SEQ ID NO: 1433865 - RNA, 13 nt, Pseudomonas aeruginosa PA01
gacgucccuuccc

SEQ ID NO: 1433866 - RNA, 20 nt, Pseudomonas aeruginosa PA01
gacguccuccaccgcuccgg

SEQ ID NO: 1433867 - RNA, 12 nt, Pseudomonas aeruginosa PA01
gacguccggcag

SEQ ID NO: 1433868 - RNA, 20 nt, Pseudomonas aeruginosa PA01
gacguagucggcagucgccg

SEQ ID NO: 1433869 - RNA, 21 nt, Pseudomonas aeruginosa PA01
gacguagucggcagucgccgc

SEQ ID NO: 1433870 - RNA, 20 nt, Pseudomonas aeruginosa PA01
gacgucacggauaggcggcg

SEQ ID NO: 1433871 - RNA, 21 nt, Pseudomonas aeruginosa PA01
gacgucacggauaggcggcgg

SEQ ID NO: 1433872 - RNA, 16 nt, Pseudomonas aeruginosa PA01
gacugacgguggaggc

SEQ ID NO: 1433873 - RNA, 16 nt, Pseudomonas aeruginosa PA01
gacugcaacuggccga

SEQ ID NO: 1433874 - RNA, 17 nt, Pseudomonas aeruginosa PA01
gacugcaacuggccgag

SEQ ID NO: 1433875 - RNA, 14 nt, Pseudomonas aeruginosa PA01
gacuccggcgcagc

SEQ ID NO: 1433876 - RNA, 13 nt, Pseudomonas aeruginosa PA01
gacucgauaccgu

SEQ ID NO: 1433877 - RNA, 19 nt, Pseudomonas aeruginosa PA01
gacucgaugaacgcccuga

SEQ ID NO: 1433878 - RNA, 16 nt, Pseudomonas aeruginosa PA01
gacucgaugcgcagcu

SEQ ID NO: 1433879 - RNA, 21 nt, Pseudomonas aeruginosa PA01
gacucgcucgcuucagcgagc

SEQ ID NO: 1433880 - RNA, 22 nt, Pseudomonas aeruginosa PA01
gacucgcucgcuucagcgagcg

SEQ ID NO: 1433881 - RNA, 18 nt, Pseudomonas aeruginosa PA01
gacucgcugccggcgcgc

SEQ ID NO: 1433882 - RNA, 19 nt, Pseudomonas aeruginosa PA01
gacucgcugccggcgcgca

SEQ ID NO: 1433883 - RNA, 16 nt, Pseudomonas aeruginosa PA01
gacucgcugggcgccg

SEQ ID NO: 1433884 - RNA, 20 nt, Pseudomonas aeruginosa PA01
gacucgcugggcgccggcag

SEQ ID NO: 1433885 - RNA, 23 nt, Pseudomonas aeruginosa PA01
gacucgcugggcgccggcaggcc

SEQ ID NO: 1433886 - RNA, 18 nt, Pseudomonas aeruginosa PA01
gacucguugcacgcaggc

SEQ ID NO: 1433887 - RNA, 20 nt, Pseudomonas aeruginosa PA01
gacucguugcacgcaggccg

SEQ ID NO: 1433888 - RNA, 19 nt, Pseudomonas aeruginosa PA01
gacucgguaaagcccaggu

SEQ ID NO: 1433889 - RNA, 21 nt, Pseudomonas aeruginosa PA01
gacucggugcguagcgacagg

SEQ ID NO: 1433890 - RNA, 16 nt, Pseudomonas aeruginosa PA01
gacugcccagcgccgc

SEQ ID NO: 1433891 - RNA, 18 nt, Pseudomonas aeruginosa PA01
gacugcccagcgccgcca

SEQ ID NO: 1433892 - RNA, 20 nt, Pseudomonas aeruginosa PA01
gacugcccagcgccgccagc

SEQ ID NO: 1433893 - RNA, 22 nt, Pseudomonas aeruginosa PA01
gacugcccagcgccgccagcag

SEQ ID NO: 1433894 - RNA, 19 nt, Pseudomonas aeruginosa PA01
gacugcaugaugccgugca

SEQ ID NO: 1433895 - RNA, 16 nt, Pseudomonas aeruginosa PA01
gacugccaacuggcgu

SEQ ID NO: 1433896 - RNA, 17 nt, Pseudomonas aeruginosa PA01
gacugccaacuggcguc

SEQ ID NO: 1433897 - RNA, 13 nt, Pseudomonas aeruginosa PA01
gacugccugcagg

SEQ ID NO: 1433898 - RNA, 17 nt, Pseudomonas aeruginosa PA01
gacugccugcagguagc

SEQ ID NO: 1433899 - RNA, 16 nt, Pseudomonas aeruginosa PA01
gacugccgucggcgcc

SEQ ID NO: 1433900 - RNA, 15 nt, Pseudomonas aeruginosa PA01
gacugcucgccgccg

SEQ ID NO: 1433901 - RNA, 18 nt, Pseudomonas aeruginosa PA01
gacugcucgccgccggcg

SEQ ID NO: 1433902 - RNA, 19 nt, Pseudomonas aeruginosa PA01
gacugcucgccgccggcga

SEQ ID NO: 1433903 - RNA, 14 nt, Pseudomonas aeruginosa PA01
gacugcugcugcgg

SEQ ID NO: 1433904 - RNA, 15 nt, Pseudomonas aeruginosa PA01
gacugcugcugcggg

SEQ ID NO: 1433905 - RNA, 22 nt, Pseudomonas aeruginosa PA01
gacugcugcugcggggccugcu

SEQ ID NO: 1433906 - RNA, 15 nt, Pseudomonas aeruginosa PA01
gacugcgagccgacu

SEQ ID NO: 1433907 - RNA, 21 nt, Pseudomonas aeruginosa PA01
gacugcggcagcuuggcgacg

SEQ ID NO: 1433908 - RNA, 19 nt, Pseudomonas aeruginosa PA01
gacuggggcaucucggcca

SEQ ID NO: 1433909 - RNA, 16 nt, Pseudomonas aeruginosa PA01
gacuggauucggccug

SEQ ID NO: 1433910 - RNA, 20 nt, Pseudomonas aeruginosa PA01
gacuggcagcgauaaccgcg

SEQ ID NO: 1433911 - RNA, 13 nt, Pseudomonas aeruginosa PA01
gacuggcccuggu

SEQ ID NO: 1433912 - RNA, 14 nt, Pseudomonas aeruginosa PA01
gacuggcccuggua

SEQ ID NO: 1433913 - RNA, 18 nt, Pseudomonas aeruginosa PA01
gacugguugaccugcagc

SEQ ID NO: 1433914 - RNA, 23 nt, Pseudomonas aeruginosa PA01
gacugguugaccugcagcgccuc

SEQ ID NO: 1433915 - RNA, 22 nt, Pseudomonas aeruginosa PA01
gacugguaggacagggccaggc

SEQ ID NO: 1433916 - RNA, 19 nt, Pseudomonas aeruginosa PA01
gacugucgagcagggucgc

SEQ ID NO: 1433917 - RNA, 18 nt, Pseudomonas aeruginosa PA01
gacuguccaauauagcca

SEQ ID NO: 1433918 - RNA, 20 nt, Pseudomonas aeruginosa PA01
gacuucgucgaagaccaggg

SEQ ID NO: 1433919 - RNA, 16 nt, Pseudomonas aeruginosa PA01
gacuuguacucgccgg

SEQ ID NO: 1433920 - RNA, 20 nt, Pseudomonas aeruginosa PA01
gacuuggagaagaucgccgu

SEQ ID NO: 1433921 - RNA, 19 nt, Pseudomonas aeruginosa PA01
gacuucgcaccagccggcc

SEQ ID NO: 1433922 - RNA, 22 nt, Pseudomonas aeruginosa PA01
gacuucgcaccagccggccgcg

SEQ ID NO: 1433923 - RNA, 20 nt, Pseudomonas aeruginosa PA01
gacuucggcgacagccgggc

SEQ ID NO: 1433924 - RNA, 16 nt, Pseudomonas aeruginosa PA01
gacuuccaggcgcagg

SEQ ID NO: 1433925 - RNA, 17 nt, Pseudomonas aeruginosa PA01
gacuuccaggcgcaggc

SEQ ID NO: 1433926 - RNA, 17 nt, Pseudomonas aeruginosa PA01
gacuuccaucagcucca

SEQ ID NO: 1433927 - RNA, 15 nt, Pseudomonas aeruginosa PA01
gagaagcagaacgcc

SEQ ID NO: 1433928 - RNA, 19 nt, Pseudomonas aeruginosa PA01
gagaacuugccggcgccau

SEQ ID NO: 1433929 - RNA, 22 nt, Pseudomonas aeruginosa PA01
gagaacuuuucccagcggcugc

SEQ ID NO: 1433930 - RNA, 22 nt, Pseudomonas aeruginosa PA01
gagaacgcggcgaagggcgcuu

SEQ ID NO: 1433931 - RNA, 23 nt, Pseudomonas aeruginosa PA01
gagaacgcggcgaagggcgcuuc

SEQ ID NO: 1433932 - RNA, 13 nt, Pseudomonas aeruginosa PA01
gagaacgccgcca

SEQ ID NO: 1433933 - RNA, 15 nt, Pseudomonas aeruginosa PA01
gagaacccggccagg

SEQ ID NO: 1433934 - RNA, 16 nt, Pseudomonas aeruginosa PA01
gagaacccggccaggc

SEQ ID NO: 1433935 - RNA, 17 nt, Pseudomonas aeruginosa PA01
gagaacccggccaggcc

SEQ ID NO: 1433936 - RNA, 21 nt, Pseudomonas aeruginosa PA01
gagaaauccggcuggcgccgg

SEQ ID NO: 1433937 - RNA, 22 nt, Pseudomonas aeruginosa PA01
gagaaagucgaucagcgcgcgg

SEQ ID NO: 1433938 - RNA, 23 nt, Pseudomonas aeruginosa PA01
gagaaaaaccacgggaauggcgg

SEQ ID NO: 1433939 - RNA, 16 nt, Pseudomonas aeruginosa PA01
aacuagcccucgaccu

SEQ ID NO: 1433940 - RNA, 15 nt, Pseudomonas aeruginosa PA01
gacugugguguagcg

SEQ ID NO: 1433941 - RNA, 20 nt, Pseudomonas aeruginosa PA01
gacugugguguagcgcaggu

SEQ ID NO: 1433942 - RNA, 23 nt, Pseudomonas aeruginosa PA01
gacugugguguagcgcagguugc

SEQ ID NO: 1433943 - RNA, 14 nt, Pseudomonas aeruginosa PA01
gaggaacaggucga

SEQ ID NO: 1433944 - RNA, 22 nt, Pseudomonas aeruginosa PA01
gaggaaaugauguugcgccaga

SEQ ID NO: 1433945 - RNA, 20 nt, Pseudomonas aeruginosa PA01
gaggaacgccgacaggccgg

SEQ ID NO: 1433946 - RNA, 18 nt, Pseudomonas aeruginosa PA01
gaggaacuugucgaccac

SEQ ID NO: 1433947 - RNA, 20 nt, Pseudomonas aeruginosa PA01
gaggaagagcagcgcggcgg

SEQ ID NO: 1433948 - RNA, 22 nt, Pseudomonas aeruginosa PA01
gaggaagagcagcgcggcggcg

SEQ ID NO: 1433949 - RNA, 15 nt, Pseudomonas aeruginosa PA01
gaggaaggccagcag

SEQ ID NO: 1433950 - RNA, 18 nt, Pseudomonas aeruginosa PA01
gaggaaggccaggucgcc

SEQ ID NO: 1433951 - RNA, 21 nt, Pseudomonas aeruginosa PA01
gaggaagcuccccgcaccugc

SEQ ID NO: 1433952 - RNA, 14 nt, Pseudomonas aeruginosa PA01
gaggaagccgaccg

SEQ ID NO: 1433953 - RNA, 19 nt, Pseudomonas aeruginosa PA01
gaggaacuccuccucgcuc

SEQ ID NO: 1433954 - RNA, 15 nt, Pseudomonas aeruginosa PA01
gaggaaguugcgcag

SEQ ID NO: 1433955 - RNA, 21 nt, Pseudomonas aeruginosa PA01
gaggaauaaagaaaaggccgc

SEQ ID NO: 1433956 - RNA, 15 nt, Pseudomonas aeruginosa PA01
gaggaaggcgccggc

SEQ ID NO: 1433957 - RNA, 18 nt, Pseudomonas aeruginosa PA01
gaggaaggcgcuggcgcu

SEQ ID NO: 1433958 - RNA, 22 nt, Pseudomonas aeruginosa PA01
gagcgcgcccugcaggccgaau

SEQ ID NO: 1433959 - RNA, 14 nt, Pseudomonas aeruginosa PA01
gagcgcgagcggca

SEQ ID NO: 1433960 - RNA, 17 nt, Pseudomonas aeruginosa PA01
gagcgcgaucagccgcu

SEQ ID NO: 1433961 - RNA, 22 nt, Pseudomonas aeruginosa PA01
gagcgcgaucagccgcuccagg

SEQ ID NO: 1433962 - RNA, 22 nt, Pseudomonas aeruginosa PA01
gaggaucuccgaguccugcugc

SEQ ID NO: 1433963 - RNA, 14 nt, Pseudomonas aeruginosa PA01
gaggaucuccuggc

SEQ ID NO: 1433964 - RNA, 16 nt, Pseudomonas aeruginosa PA01
gaggaucuccuggcgc

SEQ ID NO: 1433965 - RNA, 14 nt, Pseudomonas aeruginosa PA01
gaggaucucgccac

SEQ ID NO: 1433966 - RNA, 13 nt, Pseudomonas aeruginosa PA01
gaggaucucgcgc

SEQ ID NO: 1433967 - RNA, 14 nt, Pseudomonas aeruginosa PA01
gaggaucucgcgcc

SEQ ID NO: 1433968 - RNA, 18 nt, Pseudomonas aeruginosa PA01
gaggaagucggcggccgc

SEQ ID NO: 1433969 - RNA, 16 nt, Pseudomonas aeruginosa PA01
gaggaucuugcgcccg

SEQ ID NO: 1433970 - RNA, 18 nt, Pseudomonas aeruginosa PA01
gaggaucuugcgcccggc

SEQ ID NO: 1433971 - RNA, 17 nt, Pseudomonas aeruginosa PA01
gaggauggucaggccgg

SEQ ID NO: 1433972 - RNA, 18 nt, Pseudomonas aeruginosa PA01
gaggaugcugaucagcac

SEQ ID NO: 1433973 - RNA, 15 nt, Pseudomonas aeruginosa PA01
gaggauggccguccu

SEQ ID NO: 1433974 - RNA, 20 nt, Pseudomonas aeruginosa PA01
gaggcaaucugcccggcauc

SEQ ID NO: 1433975 - RNA, 23 nt, Pseudomonas aeruginosa PA01
gaggccgacgaacagccagaggu

SEQ ID NO: 1433976 - RNA, 15 nt, Pseudomonas aeruginosa PA01
gaggauucagcagga

SEQ ID NO: 1433977 - RNA, 17 nt, Pseudomonas aeruginosa PA01
gaggauuuccgcgcccg

SEQ ID NO: 1433978 - RNA, 21 nt, Pseudomonas aeruginosa PA01
gaggauuuccggcuugccgau

SEQ ID NO: 1433979 - RNA, 20 nt, Pseudomonas aeruginosa PA01
gaggauuuucuccggcgccg

SEQ ID NO: 1433980 - RNA, 19 nt, Pseudomonas aeruginosa PA01
gaggcaacaccaucggccc

SEQ ID NO: 1433981 - RNA, 18 nt, Pseudomonas aeruginosa PA01
gaggcgucggcgggaagg

SEQ ID NO: 1433982 - RNA, 20 nt, Pseudomonas aeruginosa PA01
gaggcgucgaaacgggcgcu

SEQ ID NO: 1433983 - RNA, 23 nt, Pseudomonas aeruginosa PA01
gaggcguaccggcuacaggccgu

SEQ ID NO: 1433984 - RNA, 14 nt, Pseudomonas aeruginosa PA01
gaggcggcgcagca

SEQ ID NO: 1433985 - RNA, 17 nt, Pseudomonas aeruginosa PA01
gaggcgggccagcaggg

SEQ ID NO: 1433986 - RNA, 12 nt, Pseudomonas aeruginosa PA01
gaggcgcgccga

SEQ ID NO: 1433987 - RNA, 14 nt, Pseudomonas aeruginosa PA01
gaggcgcgccgaca

SEQ ID NO: 1433988 - RNA, 14 nt, Pseudomonas aeruginosa PA01
gaggcgcgccuggu

SEQ ID NO: 1433989 - RNA, 12 nt, Pseudomonas aeruginosa PA01
gaggcgcggcgg

SEQ ID NO: 1433990 - RNA, 23 nt, Pseudomonas aeruginosa PA01
gaggcgcuccaccagggccucgg

SEQ ID NO: 1433991 - RNA, 12 nt, Pseudomonas aeruginosa PA01
gaggcggccgag

SEQ ID NO: 1433992 - RNA, 15 nt, Pseudomonas aeruginosa PA01
gaggcggccgagggc

SEQ ID NO: 1433993 - RNA, 18 nt, Pseudomonas aeruginosa PA01
gaggcggauuugccgccg

SEQ ID NO: 1433994 - RNA, 19 nt, Pseudomonas aeruginosa PA01
gaggcggauuugccgccga

SEQ ID NO: 1433995 - RNA, 21 nt, Pseudomonas aeruginosa PA01
gaggcggauuugccgccgagg

SEQ ID NO: 1433996 - RNA, 22 nt, Pseudomonas aeruginosa PA01
gaggcggauuugccgccgaggg

SEQ ID NO: 1433997 - RNA, 18 nt, Pseudomonas aeruginosa PA01
gaggcgcuggccagcgcu

SEQ ID NO: 1433998 - RNA, 18 nt, Pseudomonas aeruginosa PA01
gaggcgcagcagcgccag

SEQ ID NO: 1433999 - RNA, 19 nt, Pseudomonas aeruginosa PA01
gaggcgcagcagcgccagu

SEQ ID NO: 1434000 - RNA, 20 nt, Pseudomonas aeruginosa PA01
gaggcgcagcagcgccaguu

SEQ ID NO: 1434001 - RNA, 17 nt, Pseudomonas aeruginosa PA01
gaggcgaucgccgcggc

SEQ ID NO: 1434002 - RNA, 15 nt, Pseudomonas aeruginosa PA01
gaggcgaccuuggcc

SEQ ID NO: 1434003 - RNA, 18 nt, Pseudomonas aeruginosa PA01
gaggcgaccuuggccagc

SEQ ID NO: 1434004 - RNA, 23 nt, Pseudomonas aeruginosa PA01
gaggcgaggaaaaggaucgccgc

SEQ ID NO: 1434005 - RNA, 15 nt, Pseudomonas aeruginosa PA01
gaggcgaggucgccg

SEQ ID NO: 1434006 - RNA, 16 nt, Pseudomonas aeruginosa PA01
gaggcgaacggcaggu

SEQ ID NO: 1434007 - RNA, 17 nt, Pseudomonas aeruginosa PA01
gaggcgaccagccgggg

SEQ ID NO: 1434008 - RNA, 16 nt, Pseudomonas aeruginosa PA01
gaggccgcccagcgca

SEQ ID NO: 1434009 - RNA, 22 nt, Pseudomonas aeruginosa PA01
gaggccgcggagcaccgcgccu

SEQ ID NO: 1434010 - RNA, 13 nt, Pseudomonas aeruginosa PA01
gaggccgcccugg

SEQ ID NO: 1434011 - RNA, 19 nt, Pseudomonas aeruginosa PA01
gaggccggcaugcaggugg

SEQ ID NO: 1434012 - RNA, 21 nt, Pseudomonas aeruginosa PA01
gaggccggccccaccagcaac

SEQ ID NO: 1434013 - RNA, 23 nt, Pseudomonas aeruginosa PA01
gaggccggcgaucagcucgcggu

SEQ ID NO: 1434014 - RNA, 20 nt, Pseudomonas aeruginosa PA01
gaggccuucgccgaccaggu

SEQ ID NO: 1434015 - RNA, 22 nt, Pseudomonas aeruginosa PA01
gaggccgguguagcgacggaag

SEQ ID NO: 1434016 - RNA, 14 nt, Pseudomonas aeruginosa PA01
gaggccgugguggc

SEQ ID NO: 1434017 - RNA, 23 nt, Pseudomonas aeruginosa PA01
gaguguucccucaggauagccgg

SEQ ID NO: 1434018 - RNA, 20 nt, Pseudomonas aeruginosa PA01
gaguucccagaccuggccgc

SEQ ID NO: 1434019 - RNA, 21 nt, Pseudomonas aeruginosa PA01
gaguucccagaccuggccgcu

SEQ ID NO: 1434020 - RNA, 20 nt, Pseudomonas aeruginosa PA01
gaguggccgcgccccacggc

SEQ ID NO: 1434021 - RNA, 13 nt, Pseudomonas aeruginosa PA01
gaguggccgcuga

SEQ ID NO: 1434022 - RNA, 19 nt, Pseudomonas aeruginosa PA01
gaguggccgcugagcagca

SEQ ID NO: 1434023 - RNA, 21 nt, Pseudomonas aeruginosa PA01
gaguggcgaagccagcacggu

SEQ ID NO: 1434024 - RNA, 15 nt, Pseudomonas aeruginosa PA01
gaguggcgcagcgcc

SEQ ID NO: 1434025 - RNA, 23 nt, Pseudomonas aeruginosa PA01
gaguggcgcagcgcccgauaggc

SEQ ID NO: 1434026 - RNA, 14 nt, Pseudomonas aeruginosa PA01
gagugggaugacga

SEQ ID NO: 1434027 - RNA, 16 nt, Pseudomonas aeruginosa PA01
gagugcgcagcagcgu

SEQ ID NO: 1434028 - RNA, 13 nt, Pseudomonas aeruginosa PA01
gagggcggcgacc

SEQ ID NO: 1434029 - RNA, 15 nt, Pseudomonas aeruginosa PA01
gagggcggcggcuca

SEQ ID NO: 1434030 - RNA, 17 nt, Pseudomonas aeruginosa PA01
gagggcgcggcgccagc

SEQ ID NO: 1434031 - RNA, 19 nt, Pseudomonas aeruginosa PA01
gagggcgacccagcgcugg

SEQ ID NO: 1434032 - RNA, 17 nt, Pseudomonas aeruginosa PA01
gagggcgaccgccaggc

SEQ ID NO: 1434033 - RNA, 22 nt, Pseudomonas aeruginosa PA01
gagggcgaccgccaggcggccg

SEQ ID NO: 1434034 - RNA, 23 nt, Pseudomonas aeruginosa PA01
gagggcguccugcuuccagaccu

SEQ ID NO: 1434035 - RNA, 14 nt, Pseudomonas aeruginosa PA01
gagggcacggccag

SEQ ID NO: 1434036 - RNA, 18 nt, Pseudomonas aeruginosa PA01
gagggcaugaccgauggc

SEQ ID NO: 1434037 - RNA, 20 nt, Pseudomonas aeruginosa PA01
gagggcccggggagggugcc

SEQ ID NO: 1434038 - RNA, 11 nt, Pseudomonas aeruginosa PA01
gagggccgcgc

SEQ ID NO: 1434039 - RNA, 14 nt, Pseudomonas aeruginosa PA01
gagggccgcgccga

SEQ ID NO: 1434040 - RNA, 14 nt, Pseudomonas aeruginosa PA01
gaggcguggaaggg

SEQ ID NO: 1434041 - RNA, 18 nt, Pseudomonas aeruginosa PA01
gaggcguuauccgccgau

SEQ ID NO: 1434042 - RNA, 19 nt, Pseudomonas aeruginosa PA01
gaggcguuauccgccgaua

SEQ ID NO: 1434043 - RNA, 22 nt, Pseudomonas aeruginosa PA01
gaggcguucaugaaagccagca

SEQ ID NO: 1434044 - RNA, 17 nt, Pseudomonas aeruginosa PA01
gagggagcgccuggcgu

SEQ ID NO: 1434045 - RNA, 22 nt, Pseudomonas aeruginosa PA01
gagggcaaaggcgcgcagggcc

SEQ ID NO: 1434046 - RNA, 24 nt, Pseudomonas aeruginosa PA01
gagggcaaaggcgcgcagggccgc

SEQ ID NO: 1434047 - RNA, 18 nt, Pseudomonas aeruginosa PA01
gagggauaccaacuuucc

SEQ ID NO: 1434048 - RNA, 18 nt, Pseudomonas aeruginosa PA01
gagggauguuccaggccc

SEQ ID NO: 1434049 - RNA, 13 nt, Pseudomonas aeruginosa PA01
gaggugucgccgc

SEQ ID NO: 1434050 - RNA, 16 nt, Pseudomonas aeruginosa PA01
gaggugucgccgcgga

SEQ ID NO: 1434051 - RNA, 21 nt, Pseudomonas aeruginosa PA01
gagguggccgaguggccgaag

SEQ ID NO: 1434052 - RNA, 15 nt, Pseudomonas aeruginosa PA01
gaggugcggcugccg

SEQ ID NO: 1434053 - RNA, 16 nt, Pseudomonas aeruginosa PA01
gaggugcggcugccgg

SEQ ID NO: 1434054 - RNA, 17 nt, Pseudomonas aeruginosa PA01
gagguggaugaacagcg

SEQ ID NO: 1434055 - RNA, 18 nt, Pseudomonas aeruginosa PA01
gagguuccgcggcgacgg

SEQ ID NO: 1434056 - RNA, 20 nt, Pseudomonas aeruginosa PA01
gaguaucgcccuggccucgg

SEQ ID NO: 1434057 - RNA, 22 nt, Pseudomonas aeruginosa PA01
gagucaccccgaccagcgcgcu

SEQ ID NO: 1434058 - RNA, 15 nt, Pseudomonas aeruginosa PA01
gagucaggcgccggc

SEQ ID NO: 1434059 - RNA, 17 nt, Pseudomonas aeruginosa PA01
gagucaggcgccggccu

SEQ ID NO: 1434060 - RNA, 18 nt, Pseudomonas aeruginosa PA01
gagucaggcgccggccuc

SEQ ID NO: 1434061 - RNA, 15 nt, Pseudomonas aeruginosa PA01
gagucaacgccuggc

SEQ ID NO: 1434062 - RNA, 16 nt, Pseudomonas aeruginosa PA01
gagucaacgccuggcc

SEQ ID NO: 1434063 - RNA, 22 nt, Pseudomonas aeruginosa PA01
gagucaacgccuggccacgcca

SEQ ID NO: 1434064 - RNA, 22 nt, Pseudomonas aeruginosa PA01
gauaaagcuggaccaccguggc

SEQ ID NO: 1434065 - RNA, 13 nt, Pseudomonas aeruginosa PA01
gaguugcaggccg

SEQ ID NO: 1434066 - RNA, 22 nt, Pseudomonas aeruginosa PA01
gaguugccagacgaucagcggc

SEQ ID NO: 1434067 - RNA, 18 nt, Pseudomonas aeruginosa PA01
gaguuugcccagcgccgc

SEQ ID NO: 1434068 - RNA, 21 nt, Pseudomonas aeruginosa PA01
gaguuugcccagcgccgccug

SEQ ID NO: 1434069 - RNA, 18 nt, Pseudomonas aeruginosa PA01
gaguucgaagcgccaggc

SEQ ID NO: 1434070 - RNA, 13 nt, Pseudomonas aeruginosa PA01
gaguucggcugcg

SEQ ID NO: 1434071 - RNA, 20 nt, Pseudomonas aeruginosa PA01
gaguucgcgcgggucgucga

SEQ ID NO: 1434072 - RNA, 19 nt, Pseudomonas aeruginosa PA01
gaguucgcugaggacugcc

SEQ ID NO: 1434073 - RNA, 16 nt, Pseudomonas aeruginosa PA01
gaguugaccagcaugu

SEQ ID NO: 1434074 - RNA, 16 nt, Pseudomonas aeruginosa PA01
gaguucgucaaccagc

SEQ ID NO: 1434075 - RNA, 20 nt, Pseudomonas aeruginosa PA01
gaguucgucgagcaugacga

SEQ ID NO: 1434076 - RNA, 23 nt, Pseudomonas aeruginosa PA01
gaguucgcccagcucgccgcucc

SEQ ID NO: 1434077 - RNA, 14 nt, Pseudomonas aeruginosa PA01
gauaccgcuggcca

SEQ ID NO: 1434078 - RNA, 16 nt, Pseudomonas aeruginosa PA01
gauaccgcuggccagg

SEQ ID NO: 1434079 - RNA, 20 nt, Pseudomonas aeruginosa PA01
gauacgcaggaacuggucga

SEQ ID NO: 1434080 - RNA, 15 nt, Pseudomonas aeruginosa PA01
gauaccgccggcggc

SEQ ID NO: 1434081 - RNA, 16 nt, Pseudomonas aeruginosa PA01
gauaccgcacggccgu

SEQ ID NO: 1434082 - RNA, 17 nt, Pseudomonas aeruginosa PA01
gauaagccgcgccaucg

SEQ ID NO: 1434083 - RNA, 18 nt, Pseudomonas aeruginosa PA01
gauaucgucgggacgcau

SEQ ID NO: 1434084 - RNA, 14 nt, Pseudomonas aeruginosa PA01
gauaugcaggucga

SEQ ID NO: 1434085 - RNA, 19 nt, Pseudomonas aeruginosa PA01
gaucaacuggucgcagccg

SEQ ID NO: 1434086 - RNA, 20 nt, Pseudomonas aeruginosa PA01
gaucaacuggucgcagccgc

SEQ ID NO: 1434087 - RNA, 13 nt, Pseudomonas aeruginosa PA01
gaucaacgcggcc

SEQ ID NO: 1434088 - RNA, 19 nt, Pseudomonas aeruginosa PA01
gaucaacgcggccagcagc

SEQ ID NO: 1434089 - RNA, 22 nt, Pseudomonas aeruginosa PA01
gaucacccccagcgagccgagc

SEQ ID NO: 1434090 - RNA, 15 nt, Pseudomonas aeruginosa PA01
gaucacccgcccgcc

SEQ ID NO: 1434091 - RNA, 16 nt, Pseudomonas aeruginosa PA01
gaucacccgcccgccg

SEQ ID NO: 1434092 - RNA, 20 nt, Pseudomonas aeruginosa PA01
gaucacccgcccgccgucgc

SEQ ID NO: 1434093 - RNA, 19 nt, Pseudomonas aeruginosa PA01
gaucacgaagcggucgccg

SEQ ID NO: 1434094 - RNA, 21 nt, Pseudomonas aeruginosa PA01
gaucaccgcggugcggauggc

SEQ ID NO: 1434095 - RNA, 18 nt, Pseudomonas aeruginosa PA01
gaucaccgcaucgaaggc

SEQ ID NO: 1434096 - RNA, 22 nt, Pseudomonas aeruginosa PA01
gaucaccgcaucgaaggcgccg

SEQ ID NO: 1434097 - RNA, 13 nt, Pseudomonas aeruginosa PA01
gauagccgcaagc

SEQ ID NO: 1434098 - RNA, 17 nt, Pseudomonas aeruginosa PA01
gauagccgaccaggccg

SEQ ID NO: 1434099 - RNA, 20 nt, Pseudomonas aeruginosa PA01
gauagaccaggaaggccggg

SEQ ID NO: 1434100 - RNA, 20 nt, Pseudomonas aeruginosa PA01
gauagagcuucucgucgccg

SEQ ID NO: 1434101 - RNA, 22 nt, Pseudomonas aeruginosa PA01
gauagagcuucucgucgccgcc

SEQ ID NO: 1434102 - RNA, 21 nt, Pseudomonas aeruginosa PA01
gauagucguucuuccugagca

SEQ ID NO: 1434103 - RNA, 19 nt, Pseudomonas aeruginosa PA01
gauagggaaacacgucgau

SEQ ID NO: 1434104 - RNA, 16 nt, Pseudomonas aeruginosa PA01
gauagggcaucagccc

SEQ ID NO: 1434105 - RNA, 21 nt, Pseudomonas aeruginosa PA01
gauagggcaucagccccucgg

SEQ ID NO: 1434106 - RNA, 18 nt, Pseudomonas aeruginosa PA01
gauauccgggcccaggcu

SEQ ID NO: 1434107 - RNA, 17 nt, Pseudomonas aeruginosa PA01
gauauccagggccagga

SEQ ID NO: 1434108 - RNA, 14 nt, Pseudomonas aeruginosa PA01
gauaucggcgccgg

SEQ ID NO: 1434109 - RNA, 15 nt, Pseudomonas aeruginosa PA01
gauaucggcgccggc

SEQ ID NO: 1434110 - RNA, 16 nt, Pseudomonas aeruginosa PA01
gauaucggcgccggcc

SEQ ID NO: 1434111 - RNA, 18 nt, Pseudomonas aeruginosa PA01
gauagugcggccaggcgu

SEQ ID NO: 1434112 - RNA, 15 nt, Pseudomonas aeruginosa PA01
gaucgcggcgcaggc

SEQ ID NO: 1434113 - RNA, 17 nt, Pseudomonas aeruginosa PA01
gaucgcggccagccgcu

SEQ ID NO: 1434114 - RNA, 18 nt, Pseudomonas aeruginosa PA01
gaucgcggccagccgcua

SEQ ID NO: 1434115 - RNA, 23 nt, Pseudomonas aeruginosa PA01
gaucgcggcgacgaucaccccca

SEQ ID NO: 1434116 - RNA, 18 nt, Pseudomonas aeruginosa PA01
gaucgcgccgagcuggcg

SEQ ID NO: 1434117 - RNA, 21 nt, Pseudomonas aeruginosa PA01
gaucgcgccggaugggcgagc

SEQ ID NO: 1434118 - RNA, 12 nt, Pseudomonas aeruginosa PA01
gaucgcgcggcu

SEQ ID NO: 1434119 - RNA, 13 nt, Pseudomonas aeruginosa PA01
gaucgcgcggcug

SEQ ID NO: 1434120 - RNA, 16 nt, Pseudomonas aeruginosa PA01
gaucgcgccgucgcug

SEQ ID NO: 1434121 - RNA, 21 nt, Pseudomonas aeruginosa PA01
gaucgcgccgucgcuggcgau

SEQ ID NO: 1434122 - RNA, 15 nt, Pseudomonas aeruginosa PA01
gaucgcgcuggccag

SEQ ID NO: 1434123 - RNA, 16 nt, Pseudomonas aeruginosa PA01
gaucgcgcuggccagu

SEQ ID NO: 1434124 - RNA, 20 nt, Pseudomonas aeruginosa PA01
gaucgcgucguauaggcgcu

SEQ ID NO: 1434125 - RNA, 18 nt, Pseudomonas aeruginosa PA01
gaucgcgugggccaccau

SEQ ID NO: 1434126 - RNA, 15 nt, Pseudomonas aeruginosa PA01
gaucgcgucgcaggc

SEQ ID NO: 1434127 - RNA, 16 nt, Pseudomonas aeruginosa PA01
gaucgcgucgcaggcg

SEQ ID NO: 1434128 - RNA, 21 nt, Pseudomonas aeruginosa PA01
gaucgcgucgcaggcgaugcc

SEQ ID NO: 1434129 - RNA, 16 nt, Pseudomonas aeruginosa PA01
gaucgcuucgcggauc

SEQ ID NO: 1434130 - RNA, 17 nt, Pseudomonas aeruginosa PA01
gaucgcuucgcggaucu

SEQ ID NO: 1434131 - RNA, 15 nt, Pseudomonas aeruginosa PA01
gaucgcguuccagca

SEQ ID NO: 1434132 - RNA, 14 nt, Pseudomonas aeruginosa PA01
gaucgcucccaggc

SEQ ID NO: 1434133 - RNA, 15 nt, Pseudomonas aeruginosa PA01
gaucgcucccaggcu

SEQ ID NO: 1434134 - RNA, 21 nt, Pseudomonas aeruginosa PA01
gaucggcgcgcagggccagca

SEQ ID NO: 1434135 - RNA, 22 nt, Pseudomonas aeruginosa PA01
gaucggcgcgcagggccagcaa

SEQ ID NO: 1434136 - RNA, 12 nt, Pseudomonas aeruginosa PA01
gaucggcgcgcc

SEQ ID NO: 1434137 - RNA, 21 nt, Pseudomonas aeruginosa PA01
gaucggcgcccagcaccacag

SEQ ID NO: 1434138 - RNA, 13 nt, Pseudomonas aeruginosa PA01
gaucggccuuggc

SEQ ID NO: 1434139 - RNA, 14 nt, Pseudomonas aeruginosa PA01
gaucggccuuggcg

SEQ ID NO: 1434140 - RNA, 15 nt, Pseudomonas aeruginosa PA01
gaucggccucgcggc

SEQ ID NO: 1434141 - RNA, 20 nt, Pseudomonas aeruginosa PA01
gaucggccucgcggcgcucg

SEQ ID NO: 1434142 - RNA, 12 nt, Pseudomonas aeruginosa PA01
gaucggcccggg

SEQ ID NO: 1434143 - RNA, 13 nt, Pseudomonas aeruginosa PA01
gaucggcccgggc

SEQ ID NO: 1434144 - RNA, 20 nt, Pseudomonas aeruginosa PA01
gaucggcccgggcgccaccg

SEQ ID NO: 1434145 - RNA, 15 nt, Pseudomonas aeruginosa PA01
gaucggcgcgccggc

SEQ ID NO: 1434146 - RNA, 24 nt, Pseudomonas aeruginosa PA01
gaucggcaagcugaagcgccgcgg

SEQ ID NO: 1434147 - RNA, 19 nt, Pseudomonas aeruginosa PA01
gaucggauugaggacgcug

SEQ ID NO: 1434148 - RNA, 20 nt, Pseudomonas aeruginosa PA01
gaucggcaacuggcuggccu

SEQ ID NO: 1434149 - RNA, 14 nt, Pseudomonas aeruginosa PA01
gaucgcuaccgaca

SEQ ID NO: 1434150 - RNA, 21 nt, Pseudomonas aeruginosa PA01
gaucggaagaucgcccgccug

SEQ ID NO: 1434151 - RNA, 21 nt, Pseudomonas aeruginosa PA01
gaucggagagacccgccagcg

SEQ ID NO: 1434152 - RNA, 20 nt, Pseudomonas aeruginosa PA01
gaucggauaccagaucacca

SEQ ID NO: 1434153 - RNA, 17 nt, Pseudomonas aeruginosa PA01
gaucggcagcaucagcc

SEQ ID NO: 1434154 - RNA, 21 nt, Pseudomonas aeruginosa PA01
gaucggcagcaucagccgcga

SEQ ID NO: 1434155 - RNA, 14 nt, Pseudomonas aeruginosa PA01
gaucggcagcucgc

SEQ ID NO: 1434156 - RNA, 20 nt, Pseudomonas aeruginosa PA01
gaucggcagggcgccgacca

SEQ ID NO: 1434157 - RNA, 13 nt, Pseudomonas aeruginosa PA01
gaucggcccggcg

SEQ ID NO: 1434158 - RNA, 15 nt, Pseudomonas aeruginosa PA01
gaucucgcgccccgg

SEQ ID NO: 1434159 - RNA, 22 nt, Pseudomonas aeruginosa PA01
gaucucgcccagggcguggucg

SEQ ID NO: 1434160 - RNA, 20 nt, Pseudomonas aeruginosa PA01
gaucucgcggcgcggcgggu

SEQ ID NO: 1434161 - RNA, 17 nt, Pseudomonas aeruginosa PA01
gaucucgcguuccagca

SEQ ID NO: 1434162 - RNA, 16 nt, Pseudomonas aeruginosa PA01
gaucgucgaagcucgg

SEQ ID NO: 1434163 - RNA, 16 nt, Pseudomonas aeruginosa PA01
gaucgucgcggcgcga

SEQ ID NO: 1434164 - RNA, 20 nt, Pseudomonas aeruginosa PA01
gaucgucucggugcucaggc

SEQ ID NO: 1434165 - RNA, 20 nt, Pseudomonas aeruginosa PA01
gaucgucuuucucgaucucg

SEQ ID NO: 1434166 - RNA, 18 nt, Pseudomonas aeruginosa PA01
gaucgucgaaagccucga

SEQ ID NO: 1434167 - RNA, 21 nt, Pseudomonas aeruginosa PA01
gaucgucgaaagccucgacga

SEQ ID NO: 1434168 - RNA, 23 nt, Pseudomonas aeruginosa PA01
gaucggugcgggcagacaccacc

SEQ ID NO: 1434169 - RNA, 14 nt, Pseudomonas aeruginosa PA01
gaucggcuggucgu

SEQ ID NO: 1434170 - RNA, 19 nt, Pseudomonas aeruginosa PA01
gaucggcguuuacgcgcca

SEQ ID NO: 1434171 - RNA, 15 nt, Pseudomonas aeruginosa PA01
gaucggcggcgcggc

SEQ ID NO: 1434172 - RNA, 16 nt, Pseudomonas aeruginosa PA01
gaucggcggcgcggcg

SEQ ID NO: 1434173 - RNA, 13 nt, Pseudomonas aeruginosa PA01
gaucggcggcgcg

SEQ ID NO: 1434174 - RNA, 20 nt, Pseudomonas aeruginosa PA01
gaucggcugaccggcaucga

SEQ ID NO: 1434175 - RNA, 19 nt, Pseudomonas aeruginosa PA01
gaucggcugcaacgccggc

SEQ ID NO: 1434176 - RNA, 21 nt, Pseudomonas aeruginosa PA01
gaucggggaagggacgucgcc

SEQ ID NO: 1434177 - RNA, 23 nt, Pseudomonas aeruginosa PA01
gaucggggaagggacgucgccag

SEQ ID NO: 1434178 - RNA, 15 nt, Pseudomonas aeruginosa PA01
gaucgggcuucggca

SEQ ID NO: 1434179 - RNA, 17 nt, Pseudomonas aeruginosa PA01
gaucgggcuucggcagc

SEQ ID NO: 1434180 - RNA, 20 nt, Pseudomonas aeruginosa PA01
gaucagucaggaucggcgcc

SEQ ID NO: 1434181 - RNA, 14 nt, Pseudomonas aeruginosa PA01
gauccacagcaggu

SEQ ID NO: 1434182 - RNA, 22 nt, Pseudomonas aeruginosa PA01
gauccacagcagguugcuggcg

SEQ ID NO: 1434183 - RNA, 14 nt, Pseudomonas aeruginosa PA01
gauccacucgcccu

SEQ ID NO: 1434184 - RNA, 13 nt, Pseudomonas aeruginosa PA01
gaucaguggucgc

SEQ ID NO: 1434185 - RNA, 16 nt, Pseudomonas aeruginosa PA01
gaucaguaccggcagc

SEQ ID NO: 1434186 - RNA, 20 nt, Pseudomonas aeruginosa PA01
gaucaguaccggcagcgccg

SEQ ID NO: 1434187 - RNA, 21 nt, Pseudomonas aeruginosa PA01
gaucaguaccggcagcgccga

SEQ ID NO: 1434188 - RNA, 15 nt, Pseudomonas aeruginosa PA01
gaucauguagagcag

SEQ ID NO: 1434189 - RNA, 19 nt, Pseudomonas aeruginosa PA01
gaucauguagagcaggcug

SEQ ID NO: 1434190 - RNA, 20 nt, Pseudomonas aeruginosa PA01
gaucauguagagcaggcugc

SEQ ID NO: 1434191 - RNA, 19 nt, Pseudomonas aeruginosa PA01
gaucaugggggccagcagg

SEQ ID NO: 1434192 - RNA, 12 nt, Pseudomonas aeruginosa PA01
gaucccgaucgc

SEQ ID NO: 1434193 - RNA, 19 nt, Pseudomonas aeruginosa PA01
gaucccgcgcgggccgagg

SEQ ID NO: 1434194 - RNA, 15 nt, Pseudomonas aeruginosa PA01
gauccccucccgcgc

SEQ ID NO: 1434195 - RNA, 17 nt, Pseudomonas aeruginosa PA01
gauccccucccgcgcca

SEQ ID NO: 1434196 - RNA, 19 nt, Pseudomonas aeruginosa PA01
gauccccucccgcgccagc

SEQ ID NO: 1434197 - RNA, 20 nt, Pseudomonas aeruginosa PA01
gauccccucccgcgccagcg

SEQ ID NO: 1434198 - RNA, 23 nt, Pseudomonas aeruginosa PA01
gauccccucccgcgccagcgccg

SEQ ID NO: 1434199 - RNA, 16 nt, Pseudomonas aeruginosa PA01
gauccccuccuccagc

SEQ ID NO: 1434200 - RNA, 17 nt, Pseudomonas aeruginosa PA01
gauccauguagaaggcg

SEQ ID NO: 1434201 - RNA, 13 nt, Pseudomonas aeruginosa PA01
gaucacucgccgc

SEQ ID NO: 1434202 - RNA, 18 nt, Pseudomonas aeruginosa PA01
gaucacucgccgccgucc

SEQ ID NO: 1434203 - RNA, 20 nt, Pseudomonas aeruginosa PA01
gaucacguagaugccggugc

SEQ ID NO: 1434204 - RNA, 20 nt, Pseudomonas aeruginosa PA01
gaucacguaggacaggucgg

SEQ ID NO: 1434205 - RNA, 21 nt, Pseudomonas aeruginosa PA01
gaucacgccgcgcaccagcac

SEQ ID NO: 1434206 - RNA, 14 nt, Pseudomonas aeruginosa PA01
gaucacgcagcagg

SEQ ID NO: 1434207 - RNA, 15 nt, Pseudomonas aeruginosa PA01
gaucacgcagcaggc

SEQ ID NO: 1434208 - RNA, 19 nt, Pseudomonas aeruginosa PA01
gaucacgaucggcaccauc

SEQ ID NO: 1434209 - RNA, 14 nt, Pseudomonas aeruginosa PA01
gaucacgauggccg

SEQ ID NO: 1434210 - RNA, 20 nt, Pseudomonas aeruginosa PA01
gaucacgauggccggcagca

SEQ ID NO: 1434211 - RNA, 22 nt, Pseudomonas aeruginosa PA01
gaucacgcaagugcccugggcg

SEQ ID NO: 1434212 - RNA, 15 nt, Pseudomonas aeruginosa PA01
gaucagguucggcag

SEQ ID NO: 1434213 - RNA, 20 nt, Pseudomonas aeruginosa PA01
gaucagguucggcagcgccu

SEQ ID NO: 1434214 - RNA, 17 nt, Pseudomonas aeruginosa PA01
gaucagguugaagagca

SEQ ID NO: 1434215 - RNA, 23 nt, Pseudomonas aeruginosa PA01
gaucagguugaagagcagcacca

SEQ ID NO: 1434216 - RNA, 16 nt, Pseudomonas aeruginosa PA01
gaucagguugccggcg

SEQ ID NO: 1434217 - RNA, 17 nt, Pseudomonas aeruginosa PA01
gaucagguugccggcgu

SEQ ID NO: 1434218 - RNA, 15 nt, Pseudomonas aeruginosa PA01
gaucaggucgccgcc

SEQ ID NO: 1434219 - RNA, 18 nt, Pseudomonas aeruginosa PA01
gaucaggucgcgcgccuu

SEQ ID NO: 1434220 - RNA, 14 nt, Pseudomonas aeruginosa PA01
gaucaggucggccg

SEQ ID NO: 1434221 - RNA, 16 nt, Pseudomonas aeruginosa PA01
gaucaggucggccgcc

SEQ ID NO: 1434222 - RNA, 18 nt, Pseudomonas aeruginosa PA01
gaucaggucggccgccuc

SEQ ID NO: 1434223 - RNA, 16 nt, Pseudomonas aeruginosa PA01
gaucaggucgccagcg

SEQ ID NO: 1434224 - RNA, 17 nt, Pseudomonas aeruginosa PA01
gaucaggucgccagcgc

SEQ ID NO: 1434225 - RNA, 13 nt, Pseudomonas aeruginosa PA01
gaucaggucgccg

SEQ ID NO: 1434226 - RNA, 14 nt, Pseudomonas aeruginosa PA01
gaucagguccuggc

SEQ ID NO: 1434227 - RNA, 17 nt, Pseudomonas aeruginosa PA01
gaucagguccuggccga

SEQ ID NO: 1434228 - RNA, 20 nt, Pseudomonas aeruginosa PA01
gaucagguccuggccgaagu

SEQ ID NO: 1434229 - RNA, 19 nt, Pseudomonas aeruginosa PA01
gaucagguaggcgccgugc

SEQ ID NO: 1434230 - RNA, 20 nt, Pseudomonas aeruginosa PA01
gaucagguaggcgccgugcu

SEQ ID NO: 1434231 - RNA, 17 nt, Pseudomonas aeruginosa PA01
gaucagcaccgccacca

SEQ ID NO: 1434232 - RNA, 19 nt, Pseudomonas aeruginosa PA01
gaucagcacccggucggcc

SEQ ID NO: 1434233 - RNA, 23 nt, Pseudomonas aeruginosa PA01
gaucgcauuguugcggucgcgcc

SEQ ID NO: 1434234 - RNA, 20 nt, Pseudomonas aeruginosa PA01
gaucgccacgccggcgcucc

SEQ ID NO: 1434235 - RNA, 13 nt, Pseudomonas aeruginosa PA01
gaucgccaccccg

SEQ ID NO: 1434236 - RNA, 15 nt, Pseudomonas aeruginosa PA01
gaucgccaccccgcc

SEQ ID NO: 1434237 - RNA, 20 nt, Pseudomonas aeruginosa PA01
gaucgccaccccgccgcugg

SEQ ID NO: 1434238 - RNA, 22 nt, Pseudomonas aeruginosa PA01
gaucgccaccccgccgcuggcg

SEQ ID NO: 1434239 - RNA, 23 nt, Pseudomonas aeruginosa PA01
gaucgccaccccgccgcuggcgg

SEQ ID NO: 1434240 - RNA, 12 nt, Pseudomonas aeruginosa PA01
gaucgccagccc

SEQ ID NO: 1434241 - RNA, 12 nt, Pseudomonas aeruginosa PA01
gaucgccagcaa

SEQ ID NO: 1434242 - RNA, 23 nt, Pseudomonas aeruginosa PA01
gaucgccagcaauugccgcugca

SEQ ID NO: 1434243 - RNA, 20 nt, Pseudomonas aeruginosa PA01
gaucgccaggcgauccagcg

SEQ ID NO: 1434244 - RNA, 20 nt, Pseudomonas aeruginosa PA01
gaucgccagcgguacccgcc

SEQ ID NO: 1434245 - RNA, 18 nt, Pseudomonas aeruginosa PA01
gaucgccagcucgccgcg

SEQ ID NO: 1434246 - RNA, 13 nt, Pseudomonas aeruginosa PA01
gaucgccagcgcc

SEQ ID NO: 1434247 - RNA, 14 nt, Pseudomonas aeruginosa PA01
gaucgccagcgcca

SEQ ID NO: 1434248 - RNA, 16 nt, Pseudomonas aeruginosa PA01
gaucgccagcgccagc

SEQ ID NO: 1434249 - RNA, 19 nt, Pseudomonas aeruginosa PA01
gaucgccagcgccagcagg

SEQ ID NO: 1434250 - RNA, 15 nt, Pseudomonas aeruginosa PA01
gaucgcccagcggcu

SEQ ID NO: 1434251 - RNA, 23 nt, Pseudomonas aeruginosa PA01
gaucgcccagcggcuggcgggcg

SEQ ID NO: 1434252 - RNA, 16 nt, Pseudomonas aeruginosa PA01
gaucgcgaagcgcagc

SEQ ID NO: 1434253 - RNA, 17 nt, Pseudomonas aeruginosa PA01
gaucgcgaagcgcagca

SEQ ID NO: 1434254 - RNA, 21 nt, Pseudomonas aeruginosa PA01
gaucgcgcaaugccgcgucga

SEQ ID NO: 1434255 - RNA, 17 nt, Pseudomonas aeruginosa PA01
gaucgccuugcgcgugc

SEQ ID NO: 1434256 - RNA, 20 nt, Pseudomonas aeruginosa PA01
gaucgccuugcgcgugcugg

SEQ ID NO: 1434257 - RNA, 22 nt, Pseudomonas aeruginosa PA01
gaucgcgaagaacacgccccag

SEQ ID NO: 1434258 - RNA, 16 nt, Pseudomonas aeruginosa PA01
gaucgcccgaacgccg

SEQ ID NO: 1434259 - RNA, 17 nt, Pseudomonas aeruginosa PA01
gaucgccugcuggccgg

SEQ ID NO: 1434260 - RNA, 13 nt, Pseudomonas aeruginosa PA01
gaucgccucggcc

SEQ ID NO: 1434261 - RNA, 14 nt, Pseudomonas aeruginosa PA01
gaucgccucggcgc

SEQ ID NO: 1434262 - RNA, 16 nt, Pseudomonas aeruginosa PA01
gaucgccucgucgagc

SEQ ID NO: 1434263 - RNA, 20 nt, Pseudomonas aeruginosa PA01
gaucgccucguucagcagca

SEQ ID NO: 1434264 - RNA, 20 nt, Pseudomonas aeruginosa PA01
gaucccguguaccacgcccg

SEQ ID NO: 1434265 - RNA, 21 nt, Pseudomonas aeruginosa PA01
gaucccguguaccacgcccgc

SEQ ID NO: 1434266 - RNA, 23 nt, Pseudomonas aeruginosa PA01
gauccgcgcuuccgcaucggccg

SEQ ID NO: 1434267 - RNA, 19 nt, Pseudomonas aeruginosa PA01
gauccgcggaucguccggg

SEQ ID NO: 1434268 - RNA, 14 nt, Pseudomonas aeruginosa PA01
gauccgcgccugcu

SEQ ID NO: 1434269 - RNA, 17 nt, Pseudomonas aeruginosa PA01
gaucccguagaccggcu

SEQ ID NO: 1434270 - RNA, 18 nt, Pseudomonas aeruginosa PA01
gaucccguagaccggcuc

SEQ ID NO: 1434271 - RNA, 19 nt, Pseudomonas aeruginosa PA01
gaucccggauucgccgagg

SEQ ID NO: 1434272 - RNA, 12 nt, Pseudomonas aeruginosa PA01
gaucccggcggc

SEQ ID NO: 1434273 - RNA, 16 nt, Pseudomonas aeruginosa PA01
gaucccggcggcgacc

SEQ ID NO: 1434274 - RNA, 17 nt, Pseudomonas aeruginosa PA01
gaucccggcggcgaccc

SEQ ID NO: 1434275 - RNA, 18 nt, Pseudomonas aeruginosa PA01
gaucccggcggcgaccca

SEQ ID NO: 1434276 - RNA, 12 nt, Pseudomonas aeruginosa PA01
gaucccggcggu

SEQ ID NO: 1434277 - RNA, 21 nt, Pseudomonas aeruginosa PA01
gauccggccgaucuccuggcg

SEQ ID NO: 1434278 - RNA, 22 nt, Pseudomonas aeruginosa PA01
gauccggacuggauucggccug

SEQ ID NO: 1434279 - RNA, 17 nt, Pseudomonas aeruginosa PA01
gauccgcuccagcgccu

SEQ ID NO: 1434280 - RNA, 19 nt, Pseudomonas aeruginosa PA01
gauccgcuccagcgccucg

SEQ ID NO: 1434281 - RNA, 20 nt, Pseudomonas aeruginosa PA01
gauccgcuccagcgccucga

SEQ ID NO: 1434282 - RNA, 13 nt, Pseudomonas aeruginosa PA01
gauccgcuccagg

SEQ ID NO: 1434283 - RNA, 20 nt, Pseudomonas aeruginosa PA01
gauccgcucgaucccggcgc

SEQ ID NO: 1434284 - RNA, 17 nt, Pseudomonas aeruginosa PA01
gauccgcguggcgugcu

SEQ ID NO: 1434285 - RNA, 19 nt, Pseudomonas aeruginosa PA01
gauccgcguuaccguccgc

SEQ ID NO: 1434286 - RNA, 22 nt, Pseudomonas aeruginosa PA01
gauccgcguuaccguccgcgcc

SEQ ID NO: 1434287 - RNA, 19 nt, Pseudomonas aeruginosa PA01
gaucgagcagcggcgccaa

SEQ ID NO: 1434288 - RNA, 14 nt, Pseudomonas aeruginosa PA01
gaucgagccagcgc

SEQ ID NO: 1434289 - RNA, 18 nt, Pseudomonas aeruginosa PA01
gaucgagccagcgcucga

SEQ ID NO: 1434290 - RNA, 23 nt, Pseudomonas aeruginosa PA01
gaucgagccagcgcucgaacgcc

SEQ ID NO: 1434291 - RNA, 14 nt, Pseudomonas aeruginosa PA01
gaucgagcccuggu

SEQ ID NO: 1434292 - RNA, 14 nt, Pseudomonas aeruginosa PA01
gaucgagcccuugc

SEQ ID NO: 1434293 - RNA, 20 nt, Pseudomonas aeruginosa PA01
gaucgagcccuugcgcggcg

SEQ ID NO: 1434294 - RNA, 16 nt, Pseudomonas aeruginosa PA01
gaucgacucgauggcg

SEQ ID NO: 1434295 - RNA, 17 nt, Pseudomonas aeruginosa PA01
gaucgacugcaugaccu

SEQ ID NO: 1434296 - RNA, 15 nt, Pseudomonas aeruginosa PA01
gaucgacgccgcugg

SEQ ID NO: 1434297 - RNA, 16 nt, Pseudomonas aeruginosa PA01
gaucgacgccgcuggc

SEQ ID NO: 1434298 - RNA, 17 nt, Pseudomonas aeruginosa PA01
gaucgacgccgcuggcg

SEQ ID NO: 1434299 - RNA, 18 nt, Pseudomonas aeruginosa PA01
gaucgacgccgcuggcgg

SEQ ID NO: 1434300 - RNA, 20 nt, Pseudomonas aeruginosa PA01
gaucgacgccgcuggcggcg

SEQ ID NO: 1434301 - RNA, 22 nt, Pseudomonas aeruginosa PA01
gaucgacgccgcuggcggcgcu

SEQ ID NO: 1434302 - RNA, 23 nt, Pseudomonas aeruginosa PA01
gaucgacgccuucguggccgcgg

SEQ ID NO: 1434303 - RNA, 13 nt, Pseudomonas aeruginosa PA01
gaucgagccgccg

SEQ ID NO: 1434304 - RNA, 14 nt, Pseudomonas aeruginosa PA01
gaucgagccgccgg

SEQ ID NO: 1434305 - RNA, 15 nt, Pseudomonas aeruginosa PA01
gcacgcguccgacca

SEQ ID NO: 1434306 - RNA, 12 nt, Pseudomonas aeruginosa PA01
gcacgcuggcgu

SEQ ID NO: 1434307 - RNA, 12 nt, Pseudomonas aeruginosa PA01
gcacgcuggcga

SEQ ID NO: 1434308 - RNA, 13 nt, Pseudomonas aeruginosa PA01
gcacgcuggcgag

SEQ ID NO: 1434309 - RNA, 22 nt, Pseudomonas aeruginosa PA01
gcacgcuggcgaggacgccggg

SEQ ID NO: 1434310 - RNA, 23 nt, Pseudomonas aeruginosa PA01
gcacgcuggcgaggacgccgggc

SEQ ID NO: 1434311 - RNA, 17 nt, Pseudomonas aeruginosa PA01
gcacggaaacgccgaga

SEQ ID NO: 1434312 - RNA, 18 nt, Pseudomonas aeruginosa PA01
gcacggaaacgccgagaa

SEQ ID NO: 1434313 - RNA, 16 nt, Pseudomonas aeruginosa PA01
gcacggauaccacccg

SEQ ID NO: 1434314 - RNA, 20 nt, Pseudomonas aeruginosa PA01
gcacggauaccacccgcagc

SEQ ID NO: 1434315 - RNA, 18 nt, Pseudomonas aeruginosa PA01
gcacggaucgcgcugggc

SEQ ID NO: 1434316 - RNA, 20 nt, Pseudomonas aeruginosa PA01
gcacggaucgcgcugggcgc

SEQ ID NO: 1434317 - RNA, 14 nt, Pseudomonas aeruginosa PA01
gcacggaugcccag

SEQ ID NO: 1434318 - RNA, 15 nt, Pseudomonas aeruginosa PA01
gcacggaggcgcuca

SEQ ID NO: 1434319 - RNA, 21 nt, Pseudomonas aeruginosa PA01
gcacgcuucuccucggccgac

SEQ ID NO: 1434320 - RNA, 15 nt, Pseudomonas aeruginosa PA01
gcacgcuggugccga

SEQ ID NO: 1434321 - RNA, 21 nt, Pseudomonas aeruginosa PA01
gcacggaagcgcugcucgacc

SEQ ID NO: 1434322 - RNA, 22 nt, Pseudomonas aeruginosa PA01
gcacggaagcgcugcucgacca

SEQ ID NO: 1434323 - RNA, 23 nt, Pseudomonas aeruginosa PA01
gcacggaagcgcugcucgaccac

SEQ ID NO: 1434324 - RNA, 13 nt, Pseudomonas aeruginosa PA01
gcacgccggccuc

SEQ ID NO: 1434325 - RNA, 15 nt, Pseudomonas aeruginosa PA01
gcacgccgcggaagg

SEQ ID NO: 1434326 - RNA, 12 nt, Pseudomonas aeruginosa PA01
gcacgccgaucc

SEQ ID NO: 1434327 - RNA, 16 nt, Pseudomonas aeruginosa PA01
gcacgccgcgaccgaa

SEQ ID NO: 1434328 - RNA, 18 nt, Pseudomonas aeruginosa PA01
gcacgcggaucuggcccu

SEQ ID NO: 1434329 - RNA, 20 nt, Pseudomonas aeruginosa PA01
gcacgggauuuccgauccuc

SEQ ID NO: 1434330 - RNA, 14 nt, Pseudomonas aeruginosa PA01
gcacggcucggcga

SEQ ID NO: 1434331 - RNA, 16 nt, Pseudomonas aeruginosa PA01
gcacggcucggcgagg

SEQ ID NO: 1434332 - RNA, 23 nt, Pseudomonas aeruginosa PA01
gcacggcucggcgaggaacagca

SEQ ID NO: 1434333 - RNA, 20 nt, Pseudomonas aeruginosa PA01
gcacggcuucagcgccaggc

SEQ ID NO: 1434334 - RNA, 19 nt, Pseudomonas aeruginosa PA01
gcacggcggcuacccgcgc

SEQ ID NO: 1434335 - RNA, 12 nt, Pseudomonas aeruginosa PA01
gcaccugcgccc

SEQ ID NO: 1434336 - RNA, 13 nt, Pseudomonas aeruginosa PA01
gcaccugcgcccc

SEQ ID NO: 1434337 - RNA, 13 nt, Pseudomonas aeruginosa PA01
gcaccugcgccga

SEQ ID NO: 1434338 - RNA, 12 nt, Pseudomonas aeruginosa PA01
gcaccuugucgc

SEQ ID NO: 1434339 - RNA, 21 nt, Pseudomonas aeruginosa PA01
gcaccuugagggccuuggccu

SEQ ID NO: 1434340 - RNA, 15 nt, Pseudomonas aeruginosa PA01
gcaccuugugcugcc

SEQ ID NO: 1434341 - RNA, 21 nt, Pseudomonas aeruginosa PA01
gcaccuuggcuugcagguagc

SEQ ID NO: 1434342 - RNA, 15 nt, Pseudomonas aeruginosa PA01
gcaccuuggccaugg

SEQ ID NO: 1434343 - RNA, 20 nt, Pseudomonas aeruginosa PA01
gcaccuuggccaugggcacg

SEQ ID NO: 1434344 - RNA, 19 nt, Pseudomonas aeruginosa PA01
gcacgaaagccaugcccag

SEQ ID NO: 1434345 - RNA, 20 nt, Pseudomonas aeruginosa PA01
gcacgaaagccaugcccaga

SEQ ID NO: 1434346 - RNA, 23 nt, Pseudomonas aeruginosa PA01
gcacgaaagcguucuucagcacu

SEQ ID NO: 1434347 - RNA, 15 nt, Pseudomonas aeruginosa PA01
gcaccucggccaggc

SEQ ID NO: 1434348 - RNA, 18 nt, Pseudomonas aeruginosa PA01
gcaccucggccaggcggu

SEQ ID NO: 1434349 - RNA, 17 nt, Pseudomonas aeruginosa PA01
gcaccucgaccgcgccg

SEQ ID NO: 1434350 - RNA, 17 nt, Pseudomonas aeruginosa PA01
gcaccucgaccugguag

SEQ ID NO: 1434351 - RNA, 20 nt, Pseudomonas aeruginosa PA01
gcaccucgaccugguagccg

SEQ ID NO: 1434352 - RNA, 16 nt, Pseudomonas aeruginosa PA01
gcaccucgacgcccgc

SEQ ID NO: 1434353 - RNA, 23 nt, Pseudomonas aeruginosa PA01
gcaccucguccagcaggacgucg

SEQ ID NO: 1434354 - RNA, 19 nt, Pseudomonas aeruginosa PA01
gcaccucgucgagcagcgc

SEQ ID NO: 1434355 - RNA, 20 nt, Pseudomonas aeruginosa PA01
gcaccucgucgagcagcgcg

SEQ ID NO: 1434356 - RNA, 17 nt, Pseudomonas aeruginosa PA01
gcaccucccccagcggg

SEQ ID NO: 1434357 - RNA, 12 nt, Pseudomonas aeruginosa PA01
gcaccucgcggg

SEQ ID NO: 1434358 - RNA, 21 nt, Pseudomonas aeruginosa PA01
gcacgaaccauugcggcccgc

SEQ ID NO: 1434359 - RNA, 22 nt, Pseudomonas aeruginosa PA01
gcacgaaccauugcggcccgcc

SEQ ID NO: 1434360 - RNA, 17 nt, Pseudomonas aeruginosa PA01
gcacgaacaggugcugg

SEQ ID NO: 1434361 - RNA, 15 nt, Pseudomonas aeruginosa PA01
gcacgacgccggugc

SEQ ID NO: 1434362 - RNA, 19 nt, Pseudomonas aeruginosa PA01
gcacgaggauuuccgcgcc

SEQ ID NO: 1434363 - RNA, 24 nt, Pseudomonas aeruginosa PA01
gcacgaggauuuccgcgcccggcu

SEQ ID NO: 1434364 - RNA, 14 nt, Pseudomonas aeruginosa PA01
gcacgcagcgccgc

SEQ ID NO: 1434365 - RNA, 14 nt, Pseudomonas aeruginosa PA01
gcacgcaggccgcu

SEQ ID NO: 1434366 - RNA, 16 nt, Pseudomonas aeruginosa PA01
gcacgcaggccgcugc

SEQ ID NO: 1434367 - RNA, 14 nt, Pseudomonas aeruginosa PA01
gcacgcagggcuau

SEQ ID NO: 1434368 - RNA, 16 nt, Pseudomonas aeruginosa PA01
gcacgcauagcgcgcu

SEQ ID NO: 1434369 - RNA, 21 nt, Pseudomonas aeruginosa PA01
gcacgcccugggacaggcguc

SEQ ID NO: 1434370 - RNA, 21 nt, Pseudomonas aeruginosa PA01
gcacgcccuugcuguucgccu

SEQ ID NO: 1434371 - RNA, 20 nt, Pseudomonas aeruginosa PA01
gcacgccgaaguccugcaac

SEQ ID NO: 1434372 - RNA, 23 nt, Pseudomonas aeruginosa PA01
gcacgccgaaguccugcaacagg

SEQ ID NO: 1434373 - RNA, 21 nt, Pseudomonas aeruginosa PA01
gcacgcaauggcgcagccgcu

SEQ ID NO: 1434374 - RNA, 17 nt, Pseudomonas aeruginosa PA01
gcacgaugucgaccugg

SEQ ID NO: 1434375 - RNA, 13 nt, Pseudomonas aeruginosa PA01
gcacgaugcugaa

SEQ ID NO: 1434376 - RNA, 14 nt, Pseudomonas aeruginosa PA01
gcaccguggucagc

SEQ ID NO: 1434377 - RNA, 17 nt, Pseudomonas aeruginosa PA01
gcaccguggucagcacc

SEQ ID NO: 1434378 - RNA, 18 nt, Pseudomonas aeruginosa PA01
gcaccguggucagcacca

SEQ ID NO: 1434379 - RNA, 19 nt, Pseudomonas aeruginosa PA01
gcaccguggucagcaccag

SEQ ID NO: 1434380 - RNA, 21 nt, Pseudomonas aeruginosa PA01
gcaccguggucagcaccaggg

SEQ ID NO: 1434381 - RNA, 14 nt, Pseudomonas aeruginosa PA01
gcaccguggcgcca

SEQ ID NO: 1434382 - RNA, 17 nt, Pseudomonas aeruginosa PA01
gcaccguggcgccaucc

SEQ ID NO: 1434383 - RNA, 18 nt, Pseudomonas aeruginosa PA01
gcaccgucgagcaccagg

SEQ ID NO: 1434384 - RNA, 20 nt, Pseudomonas aeruginosa PA01
gcaccgucgagcaccaggcg

SEQ ID NO: 1434385 - RNA, 15 nt, Pseudomonas aeruginosa PA01
gcaccggggugaucc

SEQ ID NO: 1434386 - RNA, 18 nt, Pseudomonas aeruginosa PA01
gcaccgggccgaccugcc

SEQ ID NO: 1434387 - RNA, 23 nt, Pseudomonas aeruginosa PA01
gcaccgggacgaagcggaagccg

SEQ ID NO: 1434388 - RNA, 16 nt, Pseudomonas aeruginosa PA01
gcaccgggaggcgccg

SEQ ID NO: 1434389 - RNA, 17 nt, Pseudomonas aeruginosa PA01
gcaccgggaggcgccgc

SEQ ID NO: 1434390 - RNA, 23 nt, Pseudomonas aeruginosa PA01
gcaccgggaggcgccgcgccagg

SEQ ID NO: 1434391 - RNA, 12 nt, Pseudomonas aeruginosa PA01
gcaccgucaagg

SEQ ID NO: 1434392 - RNA, 15 nt, Pseudomonas aeruginosa PA01
gcaccgucaagggcc

SEQ ID NO: 1434393 - RNA, 15 nt, Pseudomonas aeruginosa PA01
gcaccguagcggcug

SEQ ID NO: 1434394 - RNA, 17 nt, Pseudomonas aeruginosa PA01
gcaccguagcggcugcg

SEQ ID NO: 1434395 - RNA, 15 nt, Pseudomonas aeruginosa PA01
gcaccguaggccagg

SEQ ID NO: 1434396 - RNA, 17 nt, Pseudomonas aeruginosa PA01
gcaccguaggccaggca

SEQ ID NO: 1434397 - RNA, 21 nt, Pseudomonas aeruginosa PA01
gcaccgucauggugcguuacc

SEQ ID NO: 1434398 - RNA, 22 nt, Pseudomonas aeruginosa PA01
gcaccgucaccuguucggcgcu

SEQ ID NO: 1434399 - RNA, 15 nt, Pseudomonas aeruginosa PA01
gcaccgcggcgcgga

SEQ ID NO: 1434400 - RNA, 16 nt, Pseudomonas aeruginosa PA01
gcaccggcggcgccag

SEQ ID NO: 1434401 - RNA, 23 nt, Pseudomonas aeruginosa PA01
gcaccggcggcgccaggccggcg

SEQ ID NO: 1434402 - RNA, 18 nt, Pseudomonas aeruginosa PA01
gcaccggcgauggccggc

SEQ ID NO: 1434403 - RNA, 21 nt, Pseudomonas aeruginosa PA01
gcaccggcgauggccggcacc

SEQ ID NO: 1434404 - RNA, 21 nt, Pseudomonas aeruginosa PA01
gcaccggcuucuggaaggcgg

SEQ ID NO: 1434405 - RNA, 21 nt, Pseudomonas aeruginosa PA01
gcaccggcuuguugcgcucca

SEQ ID NO: 1434406 - RNA, 15 nt, Pseudomonas aeruginosa PA01
gcaccgcgccggcgg

SEQ ID NO: 1434407 - RNA, 15 nt, Pseudomonas aeruginosa PA01
gcaccgcccagccga

SEQ ID NO: 1434408 - RNA, 16 nt, Pseudomonas aeruginosa PA01
gcaccgcgccggcggu

SEQ ID NO: 1434409 - RNA, 14 nt, Pseudomonas aeruginosa PA01
gcaccgcgccggga

SEQ ID NO: 1434410 - RNA, 15 nt, Pseudomonas aeruginosa PA01
gcaccgcgccgggaa

SEQ ID NO: 1434411 - RNA, 16 nt, Pseudomonas aeruginosa PA01
gcaccgcgccuuccag

SEQ ID NO: 1434412 - RNA, 18 nt, Pseudomonas aeruginosa PA01
gcaccgcgccuuccagcc

SEQ ID NO: 1434413 - RNA, 23 nt, Pseudomonas aeruginosa PA01
gcaccgcgccuuccagcccuucg

SEQ ID NO: 1434414 - RNA, 13 nt, Pseudomonas aeruginosa PA01
gcaccgcggcgag

SEQ ID NO: 1434415 - RNA, 15 nt, Pseudomonas aeruginosa PA01
gcaccgcggcgagcc

SEQ ID NO: 1434416 - RNA, 12 nt, Pseudomonas aeruginosa PA01
gcaccgcggcca

SEQ ID NO: 1434417 - RNA, 22 nt, Pseudomonas aeruginosa PA01
gcaccgcgcgcuuuuccggcgc

SEQ ID NO: 1434418 - RNA, 13 nt, Pseudomonas aeruginosa PA01
gcaccgccagccc

SEQ ID NO: 1434419 - RNA, 15 nt, Pseudomonas aeruginosa PA01
gcaccgccaccagcg

SEQ ID NO: 1434420 - RNA, 17 nt, Pseudomonas aeruginosa PA01
gcaccgccaccagcgag

SEQ ID NO: 1434421 - RNA, 13 nt, Pseudomonas aeruginosa PA01
gcaccgccagcag

SEQ ID NO: 1434422 - RNA, 14 nt, Pseudomonas aeruginosa PA01
gcaccgccagcagu

SEQ ID NO: 1434423 - RNA, 17 nt, Pseudomonas aeruginosa PA01
gcaccauccgccgcagg

SEQ ID NO: 1434424 - RNA, 13 nt, Pseudomonas aeruginosa PA01
gcaccaucagcca

SEQ ID NO: 1434425 - RNA, 14 nt, Pseudomonas aeruginosa PA01
gcaccaucagccag

SEQ ID NO: 1434426 - RNA, 17 nt, Pseudomonas aeruginosa PA01
gcaccaucagccagccc

SEQ ID NO: 1434427 - RNA, 19 nt, Pseudomonas aeruginosa PA01
gcaccaucagccagcccag

SEQ ID NO: 1434428 - RNA, 20 nt, Pseudomonas aeruginosa PA01
gcacccaggauuuguccgcg

SEQ ID NO: 1434429 - RNA, 18 nt, Pseudomonas aeruginosa PA01
gcacccaggccacgccca

SEQ ID NO: 1434430 - RNA, 21 nt, Pseudomonas aeruginosa PA01
gcacccagucuucgcuggcga

SEQ ID NO: 1434431 - RNA, 24 nt, Pseudomonas aeruginosa PA01
gcacccagguagagaagcguucgc

SEQ ID NO: 1434432 - RNA, 16 nt, Pseudomonas aeruginosa PA01
gcaccccgaccacccu

SEQ ID NO: 1434433 - RNA, 17 nt, Pseudomonas aeruginosa PA01
gcaccccgagcccggcc

SEQ ID NO: 1434434 - RNA, 20 nt, Pseudomonas aeruginosa PA01
gcaccccgagcccggccggg

SEQ ID NO: 1434435 - RNA, 17 nt, Pseudomonas aeruginosa PA01
gcaccccgagcggcgcg

SEQ ID NO: 1434436 - RNA, 17 nt, Pseudomonas aeruginosa PA01
gcaccaguggcgccgcc

SEQ ID NO: 1434437 - RNA, 18 nt, Pseudomonas aeruginosa PA01
gcaccaguggcgccgcca

SEQ ID NO: 1434438 - RNA, 20 nt, Pseudomonas aeruginosa PA01
gcaccauagcgagccgcgcu

SEQ ID NO: 1434439 - RNA, 13 nt, Pseudomonas aeruginosa PA01
gcaccaucaccga

SEQ ID NO: 1434440 - RNA, 20 nt, Pseudomonas aeruginosa PA01
gcaccagucccuggccggcg

SEQ ID NO: 1434441 - RNA, 22 nt, Pseudomonas aeruginosa PA01
gcaccagucccuggccggcgau

SEQ ID NO: 1434442 - RNA, 13 nt, Pseudomonas aeruginosa PA01
gcaccgacacgca

SEQ ID NO: 1434443 - RNA, 17 nt, Pseudomonas aeruginosa PA01
gcaccgacacgcacuca

SEQ ID NO: 1434444 - RNA, 13 nt, Pseudomonas aeruginosa PA01
gcaccgacgccga

SEQ ID NO: 1434445 - RNA, 21 nt, Pseudomonas aeruginosa PA01
gcaccgacgccgccugcgccu

SEQ ID NO: 1434446 - RNA, 15 nt, Pseudomonas aeruginosa PA01
gcaccgacucgcccu

SEQ ID NO: 1434447 - RNA, 22 nt, Pseudomonas aeruginosa PA01
gcacccugaccgcgagcgccgc

SEQ ID NO: 1434448 - RNA, 16 nt, Pseudomonas aeruginosa PA01
gcacccuuggcgcagg

SEQ ID NO: 1434449 - RNA, 19 nt, Pseudomonas aeruginosa PA01
gcacccuuggcgcagguag

SEQ ID NO: 1434450 - RNA, 12 nt, Pseudomonas aeruginosa PA01
gcacccuggcca

SEQ ID NO: 1434451 - RNA, 23 nt, Pseudomonas aeruginosa PA01
gcagacggcuguugucgaacagg

SEQ ID NO: 1434452 - RNA, 17 nt, Pseudomonas aeruginosa PA01
gcagacggggccucgcu

SEQ ID NO: 1434453 - RNA, 21 nt, Pseudomonas aeruginosa PA01
gcagacggggccucgcugccu

SEQ ID NO: 1434454 - RNA, 21 nt, Pseudomonas aeruginosa PA01
gcagacgguucagcagcggca

SEQ ID NO: 1434455 - RNA, 15 nt, Pseudomonas aeruginosa PA01
gcagacgauugaccu

SEQ ID NO: 1434456 - RNA, 20 nt, Pseudomonas aeruginosa PA01
gcagaccuggugggcggcgg

SEQ ID NO: 1434457 - RNA, 14 nt, Pseudomonas aeruginosa PA01
gcagaccugcagca

SEQ ID NO: 1434458 - RNA, 15 nt, Pseudomonas aeruginosa PA01
gcagaccugcagcag

SEQ ID NO: 1434459 - RNA, 24 nt, Pseudomonas aeruginosa PA01
gcagaccugcagcaggaucagcgc

SEQ ID NO: 1434460 - RNA, 22 nt, Pseudomonas aeruginosa PA01
gcagacgaucuccugcugggcg

SEQ ID NO: 1434461 - RNA, 17 nt, Pseudomonas aeruginosa PA01
gcagagcagagucgccg

SEQ ID NO: 1434462 - RNA, 18 nt, Pseudomonas aeruginosa PA01
gcagagcagagucgccgg

SEQ ID NO: 1434463 - RNA, 16 nt, Pseudomonas aeruginosa PA01
gcagagacgcagcgcu

SEQ ID NO: 1434464 - RNA, 16 nt, Pseudomonas aeruginosa PA01
gcagagaggcuggcgc

SEQ ID NO: 1434465 - RNA, 22 nt, Pseudomonas aeruginosa PA01
gcagagaggcuggcgcucugca

SEQ ID NO: 1434466 - RNA, 13 nt, Pseudomonas aeruginosa PA01
gcagagccagccg

SEQ ID NO: 1434467 - RNA, 14 nt, Pseudomonas aeruginosa PA01
gcagagaucggcgg

SEQ ID NO: 1434468 - RNA, 15 nt, Pseudomonas aeruginosa PA01
gcagagaucggcggc

SEQ ID NO: 1434469 - RNA, 16 nt, Pseudomonas aeruginosa PA01
gcagagaucggcggcg

SEQ ID NO: 1434470 - RNA, 22 nt, Pseudomonas aeruginosa PA01
gcagacguggcauucgucgccg

SEQ ID NO: 1434471 - RNA, 18 nt, Pseudomonas aeruginosa PA01
gcagacuccggcgcagcc

SEQ ID NO: 1434472 - RNA, 21 nt, Pseudomonas aeruginosa PA01
gcagacuccggcgcagcccag

SEQ ID NO: 1434473 - RNA, 13 nt, Pseudomonas aeruginosa PA01
aagaaaaggccgc

SEQ ID NO: 1434474 - RNA, 16 nt, Pseudomonas aeruginosa PA01
gcagagaaaaggccgc

SEQ ID NO: 1434475 - RNA, 17 nt, Pseudomonas aeruginosa PA01
gcagagaaaaggccgcu

SEQ ID NO: 1434476 - RNA, 18 nt, Pseudomonas aeruginosa PA01
gcacguugcugugcugca

SEQ ID NO: 1434477 - RNA, 18 nt, Pseudomonas aeruginosa PA01
gcacguuguugcccaccu

SEQ ID NO: 1434478 - RNA, 16 nt, Pseudomonas aeruginosa PA01
gcagaacggauagcga

SEQ ID NO: 1434479 - RNA, 20 nt, Pseudomonas aeruginosa PA01
gcagaacugccgggccagcu

SEQ ID NO: 1434480 - RNA, 20 nt, Pseudomonas aeruginosa PA01
gcagaacuugcgcaccgcgc

SEQ ID NO: 1434481 - RNA, 23 nt, Pseudomonas aeruginosa PA01
gcagaacuugcgcaccgcgccgg

SEQ ID NO: 1434482 - RNA, 19 nt, Pseudomonas aeruginosa PA01
gcagaagacgcccagcagg

SEQ ID NO: 1434483 - RNA, 18 nt, Pseudomonas aeruginosa PA01
gcacguggaguucaccgu

SEQ ID NO: 1434484 - RNA, 20 nt, Pseudomonas aeruginosa PA01
gcacgucgauauccagcggc

SEQ ID NO: 1434485 - RNA, 21 nt, Pseudomonas aeruginosa PA01
gcacgucgauauccagcggca

SEQ ID NO: 1434486 - RNA, 22 nt, Pseudomonas aeruginosa PA01
gcacgucgauauccagcggcag

SEQ ID NO: 1434487 - RNA, 13 nt, Pseudomonas aeruginosa PA01
gcacguuccagcu

SEQ ID NO: 1434488 - RNA, 18 nt, Pseudomonas aeruginosa PA01
gcacguugaggucgaaga

SEQ ID NO: 1434489 - RNA, 20 nt, Pseudomonas aeruginosa PA01
gcacguugccauccagcgcc

SEQ ID NO: 1434490 - RNA, 21 nt, Pseudomonas aeruginosa PA01
gcagaaggcgcuuucguaggg

SEQ ID NO: 1434491 - RNA, 20 nt, Pseudomonas aeruginosa PA01
gcagcacgcccugggacagg

SEQ ID NO: 1434492 - RNA, 20 nt, Pseudomonas aeruginosa PA01
gcagcacgcugacgccggca

SEQ ID NO: 1434493 - RNA, 14 nt, Pseudomonas aeruginosa PA01
gcagcacgcuggcg

SEQ ID NO: 1434494 - RNA, 20 nt, Pseudomonas aeruginosa PA01
gcagcacgcuggcgucgggc

SEQ ID NO: 1434495 - RNA, 14 nt, Pseudomonas aeruginosa PA01
gcagcacggcggcu

SEQ ID NO: 1434496 - RNA, 13 nt, Pseudomonas aeruginosa PA01
gcagcacggccuc

SEQ ID NO: 1434497 - RNA, 16 nt, Pseudomonas aeruginosa PA01
gcagcacggccucgcg

SEQ ID NO: 1434498 - RNA, 16 nt, Pseudomonas aeruginosa PA01
gcagcacggcgacgaa

SEQ ID NO: 1434499 - RNA, 22 nt, Pseudomonas aeruginosa PA01
gcagcacuuccugaaggcgcgg

SEQ ID NO: 1434500 - RNA, 23 nt, Pseudomonas aeruginosa PA01
gcagcacuuccugaaggcgcggg

SEQ ID NO: 1434501 - RNA, 22 nt, Pseudomonas aeruginosa PA01
gcagcacgguguuguggcuggc

SEQ ID NO: 1434502 - RNA, 14 nt, Pseudomonas aeruginosa PA01
gcagcagagcgcca

SEQ ID NO: 1434503 - RNA, 20 nt, Pseudomonas aeruginosa PA01
gcagcagcaugaugccgagg

SEQ ID NO: 1434504 - RNA, 14 nt, Pseudomonas aeruginosa PA01
gcagcagccaaccg

SEQ ID NO: 1434505 - RNA, 21 nt, Pseudomonas aeruginosa PA01
gcagcagccaaccgucgcccu

SEQ ID NO: 1434506 - RNA, 23 nt, Pseudomonas aeruginosa PA01
gcagcagccaaccgucgcccugg

SEQ ID NO: 1434507 - RNA, 15 nt, Pseudomonas aeruginosa PA01
gcagcagcgaacgcc

SEQ ID NO: 1434508 - RNA, 16 nt, Pseudomonas aeruginosa PA01
gcagcagcgaacgccg

SEQ ID NO: 1434509 - RNA, 19 nt, Pseudomonas aeruginosa PA01
gcagcagcgccgcgaacac

SEQ ID NO: 1434510 - RNA, 14 nt, Pseudomonas aeruginosa PA01
gcagcagcgccagu

SEQ ID NO: 1434511 - RNA, 13 nt, Pseudomonas aeruginosa PA01
gcagcagcgccgc

SEQ ID NO: 1434512 - RNA, 22 nt, Pseudomonas aeruginosa PA01
gcagaugcuccagggagcgcuc

SEQ ID NO: 1434513 - RNA, 17 nt, Pseudomonas aeruginosa PA01
gcagcacaugccacgca

SEQ ID NO: 1434514 - RNA, 23 nt, Pseudomonas aeruginosa PA01
gcagcacauagagggucagccgg

SEQ ID NO: 1434515 - RNA, 23 nt, Pseudomonas aeruginosa PA01
gcagcacagccccagccucggca

SEQ ID NO: 1434516 - RNA, 15 nt, Pseudomonas aeruginosa PA01
gcagcaccaggcugg

SEQ ID NO: 1434517 - RNA, 15 nt, Pseudomonas aeruginosa PA01
gcagcaccaccucgc

SEQ ID NO: 1434518 - RNA, 20 nt, Pseudomonas aeruginosa PA01
gcagcaccaccucgccaagc

SEQ ID NO: 1434519 - RNA, 16 nt, Pseudomonas aeruginosa PA01
gcagcaccaucagcca

SEQ ID NO: 1434520 - RNA, 18 nt, Pseudomonas aeruginosa PA01
gcagcaccaucagccagc

SEQ ID NO: 1434521 - RNA, 13 nt, Pseudomonas aeruginosa PA01
gcagcacccccag

SEQ ID NO: 1434522 - RNA, 14 nt, Pseudomonas aeruginosa PA01
gcagcacccccagc

SEQ ID NO: 1434523 - RNA, 22 nt, Pseudomonas aeruginosa PA01
gcagcaccggcuuguugcgcuc

SEQ ID NO: 1434524 - RNA, 17 nt, Pseudomonas aeruginosa PA01
gcagaucucccuguccu

SEQ ID NO: 1434525 - RNA, 15 nt, Pseudomonas aeruginosa PA01
gcagaugcggggcga

SEQ ID NO: 1434526 - RNA, 14 nt, Pseudomonas aeruginosa PA01
gcagaucgcggcgc

SEQ ID NO: 1434527 - RNA, 14 nt, Pseudomonas aeruginosa PA01
gcagaucgccgcgu

SEQ ID NO: 1434528 - RNA, 22 nt, Pseudomonas aeruginosa PA01
gcagaucgccgcguagcgccag

SEQ ID NO: 1434529 - RNA, 16 nt, Pseudomonas aeruginosa PA01
gcagauccagcggcag

SEQ ID NO: 1434530 - RNA, 21 nt, Pseudomonas aeruginosa PA01
gcagauccgccgugaggcgcg

SEQ ID NO: 1434531 - RNA, 20 nt, Pseudomonas aeruginosa PA01
gcagccagcuucagccgacc

SEQ ID NO: 1434532 - RNA, 16 nt, Pseudomonas aeruginosa PA01
gcagccacuggcggac

SEQ ID NO: 1434533 - RNA, 20 nt, Pseudomonas aeruginosa PA01
gcagccagcacaugcggugc

SEQ ID NO: 1434534 - RNA, 16 nt, Pseudomonas aeruginosa PA01
gcagccagccgccgaa

SEQ ID NO: 1434535 - RNA, 13 nt, Pseudomonas aeruginosa PA01
gcagccagccguc

SEQ ID NO: 1434536 - RNA, 14 nt, Pseudomonas aeruginosa PA01
gcagccagccgucg

SEQ ID NO: 1434537 - RNA, 22 nt, Pseudomonas aeruginosa PA01
gcagccagccgucgucguccac

SEQ ID NO: 1434538 - RNA, 13 nt, Pseudomonas aeruginosa PA01
gcagccacccgcg

SEQ ID NO: 1434539 - RNA, 20 nt, Pseudomonas aeruginosa PA01
gcagccacccgcgggcagca

SEQ ID NO: 1434540 - RNA, 13 nt, Pseudomonas aeruginosa PA01
gcagccacccgcu

SEQ ID NO: 1434541 - RNA, 18 nt, Pseudomonas aeruginosa PA01
gcagccacccgcucgacc

SEQ ID NO: 1434542 - RNA, 20 nt, Pseudomonas aeruginosa PA01
gcagccacggcacacgucgg

SEQ ID NO: 1434543 - RNA, 15 nt, Pseudomonas aeruginosa PA01
gcagccacucggcca

SEQ ID NO: 1434544 - RNA, 19 nt, Pseudomonas aeruginosa PA01
gcagccacucggccaggcg

SEQ ID NO: 1434545 - RNA, 20 nt, Pseudomonas aeruginosa PA01
gcagccacucggccaggcgc

SEQ ID NO: 1434546 - RNA, 21 nt, Pseudomonas aeruginosa PA01
gcagccagagcuccagggcug

SEQ ID NO: 1434547 - RNA, 15 nt, Pseudomonas aeruginosa PA01
gcagccacaggcgcc

SEQ ID NO: 1434548 - RNA, 19 nt, Pseudomonas aeruginosa PA01
gcagccaaggaugcgccag

SEQ ID NO: 1434549 - RNA, 23 nt, Pseudomonas aeruginosa PA01
gcagccaaggaugcgccagcggc

SEQ ID NO: 1434550 - RNA, 19 nt, Pseudomonas aeruginosa PA01
gcagccaagccaccagcga

SEQ ID NO: 1434551 - RNA, 20 nt, Pseudomonas aeruginosa PA01
gcagccaagccaccagcgac

SEQ ID NO: 1434552 - RNA, 14 nt, Pseudomonas aeruginosa PA01
gcagcauguagaac

SEQ ID NO: 1434553 - RNA, 18 nt, Pseudomonas aeruginosa PA01
gcagcaugucgccgggga

SEQ ID NO: 1434554 - RNA, 15 nt, Pseudomonas aeruginosa PA01
gcagcaugucgucga

SEQ ID NO: 1434555 - RNA, 17 nt, Pseudomonas aeruginosa PA01
gcagcaugggauggcgc

SEQ ID NO: 1434556 - RNA, 19 nt, Pseudomonas aeruginosa PA01
gcagcaugggauggcgcgg

SEQ ID NO: 1434557 - RNA, 15 nt, Pseudomonas aeruginosa PA01
gcagcaugccgcucu

SEQ ID NO: 1434558 - RNA, 20 nt, Pseudomonas aeruginosa PA01
gcagcaugccgcucugccag

SEQ ID NO: 1434559 - RNA, 18 nt, Pseudomonas aeruginosa PA01
gcagcaucuucucggcga

SEQ ID NO: 1434560 - RNA, 23 nt, Pseudomonas aeruginosa PA01
gcagcaggguaccgcuggcgcug

SEQ ID NO: 1434561 - RNA, 12 nt, Pseudomonas aeruginosa PA01
gcagcaggcgcu

SEQ ID NO: 1434562 - RNA, 14 nt, Pseudomonas aeruginosa PA01
gcagcaggcgcucg

SEQ ID NO: 1434563 - RNA, 15 nt, Pseudomonas aeruginosa PA01
gcagcaggcgcucgg

SEQ ID NO: 1434564 - RNA, 18 nt, Pseudomonas aeruginosa PA01
gcagcaggcguucggcga

SEQ ID NO: 1434565 - RNA, 14 nt, Pseudomonas aeruginosa PA01
gcagcagcuugccg

SEQ ID NO: 1434566 - RNA, 18 nt, Pseudomonas aeruginosa PA01
gcagcaggcgacggucag

SEQ ID NO: 1434567 - RNA, 14 nt, Pseudomonas aeruginosa PA01
gcagcaggccgcug

SEQ ID NO: 1434568 - RNA, 15 nt, Pseudomonas aeruginosa PA01
gcagcaggccggcga

SEQ ID NO: 1434569 - RNA, 17 nt, Pseudomonas aeruginosa PA01
gcagcaggccggcgacc

SEQ ID NO: 1434570 - RNA, 18 nt, Pseudomonas aeruginosa PA01
gcagcaggcacagggcga

SEQ ID NO: 1434571 - RNA, 14 nt, Pseudomonas aeruginosa PA01
gcagcaggccgccg

SEQ ID NO: 1434572 - RNA, 15 nt, Pseudomonas aeruginosa PA01
gcagcaggccgccgc

SEQ ID NO: 1434573 - RNA, 17 nt, Pseudomonas aeruginosa PA01
gcagcaggccgccgcgu

SEQ ID NO: 1434574 - RNA, 15 nt, Pseudomonas aeruginosa PA01
gcagcagcuugccgg

SEQ ID NO: 1434575 - RNA, 14 nt, Pseudomonas aeruginosa PA01
gcagcaggaucagc

SEQ ID NO: 1434576 - RNA, 16 nt, Pseudomonas aeruginosa PA01
gcagcaggaucagcgc

SEQ ID NO: 1434577 - RNA, 15 nt, Pseudomonas aeruginosa PA01
gcagcaggauccagg

SEQ ID NO: 1434578 - RNA, 18 nt, Pseudomonas aeruginosa PA01
gcagcaggauccaggugc

SEQ ID NO: 1434579 - RNA, 15 nt, Pseudomonas aeruginosa PA01
gcagcagcggcgaca

SEQ ID NO: 1434580 - RNA, 21 nt, Pseudomonas aeruginosa PA01
gcagcagcggcgacaccgcca

SEQ ID NO: 1434581 - RNA, 19 nt, Pseudomonas aeruginosa PA01
gcagcagcgguacggucga

SEQ ID NO: 1434582 - RNA, 17 nt, Pseudomonas aeruginosa PA01
gcagcagcggaucggcg

SEQ ID NO: 1434583 - RNA, 19 nt, Pseudomonas aeruginosa PA01
gcagcagcggaucggcggu

SEQ ID NO: 1434584 - RNA, 21 nt, Pseudomonas aeruginosa PA01
gcagcagcggaucggcggugc

SEQ ID NO: 1434585 - RNA, 12 nt, Pseudomonas aeruginosa PA01
gcagcagcgccu

SEQ ID NO: 1434586 - RNA, 18 nt, Pseudomonas aeruginosa PA01
gcagcagucgcagcucgg

SEQ ID NO: 1434587 - RNA, 20 nt, Pseudomonas aeruginosa PA01
gcagcagguggcaagccucg

SEQ ID NO: 1434588 - RNA, 18 nt, Pseudomonas aeruginosa PA01
gcagcagguuccuccugg

SEQ ID NO: 1434589 - RNA, 23 nt, Pseudomonas aeruginosa PA01
gcagcagguucgaaugcugcccg

SEQ ID NO: 1434590 - RNA, 20 nt, Pseudomonas aeruginosa PA01
gcagcagguugaccccgcgg

SEQ ID NO: 1434591 - RNA, 12 nt, Pseudomonas aeruginosa PA01
gcagcagguagu

SEQ ID NO: 1434592 - RNA, 21 nt, Pseudomonas aeruginosa PA01
gcagcagguagugcggcgggc

SEQ ID NO: 1434593 - RNA, 22 nt, Pseudomonas aeruginosa PA01
gcagcagguagugcucggccag

SEQ ID NO: 1434594 - RNA, 14 nt, Pseudomonas aeruginosa PA01
gcagcaggucgagc

SEQ ID NO: 1434595 - RNA, 14 nt, Pseudomonas aeruginosa PA01
gcagcaggucgcgc

SEQ ID NO: 1434596 - RNA, 23 nt, Pseudomonas aeruginosa PA01
gcagcaucucggugcgccccagg

SEQ ID NO: 1434597 - RNA, 16 nt, Pseudomonas aeruginosa PA01
gcagcaucagccgcga

SEQ ID NO: 1434598 - RNA, 17 nt, Pseudomonas aeruginosa PA01
gcagcccagcgcuuccu

SEQ ID NO: 1434599 - RNA, 23 nt, Pseudomonas aeruginosa PA01
gcagccaugaaaaagccgggaug

SEQ ID NO: 1434600 - RNA, 13 nt, Pseudomonas aeruginosa PA01
gcagccauggcug

SEQ ID NO: 1434601 - RNA, 17 nt, Pseudomonas aeruginosa PA01
gcagccauucgccgcga

SEQ ID NO: 1434602 - RNA, 16 nt, Pseudomonas aeruginosa PA01
gcagcccggucacgcc

SEQ ID NO: 1434603 - RNA, 22 nt, Pseudomonas aeruginosa PA01
gcagcccgguccguccagcgcg

SEQ ID NO: 1434604 - RNA, 23 nt, Pseudomonas aeruginosa PA01
gcagcccaguucgcgcaggaccu

SEQ ID NO: 1434605 - RNA, 16 nt, Pseudomonas aeruginosa PA01
gcagcccagccgcucg

SEQ ID NO: 1434606 - RNA, 18 nt, Pseudomonas aeruginosa PA01
gcagcccagccgcucgcg

SEQ ID NO: 1434607 - RNA, 19 nt, Pseudomonas aeruginosa PA01
gcagccaggcgaaggcgau

SEQ ID NO: 1434608 - RNA, 18 nt, Pseudomonas aeruginosa PA01
gcagcccgggcaacugcc

SEQ ID NO: 1434609 - RNA, 19 nt, Pseudomonas aeruginosa PA01
gcagcccuggcguggccgg

SEQ ID NO: 1434610 - RNA, 20 nt, Pseudomonas aeruginosa PA01
gcagcccuggcguggccggc

SEQ ID NO: 1434611 - RNA, 21 nt, Pseudomonas aeruginosa PA01
gcagcccuggcguggccggcg

SEQ ID NO: 1434612 - RNA, 22 nt, Pseudomonas aeruginosa PA01
gcagcccuggcguggccggcga

SEQ ID NO: 1434613 - RNA, 14 nt, Pseudomonas aeruginosa PA01
gcagccgccgcggc

SEQ ID NO: 1434614 - RNA, 19 nt, Pseudomonas aeruginosa PA01
gcagccgccgcggcaccgg

SEQ ID NO: 1434615 - RNA, 20 nt, Pseudomonas aeruginosa PA01
gcagccgccgcggcaccggc

SEQ ID NO: 1434616 - RNA, 21 nt, Pseudomonas aeruginosa PA01
gcagccgccgcggcaccggcg

SEQ ID NO: 1434617 - RNA, 16 nt, Pseudomonas aeruginosa PA01
gcagcccuugcaaccg

SEQ ID NO: 1434618 - RNA, 15 nt, Pseudomonas aeruginosa PA01
gcagccgauggcgaa

SEQ ID NO: 1434619 - RNA, 16 nt, Pseudomonas aeruginosa PA01
gcagccgcaaggccag

SEQ ID NO: 1434620 - RNA, 16 nt, Pseudomonas aeruginosa PA01
gcagccgcaggaugcc

SEQ ID NO: 1434621 - RNA, 20 nt, Pseudomonas aeruginosa PA01
gcagccgcaggaugccgccu

SEQ ID NO: 1434622 - RNA, 21 nt, Pseudomonas aeruginosa PA01
gcagccgcaggaugccgccug

SEQ ID NO: 1434623 - RNA, 22 nt, Pseudomonas aeruginosa PA01
gcagccgcaggaugccgccugc

SEQ ID NO: 1434624 - RNA, 21 nt, Pseudomonas aeruginosa PA01
gcagccuucgcaaagcgagcg

SEQ ID NO: 1434625 - RNA, 18 nt, Pseudomonas aeruginosa PA01
gcagccuuggcaugaccg

SEQ ID NO: 1434626 - RNA, 18 nt, Pseudomonas aeruginosa PA01
gcagcgacuccagccagg

SEQ ID NO: 1434627 - RNA, 20 nt, Pseudomonas aeruginosa PA01
gcagcgacuccagccaggcg

SEQ ID NO: 1434628 - RNA, 21 nt, Pseudomonas aeruginosa PA01
gcagcgacuccagccaggcga

SEQ ID NO: 1434629 - RNA, 19 nt, Pseudomonas aeruginosa PA01
gcagcgacucgcugggcgc

SEQ ID NO: 1434630 - RNA, 22 nt, Pseudomonas aeruginosa PA01
gcagcgacucgcugggcgccgg

SEQ ID NO: 1434631 - RNA, 21 nt, Pseudomonas aeruginosa PA01
gcagccguccgcccaguucgc

SEQ ID NO: 1434632 - RNA, 18 nt, Pseudomonas aeruginosa PA01
gcagccucaguggaucgu

SEQ ID NO: 1434633 - RNA, 21 nt, Pseudomonas aeruginosa PA01
gcagccucgcgcucggcggcc

SEQ ID NO: 1434634 - RNA, 20 nt, Pseudomonas aeruginosa PA01
gcagccguucccggucgagg

SEQ ID NO: 1434635 - RNA, 16 nt, Pseudomonas aeruginosa PA01
gcagccguuggccagc

SEQ ID NO: 1434636 - RNA, 17 nt, Pseudomonas aeruginosa PA01
gcagccguuggccagca

SEQ ID NO: 1434637 - RNA, 20 nt, Pseudomonas aeruginosa PA01
gcagccguuggccagcaggc

SEQ ID NO: 1434638 - RNA, 22 nt, Pseudomonas aeruginosa PA01
gcagcgccauggggaucaccgg

SEQ ID NO: 1434639 - RNA, 14 nt, Pseudomonas aeruginosa PA01
gcagcgccagggcc

SEQ ID NO: 1434640 - RNA, 21 nt, Pseudomonas aeruginosa PA01
gcagcgccaguuggacgcggc

SEQ ID NO: 1434641 - RNA, 22 nt, Pseudomonas aeruginosa PA01
gcagcgccaguuggacgcggcc

SEQ ID NO: 1434642 - RNA, 21 nt, Pseudomonas aeruginosa PA01
gcagcgccccucccagccaca

SEQ ID NO: 1434643 - RNA, 21 nt, Pseudomonas aeruginosa PA01
gcagcgcccgauaggcgccgg

SEQ ID NO: 1434644 - RNA, 14 nt, Pseudomonas aeruginosa PA01
gcagcgccccagca

SEQ ID NO: 1434645 - RNA, 20 nt, Pseudomonas aeruginosa PA01
gcagcgccccagcaccucgc

SEQ ID NO: 1434646 - RNA, 13 nt, Pseudomonas aeruginosa PA01
gcagcgccguugc

SEQ ID NO: 1434647 - RNA, 22 nt, Pseudomonas aeruginosa PA01
gcagcgccguugccgaugccgg

SEQ ID NO: 1434648 - RNA, 13 nt, Pseudomonas aeruginosa PA01
gcagcgccacgcu

SEQ ID NO: 1434649 - RNA, 18 nt, Pseudomonas aeruginosa PA01
gcagcgccacgcugauca

SEQ ID NO: 1434650 - RNA, 19 nt, Pseudomonas aeruginosa PA01
gcagcgaggggaagaucuc

SEQ ID NO: 1434651 - RNA, 22 nt, Pseudomonas aeruginosa PA01
gcagcgaggggaagaucuccgg

SEQ ID NO: 1434652 - RNA, 15 nt, Pseudomonas aeruginosa PA01
gcagcgagcggguca

SEQ ID NO: 1434653 - RNA, 21 nt, Pseudomonas aeruginosa PA01
gaugguuugaaggucggcgca

SEQ ID NO: 1434654 - RNA, 19 nt, Pseudomonas aeruginosa PA01
gauguccaucagccgcgcg

SEQ ID NO: 1434655 - RNA, 14 nt, Pseudomonas aeruginosa PA01
gauguccccggcca

SEQ ID NO: 1434656 - RNA, 16 nt, Pseudomonas aeruginosa PA01
gauguccccggccagc

SEQ ID NO: 1434657 - RNA, 20 nt, Pseudomonas aeruginosa PA01
gauguccccggccagcagcg

SEQ ID NO: 1434658 - RNA, 15 nt, Pseudomonas aeruginosa PA01
gaugguugccggugu

SEQ ID NO: 1434659 - RNA, 16 nt, Pseudomonas aeruginosa PA01
gauggugugcagcagc

SEQ ID NO: 1434660 - RNA, 18 nt, Pseudomonas aeruginosa PA01
gauggugcgcucgcggac

SEQ ID NO: 1434661 - RNA, 17 nt, Pseudomonas aeruginosa PA01
gauggucaacaccagcg

SEQ ID NO: 1434662 - RNA, 21 nt, Pseudomonas aeruginosa PA01
gauggucaacaccagcgccgc

SEQ ID NO: 1434663 - RNA, 21 nt, Pseudomonas aeruginosa PA01
gauggucacuggcgaggcugc

SEQ ID NO: 1434664 - RNA, 14 nt, Pseudomonas aeruginosa PA01
gauggugccgccgg

SEQ ID NO: 1434665 - RNA, 15 nt, Pseudomonas aeruginosa PA01
gauguccgccgccca

SEQ ID NO: 1434666 - RNA, 16 nt, Pseudomonas aeruginosa PA01
gauguccuggaucggc

SEQ ID NO: 1434667 - RNA, 19 nt, Pseudomonas aeruginosa PA01
gauguccuuguucggcugg

SEQ ID NO: 1434668 - RNA, 17 nt, Pseudomonas aeruginosa PA01
gaugucguagccgcgcg

SEQ ID NO: 1434669 - RNA, 22 nt, Pseudomonas aeruginosa PA01
gaugucguagccgcgcgccagc

SEQ ID NO: 1434670 - RNA, 23 nt, Pseudomonas aeruginosa PA01
gaugucguagccgcgcgccagca

SEQ ID NO: 1434671 - RNA, 22 nt, Pseudomonas aeruginosa PA01
gaugucgaacaacccgccagca

SEQ ID NO: 1434672 - RNA, 18 nt, Pseudomonas aeruginosa PA01
gaugucgaccacgaucuc

SEQ ID NO: 1434673 - RNA, 14 nt, Pseudomonas aeruginosa PA01
gauggcgccgccga

SEQ ID NO: 1434674 - RNA, 15 nt, Pseudomonas aeruginosa PA01
gauggcgcgcgggcc

SEQ ID NO: 1434675 - RNA, 22 nt, Pseudomonas aeruginosa PA01
gauggcgccauugugcgcgcgc

SEQ ID NO: 1434676 - RNA, 17 nt, Pseudomonas aeruginosa PA01
gauggcgcaccacugca

SEQ ID NO: 1434677 - RNA, 23 nt, Pseudomonas aeruginosa PA01
gauggcgaacaugaagccgcgcg

SEQ ID NO: 1434678 - RNA, 21 nt, Pseudomonas aeruginosa PA01
gaugguaguccgcugcgagca

SEQ ID NO: 1434679 - RNA, 17 nt, Pseudomonas aeruginosa PA01
gauggucacgccgaggc

SEQ ID NO: 1434680 - RNA, 20 nt, Pseudomonas aeruginosa PA01
gauggucacgccgaggcugc

SEQ ID NO: 1434681 - RNA, 21 nt, Pseudomonas aeruginosa PA01
gaugggcgaagccggcggcgc

SEQ ID NO: 1434682 - RNA, 14 nt, Pseudomonas aeruginosa PA01
gaugggcgagcgac

SEQ ID NO: 1434683 - RNA, 22 nt, Pseudomonas aeruginosa PA01
gauggcgugaaguagccgccgg

SEQ ID NO: 1434684 - RNA, 13 nt, Pseudomonas aeruginosa PA01
gaucugcgagcgc

SEQ ID NO: 1434685 - RNA, 12 nt, Pseudomonas aeruginosa PA01
gaucucguccuc

SEQ ID NO: 1434686 - RNA, 16 nt, Pseudomonas aeruginosa PA01
gaucucgucgaagcgc

SEQ ID NO: 1434687 - RNA, 15 nt, Pseudomonas aeruginosa PA01
gaucugcuccugcag

SEQ ID NO: 1434688 - RNA, 16 nt, Pseudomonas aeruginosa PA01
gaucugcucgacgucg

SEQ ID NO: 1434689 - RNA, 19 nt, Pseudomonas aeruginosa PA01
gaucugcucguccaggccg

SEQ ID NO: 1434690 - RNA, 21 nt, Pseudomonas aeruginosa PA01
gaucugcugggucaucgaggc

SEQ ID NO: 1434691 - RNA, 22 nt, Pseudomonas aeruginosa PA01
gaucugcugguugaggccgucc

SEQ ID NO: 1434692 - RNA, 18 nt, Pseudomonas aeruginosa PA01
gaucuggaauucgccgcg

SEQ ID NO: 1434693 - RNA, 14 nt, Pseudomonas aeruginosa PA01
gaugcggggcgacc

SEQ ID NO: 1434694 - RNA, 16 nt, Pseudomonas aeruginosa PA01
gaugcggggcgaccag

SEQ ID NO: 1434695 - RNA, 17 nt, Pseudomonas aeruginosa PA01
gaugcggggcgaccagc

SEQ ID NO: 1434696 - RNA, 14 nt, Pseudomonas aeruginosa PA01
gaugcggucaugcc

SEQ ID NO: 1434697 - RNA, 17 nt, Pseudomonas aeruginosa PA01
gaugcgguaggugcucu

SEQ ID NO: 1434698 - RNA, 20 nt, Pseudomonas aeruginosa PA01
gaugcgguagucgcugcugg

SEQ ID NO: 1434699 - RNA, 17 nt, Pseudomonas aeruginosa PA01
gaugcggcugugcucga

SEQ ID NO: 1434700 - RNA, 13 nt, Pseudomonas aeruginosa PA01
gaugcggcgcugc

SEQ ID NO: 1434701 - RNA, 21 nt, Pseudomonas aeruginosa PA01
gauggaagagcgccgcggcgg

SEQ ID NO: 1434702 - RNA, 20 nt, Pseudomonas aeruginosa PA01
gauggccaucagggucggcc

SEQ ID NO: 1434703 - RNA, 23 nt, Pseudomonas aeruginosa PA01
gauggccaucagggucggcccgg

SEQ ID NO: 1434704 - RNA, 14 nt, Pseudomonas aeruginosa PA01
gauggccccggcga

SEQ ID NO: 1434705 - RNA, 15 nt, Pseudomonas aeruginosa PA01
gauggccccggcgau

SEQ ID NO: 1434706 - RNA, 22 nt, Pseudomonas aeruginosa PA01
gauggccccggcgauccgcgca

SEQ ID NO: 1434707 - RNA, 21 nt, Pseudomonas aeruginosa PA01
gauggcccagaugaucaggcc

SEQ ID NO: 1434708 - RNA, 23 nt, Pseudomonas aeruginosa PA01
gauggcccagaugaucaggccga

SEQ ID NO: 1434709 - RNA, 18 nt, Pseudomonas aeruginosa PA01
gauggcccuucgcccugc

SEQ ID NO: 1434710 - RNA, 13 nt, Pseudomonas aeruginosa PA01
gauggccgccagc

SEQ ID NO: 1434711 - RNA, 16 nt, Pseudomonas aeruginosa PA01
gauggccgccagcagg

SEQ ID NO: 1434712 - RNA, 14 nt, Pseudomonas aeruginosa PA01
gauggcgaagccga

SEQ ID NO: 1434713 - RNA, 14 nt, Pseudomonas aeruginosa PA01
gauggcgaagcgcu

SEQ ID NO: 1434714 - RNA, 17 nt, Pseudomonas aeruginosa PA01
gauggccuggucggcgc

SEQ ID NO: 1434715 - RNA, 20 nt, Pseudomonas aeruginosa PA01
gauggccuggucggcgcggc

SEQ ID NO: 1434716 - RNA, 15 nt, Pseudomonas aeruginosa PA01
gaugcguccgcgcag

SEQ ID NO: 1434717 - RNA, 17 nt, Pseudomonas aeruginosa PA01
gaugcgucgcaccaggu

SEQ ID NO: 1434718 - RNA, 15 nt, Pseudomonas aeruginosa PA01
gaugcugcgggcgcc

SEQ ID NO: 1434719 - RNA, 23 nt, Pseudomonas aeruginosa PA01
gaugcugcgggcgccgccgcugg

SEQ ID NO: 1434720 - RNA, 18 nt, Pseudomonas aeruginosa PA01
gaugcuggagcuugccgg

SEQ ID NO: 1434721 - RNA, 21 nt, Pseudomonas aeruginosa PA01
gaugcuggcaacggcgggccg

SEQ ID NO: 1434722 - RNA, 22 nt, Pseudomonas aeruginosa PA01
gaugcuggcaacggcgggccgc

SEQ ID NO: 1434723 - RNA, 21 nt, Pseudomonas aeruginosa PA01
gaugcuguaguugacgucgcc

SEQ ID NO: 1434724 - RNA, 21 nt, Pseudomonas aeruginosa PA01
gauggaaguugcgcacccgcu

SEQ ID NO: 1434725 - RNA, 17 nt, Pseudomonas aeruginosa PA01
gauggaaaucggccacu

SEQ ID NO: 1434726 - RNA, 22 nt, Pseudomonas aeruginosa PA01
gauggaacgaagaaccccggcc

SEQ ID NO: 1434727 - RNA, 20 nt, Pseudomonas aeruginosa PA01
gauggaacgcggguugcccg

SEQ ID NO: 1434728 - RNA, 19 nt, Pseudomonas aeruginosa PA01
gcaacaaggcauucaccag

SEQ ID NO: 1434729 - RNA, 21 nt, Pseudomonas aeruginosa PA01
gcaacaaggcauucaccagcg

SEQ ID NO: 1434730 - RNA, 15 nt, Pseudomonas aeruginosa PA01
gcaacauggcgucgg

SEQ ID NO: 1434731 - RNA, 18 nt, Pseudomonas aeruginosa PA01
gcaacauggcgucggcga

SEQ ID NO: 1434732 - RNA, 22 nt, Pseudomonas aeruginosa PA01
gcaaccccuucggucgcgcccc

SEQ ID NO: 1434733 - RNA, 15 nt, Pseudomonas aeruginosa PA01
gcaaccagcccuggc

SEQ ID NO: 1434734 - RNA, 16 nt, Pseudomonas aeruginosa PA01
gcaaccagcccuggcg

SEQ ID NO: 1434735 - RNA, 23 nt, Pseudomonas aeruginosa PA01
gcaaccagcgcucguagccggcg

SEQ ID NO: 1434736 - RNA, 21 nt, Pseudomonas aeruginosa PA01
gcaaaggucggcgaaggcgaa

SEQ ID NO: 1434737 - RNA, 14 nt, Pseudomonas aeruginosa PA01
gcaaagcggcgacg

SEQ ID NO: 1434738 - RNA, 22 nt, Pseudomonas aeruginosa PA01
gcaaagcggcgacgccacccgc

SEQ ID NO: 1434739 - RNA, 16 nt, Pseudomonas aeruginosa PA01
gcaaaggcgcgcaggg

SEQ ID NO: 1434740 - RNA, 18 nt, Pseudomonas aeruginosa PA01
gcaacaccaucggcccca

SEQ ID NO: 1434741 - RNA, 18 nt, Pseudomonas aeruginosa PA01
gcaacacccaggccuggg

SEQ ID NO: 1434742 - RNA, 18 nt, Pseudomonas aeruginosa PA01
gcaaaagaaaacgcccgg

SEQ ID NO: 1434743 - RNA, 23 nt, Pseudomonas aeruginosa PA01
gcaaaagaaaacgcccggcaucu

SEQ ID NO: 1434744 - RNA, 17 nt, Pseudomonas aeruginosa PA01
gcaaaaaagcgcgcccg

SEQ ID NO: 1434745 - RNA, 15 nt, Pseudomonas aeruginosa PA01
gcaaaaaaaggggau

SEQ ID NO: 1434746 - RNA, 19 nt, Pseudomonas aeruginosa PA01
gcaaagcgagcgcccgccg

SEQ ID NO: 1434747 - RNA, 19 nt, Pseudomonas aeruginosa PA01
gauucccgaggguggcgcu

SEQ ID NO: 1434748 - RNA, 18 nt, Pseudomonas aeruginosa PA01
gauucccagugcucccgc

SEQ ID NO: 1434749 - RNA, 22 nt, Pseudomonas aeruginosa PA01
gauucguccggagccgggcaac

SEQ ID NO: 1434750 - RNA, 20 nt, Pseudomonas aeruginosa PA01
gauuccuuggucaggucgac

SEQ ID NO: 1434751 - RNA, 13 nt, Pseudomonas aeruginosa PA01
gaugugcaccagc

SEQ ID NO: 1434752 - RNA, 15 nt, Pseudomonas aeruginosa PA01
gaugugcaccagcaa

SEQ ID NO: 1434753 - RNA, 13 nt, Pseudomonas aeruginosa PA01
gaugugcgcaggc

SEQ ID NO: 1434754 - RNA, 15 nt, Pseudomonas aeruginosa PA01
gauuucuucagccug

SEQ ID NO: 1434755 - RNA, 17 nt, Pseudomonas aeruginosa PA01
gauuucuucagccuggg

SEQ ID NO: 1434756 - RNA, 12 nt, Pseudomonas aeruginosa PA01
gauuucgccgag

SEQ ID NO: 1434757 - RNA, 20 nt, Pseudomonas aeruginosa PA01
gauuggagaugcucaggcgc

SEQ ID NO: 1434758 - RNA, 11 nt, Pseudomonas aeruginosa PA01
gauuggccggg

SEQ ID NO: 1434759 - RNA, 17 nt, Pseudomonas aeruginosa PA01
gauugcguacgcccagc

SEQ ID NO: 1434760 - RNA, 17 nt, Pseudomonas aeruginosa PA01
gauugagggucagcuug

SEQ ID NO: 1434761 - RNA, 18 nt, Pseudomonas aeruginosa PA01
gauugcugggugcggugg

SEQ ID NO: 1434762 - RNA, 13 nt, Pseudomonas aeruginosa PA01
gcaaugcccgcgc

SEQ ID NO: 1434763 - RNA, 15 nt, Pseudomonas aeruginosa PA01
gcaaugcccgcgccu

SEQ ID NO: 1434764 - RNA, 13 nt, Pseudomonas aeruginosa PA01
gcaaugcggcgau

SEQ ID NO: 1434765 - RNA, 20 nt, Pseudomonas aeruginosa PA01
gcaauggauguugccgccgc

SEQ ID NO: 1434766 - RNA, 13 nt, Pseudomonas aeruginosa PA01
gcaauggcggugu

SEQ ID NO: 1434767 - RNA, 12 nt, Pseudomonas aeruginosa PA01
gcaauggccggc

SEQ ID NO: 1434768 - RNA, 14 nt, Pseudomonas aeruginosa PA01
gcaauggccggcgg

SEQ ID NO: 1434769 - RNA, 15 nt, Pseudomonas aeruginosa PA01
gcaauggccggcggg

SEQ ID NO: 1434770 - RNA, 19 nt, Pseudomonas aeruginosa PA01
gcaauggggcggccggcgc

SEQ ID NO: 1434771 - RNA, 13 nt, Pseudomonas aeruginosa PA01
gcaaucggcgagc

SEQ ID NO: 1434772 - RNA, 17 nt, Pseudomonas aeruginosa PA01
gcaaugaaaaaggcgau

SEQ ID NO: 1434773 - RNA, 13 nt, Pseudomonas aeruginosa PA01
gcaaugccagcgc

SEQ ID NO: 1434774 - RNA, 18 nt, Pseudomonas aeruginosa PA01
gcaaugccagcgccacgc

SEQ ID NO: 1434775 - RNA, 15 nt, Pseudomonas aeruginosa PA01
gcaaugcccagcgca

SEQ ID NO: 1434776 - RNA, 17 nt, Pseudomonas aeruginosa PA01
gcaaugcccagcgcagg

SEQ ID NO: 1434777 - RNA, 20 nt, Pseudomonas aeruginosa PA01
gcaauuccaccggcuggccg

SEQ ID NO: 1434778 - RNA, 17 nt, Pseudomonas aeruginosa PA01
gcacaacgggugcugcg

SEQ ID NO: 1434779 - RNA, 17 nt, Pseudomonas aeruginosa PA01
gcacaccagcuccccgu

SEQ ID NO: 1434780 - RNA, 17 nt, Pseudomonas aeruginosa PA01
gcacaccgcgcgcgccu

SEQ ID NO: 1434781 - RNA, 12 nt, Pseudomonas aeruginosa PA01
gcaauccgaccg

SEQ ID NO: 1434782 - RNA, 21 nt, Pseudomonas aeruginosa PA01
gcaaucagggcugggcgcccu

SEQ ID NO: 1434783 - RNA, 13 nt, Pseudomonas aeruginosa PA01
gcaaucgcugccg

SEQ ID NO: 1434784 - RNA, 23 nt, Pseudomonas aeruginosa PA01
gcaaucgaccaucauccgcgugg

SEQ ID NO: 1434785 - RNA, 23 nt, Pseudomonas aeruginosa PA01
gcaauccggcgcugccgaacagc

SEQ ID NO: 1434786 - RNA, 18 nt, Pseudomonas aeruginosa PA01
gcaaucgaucgcuucgcg

SEQ ID NO: 1434787 - RNA, 16 nt, Pseudomonas aeruginosa PA01
gcaauacaccgcugcg

SEQ ID NO: 1434788 - RNA, 20 nt, Pseudomonas aeruginosa PA01
gcaagucgaacaggcccuug

SEQ ID NO: 1434789 - RNA, 18 nt, Pseudomonas aeruginosa PA01
gcaaggugcgggccgucg

SEQ ID NO: 1434790 - RNA, 19 nt, Pseudomonas aeruginosa PA01
gcaaggugcgggccgucgu

SEQ ID NO: 1434791 - RNA, 18 nt, Pseudomonas aeruginosa PA01
gcaaggugcgggcgacgc

SEQ ID NO: 1434792 - RNA, 18 nt, Pseudomonas aeruginosa PA01
gcaaguucgcauaggcgg

SEQ ID NO: 1434793 - RNA, 20 nt, Pseudomonas aeruginosa PA01
gcaaguucgcauaggcggcc

SEQ ID NO: 1434794 - RNA, 12 nt, Pseudomonas aeruginosa PA01
gcaaguggcggc

SEQ ID NO: 1434795 - RNA, 20 nt, Pseudomonas aeruginosa PA01
gcaagugggucacggugagg

SEQ ID NO: 1434796 - RNA, 22 nt, Pseudomonas aeruginosa PA01
gcaagugcccugggcgaacagc

SEQ ID NO: 1434797 - RNA, 23 nt, Pseudomonas aeruginosa PA01
gcaagucggccugcaccagccag

SEQ ID NO: 1434798 - RNA, 14 nt, Pseudomonas aeruginosa PA01
gcaaggcgcagcug

SEQ ID NO: 1434799 - RNA, 12 nt, Pseudomonas aeruginosa PA01
gcaaggcgcuga

SEQ ID NO: 1434800 - RNA, 22 nt, Pseudomonas aeruginosa PA01
gcaaggccaagucggccgccca

SEQ ID NO: 1434801 - RNA, 19 nt, Pseudomonas aeruginosa PA01
gcaaggccagggcggcgcc

SEQ ID NO: 1434802 - RNA, 22 nt, Pseudomonas aeruginosa PA01
gcaagggcacuucguccaggcc

SEQ ID NO: 1434803 - RNA, 15 nt, Pseudomonas aeruginosa PA01
gcaagggcgccgccg

SEQ ID NO: 1434804 - RNA, 19 nt, Pseudomonas aeruginosa PA01
gcaagggcgccgccgacgc

SEQ ID NO: 1434805 - RNA, 16 nt, Pseudomonas aeruginosa PA01
gcaaguaccgccggca

SEQ ID NO: 1434806 - RNA, 23 nt, Pseudomonas aeruginosa PA01
gcaaggucgucucagaccuuccu

SEQ ID NO: 1434807 - RNA, 21 nt, Pseudomonas aeruginosa PA01
gcaaggguuucgugaaacgcc

SEQ ID NO: 1434808 - RNA, 20 nt, Pseudomonas aeruginosa PA01
gcaacgucaggcuguagccu

SEQ ID NO: 1434809 - RNA, 16 nt, Pseudomonas aeruginosa PA01
gcaacguccucgcgcc

SEQ ID NO: 1434810 - RNA, 17 nt, Pseudomonas aeruginosa PA01
gcaacguccucgcgccg

SEQ ID NO: 1434811 - RNA, 16 nt, Pseudomonas aeruginosa PA01
gcaacggaaacacagc

SEQ ID NO: 1434812 - RNA, 20 nt, Pseudomonas aeruginosa PA01
gcaacgcgcccacuccuccg

SEQ ID NO: 1434813 - RNA, 22 nt, Pseudomonas aeruginosa PA01
gcaacgggacgccaggcguccc

SEQ ID NO: 1434814 - RNA, 14 nt, Pseudomonas aeruginosa PA01
gcaacgcgugauac

SEQ ID NO: 1434815 - RNA, 14 nt, Pseudomonas aeruginosa PA01
gcaacgcggcguca

SEQ ID NO: 1434816 - RNA, 16 nt, Pseudomonas aeruginosa PA01
gcaacgcggcgucagg

SEQ ID NO: 1434817 - RNA, 18 nt, Pseudomonas aeruginosa PA01
gcaacgcggagcaggcgg

SEQ ID NO: 1434818 - RNA, 18 nt, Pseudomonas aeruginosa PA01
gcaacgccuggugcaggu

SEQ ID NO: 1434819 - RNA, 14 nt, Pseudomonas aeruginosa PA01
gcaacgcgcgcagg

SEQ ID NO: 1434820 - RNA, 18 nt, Pseudomonas aeruginosa PA01
gcaacgccggcccgugcc

SEQ ID NO: 1434821 - RNA, 13 nt, Pseudomonas aeruginosa PA01
gcaacgccaggcu

SEQ ID NO: 1434822 - RNA, 18 nt, Pseudomonas aeruginosa PA01
gcaacgccaggcugucag

SEQ ID NO: 1434823 - RNA, 12 nt, Pseudomonas aeruginosa PA01
gcaacgccgacg

SEQ ID NO: 1434824 - RNA, 13 nt, Pseudomonas aeruginosa PA01
gcaacgccgacgg

SEQ ID NO: 1434825 - RNA, 15 nt, Pseudomonas aeruginosa PA01
gcaacgccgacggcg

SEQ ID NO: 1434826 - RNA, 14 nt, Pseudomonas aeruginosa PA01
gcaacgccgccaac

SEQ ID NO: 1434827 - RNA, 16 nt, Pseudomonas aeruginosa PA01
gcaacgccgccaacug

SEQ ID NO: 1434828 - RNA, 18 nt, Pseudomonas aeruginosa PA01
gcaacgccgccaacuggc

SEQ ID NO: 1434829 - RNA, 12 nt, Pseudomonas aeruginosa PA01
gcaacgccgccc

SEQ ID NO: 1434830 - RNA, 13 nt, Pseudomonas aeruginosa PA01
gcaacgccgcccc

SEQ ID NO: 1434831 - RNA, 20 nt, Pseudomonas aeruginosa PA01
gcaacgccgcccccagcgcg

SEQ ID NO: 1434832 - RNA, 18 nt, Pseudomonas aeruginosa PA01
gcaaccggguaccugcuc

SEQ ID NO: 1434833 - RNA, 20 nt, Pseudomonas aeruginosa PA01
gcaaccggguaccugcucgc

SEQ ID NO: 1434834 - RNA, 22 nt, Pseudomonas aeruginosa PA01
gcaaccggguaccugcucgcgg

SEQ ID NO: 1434835 - RNA, 16 nt, Pseudomonas aeruginosa PA01
gcaaccgguccucgcc

SEQ ID NO: 1434836 - RNA, 13 nt, Pseudomonas aeruginosa PA01
gcaaccgcugccg

SEQ ID NO: 1434837 - RNA, 17 nt, Pseudomonas aeruginosa PA01
gcaaccgcugccgccgu

SEQ ID NO: 1434838 - RNA, 15 nt, Pseudomonas aeruginosa PA01
gcaacccgcccggcu

SEQ ID NO: 1434839 - RNA, 20 nt, Pseudomonas aeruginosa PA01
gcaaccgcagacuccggcgc

SEQ ID NO: 1434840 - RNA, 15 nt, Pseudomonas aeruginosa PA01
gcaaccgcggcggcc

SEQ ID NO: 1434841 - RNA, 17 nt, Pseudomonas aeruginosa PA01
gcaacccgcuccgucgc

SEQ ID NO: 1434842 - RNA, 18 nt, Pseudomonas aeruginosa PA01
gcaacccgcuccgucgcu

SEQ ID NO: 1434843 - RNA, 15 nt, Pseudomonas aeruginosa PA01
gcaacccgccgcuga

SEQ ID NO: 1434844 - RNA, 22 nt, Pseudomonas aeruginosa PA01
gcaacccgcccuugcucgcggc

SEQ ID NO: 1434845 - RNA, 23 nt, Pseudomonas aeruginosa PA01
gcaacccgcccuugcucgcggcg

SEQ ID NO: 1434846 - RNA, 12 nt, Pseudomonas aeruginosa PA01
gcaaccgccgcc

SEQ ID NO: 1434847 - RNA, 15 nt, Pseudomonas aeruginosa PA01
gcaaccgccgccgca

SEQ ID NO: 1434848 - RNA, 19 nt, Pseudomonas aeruginosa PA01
gcaaccgauauggcuggcg

SEQ ID NO: 1434849 - RNA, 21 nt, Pseudomonas aeruginosa PA01
gcaaccgauauggcuggcgca

SEQ ID NO: 1434850 - RNA, 17 nt, Pseudomonas aeruginosa PA01
gcaaccguuccagcgcc

SEQ ID NO: 1434851 - RNA, 17 nt, Pseudomonas aeruginosa PA01
gcaaccgucgaacaggu

SEQ ID NO: 1434852 - RNA, 22 nt, Pseudomonas aeruginosa PA01
gcaaccuugcacauccagcccu

SEQ ID NO: 1434853 - RNA, 18 nt, Pseudomonas aeruginosa PA01
gcaacgaaaaagggcggc

SEQ ID NO: 1434854 - RNA, 18 nt, Pseudomonas aeruginosa PA01
gcaacgaaaagccgcccc

SEQ ID NO: 1434855 - RNA, 13 nt, Pseudomonas aeruginosa PA01
gcaaccuguggaa

SEQ ID NO: 1434856 - RNA, 22 nt, Pseudomonas aeruginosa PA01
gcaacgauucgacgcagcgcgc

SEQ ID NO: 1434857 - RNA, 20 nt, Pseudomonas aeruginosa PA01
gcaacgauaccgccgccggc

SEQ ID NO: 1434858 - RNA, 22 nt, Pseudomonas aeruginosa PA01
gcaacgauaccgccgccggccu

SEQ ID NO: 1434859 - RNA, 20 nt, Pseudomonas aeruginosa PA01
gcaacgacgaggccuggaug

SEQ ID NO: 1434860 - RNA, 18 nt, Pseudomonas aeruginosa PA01
gcaagcgguuauucgccc

SEQ ID NO: 1434861 - RNA, 22 nt, Pseudomonas aeruginosa PA01
gcaagcuccccgccgccaggcg

SEQ ID NO: 1434862 - RNA, 20 nt, Pseudomonas aeruginosa PA01
gcaagcucgacgagccgcga

SEQ ID NO: 1434863 - RNA, 14 nt, Pseudomonas aeruginosa PA01
gcaagcucgucacc

SEQ ID NO: 1434864 - RNA, 24 nt, Pseudomonas aeruginosa PA01
gcaagcucgucacccgcgccugca

SEQ ID NO: 1434865 - RNA, 23 nt, Pseudomonas aeruginosa PA01
gcaagcugaagcgccgcggcccg

SEQ ID NO: 1434866 - RNA, 18 nt, Pseudomonas aeruginosa PA01
gcaagcugcacggcgacc

SEQ ID NO: 1434867 - RNA, 14 nt, Pseudomonas aeruginosa PA01
gcaaggaccugcug

SEQ ID NO: 1434868 - RNA, 16 nt, Pseudomonas aeruginosa PA01
gcaaggaccugcugcc

SEQ ID NO: 1434869 - RNA, 18 nt, Pseudomonas aeruginosa PA01
gcaaggaccugcugcccg

SEQ ID NO: 1434870 - RNA, 19 nt, Pseudomonas aeruginosa PA01
gcaaggaccugcugcccgg

SEQ ID NO: 1434871 - RNA, 17 nt, Pseudomonas aeruginosa PA01
gcaagcggauauccccc

SEQ ID NO: 1434872 - RNA, 15 nt, Pseudomonas aeruginosa PA01
gcaagcgugccccga

SEQ ID NO: 1434873 - RNA, 19 nt, Pseudomonas aeruginosa PA01
gcaagccguagaacgccag

SEQ ID NO: 1434874 - RNA, 22 nt, Pseudomonas aeruginosa PA01
gcaagcgcaugaggcuggccag

SEQ ID NO: 1434875 - RNA, 15 nt, Pseudomonas aeruginosa PA01
gcaagccuggcgcgc

SEQ ID NO: 1434876 - RNA, 21 nt, Pseudomonas aeruginosa PA01
gcaagccauuccaacuggcgu

SEQ ID NO: 1434877 - RNA, 24 nt, Pseudomonas aeruginosa PA01
gcaagccauuccaacuggcguagg

SEQ ID NO: 1434878 - RNA, 20 nt, Pseudomonas aeruginosa PA01
gcaagcccgugggaucgcca

SEQ ID NO: 1434879 - RNA, 17 nt, Pseudomonas aeruginosa PA01
gcaagauuaucagcaac

SEQ ID NO: 1434880 - RNA, 18 nt, Pseudomonas aeruginosa PA01
gcaagauuaucagcaacg

SEQ ID NO: 1434881 - RNA, 21 nt, Pseudomonas aeruginosa PA01
gcaagcaccuugagggccuug

SEQ ID NO: 1434882 - RNA, 15 nt, Pseudomonas aeruginosa PA01
gcaacucggcgccgu

SEQ ID NO: 1434883 - RNA, 18 nt, Pseudomonas aeruginosa PA01
gcaacucgucguccagcg

SEQ ID NO: 1434884 - RNA, 21 nt, Pseudomonas aeruginosa PA01
gcaacucgucguccagcggcu

SEQ ID NO: 1434885 - RNA, 23 nt, Pseudomonas aeruginosa PA01
gcaacucgucguccagcggcucg

SEQ ID NO: 1434886 - RNA, 17 nt, Pseudomonas aeruginosa PA01
gcaacugaccuggccgu

SEQ ID NO: 1434887 - RNA, 17 nt, Pseudomonas aeruginosa PA01
gcaacugaucagccggg

SEQ ID NO: 1434888 - RNA, 19 nt, Pseudomonas aeruginosa PA01
gcaacugaucagccgggcg

SEQ ID NO: 1434889 - RNA, 20 nt, Pseudomonas aeruginosa PA01
gcaacugcauguugccguug

SEQ ID NO: 1434890 - RNA, 16 nt, Pseudomonas aeruginosa PA01
gcaacugccgcccgcu

SEQ ID NO: 1434891 - RNA, 13 nt, Pseudomonas aeruginosa PA01
gcaacucgccgcc

SEQ ID NO: 1434892 - RNA, 14 nt, Pseudomonas aeruginosa PA01
gcaacucgccgccg

SEQ ID NO: 1434893 - RNA, 18 nt, Pseudomonas aeruginosa PA01
gcaacuccagagccaugg

SEQ ID NO: 1434894 - RNA, 23 nt, Pseudomonas aeruginosa PA01
gcaacuccgccuguccaccggug

SEQ ID NO: 1434895 - RNA, 23 nt, Pseudomonas aeruginosa PA01
gcaacucuuccagggucggcacc

SEQ ID NO: 1434896 - RNA, 16 nt, Pseudomonas aeruginosa PA01
gcaacugcguccgaug

SEQ ID NO: 1434897 - RNA, 17 nt, Pseudomonas aeruginosa PA01
gcaacuggaaggccgcg

SEQ ID NO: 1434898 - RNA, 20 nt, Pseudomonas aeruginosa PA01
gcaacuggaaggccgcgccg

SEQ ID NO: 1434899 - RNA, 22 nt, Pseudomonas aeruginosa PA01
gcaacuggaaggccgcgccgag

SEQ ID NO: 1434900 - RNA, 16 nt, Pseudomonas aeruginosa PA01
gcaacuggucgccgca

SEQ ID NO: 1434901 - RNA, 17 nt, Pseudomonas aeruginosa PA01
gcaacuggucgccgcag

SEQ ID NO: 1434902 - RNA, 21 nt, Pseudomonas aeruginosa PA01
gcaacuggucgcggcugcgcg

SEQ ID NO: 1434903 - RNA, 14 nt, Pseudomonas aeruginosa PA01
gcaacuggccgaga

SEQ ID NO: 1434904 - RNA, 21 nt, Pseudomonas aeruginosa PA01
ggcggcaacgacgaggccugg

SEQ ID NO: 1434905 - RNA, 14 nt, Pseudomonas aeruginosa PA01
ggcggcaagggcac

SEQ ID NO: 1434906 - RNA, 15 nt, Pseudomonas aeruginosa PA01
ggcggauacaggcgc

SEQ ID NO: 1434907 - RNA, 17 nt, Pseudomonas aeruginosa PA01
ggcggauaucgcgccgc

SEQ ID NO: 1434908 - RNA, 17 nt, Pseudomonas aeruginosa PA01
ggcggauagcgcgcagg

SEQ ID NO: 1434909 - RNA, 19 nt, Pseudomonas aeruginosa PA01
ggcggauagcgcgcaggcg

SEQ ID NO: 1434910 - RNA, 18 nt, Pseudomonas aeruginosa PA01
ggcggaucaccggcuggc

SEQ ID NO: 1434911 - RNA, 20 nt, Pseudomonas aeruginosa PA01
ggcggaucaccggcuggccc

SEQ ID NO: 1434912 - RNA, 13 nt, Pseudomonas aeruginosa PA01
ggcggcaugggca

SEQ ID NO: 1434913 - RNA, 12 nt, Pseudomonas aeruginosa PA01
ggcggcacgacc

SEQ ID NO: 1434914 - RNA, 15 nt, Pseudomonas aeruginosa PA01
ggcggcacgaccaca

SEQ ID NO: 1434915 - RNA, 16 nt, Pseudomonas aeruginosa PA01
ggcggcaucggcgccg

SEQ ID NO: 1434916 - RNA, 17 nt, Pseudomonas aeruginosa PA01
ggcggcaccacgugcag

SEQ ID NO: 1434917 - RNA, 20 nt, Pseudomonas aeruginosa PA01
ggcggcaccacgugcagcag

SEQ ID NO: 1434918 - RNA, 21 nt, Pseudomonas aeruginosa PA01
ggcggcacccucuuccgcgcu

SEQ ID NO: 1434919 - RNA, 22 nt, Pseudomonas aeruginosa PA01
ggcggcacccucuuccgcgcug

SEQ ID NO: 1434920 - RNA, 22 nt, Pseudomonas aeruginosa PA01
ggcggccaaccucuccccagac

SEQ ID NO: 1434921 - RNA, 24 nt, Pseudomonas aeruginosa PA01
ggcggccacccgaagguguccgcc

SEQ ID NO: 1434922 - RNA, 17 nt, Pseudomonas aeruginosa PA01
ggcggcauugagcgcca

SEQ ID NO: 1434923 - RNA, 20 nt, Pseudomonas aeruginosa PA01
ggcggcauugagcgccagca

SEQ ID NO: 1434924 - RNA, 23 nt, Pseudomonas aeruginosa PA01
ggcggccaccaccgugaccagca

SEQ ID NO: 1434925 - RNA, 23 nt, Pseudomonas aeruginosa PA01
ggcggccagcggaugcuggcgga

SEQ ID NO: 1434926 - RNA, 14 nt, Pseudomonas aeruginosa PA01
ggcggccagcagca

SEQ ID NO: 1434927 - RNA, 16 nt, Pseudomonas aeruginosa PA01
ggcggccagcagcacg

SEQ ID NO: 1434928 - RNA, 13 nt, Pseudomonas aeruginosa PA01
ggcggaaggucag

SEQ ID NO: 1434929 - RNA, 15 nt, Pseudomonas aeruginosa PA01
ggcggaaggucaggu

SEQ ID NO: 1434930 - RNA, 15 nt, Pseudomonas aeruginosa PA01
ggcggaagacgaucu

SEQ ID NO: 1434931 - RNA, 20 nt, Pseudomonas aeruginosa PA01
ggcggaacuugucgccgcug

SEQ ID NO: 1434932 - RNA, 22 nt, Pseudomonas aeruginosa PA01
ggcggaagaaaagaaggcggau

SEQ ID NO: 1434933 - RNA, 23 nt, Pseudomonas aeruginosa PA01
ggcggaagaaaagaaggcggaug

SEQ ID NO: 1434934 - RNA, 13 nt, Pseudomonas aeruginosa PA01
ggcggaaggccuc

SEQ ID NO: 1434935 - RNA, 13 nt, Pseudomonas aeruginosa PA01
ggcggaaggcggc

SEQ ID NO: 1434936 - RNA, 18 nt, Pseudomonas aeruginosa PA01
ggcggaaggcggcgaagu

SEQ ID NO: 1434937 - RNA, 15 nt, Pseudomonas aeruginosa PA01
ggcggaaggcggcgu

SEQ ID NO: 1434938 - RNA, 16 nt, Pseudomonas aeruginosa PA01
ggcggacauguugcag

SEQ ID NO: 1434939 - RNA, 14 nt, Pseudomonas aeruginosa PA01
ggcggacagcccgc

SEQ ID NO: 1434940 - RNA, 17 nt, Pseudomonas aeruginosa PA01
ggcggacagcccgcgcu

SEQ ID NO: 1434941 - RNA, 19 nt, Pseudomonas aeruginosa PA01
ggcggacagcccgcgcucg

SEQ ID NO: 1434942 - RNA, 17 nt, Pseudomonas aeruginosa PA01
ggcggacaggcagccgg

SEQ ID NO: 1434943 - RNA, 17 nt, Pseudomonas aeruginosa PA01
ggcggacacgcaggcgc

SEQ ID NO: 1434944 - RNA, 18 nt, Pseudomonas aeruginosa PA01
ggcggacaaccaccaugc

SEQ ID NO: 1434945 - RNA, 21 nt, Pseudomonas aeruginosa PA01
ggcggacaacccggcgcuggc

SEQ ID NO: 1434946 - RNA, 23 nt, Pseudomonas aeruginosa PA01
ggcggacaacccggcgcuggccg

SEQ ID NO: 1434947 - RNA, 15 nt, Pseudomonas aeruginosa PA01
ggcggaaaagcccgc

SEQ ID NO: 1434948 - RNA, 21 nt, Pseudomonas aeruginosa PA01
ggcggaaaccgcauugacccg

SEQ ID NO: 1434949 - RNA, 21 nt, Pseudomonas aeruginosa PA01
ggcggaaaccugugcugcgcg

SEQ ID NO: 1434950 - RNA, 15 nt, Pseudomonas aeruginosa PA01
ggcggaaaaagcgcg

SEQ ID NO: 1434951 - RNA, 16 nt, Pseudomonas aeruginosa PA01
ggcggaaaaagcgcgg

SEQ ID NO: 1434952 - RNA, 14 nt, Pseudomonas aeruginosa PA01
ggcggacgaucacu

SEQ ID NO: 1434953 - RNA, 15 nt, Pseudomonas aeruginosa PA01
ggcggacgcaggccg

SEQ ID NO: 1434954 - RNA, 16 nt, Pseudomonas aeruginosa PA01
ggcggacgcaggccga

SEQ ID NO: 1434955 - RNA, 16 nt, Pseudomonas aeruginosa PA01
ggcggaccgccucgac

SEQ ID NO: 1434956 - RNA, 17 nt, Pseudomonas aeruginosa PA01
ggcggaccuccgccagg

SEQ ID NO: 1434957 - RNA, 18 nt, Pseudomonas aeruginosa PA01
ggcggaccuccgccaggu

SEQ ID NO: 1434958 - RNA, 23 nt, Pseudomonas aeruginosa PA01
ggcggagaaacuuucuucgccau

SEQ ID NO: 1434959 - RNA, 23 nt, Pseudomonas aeruginosa PA01
ggcggacugguaggacagggcca

SEQ ID NO: 1434960 - RNA, 16 nt, Pseudomonas aeruginosa PA01
ggcggacugcucgccg

SEQ ID NO: 1434961 - RNA, 19 nt, Pseudomonas aeruginosa PA01
ggcggacugcucgccgccg

SEQ ID NO: 1434962 - RNA, 16 nt, Pseudomonas aeruginosa PA01
ggcggagauugcggcg

SEQ ID NO: 1434963 - RNA, 13 nt, Pseudomonas aeruginosa PA01
ggcggagccgucg

SEQ ID NO: 1434964 - RNA, 21 nt, Pseudomonas aeruginosa PA01
ggcggagccgucggcuccgcu

SEQ ID NO: 1434965 - RNA, 13 nt, Pseudomonas aeruginosa PA01
ggcggaguagccg

SEQ ID NO: 1434966 - RNA, 19 nt, Pseudomonas aeruginosa PA01
ggcggaguagccggcggcg

SEQ ID NO: 1434967 - RNA, 22 nt, Pseudomonas aeruginosa PA01
ggcggaguagccggcggcgaac

SEQ ID NO: 1434968 - RNA, 18 nt, Pseudomonas aeruginosa PA01
ggcggagucguagcgcau

SEQ ID NO: 1434969 - RNA, 18 nt, Pseudomonas aeruginosa PA01
ggcggauaaacggcaugc

SEQ ID NO: 1434970 - RNA, 20 nt, Pseudomonas aeruginosa PA01
ggcggauaacgccgauggcg

SEQ ID NO: 1434971 - RNA, 21 nt, Pseudomonas aeruginosa PA01
ggcggauaacgccgcuggcgu

SEQ ID NO: 1434972 - RNA, 17 nt, Pseudomonas aeruginosa PA01
ggcggauaacgccggug

SEQ ID NO: 1434973 - RNA, 20 nt, Pseudomonas aeruginosa PA01
ggcggauaacgccgguggcg

SEQ ID NO: 1434974 - RNA, 20 nt, Pseudomonas aeruginosa PA01
ggcggauaacgccguuggcg

SEQ ID NO: 1434975 - RNA, 22 nt, Pseudomonas aeruginosa PA01
ggcggauaacgccuauggcguu

SEQ ID NO: 1434976 - RNA, 16 nt, Pseudomonas aeruginosa PA01
ggcggauaacgccugc

SEQ ID NO: 1434977 - RNA, 23 nt, Pseudomonas aeruginosa PA01
ggcggauaaucgcagcgcgguca

SEQ ID NO: 1434978 - RNA, 23 nt, Pseudomonas aeruginosa PA01
ggcggaggccuacuucucgacga

SEQ ID NO: 1434979 - RNA, 16 nt, Pseudomonas aeruginosa PA01
ggcggaggcgaggucg

SEQ ID NO: 1434980 - RNA, 19 nt, Pseudomonas aeruginosa PA01
ggcggaggcgaggucgccg

SEQ ID NO: 1434981 - RNA, 20 nt, Pseudomonas aeruginosa PA01
ggcggauaacaccguuggcg

SEQ ID NO: 1434982 - RNA, 17 nt, Pseudomonas aeruginosa PA01
ggcggauaaccgcgagc

SEQ ID NO: 1434983 - RNA, 20 nt, Pseudomonas aeruginosa PA01
ggcggauaaccgcguugcgg

SEQ ID NO: 1434984 - RNA, 13 nt, Pseudomonas aeruginosa PA01
ggcggccaggcgc

SEQ ID NO: 1434985 - RNA, 14 nt, Pseudomonas aeruginosa PA01
ggcggccaggcgcu

SEQ ID NO: 1434986 - RNA, 15 nt, Pseudomonas aeruginosa PA01
ggcggccaggcgcuc

SEQ ID NO: 1434987 - RNA, 16 nt, Pseudomonas aeruginosa PA01
ggcggccaggcgcucg

SEQ ID NO: 1434988 - RNA, 14 nt, Pseudomonas aeruginosa PA01
ggcggccgcuggcg

SEQ ID NO: 1434989 - RNA, 22 nt, Pseudomonas aeruginosa PA01
ggcggccggauggccgccguuc

SEQ ID NO: 1434990 - RNA, 14 nt, Pseudomonas aeruginosa PA01
ggcggccggccagg

SEQ ID NO: 1434991 - RNA, 12 nt, Pseudomonas aeruginosa PA01
ggcggccgucgc

SEQ ID NO: 1434992 - RNA, 13 nt, Pseudomonas aeruginosa PA01
ggcggccggugcc

SEQ ID NO: 1434993 - RNA, 14 nt, Pseudomonas aeruginosa PA01
ggcggccggcgcgg

SEQ ID NO: 1434994 - RNA, 17 nt, Pseudomonas aeruginosa PA01
ggcggccgggucgaggu

SEQ ID NO: 1434995 - RNA, 19 nt, Pseudomonas aeruginosa PA01
ggcggccgggucgaggucg

SEQ ID NO: 1434996 - RNA, 19 nt, Pseudomonas aeruginosa PA01
ggcggccucaggccuggcg

SEQ ID NO: 1434997 - RNA, 19 nt, Pseudomonas aeruginosa PA01
ggcggccgucggccuggcg

SEQ ID NO: 1434998 - RNA, 14 nt, Pseudomonas aeruginosa PA01
ggcggccucgaggu

SEQ ID NO: 1434999 - RNA, 22 nt, Pseudomonas aeruginosa PA01
ggcggccucgaggucggccugg

SEQ ID NO: 1435000 - RNA, 19 nt, Pseudomonas aeruginosa PA01
ggcggccucgauggcggca

SEQ ID NO: 1435001 - RNA, 21 nt, Pseudomonas aeruginosa PA01
ggcggcgaccauccagccugc

SEQ ID NO: 1435002 - RNA, 16 nt, Pseudomonas aeruginosa PA01
ggcggcgaccccgauc

SEQ ID NO: 1435003 - RNA, 13 nt, Pseudomonas aeruginosa PA01
ggcggcgaccgaa

SEQ ID NO: 1435004 - RNA, 20 nt, Pseudomonas aeruginosa PA01
ggcggcgaccgaacagcgcg

SEQ ID NO: 1435005 - RNA, 12 nt, Pseudomonas aeruginosa PA01
ggcggcgaccgc

SEQ ID NO: 1435006 - RNA, 13 nt, Pseudomonas aeruginosa PA01
ggcggcgaccgca

SEQ ID NO: 1435007 - RNA, 22 nt, Pseudomonas aeruginosa PA01
ggcggcgaccgcaucguuggcg

SEQ ID NO: 1435008 - RNA, 15 nt, Pseudomonas aeruginosa PA01
ggcggcgacgcuggc

SEQ ID NO: 1435009 - RNA, 18 nt, Pseudomonas aeruginosa PA01
ggcggcgaccggccucac

SEQ ID NO: 1435010 - RNA, 18 nt, Pseudomonas aeruginosa PA01
ggcggcgaaggccgcuug

SEQ ID NO: 1435011 - RNA, 18 nt, Pseudomonas aeruginosa PA01
ggcggcgacgaagguauc

SEQ ID NO: 1435012 - RNA, 15 nt, Pseudomonas aeruginosa PA01
ggcggcgagcgccgc

SEQ ID NO: 1435013 - RNA, 13 nt, Pseudomonas aeruginosa PA01
ggcggcgcgaacc

SEQ ID NO: 1435014 - RNA, 21 nt, Pseudomonas aeruginosa PA01
ggcggcgcgaaccagcagcag

SEQ ID NO: 1435015 - RNA, 15 nt, Pseudomonas aeruginosa PA01
ggcggcgccuucgcc

SEQ ID NO: 1435016 - RNA, 18 nt, Pseudomonas aeruginosa PA01
ggcggcgccuucgccgga

SEQ ID NO: 1435017 - RNA, 20 nt, Pseudomonas aeruginosa PA01
ggcggcgccuucgccggaag

SEQ ID NO: 1435018 - RNA, 13 nt, Pseudomonas aeruginosa PA01
ggcggcgcggcag

SEQ ID NO: 1435019 - RNA, 14 nt, Pseudomonas aeruginosa PA01
ggcggcgcggcagu

SEQ ID NO: 1435020 - RNA, 12 nt, Pseudomonas aeruginosa PA01
ggcggcgcggcg

SEQ ID NO: 1435021 - RNA, 13 nt, Pseudomonas aeruginosa PA01
ggcggcgcgcugc

SEQ ID NO: 1435022 - RNA, 16 nt, Pseudomonas aeruginosa PA01
ggcggcgcucagucga

SEQ ID NO: 1435023 - RNA, 15 nt, Pseudomonas aeruginosa PA01
ggcggcgcuauccgc

SEQ ID NO: 1435024 - RNA, 16 nt, Pseudomonas aeruginosa PA01
ggcggcgcguccaccu

SEQ ID NO: 1435025 - RNA, 11 nt, Pseudomonas aeruginosa PA01
ggcggcgcggg

SEQ ID NO: 1435026 - RNA, 12 nt, Pseudomonas aeruginosa PA01
ggcggcggcacc

SEQ ID NO: 1435027 - RNA, 20 nt, Pseudomonas aeruginosa PA01
ggcggcggaccuccgccagg

SEQ ID NO: 1435028 - RNA, 18 nt, Pseudomonas aeruginosa PA01
ggcggcggacgcaggccg

SEQ ID NO: 1435029 - RNA, 15 nt, Pseudomonas aeruginosa PA01
ggcggcggccgcaug

SEQ ID NO: 1435030 - RNA, 13 nt, Pseudomonas aeruginosa PA01
ggcggcggccgca

SEQ ID NO: 1435031 - RNA, 14 nt, Pseudomonas aeruginosa PA01
ggcggcggcccgca

SEQ ID NO: 1435032 - RNA, 14 nt, Pseudomonas aeruginosa PA01
ggcggcggccagca

SEQ ID NO: 1435033 - RNA, 15 nt, Pseudomonas aeruginosa PA01
ggcgggaaacgcagc

SEQ ID NO: 1435034 - RNA, 18 nt, Pseudomonas aeruginosa PA01
ggcgggaaacgcagcgac

SEQ ID NO: 1435035 - RNA, 15 nt, Pseudomonas aeruginosa PA01
ggcggcuccggcgcc

SEQ ID NO: 1435036 - RNA, 21 nt, Pseudomonas aeruginosa PA01
ggcggcuccggcgccaggccg

SEQ ID NO: 1435037 - RNA, 17 nt, Pseudomonas aeruginosa PA01
ggcggcucggcuccagg

SEQ ID NO: 1435038 - RNA, 21 nt, Pseudomonas aeruginosa PA01
ggcggcucaggccgccgcguc

SEQ ID NO: 1435039 - RNA, 18 nt, Pseudomonas aeruginosa PA01
ggcggcguuggccgagga

SEQ ID NO: 1435040 - RNA, 13 nt, Pseudomonas aeruginosa PA01
ggcggcggccugc

SEQ ID NO: 1435041 - RNA, 13 nt, Pseudomonas aeruginosa PA01
ggcggcggcgagu

SEQ ID NO: 1435042 - RNA, 13 nt, Pseudomonas aeruginosa PA01
ggcggcggcgauc

SEQ ID NO: 1435043 - RNA, 18 nt, Pseudomonas aeruginosa PA01
ggcggcgugcaggccgau

SEQ ID NO: 1435044 - RNA, 16 nt, Pseudomonas aeruginosa PA01
ggcggcgugcagggua

SEQ ID NO: 1435045 - RNA, 17 nt, Pseudomonas aeruginosa PA01
ggcggcgugcaggguau

SEQ ID NO: 1435046 - RNA, 14 nt, Pseudomonas aeruginosa PA01
ggcgguuucgucga

SEQ ID NO: 1435047 - RNA, 23 nt, Pseudomonas aeruginosa PA01
ggcgguuucgucgaagcccaggg

SEQ ID NO: 1435048 - RNA, 20 nt, Pseudomonas aeruginosa PA01
ggcgguuguucagcgggcgc

SEQ ID NO: 1435049 - RNA, 23 nt, Pseudomonas aeruginosa PA01
ggcgguuguucagcgggcgcuug

SEQ ID NO: 1435050 - RNA, 14 nt, Pseudomonas aeruginosa PA01
ggcgguuggcccgc

SEQ ID NO: 1435051 - RNA, 21 nt, Pseudomonas aeruginosa PA01
ggcgguuccagacauccgggu

SEQ ID NO: 1435052 - RNA, 19 nt, Pseudomonas aeruginosa PA01
ggcgguucgccgagcgccg

SEQ ID NO: 1435053 - RNA, 21 nt, Pseudomonas aeruginosa PA01
ggcgguucgccgagcgccgcc

SEQ ID NO: 1435054 - RNA, 15 nt, Pseudomonas aeruginosa PA01
ggcgguucucgucga

SEQ ID NO: 1435055 - RNA, 13 nt, Pseudomonas aeruginosa PA01
ggcguaagcuggg

SEQ ID NO: 1435056 - RNA, 21 nt, Pseudomonas aeruginosa PA01
ggcguaaucgcgccaggccgc

SEQ ID NO: 1435057 - RNA, 16 nt, Pseudomonas aeruginosa PA01
ggcguacaggccccag

SEQ ID NO: 1435058 - RNA, 18 nt, Pseudomonas aeruginosa PA01
ggcguaccucgccaggcu

SEQ ID NO: 1435059 - RNA, 15 nt, Pseudomonas aeruginosa PA01
ggcguaccagccgcg

SEQ ID NO: 1435060 - RNA, 20 nt, Pseudomonas aeruginosa PA01
ggcguaccagccgcggucca

SEQ ID NO: 1435061 - RNA, 14 nt, Pseudomonas aeruginosa PA01
ggcguaccagcuug

SEQ ID NO: 1435062 - RNA, 18 nt, Pseudomonas aeruginosa PA01
ggcguaacggcuugucgg

SEQ ID NO: 1435063 - RNA, 20 nt, Pseudomonas aeruginosa PA01
ggcguaggccucggagucag

SEQ ID NO: 1435064 - RNA, 13 nt, Pseudomonas aeruginosa PA01
ggcguaggcgcgc

SEQ ID NO: 1435065 - RNA, 22 nt, Pseudomonas aeruginosa PA01
ggcguaggcgcgccaaggccgc

SEQ ID NO: 1435066 - RNA, 14 nt, Pseudomonas aeruginosa PA01
ggcguaggcgucgc

SEQ ID NO: 1435067 - RNA, 19 nt, Pseudomonas aeruginosa PA01
ggcguagcguugcgcgagc

SEQ ID NO: 1435068 - RNA, 23 nt, Pseudomonas aeruginosa PA01
ggcguagcguugcgcgagcaccg

SEQ ID NO: 1435069 - RNA, 17 nt, Pseudomonas aeruginosa PA01
ggcguagcgcagggucg

SEQ ID NO: 1435070 - RNA, 20 nt, Pseudomonas aeruginosa PA01
ggcguagcgcggcagcgcca

SEQ ID NO: 1435071 - RNA, 22 nt, Pseudomonas aeruginosa PA01
ggcguagcgcggcagcgccauc

SEQ ID NO: 1435072 - RNA, 16 nt, Pseudomonas aeruginosa PA01
ggcguagcggaagccg

SEQ ID NO: 1435073 - RNA, 19 nt, Pseudomonas aeruginosa PA01
ggcguagcggaagccgucg

SEQ ID NO: 1435074 - RNA, 20 nt, Pseudomonas aeruginosa PA01
ggcguagcggaagccgucgg

SEQ ID NO: 1435075 - RNA, 21 nt, Pseudomonas aeruginosa PA01
ggcguagcggaagccgucggc

SEQ ID NO: 1435076 - RNA, 15 nt, Pseudomonas aeruginosa PA01
ggcguagugcaucag

SEQ ID NO: 1435077 - RNA, 18 nt, Pseudomonas aeruginosa PA01
ggcguagugcaucagccu

SEQ ID NO: 1435078 - RNA, 19 nt, Pseudomonas aeruginosa PA01
ggcguagugcuccucgucg

SEQ ID NO: 1435079 - RNA, 21 nt, Pseudomonas aeruginosa PA01
ggcguagugcuggguggaggc

SEQ ID NO: 1435080 - RNA, 19 nt, Pseudomonas aeruginosa PA01
ggcguagaggcucggcggc

SEQ ID NO: 1435081 - RNA, 16 nt, Pseudomonas aeruginosa PA01
ggcguagaccuucucg

SEQ ID NO: 1435082 - RNA, 20 nt, Pseudomonas aeruginosa PA01
ggcguagccggccagggcgc

SEQ ID NO: 1435083 - RNA, 14 nt, Pseudomonas aeruginosa PA01
ggcguagccggcga

SEQ ID NO: 1435084 - RNA, 19 nt, Pseudomonas aeruginosa PA01
ggcguagccuuccuucucg

SEQ ID NO: 1435085 - RNA, 19 nt, Pseudomonas aeruginosa PA01
ggcguacuucggcgcggug

SEQ ID NO: 1435086 - RNA, 18 nt, Pseudomonas aeruginosa PA01
ggcgguggagcacgucga

SEQ ID NO: 1435087 - RNA, 14 nt, Pseudomonas aeruginosa PA01
ggcggugcguucgc

SEQ ID NO: 1435088 - RNA, 20 nt, Pseudomonas aeruginosa PA01
ggcggugcguucgcgggcgc

SEQ ID NO: 1435089 - RNA, 13 nt, Pseudomonas aeruginosa PA01
ggcggugcggucg

SEQ ID NO: 1435090 - RNA, 18 nt, Pseudomonas aeruginosa PA01
ggcggugcggaagacgaa

SEQ ID NO: 1435091 - RNA, 16 nt, Pseudomonas aeruginosa PA01
ggcgguggggccgccg

SEQ ID NO: 1435092 - RNA, 19 nt, Pseudomonas aeruginosa PA01
ggcgguggccgugggccgc

SEQ ID NO: 1435093 - RNA, 21 nt, Pseudomonas aeruginosa PA01
ggcgguggccgugggccgccg

SEQ ID NO: 1435094 - RNA, 19 nt, Pseudomonas aeruginosa PA01
ggcgguggccacgucgccc

SEQ ID NO: 1435095 - RNA, 14 nt, Pseudomonas aeruginosa PA01
ggcgguggccgcgu

SEQ ID NO: 1435096 - RNA, 17 nt, Pseudomonas aeruginosa PA01
ggcgguguagaccacca

SEQ ID NO: 1435097 - RNA, 19 nt, Pseudomonas aeruginosa PA01
ggcgguguagaccaccagc

SEQ ID NO: 1435098 - RNA, 20 nt, Pseudomonas aeruginosa PA01
ggcgguguccauguugccgu

SEQ ID NO: 1435099 - RNA, 19 nt, Pseudomonas aeruginosa PA01
ggcggucucgaacgccagg

SEQ ID NO: 1435100 - RNA, 16 nt, Pseudomonas aeruginosa PA01
ggcggucucggcgggu

SEQ ID NO: 1435101 - RNA, 15 nt, Pseudomonas aeruginosa PA01
ggcggucgucgccau

SEQ ID NO: 1435102 - RNA, 13 nt, Pseudomonas aeruginosa PA01
ggcggucggcuca

SEQ ID NO: 1435103 - RNA, 14 nt, Pseudomonas aeruginosa PA01
ggcggucggccagg

SEQ ID NO: 1435104 - RNA, 17 nt, Pseudomonas aeruginosa PA01
ggcggucggccaggcgg

SEQ ID NO: 1435105 - RNA, 21 nt, Pseudomonas aeruginosa PA01
ggcggucggccaggcggccga

SEQ ID NO: 1435106 - RNA, 13 nt, Pseudomonas aeruginosa PA01
ggcggucggccau

SEQ ID NO: 1435107 - RNA, 22 nt, Pseudomonas aeruginosa PA01
ggcggucggccaucuggcugcc

SEQ ID NO: 1435108 - RNA, 14 nt, Pseudomonas aeruginosa PA01
ggcggugaccagcg

SEQ ID NO: 1435109 - RNA, 17 nt, Pseudomonas aeruginosa PA01
ggcggugaccagcggca

SEQ ID NO: 1435110 - RNA, 23 nt, Pseudomonas aeruginosa PA01
ggcggucuugaucacguccaggu

SEQ ID NO: 1435111 - RNA, 12 nt, Pseudomonas aeruginosa PA01
ggcggugccgca

SEQ ID NO: 1435112 - RNA, 13 nt, Pseudomonas aeruginosa PA01
ggcggugccaugg

SEQ ID NO: 1435113 - RNA, 13 nt, Pseudomonas aeruginosa PA01
ggcggugcagcgg

SEQ ID NO: 1435114 - RNA, 21 nt, Pseudomonas aeruginosa PA01
ggcggugaccguuucgccgcc

SEQ ID NO: 1435115 - RNA, 19 nt, Pseudomonas aeruginosa PA01
ggcggucgccgaacagccg

SEQ ID NO: 1435116 - RNA, 15 nt, Pseudomonas aeruginosa PA01
ggcggucgccgaccc

SEQ ID NO: 1435117 - RNA, 13 nt, Pseudomonas aeruginosa PA01
ggcggucgccgcc

SEQ ID NO: 1435118 - RNA, 17 nt, Pseudomonas aeruginosa PA01
ggcggucgccgccggcg

SEQ ID NO: 1435119 - RNA, 21 nt, Pseudomonas aeruginosa PA01
ggcggucgccgccggcgaaca

SEQ ID NO: 1435120 - RNA, 20 nt, Pseudomonas aeruginosa PA01
ggcggucggaaagcagggcg

SEQ ID NO: 1435121 - RNA, 14 nt, Pseudomonas aeruginosa PA01
ggcgguagcccggc

SEQ ID NO: 1435122 - RNA, 12 nt, Pseudomonas aeruginosa PA01
ggcgguccagcc

SEQ ID NO: 1435123 - RNA, 23 nt, Pseudomonas aeruginosa PA01
ggcggucgagacgccaucaacgg

SEQ ID NO: 1435124 - RNA, 15 nt, Pseudomonas aeruginosa PA01
ggcggucgaggcccu

SEQ ID NO: 1435125 - RNA, 17 nt, Pseudomonas aeruginosa PA01
ggcggucgaggcccucg

SEQ ID NO: 1435126 - RNA, 21 nt, Pseudomonas aeruginosa PA01
ggcggucgaggcccucggcgg

SEQ ID NO: 1435127 - RNA, 23 nt, Pseudomonas aeruginosa PA01
ggcggucgaggcccucggcggcg

SEQ ID NO: 1435128 - RNA, 15 nt, Pseudomonas aeruginosa PA01
ggcggucccuucgug

SEQ ID NO: 1435129 - RNA, 22 nt, Pseudomonas aeruginosa PA01
ggcggucccuucgugggccugc

SEQ ID NO: 1435130 - RNA, 16 nt, Pseudomonas aeruginosa PA01
ggcggucccagaccag

SEQ ID NO: 1435131 - RNA, 17 nt, Pseudomonas aeruginosa PA01
ggcggucccagaccagc

SEQ ID NO: 1435132 - RNA, 21 nt, Pseudomonas aeruginosa PA01
ggcggucccagaccagcagcg

SEQ ID NO: 1435133 - RNA, 22 nt, Pseudomonas aeruginosa PA01
ggcggucccagaccagcagcgg

SEQ ID NO: 1435134 - RNA, 15 nt, Pseudomonas aeruginosa PA01
ggcggucccaucagc

SEQ ID NO: 1435135 - RNA, 16 nt, Pseudomonas aeruginosa PA01
ggcggucccaucagca

SEQ ID NO: 1435136 - RNA, 17 nt, Pseudomonas aeruginosa PA01
ggcggucaucgcgccgc

SEQ ID NO: 1435137 - RNA, 19 nt, Pseudomonas aeruginosa PA01
ggcggucaucgcgccgccg

SEQ ID NO: 1435138 - RNA, 16 nt, Pseudomonas aeruginosa PA01
ggcggucaggcucagc

SEQ ID NO: 1435139 - RNA, 18 nt, Pseudomonas aeruginosa PA01
ggcggucagaucagcggg

SEQ ID NO: 1435140 - RNA, 18 nt, Pseudomonas aeruginosa PA01
ggcggucagcgacuggcc

SEQ ID NO: 1435141 - RNA, 12 nt, Pseudomonas aeruginosa PA01
ggcggucagcgc

SEQ ID NO: 1435142 - RNA, 13 nt, Pseudomonas aeruginosa PA01
ggcggucagcgcg

SEQ ID NO: 1435143 - RNA, 20 nt, Pseudomonas aeruginosa PA01
ggcgguaguguugaagccgc

SEQ ID NO: 1435144 - RNA, 17 nt, Pseudomonas aeruginosa PA01
ggcgguaggcguugauc

SEQ ID NO: 1435145 - RNA, 20 nt, Pseudomonas aeruginosa PA01
ggcgguaugccggagugccg

SEQ ID NO: 1435146 - RNA, 21 nt, Pseudomonas aeruginosa PA01
ggcgguaggugagcgacccgc

SEQ ID NO: 1435147 - RNA, 21 nt, Pseudomonas aeruginosa PA01
ggcgguaguaggguucgccga

SEQ ID NO: 1435148 - RNA, 22 nt, Pseudomonas aeruginosa PA01
ggcgguaguaggguucgccgac

SEQ ID NO: 1435149 - RNA, 22 nt, Pseudomonas aeruginosa PA01
ggcgguagcuccaggccgaaga

SEQ ID NO: 1435150 - RNA, 18 nt, Pseudomonas aeruginosa PA01
ggcgguagccgaggcggc

SEQ ID NO: 1435151 - RNA, 22 nt, Pseudomonas aeruginosa PA01
ggcgguagccgaggcggccgag

SEQ ID NO: 1435152 - RNA, 15 nt, Pseudomonas aeruginosa PA01
ggcgguagcgccgcg

SEQ ID NO: 1435153 - RNA, 18 nt, Pseudomonas aeruginosa PA01
ggcgguagcgccgcgcca

SEQ ID NO: 1435154 - RNA, 13 nt, Pseudomonas aeruginosa PA01
ggcgguagcgcga

SEQ ID NO: 1435155 - RNA, 18 nt, Pseudomonas aeruginosa PA01
ggcgguacagcccccagg

SEQ ID NO: 1435156 - RNA, 14 nt, Pseudomonas aeruginosa PA01
ggcgguacaggcgc

SEQ ID NO: 1435157 - RNA, 18 nt, Pseudomonas aeruginosa PA01
ggcgguacauggccuucu

SEQ ID NO: 1435158 - RNA, 16 nt, Pseudomonas aeruginosa PA01
ggcggguucagcccgc

SEQ ID NO: 1435159 - RNA, 23 nt, Pseudomonas aeruginosa PA01
ggcggguucagcccgccgugcgc

SEQ ID NO: 1435160 - RNA, 13 nt, Pseudomonas aeruginosa PA01
ggcgggcgcccgc

SEQ ID NO: 1435161 - RNA, 12 nt, Pseudomonas aeruginosa PA01
ggcgggcgcgga

SEQ ID NO: 1435162 - RNA, 23 nt, Pseudomonas aeruginosa PA01
ggcgggaucgaguaagugccgac

SEQ ID NO: 1435163 - RNA, 16 nt, Pseudomonas aeruginosa PA01
ggcgggaucaggucgc

SEQ ID NO: 1435164 - RNA, 16 nt, Pseudomonas aeruginosa PA01
ggcgggaucgacgccg

SEQ ID NO: 1435165 - RNA, 17 nt, Pseudomonas aeruginosa PA01
ggcgggaucgacgccgc

SEQ ID NO: 1435166 - RNA, 18 nt, Pseudomonas aeruginosa PA01
ggcgggauugucgccgcc

SEQ ID NO: 1435167 - RNA, 23 nt, Pseudomonas aeruginosa PA01
ggcgggauugucgccgccgagua

SEQ ID NO: 1435168 - RNA, 18 nt, Pseudomonas aeruginosa PA01
ggcgggaucuccgcgcca

SEQ ID NO: 1435169 - RNA, 18 nt, Pseudomonas aeruginosa PA01
ggcgggaggcuacagccu

SEQ ID NO: 1435170 - RNA, 21 nt, Pseudomonas aeruginosa PA01
ggcgggucacgccgagggcgc

SEQ ID NO: 1435171 - RNA, 18 nt, Pseudomonas aeruginosa PA01
ggcggguagagucgcucg

SEQ ID NO: 1435172 - RNA, 18 nt, Pseudomonas aeruginosa PA01
ggcgggugaucuugaucu

SEQ ID NO: 1435173 - RNA, 20 nt, Pseudomonas aeruginosa PA01
ggcgggugugguccgcggug

SEQ ID NO: 1435174 - RNA, 18 nt, Pseudomonas aeruginosa PA01
ggcggguaaagcgcccgc

SEQ ID NO: 1435175 - RNA, 18 nt, Pseudomonas aeruginosa PA01
ggcggggucgcgccggug

SEQ ID NO: 1435176 - RNA, 12 nt, Pseudomonas aeruginosa PA01
ggcgggcugccg

SEQ ID NO: 1435177 - RNA, 16 nt, Pseudomonas aeruginosa PA01
ggcgggcuggaaaacg

SEQ ID NO: 1435178 - RNA, 12 nt, Pseudomonas aeruginosa PA01
ggcgggcuccgc

SEQ ID NO: 1435179 - RNA, 16 nt, Pseudomonas aeruginosa PA01
ggcgggcuccgccgcc

SEQ ID NO: 1435180 - RNA, 21 nt, Pseudomonas aeruginosa PA01
ggcggggcguauagcccgggu

SEQ ID NO: 1435181 - RNA, 18 nt, Pseudomonas aeruginosa PA01
aaggucggucucgccacc

SEQ ID NO: 1435182 - RNA, 14 nt, Pseudomonas aeruginosa PA01
aaggucgccgggcu

SEQ ID NO: 1435183 - RNA, 17 nt, Pseudomonas aeruginosa PA01
aaggugggcagcagcga

SEQ ID NO: 1435184 - RNA, 18 nt, Pseudomonas aeruginosa PA01
aaggugggcagcagcgaa

SEQ ID NO: 1435185 - RNA, 19 nt, Pseudomonas aeruginosa PA01
aaggugcaggccgcgcgau

SEQ ID NO: 1435186 - RNA, 13 nt, Pseudomonas aeruginosa PA01
ggcgcucagcgcc

SEQ ID NO: 1435187 - RNA, 14 nt, Pseudomonas aeruginosa PA01
ggcgcucagcgccg

SEQ ID NO: 1435188 - RNA, 15 nt, Pseudomonas aeruginosa PA01
ggcgcucagcgccgc

SEQ ID NO: 1435189 - RNA, 22 nt, Pseudomonas aeruginosa PA01
ggcgcuauccgccguuacgccg

SEQ ID NO: 1435190 - RNA, 16 nt, Pseudomonas aeruginosa PA01
ggcgcucagcaucagc

SEQ ID NO: 1435191 - RNA, 21 nt, Pseudomonas aeruginosa PA01
aagguugucgaagcgaucgga

SEQ ID NO: 1435192 - RNA, 14 nt, Pseudomonas aeruginosa PA01
ggcgcuaugcgccg

SEQ ID NO: 1435193 - RNA, 19 nt, Pseudomonas aeruginosa PA01
ggcgcucaacgccucgcgg

SEQ ID NO: 1435194 - RNA, 20 nt, Pseudomonas aeruginosa PA01
ggcgcucaacgccucgcggc

SEQ ID NO: 1435195 - RNA, 22 nt, Pseudomonas aeruginosa PA01
ggcgcucaacgccucgcggcua

SEQ ID NO: 1435196 - RNA, 22 nt, Pseudomonas aeruginosa PA01
ggcgcgucggcggugucgguau

SEQ ID NO: 1435197 - RNA, 17 nt, Pseudomonas aeruginosa PA01
ggcgcgucggccgcucg

SEQ ID NO: 1435198 - RNA, 15 nt, Pseudomonas aeruginosa PA01
ggcgcgucgcggccu

SEQ ID NO: 1435199 - RNA, 20 nt, Pseudomonas aeruginosa PA01
ggcgcgucgcggccucuucg

SEQ ID NO: 1435200 - RNA, 23 nt, Pseudomonas aeruginosa PA01
ggcgcgucgcggccucuucgucg

SEQ ID NO: 1435201 - RNA, 18 nt, Pseudomonas aeruginosa PA01
ggcgcgucgcucauccgc

SEQ ID NO: 1435202 - RNA, 14 nt, Pseudomonas aeruginosa PA01
ggcgcgucgcugcc

SEQ ID NO: 1435203 - RNA, 16 nt, Pseudomonas aeruginosa PA01
ggcgcgucgcugccgc

SEQ ID NO: 1435204 - RNA, 15 nt, Pseudomonas aeruginosa PA01
ggcgcgucuccagcu

SEQ ID NO: 1435205 - RNA, 16 nt, Pseudomonas aeruginosa PA01
ggcgcgucuccagcuc

SEQ ID NO: 1435206 - RNA, 21 nt, Pseudomonas aeruginosa PA01
ggcgcgucuccagcucggcga

SEQ ID NO: 1435207 - RNA, 14 nt, Pseudomonas aeruginosa PA01
ggcgcgucggugcc

SEQ ID NO: 1435208 - RNA, 19 nt, Pseudomonas aeruginosa PA01
ggcgcgucggugccgcccg

SEQ ID NO: 1435209 - RNA, 14 nt, Pseudomonas aeruginosa PA01
ggcgcgucgguggc

SEQ ID NO: 1435210 - RNA, 15 nt, Pseudomonas aeruginosa PA01
ggcgcuauccgccgu

SEQ ID NO: 1435211 - RNA, 12 nt, Pseudomonas aeruginosa PA01
ggcgcggcgcca

SEQ ID NO: 1435212 - RNA, 13 nt, Pseudomonas aeruginosa PA01
ggcgcggcgccag

SEQ ID NO: 1435213 - RNA, 16 nt, Pseudomonas aeruginosa PA01
ggcgcggcgcuccagg

SEQ ID NO: 1435214 - RNA, 19 nt, Pseudomonas aeruginosa PA01
ggcgcggcgcuccaggcgg

SEQ ID NO: 1435215 - RNA, 21 nt, Pseudomonas aeruginosa PA01
ggcgcggcgccuucagcgccg

SEQ ID NO: 1435216 - RNA, 16 nt, Pseudomonas aeruginosa PA01
ggcgcggcugaucggc

SEQ ID NO: 1435217 - RNA, 17 nt, Pseudomonas aeruginosa PA01
ggcgcggcugaucggcc

SEQ ID NO: 1435218 - RNA, 12 nt, Pseudomonas aeruginosa PA01
ggcgcggcgucg

SEQ ID NO: 1435219 - RNA, 19 nt, Pseudomonas aeruginosa PA01
ggcgcggcguaccagccgc

SEQ ID NO: 1435220 - RNA, 13 nt, Pseudomonas aeruginosa PA01
ggcgcguccagcu

SEQ ID NO: 1435221 - RNA, 19 nt, Pseudomonas aeruginosa PA01
ggcgcguccagcuccacca

SEQ ID NO: 1435222 - RNA, 20 nt, Pseudomonas aeruginosa PA01
ggcgcgucccugggcgcagg

SEQ ID NO: 1435223 - RNA, 13 nt, Pseudomonas aeruginosa PA01
ggcgcggcggccg

SEQ ID NO: 1435224 - RNA, 19 nt, Pseudomonas aeruginosa PA01
ggcgcggcagugcucgauc

SEQ ID NO: 1435225 - RNA, 17 nt, Pseudomonas aeruginosa PA01
ggcgcggcccguccgcg

SEQ ID NO: 1435226 - RNA, 14 nt, Pseudomonas aeruginosa PA01
ggcgcggccgaacu

SEQ ID NO: 1435227 - RNA, 15 nt, Pseudomonas aeruginosa PA01
ggcgcggccgaacuc

SEQ ID NO: 1435228 - RNA, 15 nt, Pseudomonas aeruginosa PA01
ggcgcggccggcgcc

SEQ ID NO: 1435229 - RNA, 16 nt, Pseudomonas aeruginosa PA01
ggcgcggccggcgccg

SEQ ID NO: 1435230 - RNA, 15 nt, Pseudomonas aeruginosa PA01
ggcgcggccgugccu

SEQ ID NO: 1435231 - RNA, 13 nt, Pseudomonas aeruginosa PA01
ggcgcggccugca

SEQ ID NO: 1435232 - RNA, 19 nt, Pseudomonas aeruginosa PA01
ggcgcggccugcagcgacu

SEQ ID NO: 1435233 - RNA, 22 nt, Pseudomonas aeruginosa PA01
ggcgcggccugcagcgacucca

SEQ ID NO: 1435234 - RNA, 21 nt, Pseudomonas aeruginosa PA01
ggcgcggccuucuugcugccg

SEQ ID NO: 1435235 - RNA, 15 nt, Pseudomonas aeruginosa PA01
ggcgcgcgccaccgc

SEQ ID NO: 1435236 - RNA, 17 nt, Pseudomonas aeruginosa PA01
ggcgcgcgccaccgccu

SEQ ID NO: 1435237 - RNA, 12 nt, Pseudomonas aeruginosa PA01
ggcgcgcgcccc

SEQ ID NO: 1435238 - RNA, 19 nt, Pseudomonas aeruginosa PA01
ggcgcgcgcccccuggccg

SEQ ID NO: 1435239 - RNA, 12 nt, Pseudomonas aeruginosa PA01
ggcgcgcgccgg

SEQ ID NO: 1435240 - RNA, 15 nt, Pseudomonas aeruginosa PA01
ggcgcgcgccgaacu

SEQ ID NO: 1435241 - RNA, 16 nt, Pseudomonas aeruginosa PA01
ggcgcgcgccgaacuc

SEQ ID NO: 1435242 - RNA, 23 nt, Pseudomonas aeruginosa PA01
ggcgccguuguucaggcgcgcgg

SEQ ID NO: 1435243 - RNA, 20 nt, Pseudomonas aeruginosa PA01
ggcgccuccagcgggccuuc

SEQ ID NO: 1435244 - RNA, 21 nt, Pseudomonas aeruginosa PA01
ggcgccuccagcgggccuucg

SEQ ID NO: 1435245 - RNA, 21 nt, Pseudomonas aeruginosa PA01
ggcgccuagacccugggccaa

SEQ ID NO: 1435246 - RNA, 13 nt, Pseudomonas aeruginosa PA01
ggcgccucgccgc

SEQ ID NO: 1435247 - RNA, 17 nt, Pseudomonas aeruginosa PA01
ggcgccucgccgcggca

SEQ ID NO: 1435248 - RNA, 16 nt, Pseudomonas aeruginosa PA01
ggcgcgagaagccagc

SEQ ID NO: 1435249 - RNA, 17 nt, Pseudomonas aeruginosa PA01
ggcgcgauauccgccag

SEQ ID NO: 1435250 - RNA, 18 nt, Pseudomonas aeruginosa PA01
ggcgcgauauccgccagg

SEQ ID NO: 1435251 - RNA, 12 nt, Pseudomonas aeruginosa PA01
ggcgcgauccgc

SEQ ID NO: 1435252 - RNA, 14 nt, Pseudomonas aeruginosa PA01
ggcgcgauccgcgc

SEQ ID NO: 1435253 - RNA, 21 nt, Pseudomonas aeruginosa PA01
ggcgcgauccgcgcggcaacc

SEQ ID NO: 1435254 - RNA, 17 nt, Pseudomonas aeruginosa PA01
ggcgcgauccuccgcca

SEQ ID NO: 1435255 - RNA, 16 nt, Pseudomonas aeruginosa PA01
ggcgcgauccuggcgg

SEQ ID NO: 1435256 - RNA, 19 nt, Pseudomonas aeruginosa PA01
ggcgcgauccuggcggcac

SEQ ID NO: 1435257 - RNA, 17 nt, Pseudomonas aeruginosa PA01
ggcgcgaucgcguucca

SEQ ID NO: 1435258 - RNA, 18 nt, Pseudomonas aeruginosa PA01
ggcgcgaugaugccgccg

SEQ ID NO: 1435259 - RNA, 19 nt, Pseudomonas aeruginosa PA01
ggcgcgaugccgaugccgc

SEQ ID NO: 1435260 - RNA, 19 nt, Pseudomonas aeruginosa PA01
ggcgcgcaccaccuggcag

SEQ ID NO: 1435261 - RNA, 22 nt, Pseudomonas aeruginosa PA01
ggcgcgcacggaggcgcucagg

SEQ ID NO: 1435262 - RNA, 16 nt, Pseudomonas aeruginosa PA01
ggcgcgcacuuccucg

SEQ ID NO: 1435263 - RNA, 20 nt, Pseudomonas aeruginosa PA01
ggcgcgcacuuccucggcga

SEQ ID NO: 1435264 - RNA, 22 nt, Pseudomonas aeruginosa PA01
ggcgcgcacuuccucggcgacc

SEQ ID NO: 1435265 - RNA, 14 nt, Pseudomonas aeruginosa PA01
ggcgcgcagggcca

SEQ ID NO: 1435266 - RNA, 16 nt, Pseudomonas aeruginosa PA01
ggcgcgccaaggccgc

SEQ ID NO: 1435267 - RNA, 20 nt, Pseudomonas aeruginosa PA01
ggcgcgcaucggugccggca

SEQ ID NO: 1435268 - RNA, 17 nt, Pseudomonas aeruginosa PA01
ggcgcgccagaagcggc

SEQ ID NO: 1435269 - RNA, 20 nt, Pseudomonas aeruginosa PA01
ggcgcgccagaagcggccga

SEQ ID NO: 1435270 - RNA, 22 nt, Pseudomonas aeruginosa PA01
ggcgcgccagaagcggccgacc

SEQ ID NO: 1435271 - RNA, 21 nt, Pseudomonas aeruginosa PA01
ggcgcgcccgccaggucgagg

SEQ ID NO: 1435272 - RNA, 18 nt, Pseudomonas aeruginosa PA01
ggcgcgcccaggcccagc

SEQ ID NO: 1435273 - RNA, 22 nt, Pseudomonas aeruginosa PA01
ggcgcgcccaggcccagcgcgg

SEQ ID NO: 1435274 - RNA, 23 nt, Pseudomonas aeruginosa PA01
ggcgcgcccaggcccagcgcggc

SEQ ID NO: 1435275 - RNA, 17 nt, Pseudomonas aeruginosa PA01
ggcgcgcccggcgcaga

SEQ ID NO: 1435276 - RNA, 16 nt, Pseudomonas aeruginosa PA01
ggcgcgccuucagcgc

SEQ ID NO: 1435277 - RNA, 19 nt, Pseudomonas aeruginosa PA01
ggcgcgccuucagcgccuc

SEQ ID NO: 1435278 - RNA, 23 nt, Pseudomonas aeruginosa PA01
ggcgcgccuucagcgccuccagc

SEQ ID NO: 1435279 - RNA, 14 nt, Pseudomonas aeruginosa PA01
ggcgcgccugguau

SEQ ID NO: 1435280 - RNA, 13 nt, Pseudomonas aeruginosa PA01
ggcgcgcgacaga

SEQ ID NO: 1435281 - RNA, 20 nt, Pseudomonas aeruginosa PA01
ggcgcgccuggaucagcgcc

SEQ ID NO: 1435282 - RNA, 23 nt, Pseudomonas aeruginosa PA01
ggcgcgccuggaucagcgccucg

SEQ ID NO: 1435283 - RNA, 20 nt, Pseudomonas aeruginosa PA01
ggcgcgccuggcccuggcgg

SEQ ID NO: 1435284 - RNA, 12 nt, Pseudomonas aeruginosa PA01
ggcgcgccggug

SEQ ID NO: 1435285 - RNA, 12 nt, Pseudomonas aeruginosa PA01
ggcgcgccgguu

SEQ ID NO: 1435286 - RNA, 20 nt, Pseudomonas aeruginosa PA01
ggcgcgccgguuucgaccgg

SEQ ID NO: 1435287 - RNA, 21 nt, Pseudomonas aeruginosa PA01
ggcgcgccgguuucgaccggc

SEQ ID NO: 1435288 - RNA, 17 nt, Pseudomonas aeruginosa PA01
ggcgcgccuccugcgga

SEQ ID NO: 1435289 - RNA, 14 nt, Pseudomonas aeruginosa PA01
ggcgcgccugagcu

SEQ ID NO: 1435290 - RNA, 18 nt, Pseudomonas aeruginosa PA01
ggcgcgccugagcuggcc

SEQ ID NO: 1435291 - RNA, 19 nt, Pseudomonas aeruginosa PA01
ggcgcgccggcuuggcuca

SEQ ID NO: 1435292 - RNA, 17 nt, Pseudomonas aeruginosa PA01
ggcgcgccggcccgggu

SEQ ID NO: 1435293 - RNA, 12 nt, Pseudomonas aeruginosa PA01
ggcgcgccgaca

SEQ ID NO: 1435294 - RNA, 16 nt, Pseudomonas aeruginosa PA01
ggcgcccuucagcgcc

SEQ ID NO: 1435295 - RNA, 17 nt, Pseudomonas aeruginosa PA01
ggcgcccuucagcgccu

SEQ ID NO: 1435296 - RNA, 23 nt, Pseudomonas aeruginosa PA01
ggcgcccuucagcgccucgagga

SEQ ID NO: 1435297 - RNA, 13 nt, Pseudomonas aeruginosa PA01
ggcgcccugcucu

SEQ ID NO: 1435298 - RNA, 23 nt, Pseudomonas aeruginosa PA01
ggcgcccugcucugguucggcgu

SEQ ID NO: 1435299 - RNA, 13 nt, Pseudomonas aeruginosa PA01
ggcgcccuggccg

SEQ ID NO: 1435300 - RNA, 14 nt, Pseudomonas aeruginosa PA01
ggcgcccuggccgc

SEQ ID NO: 1435301 - RNA, 13 nt, Pseudomonas aeruginosa PA01
ggcgcccugccgg

SEQ ID NO: 1435302 - RNA, 16 nt, Pseudomonas aeruginosa PA01
ggcgcccgguggaggu

SEQ ID NO: 1435303 - RNA, 17 nt, Pseudomonas aeruginosa PA01
ggcgccgccggcgaacg

SEQ ID NO: 1435304 - RNA, 17 nt, Pseudomonas aeruginosa PA01
ggcgccggccuccagcg

SEQ ID NO: 1435305 - RNA, 19 nt, Pseudomonas aeruginosa PA01
ggcgccggcggaucagccc

SEQ ID NO: 1435306 - RNA, 14 nt, Pseudomonas aeruginosa PA01
ggcgccggcgcgcg

SEQ ID NO: 1435307 - RNA, 15 nt, Pseudomonas aeruginosa PA01
ggcgccggcgcgcgg

SEQ ID NO: 1435308 - RNA, 17 nt, Pseudomonas aeruginosa PA01
ggcgccggcgcgcggcg

SEQ ID NO: 1435309 - RNA, 19 nt, Pseudomonas aeruginosa PA01
ggcgccggcgcgcuugccg

SEQ ID NO: 1435310 - RNA, 20 nt, Pseudomonas aeruginosa PA01
ggcgccggcucgcccagcag

SEQ ID NO: 1435311 - RNA, 23 nt, Pseudomonas aeruginosa PA01
ggcgccggcucgcccagcaggcg

SEQ ID NO: 1435312 - RNA, 13 nt, Pseudomonas aeruginosa PA01
ggcgccggcugac

SEQ ID NO: 1435313 - RNA, 16 nt, Pseudomonas aeruginosa PA01
ggcgccggcugacgcu

SEQ ID NO: 1435314 - RNA, 21 nt, Pseudomonas aeruginosa PA01
ggcgccggcugacgcuggcga

SEQ ID NO: 1435315 - RNA, 13 nt, Pseudomonas aeruginosa PA01
ggcgccgggcgcg

SEQ ID NO: 1435316 - RNA, 13 nt, Pseudomonas aeruginosa PA01
ggcgccagcgccc

SEQ ID NO: 1435317 - RNA, 16 nt, Pseudomonas aeruginosa PA01
ggcgcccgcgggcgcc

SEQ ID NO: 1435318 - RNA, 14 nt, Pseudomonas aeruginosa PA01
ggcgcccgccggcc

SEQ ID NO: 1435319 - RNA, 19 nt, Pseudomonas aeruginosa PA01
ggcgccagcuccagcgccc

SEQ ID NO: 1435320 - RNA, 17 nt, Pseudomonas aeruginosa PA01
ggcgccagcucggacaa

SEQ ID NO: 1435321 - RNA, 21 nt, Pseudomonas aeruginosa PA01
ggcgcccgcccggaaccaccg

SEQ ID NO: 1435322 - RNA, 19 nt, Pseudomonas aeruginosa PA01
ggcgccaggacucgccauc

SEQ ID NO: 1435323 - RNA, 23 nt, Pseudomonas aeruginosa PA01
ggcgccaggacucgccaucggcc

SEQ ID NO: 1435324 - RNA, 15 nt, Pseudomonas aeruginosa PA01
ggcgccaggcccucg

SEQ ID NO: 1435325 - RNA, 19 nt, Pseudomonas aeruginosa PA01
ggcgccaggcccucggcga

SEQ ID NO: 1435326 - RNA, 21 nt, Pseudomonas aeruginosa PA01
ggcgccaggcccucggcgacc

SEQ ID NO: 1435327 - RNA, 12 nt, Pseudomonas aeruginosa PA01
ggcgccaggccg

SEQ ID NO: 1435328 - RNA, 13 nt, Pseudomonas aeruginosa PA01
ggcgccaggccgc

SEQ ID NO: 1435329 - RNA, 14 nt, Pseudomonas aeruginosa PA01
ggcgccaggccgga

SEQ ID NO: 1435330 - RNA, 15 nt, Pseudomonas aeruginosa PA01
ggcgccaggccggag

SEQ ID NO: 1435331 - RNA, 19 nt, Pseudomonas aeruginosa PA01
ggcgcccggccggauuggc

SEQ ID NO: 1435332 - RNA, 13 nt, Pseudomonas aeruginosa PA01
ggcgcccggcgca

SEQ ID NO: 1435333 - RNA, 16 nt, Pseudomonas aeruginosa PA01
ggcgcccucgggcgcc

SEQ ID NO: 1435334 - RNA, 18 nt, Pseudomonas aeruginosa PA01
ggcgccagagcgcgcuac

SEQ ID NO: 1435335 - RNA, 12 nt, Pseudomonas aeruginosa PA01
ggcgccagccag

SEQ ID NO: 1435336 - RNA, 17 nt, Pseudomonas aeruginosa PA01
ggcgccagccagcccgg

SEQ ID NO: 1435337 - RNA, 22 nt, Pseudomonas aeruginosa PA01
ggcgccagccagcccggcggug

SEQ ID NO: 1435338 - RNA, 13 nt, Pseudomonas aeruginosa PA01
ggcgccagccuac

SEQ ID NO: 1435339 - RNA, 22 nt, Pseudomonas aeruginosa PA01
ggcgccagccuacugggcgugg

SEQ ID NO: 1435340 - RNA, 16 nt, Pseudomonas aeruginosa PA01
ggcgccagccgccauc

SEQ ID NO: 1435341 - RNA, 23 nt, Pseudomonas aeruginosa PA01
ggcgccagccgccaucaccagcg

SEQ ID NO: 1435342 - RNA, 14 nt, Pseudomonas aeruginosa PA01
ggcgccacucggcg

SEQ ID NO: 1435343 - RNA, 18 nt, Pseudomonas aeruginosa PA01
ggcgccacucggcgugcc

SEQ ID NO: 1435344 - RNA, 14 nt, Pseudomonas aeruginosa PA01
ggcgccacgcucac

SEQ ID NO: 1435345 - RNA, 13 nt, Pseudomonas aeruginosa PA01
ggcgccaccccgc

SEQ ID NO: 1435346 - RNA, 19 nt, Pseudomonas aeruginosa PA01
ggcgccaccccgccgcgca

SEQ ID NO: 1435347 - RNA, 20 nt, Pseudomonas aeruginosa PA01
ggcgccaccgauucgccggc

SEQ ID NO: 1435348 - RNA, 17 nt, Pseudomonas aeruginosa PA01
ggcgccaccgcgacgcg

SEQ ID NO: 1435349 - RNA, 23 nt, Pseudomonas aeruginosa PA01
ggcgccaccgcgacgcgcuggac

SEQ ID NO: 1435350 - RNA, 13 nt, Pseudomonas aeruginosa PA01
ggcgccaccgcgu

SEQ ID NO: 1435351 - RNA, 15 nt, Pseudomonas aeruginosa PA01
ggcgccaccgcguug

SEQ ID NO: 1435352 - RNA, 21 nt, Pseudomonas aeruginosa PA01
ggcgccaccgcguugaccgug

SEQ ID NO: 1435353 - RNA, 16 nt, Pseudomonas aeruginosa PA01
ggcgcagcggcgaacc

SEQ ID NO: 1435354 - RNA, 23 nt, Pseudomonas aeruginosa PA01
ggcgcagcggcgaacccucggug

SEQ ID NO: 1435355 - RNA, 13 nt, Pseudomonas aeruginosa PA01
ggcgcagcguccu

SEQ ID NO: 1435356 - RNA, 15 nt, Pseudomonas aeruginosa PA01
ggcgcagcggcagcg

SEQ ID NO: 1435357 - RNA, 17 nt, Pseudomonas aeruginosa PA01
ggcgcaagggcgccgcc

SEQ ID NO: 1435358 - RNA, 18 nt, Pseudomonas aeruginosa PA01
ggcgcaaggugccgaggu

SEQ ID NO: 1435359 - RNA, 23 nt, Pseudomonas aeruginosa PA01
ggcgcaaggugccgaggucgucg

SEQ ID NO: 1435360 - RNA, 19 nt, Pseudomonas aeruginosa PA01
ggcgcaauacaccgcugcg

SEQ ID NO: 1435361 - RNA, 21 nt, Pseudomonas aeruginosa PA01
ggcgcaauacaccgcugcgcc

SEQ ID NO: 1435362 - RNA, 13 nt, Pseudomonas aeruginosa PA01
ggcgcaaggccag

SEQ ID NO: 1435363 - RNA, 18 nt, Pseudomonas aeruginosa PA01
ggcgcaaggccagcggca

SEQ ID NO: 1435364 - RNA, 14 nt, Pseudomonas aeruginosa PA01
ggcgcagcuucucc

SEQ ID NO: 1435365 - RNA, 20 nt, Pseudomonas aeruginosa PA01
ggcgcaggaccgccauggcg

SEQ ID NO: 1435366 - RNA, 22 nt, Pseudomonas aeruginosa PA01
ggcgcaggaccgccauggcgcu

SEQ ID NO: 1435367 - RNA, 14 nt, Pseudomonas aeruginosa PA01
ggcgcaggcgaacu

SEQ ID NO: 1435368 - RNA, 18 nt, Pseudomonas aeruginosa PA01
ggcgcaggcgaacugccg

SEQ ID NO: 1435369 - RNA, 12 nt, Pseudomonas aeruginosa PA01
ggcgcaggcgag

SEQ ID NO: 1435370 - RNA, 22 nt, Pseudomonas aeruginosa PA01
ggcgcaggcgaggauggccguc

SEQ ID NO: 1435371 - RNA, 21 nt, Pseudomonas aeruginosa PA01
ggcgcaggcgaugaucagccc

SEQ ID NO: 1435372 - RNA, 12 nt, Pseudomonas aeruginosa PA01
ggcgcaggccgg

SEQ ID NO: 1435373 - RNA, 13 nt, Pseudomonas aeruginosa PA01
ggcgcaggccgag

SEQ ID NO: 1435374 - RNA, 11 nt, Pseudomonas aeruginosa PA01
ggcgcaggcau

SEQ ID NO: 1435375 - RNA, 13 nt, Pseudomonas aeruginosa PA01
ggcgcaggcaugg

SEQ ID NO: 1435376 - RNA, 21 nt, Pseudomonas aeruginosa PA01
ggcgcauagccaccgccgaca

SEQ ID NO: 1435377 - RNA, 14 nt, Pseudomonas aeruginosa PA01
ggcgcauagcggcc

SEQ ID NO: 1435378 - RNA, 15 nt, Pseudomonas aeruginosa PA01
ggcgcauagcggcca

SEQ ID NO: 1435379 - RNA, 18 nt, Pseudomonas aeruginosa PA01
ggcgcauagcggccauug

SEQ ID NO: 1435380 - RNA, 18 nt, Pseudomonas aeruginosa PA01
ggcgcauaaccgcucgcg

SEQ ID NO: 1435381 - RNA, 17 nt, Pseudomonas aeruginosa PA01
ggcgcagguugagggcc

SEQ ID NO: 1435382 - RNA, 18 nt, Pseudomonas aeruginosa PA01
ggcgcagguugagggccg

SEQ ID NO: 1435383 - RNA, 19 nt, Pseudomonas aeruginosa PA01
ggcgcagguugagggccgc

SEQ ID NO: 1435384 - RNA, 15 nt, Pseudomonas aeruginosa PA01
ggcgcaggucgcugg

SEQ ID NO: 1435385 - RNA, 18 nt, Pseudomonas aeruginosa PA01
ggcgcaggucgcuggcgu

SEQ ID NO: 1435386 - RNA, 17 nt, Pseudomonas aeruginosa PA01
ggcgcaggucggccucg

SEQ ID NO: 1435387 - RNA, 23 nt, Pseudomonas aeruginosa PA01
ggcgcagguagaaggugcccagc

SEQ ID NO: 1435388 - RNA, 12 nt, Pseudomonas aeruginosa PA01
ggcgcagguagu

SEQ ID NO: 1435389 - RNA, 20 nt, Pseudomonas aeruginosa PA01
ggcgcaggccgggcggacgc

SEQ ID NO: 1435390 - RNA, 24 nt, Pseudomonas aeruginosa PA01
ggcgcaggggcgagagacugaacu

SEQ ID NO: 1435391 - RNA, 16 nt, Pseudomonas aeruginosa PA01
ggcgcaggggcgcgcc

SEQ ID NO: 1435392 - RNA, 19 nt, Pseudomonas aeruginosa PA01
ggcgcagggcguucuucac

SEQ ID NO: 1435393 - RNA, 12 nt, Pseudomonas aeruginosa PA01
ggcgcaggcggc

SEQ ID NO: 1435394 - RNA, 13 nt, Pseudomonas aeruginosa PA01
ggcgcaggcggcg

SEQ ID NO: 1435395 - RNA, 14 nt, Pseudomonas aeruginosa PA01
ggcgcaggcggcgc

SEQ ID NO: 1435396 - RNA, 12 nt, Pseudomonas aeruginosa PA01
ggcgcaggcugu

SEQ ID NO: 1435397 - RNA, 17 nt, Pseudomonas aeruginosa PA01
ggcgcaggcugucggcc

SEQ ID NO: 1435398 - RNA, 22 nt, Pseudomonas aeruginosa PA01
ggcgcaggcugucggccagccc

SEQ ID NO: 1435399 - RNA, 22 nt, Pseudomonas aeruginosa PA01
ggcgcaggcuuggucagggucg

SEQ ID NO: 1435400 - RNA, 13 nt, Pseudomonas aeruginosa PA01
ggcgagccgcagc

SEQ ID NO: 1435401 - RNA, 21 nt, Pseudomonas aeruginosa PA01
ggcgagcauuccucagcgccg

SEQ ID NO: 1435402 - RNA, 15 nt, Pseudomonas aeruginosa PA01
ggcgagccgccgggc

SEQ ID NO: 1435403 - RNA, 19 nt, Pseudomonas aeruginosa PA01
ggcgagccgcgacggcugc

SEQ ID NO: 1435404 - RNA, 21 nt, Pseudomonas aeruginosa PA01
ggcgagcgacggugauagagc

SEQ ID NO: 1435405 - RNA, 13 nt, Pseudomonas aeruginosa PA01
ggcgagcgcagac

SEQ ID NO: 1435406 - RNA, 21 nt, Pseudomonas aeruginosa PA01
ggcgagcgcagacgggugcug

SEQ ID NO: 1435407 - RNA, 19 nt, Pseudomonas aeruginosa PA01
ggcgagcgggucgauggcu

SEQ ID NO: 1435408 - RNA, 12 nt, Pseudomonas aeruginosa PA01
ggcgagcgccgc

SEQ ID NO: 1435409 - RNA, 19 nt, Pseudomonas aeruginosa PA01
ggcgagcgccgcggcgaac

SEQ ID NO: 1435410 - RNA, 20 nt, Pseudomonas aeruginosa PA01
ggcgagcgccgcggcgaaca

SEQ ID NO: 1435411 - RNA, 15 nt, Pseudomonas aeruginosa PA01
ggcgagcgcgaucuc

SEQ ID NO: 1435412 - RNA, 16 nt, Pseudomonas aeruginosa PA01
ggcgagcgcgaucucu

SEQ ID NO: 1435413 - RNA, 20 nt, Pseudomonas aeruginosa PA01
ggcgaggaaaaggaucgccg

SEQ ID NO: 1435414 - RNA, 15 nt, Pseudomonas aeruginosa PA01
ggcgaggaacaccca

SEQ ID NO: 1435415 - RNA, 19 nt, Pseudomonas aeruginosa PA01
ggcgcaacaccuugcgcac

SEQ ID NO: 1435416 - RNA, 18 nt, Pseudomonas aeruginosa PA01
ggcgcaaccagaccagca

SEQ ID NO: 1435417 - RNA, 13 nt, Pseudomonas aeruginosa PA01
ggcgagcgccgcg

SEQ ID NO: 1435418 - RNA, 14 nt, Pseudomonas aeruginosa PA01
ggcgagcgucgagu

SEQ ID NO: 1435419 - RNA, 22 nt, Pseudomonas aeruginosa PA01
ggcgagcuggaucggcaggcug

SEQ ID NO: 1435420 - RNA, 16 nt, Pseudomonas aeruginosa PA01
aagggaucgaccgguu

SEQ ID NO: 1435421 - RNA, 17 nt, Pseudomonas aeruginosa PA01
aagggcccgaacgggcc

SEQ ID NO: 1435422 - RNA, 14 nt, Pseudomonas aeruginosa PA01
aagggcagcggcga

SEQ ID NO: 1435423 - RNA, 12 nt, Pseudomonas aeruginosa PA01
aaggggccgcgc

SEQ ID NO: 1435424 - RNA, 18 nt, Pseudomonas aeruginosa PA01
aagggcacgugcagcggc

SEQ ID NO: 1435425 - RNA, 20 nt, Pseudomonas aeruginosa PA01
aagggcucagcccaggcgcc

SEQ ID NO: 1435426 - RNA, 15 nt, Pseudomonas aeruginosa PA01
ggcgcaacugcacgu

SEQ ID NO: 1435427 - RNA, 18 nt, Pseudomonas aeruginosa PA01
ggcgcaacugcgccagcc

SEQ ID NO: 1435428 - RNA, 14 nt, Pseudomonas aeruginosa PA01
ggcgcaacgccggc

SEQ ID NO: 1435429 - RNA, 22 nt, Pseudomonas aeruginosa PA01
aagggucugcuugcgcuggccg

SEQ ID NO: 1435430 - RNA, 17 nt, Pseudomonas aeruginosa PA01
aaggcgcuccggaacgc

SEQ ID NO: 1435431 - RNA, 19 nt, Pseudomonas aeruginosa PA01
aaggcgcggggcgaggucg

SEQ ID NO: 1435432 - RNA, 19 nt, Pseudomonas aeruginosa PA01
aaggcgcgcaccagcgggu

SEQ ID NO: 1435433 - RNA, 13 nt, Pseudomonas aeruginosa PA01
ggccuggggcucg

SEQ ID NO: 1435434 - RNA, 20 nt, Pseudomonas aeruginosa PA01
ggccuggggcucggcuucca

SEQ ID NO: 1435435 - RNA, 19 nt, Pseudomonas aeruginosa PA01
ggccugggguagccggccg

SEQ ID NO: 1435436 - RNA, 21 nt, Pseudomonas aeruginosa PA01
ggccugggguagccggccgau

SEQ ID NO: 1435437 - RNA, 14 nt, Pseudomonas aeruginosa PA01
ggccuggguacgca

SEQ ID NO: 1435438 - RNA, 19 nt, Pseudomonas aeruginosa PA01
ggccuggguacgcaccggc

SEQ ID NO: 1435439 - RNA, 17 nt, Pseudomonas aeruginosa PA01
ggccugggucaccagca

SEQ ID NO: 1435440 - RNA, 20 nt, Pseudomonas aeruginosa PA01
ggccugggucaccagcacca

SEQ ID NO: 1435441 - RNA, 19 nt, Pseudomonas aeruginosa PA01
ggccugggugaacagcggc

SEQ ID NO: 1435442 - RNA, 20 nt, Pseudomonas aeruginosa PA01
ggccugggugaacagcggcc

SEQ ID NO: 1435443 - RNA, 21 nt, Pseudomonas aeruginosa PA01
ggccugggugaacagcggccc

SEQ ID NO: 1435444 - RNA, 14 nt, Pseudomonas aeruginosa PA01
aaggcggcgcggcg

SEQ ID NO: 1435445 - RNA, 11 nt, Pseudomonas aeruginosa PA01
aaggcgcuggc

SEQ ID NO: 1435446 - RNA, 15 nt, Pseudomonas aeruginosa PA01
aaggcgucgaaggcc

SEQ ID NO: 1435447 - RNA, 12 nt, Pseudomonas aeruginosa PA01
aaggcgucgccg

SEQ ID NO: 1435448 - RNA, 18 nt, Pseudomonas aeruginosa PA01
aaggcgucggcuucgccc

SEQ ID NO: 1435449 - RNA, 17 nt, Pseudomonas aeruginosa PA01
aaggcgugggcgccggc

SEQ ID NO: 1435450 - RNA, 18 nt, Pseudomonas aeruginosa PA01
aaggcgugggcgccggcg

SEQ ID NO: 1435451 - RNA, 21 nt, Pseudomonas aeruginosa PA01
aaggcggucagcaguugccgg

SEQ ID NO: 1435452 - RNA, 21 nt, Pseudomonas aeruginosa PA01
ggccucguaccuuucuccccu

SEQ ID NO: 1435453 - RNA, 22 nt, Pseudomonas aeruginosa PA01
ggccucggcgucgcgcaggcuu

SEQ ID NO: 1435454 - RNA, 15 nt, Pseudomonas aeruginosa PA01
ggccucggcggcgcg

SEQ ID NO: 1435455 - RNA, 17 nt, Pseudomonas aeruginosa PA01
ggccucggucaggcgcu

SEQ ID NO: 1435456 - RNA, 21 nt, Pseudomonas aeruginosa PA01
ggccucgucgagcaucugccg

SEQ ID NO: 1435457 - RNA, 17 nt, Pseudomonas aeruginosa PA01
ggccucgucgaucucgc

SEQ ID NO: 1435458 - RNA, 20 nt, Pseudomonas aeruginosa PA01
ggccucgucgaucucgccga

SEQ ID NO: 1435459 - RNA, 19 nt, Pseudomonas aeruginosa PA01
ggccucgucguucagccca

SEQ ID NO: 1435460 - RNA, 22 nt, Pseudomonas aeruginosa PA01
ggccucgucguucagcccaccc

SEQ ID NO: 1435461 - RNA, 20 nt, Pseudomonas aeruginosa PA01
ggccucuccgagacgcugca

SEQ ID NO: 1435462 - RNA, 19 nt, Pseudomonas aeruginosa PA01
ggccucugccucgacgcuc

SEQ ID NO: 1435463 - RNA, 19 nt, Pseudomonas aeruginosa PA01
ggccucuucgcaacggccg

SEQ ID NO: 1435464 - RNA, 19 nt, Pseudomonas aeruginosa PA01
ggccugggcguacaggccc

SEQ ID NO: 1435465 - RNA, 14 nt, Pseudomonas aeruginosa PA01
ggccugggcgaagu

SEQ ID NO: 1435466 - RNA, 13 nt, Pseudomonas aeruginosa PA01
ggccugggcgcag

SEQ ID NO: 1435467 - RNA, 18 nt, Pseudomonas aeruginosa PA01
ggccugggcgcaggccga

SEQ ID NO: 1435468 - RNA, 13 nt, Pseudomonas aeruginosa PA01
ggccugggcgccg

SEQ ID NO: 1435469 - RNA, 16 nt, Pseudomonas aeruginosa PA01
ggccugggcgccgcca

SEQ ID NO: 1435470 - RNA, 14 nt, Pseudomonas aeruginosa PA01
ggccucuucgucgg

SEQ ID NO: 1435471 - RNA, 17 nt, Pseudomonas aeruginosa PA01
ggccucuucgucggcga

SEQ ID NO: 1435472 - RNA, 19 nt, Pseudomonas aeruginosa PA01
ggccucuucgucggcgaac

SEQ ID NO: 1435473 - RNA, 20 nt, Pseudomonas aeruginosa PA01
ggccucuugaaaacugucgg

SEQ ID NO: 1435474 - RNA, 17 nt, Pseudomonas aeruginosa PA01
ggccuugaugccggcga

SEQ ID NO: 1435475 - RNA, 13 nt, Pseudomonas aeruginosa PA01
ggccuugcagcaa

SEQ ID NO: 1435476 - RNA, 22 nt, Pseudomonas aeruginosa PA01
ggccuugcagcaacucgccgcc

SEQ ID NO: 1435477 - RNA, 17 nt, Pseudomonas aeruginosa PA01
ggccuugcagggccgcc

SEQ ID NO: 1435478 - RNA, 13 nt, Pseudomonas aeruginosa PA01
ggccuugccgcga

SEQ ID NO: 1435479 - RNA, 21 nt, Pseudomonas aeruginosa PA01
ggccuugccguccagccggcg

SEQ ID NO: 1435480 - RNA, 23 nt, Pseudomonas aeruginosa PA01
ggccuugccguccagccggcgcu

SEQ ID NO: 1435481 - RNA, 16 nt, Pseudomonas aeruginosa PA01
ggccuugccggcaucg

SEQ ID NO: 1435482 - RNA, 20 nt, Pseudomonas aeruginosa PA01
ggccuugagcacgguccgcg

SEQ ID NO: 1435483 - RNA, 14 nt, Pseudomonas aeruginosa PA01
ggccuugagcaggc

SEQ ID NO: 1435484 - RNA, 17 nt, Pseudomonas aeruginosa PA01
ggccuugagcaggcggc

SEQ ID NO: 1435485 - RNA, 20 nt, Pseudomonas aeruginosa PA01
ggccuugagcaggcggccgu

SEQ ID NO: 1435486 - RNA, 16 nt, Pseudomonas aeruginosa PA01
ggccuugagcaggcgu

SEQ ID NO: 1435487 - RNA, 22 nt, Pseudomonas aeruginosa PA01
ggccuugagcaugauggugccg

SEQ ID NO: 1435488 - RNA, 16 nt, Pseudomonas aeruginosa PA01
ggccuugagcgccgaa

SEQ ID NO: 1435489 - RNA, 16 nt, Pseudomonas aeruginosa PA01
ggccuugaggcgggcc

SEQ ID NO: 1435490 - RNA, 15 nt, Pseudomonas aeruginosa PA01
ggccuugaccaccgc

SEQ ID NO: 1435491 - RNA, 20 nt, Pseudomonas aeruginosa PA01
ggccuugaccaccgccaggc

SEQ ID NO: 1435492 - RNA, 14 nt, Pseudomonas aeruginosa PA01
ggccuucggcgccg

SEQ ID NO: 1435493 - RNA, 14 nt, Pseudomonas aeruginosa PA01
ggccuucggcgucg

SEQ ID NO: 1435494 - RNA, 14 nt, Pseudomonas aeruginosa PA01
ggccuucucgucgc

SEQ ID NO: 1435495 - RNA, 22 nt, Pseudomonas aeruginosa PA01
ggccuucucgucgccgcccggc

SEQ ID NO: 1435496 - RNA, 16 nt, Pseudomonas aeruginosa PA01
ggccugguaggccucg

SEQ ID NO: 1435497 - RNA, 16 nt, Pseudomonas aeruginosa PA01
ggccugguagucgccg

SEQ ID NO: 1435498 - RNA, 22 nt, Pseudomonas aeruginosa PA01
ggccuggucgaaagccugccgg

SEQ ID NO: 1435499 - RNA, 14 nt, Pseudomonas aeruginosa PA01
ggccuggucggcgc

SEQ ID NO: 1435500 - RNA, 15 nt, Pseudomonas aeruginosa PA01
ggccuggucggcgcg

SEQ ID NO: 1435501 - RNA, 19 nt, Pseudomonas aeruginosa PA01
ggccuggugcaccuggcga

SEQ ID NO: 1435502 - RNA, 21 nt, Pseudomonas aeruginosa PA01
ggccugguuguaggcgccgcc

SEQ ID NO: 1435503 - RNA, 22 nt, Pseudomonas aeruginosa PA01
ggccugucgggggcugcgcauc

SEQ ID NO: 1435504 - RNA, 21 nt, Pseudomonas aeruginosa PA01
ggccugucacgccgggggucg

SEQ ID NO: 1435505 - RNA, 18 nt, Pseudomonas aeruginosa PA01
ggccuucaccgcgccgcg

SEQ ID NO: 1435506 - RNA, 19 nt, Pseudomonas aeruginosa PA01
ggccuucaccgcgccgcgc

SEQ ID NO: 1435507 - RNA, 15 nt, Pseudomonas aeruginosa PA01
ggccuguucggccuu

SEQ ID NO: 1435508 - RNA, 16 nt, Pseudomonas aeruginosa PA01
ggccuguggauagaaa

SEQ ID NO: 1435509 - RNA, 14 nt, Pseudomonas aeruginosa PA01
ggccuucaggcgcu

SEQ ID NO: 1435510 - RNA, 19 nt, Pseudomonas aeruginosa PA01
ggccuuccacgccuucgcg

SEQ ID NO: 1435511 - RNA, 23 nt, Pseudomonas aeruginosa PA01
ggccuuccacgccuucgcggccg

SEQ ID NO: 1435512 - RNA, 14 nt, Pseudomonas aeruginosa PA01
ggccuucgccagcg

SEQ ID NO: 1435513 - RNA, 15 nt, Pseudomonas aeruginosa PA01
ggccuucgccagcgg

SEQ ID NO: 1435514 - RNA, 17 nt, Pseudomonas aeruginosa PA01
ggccuucgccagcggcc

SEQ ID NO: 1435515 - RNA, 20 nt, Pseudomonas aeruginosa PA01
ggccuuccgggaagcggucg

SEQ ID NO: 1435516 - RNA, 20 nt, Pseudomonas aeruginosa PA01
ggcgaacgcccggcuuuccu

SEQ ID NO: 1435517 - RNA, 16 nt, Pseudomonas aeruginosa PA01
ggcgaagccgcgcccg

SEQ ID NO: 1435518 - RNA, 17 nt, Pseudomonas aeruginosa PA01
ggcgaagccgcgcccgg

SEQ ID NO: 1435519 - RNA, 17 nt, Pseudomonas aeruginosa PA01
ggcgaagcccagcgagc

SEQ ID NO: 1435520 - RNA, 20 nt, Pseudomonas aeruginosa PA01
ggcgaagccgauacccuggg

SEQ ID NO: 1435521 - RNA, 13 nt, Pseudomonas aeruginosa PA01
ggcgaagcgcagg

SEQ ID NO: 1435522 - RNA, 19 nt, Pseudomonas aeruginosa PA01
ggcgaagcgcuugcccagg

SEQ ID NO: 1435523 - RNA, 20 nt, Pseudomonas aeruginosa PA01
ggcgaagcggaagcgcagcc

SEQ ID NO: 1435524 - RNA, 14 nt, Pseudomonas aeruginosa PA01
ggcgaagcggcccu

SEQ ID NO: 1435525 - RNA, 19 nt, Pseudomonas aeruginosa PA01
ggcgaagcggcccuugucg

SEQ ID NO: 1435526 - RNA, 14 nt, Pseudomonas aeruginosa PA01
ggcgaagcggcucg

SEQ ID NO: 1435527 - RNA, 15 nt, Pseudomonas aeruginosa PA01
ggcgaagcggcucgg

SEQ ID NO: 1435528 - RNA, 16 nt, Pseudomonas aeruginosa PA01
ggcgaagcggcucggc

SEQ ID NO: 1435529 - RNA, 18 nt, Pseudomonas aeruginosa PA01
ggcgaagcggcucggcca

SEQ ID NO: 1435530 - RNA, 13 nt, Pseudomonas aeruginosa PA01
ggcgaagcggcug

SEQ ID NO: 1435531 - RNA, 19 nt, Pseudomonas aeruginosa PA01
ggcgaagcggcuggccgcg

SEQ ID NO: 1435532 - RNA, 22 nt, Pseudomonas aeruginosa PA01
ggcgaagcggcuggccgcggug

SEQ ID NO: 1435533 - RNA, 17 nt, Pseudomonas aeruginosa PA01
ggcgaaggcaaugccgc

SEQ ID NO: 1435534 - RNA, 14 nt, Pseudomonas aeruginosa PA01
ggcgaaggccacca

SEQ ID NO: 1435535 - RNA, 20 nt, Pseudomonas aeruginosa PA01
ggcgaaggccaccaucgcgg

SEQ ID NO: 1435536 - RNA, 16 nt, Pseudomonas aeruginosa PA01
ggcgaagccggcggcg

SEQ ID NO: 1435537 - RNA, 21 nt, Pseudomonas aeruginosa PA01
ggcgaagccggcggcgcggca

SEQ ID NO: 1435538 - RNA, 16 nt, Pseudomonas aeruginosa PA01
ggcgaagccugcggcg

SEQ ID NO: 1435539 - RNA, 18 nt, Pseudomonas aeruginosa PA01
ggcgaagggcaggccgau

SEQ ID NO: 1435540 - RNA, 12 nt, Pseudomonas aeruginosa PA01
ggcgaaggccgc

SEQ ID NO: 1435541 - RNA, 22 nt, Pseudomonas aeruginosa PA01
ggcgaaggccgcuuggccaugg

SEQ ID NO: 1435542 - RNA, 18 nt, Pseudomonas aeruginosa PA01
ggcgaaggccucgucgau

SEQ ID NO: 1435543 - RNA, 15 nt, Pseudomonas aeruginosa PA01
ggcgaaggcgauccc

SEQ ID NO: 1435544 - RNA, 13 nt, Pseudomonas aeruginosa PA01
ggcgaaggcgaug

SEQ ID NO: 1435545 - RNA, 22 nt, Pseudomonas aeruginosa PA01
ggcgaaggucgaaggcgcggcg

SEQ ID NO: 1435546 - RNA, 22 nt, Pseudomonas aeruginosa PA01
ggcgaaggucugccccggcuug

SEQ ID NO: 1435547 - RNA, 20 nt, Pseudomonas aeruginosa PA01
ggcgaaguccaccaggcgcc

SEQ ID NO: 1435548 - RNA, 22 nt, Pseudomonas aeruginosa PA01
ggcgaaguccaccaggcgccgg

SEQ ID NO: 1435549 - RNA, 20 nt, Pseudomonas aeruginosa PA01
ggcgaagcuggggcuguugc

SEQ ID NO: 1435550 - RNA, 14 nt, Pseudomonas aeruginosa PA01
ggcgaagucggcgc

SEQ ID NO: 1435551 - RNA, 15 nt, Pseudomonas aeruginosa PA01
ggcgaagucggcgcg

SEQ ID NO: 1435552 - RNA, 15 nt, Pseudomonas aeruginosa PA01
ggcgaagucugccug

SEQ ID NO: 1435553 - RNA, 20 nt, Pseudomonas aeruginosa PA01
ggcgaagucugccuguccgc

SEQ ID NO: 1435554 - RNA, 16 nt, Pseudomonas aeruginosa PA01
ggcgaaguugccgccg

SEQ ID NO: 1435555 - RNA, 18 nt, Pseudomonas aeruginosa PA01
ggcgaacgaugguggucg

SEQ ID NO: 1435556 - RNA, 20 nt, Pseudomonas aeruginosa PA01
ggcgaacgaugguggucggc

SEQ ID NO: 1435557 - RNA, 16 nt, Pseudomonas aeruginosa PA01
ggcgaacggcagcguc

SEQ ID NO: 1435558 - RNA, 23 nt, Pseudomonas aeruginosa PA01
ggcgaaccgugguucucggucgg

SEQ ID NO: 1435559 - RNA, 16 nt, Pseudomonas aeruginosa PA01
ggcgaacgacagcacc

SEQ ID NO: 1435560 - RNA, 17 nt, Pseudomonas aeruginosa PA01
ggcgaacgacagcacca

SEQ ID NO: 1435561 - RNA, 22 nt, Pseudomonas aeruginosa PA01
ggcgaagaucucgccauggcgg

SEQ ID NO: 1435562 - RNA, 15 nt, Pseudomonas aeruginosa PA01
ggcgaacuucaggcc

SEQ ID NO: 1435563 - RNA, 18 nt, Pseudomonas aeruginosa PA01
ggcgaacuucaggccggc

SEQ ID NO: 1435564 - RNA, 22 nt, Pseudomonas aeruginosa PA01
ggcgaacuucaggccggcgccg

SEQ ID NO: 1435565 - RNA, 16 nt, Pseudomonas aeruginosa PA01
ggcgaagaacagcggg

SEQ ID NO: 1435566 - RNA, 23 nt, Pseudomonas aeruginosa PA01
ggcgaagaacagcgggucgcggc

SEQ ID NO: 1435567 - RNA, 23 nt, Pseudomonas aeruginosa PA01
ggcgaacuccgccagcuuguccg

SEQ ID NO: 1435568 - RNA, 15 nt, Pseudomonas aeruginosa PA01
ggcgaacugccgacg

SEQ ID NO: 1435569 - RNA, 19 nt, Pseudomonas aeruginosa PA01
ggcgaacugccgacggcgg

SEQ ID NO: 1435570 - RNA, 21 nt, Pseudomonas aeruginosa PA01
ggcgaacugccgacggcggcg

SEQ ID NO: 1435571 - RNA, 22 nt, Pseudomonas aeruginosa PA01
ggcgaacugccgacggcggcgg

SEQ ID NO: 1435572 - RNA, 23 nt, Pseudomonas aeruginosa PA01
ggcgaacugccgacggcggcggc

SEQ ID NO: 1435573 - RNA, 16 nt, Pseudomonas aeruginosa PA01
ggcgaacagcgagacc

SEQ ID NO: 1435574 - RNA, 20 nt, Pseudomonas aeruginosa PA01
ggcgaacagcgccgcggcug

SEQ ID NO: 1435575 - RNA, 13 nt, Pseudomonas aeruginosa PA01
ggcgaacagcgcu

SEQ ID NO: 1435576 - RNA, 17 nt, Pseudomonas aeruginosa PA01
ggcgaacacgucggcgc

SEQ ID NO: 1435577 - RNA, 19 nt, Pseudomonas aeruginosa PA01
ggcgaacacgucggcgcgc

SEQ ID NO: 1435578 - RNA, 20 nt, Pseudomonas aeruginosa PA01
ggcgaacacgucggcgcgca

SEQ ID NO: 1435579 - RNA, 17 nt, Pseudomonas aeruginosa PA01
ggcgaacagcacccagg

SEQ ID NO: 1435580 - RNA, 21 nt, Pseudomonas aeruginosa PA01
ggcgaacagcagcgguaggcg

SEQ ID NO: 1435581 - RNA, 12 nt, Pseudomonas aeruginosa PA01
ggcgaacagcca

SEQ ID NO: 1435582 - RNA, 16 nt, Pseudomonas aeruginosa PA01
ggcgaacagccagcgg

SEQ ID NO: 1435583 - RNA, 18 nt, Pseudomonas aeruginosa PA01
ggcgaacagccagcgguu

SEQ ID NO: 1435584 - RNA, 17 nt, Pseudomonas aeruginosa PA01
ggcgaacaccgggccgc

SEQ ID NO: 1435585 - RNA, 19 nt, Pseudomonas aeruginosa PA01
ggcgaacaccgggccgccg

SEQ ID NO: 1435586 - RNA, 16 nt, Pseudomonas aeruginosa PA01
ggcgaacaacgccgcc

SEQ ID NO: 1435587 - RNA, 20 nt, Pseudomonas aeruginosa PA01
ggcgaaccagugcaccgccg

SEQ ID NO: 1435588 - RNA, 16 nt, Pseudomonas aeruginosa PA01
ggcgaacccucggugc

SEQ ID NO: 1435589 - RNA, 17 nt, Pseudomonas aeruginosa PA01
ggcgaacccggcgcggc

SEQ ID NO: 1435590 - RNA, 18 nt, Pseudomonas aeruginosa PA01
ggcgaacccggcgcggcg

SEQ ID NO: 1435591 - RNA, 14 nt, Pseudomonas aeruginosa PA01
ggcgaaccacucgg

SEQ ID NO: 1435592 - RNA, 17 nt, Pseudomonas aeruginosa PA01
ggcgaaccacucggcgc

SEQ ID NO: 1435593 - RNA, 21 nt, Pseudomonas aeruginosa PA01
ggcgaacaucauccacagcgu

SEQ ID NO: 1435594 - RNA, 17 nt, Pseudomonas aeruginosa PA01
ggcgaacaugaagccgc

SEQ ID NO: 1435595 - RNA, 22 nt, Pseudomonas aeruginosa PA01
ggcgaacaugaagccgcgcgcc

SEQ ID NO: 1435596 - RNA, 23 nt, Pseudomonas aeruginosa PA01
ggcgaacaugaagccgcgcgccg

SEQ ID NO: 1435597 - RNA, 18 nt, Pseudomonas aeruginosa PA01
ggcgaaaucgagcugcuc

SEQ ID NO: 1435598 - RNA, 18 nt, Pseudomonas aeruginosa PA01
ggcgaaaugcaggccggu

SEQ ID NO: 1435599 - RNA, 23 nt, Pseudomonas aeruginosa PA01
ggcgaaaugcaggccgguggucg

SEQ ID NO: 1435600 - RNA, 21 nt, Pseudomonas aeruginosa PA01
ggcgaaagcgguaccgggcca

SEQ ID NO: 1435601 - RNA, 15 nt, Pseudomonas aeruginosa PA01
ggcgaaagucggcgc

SEQ ID NO: 1435602 - RNA, 17 nt, Pseudomonas aeruginosa PA01
ggcgaaagucggcgcga

SEQ ID NO: 1435603 - RNA, 20 nt, Pseudomonas aeruginosa PA01
ggcgaaagucggcgcgacug

SEQ ID NO: 1435604 - RNA, 16 nt, Pseudomonas aeruginosa PA01
ggcgaaacguccggcg

SEQ ID NO: 1435605 - RNA, 17 nt, Pseudomonas aeruginosa PA01
ggcgaaacuccagcagg

SEQ ID NO: 1435606 - RNA, 14 nt, Pseudomonas aeruginosa PA01
ggcgaaacggcagg

SEQ ID NO: 1435607 - RNA, 20 nt, Pseudomonas aeruginosa PA01
ggcgaaacggcaggccagca

SEQ ID NO: 1435608 - RNA, 22 nt, Pseudomonas aeruginosa PA01
ggcgaaacggcaggccagcagg

SEQ ID NO: 1435609 - RNA, 14 nt, Pseudomonas aeruginosa PA01
ggcgaaaccggcca

SEQ ID NO: 1435610 - RNA, 18 nt, Pseudomonas aeruginosa PA01
ggcgaaaccggccagcgc

SEQ ID NO: 1435611 - RNA, 19 nt, Pseudomonas aeruginosa PA01
ggcgaaaccggccagcgcg

SEQ ID NO: 1435612 - RNA, 17 nt, Pseudomonas aeruginosa PA01
ggccuuggucucgcggg

SEQ ID NO: 1435613 - RNA, 22 nt, Pseudomonas aeruginosa PA01
ggccuuguagaguuugccgaac

SEQ ID NO: 1435614 - RNA, 14 nt, Pseudomonas aeruginosa PA01
ggccuuggcgaucu

SEQ ID NO: 1435615 - RNA, 17 nt, Pseudomonas aeruginosa PA01
ggccuugugcgccagcu

SEQ ID NO: 1435616 - RNA, 22 nt, Pseudomonas aeruginosa PA01
ggccuuucuuuucugccacccg

SEQ ID NO: 1435617 - RNA, 17 nt, Pseudomonas aeruginosa PA01
ggccuuguucagggugg

SEQ ID NO: 1435618 - RNA, 16 nt, Pseudomonas aeruginosa PA01
ggccuuuucggcggcc

SEQ ID NO: 1435619 - RNA, 23 nt, Pseudomonas aeruginosa PA01
ggccuuuuucucguucgggcgcu

SEQ ID NO: 1435620 - RNA, 22 nt, Pseudomonas aeruginosa PA01
ggcgacgcugaugaugccgcgg

SEQ ID NO: 1435621 - RNA, 14 nt, Pseudomonas aeruginosa PA01
ggcgacgcugaugc

SEQ ID NO: 1435622 - RNA, 22 nt, Pseudomonas aeruginosa PA01
ggcgacgcugaugccggcgaac

SEQ ID NO: 1435623 - RNA, 23 nt, Pseudomonas aeruginosa PA01
ggcgacgcucuucagcgguccgc

SEQ ID NO: 1435624 - RNA, 13 nt, Pseudomonas aeruginosa PA01
ggcgacgcggaca

SEQ ID NO: 1435625 - RNA, 23 nt, Pseudomonas aeruginosa PA01
ggcgacgcggacagccugggcgg

SEQ ID NO: 1435626 - RNA, 11 nt, Pseudomonas aeruginosa PA01
ggcgacgccgg

SEQ ID NO: 1435627 - RNA, 14 nt, Pseudomonas aeruginosa PA01
ggcgacgccggucg

SEQ ID NO: 1435628 - RNA, 19 nt, Pseudomonas aeruginosa PA01
ggcgacgcgcaggccggug

SEQ ID NO: 1435629 - RNA, 15 nt, Pseudomonas aeruginosa PA01
ggcgacgccgcgcug

SEQ ID NO: 1435630 - RNA, 13 nt, Pseudomonas aeruginosa PA01
ggcgacgagguag

SEQ ID NO: 1435631 - RNA, 11 nt, Pseudomonas aeruginosa PA01
ggcgacgauca

SEQ ID NO: 1435632 - RNA, 13 nt, Pseudomonas aeruginosa PA01
ggcgacgaucagc

SEQ ID NO: 1435633 - RNA, 22 nt, Pseudomonas aeruginosa PA01
ggcgacgaucagcccgccggcg

SEQ ID NO: 1435634 - RNA, 23 nt, Pseudomonas aeruginosa PA01
ggcgacgaucagcccgccggcga

SEQ ID NO: 1435635 - RNA, 14 nt, Pseudomonas aeruginosa PA01
ggcgacgaugccgc

SEQ ID NO: 1435636 - RNA, 18 nt, Pseudomonas aeruginosa PA01
ggcgacgaugccgccgcc

SEQ ID NO: 1435637 - RNA, 14 nt, Pseudomonas aeruginosa PA01
ggcgacgcagcacg

SEQ ID NO: 1435638 - RNA, 15 nt, Pseudomonas aeruginosa PA01
ggcgacgcagcacgg

SEQ ID NO: 1435639 - RNA, 15 nt, Pseudomonas aeruginosa PA01
ggcgacgccacccgc

SEQ ID NO: 1435640 - RNA, 14 nt, Pseudomonas aeruginosa PA01
ggcgacgcccaugu

SEQ ID NO: 1435641 - RNA, 22 nt, Pseudomonas aeruginosa PA01
ggcgacgcccuguucggcggga

SEQ ID NO: 1435642 - RNA, 14 nt, Pseudomonas aeruginosa PA01
ggcgacgccgaugc

SEQ ID NO: 1435643 - RNA, 18 nt, Pseudomonas aeruginosa PA01
ggcgacgccgaugcucgg

SEQ ID NO: 1435644 - RNA, 12 nt, Pseudomonas aeruginosa PA01
ggcgacgaugcg

SEQ ID NO: 1435645 - RNA, 19 nt, Pseudomonas aeruginosa PA01
ggcgacgaugcgccccagc

SEQ ID NO: 1435646 - RNA, 23 nt, Pseudomonas aeruginosa PA01
ggcgacgaugcgccccagcgccu

SEQ ID NO: 1435647 - RNA, 14 nt, Pseudomonas aeruginosa PA01
aaggcugccgggcu

SEQ ID NO: 1435648 - RNA, 22 nt, Pseudomonas aeruginosa PA01
aaggcugccgggcucugguagc

SEQ ID NO: 1435649 - RNA, 17 nt, Pseudomonas aeruginosa PA01
aaggcugcuucggcagc

SEQ ID NO: 1435650 - RNA, 21 nt, Pseudomonas aeruginosa PA01
aaggcucguucguagaucccu

SEQ ID NO: 1435651 - RNA, 20 nt, Pseudomonas aeruginosa PA01
ggcgacgggaagcgaaccag

SEQ ID NO: 1435652 - RNA, 21 nt, Pseudomonas aeruginosa PA01
ggcgacgguaccagggaagcg

SEQ ID NO: 1435653 - RNA, 17 nt, Pseudomonas aeruginosa PA01
aagggaaacaccaggcc

SEQ ID NO: 1435654 - RNA, 14 nt, Pseudomonas aeruginosa PA01
aaggcuucgcgguu

SEQ ID NO: 1435655 - RNA, 23 nt, Pseudomonas aeruginosa PA01
aagggacgucgccagggaggcga

SEQ ID NO: 1435656 - RNA, 19 nt, Pseudomonas aeruginosa PA01
ggcgacggucaggccgagc

SEQ ID NO: 1435657 - RNA, 13 nt, Pseudomonas aeruginosa PA01
aagggagccaggc

SEQ ID NO: 1435658 - RNA, 17 nt, Pseudomonas aeruginosa PA01
ggcgacguucugcucgc

SEQ ID NO: 1435659 - RNA, 16 nt, Pseudomonas aeruginosa PA01
ggcgacguugcgcagg

SEQ ID NO: 1435660 - RNA, 17 nt, Pseudomonas aeruginosa PA01
ggcgacguuuuucccgu

SEQ ID NO: 1435661 - RNA, 13 nt, Pseudomonas aeruginosa PA01
ggcgacguccugc

SEQ ID NO: 1435662 - RNA, 22 nt, Pseudomonas aeruginosa PA01
ggcgagaaagucgaucagcgcg

SEQ ID NO: 1435663 - RNA, 21 nt, Pseudomonas aeruginosa PA01
ggcgagacuaccgaucggcug

SEQ ID NO: 1435664 - RNA, 15 nt, Pseudomonas aeruginosa PA01
ggcgagagcgccgac

SEQ ID NO: 1435665 - RNA, 19 nt, Pseudomonas aeruginosa PA01
ggcgagaccggggaucagc

SEQ ID NO: 1435666 - RNA, 14 nt, Pseudomonas aeruginosa PA01
ggcgagaaucgccg

SEQ ID NO: 1435667 - RNA, 15 nt, Pseudomonas aeruginosa PA01
ggcgagaaucgccga

SEQ ID NO: 1435668 - RNA, 22 nt, Pseudomonas aeruginosa PA01
ggcgagaaucgccgaggcgucg

SEQ ID NO: 1435669 - RNA, 22 nt, Pseudomonas aeruginosa PA01
ggcgacuucgcauuccaccuug

SEQ ID NO: 1435670 - RNA, 19 nt, Pseudomonas aeruginosa PA01
ggcgagcaucucggccagg

SEQ ID NO: 1435671 - RNA, 14 nt, Pseudomonas aeruginosa PA01
ggcgagcagcggca

SEQ ID NO: 1435672 - RNA, 17 nt, Pseudomonas aeruginosa PA01
ggcgagcagcggcacgc

SEQ ID NO: 1435673 - RNA, 15 nt, Pseudomonas aeruginosa PA01
ggcgagcagcggcgc

SEQ ID NO: 1435674 - RNA, 22 nt, Pseudomonas aeruginosa PA01
ggcgagcagggcgcugagcgcg

SEQ ID NO: 1435675 - RNA, 14 nt, Pseudomonas aeruginosa PA01
ggcgagcaggguca

SEQ ID NO: 1435676 - RNA, 18 nt, Pseudomonas aeruginosa PA01
ggcgagaggucggcgcgc

SEQ ID NO: 1435677 - RNA, 19 nt, Pseudomonas aeruginosa PA01
ggcgagaucuucaggccga

SEQ ID NO: 1435678 - RNA, 16 nt, Pseudomonas aeruginosa PA01
ggcgaccgcgcgcaug

SEQ ID NO: 1435679 - RNA, 17 nt, Pseudomonas aeruginosa PA01
ggcgaccgcgcgcaugg

SEQ ID NO: 1435680 - RNA, 23 nt, Pseudomonas aeruginosa PA01
ggcgaccgcgcgcauggucgcgc

SEQ ID NO: 1435681 - RNA, 19 nt, Pseudomonas aeruginosa PA01
ggcgaccggaugcuccagg

SEQ ID NO: 1435682 - RNA, 20 nt, Pseudomonas aeruginosa PA01
ggcgacccuggggucgccgu

SEQ ID NO: 1435683 - RNA, 17 nt, Pseudomonas aeruginosa PA01
ggcgaccgaacagcgcg

SEQ ID NO: 1435684 - RNA, 19 nt, Pseudomonas aeruginosa PA01
ggcgaccgccaggcggccg

SEQ ID NO: 1435685 - RNA, 20 nt, Pseudomonas aeruginosa PA01
ggcgaccgccaggcggccgc

SEQ ID NO: 1435686 - RNA, 15 nt, Pseudomonas aeruginosa PA01
ggcgacccggcauua

SEQ ID NO: 1435687 - RNA, 23 nt, Pseudomonas aeruginosa PA01
ggcgacccaggccgacagcggcu

SEQ ID NO: 1435688 - RNA, 12 nt, Pseudomonas aeruginosa PA01
ggcgacccgccg

SEQ ID NO: 1435689 - RNA, 20 nt, Pseudomonas aeruginosa PA01
ggcgaccauguucaccagcg

SEQ ID NO: 1435690 - RNA, 22 nt, Pseudomonas aeruginosa PA01
ggcgaccauguucaccagcgcu

SEQ ID NO: 1435691 - RNA, 21 nt, Pseudomonas aeruginosa PA01
ggcgacccagaccugccgccc

SEQ ID NO: 1435692 - RNA, 23 nt, Pseudomonas aeruginosa PA01
ggcgacccagaccugccgcccgg

SEQ ID NO: 1435693 - RNA, 16 nt, Pseudomonas aeruginosa PA01
ggcgacgaagcccagg

SEQ ID NO: 1435694 - RNA, 19 nt, Pseudomonas aeruginosa PA01
ggcgacgaagcccaggcug

SEQ ID NO: 1435695 - RNA, 19 nt, Pseudomonas aeruginosa PA01
ggcgacgaagcccucgcga

SEQ ID NO: 1435696 - RNA, 17 nt, Pseudomonas aeruginosa PA01
ggcgacgaagcuggcga

SEQ ID NO: 1435697 - RNA, 14 nt, Pseudomonas aeruginosa PA01
ggcgacgaaggccu

SEQ ID NO: 1435698 - RNA, 17 nt, Pseudomonas aeruginosa PA01
ggcgacgaaggccuggu

SEQ ID NO: 1435699 - RNA, 16 nt, Pseudomonas aeruginosa PA01
ggcgacgaaggucggc

SEQ ID NO: 1435700 - RNA, 17 nt, Pseudomonas aeruginosa PA01
ggcgacgaaggucggcg

SEQ ID NO: 1435701 - RNA, 22 nt, Pseudomonas aeruginosa PA01
ggcgacgaaggucggcggcagc

SEQ ID NO: 1435702 - RNA, 21 nt, Pseudomonas aeruginosa PA01
ggcgaccgguuccgcgucgcc

SEQ ID NO: 1435703 - RNA, 23 nt, Pseudomonas aeruginosa PA01
ggcgaccgguuccgcgucgccuu

SEQ ID NO: 1435704 - RNA, 20 nt, Pseudomonas aeruginosa PA01
ggcgaccugguggcgccggc

SEQ ID NO: 1435705 - RNA, 21 nt, Pseudomonas aeruginosa PA01
ggcgaccugguggcgccggcu

SEQ ID NO: 1435706 - RNA, 16 nt, Pseudomonas aeruginosa PA01
ggcgaccuucagcggg

SEQ ID NO: 1435707 - RNA, 22 nt, Pseudomonas aeruginosa PA01
ggcgaccuucagcgggucgagc

SEQ ID NO: 1435708 - RNA, 14 nt, Pseudomonas aeruginosa PA01
ggcgaccuugcgca

SEQ ID NO: 1435709 - RNA, 23 nt, Pseudomonas aeruginosa PA01
ggcgaccuugcgcaccagggcca

SEQ ID NO: 1435710 - RNA, 16 nt, Pseudomonas aeruginosa PA01
ggcgaccugcucgcgc

SEQ ID NO: 1435711 - RNA, 23 nt, Pseudomonas aeruginosa PA01
ggcgaccuuguccugcggccggg

SEQ ID NO: 1435712 - RNA, 19 nt, Pseudomonas aeruginosa PA01
ggcgacgaaagacgcugcg

SEQ ID NO: 1435713 - RNA, 18 nt, Pseudomonas aeruginosa PA01
ggcgacacagacgcagcc

SEQ ID NO: 1435714 - RNA, 15 nt, Pseudomonas aeruginosa PA01
ggcgacaccgccagc

SEQ ID NO: 1435715 - RNA, 16 nt, Pseudomonas aeruginosa PA01
ggcgaauucgucgccg

SEQ ID NO: 1435716 - RNA, 18 nt, Pseudomonas aeruginosa PA01
ggcgaauucgucgccgcc

SEQ ID NO: 1435717 - RNA, 22 nt, Pseudomonas aeruginosa PA01
ggcgaauucgucgccgccgagg

SEQ ID NO: 1435718 - RNA, 17 nt, Pseudomonas aeruginosa PA01
ggcgaauuuccugcugg

SEQ ID NO: 1435719 - RNA, 22 nt, Pseudomonas aeruginosa PA01
ggcgaauuuccugcuggcgagc

SEQ ID NO: 1435720 - RNA, 17 nt, Pseudomonas aeruginosa PA01
ggcgacaaaucggcauc

SEQ ID NO: 1435721 - RNA, 23 nt, Pseudomonas aeruginosa PA01
ggcgaauauccucgucgauccgc

SEQ ID NO: 1435722 - RNA, 12 nt, Pseudomonas aeruginosa PA01
ggcgaaugccuu

SEQ ID NO: 1435723 - RNA, 14 nt, Pseudomonas aeruginosa PA01
ggcgaaucgucgau

SEQ ID NO: 1435724 - RNA, 16 nt, Pseudomonas aeruginosa PA01
ggcgaauagcgccgca

SEQ ID NO: 1435725 - RNA, 17 nt, Pseudomonas aeruginosa PA01
ggcgaauagcgccgcag

SEQ ID NO: 1435726 - RNA, 16 nt, Pseudomonas aeruginosa PA01
ggcgaauagcgccgcg

SEQ ID NO: 1435727 - RNA, 17 nt, Pseudomonas aeruginosa PA01
ggcgaauagcgccgcgg

SEQ ID NO: 1435728 - RNA, 21 nt, Pseudomonas aeruginosa PA01
ggcgaauaaccgcaucgcggu

SEQ ID NO: 1435729 - RNA, 16 nt, Pseudomonas aeruginosa PA01
ggcgaauaacgccaca

SEQ ID NO: 1435730 - RNA, 17 nt, Pseudomonas aeruginosa PA01
ggcgaauaacgccaccg

SEQ ID NO: 1435731 - RNA, 18 nt, Pseudomonas aeruginosa PA01
ggcgaauaacgccaccgg

SEQ ID NO: 1435732 - RNA, 20 nt, Pseudomonas aeruginosa PA01
ggcgaauaacgccaccggcg

SEQ ID NO: 1435733 - RNA, 14 nt, Pseudomonas aeruginosa PA01
ggcgaauaacgccg

SEQ ID NO: 1435734 - RNA, 15 nt, Pseudomonas aeruginosa PA01
ggcgaauaacgccgc

SEQ ID NO: 1435735 - RNA, 17 nt, Pseudomonas aeruginosa PA01
ggcgaauaacgccgcag

SEQ ID NO: 1435736 - RNA, 20 nt, Pseudomonas aeruginosa PA01
ggcgaauaacgccgcaggcg

SEQ ID NO: 1435737 - RNA, 17 nt, Pseudomonas aeruginosa PA01
ggcgaauaccagugccg

SEQ ID NO: 1435738 - RNA, 18 nt, Pseudomonas aeruginosa PA01
ggcgaauaccagugccgc

SEQ ID NO: 1435739 - RNA, 17 nt, Pseudomonas aeruginosa PA01
ggcgaccaccacgucga

SEQ ID NO: 1435740 - RNA, 21 nt, Pseudomonas aeruginosa PA01
ggcgacauagccggcgaacca

SEQ ID NO: 1435741 - RNA, 22 nt, Pseudomonas aeruginosa PA01
ggcgacauagcggcugcugucg

SEQ ID NO: 1435742 - RNA, 19 nt, Pseudomonas aeruginosa PA01
ggcgacagcaccacgccgc

SEQ ID NO: 1435743 - RNA, 21 nt, Pseudomonas aeruginosa PA01
ggcgacagcaccacgccgcug

SEQ ID NO: 1435744 - RNA, 14 nt, Pseudomonas aeruginosa PA01
ggcgaccagcgcgg

SEQ ID NO: 1435745 - RNA, 20 nt, Pseudomonas aeruginosa PA01
ggcgaccagcgucgcgcgug

SEQ ID NO: 1435746 - RNA, 18 nt, Pseudomonas aeruginosa PA01
ggcgaccacccggcgguc

SEQ ID NO: 1435747 - RNA, 14 nt, Pseudomonas aeruginosa PA01
ggcgaccaccgccg

SEQ ID NO: 1435748 - RNA, 15 nt, Pseudomonas aeruginosa PA01
ggcgaccaccgccgg

SEQ ID NO: 1435749 - RNA, 20 nt, Pseudomonas aeruginosa PA01
ggcgaccaccgcgaauccgc

SEQ ID NO: 1435750 - RNA, 13 nt, Pseudomonas aeruginosa PA01
ggcgaccagcccg

SEQ ID NO: 1435751 - RNA, 14 nt, Pseudomonas aeruginosa PA01
ggcgaccagcccgc

SEQ ID NO: 1435752 - RNA, 14 nt, Pseudomonas aeruginosa PA01
ggcgaccagccggg

SEQ ID NO: 1435753 - RNA, 16 nt, Pseudomonas aeruginosa PA01
ggccgccagccgccag

SEQ ID NO: 1435754 - RNA, 17 nt, Pseudomonas aeruginosa PA01
ggccgccagcaggccga

SEQ ID NO: 1435755 - RNA, 14 nt, Pseudomonas aeruginosa PA01
ggccgccagcaggu

SEQ ID NO: 1435756 - RNA, 19 nt, Pseudomonas aeruginosa PA01
ggccgccagcagguagacg

SEQ ID NO: 1435757 - RNA, 14 nt, Pseudomonas aeruginosa PA01
ggccgccaggcugg

SEQ ID NO: 1435758 - RNA, 14 nt, Pseudomonas aeruginosa PA01
ggccgccaggccuc

SEQ ID NO: 1435759 - RNA, 18 nt, Pseudomonas aeruginosa PA01
ggccgccaggccucggcg

SEQ ID NO: 1435760 - RNA, 21 nt, Pseudomonas aeruginosa PA01
ggccgccaggccucggcgcgg

SEQ ID NO: 1435761 - RNA, 22 nt, Pseudomonas aeruginosa PA01
ggccgccaggccucggcgcggg

SEQ ID NO: 1435762 - RNA, 14 nt, Pseudomonas aeruginosa PA01
ggccgccaggcgcg

SEQ ID NO: 1435763 - RNA, 16 nt, Pseudomonas aeruginosa PA01
ggccgccaggcgcguc

SEQ ID NO: 1435764 - RNA, 20 nt, Pseudomonas aeruginosa PA01
ggccgccaggcgcgucgcgg

SEQ ID NO: 1435765 - RNA, 16 nt, Pseudomonas aeruginosa PA01
ggccgccaucgcccgg

SEQ ID NO: 1435766 - RNA, 15 nt, Pseudomonas aeruginosa PA01
ggccgccaugcucgg

SEQ ID NO: 1435767 - RNA, 16 nt, Pseudomonas aeruginosa PA01
ggccgccaugcucggc

SEQ ID NO: 1435768 - RNA, 18 nt, Pseudomonas aeruginosa PA01
ggccgccaugcucggcca

SEQ ID NO: 1435769 - RNA, 15 nt, Pseudomonas aeruginosa PA01
ggccgcccgagccgc

SEQ ID NO: 1435770 - RNA, 19 nt, Pseudomonas aeruginosa PA01
ggccgcccgagccgcugca

SEQ ID NO: 1435771 - RNA, 22 nt, Pseudomonas aeruginosa PA01
ggccgccagggcgucggagaga

SEQ ID NO: 1435772 - RNA, 14 nt, Pseudomonas aeruginosa PA01
ggccgcccagcgca

SEQ ID NO: 1435773 - RNA, 15 nt, Pseudomonas aeruginosa PA01
ggccgcccagcgcag

SEQ ID NO: 1435774 - RNA, 16 nt, Pseudomonas aeruginosa PA01
ggccgcccagcgcagc

SEQ ID NO: 1435775 - RNA, 20 nt, Pseudomonas aeruginosa PA01
ggccgcccagcggaugcgcg

SEQ ID NO: 1435776 - RNA, 13 nt, Pseudomonas aeruginosa PA01
ggccgcccuggcc

SEQ ID NO: 1435777 - RNA, 15 nt, Pseudomonas aeruginosa PA01
ggccgcccuggccga

SEQ ID NO: 1435778 - RNA, 16 nt, Pseudomonas aeruginosa PA01
ggccgcccuggccgag

SEQ ID NO: 1435779 - RNA, 17 nt, Pseudomonas aeruginosa PA01
ggccgcccuggccgagc

SEQ ID NO: 1435780 - RNA, 16 nt, Pseudomonas aeruginosa PA01
ggccgcccuugacccc

SEQ ID NO: 1435781 - RNA, 13 nt, Pseudomonas aeruginosa PA01
ggccgccgaagaa

SEQ ID NO: 1435782 - RNA, 18 nt, Pseudomonas aeruginosa PA01
ggccccggcgauccgcgc

SEQ ID NO: 1435783 - RNA, 13 nt, Pseudomonas aeruginosa PA01
ggccccggcgccg

SEQ ID NO: 1435784 - RNA, 16 nt, Pseudomonas aeruginosa PA01
ggccccugggccggcu

SEQ ID NO: 1435785 - RNA, 20 nt, Pseudomonas aeruginosa PA01
ggcccaguugcccggccugg

SEQ ID NO: 1435786 - RNA, 20 nt, Pseudomonas aeruginosa PA01
ggcccaguucgcugccgccg

SEQ ID NO: 1435787 - RNA, 23 nt, Pseudomonas aeruginosa PA01
ggcccaucauguagacgaugccg

SEQ ID NO: 1435788 - RNA, 16 nt, Pseudomonas aeruginosa PA01
ggcccauccuggcgau

SEQ ID NO: 1435789 - RNA, 24 nt, Pseudomonas aeruginosa PA01
ggcccauccuggcgaucaggccaa

SEQ ID NO: 1435790 - RNA, 23 nt, Pseudomonas aeruginosa PA01
ggccccggccagguaccggccag

SEQ ID NO: 1435791 - RNA, 12 nt, Pseudomonas aeruginosa PA01
ggccccggccgg

SEQ ID NO: 1435792 - RNA, 19 nt, Pseudomonas aeruginosa PA01
ggccccggcaagggccugc

SEQ ID NO: 1435793 - RNA, 13 nt, Pseudomonas aeruginosa PA01
ggccgccacggcg

SEQ ID NO: 1435794 - RNA, 16 nt, Pseudomonas aeruginosa PA01
ggcccgaaggccccuu

SEQ ID NO: 1435795 - RNA, 21 nt, Pseudomonas aeruginosa PA01
ggccgcgcugcugccauccgc

SEQ ID NO: 1435796 - RNA, 23 nt, Pseudomonas aeruginosa PA01
ggccgcgcugcugccauccgcgc

SEQ ID NO: 1435797 - RNA, 12 nt, Pseudomonas aeruginosa PA01
ggccgcggcugg

SEQ ID NO: 1435798 - RNA, 16 nt, Pseudomonas aeruginosa PA01
ggccgcgggaggccgc

SEQ ID NO: 1435799 - RNA, 17 nt, Pseudomonas aeruginosa PA01
ggccgcgggaggccgcc

SEQ ID NO: 1435800 - RNA, 16 nt, Pseudomonas aeruginosa PA01
ggccgcggucgggcag

SEQ ID NO: 1435801 - RNA, 17 nt, Pseudomonas aeruginosa PA01
ggccgcggucgggcaga

SEQ ID NO: 1435802 - RNA, 15 nt, Pseudomonas aeruginosa PA01
ggccgcguaagcggc

SEQ ID NO: 1435803 - RNA, 16 nt, Pseudomonas aeruginosa PA01
ggccgcguaagcggcc

SEQ ID NO: 1435804 - RNA, 19 nt, Pseudomonas aeruginosa PA01
ggccgcguaagcggccuuu

SEQ ID NO: 1435805 - RNA, 17 nt, Pseudomonas aeruginosa PA01
ggccgcgucgcccaggc

SEQ ID NO: 1435806 - RNA, 15 nt, Pseudomonas aeruginosa PA01
ggccgcguucgccga

SEQ ID NO: 1435807 - RNA, 15 nt, Pseudomonas aeruginosa PA01
ggccgcuacgcggcg

SEQ ID NO: 1435808 - RNA, 14 nt, Pseudomonas aeruginosa PA01
ggccgcugagcagc

SEQ ID NO: 1435809 - RNA, 20 nt, Pseudomonas aeruginosa PA01
ggccgcugagcagcaggugg

SEQ ID NO: 1435810 - RNA, 15 nt, Pseudomonas aeruginosa PA01
ggccgcugccgccgc

SEQ ID NO: 1435811 - RNA, 18 nt, Pseudomonas aeruginosa PA01
ggccgcugccgccgcgca

SEQ ID NO: 1435812 - RNA, 15 nt, Pseudomonas aeruginosa PA01
ggccgcugccgcucu

SEQ ID NO: 1435813 - RNA, 22 nt, Pseudomonas aeruginosa PA01
ggccgcugccgcucuggcugcu

SEQ ID NO: 1435814 - RNA, 12 nt, Pseudomonas aeruginosa PA01
ggccgcugccgg

SEQ ID NO: 1435815 - RNA, 13 nt, Pseudomonas aeruginosa PA01
ggccgcugccggg

SEQ ID NO: 1435816 - RNA, 12 nt, Pseudomonas aeruginosa PA01
ggccgcugccgu

SEQ ID NO: 1435817 - RNA, 16 nt, Pseudomonas aeruginosa PA01
ggccgcugccguugca

SEQ ID NO: 1435818 - RNA, 22 nt, Pseudomonas aeruginosa PA01
ggccgcugccguugcaggccca

SEQ ID NO: 1435819 - RNA, 23 nt, Pseudomonas aeruginosa PA01
ggccgcucgagggcgaccgccag

SEQ ID NO: 1435820 - RNA, 16 nt, Pseudomonas aeruginosa PA01
ggccgcucgcgcggca

SEQ ID NO: 1435821 - RNA, 14 nt, Pseudomonas aeruginosa PA01
ggccgcucaccgcc

SEQ ID NO: 1435822 - RNA, 18 nt, Pseudomonas aeruginosa PA01
ggccgcucaccgccaccc

SEQ ID NO: 1435823 - RNA, 12 nt, Pseudomonas aeruginosa PA01
ggccgccgcggg

SEQ ID NO: 1435824 - RNA, 13 nt, Pseudomonas aeruginosa PA01
ggccgccgcgggc

SEQ ID NO: 1435825 - RNA, 14 nt, Pseudomonas aeruginosa PA01
ggccgccgcgggca

SEQ ID NO: 1435826 - RNA, 22 nt, Pseudomonas aeruginosa PA01
ggccgccgcgugccgccggacc

SEQ ID NO: 1435827 - RNA, 14 nt, Pseudomonas aeruginosa PA01
ggccgccggcggcc

SEQ ID NO: 1435828 - RNA, 12 nt, Pseudomonas aeruginosa PA01
ggccgccggcga

SEQ ID NO: 1435829 - RNA, 15 nt, Pseudomonas aeruginosa PA01
ggccgccggcgaccg

SEQ ID NO: 1435830 - RNA, 14 nt, Pseudomonas aeruginosa PA01
ggccgccggcgacg

SEQ ID NO: 1435831 - RNA, 15 nt, Pseudomonas aeruginosa PA01
ggccgccggcgacga

SEQ ID NO: 1435832 - RNA, 18 nt, Pseudomonas aeruginosa PA01
ggccgccggcgacgaggu

SEQ ID NO: 1435833 - RNA, 20 nt, Pseudomonas aeruginosa PA01
ggccgccggcggccagggcg

SEQ ID NO: 1435834 - RNA, 15 nt, Pseudomonas aeruginosa PA01
ggccgcgagcgcggc

SEQ ID NO: 1435835 - RNA, 17 nt, Pseudomonas aeruginosa PA01
ggccgcgagcgcggccg

SEQ ID NO: 1435836 - RNA, 18 nt, Pseudomonas aeruginosa PA01
ggccgcgagcgcggccgg

SEQ ID NO: 1435837 - RNA, 14 nt, Pseudomonas aeruginosa PA01
ggccgcgcgauggc

SEQ ID NO: 1435838 - RNA, 20 nt, Pseudomonas aeruginosa PA01
ggccgcgcggcuugccggcg

SEQ ID NO: 1435839 - RNA, 21 nt, Pseudomonas aeruginosa PA01
ggccgcgcagaucgcguccag

SEQ ID NO: 1435840 - RNA, 16 nt, Pseudomonas aeruginosa PA01
ggccgcgcagucccgc

SEQ ID NO: 1435841 - RNA, 18 nt, Pseudomonas aeruginosa PA01
ggccgcgcagucccgcgc

SEQ ID NO: 1435842 - RNA, 20 nt, Pseudomonas aeruginosa PA01
ggccgcgcagucccgcgcgg

SEQ ID NO: 1435843 - RNA, 22 nt, Pseudomonas aeruginosa PA01
ggccgcgcagucccgcgcggcc

SEQ ID NO: 1435844 - RNA, 12 nt, Pseudomonas aeruginosa PA01
ggccgcgccagc

SEQ ID NO: 1435845 - RNA, 13 nt, Pseudomonas aeruginosa PA01
ggccgcgccagcc

SEQ ID NO: 1435846 - RNA, 14 nt, Pseudomonas aeruginosa PA01
ggccgcgccagcca

SEQ ID NO: 1435847 - RNA, 18 nt, Pseudomonas aeruginosa PA01
ggccgcugcgcaggccga

SEQ ID NO: 1435848 - RNA, 14 nt, Pseudomonas aeruginosa PA01
ggccgcuggcggcg

SEQ ID NO: 1435849 - RNA, 18 nt, Pseudomonas aeruginosa PA01
ggccgcuggcggcgacga

SEQ ID NO: 1435850 - RNA, 23 nt, Pseudomonas aeruginosa PA01
ggccggccacgcgaccagcgcca

SEQ ID NO: 1435851 - RNA, 16 nt, Pseudomonas aeruginosa PA01
ggccggcaugcucagc

SEQ ID NO: 1435852 - RNA, 21 nt, Pseudomonas aeruginosa PA01
ggccggcaugcagguggcgcu

SEQ ID NO: 1435853 - RNA, 17 nt, Pseudomonas aeruginosa PA01
ggccggcgcaucgucga

SEQ ID NO: 1435854 - RNA, 18 nt, Pseudomonas aeruginosa PA01
ggccggcgcaucgucgaa

SEQ ID NO: 1435855 - RNA, 14 nt, Pseudomonas aeruginosa PA01
ggccggcgccagca

SEQ ID NO: 1435856 - RNA, 17 nt, Pseudomonas aeruginosa PA01
ggccggccccaccagca

SEQ ID NO: 1435857 - RNA, 14 nt, Pseudomonas aeruginosa PA01
ggccggccagccuu

SEQ ID NO: 1435858 - RNA, 23 nt, Pseudomonas aeruginosa PA01
ggccggccagccuucccggcgcu

SEQ ID NO: 1435859 - RNA, 18 nt, Pseudomonas aeruginosa PA01
ggccggccagggcgaaca

SEQ ID NO: 1435860 - RNA, 17 nt, Pseudomonas aeruginosa PA01
ggccggcggccgaggcu

SEQ ID NO: 1435861 - RNA, 21 nt, Pseudomonas aeruginosa PA01
ggccggcggccugagccggcc

SEQ ID NO: 1435862 - RNA, 22 nt, Pseudomonas aeruginosa PA01
ggccggcggugagggcgacggc

SEQ ID NO: 1435863 - RNA, 23 nt, Pseudomonas aeruginosa PA01
ggccggcggugagggcgacggcg

SEQ ID NO: 1435864 - RNA, 15 nt, Pseudomonas aeruginosa PA01
ggccggcgcccuucg

SEQ ID NO: 1435865 - RNA, 20 nt, Pseudomonas aeruginosa PA01
ggccggcgcccuucgagaaa

SEQ ID NO: 1435866 - RNA, 14 nt, Pseudomonas aeruginosa PA01
ggccggcgccgaug

SEQ ID NO: 1435867 - RNA, 14 nt, Pseudomonas aeruginosa PA01
ggccggcgccgcgg

SEQ ID NO: 1435868 - RNA, 22 nt, Pseudomonas aeruginosa PA01
ggccggcgcggcguucaucgcu

SEQ ID NO: 1435869 - RNA, 12 nt, Pseudomonas aeruginosa PA01
ggccggcgcgcc

SEQ ID NO: 1435870 - RNA, 21 nt, Pseudomonas aeruginosa PA01
ggccggcgcggacggccugcg

SEQ ID NO: 1435871 - RNA, 12 nt, Pseudomonas aeruginosa PA01
ggccggcgcggc

SEQ ID NO: 1435872 - RNA, 13 nt, Pseudomonas aeruginosa PA01
ggccggcgcggcg

SEQ ID NO: 1435873 - RNA, 23 nt, Pseudomonas aeruginosa PA01
ggccggcguacuucggcgcggug

SEQ ID NO: 1435874 - RNA, 18 nt, Pseudomonas aeruginosa PA01
ggccggcgugcccauccg

SEQ ID NO: 1435875 - RNA, 22 nt, Pseudomonas aeruginosa PA01
ggccggcgugcccauccgcucg

SEQ ID NO: 1435876 - RNA, 14 nt, Pseudomonas aeruginosa PA01
ggccggcucagcgc

SEQ ID NO: 1435877 - RNA, 19 nt, Pseudomonas aeruginosa PA01
ggccgggagcuacagcgau

SEQ ID NO: 1435878 - RNA, 16 nt, Pseudomonas aeruginosa PA01
ggccgggauacagcag

SEQ ID NO: 1435879 - RNA, 17 nt, Pseudomonas aeruginosa PA01
ggccgggauacagcagc

SEQ ID NO: 1435880 - RNA, 21 nt, Pseudomonas aeruginosa PA01
ggccgggaauggagaugccga

SEQ ID NO: 1435881 - RNA, 23 nt, Pseudomonas aeruginosa PA01
ggccgggaauggagaugccgaac

SEQ ID NO: 1435882 - RNA, 12 nt, Pseudomonas aeruginosa PA01
ggccgggcggcg

SEQ ID NO: 1435883 - RNA, 14 nt, Pseudomonas aeruginosa PA01
ggccgggcggcggc

SEQ ID NO: 1435884 - RNA, 23 nt, Pseudomonas aeruginosa PA01
ggccgggcaccccgagcggcgcg

SEQ ID NO: 1435885 - RNA, 13 nt, Pseudomonas aeruginosa PA01
ggccgggcaggcc

SEQ ID NO: 1435886 - RNA, 14 nt, Pseudomonas aeruginosa PA01
ggccgggcaggccg

SEQ ID NO: 1435887 - RNA, 22 nt, Pseudomonas aeruginosa PA01
ggccgggcaggccgaggccggc

SEQ ID NO: 1435888 - RNA, 15 nt, Pseudomonas aeruginosa PA01
ggccgggccgaugcg

SEQ ID NO: 1435889 - RNA, 14 nt, Pseudomonas aeruginosa PA01
ggccgggcuggcca

SEQ ID NO: 1435890 - RNA, 15 nt, Pseudomonas aeruginosa PA01
ggccgggcuggccac

SEQ ID NO: 1435891 - RNA, 18 nt, Pseudomonas aeruginosa PA01
ggccgggcuggccaccgc

SEQ ID NO: 1435892 - RNA, 13 nt, Pseudomonas aeruginosa PA01
ggccgguagucgg

SEQ ID NO: 1435893 - RNA, 15 nt, Pseudomonas aeruginosa PA01
ggccggggaacaggu

SEQ ID NO: 1435894 - RNA, 14 nt, Pseudomonas aeruginosa PA01
ggccggggccggca

SEQ ID NO: 1435895 - RNA, 13 nt, Pseudomonas aeruginosa PA01
ggccucgauggcg

SEQ ID NO: 1435896 - RNA, 16 nt, Pseudomonas aeruginosa PA01
ggccucgaugaucgcc

SEQ ID NO: 1435897 - RNA, 18 nt, Pseudomonas aeruginosa PA01
ggccucgaugaucgccgg

SEQ ID NO: 1435898 - RNA, 19 nt, Pseudomonas aeruginosa PA01
ggccucgaugauggugcgg

SEQ ID NO: 1435899 - RNA, 14 nt, Pseudomonas aeruginosa PA01
ggccucgccggucg

SEQ ID NO: 1435900 - RNA, 16 nt, Pseudomonas aeruginosa PA01
ggccucgcugccgccg

SEQ ID NO: 1435901 - RNA, 22 nt, Pseudomonas aeruginosa PA01
ggccucgcugccuggggacggc

SEQ ID NO: 1435902 - RNA, 15 nt, Pseudomonas aeruginosa PA01
ggccucgcugcgcag

SEQ ID NO: 1435903 - RNA, 14 nt, Pseudomonas aeruginosa PA01
ggccucgcggcgcu

SEQ ID NO: 1435904 - RNA, 13 nt, Pseudomonas aeruginosa PA01
ggccucggcgauc

SEQ ID NO: 1435905 - RNA, 14 nt, Pseudomonas aeruginosa PA01
ggccucggcgcggg

SEQ ID NO: 1435906 - RNA, 23 nt, Pseudomonas aeruginosa PA01
ggccucggcgaggaucagucgcu

SEQ ID NO: 1435907 - RNA, 13 nt, Pseudomonas aeruginosa PA01
ggccucgcuggcg

SEQ ID NO: 1435908 - RNA, 11 nt, Pseudomonas aeruginosa PA01
ggccucggcca

SEQ ID NO: 1435909 - RNA, 16 nt, Pseudomonas aeruginosa PA01
ggccucggccagcgcc

SEQ ID NO: 1435910 - RNA, 18 nt, Pseudomonas aeruginosa PA01
ggccucggccagcgccgc

SEQ ID NO: 1435911 - RNA, 19 nt, Pseudomonas aeruginosa PA01
ggccucggccagcgccgcc

SEQ ID NO: 1435912 - RNA, 11 nt, Pseudomonas aeruginosa PA01
ggccucggccu

SEQ ID NO: 1435913 - RNA, 14 nt, Pseudomonas aeruginosa PA01
ggccucggccuggu

SEQ ID NO: 1435914 - RNA, 16 nt, Pseudomonas aeruginosa PA01
ggccucggccuggucg

SEQ ID NO: 1435915 - RNA, 17 nt, Pseudomonas aeruginosa PA01
ggccucggccuggucgu

SEQ ID NO: 1435916 - RNA, 18 nt, Pseudomonas aeruginosa PA01
ggccucggcgaagucgcc

SEQ ID NO: 1435917 - RNA, 20 nt, Pseudomonas aeruginosa PA01
ggccucggcgaagucgccgu

SEQ ID NO: 1435918 - RNA, 21 nt, Pseudomonas aeruginosa PA01
ggccucggcgaagucgccguc

SEQ ID NO: 1435919 - RNA, 18 nt, Pseudomonas aeruginosa PA01
ggccucaggccuggcgca

SEQ ID NO: 1435920 - RNA, 13 nt, Pseudomonas aeruginosa PA01
ggccucgacgcag

SEQ ID NO: 1435921 - RNA, 17 nt, Pseudomonas aeruginosa PA01
ggccucgagguucucga

SEQ ID NO: 1435922 - RNA, 18 nt, Pseudomonas aeruginosa PA01
ggccucgagcaucuccgg

SEQ ID NO: 1435923 - RNA, 22 nt, Pseudomonas aeruginosa PA01
ggccuccugcaacgccuggugc

SEQ ID NO: 1435924 - RNA, 15 nt, Pseudomonas aeruginosa PA01
ggccuccuggcggcg

SEQ ID NO: 1435925 - RNA, 20 nt, Pseudomonas aeruginosa PA01
ggccucgaagaacuccaucu

SEQ ID NO: 1435926 - RNA, 21 nt, Pseudomonas aeruginosa PA01
ggccucgacaucgucucgcga

SEQ ID NO: 1435927 - RNA, 21 nt, Pseudomonas aeruginosa PA01
ggccuacccgcgcuucuucga

SEQ ID NO: 1435928 - RNA, 17 nt, Pseudomonas aeruginosa PA01
ggccuacuugaucagcc

SEQ ID NO: 1435929 - RNA, 20 nt, Pseudomonas aeruginosa PA01
ggccuacuugaucagccgca

SEQ ID NO: 1435930 - RNA, 13 nt, Pseudomonas aeruginosa PA01
ggccgucacggcc

SEQ ID NO: 1435931 - RNA, 23 nt, Pseudomonas aeruginosa PA01
ggccgucacggccuccgguggcg

SEQ ID NO: 1435932 - RNA, 17 nt, Pseudomonas aeruginosa PA01
ggccgucuuccagggcg

SEQ ID NO: 1435933 - RNA, 20 nt, Pseudomonas aeruginosa PA01
ggccgucuuccagggcggcg

SEQ ID NO: 1435934 - RNA, 22 nt, Pseudomonas aeruginosa PA01
ggccgucuuccagggcggcgcg

SEQ ID NO: 1435935 - RNA, 15 nt, Pseudomonas aeruginosa PA01
ggccgugcagcccuc

SEQ ID NO: 1435936 - RNA, 16 nt, Pseudomonas aeruginosa PA01
ggccgugcagcccucg

SEQ ID NO: 1435937 - RNA, 17 nt, Pseudomonas aeruginosa PA01
ggccguaggcgauggcc

SEQ ID NO: 1435938 - RNA, 14 nt, Pseudomonas aeruginosa PA01
ggccguagccgucg

SEQ ID NO: 1435939 - RNA, 14 nt, Pseudomonas aeruginosa PA01
ggccguagcgcucg

SEQ ID NO: 1435940 - RNA, 20 nt, Pseudomonas aeruginosa PA01
ggccguagcgcucgauagcg

SEQ ID NO: 1435941 - RNA, 23 nt, Pseudomonas aeruginosa PA01
ggccguaguucgaaccguggcgg

SEQ ID NO: 1435942 - RNA, 20 nt, Pseudomonas aeruginosa PA01
ggccggugacgaacgaagcg

SEQ ID NO: 1435943 - RNA, 19 nt, Pseudomonas aeruginosa PA01
ggccggugccauacagcgc

SEQ ID NO: 1435944 - RNA, 20 nt, Pseudomonas aeruginosa PA01
ggccggugccauacagcgcc

SEQ ID NO: 1435945 - RNA, 17 nt, Pseudomonas aeruginosa PA01
ggccggugccgcccugg

SEQ ID NO: 1435946 - RNA, 14 nt, Pseudomonas aeruginosa PA01
ggccggugccgccg

SEQ ID NO: 1435947 - RNA, 17 nt, Pseudomonas aeruginosa PA01
ggccggugccgccggcc

SEQ ID NO: 1435948 - RNA, 14 nt, Pseudomonas aeruginosa PA01
ggccggugccuucg

SEQ ID NO: 1435949 - RNA, 22 nt, Pseudomonas aeruginosa PA01
ggccggugccuucggcggcgcc

SEQ ID NO: 1435950 - RNA, 14 nt, Pseudomonas aeruginosa PA01
ggccggugcgaacc

SEQ ID NO: 1435951 - RNA, 20 nt, Pseudomonas aeruginosa PA01
ggccggugcgaaccggccuu

SEQ ID NO: 1435952 - RNA, 16 nt, Pseudomonas aeruginosa PA01
ggcagacaccaccagg

SEQ ID NO: 1435953 - RNA, 15 nt, Pseudomonas aeruginosa PA01
ggcagaccagcagcg

SEQ ID NO: 1435954 - RNA, 23 nt, Pseudomonas aeruginosa PA01
ggcagaccagcgcaagcggcggc

SEQ ID NO: 1435955 - RNA, 14 nt, Pseudomonas aeruginosa PA01
ggcagaccaggccg

SEQ ID NO: 1435956 - RNA, 18 nt, Pseudomonas aeruginosa PA01
ggcagaccaggccgagca

SEQ ID NO: 1435957 - RNA, 12 nt, Pseudomonas aeruginosa PA01
ggcagcaccagg

SEQ ID NO: 1435958 - RNA, 18 nt, Pseudomonas aeruginosa PA01
ggcagcacaugccacgca

SEQ ID NO: 1435959 - RNA, 19 nt, Pseudomonas aeruginosa PA01
ggcagcacaugccacgcac

SEQ ID NO: 1435960 - RNA, 13 nt, Pseudomonas aeruginosa PA01
ggcagcacccgca

SEQ ID NO: 1435961 - RNA, 18 nt, Pseudomonas aeruginosa PA01
ggcagcacgcuggcgucg

SEQ ID NO: 1435962 - RNA, 19 nt, Pseudomonas aeruginosa PA01
ggcagcagccaaccgucgc

SEQ ID NO: 1435963 - RNA, 15 nt, Pseudomonas aeruginosa PA01
ggcagcagcgaacgc

SEQ ID NO: 1435964 - RNA, 17 nt, Pseudomonas aeruginosa PA01
ggcagcagcgaacgccg

SEQ ID NO: 1435965 - RNA, 13 nt, Pseudomonas aeruginosa PA01
ggcagcagcgcca

SEQ ID NO: 1435966 - RNA, 21 nt, Pseudomonas aeruginosa PA01
ggcagcagcgccaggaagccg

SEQ ID NO: 1435967 - RNA, 22 nt, Pseudomonas aeruginosa PA01
ggcagcagcgccaggaagccgc

SEQ ID NO: 1435968 - RNA, 21 nt, Pseudomonas aeruginosa PA01
ggcagcagcggauauucgacg

SEQ ID NO: 1435969 - RNA, 14 nt, Pseudomonas aeruginosa PA01
ggcagcaggccgcc

SEQ ID NO: 1435970 - RNA, 15 nt, Pseudomonas aeruginosa PA01
ggcagcaggccgccg

SEQ ID NO: 1435971 - RNA, 14 nt, Pseudomonas aeruginosa PA01
ggcagcaggcgggc

SEQ ID NO: 1435972 - RNA, 13 nt, Pseudomonas aeruginosa PA01
ggcagcaggcugu

SEQ ID NO: 1435973 - RNA, 13 nt, Pseudomonas aeruginosa PA01
ggcagcaggguca

SEQ ID NO: 1435974 - RNA, 15 nt, Pseudomonas aeruginosa PA01
ggcagcagggucagc

SEQ ID NO: 1435975 - RNA, 20 nt, Pseudomonas aeruginosa PA01
ggcagcagggucagcagcgc

SEQ ID NO: 1435976 - RNA, 19 nt, Pseudomonas aeruginosa PA01
ggcagcagucgcagcucgg

SEQ ID NO: 1435977 - RNA, 13 nt, Pseudomonas aeruginosa PA01
ggcagcaucagcc

SEQ ID NO: 1435978 - RNA, 14 nt, Pseudomonas aeruginosa PA01
ggcagcaucagccg

SEQ ID NO: 1435979 - RNA, 16 nt, Pseudomonas aeruginosa PA01
ggcagcaucagccgcg

SEQ ID NO: 1435980 - RNA, 21 nt, Pseudomonas aeruginosa PA01
ggcagcaucagccgcgacgac

SEQ ID NO: 1435981 - RNA, 21 nt, Pseudomonas aeruginosa PA01
ggcagcaucucggugcgcccc

SEQ ID NO: 1435982 - RNA, 17 nt, Pseudomonas aeruginosa PA01
ggcagcauccguaccag

SEQ ID NO: 1435983 - RNA, 19 nt, Pseudomonas aeruginosa PA01
ggcagccuuggccacggca

SEQ ID NO: 1435984 - RNA, 15 nt, Pseudomonas aeruginosa PA01
ggcagcgaccaccac

SEQ ID NO: 1435985 - RNA, 19 nt, Pseudomonas aeruginosa PA01
ggcagcgaccaccaccagg

SEQ ID NO: 1435986 - RNA, 23 nt, Pseudomonas aeruginosa PA01
ggcagcgaccaccaccaggucgg

SEQ ID NO: 1435987 - RNA, 14 nt, Pseudomonas aeruginosa PA01
ggcagccguuggcg

SEQ ID NO: 1435988 - RNA, 16 nt, Pseudomonas aeruginosa PA01
ggcagcgaucgccgcc

SEQ ID NO: 1435989 - RNA, 13 nt, Pseudomonas aeruginosa PA01
ggcagcgccaggu

SEQ ID NO: 1435990 - RNA, 22 nt, Pseudomonas aeruginosa PA01
ggcagcgccgaggucuuggcca

SEQ ID NO: 1435991 - RNA, 21 nt, Pseudomonas aeruginosa PA01
ggcagcggcgugaagccgccg

SEQ ID NO: 1435992 - RNA, 15 nt, Pseudomonas aeruginosa PA01
ggcagcggcucguca

SEQ ID NO: 1435993 - RNA, 14 nt, Pseudomonas aeruginosa PA01
ggcagcggcuggcc

SEQ ID NO: 1435994 - RNA, 14 nt, Pseudomonas aeruginosa PA01
ggcagcgggccagg

SEQ ID NO: 1435995 - RNA, 18 nt, Pseudomonas aeruginosa PA01
ggcagcgggccaggcggu

SEQ ID NO: 1435996 - RNA, 18 nt, Pseudomonas aeruginosa PA01
ggcagcgccucggcggcg

SEQ ID NO: 1435997 - RNA, 16 nt, Pseudomonas aeruginosa PA01
ggcagcgccgccagca

SEQ ID NO: 1435998 - RNA, 18 nt, Pseudomonas aeruginosa PA01
ggcagcgccgccagcagg

SEQ ID NO: 1435999 - RNA, 13 nt, Pseudomonas aeruginosa PA01
ggcagcgccgcgc

SEQ ID NO: 1436000 - RNA, 14 nt, Pseudomonas aeruginosa PA01
ggcagcgccgcgcg

SEQ ID NO: 1436001 - RNA, 17 nt, Pseudomonas aeruginosa PA01
ggcagcgccgcgcggca

SEQ ID NO: 1436002 - RNA, 15 nt, Pseudomonas aeruginosa PA01
ggcagccgccgcggc

SEQ ID NO: 1436003 - RNA, 16 nt, Pseudomonas aeruginosa PA01
ggcagccgccgcggca

SEQ ID NO: 1436004 - RNA, 18 nt, Pseudomonas aeruginosa PA01
ggcagccgccgcggcacc

SEQ ID NO: 1436005 - RNA, 21 nt, Pseudomonas aeruginosa PA01
ggcagccgccgcggcaccggc

SEQ ID NO: 1436006 - RNA, 18 nt, Pseudomonas aeruginosa PA01
ggcagccccuugagcgcg

SEQ ID NO: 1436007 - RNA, 16 nt, Pseudomonas aeruginosa PA01
ggcagccccuugcgcu

SEQ ID NO: 1436008 - RNA, 22 nt, Pseudomonas aeruginosa PA01
ggcagccccuugcgcucuggcg

SEQ ID NO: 1436009 - RNA, 18 nt, Pseudomonas aeruginosa PA01
ggcagccacucggccagg

SEQ ID NO: 1436010 - RNA, 13 nt, Pseudomonas aeruginosa PA01
ggcagccaccagg

SEQ ID NO: 1436011 - RNA, 15 nt, Pseudomonas aeruginosa PA01
ggcagccagccgccg

SEQ ID NO: 1436012 - RNA, 14 nt, Pseudomonas aeruginosa PA01
ggcagugcgcccuc

SEQ ID NO: 1436013 - RNA, 21 nt, Pseudomonas aeruginosa PA01
ggcagugcgcccucgaacggc

SEQ ID NO: 1436014 - RNA, 15 nt, Pseudomonas aeruginosa PA01
ggcagugcgccggca

SEQ ID NO: 1436015 - RNA, 23 nt, Pseudomonas aeruginosa PA01
ggcagucccugccaggggcuagu

SEQ ID NO: 1436016 - RNA, 21 nt, Pseudomonas aeruginosa PA01
ggcaguccuugagcgccagca

SEQ ID NO: 1436017 - RNA, 22 nt, Pseudomonas aeruginosa PA01
ggcagucccagaaggccagggc

SEQ ID NO: 1436018 - RNA, 16 nt, Pseudomonas aeruginosa PA01
ggcagucgccgcaccg

SEQ ID NO: 1436019 - RNA, 14 nt, Pseudomonas aeruginosa PA01
ggcagucgccgcca

SEQ ID NO: 1436020 - RNA, 18 nt, Pseudomonas aeruginosa PA01
ggcagucgucgcagccga

SEQ ID NO: 1436021 - RNA, 19 nt, Pseudomonas aeruginosa PA01
ggcagguagaccucgaugu

SEQ ID NO: 1436022 - RNA, 21 nt, Pseudomonas aeruginosa PA01
ggcagguagaccucgaugucc

SEQ ID NO: 1436023 - RNA, 16 nt, Pseudomonas aeruginosa PA01
ggcaggguggcgcaug

SEQ ID NO: 1436024 - RNA, 15 nt, Pseudomonas aeruginosa PA01
ggcagggugucgacg

SEQ ID NO: 1436025 - RNA, 20 nt, Pseudomonas aeruginosa PA01
ggcagggugucgacgacagu

SEQ ID NO: 1436026 - RNA, 16 nt, Pseudomonas aeruginosa PA01
ggcaggguagccacgc

SEQ ID NO: 1436027 - RNA, 13 nt, Pseudomonas aeruginosa PA01
ggcagggucagcc

SEQ ID NO: 1436028 - RNA, 15 nt, Pseudomonas aeruginosa PA01
ggcagcggucgccgg

SEQ ID NO: 1436029 - RNA, 20 nt, Pseudomonas aeruginosa PA01
ggcagcgguucgcccgcggg

SEQ ID NO: 1436030 - RNA, 16 nt, Pseudomonas aeruginosa PA01
ggcagcgucucagccc

SEQ ID NO: 1436031 - RNA, 22 nt, Pseudomonas aeruginosa PA01
ggcagcgucucggcugccgcca

SEQ ID NO: 1436032 - RNA, 14 nt, Pseudomonas aeruginosa PA01
ggcagcgucgccgg

SEQ ID NO: 1436033 - RNA, 18 nt, Pseudomonas aeruginosa PA01
ggcagcgucgccgggcgu

SEQ ID NO: 1436034 - RNA, 19 nt, Pseudomonas aeruginosa PA01
ggcagcgucgccgggcgua

SEQ ID NO: 1436035 - RNA, 17 nt, Pseudomonas aeruginosa PA01
ggcagcguccgaacgcg

SEQ ID NO: 1436036 - RNA, 20 nt, Pseudomonas aeruginosa PA01
ggcagcguccgaacgcgcug

SEQ ID NO: 1436037 - RNA, 23 nt, Pseudomonas aeruginosa PA01
ggcagcguccgaacgcgcugacg

SEQ ID NO: 1436038 - RNA, 20 nt, Pseudomonas aeruginosa PA01
ggcagcgucgagcuggcgca

SEQ ID NO: 1436039 - RNA, 19 nt, Pseudomonas aeruginosa PA01
ggcagcucauaggucaggu

SEQ ID NO: 1436040 - RNA, 21 nt, Pseudomonas aeruginosa PA01
ggcagcucauaggucagguac

SEQ ID NO: 1436041 - RNA, 15 nt, Pseudomonas aeruginosa PA01
ggcaggcugcgccgc

SEQ ID NO: 1436042 - RNA, 15 nt, Pseudomonas aeruginosa PA01
ggcaggcucaccgcg

SEQ ID NO: 1436043 - RNA, 14 nt, Pseudomonas aeruginosa PA01
ggcaggcucagcgc

SEQ ID NO: 1436044 - RNA, 15 nt, Pseudomonas aeruginosa PA01
ggcaggcucagcgca

SEQ ID NO: 1436045 - RNA, 14 nt, Pseudomonas aeruginosa PA01
ggcagggcagccgc

SEQ ID NO: 1436046 - RNA, 16 nt, Pseudomonas aeruginosa PA01
ggcagggcagccgccg

SEQ ID NO: 1436047 - RNA, 21 nt, Pseudomonas aeruginosa PA01
ggcagggcagccgccgcggca

SEQ ID NO: 1436048 - RNA, 19 nt, Pseudomonas aeruginosa PA01
ggcaggcugugccauuccu

SEQ ID NO: 1436049 - RNA, 15 nt, Pseudomonas aeruginosa PA01
ggcagggaguccgcc

SEQ ID NO: 1436050 - RNA, 18 nt, Pseudomonas aeruginosa PA01
ggcagggaguccgccagc

SEQ ID NO: 1436051 - RNA, 13 nt, Pseudomonas aeruginosa PA01
ggcagggaucacg

SEQ ID NO: 1436052 - RNA, 19 nt, Pseudomonas aeruginosa PA01
ggcagggccucgggcggga

SEQ ID NO: 1436053 - RNA, 15 nt, Pseudomonas aeruginosa PA01
ggcagggcgauccgc

SEQ ID NO: 1436054 - RNA, 20 nt, Pseudomonas aeruginosa PA01
ggcauccccggaccagggcg

SEQ ID NO: 1436055 - RNA, 12 nt, Pseudomonas aeruginosa PA01
ggcaucccgccc

SEQ ID NO: 1436056 - RNA, 20 nt, Pseudomonas aeruginosa PA01
ggcaucccgcccggucucag

SEQ ID NO: 1436057 - RNA, 23 nt, Pseudomonas aeruginosa PA01
ggcauccagcauccgugcgaaca

SEQ ID NO: 1436058 - RNA, 15 nt, Pseudomonas aeruginosa PA01
ggcauccagcggacg

SEQ ID NO: 1436059 - RNA, 16 nt, Pseudomonas aeruginosa PA01
ggcauccagcggacgc

SEQ ID NO: 1436060 - RNA, 15 nt, Pseudomonas aeruginosa PA01
ggcauccggcaggcg

SEQ ID NO: 1436061 - RNA, 15 nt, Pseudomonas aeruginosa PA01
ggcauccuggcgguu

SEQ ID NO: 1436062 - RNA, 17 nt, Pseudomonas aeruginosa PA01
ggcauccuguggcugca

SEQ ID NO: 1436063 - RNA, 16 nt, Pseudomonas aeruginosa PA01
ggcaucgauccgcacc

SEQ ID NO: 1436064 - RNA, 17 nt, Pseudomonas aeruginosa PA01
ggcaucgaccagggccg

SEQ ID NO: 1436065 - RNA, 19 nt, Pseudomonas aeruginosa PA01
ggcaucgaccagggccggg

SEQ ID NO: 1436066 - RNA, 16 nt, Pseudomonas aeruginosa PA01
ggcaucgaccaugccg

SEQ ID NO: 1436067 - RNA, 19 nt, Pseudomonas aeruginosa PA01
ggcaucgccauggcgcugc

SEQ ID NO: 1436068 - RNA, 13 nt, Pseudomonas aeruginosa PA01
ggcaucgccgaca

SEQ ID NO: 1436069 - RNA, 12 nt, Pseudomonas aeruginosa PA01
ggcaucgccgcc

SEQ ID NO: 1436070 - RNA, 13 nt, Pseudomonas aeruginosa PA01
ggcaucgccgccc

SEQ ID NO: 1436071 - RNA, 17 nt, Pseudomonas aeruginosa PA01
ggcagugugcaccgagu

SEQ ID NO: 1436072 - RNA, 16 nt, Pseudomonas aeruginosa PA01
ggcauaggcgccagcc

SEQ ID NO: 1436073 - RNA, 17 nt, Pseudomonas aeruginosa PA01
ggcaucaugccgagcau

SEQ ID NO: 1436074 - RNA, 23 nt, Pseudomonas aeruginosa PA01
ggcauauggaucggccucgcggc

SEQ ID NO: 1436075 - RNA, 24 nt, Pseudomonas aeruginosa PA01
ggcauauggaucggccucgcggcg

SEQ ID NO: 1436076 - RNA, 11 nt, Pseudomonas aeruginosa PA01
ggcaucagccc

SEQ ID NO: 1436077 - RNA, 19 nt, Pseudomonas aeruginosa PA01
ggcaucagccccucggcca

SEQ ID NO: 1436078 - RNA, 17 nt, Pseudomonas aeruginosa PA01
ggcaucaguagcgggca

SEQ ID NO: 1436079 - RNA, 18 nt, Pseudomonas aeruginosa PA01
ggcaucaguagcgggcau

SEQ ID NO: 1436080 - RNA, 22 nt, Pseudomonas aeruginosa PA01
ggcaacaccaucggccccaccg

SEQ ID NO: 1436081 - RNA, 17 nt, Pseudomonas aeruginosa PA01
ggcaacagcccgcgccg

SEQ ID NO: 1436082 - RNA, 19 nt, Pseudomonas aeruginosa PA01
ggaucgagcagcggcgcca

SEQ ID NO: 1436083 - RNA, 16 nt, Pseudomonas aeruginosa PA01
ggaucgagccagcgcu

SEQ ID NO: 1436084 - RNA, 17 nt, Pseudomonas aeruginosa PA01
ggaucgagccagcgcuc

SEQ ID NO: 1436085 - RNA, 18 nt, Pseudomonas aeruginosa PA01
ggaucgacagcagcgcca

SEQ ID NO: 1436086 - RNA, 19 nt, Pseudomonas aeruginosa PA01
ggaucgacagcagcgccag

SEQ ID NO: 1436087 - RNA, 16 nt, Pseudomonas aeruginosa PA01
ggcaagcugcacggcg

SEQ ID NO: 1436088 - RNA, 23 nt, Pseudomonas aeruginosa PA01
ggcaaggccaagucggccgccca

SEQ ID NO: 1436089 - RNA, 13 nt, Pseudomonas aeruginosa PA01
ggcaaggcggccu

SEQ ID NO: 1436090 - RNA, 22 nt, Pseudomonas aeruginosa PA01
ggcaacgcgcccacuccuccgc

SEQ ID NO: 1436091 - RNA, 17 nt, Pseudomonas aeruginosa PA01
ggcaacugaucagccgg

SEQ ID NO: 1436092 - RNA, 20 nt, Pseudomonas aeruginosa PA01
ggcaacugaucagccgggcg

SEQ ID NO: 1436093 - RNA, 21 nt, Pseudomonas aeruginosa PA01
ggcaagcuccgcgaugucccc

SEQ ID NO: 1436094 - RNA, 16 nt, Pseudomonas aeruginosa PA01
ggcaagcucgacgagc

SEQ ID NO: 1436095 - RNA, 14 nt, Pseudomonas aeruginosa PA01
ggcaacgucaggcu

SEQ ID NO: 1436096 - RNA, 16 nt, Pseudomonas aeruginosa PA01
ggcaacgucaggcugu

SEQ ID NO: 1436097 - RNA, 14 nt, Pseudomonas aeruginosa PA01
ggcaacggagcugg

SEQ ID NO: 1436098 - RNA, 19 nt, Pseudomonas aeruginosa PA01
ggcaacggagcugguacgc

SEQ ID NO: 1436099 - RNA, 14 nt, Pseudomonas aeruginosa PA01
ggcaaucaggcgcg

SEQ ID NO: 1436100 - RNA, 19 nt, Pseudomonas aeruginosa PA01
ggcaaggucgucucagacc

SEQ ID NO: 1436101 - RNA, 22 nt, Pseudomonas aeruginosa PA01
ggcaagguaguccaucaccgcg

SEQ ID NO: 1436102 - RNA, 22 nt, Pseudomonas aeruginosa PA01
ggcaagggcacgugcagcggca

SEQ ID NO: 1436103 - RNA, 15 nt, Pseudomonas aeruginosa PA01
ggcacacgucggcau

SEQ ID NO: 1436104 - RNA, 18 nt, Pseudomonas aeruginosa PA01
ggcacaaaaaaggcggau

SEQ ID NO: 1436105 - RNA, 19 nt, Pseudomonas aeruginosa PA01
ggcaccgucgagcaccagg

SEQ ID NO: 1436106 - RNA, 23 nt, Pseudomonas aeruginosa PA01
ggcaccgucgagcaccaggcggu

SEQ ID NO: 1436107 - RNA, 18 nt, Pseudomonas aeruginosa PA01
ggcacgccgaaguccugc

SEQ ID NO: 1436108 - RNA, 17 nt, Pseudomonas aeruginosa PA01
ggcacgccgcucugccc

SEQ ID NO: 1436109 - RNA, 18 nt, Pseudomonas aeruginosa PA01
ggcacgccgguggccagg

SEQ ID NO: 1436110 - RNA, 22 nt, Pseudomonas aeruginosa PA01
ggcacgccccauccgggcggcg

SEQ ID NO: 1436111 - RNA, 15 nt, Pseudomonas aeruginosa PA01
ggcacgaugcugaac

SEQ ID NO: 1436112 - RNA, 14 nt, Pseudomonas aeruginosa PA01
ggcacgaucugcgc

SEQ ID NO: 1436113 - RNA, 20 nt, Pseudomonas aeruginosa PA01
ggcacgaucugcgccgcaag

SEQ ID NO: 1436114 - RNA, 13 nt, Pseudomonas aeruginosa PA01
ggcacgcagggcu

SEQ ID NO: 1436115 - RNA, 12 nt, Pseudomonas aeruginosa PA01
ggcacgguagcc

SEQ ID NO: 1436116 - RNA, 19 nt, Pseudomonas aeruginosa PA01
ggcacguacguccagggca

SEQ ID NO: 1436117 - RNA, 16 nt, Pseudomonas aeruginosa PA01
ggcacgugcagcggca

SEQ ID NO: 1436118 - RNA, 22 nt, Pseudomonas aeruginosa PA01
ggcacuuccuuggugaucaccg

SEQ ID NO: 1436119 - RNA, 19 nt, Pseudomonas aeruginosa PA01
ggcacuucguccaggccgc

SEQ ID NO: 1436120 - RNA, 20 nt, Pseudomonas aeruginosa PA01
ggcacuucguccaggccgcc

SEQ ID NO: 1436121 - RNA, 22 nt, Pseudomonas aeruginosa PA01
ggcacuucguccaggccgccua

SEQ ID NO: 1436122 - RNA, 18 nt, Pseudomonas aeruginosa PA01
ggcagaaaaacccagcgu

SEQ ID NO: 1436123 - RNA, 14 nt, Pseudomonas aeruginosa PA01
ggcagaacacccgg

SEQ ID NO: 1436124 - RNA, 22 nt, Pseudomonas aeruginosa PA01
ggcagaacaucgcccauugccg

SEQ ID NO: 1436125 - RNA, 13 nt, Pseudomonas aeruginosa PA01
ggcaccagcgcgu

SEQ ID NO: 1436126 - RNA, 19 nt, Pseudomonas aeruginosa PA01
ggcacccgguugaccccgc

SEQ ID NO: 1436127 - RNA, 22 nt, Pseudomonas aeruginosa PA01
ggcacccgguugaccccgcggg

SEQ ID NO: 1436128 - RNA, 13 nt, Pseudomonas aeruginosa PA01
ggcacccggcugg

SEQ ID NO: 1436129 - RNA, 11 nt, Pseudomonas aeruginosa PA01
ggcaccaccgc

SEQ ID NO: 1436130 - RNA, 14 nt, Pseudomonas aeruginosa PA01
ggcaccaccgccgc

SEQ ID NO: 1436131 - RNA, 15 nt, Pseudomonas aeruginosa PA01
ggcaccaccgccgcc

SEQ ID NO: 1436132 - RNA, 14 nt, Pseudomonas aeruginosa PA01
ggcaccggccaggc

SEQ ID NO: 1436133 - RNA, 21 nt, Pseudomonas aeruginosa PA01
ggcaccggccaggcgcugguc

SEQ ID NO: 1436134 - RNA, 15 nt, Pseudomonas aeruginosa PA01
ggcaccguaggccag

SEQ ID NO: 1436135 - RNA, 18 nt, Pseudomonas aeruginosa PA01
ggcaccguaggccaggca

SEQ ID NO: 1436136 - RNA, 18 nt, Pseudomonas aeruginosa PA01
ggcaccgucaagggccag

SEQ ID NO: 1436137 - RNA, 12 nt, Pseudomonas aeruginosa PA01
ggcacccugacc

SEQ ID NO: 1436138 - RNA, 22 nt, Pseudomonas aeruginosa PA01
ggcacccugaccgcgagcgccg

SEQ ID NO: 1436139 - RNA, 23 nt, Pseudomonas aeruginosa PA01
ggcacccugaccgcgagcgccgc

SEQ ID NO: 1436140 - RNA, 14 nt, Pseudomonas aeruginosa PA01
ggcacccuggaccc

SEQ ID NO: 1436141 - RNA, 23 nt, Pseudomonas aeruginosa PA01
ggcaccgaagcugaggccggugu

SEQ ID NO: 1436142 - RNA, 20 nt, Pseudomonas aeruginosa PA01
ggccaucuggcugccgaggg

SEQ ID NO: 1436143 - RNA, 13 nt, Pseudomonas aeruginosa PA01
ggccaucuucucg

SEQ ID NO: 1436144 - RNA, 21 nt, Pseudomonas aeruginosa PA01
ggccaugaugugcgcaggcug

SEQ ID NO: 1436145 - RNA, 22 nt, Pseudomonas aeruginosa PA01
ggccaugaugugcgcaggcugg

SEQ ID NO: 1436146 - RNA, 17 nt, Pseudomonas aeruginosa PA01
ggccaugaucaucgccu

SEQ ID NO: 1436147 - RNA, 18 nt, Pseudomonas aeruginosa PA01
ggccaugagcagggcgga

SEQ ID NO: 1436148 - RNA, 19 nt, Pseudomonas aeruginosa PA01
ggccaugagcagggcggau

SEQ ID NO: 1436149 - RNA, 22 nt, Pseudomonas aeruginosa PA01
ggccaugccggccaggaaggcc

SEQ ID NO: 1436150 - RNA, 15 nt, Pseudomonas aeruginosa PA01
ggccaugccgccgac

SEQ ID NO: 1436151 - RNA, 18 nt, Pseudomonas aeruginosa PA01
ggccauggcgcuugcgca

SEQ ID NO: 1436152 - RNA, 15 nt, Pseudomonas aeruginosa PA01
ggccaugggcacgcc

SEQ ID NO: 1436153 - RNA, 16 nt, Pseudomonas aeruginosa PA01
ggccaugggcacgccg

SEQ ID NO: 1436154 - RNA, 16 nt, Pseudomonas aeruginosa PA01
ggccaugaucuggcug

SEQ ID NO: 1436155 - RNA, 15 nt, Pseudomonas aeruginosa PA01
ggccauggcagagcu

SEQ ID NO: 1436156 - RNA, 23 nt, Pseudomonas aeruginosa PA01
ggccauggcagagcuggaagucg

SEQ ID NO: 1436157 - RNA, 20 nt, Pseudomonas aeruginosa PA01
ggccauggccgagcccagcg

SEQ ID NO: 1436158 - RNA, 14 nt, Pseudomonas aeruginosa PA01
ggcccaagccgagc

SEQ ID NO: 1436159 - RNA, 17 nt, Pseudomonas aeruginosa PA01
ggcccaagccgagcggc

SEQ ID NO: 1436160 - RNA, 19 nt, Pseudomonas aeruginosa PA01
ggcccaagccgagcggcaa

SEQ ID NO: 1436161 - RNA, 19 nt, Pseudomonas aeruginosa PA01
ggcccaauccgcgccggug

SEQ ID NO: 1436162 - RNA, 15 nt, Pseudomonas aeruginosa PA01
ggccaugggugucgg

SEQ ID NO: 1436163 - RNA, 20 nt, Pseudomonas aeruginosa PA01
ggccaugggugucggcgauc

SEQ ID NO: 1436164 - RNA, 13 nt, Pseudomonas aeruginosa PA01
ggccaugucccgg

SEQ ID NO: 1436165 - RNA, 15 nt, Pseudomonas aeruginosa PA01
ggccauuacgccgag

SEQ ID NO: 1436166 - RNA, 17 nt, Pseudomonas aeruginosa PA01
ggccauugaaggccgac

SEQ ID NO: 1436167 - RNA, 21 nt, Pseudomonas aeruginosa PA01
ggccauucgcuucggccacca

SEQ ID NO: 1436168 - RNA, 14 nt, Pseudomonas aeruginosa PA01
ggccauucggccug

SEQ ID NO: 1436169 - RNA, 15 nt, Pseudomonas aeruginosa PA01
ggccauucggccugg

SEQ ID NO: 1436170 - RNA, 18 nt, Pseudomonas aeruginosa PA01
ggcccagcguucggcgcu

SEQ ID NO: 1436171 - RNA, 21 nt, Pseudomonas aeruginosa PA01
ggcccagcguucggcgcuggc

SEQ ID NO: 1436172 - RNA, 16 nt, Pseudomonas aeruginosa PA01
ggcccagcgcggcgcc

SEQ ID NO: 1436173 - RNA, 18 nt, Pseudomonas aeruginosa PA01
ggcccagcgcggcgcccc

SEQ ID NO: 1436174 - RNA, 13 nt, Pseudomonas aeruginosa PA01
ggcccagcgcccc

SEQ ID NO: 1436175 - RNA, 20 nt, Pseudomonas aeruginosa PA01
ggcccagccauugcgccagg

SEQ ID NO: 1436176 - RNA, 18 nt, Pseudomonas aeruginosa PA01
ggcccagccgcggcgcca

SEQ ID NO: 1436177 - RNA, 21 nt, Pseudomonas aeruginosa PA01
ggcccagccgcggcgccacgc

SEQ ID NO: 1436178 - RNA, 15 nt, Pseudomonas aeruginosa PA01
ggcccaggcuggcgg

SEQ ID NO: 1436179 - RNA, 13 nt, Pseudomonas aeruginosa PA01
ggcccaggccggg

SEQ ID NO: 1436180 - RNA, 19 nt, Pseudomonas aeruginosa PA01
ggcccagcgccccgccuac

SEQ ID NO: 1436181 - RNA, 22 nt, Pseudomonas aeruginosa PA01
ggcccagcuucuuggcccggug

SEQ ID NO: 1436182 - RNA, 13 nt, Pseudomonas aeruginosa PA01
ggcccagcagcgc

SEQ ID NO: 1436183 - RNA, 21 nt, Pseudomonas aeruginosa PA01
ggcccagaugaucaggccgag

SEQ ID NO: 1436184 - RNA, 15 nt, Pseudomonas aeruginosa PA01
ggcccagcaggccgg

SEQ ID NO: 1436185 - RNA, 16 nt, Pseudomonas aeruginosa PA01
ggcccagcaggccggc

SEQ ID NO: 1436186 - RNA, 14 nt, Pseudomonas aeruginosa PA01
ggcccacgggcggc

SEQ ID NO: 1436187 - RNA, 23 nt, Pseudomonas aeruginosa PA01
ggcccacgggcggccgacgugca

SEQ ID NO: 1436188 - RNA, 17 nt, Pseudomonas aeruginosa PA01
ggcccagagcagcacca

SEQ ID NO: 1436189 - RNA, 22 nt, Pseudomonas aeruginosa PA01
ggcccagauauccagggccagg

SEQ ID NO: 1436190 - RNA, 22 nt, Pseudomonas aeruginosa PA01
ggccaguugcgcuccgguggcg

SEQ ID NO: 1436191 - RNA, 17 nt, Pseudomonas aeruginosa PA01
ggccauccagccaggcg

SEQ ID NO: 1436192 - RNA, 18 nt, Pseudomonas aeruginosa PA01
ggccauccagccaggcgc

SEQ ID NO: 1436193 - RNA, 16 nt, Pseudomonas aeruginosa PA01
ggccauccccgaggcg

SEQ ID NO: 1436194 - RNA, 17 nt, Pseudomonas aeruginosa PA01
ggccauccccgaggcga

SEQ ID NO: 1436195 - RNA, 19 nt, Pseudomonas aeruginosa PA01
ggccauccccgaggcgacg

SEQ ID NO: 1436196 - RNA, 21 nt, Pseudomonas aeruginosa PA01
ggccauccccgaggcgacgcc

SEQ ID NO: 1436197 - RNA, 22 nt, Pseudomonas aeruginosa PA01
ggccauccccgaggcgacgccc

SEQ ID NO: 1436198 - RNA, 21 nt, Pseudomonas aeruginosa PA01
ggccauccauaucggccaccg

SEQ ID NO: 1436199 - RNA, 20 nt, Pseudomonas aeruginosa PA01
ggccaucgagcgcuccaccg

SEQ ID NO: 1436200 - RNA, 19 nt, Pseudomonas aeruginosa PA01
ggccaucgaaaucgcccac

SEQ ID NO: 1436201 - RNA, 23 nt, Pseudomonas aeruginosa PA01
ggccaucgaaaucgcccaccagg

SEQ ID NO: 1436202 - RNA, 13 nt, Pseudomonas aeruginosa PA01
ggccaucgccggc

SEQ ID NO: 1436203 - RNA, 22 nt, Pseudomonas aeruginosa PA01
ggccaucgccggcccgcgcggc

SEQ ID NO: 1436204 - RNA, 16 nt, Pseudomonas aeruginosa PA01
ggccaguuggugcacg

SEQ ID NO: 1436205 - RNA, 15 nt, Pseudomonas aeruginosa PA01
ggccaguugcaccgc

SEQ ID NO: 1436206 - RNA, 16 nt, Pseudomonas aeruginosa PA01
ggccaguugcaccgca

SEQ ID NO: 1436207 - RNA, 22 nt, Pseudomonas aeruginosa PA01
ggccaguucgucgagcaugccg

SEQ ID NO: 1436208 - RNA, 17 nt, Pseudomonas aeruginosa PA01
ggccaguucgcggcgca

SEQ ID NO: 1436209 - RNA, 23 nt, Pseudomonas aeruginosa PA01
ggccaguuccaugucgcuggccu

SEQ ID NO: 1436210 - RNA, 11 nt, Pseudomonas aeruginosa PA01
ggccaguucga

SEQ ID NO: 1436211 - RNA, 22 nt, Pseudomonas aeruginosa PA01
ggccaguucggggucggccugc

SEQ ID NO: 1436212 - RNA, 18 nt, Pseudomonas aeruginosa PA01
ggccauaccuccagccag

SEQ ID NO: 1436213 - RNA, 13 nt, Pseudomonas aeruginosa PA01
ggccauagcgcgc

SEQ ID NO: 1436214 - RNA, 15 nt, Pseudomonas aeruginosa PA01
ggccaucaggcgcug

SEQ ID NO: 1436215 - RNA, 14 nt, Pseudomonas aeruginosa PA01
ggccaucagggcga

SEQ ID NO: 1436216 - RNA, 19 nt, Pseudomonas aeruginosa PA01
ggccaucagggucggcccg

SEQ ID NO: 1436217 - RNA, 14 nt, Pseudomonas aeruginosa PA01
ggccaucagcgccg

SEQ ID NO: 1436218 - RNA, 15 nt, Pseudomonas aeruginosa PA01
ggccaucagcgccgc

SEQ ID NO: 1436219 - RNA, 22 nt, Pseudomonas aeruginosa PA01
ggccagcuuggucgggauggcg

SEQ ID NO: 1436220 - RNA, 20 nt, Pseudomonas aeruginosa PA01
ggccagggaaaagcccaggu

SEQ ID NO: 1436221 - RNA, 18 nt, Pseudomonas aeruginosa PA01
ggccaggaaaucgagcgc

SEQ ID NO: 1436222 - RNA, 18 nt, Pseudomonas aeruginosa PA01
ggccagggaggcgcuggc

SEQ ID NO: 1436223 - RNA, 16 nt, Pseudomonas aeruginosa PA01
ggccagggagucgcug

SEQ ID NO: 1436224 - RNA, 21 nt, Pseudomonas aeruginosa PA01
ggccagggauuccuuggucag

SEQ ID NO: 1436225 - RNA, 17 nt, Pseudomonas aeruginosa PA01
ggccagggcgaggauca

SEQ ID NO: 1436226 - RNA, 20 nt, Pseudomonas aeruginosa PA01
ggccagggcgaggaucacgc

SEQ ID NO: 1436227 - RNA, 19 nt, Pseudomonas aeruginosa PA01
ggccagggcgaacagcgcc

SEQ ID NO: 1436228 - RNA, 13 nt, Pseudomonas aeruginosa PA01
ggccagggcggcg

SEQ ID NO: 1436229 - RNA, 15 nt, Pseudomonas aeruginosa PA01
ggccagggcggcgcc

SEQ ID NO: 1436230 - RNA, 19 nt, Pseudomonas aeruginosa PA01
ggccagguacuuggccacg

SEQ ID NO: 1436231 - RNA, 22 nt, Pseudomonas aeruginosa PA01
ggccagguacuuggccacgccu

SEQ ID NO: 1436232 - RNA, 15 nt, Pseudomonas aeruginosa PA01
ggccagguagcggac

SEQ ID NO: 1436233 - RNA, 14 nt, Pseudomonas aeruginosa PA01
ggccagguaggcga

SEQ ID NO: 1436234 - RNA, 15 nt, Pseudomonas aeruginosa PA01
ggccagguaccggcc

SEQ ID NO: 1436235 - RNA, 21 nt, Pseudomonas aeruginosa PA01
ggccagguaccggccaggcgg

SEQ ID NO: 1436236 - RNA, 22 nt, Pseudomonas aeruginosa PA01
ggccagguaccggccaggcggu

SEQ ID NO: 1436237 - RNA, 22 nt, Pseudomonas aeruginosa PA01
ggccaggguccgcuucagcgcg

SEQ ID NO: 1436238 - RNA, 19 nt, Pseudomonas aeruginosa PA01
ggccagggucgccagcagg

SEQ ID NO: 1436239 - RNA, 20 nt, Pseudomonas aeruginosa PA01
ggccagggucgccagcaggu

SEQ ID NO: 1436240 - RNA, 20 nt, Pseudomonas aeruginosa PA01
ggccaggggcugaacagcgc

SEQ ID NO: 1436241 - RNA, 16 nt, Pseudomonas aeruginosa PA01
ggccagggggccuggc

SEQ ID NO: 1436242 - RNA, 22 nt, Pseudomonas aeruginosa PA01
ggccagggggccuggcucgauc

SEQ ID NO: 1436243 - RNA, 17 nt, Pseudomonas aeruginosa PA01
ggccagggcguugcucg

SEQ ID NO: 1436244 - RNA, 15 nt, Pseudomonas aeruginosa PA01
ggccaggggagcgcc

SEQ ID NO: 1436245 - RNA, 18 nt, Pseudomonas aeruginosa PA01
ggccaggggagcgccggc

SEQ ID NO: 1436246 - RNA, 19 nt, Pseudomonas aeruginosa PA01
ggccaggggagcgccggcg

SEQ ID NO: 1436247 - RNA, 22 nt, Pseudomonas aeruginosa PA01
ggccaggggagcgccggcgcgg

SEQ ID NO: 1436248 - RNA, 23 nt, Pseudomonas aeruginosa PA01
ggccaggggagcgccggcgcggu

SEQ ID NO: 1436249 - RNA, 17 nt, Pseudomonas aeruginosa PA01
ggccagucgcguuggcc

SEQ ID NO: 1436250 - RNA, 19 nt, Pseudomonas aeruginosa PA01
ggccaguccggcaccgcuc

SEQ ID NO: 1436251 - RNA, 21 nt, Pseudomonas aeruginosa PA01
ggccaggucguugcgccggcc

SEQ ID NO: 1436252 - RNA, 16 nt, Pseudomonas aeruginosa PA01
ggccaggucgcccacc

SEQ ID NO: 1436253 - RNA, 17 nt, Pseudomonas aeruginosa PA01
ggccaggucgcccaccu

SEQ ID NO: 1436254 - RNA, 15 nt, Pseudomonas aeruginosa PA01
ggccaggucgcgcag

SEQ ID NO: 1436255 - RNA, 21 nt, Pseudomonas aeruginosa PA01
ggccaggucgcgcagggccag

SEQ ID NO: 1436256 - RNA, 11 nt, Pseudomonas aeruginosa PA01
ggccaggucgg

SEQ ID NO: 1436257 - RNA, 15 nt, Pseudomonas aeruginosa PA01
ggccacuucccggcg

SEQ ID NO: 1436258 - RNA, 20 nt, Pseudomonas aeruginosa PA01
ggccagcaaugcccgcgccu

SEQ ID NO: 1436259 - RNA, 20 nt, Pseudomonas aeruginosa PA01
ggccacuucguccggccgcc

SEQ ID NO: 1436260 - RNA, 14 nt, Pseudomonas aeruginosa PA01
ggccagcagcacgc

SEQ ID NO: 1436261 - RNA, 16 nt, Pseudomonas aeruginosa PA01
ggccagcagcacggcg

SEQ ID NO: 1436262 - RNA, 21 nt, Pseudomonas aeruginosa PA01
ggccagcagcaugggauggcg

SEQ ID NO: 1436263 - RNA, 22 nt, Pseudomonas aeruginosa PA01
ggccagcagguagccugcggcc

SEQ ID NO: 1436264 - RNA, 24 nt, Pseudomonas aeruginosa PA01
ggccagcagguagccugcggccag

SEQ ID NO: 1436265 - RNA, 22 nt, Pseudomonas aeruginosa PA01
ggccagcaggguggccaggguc

SEQ ID NO: 1436266 - RNA, 15 nt, Pseudomonas aeruginosa PA01
ggccagccagagcca

SEQ ID NO: 1436267 - RNA, 15 nt, Pseudomonas aeruginosa PA01
ggccagccagggcag

SEQ ID NO: 1436268 - RNA, 19 nt, Pseudomonas aeruginosa PA01
ggccagccagggcagcagg

SEQ ID NO: 1436269 - RNA, 19 nt, Pseudomonas aeruginosa PA01
ggccagcgcuuccaccgcc

SEQ ID NO: 1436270 - RNA, 22 nt, Pseudomonas aeruginosa PA01
ggccagcgcuuccaccgccugc

SEQ ID NO: 1436271 - RNA, 15 nt, Pseudomonas aeruginosa PA01
ggccagcgcuucgcg

SEQ ID NO: 1436272 - RNA, 16 nt, Pseudomonas aeruginosa PA01
ggccagcgcuucgcga

SEQ ID NO: 1436273 - RNA, 20 nt, Pseudomonas aeruginosa PA01
ggccagcggaugcuggcgga

SEQ ID NO: 1436274 - RNA, 14 nt, Pseudomonas aeruginosa PA01
ggccagcucgccga

SEQ ID NO: 1436275 - RNA, 13 nt, Pseudomonas aeruginosa PA01
ggccagcuugucg

SEQ ID NO: 1436276 - RNA, 14 nt, Pseudomonas aeruginosa PA01
ggccagcuugucgg

SEQ ID NO: 1436277 - RNA, 18 nt, Pseudomonas aeruginosa PA01
ggccagcuugucggccuu

SEQ ID NO: 1436278 - RNA, 20 nt, Pseudomonas aeruginosa PA01
ggccagcuugucggccuugg

SEQ ID NO: 1436279 - RNA, 19 nt, Pseudomonas aeruginosa PA01
ggccagcuuccaggcgcgc

SEQ ID NO: 1436280 - RNA, 21 nt, Pseudomonas aeruginosa PA01
ggccagcuuccaggcgcgcug

SEQ ID NO: 1436281 - RNA, 14 nt, Pseudomonas aeruginosa PA01
ggccagcucgucgc

SEQ ID NO: 1436282 - RNA, 14 nt, Pseudomonas aeruginosa PA01
ggccagcucgccgg

SEQ ID NO: 1436283 - RNA, 16 nt, Pseudomonas aeruginosa PA01
ggccagcucgccgguc

SEQ ID NO: 1436284 - RNA, 13 nt, Pseudomonas aeruginosa PA01
ggccagcucgucg

SEQ ID NO: 1436285 - RNA, 15 nt, Pseudomonas aeruginosa PA01
ggccagcgcggcgcg

SEQ ID NO: 1436286 - RNA, 16 nt, Pseudomonas aeruginosa PA01
ggccagcgcggcgcgc

SEQ ID NO: 1436287 - RNA, 18 nt, Pseudomonas aeruginosa PA01
ggccagcgcggcgcgcug

SEQ ID NO: 1436288 - RNA, 19 nt, Pseudomonas aeruginosa PA01
ggccagcgcggcgcggaca

SEQ ID NO: 1436289 - RNA, 15 nt, Pseudomonas aeruginosa PA01
ggccagcgcggccgc

SEQ ID NO: 1436290 - RNA, 19 nt, Pseudomonas aeruginosa PA01
ggccagcgcggccgccgcc

SEQ ID NO: 1436291 - RNA, 15 nt, Pseudomonas aeruginosa PA01
ggccagcgcccaggc

SEQ ID NO: 1436292 - RNA, 17 nt, Pseudomonas aeruginosa PA01
ggccagcgcccaggccg

SEQ ID NO: 1436293 - RNA, 18 nt, Pseudomonas aeruginosa PA01
ggccagcgcccaggccgg

SEQ ID NO: 1436294 - RNA, 22 nt, Pseudomonas aeruginosa PA01
ggccagcgcccaggccgggucg

SEQ ID NO: 1436295 - RNA, 17 nt, Pseudomonas aeruginosa PA01
ggccagcgccaggagca

SEQ ID NO: 1436296 - RNA, 22 nt, Pseudomonas aeruginosa PA01
ggccagcgccaggagcagggcg

SEQ ID NO: 1436297 - RNA, 22 nt, Pseudomonas aeruginosa PA01
ggccagcgccagguuggccugg

SEQ ID NO: 1436298 - RNA, 24 nt, Pseudomonas aeruginosa PA01
ggccagccguucgcuggacaggcg

SEQ ID NO: 1436299 - RNA, 19 nt, Pseudomonas aeruginosa PA01
ggccagccuucccggcgcu

SEQ ID NO: 1436300 - RNA, 15 nt, Pseudomonas aeruginosa PA01
ggccagccuuccucg

SEQ ID NO: 1436301 - RNA, 14 nt, Pseudomonas aeruginosa PA01
ggccagccuggcca

SEQ ID NO: 1436302 - RNA, 22 nt, Pseudomonas aeruginosa PA01
ggccagccuggccagcgcuucg

SEQ ID NO: 1436303 - RNA, 21 nt, Pseudomonas aeruginosa PA01
ggccagcgaccgucgaaccag

SEQ ID NO: 1436304 - RNA, 21 nt, Pseudomonas aeruginosa PA01
ggccagcgaacccaggccgcg

SEQ ID NO: 1436305 - RNA, 19 nt, Pseudomonas aeruginosa PA01
ggccagcgaacgcacuucg

SEQ ID NO: 1436306 - RNA, 22 nt, Pseudomonas aeruginosa PA01
ggccagcgaacgcacuucgucc

SEQ ID NO: 1436307 - RNA, 17 nt, Pseudomonas aeruginosa PA01
ggccagcgccaccagca

SEQ ID NO: 1436308 - RNA, 13 nt, Pseudomonas aeruginosa PA01
ggccagcgccacc

SEQ ID NO: 1436309 - RNA, 14 nt, Pseudomonas aeruginosa PA01
ggccagcgccacca

SEQ ID NO: 1436310 - RNA, 17 nt, Pseudomonas aeruginosa PA01
ggcaugcucagccgcgc

SEQ ID NO: 1436311 - RNA, 15 nt, Pseudomonas aeruginosa PA01
ggcaugcucggccag

SEQ ID NO: 1436312 - RNA, 14 nt, Pseudomonas aeruginosa PA01
ggcaugcugcucgg

SEQ ID NO: 1436313 - RNA, 16 nt, Pseudomonas aeruginosa PA01
ggcaugcugcucggca

SEQ ID NO: 1436314 - RNA, 17 nt, Pseudomonas aeruginosa PA01
ggcaugcugcucggcau

SEQ ID NO: 1436315 - RNA, 15 nt, Pseudomonas aeruginosa PA01
ggccaccgccaggac

SEQ ID NO: 1436316 - RNA, 20 nt, Pseudomonas aeruginosa PA01
ggccaccgccaggaccucga

SEQ ID NO: 1436317 - RNA, 13 nt, Pseudomonas aeruginosa PA01
ggccaccagcacc

SEQ ID NO: 1436318 - RNA, 14 nt, Pseudomonas aeruginosa PA01
ggccaccagcaccu

SEQ ID NO: 1436319 - RNA, 14 nt, Pseudomonas aeruginosa PA01
ggccaccagcgaaa

SEQ ID NO: 1436320 - RNA, 20 nt, Pseudomonas aeruginosa PA01
ggcaugcaagaggucgacgg

SEQ ID NO: 1436321 - RNA, 15 nt, Pseudomonas aeruginosa PA01
ggcaugcaccuacca

SEQ ID NO: 1436322 - RNA, 16 nt, Pseudomonas aeruginosa PA01
ggcaucggcgccgcgc

SEQ ID NO: 1436323 - RNA, 13 nt, Pseudomonas aeruginosa PA01
ggcaucggccacu

SEQ ID NO: 1436324 - RNA, 19 nt, Pseudomonas aeruginosa PA01
ggcaugcggccccggcgcu

SEQ ID NO: 1436325 - RNA, 16 nt, Pseudomonas aeruginosa PA01
ggcaugcgggcgcgag

SEQ ID NO: 1436326 - RNA, 18 nt, Pseudomonas aeruginosa PA01
ggcaugccguugggccag

SEQ ID NO: 1436327 - RNA, 12 nt, Pseudomonas aeruginosa PA01
ggcaugcccugc

SEQ ID NO: 1436328 - RNA, 17 nt, Pseudomonas aeruginosa PA01
ggccacgacccugcugg

SEQ ID NO: 1436329 - RNA, 20 nt, Pseudomonas aeruginosa PA01
ggccacguagggcguggugu

SEQ ID NO: 1436330 - RNA, 12 nt, Pseudomonas aeruginosa PA01
ggccacgcccgg

SEQ ID NO: 1436331 - RNA, 17 nt, Pseudomonas aeruginosa PA01
ggccacgcccggugucg

SEQ ID NO: 1436332 - RNA, 15 nt, Pseudomonas aeruginosa PA01
ggccacgucgcccca

SEQ ID NO: 1436333 - RNA, 19 nt, Pseudomonas aeruginosa PA01
ggccacuauuccuugcgcc

SEQ ID NO: 1436334 - RNA, 22 nt, Pseudomonas aeruginosa PA01
ggccacuauuccuugcgccaug

SEQ ID NO: 1436335 - RNA, 13 nt, Pseudomonas aeruginosa PA01
ggccacuccagcc

SEQ ID NO: 1436336 - RNA, 15 nt, Pseudomonas aeruginosa PA01
ggccacuccagcccc

SEQ ID NO: 1436337 - RNA, 16 nt, Pseudomonas aeruginosa PA01
ggccacuccgggcugg

SEQ ID NO: 1436338 - RNA, 17 nt, Pseudomonas aeruginosa PA01
ggccacuccgggcuggu

SEQ ID NO: 1436339 - RNA, 20 nt, Pseudomonas aeruginosa PA01
ggccacuccgggcuggucgu

SEQ ID NO: 1436340 - RNA, 13 nt, Pseudomonas aeruginosa PA01
ggccacucgcagc

SEQ ID NO: 1436341 - RNA, 16 nt, Pseudomonas aeruginosa PA01
ggccacucgcagccgc

SEQ ID NO: 1436342 - RNA, 17 nt, Pseudomonas aeruginosa PA01
ggccacucgcagccgcg

SEQ ID NO: 1436343 - RNA, 21 nt, Pseudomonas aeruginosa PA01
ggccacucgcagccgcgcucg

SEQ ID NO: 1436344 - RNA, 14 nt, Pseudomonas aeruginosa PA01
ggccaccgcgcagc

SEQ ID NO: 1436345 - RNA, 13 nt, Pseudomonas aeruginosa PA01
ggccaccgcggcg

SEQ ID NO: 1436346 - RNA, 12 nt, Pseudomonas aeruginosa PA01
ggccaccgcggc

SEQ ID NO: 1436347 - RNA, 15 nt, Pseudomonas aeruginosa PA01
ggccacgcaccagcu

SEQ ID NO: 1436348 - RNA, 18 nt, Pseudomonas aeruginosa PA01
ggccacgcaccagcuccc

SEQ ID NO: 1436349 - RNA, 17 nt, Pseudomonas aeruginosa PA01
ggccaccgcggcguccg

SEQ ID NO: 1436350 - RNA, 18 nt, Pseudomonas aeruginosa PA01
ggccaccgcggcguccgc

SEQ ID NO: 1436351 - RNA, 12 nt, Pseudomonas aeruginosa PA01
aaggcacgcccc

SEQ ID NO: 1436352 - RNA, 20 nt, Pseudomonas aeruginosa PA01
aaggccaccagagccagccg

SEQ ID NO: 1436353 - RNA, 21 nt, Pseudomonas aeruginosa PA01
aaggccaccagagccagccgc

SEQ ID NO: 1436354 - RNA, 19 nt, Pseudomonas aeruginosa PA01
aaggccaccaucgcggcga

SEQ ID NO: 1436355 - RNA, 17 nt, Pseudomonas aeruginosa PA01
aaggccaguccggcacc

SEQ ID NO: 1436356 - RNA, 16 nt, Pseudomonas aeruginosa PA01
aaggccagcucgucgc

SEQ ID NO: 1436357 - RNA, 13 nt, Pseudomonas aeruginosa PA01
aaggccaggccgg

SEQ ID NO: 1436358 - RNA, 14 nt, Pseudomonas aeruginosa PA01
aaggccaggccggc

SEQ ID NO: 1436359 - RNA, 12 nt, Pseudomonas aeruginosa PA01
aaggccaggcuc

SEQ ID NO: 1436360 - RNA, 16 nt, Pseudomonas aeruginosa PA01
aaggccaggucgacga

SEQ ID NO: 1436361 - RNA, 17 nt, Pseudomonas aeruginosa PA01
aaggccgaacgguaggu

SEQ ID NO: 1436362 - RNA, 17 nt, Pseudomonas aeruginosa PA01
aaggccgaagaggcccu

SEQ ID NO: 1436363 - RNA, 18 nt, Pseudomonas aeruginosa PA01
aaggccgaagaggcccuc

SEQ ID NO: 1436364 - RNA, 15 nt, Pseudomonas aeruginosa PA01
aaggcccugcugcag

SEQ ID NO: 1436365 - RNA, 13 nt, Pseudomonas aeruginosa PA01
aaggccgcgccgg

SEQ ID NO: 1436366 - RNA, 14 nt, Pseudomonas aeruginosa PA01
aaggccgcgccgga

SEQ ID NO: 1436367 - RNA, 17 nt, Pseudomonas aeruginosa PA01
aaggaucgagccagcgc

SEQ ID NO: 1436368 - RNA, 13 nt, Pseudomonas aeruginosa PA01
aaggaucgccgcg

SEQ ID NO: 1436369 - RNA, 18 nt, Pseudomonas aeruginosa PA01
aaggacugugccuggaag

SEQ ID NO: 1436370 - RNA, 20 nt, Pseudomonas aeruginosa PA01
ggagcgaaacgccccgucga

SEQ ID NO: 1436371 - RNA, 15 nt, Pseudomonas aeruginosa PA01
ggagccggugccggc

SEQ ID NO: 1436372 - RNA, 16 nt, Pseudomonas aeruginosa PA01
ggagccggugccggcg

SEQ ID NO: 1436373 - RNA, 17 nt, Pseudomonas aeruginosa PA01
ggagccggugccggcgg

SEQ ID NO: 1436374 - RNA, 15 nt, Pseudomonas aeruginosa PA01
ggagccggccaggcg

SEQ ID NO: 1436375 - RNA, 21 nt, Pseudomonas aeruginosa PA01
ggagagcagccaagccaccag

SEQ ID NO: 1436376 - RNA, 17 nt, Pseudomonas aeruginosa PA01
ggagagggcggcgaccg

SEQ ID NO: 1436377 - RNA, 21 nt, Pseudomonas aeruginosa PA01
ggagaggggcuacuucgccgg

SEQ ID NO: 1436378 - RNA, 13 nt, Pseudomonas aeruginosa PA01
ggagagggucagc

SEQ ID NO: 1436379 - RNA, 22 nt, Pseudomonas aeruginosa PA01
ggagagauagagcuucucgucg

SEQ ID NO: 1436380 - RNA, 12 nt, Pseudomonas aeruginosa PA01
ggagacgcggca

SEQ ID NO: 1436381 - RNA, 16 nt, Pseudomonas aeruginosa PA01
ggagaccgugccgccg

SEQ ID NO: 1436382 - RNA, 14 nt, Pseudomonas aeruginosa PA01
ggagaacgccgcca

SEQ ID NO: 1436383 - RNA, 16 nt, Pseudomonas aeruginosa PA01
ggagaacuuuucccag

SEQ ID NO: 1436384 - RNA, 21 nt, Pseudomonas aeruginosa PA01
ggagaacuuuucccagcggcu

SEQ ID NO: 1436385 - RNA, 15 nt, Pseudomonas aeruginosa PA01
ggagaaccaggcggu

SEQ ID NO: 1436386 - RNA, 17 nt, Pseudomonas aeruginosa PA01
ggagaaccaggcggugu

SEQ ID NO: 1436387 - RNA, 14 nt, Pseudomonas aeruginosa PA01
ggagaacagcagcg

SEQ ID NO: 1436388 - RNA, 22 nt, Pseudomonas aeruginosa PA01
ggagaacagcagcggcaccagc

SEQ ID NO: 1436389 - RNA, 13 nt, Pseudomonas aeruginosa PA01
ggagaacagcagg

SEQ ID NO: 1436390 - RNA, 17 nt, Pseudomonas aeruginosa PA01
ggagaacagcaggguca

SEQ ID NO: 1436391 - RNA, 19 nt, Pseudomonas aeruginosa PA01
ggagccggauagaucaggc

SEQ ID NO: 1436392 - RNA, 23 nt, Pseudomonas aeruginosa PA01
ggagccggauagaucaggccggc

SEQ ID NO: 1436393 - RNA, 14 nt, Pseudomonas aeruginosa PA01
ggagcaggccaugg

SEQ ID NO: 1436394 - RNA, 13 nt, Pseudomonas aeruginosa PA01
ggagcagggcgca

SEQ ID NO: 1436395 - RNA, 14 nt, Pseudomonas aeruginosa PA01
ggagcagggcgccg

SEQ ID NO: 1436396 - RNA, 13 nt, Pseudomonas aeruginosa PA01
ggagcagcagcgc

SEQ ID NO: 1436397 - RNA, 16 nt, Pseudomonas aeruginosa PA01
ggagaugcagcgucgc

SEQ ID NO: 1436398 - RNA, 17 nt, Pseudomonas aeruginosa PA01
ggagaugccgaacaccu

SEQ ID NO: 1436399 - RNA, 18 nt, Pseudomonas aeruginosa PA01
ggagaugcucaggcgcug

SEQ ID NO: 1436400 - RNA, 20 nt, Pseudomonas aeruginosa PA01
ggagaugcucaggcgcugcu

SEQ ID NO: 1436401 - RNA, 14 nt, Pseudomonas aeruginosa PA01
ggagauugcggcga

SEQ ID NO: 1436402 - RNA, 21 nt, Pseudomonas aeruginosa PA01
ggagcagaaccgccagcagug

SEQ ID NO: 1436403 - RNA, 15 nt, Pseudomonas aeruginosa PA01
ggagcacgccgugca

SEQ ID NO: 1436404 - RNA, 14 nt, Pseudomonas aeruginosa PA01
ggagaggucgccga

SEQ ID NO: 1436405 - RNA, 22 nt, Pseudomonas aeruginosa PA01
ggagaucggcguuuacgcgcca

SEQ ID NO: 1436406 - RNA, 22 nt, Pseudomonas aeruginosa PA01
ggacugcucgccgccggcgagg

SEQ ID NO: 1436407 - RNA, 18 nt, Pseudomonas aeruginosa PA01
ggacugcccgcgucccau

SEQ ID NO: 1436408 - RNA, 20 nt, Pseudomonas aeruginosa PA01
ggacugccgauggugauacg

SEQ ID NO: 1436409 - RNA, 16 nt, Pseudomonas aeruginosa PA01
ggacugcccagcgccg

SEQ ID NO: 1436410 - RNA, 21 nt, Pseudomonas aeruginosa PA01
ggacugcccagcgccgccagc

SEQ ID NO: 1436411 - RNA, 22 nt, Pseudomonas aeruginosa PA01
ggacugcccagcgccgccagca

SEQ ID NO: 1436412 - RNA, 23 nt, Pseudomonas aeruginosa PA01
ggacuugaugaccguccacggcg

SEQ ID NO: 1436413 - RNA, 21 nt, Pseudomonas aeruginosa PA01
ggacugguaggacagggccag

SEQ ID NO: 1436414 - RNA, 16 nt, Pseudomonas aeruginosa PA01
ggacggugcaggccga

SEQ ID NO: 1436415 - RNA, 17 nt, Pseudomonas aeruginosa PA01
ggacggugcaggccgac

SEQ ID NO: 1436416 - RNA, 21 nt, Pseudomonas aeruginosa PA01
ggacgucguagccaggcacca

SEQ ID NO: 1436417 - RNA, 17 nt, Pseudomonas aeruginosa PA01
ggacguccuggccgagc

SEQ ID NO: 1436418 - RNA, 23 nt, Pseudomonas aeruginosa PA01
ggacguccuggccgagccgcuug

SEQ ID NO: 1436419 - RNA, 19 nt, Pseudomonas aeruginosa PA01
ggacgucgccagggaggcg

SEQ ID NO: 1436420 - RNA, 15 nt, Pseudomonas aeruginosa PA01
ggacgugcaggauca

SEQ ID NO: 1436421 - RNA, 21 nt, Pseudomonas aeruginosa PA01
ggacgugggaaaucaccgcca

SEQ ID NO: 1436422 - RNA, 22 nt, Pseudomonas aeruginosa PA01
ggacgugggaaaucaccgccac

SEQ ID NO: 1436423 - RNA, 15 nt, Pseudomonas aeruginosa PA01
ggacguuuccagcgg

SEQ ID NO: 1436424 - RNA, 22 nt, Pseudomonas aeruginosa PA01
ggacuccgacgcgucguccgag

SEQ ID NO: 1436425 - RNA, 23 nt, Pseudomonas aeruginosa PA01
ggacuccgcccaguucuucgccg

SEQ ID NO: 1436426 - RNA, 14 nt, Pseudomonas aeruginosa PA01
ggacggcagccugg

SEQ ID NO: 1436427 - RNA, 16 nt, Pseudomonas aeruginosa PA01
ggacggauaacggcag

SEQ ID NO: 1436428 - RNA, 15 nt, Pseudomonas aeruginosa PA01
ggacgcuccugcgcc

SEQ ID NO: 1436429 - RNA, 16 nt, Pseudomonas aeruginosa PA01
ggacgcuccugcgccg

SEQ ID NO: 1436430 - RNA, 17 nt, Pseudomonas aeruginosa PA01
ggacggccgcgccggcu

SEQ ID NO: 1436431 - RNA, 17 nt, Pseudomonas aeruginosa PA01
ggacggccggcucggug

SEQ ID NO: 1436432 - RNA, 16 nt, Pseudomonas aeruginosa PA01
ggacgggugcgcgcca

SEQ ID NO: 1436433 - RNA, 19 nt, Pseudomonas aeruginosa PA01
ggacgggugcgcgccaccu

SEQ ID NO: 1436434 - RNA, 16 nt, Pseudomonas aeruginosa PA01
ggacggucucgccgcc

SEQ ID NO: 1436435 - RNA, 13 nt, Pseudomonas aeruginosa PA01
ggacggcggcugg

SEQ ID NO: 1436436 - RNA, 21 nt, Pseudomonas aeruginosa PA01
ggacggcucgcgcagcggcgc

SEQ ID NO: 1436437 - RNA, 22 nt, Pseudomonas aeruginosa PA01
ggacgccucgucggaggcgagg

SEQ ID NO: 1436438 - RNA, 14 nt, Pseudomonas aeruginosa PA01
ggacgccgccgguc

SEQ ID NO: 1436439 - RNA, 14 nt, Pseudomonas aeruginosa PA01
ggacgccgggcugg

SEQ ID NO: 1436440 - RNA, 16 nt, Pseudomonas aeruginosa PA01
ggacgcgcagcggcgc

SEQ ID NO: 1436441 - RNA, 17 nt, Pseudomonas aeruginosa PA01
ggacgcgcagcggcgcc

SEQ ID NO: 1436442 - RNA, 14 nt, Pseudomonas aeruginosa PA01
ggacgcgcaggguc

SEQ ID NO: 1436443 - RNA, 23 nt, Pseudomonas aeruginosa PA01
ggacgcgcagggucaggcccuug

SEQ ID NO: 1436444 - RNA, 11 nt, Pseudomonas aeruginosa PA01
ggacgcgccgg

SEQ ID NO: 1436445 - RNA, 14 nt, Pseudomonas aeruginosa PA01
ggacgcgccggcgg

SEQ ID NO: 1436446 - RNA, 22 nt, Pseudomonas aeruginosa PA01
ggacgcgcuuguccuccagcug

SEQ ID NO: 1436447 - RNA, 14 nt, Pseudomonas aeruginosa PA01
ggacgcggccuggg

SEQ ID NO: 1436448 - RNA, 13 nt, Pseudomonas aeruginosa PA01
ggacgcggcgugg

SEQ ID NO: 1436449 - RNA, 24 nt, Pseudomonas aeruginosa PA01
ggacgcggcguggucuccgugcug

SEQ ID NO: 1436450 - RNA, 22 nt, Pseudomonas aeruginosa PA01
ggacgcuggcgauaucgaaggc

SEQ ID NO: 1436451 - RNA, 14 nt, Pseudomonas aeruginosa PA01
ggacgcuggcgauc

SEQ ID NO: 1436452 - RNA, 16 nt, Pseudomonas aeruginosa PA01
ggacgcuggcgaucau

SEQ ID NO: 1436453 - RNA, 16 nt, Pseudomonas aeruginosa PA01
ggacgcugggcugggu

SEQ ID NO: 1436454 - RNA, 21 nt, Pseudomonas aeruginosa PA01
ggacgcuuguccuucggccag

SEQ ID NO: 1436455 - RNA, 13 nt, Pseudomonas aeruginosa PA01
ggagcuggucauc

SEQ ID NO: 1436456 - RNA, 20 nt, Pseudomonas aeruginosa PA01
ggagcuuugcagggcgaucc

SEQ ID NO: 1436457 - RNA, 16 nt, Pseudomonas aeruginosa PA01
ggagcguugcgggcag

SEQ ID NO: 1436458 - RNA, 19 nt, Pseudomonas aeruginosa PA01
ggaggcccacgggcggccg

SEQ ID NO: 1436459 - RNA, 14 nt, Pseudomonas aeruginosa PA01
ggaggauucgccag

SEQ ID NO: 1436460 - RNA, 13 nt, Pseudomonas aeruginosa PA01
ggaggaucgccag

SEQ ID NO: 1436461 - RNA, 21 nt, Pseudomonas aeruginosa PA01
ggaggaucgccaggacgcucg

SEQ ID NO: 1436462 - RNA, 21 nt, Pseudomonas aeruginosa PA01
ggaggaucuccaacuggcggc

SEQ ID NO: 1436463 - RNA, 16 nt, Pseudomonas aeruginosa PA01
ggaggcgccgcgccag

SEQ ID NO: 1436464 - RNA, 13 nt, Pseudomonas aeruginosa PA01
ggaggcgccgggu

SEQ ID NO: 1436465 - RNA, 13 nt, Pseudomonas aeruginosa PA01
ggaggcgcuggcc

SEQ ID NO: 1436466 - RNA, 15 nt, Pseudomonas aeruginosa PA01
ggaggcgcuggccag

SEQ ID NO: 1436467 - RNA, 16 nt, Pseudomonas aeruginosa PA01
ggaggcgcuggccagc

SEQ ID NO: 1436468 - RNA, 12 nt, Pseudomonas aeruginosa PA01
ggaggccgccuc

SEQ ID NO: 1436469 - RNA, 13 nt, Pseudomonas aeruginosa PA01
ggagcggcugccg

SEQ ID NO: 1436470 - RNA, 13 nt, Pseudomonas aeruginosa PA01
ggagcggccgugc

SEQ ID NO: 1436471 - RNA, 15 nt, Pseudomonas aeruginosa PA01
ggagcggccgugcau

SEQ ID NO: 1436472 - RNA, 15 nt, Pseudomonas aeruginosa PA01
ggagcgccagcacca

SEQ ID NO: 1436473 - RNA, 14 nt, Pseudomonas aeruginosa PA01
ggagcgccaucagc

SEQ ID NO: 1436474 - RNA, 15 nt, Pseudomonas aeruginosa PA01
ggagcgccggcgcgg

SEQ ID NO: 1436475 - RNA, 20 nt, Pseudomonas aeruginosa PA01
ggagcgccucgaaggccucg

SEQ ID NO: 1436476 - RNA, 12 nt, Pseudomonas aeruginosa PA01
ggagcgcgagcg

SEQ ID NO: 1436477 - RNA, 15 nt, Pseudomonas aeruginosa PA01
ggagcgcgagcggca

SEQ ID NO: 1436478 - RNA, 15 nt, Pseudomonas aeruginosa PA01
ggagcgcgaggcgca

SEQ ID NO: 1436479 - RNA, 19 nt, Pseudomonas aeruginosa PA01
ggagcgcgaggcgcaggca

SEQ ID NO: 1436480 - RNA, 23 nt, Pseudomonas aeruginosa PA01
aaggccuccucguaggcguccug

SEQ ID NO: 1436481 - RNA, 20 nt, Pseudomonas aeruginosa PA01
aaggccggucgcaaccggcc

SEQ ID NO: 1436482 - RNA, 22 nt, Pseudomonas aeruginosa PA01
aaggccggugcgaaccggccuu

SEQ ID NO: 1436483 - RNA, 18 nt, Pseudomonas aeruginosa PA01
aaggccgguugcgaccgg

SEQ ID NO: 1436484 - RNA, 13 nt, Pseudomonas aeruginosa PA01
aaggccucgucga

SEQ ID NO: 1436485 - RNA, 13 nt, Pseudomonas aeruginosa PA01
aaggccucgucgc

SEQ ID NO: 1436486 - RNA, 15 nt, Pseudomonas aeruginosa PA01
aaggccucgucgccc

SEQ ID NO: 1436487 - RNA, 16 nt, Pseudomonas aeruginosa PA01
aaggccucgucgcccg

SEQ ID NO: 1436488 - RNA, 13 nt, Pseudomonas aeruginosa PA01
aaggccugacgca

SEQ ID NO: 1436489 - RNA, 22 nt, Pseudomonas aeruginosa PA01
aaggccugacgcaagcgcucgg

SEQ ID NO: 1436490 - RNA, 17 nt, Pseudomonas aeruginosa PA01
aaggccugcgcuuccgg

SEQ ID NO: 1436491 - RNA, 12 nt, Pseudomonas aeruginosa PA01
aaggccuggccg

SEQ ID NO: 1436492 - RNA, 14 nt, Pseudomonas aeruginosa PA01
ggaguagccggcgg

SEQ ID NO: 1436493 - RNA, 21 nt, Pseudomonas aeruginosa PA01
ggaguccaggcgggccagcug

SEQ ID NO: 1436494 - RNA, 18 nt, Pseudomonas aeruginosa PA01
ggagucaggcgccggccu

SEQ ID NO: 1436495 - RNA, 22 nt, Pseudomonas aeruginosa PA01
ggagucgaucucggugggcuug

SEQ ID NO: 1436496 - RNA, 20 nt, Pseudomonas aeruginosa PA01
ggagucguagcgcgcggcga

SEQ ID NO: 1436497 - RNA, 21 nt, Pseudomonas aeruginosa PA01
ggagucguagcgcgcggcgag

SEQ ID NO: 1436498 - RNA, 16 nt, Pseudomonas aeruginosa PA01
ggagguagcugcgccg

SEQ ID NO: 1436499 - RNA, 17 nt, Pseudomonas aeruginosa PA01
ggagguagcugcgccgc

SEQ ID NO: 1436500 - RNA, 13 nt, Pseudomonas aeruginosa PA01
ggaggucgcacgc

SEQ ID NO: 1436501 - RNA, 19 nt, Pseudomonas aeruginosa PA01
ggagggcugcuguccagcg

SEQ ID NO: 1436502 - RNA, 13 nt, Pseudomonas aeruginosa PA01
ggaggcggcgagc

SEQ ID NO: 1436503 - RNA, 19 nt, Pseudomonas aeruginosa PA01
ggagugaggccgagccgac

SEQ ID NO: 1436504 - RNA, 18 nt, Pseudomonas aeruginosa PA01
ggaguuucaucucggcgc

SEQ ID NO: 1436505 - RNA, 17 nt, Pseudomonas aeruginosa PA01
ggauaacgcccgcggcg

SEQ ID NO: 1436506 - RNA, 19 nt, Pseudomonas aeruginosa PA01
ggaucaccagggucggcac

SEQ ID NO: 1436507 - RNA, 20 nt, Pseudomonas aeruginosa PA01
ggaucaccagggucggcacc

SEQ ID NO: 1436508 - RNA, 21 nt, Pseudomonas aeruginosa PA01
ggaucaccagggucggcaccu

SEQ ID NO: 1436509 - RNA, 18 nt, Pseudomonas aeruginosa PA01
ggaucacgaucgcggcga

SEQ ID NO: 1436510 - RNA, 19 nt, Pseudomonas aeruginosa PA01
ggaucacgauggccggcag

SEQ ID NO: 1436511 - RNA, 20 nt, Pseudomonas aeruginosa PA01
ggaucacgcagcaggcgacg

SEQ ID NO: 1436512 - RNA, 22 nt, Pseudomonas aeruginosa PA01
ggaucaccucgaaccccuggcg

SEQ ID NO: 1436513 - RNA, 16 nt, Pseudomonas aeruginosa PA01
ggaucaccgcggcgcu

SEQ ID NO: 1436514 - RNA, 20 nt, Pseudomonas aeruginosa PA01
ggaucaccggcuggcccucc

SEQ ID NO: 1436515 - RNA, 13 nt, Pseudomonas aeruginosa PA01
ggauaugcgccgc

SEQ ID NO: 1436516 - RNA, 15 nt, Pseudomonas aeruginosa PA01
ggauaugcgccgcca

SEQ ID NO: 1436517 - RNA, 23 nt, Pseudomonas aeruginosa PA01
ggauaugcgccgccacgugcacg

SEQ ID NO: 1436518 - RNA, 15 nt, Pseudomonas aeruginosa PA01
ggauaucugggccau

SEQ ID NO: 1436519 - RNA, 22 nt, Pseudomonas aeruginosa PA01
ggauaucgcccagggccagcgg

SEQ ID NO: 1436520 - RNA, 13 nt, Pseudomonas aeruginosa PA01
ggauauaggucgg

SEQ ID NO: 1436521 - RNA, 15 nt, Pseudomonas aeruginosa PA01
ggauaccgcacggcc

SEQ ID NO: 1436522 - RNA, 12 nt, Pseudomonas aeruginosa PA01
ggauaccacccg

SEQ ID NO: 1436523 - RNA, 20 nt, Pseudomonas aeruginosa PA01
ggauaccacccgcagccccg

SEQ ID NO: 1436524 - RNA, 21 nt, Pseudomonas aeruginosa PA01
ggauaccacccgcagccccgc

SEQ ID NO: 1436525 - RNA, 18 nt, Pseudomonas aeruginosa PA01
ggauacaggcgcagcagc

SEQ ID NO: 1436526 - RNA, 18 nt, Pseudomonas aeruginosa PA01
ggauagcgauaggccuug

SEQ ID NO: 1436527 - RNA, 18 nt, Pseudomonas aeruginosa PA01
ggauagcgcgcaggcgcu

SEQ ID NO: 1436528 - RNA, 18 nt, Pseudomonas aeruginosa PA01
ggauagaucaggccggcg

SEQ ID NO: 1436529 - RNA, 17 nt, Pseudomonas aeruginosa PA01
ggauaccggccaucagc

SEQ ID NO: 1436530 - RNA, 21 nt, Pseudomonas aeruginosa PA01
ggauacggcaggguagccacg

SEQ ID NO: 1436531 - RNA, 22 nt, Pseudomonas aeruginosa PA01
ggauacuccuucaaccacucca

SEQ ID NO: 1436532 - RNA, 13 nt, Pseudomonas aeruginosa PA01
ggaucaggcgggc

SEQ ID NO: 1436533 - RNA, 22 nt, Pseudomonas aeruginosa PA01
ggaucaggcgggcuccgccgcc

SEQ ID NO: 1436534 - RNA, 22 nt, Pseudomonas aeruginosa PA01
ggaucaguucgugccaggcgac

SEQ ID NO: 1436535 - RNA, 17 nt, Pseudomonas aeruginosa PA01
ggaucaggucgccagcg

SEQ ID NO: 1436536 - RNA, 18 nt, Pseudomonas aeruginosa PA01
ggaucaggucgccagcgc

SEQ ID NO: 1436537 - RNA, 16 nt, Pseudomonas aeruginosa PA01
ggauccacgccuggcc

SEQ ID NO: 1436538 - RNA, 17 nt, Pseudomonas aeruginosa PA01
ggaucagcgaacccggg

SEQ ID NO: 1436539 - RNA, 21 nt, Pseudomonas aeruginosa PA01
ggaucagcucgaucagcccgc

SEQ ID NO: 1436540 - RNA, 13 nt, Pseudomonas aeruginosa PA01
ggaucagcucgcg

SEQ ID NO: 1436541 - RNA, 12 nt, Pseudomonas aeruginosa PA01
ggaucagccacg

SEQ ID NO: 1436542 - RNA, 23 nt, Pseudomonas aeruginosa PA01
ggaucagccacgggcgccagcgg

SEQ ID NO: 1436543 - RNA, 21 nt, Pseudomonas aeruginosa PA01
ggaucacguaggacaggucgg

SEQ ID NO: 1436544 - RNA, 16 nt, Pseudomonas aeruginosa PA01
ggaucacucgccgccg

SEQ ID NO: 1436545 - RNA, 18 nt, Pseudomonas aeruginosa PA01
ggauccgugccaggcgcu

SEQ ID NO: 1436546 - RNA, 19 nt, Pseudomonas aeruginosa PA01
ggauccucgccucgcgcca

SEQ ID NO: 1436547 - RNA, 20 nt, Pseudomonas aeruginosa PA01
ggauccugcucagcggccca

SEQ ID NO: 1436548 - RNA, 21 nt, Pseudomonas aeruginosa PA01
ggaucaugggugaagaccagu

SEQ ID NO: 1436549 - RNA, 18 nt, Pseudomonas aeruginosa PA01
ggauccaggugcgcggca

SEQ ID NO: 1436550 - RNA, 18 nt, Pseudomonas aeruginosa PA01
ggauccccucccgcgcca

SEQ ID NO: 1436551 - RNA, 20 nt, Pseudomonas aeruginosa PA01
ggauccccucccgcgccagc

SEQ ID NO: 1436552 - RNA, 16 nt, Pseudomonas aeruginosa PA01
ggaaucugcgccaggu

SEQ ID NO: 1436553 - RNA, 19 nt, Pseudomonas aeruginosa PA01
ggaaucgucacggcgugcc

SEQ ID NO: 1436554 - RNA, 21 nt, Pseudomonas aeruginosa PA01
ggaaugcaaaaagcccacucg

SEQ ID NO: 1436555 - RNA, 18 nt, Pseudomonas aeruginosa PA01
ggaauggagaugccgaac

SEQ ID NO: 1436556 - RNA, 21 nt, Pseudomonas aeruginosa PA01
ggaaugcucagcacggcgacg

SEQ ID NO: 1436557 - RNA, 21 nt, Pseudomonas aeruginosa PA01
ggaauccccaguagcgcuucg

SEQ ID NO: 1436558 - RNA, 14 nt, Pseudomonas aeruginosa PA01
ggaauccuccgcca

SEQ ID NO: 1436559 - RNA, 16 nt, Pseudomonas aeruginosa PA01
ggaauccuccgccagc

SEQ ID NO: 1436560 - RNA, 13 nt, Pseudomonas aeruginosa PA01
ggaaucgccagca

SEQ ID NO: 1436561 - RNA, 19 nt, Pseudomonas aeruginosa PA01
ggaauccuucgcggcggcg

SEQ ID NO: 1436562 - RNA, 16 nt, Pseudomonas aeruginosa PA01
ggaagggacgucgcca

SEQ ID NO: 1436563 - RNA, 23 nt, Pseudomonas aeruginosa PA01
ggaaggcgacgauguucuccacg

SEQ ID NO: 1436564 - RNA, 15 nt, Pseudomonas aeruginosa PA01
ggaaggcgcgcacca

SEQ ID NO: 1436565 - RNA, 16 nt, Pseudomonas aeruginosa PA01
ggaaggcgcgcaccag

SEQ ID NO: 1436566 - RNA, 14 nt, Pseudomonas aeruginosa PA01
ggaaggccucggug

SEQ ID NO: 1436567 - RNA, 17 nt, Pseudomonas aeruginosa PA01
ggaaggccacgccgccg

SEQ ID NO: 1436568 - RNA, 15 nt, Pseudomonas aeruginosa PA01
ggaaggcccgcgagc

SEQ ID NO: 1436569 - RNA, 14 nt, Pseudomonas aeruginosa PA01
ggaaggucggcagc

SEQ ID NO: 1436570 - RNA, 16 nt, Pseudomonas aeruginosa PA01
ggaaggucucgccgcc

SEQ ID NO: 1436571 - RNA, 19 nt, Pseudomonas aeruginosa PA01
ggaagguugucgaagcgau

SEQ ID NO: 1436572 - RNA, 16 nt, Pseudomonas aeruginosa PA01
ggaaguacggcgcggu

SEQ ID NO: 1436573 - RNA, 14 nt, Pseudomonas aeruginosa PA01
ggaaguaucggcgu

SEQ ID NO: 1436574 - RNA, 19 nt, Pseudomonas aeruginosa PA01
ggaagugcagggcguccag

SEQ ID NO: 1436575 - RNA, 15 nt, Pseudomonas aeruginosa PA01
ggaaguccgggcgcg

SEQ ID NO: 1436576 - RNA, 16 nt, Pseudomonas aeruginosa PA01
ggaaguccgggcgcgg

SEQ ID NO: 1436577 - RNA, 16 nt, Pseudomonas aeruginosa PA01
ggaaguauucggcggg

SEQ ID NO: 1436578 - RNA, 19 nt, Pseudomonas aeruginosa PA01
ggaaguauugcuccacccg

SEQ ID NO: 1436579 - RNA, 17 nt, Pseudomonas aeruginosa PA01
ggaaguggcagcgccgu

SEQ ID NO: 1436580 - RNA, 16 nt, Pseudomonas aeruginosa PA01
ggaaguuaucggggcc

SEQ ID NO: 1436581 - RNA, 19 nt, Pseudomonas aeruginosa PA01
ggaagucgaugaacgcgcg

SEQ ID NO: 1436582 - RNA, 19 nt, Pseudomonas aeruginosa PA01
ggaagucgcccugcccggu

SEQ ID NO: 1436583 - RNA, 16 nt, Pseudomonas aeruginosa PA01
ggaagucggcggccgc

SEQ ID NO: 1436584 - RNA, 17 nt, Pseudomonas aeruginosa PA01
ggaagucguccagcagg

SEQ ID NO: 1436585 - RNA, 23 nt, Pseudomonas aeruginosa PA01
ggaagaagcccuuguucgggucg

SEQ ID NO: 1436586 - RNA, 20 nt, Pseudomonas aeruginosa PA01
ggaagaauaccgccagcucg

SEQ ID NO: 1436587 - RNA, 16 nt, Pseudomonas aeruginosa PA01
ggaagaauggcguggc

SEQ ID NO: 1436588 - RNA, 17 nt, Pseudomonas aeruginosa PA01
ggaagagcaucucgccg

SEQ ID NO: 1436589 - RNA, 22 nt, Pseudomonas aeruginosa PA01
ggaagauguucgccgccgccag

SEQ ID NO: 1436590 - RNA, 19 nt, Pseudomonas aeruginosa PA01
ggaagcaccgacucgcccu

SEQ ID NO: 1436591 - RNA, 16 nt, Pseudomonas aeruginosa PA01
ggaagcacggcucggc

SEQ ID NO: 1436592 - RNA, 13 nt, Pseudomonas aeruginosa PA01
ggaagagcgccgc

SEQ ID NO: 1436593 - RNA, 14 nt, Pseudomonas aeruginosa PA01
ggaacuggucgauc

SEQ ID NO: 1436594 - RNA, 13 nt, Pseudomonas aeruginosa PA01
ggaacuggcguug

SEQ ID NO: 1436595 - RNA, 22 nt, Pseudomonas aeruginosa PA01
ggaacuggcguugcugaucacg

SEQ ID NO: 1436596 - RNA, 14 nt, Pseudomonas aeruginosa PA01
ggaacucuguucgu

SEQ ID NO: 1436597 - RNA, 14 nt, Pseudomonas aeruginosa PA01
ggaacugcagggca

SEQ ID NO: 1436598 - RNA, 17 nt, Pseudomonas aeruginosa PA01
ggaacugcagggcaucg

SEQ ID NO: 1436599 - RNA, 20 nt, Pseudomonas aeruginosa PA01
ggaacuguuggggcugccca

SEQ ID NO: 1436600 - RNA, 19 nt, Pseudomonas aeruginosa PA01
ggaagaaacugcgguugaa

SEQ ID NO: 1436601 - RNA, 18 nt, Pseudomonas aeruginosa PA01
ggaagaaaagaaggcgga

SEQ ID NO: 1436602 - RNA, 14 nt, Pseudomonas aeruginosa PA01
ggaacuuggcgcgc

SEQ ID NO: 1436603 - RNA, 15 nt, Pseudomonas aeruginosa PA01
ggaacuuggcgcgca

SEQ ID NO: 1436604 - RNA, 15 nt, Pseudomonas aeruginosa PA01
ggaagcauggccggc

SEQ ID NO: 1436605 - RNA, 15 nt, Pseudomonas aeruginosa PA01
ggaagccgaucggca

SEQ ID NO: 1436606 - RNA, 18 nt, Pseudomonas aeruginosa PA01
ggaagcccugcuggcgca

SEQ ID NO: 1436607 - RNA, 23 nt, Pseudomonas aeruginosa PA01
ggaagcccugcuggcgcagccag

SEQ ID NO: 1436608 - RNA, 16 nt, Pseudomonas aeruginosa PA01
ggaagccgaccacucg

SEQ ID NO: 1436609 - RNA, 17 nt, Pseudomonas aeruginosa PA01
ggaagcccagcaggucg

SEQ ID NO: 1436610 - RNA, 20 nt, Pseudomonas aeruginosa PA01
ggaagccccagaagaucgcc

SEQ ID NO: 1436611 - RNA, 16 nt, Pseudomonas aeruginosa PA01
ggaagccuucgcccgg

SEQ ID NO: 1436612 - RNA, 21 nt, Pseudomonas aeruginosa PA01
ggaagcgcccgaugaucgagc

SEQ ID NO: 1436613 - RNA, 12 nt, Pseudomonas aeruginosa PA01
ggaagccgcgcu

SEQ ID NO: 1436614 - RNA, 21 nt, Pseudomonas aeruginosa PA01
ggaagccgcucggcguagccg

SEQ ID NO: 1436615 - RNA, 20 nt, Pseudomonas aeruginosa PA01
ggaagccgucggcgaucgcc

SEQ ID NO: 1436616 - RNA, 16 nt, Pseudomonas aeruginosa PA01
ggaagccguggcgggc

SEQ ID NO: 1436617 - RNA, 16 nt, Pseudomonas aeruginosa PA01
ggaagccugccagacc

SEQ ID NO: 1436618 - RNA, 12 nt, Pseudomonas aeruginosa PA01
ggaagccgcgcc

SEQ ID NO: 1436619 - RNA, 14 nt, Pseudomonas aeruginosa PA01
ggaagccgcgcccc

SEQ ID NO: 1436620 - RNA, 17 nt, Pseudomonas aeruginosa PA01
ggaagcucggcagcacg

SEQ ID NO: 1436621 - RNA, 19 nt, Pseudomonas aeruginosa PA01
ggaagcucggcagcacgcu

SEQ ID NO: 1436622 - RNA, 20 nt, Pseudomonas aeruginosa PA01
ggaagcucugcacaaacuca

SEQ ID NO: 1436623 - RNA, 22 nt, Pseudomonas aeruginosa PA01
ggaaggaucgagccagcgcucg

SEQ ID NO: 1436624 - RNA, 14 nt, Pseudomonas aeruginosa PA01
ggaagcuucaggcu

SEQ ID NO: 1436625 - RNA, 18 nt, Pseudomonas aeruginosa PA01
ggaagcuucaggcucggc

SEQ ID NO: 1436626 - RNA, 23 nt, Pseudomonas aeruginosa PA01
ggaagcuuccagcuuggcacggc

SEQ ID NO: 1436627 - RNA, 17 nt, Pseudomonas aeruginosa PA01
ggaagcggccgagcacc

SEQ ID NO: 1436628 - RNA, 15 nt, Pseudomonas aeruginosa PA01
ggaagcgggccucgg

SEQ ID NO: 1436629 - RNA, 15 nt, Pseudomonas aeruginosa PA01
ggaagcggucguagc

SEQ ID NO: 1436630 - RNA, 14 nt, Pseudomonas aeruginosa PA01
ggaagcgucagccg

SEQ ID NO: 1436631 - RNA, 16 nt, Pseudomonas aeruginosa PA01
ggaagcgucagccgcg

SEQ ID NO: 1436632 - RNA, 18 nt, Pseudomonas aeruginosa PA01
ggaagcgucagccgcggc

SEQ ID NO: 1436633 - RNA, 20 nt, Pseudomonas aeruginosa PA01
ggaagcgucagccgcggccg

SEQ ID NO: 1436634 - RNA, 17 nt, Pseudomonas aeruginosa PA01
ggaagcgucgugcgccg

SEQ ID NO: 1436635 - RNA, 16 nt, Pseudomonas aeruginosa PA01
gcuggcgccgcuggcg

SEQ ID NO: 1436636 - RNA, 13 nt, Pseudomonas aeruginosa PA01
gcuggcgccgaug

SEQ ID NO: 1436637 - RNA, 23 nt, Pseudomonas aeruginosa PA01
gcuggcgcaggaccgccauggcg

SEQ ID NO: 1436638 - RNA, 15 nt, Pseudomonas aeruginosa PA01
gcuggcgcaggccuu

SEQ ID NO: 1436639 - RNA, 16 nt, Pseudomonas aeruginosa PA01
gcuggcgcagccaggc

SEQ ID NO: 1436640 - RNA, 13 nt, Pseudomonas aeruginosa PA01
gcuggcgcagccg

SEQ ID NO: 1436641 - RNA, 16 nt, Pseudomonas aeruginosa PA01
gcuggcgcagccgcug

SEQ ID NO: 1436642 - RNA, 17 nt, Pseudomonas aeruginosa PA01
gcuggcgcagccgcugc

SEQ ID NO: 1436643 - RNA, 15 nt, Pseudomonas aeruginosa PA01
gcuggcgcagcagca

SEQ ID NO: 1436644 - RNA, 20 nt, Pseudomonas aeruginosa PA01
gcuggcgcguugugccgcca

SEQ ID NO: 1436645 - RNA, 13 nt, Pseudomonas aeruginosa PA01
gcuggcgcuaccg

SEQ ID NO: 1436646 - RNA, 17 nt, Pseudomonas aeruginosa PA01
gcuggcgcuaccgcgca

SEQ ID NO: 1436647 - RNA, 13 nt, Pseudomonas aeruginosa PA01
gcuggcgccggug

SEQ ID NO: 1436648 - RNA, 14 nt, Pseudomonas aeruginosa PA01
gcuggcgccggugc

SEQ ID NO: 1436649 - RNA, 15 nt, Pseudomonas aeruginosa PA01
gcuggcgccgucauc

SEQ ID NO: 1436650 - RNA, 21 nt, Pseudomonas aeruginosa PA01
gcuggcgcgauccgcgcggca

SEQ ID NO: 1436651 - RNA, 20 nt, Pseudomonas aeruginosa PA01
gcuggcgcgcgcgcugccag

SEQ ID NO: 1436652 - RNA, 18 nt, Pseudomonas aeruginosa PA01
ggaacagccaguaguccu

SEQ ID NO: 1436653 - RNA, 18 nt, Pseudomonas aeruginosa PA01
ggaacagccgcagcggca

SEQ ID NO: 1436654 - RNA, 15 nt, Pseudomonas aeruginosa PA01
ggaacagcagccagg

SEQ ID NO: 1436655 - RNA, 14 nt, Pseudomonas aeruginosa PA01
gcuggcgcugaccg

SEQ ID NO: 1436656 - RNA, 16 nt, Pseudomonas aeruginosa PA01
ggaacaccaggccgca

SEQ ID NO: 1436657 - RNA, 19 nt, Pseudomonas aeruginosa PA01
gcuggcgcuugccgcgccc

SEQ ID NO: 1436658 - RNA, 12 nt, Pseudomonas aeruginosa PA01
ggaacagcgccu

SEQ ID NO: 1436659 - RNA, 13 nt, Pseudomonas aeruginosa PA01
ggaacaggucgac

SEQ ID NO: 1436660 - RNA, 20 nt, Pseudomonas aeruginosa PA01
ggaacaggucgacgccaugg

SEQ ID NO: 1436661 - RNA, 12 nt, Pseudomonas aeruginosa PA01
ggaacagcgcca

SEQ ID NO: 1436662 - RNA, 21 nt, Pseudomonas aeruginosa PA01
ggaacagcgccagcggcagcg

SEQ ID NO: 1436663 - RNA, 18 nt, Pseudomonas aeruginosa PA01
ggaacagcuccuccagcg

SEQ ID NO: 1436664 - RNA, 11 nt, Pseudomonas aeruginosa PA01
ggaaccaccgg

SEQ ID NO: 1436665 - RNA, 21 nt, Pseudomonas aeruginosa PA01
ggaaccacgacgaagcgccgg

SEQ ID NO: 1436666 - RNA, 21 nt, Pseudomonas aeruginosa PA01
ggaacauugccaccaccaugc

SEQ ID NO: 1436667 - RNA, 16 nt, Pseudomonas aeruginosa PA01
ggaacaguugcggaga

SEQ ID NO: 1436668 - RNA, 21 nt, Pseudomonas aeruginosa PA01
ggaaccuguccgaacagggcg

SEQ ID NO: 1436669 - RNA, 17 nt, Pseudomonas aeruginosa PA01
ggaacgaacaugagcga

SEQ ID NO: 1436670 - RNA, 16 nt, Pseudomonas aeruginosa PA01
ggaacgaugccgcagg

SEQ ID NO: 1436671 - RNA, 20 nt, Pseudomonas aeruginosa PA01
ggaacgccgacaggccggug

SEQ ID NO: 1436672 - RNA, 21 nt, Pseudomonas aeruginosa PA01
ggaacgcaggggcaccggcgg

SEQ ID NO: 1436673 - RNA, 15 nt, Pseudomonas aeruginosa PA01
ggaacgcccgcggca

SEQ ID NO: 1436674 - RNA, 15 nt, Pseudomonas aeruginosa PA01
ggaaccggccggcag

SEQ ID NO: 1436675 - RNA, 16 nt, Pseudomonas aeruginosa PA01
ggaaccgauggccagg

SEQ ID NO: 1436676 - RNA, 16 nt, Pseudomonas aeruginosa PA01
ggaacccuugcgcagg

SEQ ID NO: 1436677 - RNA, 23 nt, Pseudomonas aeruginosa PA01
ggaaccgaguuucccggcgcggc

SEQ ID NO: 1436678 - RNA, 17 nt, Pseudomonas aeruginosa PA01
ggaaccaguugccgagc

SEQ ID NO: 1436679 - RNA, 21 nt, Pseudomonas aeruginosa PA01
ggaaccacaggagcacggccg

SEQ ID NO: 1436680 - RNA, 16 nt, Pseudomonas aeruginosa PA01
ggaacccgcggcgcgc

SEQ ID NO: 1436681 - RNA, 22 nt, Pseudomonas aeruginosa PA01
ggaacgccgggcaacgccaggc

SEQ ID NO: 1436682 - RNA, 22 nt, Pseudomonas aeruginosa PA01
ggaacgccucgcagagcgccag

SEQ ID NO: 1436683 - RNA, 23 nt, Pseudomonas aeruginosa PA01
ggaacgccucgcagagcgccagc

SEQ ID NO: 1436684 - RNA, 20 nt, Pseudomonas aeruginosa PA01
ggaacgcgaggagaucggcg

SEQ ID NO: 1436685 - RNA, 14 nt, Pseudomonas aeruginosa PA01
ggaacggcucgcga

SEQ ID NO: 1436686 - RNA, 15 nt, Pseudomonas aeruginosa PA01
ggaacggcucgcggg

SEQ ID NO: 1436687 - RNA, 13 nt, Pseudomonas aeruginosa PA01
ggaacggcuugcu

SEQ ID NO: 1436688 - RNA, 22 nt, Pseudomonas aeruginosa PA01
ggaacgguugucgaugcgcccg

SEQ ID NO: 1436689 - RNA, 21 nt, Pseudomonas aeruginosa PA01
ggaacucgaucagcgcggcca

SEQ ID NO: 1436690 - RNA, 20 nt, Pseudomonas aeruginosa PA01
ggaacuagcccucgaccugg

SEQ ID NO: 1436691 - RNA, 21 nt, Pseudomonas aeruginosa PA01
ggaacuagcccucgaccuggc

SEQ ID NO: 1436692 - RNA, 20 nt, Pseudomonas aeruginosa PA01
ggaacucauucaucucgccg

SEQ ID NO: 1436693 - RNA, 17 nt, Pseudomonas aeruginosa PA01
ggaacgugcggccugca

SEQ ID NO: 1436694 - RNA, 21 nt, Pseudomonas aeruginosa PA01
ggacagcacgcucaggcagcg

SEQ ID NO: 1436695 - RNA, 16 nt, Pseudomonas aeruginosa PA01
ggacagcagggucgcg

SEQ ID NO: 1436696 - RNA, 18 nt, Pseudomonas aeruginosa PA01
ggacagcccgcgcucggc

SEQ ID NO: 1436697 - RNA, 17 nt, Pseudomonas aeruginosa PA01
ggacacccugcugcugc

SEQ ID NO: 1436698 - RNA, 14 nt, Pseudomonas aeruginosa PA01
ggacacggcgaccu

SEQ ID NO: 1436699 - RNA, 18 nt, Pseudomonas aeruginosa PA01
ggacacgguccaggauca

SEQ ID NO: 1436700 - RNA, 22 nt, Pseudomonas aeruginosa PA01
ggacaacgacagccccggcccg

SEQ ID NO: 1436701 - RNA, 22 nt, Pseudomonas aeruginosa PA01
ggacaagguuugcgccgccgug

SEQ ID NO: 1436702 - RNA, 20 nt, Pseudomonas aeruginosa PA01
ggacaacccggcgcuggccg

SEQ ID NO: 1436703 - RNA, 12 nt, Pseudomonas aeruginosa PA01
ggacaaccgccg

SEQ ID NO: 1436704 - RNA, 17 nt, Pseudomonas aeruginosa PA01
ggaccaggcggccggug

SEQ ID NO: 1436705 - RNA, 17 nt, Pseudomonas aeruginosa PA01
ggaccaguucagcgcgc

SEQ ID NO: 1436706 - RNA, 14 nt, Pseudomonas aeruginosa PA01
ggaccagcgccugc

SEQ ID NO: 1436707 - RNA, 22 nt, Pseudomonas aeruginosa PA01
ggaccagaacgaaaaaggcgcg

SEQ ID NO: 1436708 - RNA, 18 nt, Pseudomonas aeruginosa PA01
ggaccagcgccgccaacc

SEQ ID NO: 1436709 - RNA, 12 nt, Pseudomonas aeruginosa PA01
ggaccagcccgu

SEQ ID NO: 1436710 - RNA, 11 nt, Pseudomonas aeruginosa PA01
ggaccagcgcc

SEQ ID NO: 1436711 - RNA, 17 nt, Pseudomonas aeruginosa PA01
ggacauggagaccuggc

SEQ ID NO: 1436712 - RNA, 20 nt, Pseudomonas aeruginosa PA01
ggacauggcgcucgagcuug

SEQ ID NO: 1436713 - RNA, 19 nt, Pseudomonas aeruginosa PA01
ggacauguugcagggucgc

SEQ ID NO: 1436714 - RNA, 16 nt, Pseudomonas aeruginosa PA01
ggaccaacagccggcg

SEQ ID NO: 1436715 - RNA, 17 nt, Pseudomonas aeruginosa PA01
ggaccacgcuggucacc

SEQ ID NO: 1436716 - RNA, 15 nt, Pseudomonas aeruginosa PA01
ggacauacaggcgcg

SEQ ID NO: 1436717 - RNA, 21 nt, Pseudomonas aeruginosa PA01
ggacagggcggcagcgugcuc

SEQ ID NO: 1436718 - RNA, 14 nt, Pseudomonas aeruginosa PA01
ggacaggucgcgga

SEQ ID NO: 1436719 - RNA, 20 nt, Pseudomonas aeruginosa PA01
ggacaggcgucccuggagca

SEQ ID NO: 1436720 - RNA, 16 nt, Pseudomonas aeruginosa PA01
ggacagggccaggccg

SEQ ID NO: 1436721 - RNA, 23 nt, Pseudomonas aeruginosa PA01
ggacagcuugacccguugcgccu

SEQ ID NO: 1436722 - RNA, 18 nt, Pseudomonas aeruginosa PA01
ggacaggaaaaagcccgc

SEQ ID NO: 1436723 - RNA, 19 nt, Pseudomonas aeruginosa PA01
ggacagcgugcggcccuug

SEQ ID NO: 1436724 - RNA, 23 nt, Pseudomonas aeruginosa PA01
ggacaggcagccggccaugcugg

SEQ ID NO: 1436725 - RNA, 12 nt, Pseudomonas aeruginosa PA01
ggacgccgaacg

SEQ ID NO: 1436726 - RNA, 13 nt, Pseudomonas aeruginosa PA01
ggacgccgaacgc

SEQ ID NO: 1436727 - RNA, 14 nt, Pseudomonas aeruginosa PA01
ggacgccgaacgcc

SEQ ID NO: 1436728 - RNA, 20 nt, Pseudomonas aeruginosa PA01
ggacgaugaucaccaggacc

SEQ ID NO: 1436729 - RNA, 17 nt, Pseudomonas aeruginosa PA01
ggacgauggucgccgcg

SEQ ID NO: 1436730 - RNA, 14 nt, Pseudomonas aeruginosa PA01
ggacgauggaacgc

SEQ ID NO: 1436731 - RNA, 15 nt, Pseudomonas aeruginosa PA01
ggacgcaggccgacc

SEQ ID NO: 1436732 - RNA, 16 nt, Pseudomonas aeruginosa PA01
ggacgcaggccgaccu

SEQ ID NO: 1436733 - RNA, 16 nt, Pseudomonas aeruginosa PA01
ggacgccaccaggccg

SEQ ID NO: 1436734 - RNA, 18 nt, Pseudomonas aeruginosa PA01
ggacgccaccaggccgcu

SEQ ID NO: 1436735 - RNA, 22 nt, Pseudomonas aeruginosa PA01
ggacgccaccaggccgcugccg

SEQ ID NO: 1436736 - RNA, 14 nt, Pseudomonas aeruginosa PA01
ggacgcaccagcag

SEQ ID NO: 1436737 - RNA, 17 nt, Pseudomonas aeruginosa PA01
ggacgcaccagcaggcc

SEQ ID NO: 1436738 - RNA, 15 nt, Pseudomonas aeruginosa PA01
ggacgacaucucguc

SEQ ID NO: 1436739 - RNA, 16 nt, Pseudomonas aeruginosa PA01
ggacgaaaaccgcaga

SEQ ID NO: 1436740 - RNA, 17 nt, Pseudomonas aeruginosa PA01
ggaccuucgacggcagg

SEQ ID NO: 1436741 - RNA, 22 nt, Pseudomonas aeruginosa PA01
ggaccugucggcucgcgccggc

SEQ ID NO: 1436742 - RNA, 23 nt, Pseudomonas aeruginosa PA01
ggaccugucggcucgcgccggcg

SEQ ID NO: 1436743 - RNA, 18 nt, Pseudomonas aeruginosa PA01
ggaccugcugcccggcau

SEQ ID NO: 1436744 - RNA, 12 nt, Pseudomonas aeruginosa PA01
ggaccuggccgc

SEQ ID NO: 1436745 - RNA, 13 nt, Pseudomonas aeruginosa PA01
ggaccuggccgcg

SEQ ID NO: 1436746 - RNA, 13 nt, Pseudomonas aeruginosa PA01
ggaccuggccggc

SEQ ID NO: 1436747 - RNA, 14 nt, Pseudomonas aeruginosa PA01
ggaccuggccggcg

SEQ ID NO: 1436748 - RNA, 15 nt, Pseudomonas aeruginosa PA01
ggaccuggccggcga

SEQ ID NO: 1436749 - RNA, 12 nt, Pseudomonas aeruginosa PA01
ggaccuggccgu

SEQ ID NO: 1436750 - RNA, 21 nt, Pseudomonas aeruginosa PA01
ggaccuggccguuggcgaaca

SEQ ID NO: 1436751 - RNA, 15 nt, Pseudomonas aeruginosa PA01
ggacgagcguccgcc

SEQ ID NO: 1436752 - RNA, 14 nt, Pseudomonas aeruginosa PA01
ggacgaggaaggcg

SEQ ID NO: 1436753 - RNA, 15 nt, Pseudomonas aeruginosa PA01
ggacgaggaaggcgc

SEQ ID NO: 1436754 - RNA, 18 nt, Pseudomonas aeruginosa PA01
ggacgaggaaggcgcgca

SEQ ID NO: 1436755 - RNA, 22 nt, Pseudomonas aeruginosa PA01
ggacgaggauggucaggccggc

SEQ ID NO: 1436756 - RNA, 23 nt, Pseudomonas aeruginosa PA01
ggacgaggauggucaggccggcg

SEQ ID NO: 1436757 - RNA, 14 nt, Pseudomonas aeruginosa PA01
ggacgacgcuggcc

SEQ ID NO: 1436758 - RNA, 19 nt, Pseudomonas aeruginosa PA01
ggacgacgcuggccugccg

SEQ ID NO: 1436759 - RNA, 20 nt, Pseudomonas aeruginosa PA01
ggacgacgaaagaagccgca

SEQ ID NO: 1436760 - RNA, 19 nt, Pseudomonas aeruginosa PA01
ggacgacgaagugaccgcg

SEQ ID NO: 1436761 - RNA, 18 nt, Pseudomonas aeruginosa PA01
ggaccuccagccggccau

SEQ ID NO: 1436762 - RNA, 20 nt, Pseudomonas aeruginosa PA01
ggaccuccagccggccaucc

SEQ ID NO: 1436763 - RNA, 14 nt, Pseudomonas aeruginosa PA01
ggaccuccgccagg

SEQ ID NO: 1436764 - RNA, 19 nt, Pseudomonas aeruginosa PA01
ggaccuccgccaggucgau

SEQ ID NO: 1436765 - RNA, 22 nt, Pseudomonas aeruginosa PA01
ggaccucggguuuggcgcccgc

SEQ ID NO: 1436766 - RNA, 23 nt, Pseudomonas aeruginosa PA01
ggaccuccuggcgcgucggccgc

SEQ ID NO: 1436767 - RNA, 20 nt, Pseudomonas aeruginosa PA01
ggaccucgaagcuggccagu

SEQ ID NO: 1436768 - RNA, 16 nt, Pseudomonas aeruginosa PA01
ggaccggcucgucggc

SEQ ID NO: 1436769 - RNA, 20 nt, Pseudomonas aeruginosa PA01
ggaccggcucgucggcguug

SEQ ID NO: 1436770 - RNA, 22 nt, Pseudomonas aeruginosa PA01
ggaccggugccccgcuggccca

SEQ ID NO: 1436771 - RNA, 17 nt, Pseudomonas aeruginosa PA01
ggaccgggcggcaggcg

SEQ ID NO: 1436772 - RNA, 13 nt, Pseudomonas aeruginosa PA01
ggaccgggcggcg

SEQ ID NO: 1436773 - RNA, 20 nt, Pseudomonas aeruginosa PA01
ggacccugccguucgucacc

SEQ ID NO: 1436774 - RNA, 20 nt, Pseudomonas aeruginosa PA01
ggaccgcagaaccagacgcu

SEQ ID NO: 1436775 - RNA, 14 nt, Pseudomonas aeruginosa PA01
ggaccgccauggcg

SEQ ID NO: 1436776 - RNA, 22 nt, Pseudomonas aeruginosa PA01
ggacccagaaaccgaucagcac

SEQ ID NO: 1436777 - RNA, 15 nt, Pseudomonas aeruginosa PA01
ggaccauggccggcg

SEQ ID NO: 1436778 - RNA, 22 nt, Pseudomonas aeruginosa PA01
ggacccguugccgaccgagcag

SEQ ID NO: 1436779 - RNA, 12 nt, Pseudomonas aeruginosa PA01
gggcagcggccc

SEQ ID NO: 1436780 - RNA, 15 nt, Pseudomonas aeruginosa PA01
gggcagcggucgccg

SEQ ID NO: 1436781 - RNA, 22 nt, Pseudomonas aeruginosa PA01
gggcagcgcgauaucgcaggcc

SEQ ID NO: 1436782 - RNA, 13 nt, Pseudomonas aeruginosa PA01
gggcagccgccgc

SEQ ID NO: 1436783 - RNA, 15 nt, Pseudomonas aeruginosa PA01
gggcagccuggcugc

SEQ ID NO: 1436784 - RNA, 14 nt, Pseudomonas aeruginosa PA01
gggcaggcaugcgg

SEQ ID NO: 1436785 - RNA, 18 nt, Pseudomonas aeruginosa PA01
gggcaggcaugcggcccc

SEQ ID NO: 1436786 - RNA, 23 nt, Pseudomonas aeruginosa PA01
gggcagcuuggcggucagcgacu

SEQ ID NO: 1436787 - RNA, 19 nt, Pseudomonas aeruginosa PA01
gggcagcgucgccgggcgu

SEQ ID NO: 1436788 - RNA, 12 nt, Pseudomonas aeruginosa PA01
gggcagcggcga

SEQ ID NO: 1436789 - RNA, 19 nt, Pseudomonas aeruginosa PA01
gggcagggaguccgccagc

SEQ ID NO: 1436790 - RNA, 15 nt, Pseudomonas aeruginosa PA01
gggcagggcagccgc

SEQ ID NO: 1436791 - RNA, 16 nt, Pseudomonas aeruginosa PA01
gggcauccaucgccag

SEQ ID NO: 1436792 - RNA, 15 nt, Pseudomonas aeruginosa PA01
gggcauagaugccgc

SEQ ID NO: 1436793 - RNA, 14 nt, Pseudomonas aeruginosa PA01
gggcauccagcgga

SEQ ID NO: 1436794 - RNA, 22 nt, Pseudomonas aeruginosa PA01
gggcaguuccgccagaugcgcg

SEQ ID NO: 1436795 - RNA, 21 nt, Pseudomonas aeruginosa PA01
gggcagguguucgcaaagcuc

SEQ ID NO: 1436796 - RNA, 15 nt, Pseudomonas aeruginosa PA01
gggcaguacguggcg

SEQ ID NO: 1436797 - RNA, 13 nt, Pseudomonas aeruginosa PA01
gggcaugccgugg

SEQ ID NO: 1436798 - RNA, 13 nt, Pseudomonas aeruginosa PA01
gggcaucggccau

SEQ ID NO: 1436799 - RNA, 19 nt, Pseudomonas aeruginosa PA01
gggcauucgcagcggcccc

SEQ ID NO: 1436800 - RNA, 14 nt, Pseudomonas aeruginosa PA01
gggcauucguccag

SEQ ID NO: 1436801 - RNA, 22 nt, Pseudomonas aeruginosa PA01
gggcauguccaccgccgccagc

SEQ ID NO: 1436802 - RNA, 13 nt, Pseudomonas aeruginosa PA01
gggcaugggucag

SEQ ID NO: 1436803 - RNA, 18 nt, Pseudomonas aeruginosa PA01
gggcaugggucagcgcca

SEQ ID NO: 1436804 - RNA, 19 nt, Pseudomonas aeruginosa PA01
gggcaugggucagcgccag

SEQ ID NO: 1436805 - RNA, 12 nt, Pseudomonas aeruginosa PA01
gggccaggccga

SEQ ID NO: 1436806 - RNA, 14 nt, Pseudomonas aeruginosa PA01
gggccaggccgagc

SEQ ID NO: 1436807 - RNA, 23 nt, Pseudomonas aeruginosa PA01
gggccaggccgagcaauccggcg

SEQ ID NO: 1436808 - RNA, 19 nt, Pseudomonas aeruginosa PA01
gggccaggucgguccgccg

SEQ ID NO: 1436809 - RNA, 19 nt, Pseudomonas aeruginosa PA01
gggccagggcggcggcgau

SEQ ID NO: 1436810 - RNA, 18 nt, Pseudomonas aeruginosa PA01
gggccagggaggcgcugg

SEQ ID NO: 1436811 - RNA, 19 nt, Pseudomonas aeruginosa PA01
gggccaggaugaccaggcu

SEQ ID NO: 1436812 - RNA, 18 nt, Pseudomonas aeruginosa PA01
gggccaggcauccagcac

SEQ ID NO: 1436813 - RNA, 14 nt, Pseudomonas aeruginosa PA01
gggccagcgccugg

SEQ ID NO: 1436814 - RNA, 15 nt, Pseudomonas aeruginosa PA01
gggccagcccagaac

SEQ ID NO: 1436815 - RNA, 19 nt, Pseudomonas aeruginosa PA01
gggccagcccagaacagca

SEQ ID NO: 1436816 - RNA, 12 nt, Pseudomonas aeruginosa PA01
gggccagcgccu

SEQ ID NO: 1436817 - RNA, 14 nt, Pseudomonas aeruginosa PA01
gggccaccggcugc

SEQ ID NO: 1436818 - RNA, 19 nt, Pseudomonas aeruginosa PA01
gggcauuggccaucagcgc

SEQ ID NO: 1436819 - RNA, 15 nt, Pseudomonas aeruginosa PA01
gggccagcaggccga

SEQ ID NO: 1436820 - RNA, 14 nt, Pseudomonas aeruginosa PA01
gggccagcaggcgc

SEQ ID NO: 1436821 - RNA, 14 nt, Pseudomonas aeruginosa PA01
gggccagcagcgcu

SEQ ID NO: 1436822 - RNA, 13 nt, Pseudomonas aeruginosa PA01
gggccagcagcgg

SEQ ID NO: 1436823 - RNA, 19 nt, Pseudomonas aeruginosa PA01
gggccagcagcggcggcgc

SEQ ID NO: 1436824 - RNA, 21 nt, Pseudomonas aeruginosa PA01
gggccagcagcuccgggcugg

SEQ ID NO: 1436825 - RNA, 14 nt, Pseudomonas aeruginosa PA01
gggccgccagccgc

SEQ ID NO: 1436826 - RNA, 18 nt, Pseudomonas aeruginosa PA01
gggccgccgaugccgacg

SEQ ID NO: 1436827 - RNA, 20 nt, Pseudomonas aeruginosa PA01
gggccgccuggucggggccg

SEQ ID NO: 1436828 - RNA, 22 nt, Pseudomonas aeruginosa PA01
gggccgcgagagguucaccgac

SEQ ID NO: 1436829 - RNA, 19 nt, Pseudomonas aeruginosa PA01
gggccgccguacaggccac

SEQ ID NO: 1436830 - RNA, 13 nt, Pseudomonas aeruginosa PA01
gggccgcgccgac

SEQ ID NO: 1436831 - RNA, 12 nt, Pseudomonas aeruginosa PA01
gggccgcgcugu

SEQ ID NO: 1436832 - RNA, 16 nt, Pseudomonas aeruginosa PA01
gggccggagcaggcca

SEQ ID NO: 1436833 - RNA, 13 nt, Pseudomonas aeruginosa PA01
gggccggcgccag

SEQ ID NO: 1436834 - RNA, 20 nt, Pseudomonas aeruginosa PA01
gggccggcaugcucagccgc

SEQ ID NO: 1436835 - RNA, 13 nt, Pseudomonas aeruginosa PA01
gggccggaucggc

SEQ ID NO: 1436836 - RNA, 15 nt, Pseudomonas aeruginosa PA01
gggccggaucggccu

SEQ ID NO: 1436837 - RNA, 17 nt, Pseudomonas aeruginosa PA01
gggccggaucggccuug

SEQ ID NO: 1436838 - RNA, 12 nt, Pseudomonas aeruginosa PA01
gggccggccugg

SEQ ID NO: 1436839 - RNA, 15 nt, Pseudomonas aeruginosa PA01
gggccggggaucggc

SEQ ID NO: 1436840 - RNA, 18 nt, Pseudomonas aeruginosa PA01
gggccgggggcggcgccu

SEQ ID NO: 1436841 - RNA, 20 nt, Pseudomonas aeruginosa PA01
gggccgggggcggcgccugg

SEQ ID NO: 1436842 - RNA, 21 nt, Pseudomonas aeruginosa PA01
gggccgggucaucaccggcag

SEQ ID NO: 1436843 - RNA, 19 nt, Pseudomonas aeruginosa PA01
gggccgguucggauccgga

SEQ ID NO: 1436844 - RNA, 17 nt, Pseudomonas aeruginosa PA01
gggccgguugcggcgcc

SEQ ID NO: 1436845 - RNA, 19 nt, Pseudomonas aeruginosa PA01
gggccgguugcggcgccgg

SEQ ID NO: 1436846 - RNA, 18 nt, Pseudomonas aeruginosa PA01
gggcccagagcagcacca

SEQ ID NO: 1436847 - RNA, 17 nt, Pseudomonas aeruginosa PA01
gggcccaguucgcguag

SEQ ID NO: 1436848 - RNA, 14 nt, Pseudomonas aeruginosa PA01
gggcccauggcggu

SEQ ID NO: 1436849 - RNA, 13 nt, Pseudomonas aeruginosa PA01
gggccaucgccgg

SEQ ID NO: 1436850 - RNA, 19 nt, Pseudomonas aeruginosa PA01
gggccaugagcagggcgga

SEQ ID NO: 1436851 - RNA, 22 nt, Pseudomonas aeruginosa PA01
gggccaucagguccaccagcca

SEQ ID NO: 1436852 - RNA, 21 nt, Pseudomonas aeruginosa PA01
gggccauuguucuuuggccaa

SEQ ID NO: 1436853 - RNA, 17 nt, Pseudomonas aeruginosa PA01
gggcccacagugccagg

SEQ ID NO: 1436854 - RNA, 19 nt, Pseudomonas aeruginosa PA01
gggcccacagugccaggcu

SEQ ID NO: 1436855 - RNA, 20 nt, Pseudomonas aeruginosa PA01
gggcccacagugccaggcuc

SEQ ID NO: 1436856 - RNA, 14 nt, Pseudomonas aeruginosa PA01
gggccccggccagg

SEQ ID NO: 1436857 - RNA, 15 nt, Pseudomonas aeruginosa PA01
gggccccggccaggu

SEQ ID NO: 1436858 - RNA, 14 nt, Pseudomonas aeruginosa PA01
gggccgagcgcagc

SEQ ID NO: 1436859 - RNA, 14 nt, Pseudomonas aeruginosa PA01
gggccgaugccggg

SEQ ID NO: 1436860 - RNA, 16 nt, Pseudomonas aeruginosa PA01
gggccgaugccgggca

SEQ ID NO: 1436861 - RNA, 23 nt, Pseudomonas aeruginosa PA01
gggccgaggucgcgggccaggcc

SEQ ID NO: 1436862 - RNA, 20 nt, Pseudomonas aeruginosa PA01
gggccgaucgagcggcccgc

SEQ ID NO: 1436863 - RNA, 19 nt, Pseudomonas aeruginosa PA01
gggccgaaggccaggccgg

SEQ ID NO: 1436864 - RNA, 21 nt, Pseudomonas aeruginosa PA01
gggccgaaggccaggccggcg

SEQ ID NO: 1436865 - RNA, 23 nt, Pseudomonas aeruginosa PA01
gggcccugccagaggaucggcca

SEQ ID NO: 1436866 - RNA, 15 nt, Pseudomonas aeruginosa PA01
gggcccuccaggcga

SEQ ID NO: 1436867 - RNA, 17 nt, Pseudomonas aeruginosa PA01
gggauggcgcgguccgc

SEQ ID NO: 1436868 - RNA, 18 nt, Pseudomonas aeruginosa PA01
gggauggcgcgguccgcg

SEQ ID NO: 1436869 - RNA, 14 nt, Pseudomonas aeruginosa PA01
gggaugccauggca

SEQ ID NO: 1436870 - RNA, 13 nt, Pseudomonas aeruginosa PA01
gggaugccgccgg

SEQ ID NO: 1436871 - RNA, 15 nt, Pseudomonas aeruginosa PA01
gggaugcccgucagg

SEQ ID NO: 1436872 - RNA, 22 nt, Pseudomonas aeruginosa PA01
gggaucuggcccugcaacagga

SEQ ID NO: 1436873 - RNA, 15 nt, Pseudomonas aeruginosa PA01
gggaucuccgcgcca

SEQ ID NO: 1436874 - RNA, 13 nt, Pseudomonas aeruginosa PA01
gggcaaaggcgcg

SEQ ID NO: 1436875 - RNA, 15 nt, Pseudomonas aeruginosa PA01
gggcaaaggcgcgca

SEQ ID NO: 1436876 - RNA, 17 nt, Pseudomonas aeruginosa PA01
gggcaaacagcuccggu

SEQ ID NO: 1436877 - RNA, 14 nt, Pseudomonas aeruginosa PA01
gggcaacaggccga

SEQ ID NO: 1436878 - RNA, 15 nt, Pseudomonas aeruginosa PA01
gggcaacaggccgau

SEQ ID NO: 1436879 - RNA, 13 nt, Pseudomonas aeruginosa PA01
gggcaacgccagg

SEQ ID NO: 1436880 - RNA, 14 nt, Pseudomonas aeruginosa PA01
gggcaacgccaggc

SEQ ID NO: 1436881 - RNA, 17 nt, Pseudomonas aeruginosa PA01
gggcaacgccaggccgc

SEQ ID NO: 1436882 - RNA, 18 nt, Pseudomonas aeruginosa PA01
gggcaacgccaggccgcu

SEQ ID NO: 1436883 - RNA, 15 nt, Pseudomonas aeruginosa PA01
gggcaacgccaggcu

SEQ ID NO: 1436884 - RNA, 20 nt, Pseudomonas aeruginosa PA01
gggcaacgcgcagaggcgcu

SEQ ID NO: 1436885 - RNA, 13 nt, Pseudomonas aeruginosa PA01
gggauggucgaga

SEQ ID NO: 1436886 - RNA, 18 nt, Pseudomonas aeruginosa PA01
gggauuccgggucgaggc

SEQ ID NO: 1436887 - RNA, 17 nt, Pseudomonas aeruginosa PA01
gggcaccgccagcccgc

SEQ ID NO: 1436888 - RNA, 20 nt, Pseudomonas aeruginosa PA01
gggcacccgguugaccccgc

SEQ ID NO: 1436889 - RNA, 21 nt, Pseudomonas aeruginosa PA01
gggcacccgguugaccccgcg

SEQ ID NO: 1436890 - RNA, 12 nt, Pseudomonas aeruginosa PA01
gggcaagcugca

SEQ ID NO: 1436891 - RNA, 21 nt, Pseudomonas aeruginosa PA01
gggcaagcugcacggcgaccc

SEQ ID NO: 1436892 - RNA, 20 nt, Pseudomonas aeruginosa PA01
gggcacuucguccaggccgc

SEQ ID NO: 1436893 - RNA, 22 nt, Pseudomonas aeruginosa PA01
gggcacuucucgaacagcuccu

SEQ ID NO: 1436894 - RNA, 19 nt, Pseudomonas aeruginosa PA01
gggcacguugggaucgcug

SEQ ID NO: 1436895 - RNA, 18 nt, Pseudomonas aeruginosa PA01
gggcacgaucugcgccgc

SEQ ID NO: 1436896 - RNA, 17 nt, Pseudomonas aeruginosa PA01
gggcagaguggcgcggc

SEQ ID NO: 1436897 - RNA, 14 nt, Pseudomonas aeruginosa PA01
gggcagcagcgaac

SEQ ID NO: 1436898 - RNA, 14 nt, Pseudomonas aeruginosa PA01
gggcagcaggucgc

SEQ ID NO: 1436899 - RNA, 21 nt, Pseudomonas aeruginosa PA01
gggcacgccgguggccaggcu

SEQ ID NO: 1436900 - RNA, 19 nt, Pseudomonas aeruginosa PA01
gggcacggaaucggacgau

SEQ ID NO: 1436901 - RNA, 14 nt, Pseudomonas aeruginosa PA01
gggcacgucgcgga

SEQ ID NO: 1436902 - RNA, 17 nt, Pseudomonas aeruginosa PA01
gggcacgugcagcggca

SEQ ID NO: 1436903 - RNA, 22 nt, Pseudomonas aeruginosa PA01
gggcacgugcagcggcagcguc

SEQ ID NO: 1436904 - RNA, 23 nt, Pseudomonas aeruginosa PA01
gggcacgugcagcggcagcgucu

SEQ ID NO: 1436905 - RNA, 17 nt, Pseudomonas aeruginosa PA01
gggcacgcauagcgcgc

SEQ ID NO: 1436906 - RNA, 14 nt, Pseudomonas aeruginosa PA01
gggcaccgcgccgg

SEQ ID NO: 1436907 - RNA, 20 nt, Pseudomonas aeruginosa PA01
gggcaccgccgaggaacauc

SEQ ID NO: 1436908 - RNA, 18 nt, Pseudomonas aeruginosa PA01
gggaucgaugcgcgcccu

SEQ ID NO: 1436909 - RNA, 15 nt, Pseudomonas aeruginosa PA01
gggaucgccacgccg

SEQ ID NO: 1436910 - RNA, 17 nt, Pseudomonas aeruginosa PA01
gggaucgccacgccggc

SEQ ID NO: 1436911 - RNA, 18 nt, Pseudomonas aeruginosa PA01
gggaucgccacgccggcg

SEQ ID NO: 1436912 - RNA, 20 nt, Pseudomonas aeruginosa PA01
gggaucgccacgccggcgcu

SEQ ID NO: 1436913 - RNA, 23 nt, Pseudomonas aeruginosa PA01
gggaucgccacgccggcgcuccu

SEQ ID NO: 1436914 - RNA, 20 nt, Pseudomonas aeruginosa PA01
gggauccugcucagcggccc

SEQ ID NO: 1436915 - RNA, 17 nt, Pseudomonas aeruginosa PA01
gggaucaggucgccgcu

SEQ ID NO: 1436916 - RNA, 23 nt, Pseudomonas aeruginosa PA01
gggaucagcgagagcuguccggc

SEQ ID NO: 1436917 - RNA, 19 nt, Pseudomonas aeruginosa PA01
gggaucagcggcggggcca

SEQ ID NO: 1436918 - RNA, 19 nt, Pseudomonas aeruginosa PA01
gggaucacgaagcggucgc

SEQ ID NO: 1436919 - RNA, 13 nt, Pseudomonas aeruginosa PA01
gggauaccggcca

SEQ ID NO: 1436920 - RNA, 14 nt, Pseudomonas aeruginosa PA01
gggaguccgccagc

SEQ ID NO: 1436921 - RNA, 15 nt, Pseudomonas aeruginosa PA01
gggagucgcuggcca

SEQ ID NO: 1436922 - RNA, 19 nt, Pseudomonas aeruginosa PA01
gggagucaacgccuggcca

SEQ ID NO: 1436923 - RNA, 21 nt, Pseudomonas aeruginosa PA01
gggagcgccuggcgucgaugc

SEQ ID NO: 1436924 - RNA, 13 nt, Pseudomonas aeruginosa PA01
gggagcgcgaggc

SEQ ID NO: 1436925 - RNA, 12 nt, Pseudomonas aeruginosa PA01
gggagcggccgu

SEQ ID NO: 1436926 - RNA, 14 nt, Pseudomonas aeruginosa PA01
gggaggaacccagg

SEQ ID NO: 1436927 - RNA, 15 nt, Pseudomonas aeruginosa PA01
gggaggaacccaggu

SEQ ID NO: 1436928 - RNA, 18 nt, Pseudomonas aeruginosa PA01
gggaggaagcuccccgca

SEQ ID NO: 1436929 - RNA, 14 nt, Pseudomonas aeruginosa PA01
gggaggaugccgua

SEQ ID NO: 1436930 - RNA, 18 nt, Pseudomonas aeruginosa PA01
gggaggucgcacgcagcg

SEQ ID NO: 1436931 - RNA, 22 nt, Pseudomonas aeruginosa PA01
gggaggucgcacgcagcgccgc

SEQ ID NO: 1436932 - RNA, 13 nt, Pseudomonas aeruginosa PA01
gggagggugccgu

SEQ ID NO: 1436933 - RNA, 11 nt, Pseudomonas aeruginosa PA01
gggagccaggc

SEQ ID NO: 1436934 - RNA, 13 nt, Pseudomonas aeruginosa PA01
gggaggcgccgcg

SEQ ID NO: 1436935 - RNA, 19 nt, Pseudomonas aeruginosa PA01
gggaggcgccgcgccaggu

SEQ ID NO: 1436936 - RNA, 16 nt, Pseudomonas aeruginosa PA01
gggagcaucuggcccg

SEQ ID NO: 1436937 - RNA, 13 nt, Pseudomonas aeruginosa PA01
gggagagcgccgu

SEQ ID NO: 1436938 - RNA, 12 nt, Pseudomonas aeruginosa PA01
gggagaacagca

SEQ ID NO: 1436939 - RNA, 21 nt, Pseudomonas aeruginosa PA01
gggagaacuuuucccagcggc

SEQ ID NO: 1436940 - RNA, 16 nt, Pseudomonas aeruginosa PA01
gggacugagccgcugg

SEQ ID NO: 1436941 - RNA, 15 nt, Pseudomonas aeruginosa PA01
gggacuggggcaugg

SEQ ID NO: 1436942 - RNA, 17 nt, Pseudomonas aeruginosa PA01
ggcgucaguuccacgcg

SEQ ID NO: 1436943 - RNA, 22 nt, Pseudomonas aeruginosa PA01
ggcgucaguuccgcaucggcca

SEQ ID NO: 1436944 - RNA, 23 nt, Pseudomonas aeruginosa PA01
ggcgucaguuccgcaucggccac

SEQ ID NO: 1436945 - RNA, 18 nt, Pseudomonas aeruginosa PA01
ggcgucauagcagcgccg

SEQ ID NO: 1436946 - RNA, 13 nt, Pseudomonas aeruginosa PA01
ggcgucaacgaag

SEQ ID NO: 1436947 - RNA, 15 nt, Pseudomonas aeruginosa PA01
ggcguauucggcgac

SEQ ID NO: 1436948 - RNA, 20 nt, Pseudomonas aeruginosa PA01
ggcguaguggugccacaggu

SEQ ID NO: 1436949 - RNA, 20 nt, Pseudomonas aeruginosa PA01
ggcguccacuccggcagcac

SEQ ID NO: 1436950 - RNA, 21 nt, Pseudomonas aeruginosa PA01
gggaccggcugcuuggccagg

SEQ ID NO: 1436951 - RNA, 22 nt, Pseudomonas aeruginosa PA01
gggaccugucggcucgcgccgg

SEQ ID NO: 1436952 - RNA, 15 nt, Pseudomonas aeruginosa PA01
ggcgucacgccgauc

SEQ ID NO: 1436953 - RNA, 17 nt, Pseudomonas aeruginosa PA01
gggacgcaugcgcggcg

SEQ ID NO: 1436954 - RNA, 19 nt, Pseudomonas aeruginosa PA01
gggacggaagcauggccgg

SEQ ID NO: 1436955 - RNA, 21 nt, Pseudomonas aeruginosa PA01
gggacggaagcauggccggcu

SEQ ID NO: 1436956 - RNA, 22 nt, Pseudomonas aeruginosa PA01
gggacgcccggagcgcgaaagc

SEQ ID NO: 1436957 - RNA, 13 nt, Pseudomonas aeruginosa PA01
gggacgcgcagcg

SEQ ID NO: 1436958 - RNA, 16 nt, Pseudomonas aeruginosa PA01
gggacgcgcagcggcg

SEQ ID NO: 1436959 - RNA, 21 nt, Pseudomonas aeruginosa PA01
gggacgcgcagcggcgccgag

SEQ ID NO: 1436960 - RNA, 13 nt, Pseudomonas aeruginosa PA01
gggacgcgccggc

SEQ ID NO: 1436961 - RNA, 16 nt, Pseudomonas aeruginosa PA01
gggacgcgccggcgga

SEQ ID NO: 1436962 - RNA, 21 nt, Pseudomonas aeruginosa PA01
gggacgcgccggcggaucaca

SEQ ID NO: 1436963 - RNA, 17 nt, Pseudomonas aeruginosa PA01
gggcuucccaggccagc

SEQ ID NO: 1436964 - RNA, 15 nt, Pseudomonas aeruginosa PA01
gggcuuccuggccgg

SEQ ID NO: 1436965 - RNA, 23 nt, Pseudomonas aeruginosa PA01
gggcuuccuggccgggggucgcg

SEQ ID NO: 1436966 - RNA, 16 nt, Pseudomonas aeruginosa PA01
gggcuucgguguaucg

SEQ ID NO: 1436967 - RNA, 13 nt, Pseudomonas aeruginosa PA01
gggcuucguccgc

SEQ ID NO: 1436968 - RNA, 17 nt, Pseudomonas aeruginosa PA01
gggcuucguccgccugg

SEQ ID NO: 1436969 - RNA, 18 nt, Pseudomonas aeruginosa PA01
gggcuucguccgccuggg

SEQ ID NO: 1436970 - RNA, 19 nt, Pseudomonas aeruginosa PA01
gggcuugccggggucgagg

SEQ ID NO: 1436971 - RNA, 13 nt, Pseudomonas aeruginosa PA01
gggcuugcgcccc

SEQ ID NO: 1436972 - RNA, 12 nt, Pseudomonas aeruginosa PA01
gggcugggcgcc

SEQ ID NO: 1436973 - RNA, 17 nt, Pseudomonas aeruginosa PA01
gggcugggucggcuggc

SEQ ID NO: 1436974 - RNA, 16 nt, Pseudomonas aeruginosa PA01
gggcuguaaucgccgc

SEQ ID NO: 1436975 - RNA, 14 nt, Pseudomonas aeruginosa PA01
gggcuggccgucga

SEQ ID NO: 1436976 - RNA, 17 nt, Pseudomonas aeruginosa PA01
gggcugggcagcgccgc

SEQ ID NO: 1436977 - RNA, 23 nt, Pseudomonas aeruginosa PA01
gggcugggcagcgccgccgggcg

SEQ ID NO: 1436978 - RNA, 19 nt, Pseudomonas aeruginosa PA01
gggcuuuuucaugcgugcg

SEQ ID NO: 1436979 - RNA, 20 nt, Pseudomonas aeruginosa PA01
gggcuuuuucaugcgugcga

SEQ ID NO: 1436980 - RNA, 19 nt, Pseudomonas aeruginosa PA01
gggcuuuuucguuuccggc

SEQ ID NO: 1436981 - RNA, 22 nt, Pseudomonas aeruginosa PA01
ggggaaacccucaggucggcgc

SEQ ID NO: 1436982 - RNA, 17 nt, Pseudomonas aeruginosa PA01
gggcuuuuucucgucgc

SEQ ID NO: 1436983 - RNA, 21 nt, Pseudomonas aeruginosa PA01
gggcuuuuucucgucgcgcga

SEQ ID NO: 1436984 - RNA, 22 nt, Pseudomonas aeruginosa PA01
ggggaaaccuucgguggcgacc

SEQ ID NO: 1436985 - RNA, 20 nt, Pseudomonas aeruginosa PA01
ggggaaauccuugagcaccc

SEQ ID NO: 1436986 - RNA, 21 nt, Pseudomonas aeruginosa PA01
ggggaacagcgccagcggcag

SEQ ID NO: 1436987 - RNA, 22 nt, Pseudomonas aeruginosa PA01
ggggacggaagcauggccggcu

SEQ ID NO: 1436988 - RNA, 16 nt, Pseudomonas aeruginosa PA01
ggggaggggagguaag

SEQ ID NO: 1436989 - RNA, 14 nt, Pseudomonas aeruginosa PA01
ggggaagaucuccg

SEQ ID NO: 1436990 - RNA, 22 nt, Pseudomonas aeruginosa PA01
ggggaagugaagagcucccugc

SEQ ID NO: 1436991 - RNA, 19 nt, Pseudomonas aeruginosa PA01
ggggaagcgauccaugcgc

SEQ ID NO: 1436992 - RNA, 20 nt, Pseudomonas aeruginosa PA01
ggggaagcugccuuccagca

SEQ ID NO: 1436993 - RNA, 16 nt, Pseudomonas aeruginosa PA01
ggggaaucugcgccag

SEQ ID NO: 1436994 - RNA, 13 nt, Pseudomonas aeruginosa PA01
ggggaugcgcgag

SEQ ID NO: 1436995 - RNA, 14 nt, Pseudomonas aeruginosa PA01
ggggaugcgcgagg

SEQ ID NO: 1436996 - RNA, 17 nt, Pseudomonas aeruginosa PA01
ggggauggucggugacc

SEQ ID NO: 1436997 - RNA, 17 nt, Pseudomonas aeruginosa PA01
ggggaucaggucgccgc

SEQ ID NO: 1436998 - RNA, 23 nt, Pseudomonas aeruginosa PA01
ggggaguacuacccccucgaccu

SEQ ID NO: 1436999 - RNA, 21 nt, Pseudomonas aeruginosa PA01
ggggccggacgcgacugcugc

SEQ ID NO: 1437000 - RNA, 12 nt, Pseudomonas aeruginosa PA01
ggggccggcgau

SEQ ID NO: 1437001 - RNA, 12 nt, Pseudomonas aeruginosa PA01
ggggccugcugc

SEQ ID NO: 1437002 - RNA, 19 nt, Pseudomonas aeruginosa PA01
ggggccuggcucgaucggc

SEQ ID NO: 1437003 - RNA, 18 nt, Pseudomonas aeruginosa PA01
ggggcgaggucggccugc

SEQ ID NO: 1437004 - RNA, 22 nt, Pseudomonas aeruginosa PA01
ggggcgaccagcaucaugaucu

SEQ ID NO: 1437005 - RNA, 17 nt, Pseudomonas aeruginosa PA01
ggggccuucaggcgcuc

SEQ ID NO: 1437006 - RNA, 16 nt, Pseudomonas aeruginosa PA01
ggggcgcaaggccagc

SEQ ID NO: 1437007 - RNA, 24 nt, Pseudomonas aeruginosa PA01
ggggcuuuuuuaugcgcagcgcgg

SEQ ID NO: 1437008 - RNA, 21 nt, Pseudomonas aeruginosa PA01
ggggcuuuuuucguggccgcg

SEQ ID NO: 1437009 - RNA, 17 nt, Pseudomonas aeruginosa PA01
gggcgucugcucauucg

SEQ ID NO: 1437010 - RNA, 22 nt, Pseudomonas aeruginosa PA01
gggcgucugcucauucggccag

SEQ ID NO: 1437011 - RNA, 21 nt, Pseudomonas aeruginosa PA01
gggcgucuccugccgccgaua

SEQ ID NO: 1437012 - RNA, 18 nt, Pseudomonas aeruginosa PA01
gggcgugcaggccgccga

SEQ ID NO: 1437013 - RNA, 19 nt, Pseudomonas aeruginosa PA01
gggcgugcaggccgccgag

SEQ ID NO: 1437014 - RNA, 22 nt, Pseudomonas aeruginosa PA01
gggcgugccaggagcuugccga

SEQ ID NO: 1437015 - RNA, 13 nt, Pseudomonas aeruginosa PA01
gggcguugcucga

SEQ ID NO: 1437016 - RNA, 15 nt, Pseudomonas aeruginosa PA01
gggcguuggccagcg

SEQ ID NO: 1437017 - RNA, 21 nt, Pseudomonas aeruginosa PA01
gggcguuggcuccgggccgag

SEQ ID NO: 1437018 - RNA, 19 nt, Pseudomonas aeruginosa PA01
gggcguuuucguuggcgcg

SEQ ID NO: 1437019 - RNA, 15 nt, Pseudomonas aeruginosa PA01
gggcguugcgcgccu

SEQ ID NO: 1437020 - RNA, 16 nt, Pseudomonas aeruginosa PA01
gggcuacaucgucugc

SEQ ID NO: 1437021 - RNA, 22 nt, Pseudomonas aeruginosa PA01
gggcuaccaggaagcucggcag

SEQ ID NO: 1437022 - RNA, 19 nt, Pseudomonas aeruginosa PA01
gggcguucuuggccgcgcc

SEQ ID NO: 1437023 - RNA, 23 nt, Pseudomonas aeruginosa PA01
gggcguucuuggccgcgccgaag

SEQ ID NO: 1437024 - RNA, 13 nt, Pseudomonas aeruginosa PA01
gggcgugucgagg

SEQ ID NO: 1437025 - RNA, 23 nt, Pseudomonas aeruginosa PA01
gggcgugucgaggaaggccagca

SEQ ID NO: 1437026 - RNA, 15 nt, Pseudomonas aeruginosa PA01
gggcgucgacgaacg

SEQ ID NO: 1437027 - RNA, 15 nt, Pseudomonas aeruginosa PA01
gggcgucgaacaccg

SEQ ID NO: 1437028 - RNA, 22 nt, Pseudomonas aeruginosa PA01
gggcgucgaacaccggcgccgc

SEQ ID NO: 1437029 - RNA, 20 nt, Pseudomonas aeruginosa PA01
gggcgucccguuccggcgca

SEQ ID NO: 1437030 - RNA, 23 nt, Pseudomonas aeruginosa PA01
gggcguaguagggacggugcagg

SEQ ID NO: 1437031 - RNA, 14 nt, Pseudomonas aeruginosa PA01
gggcguagcgcggc

SEQ ID NO: 1437032 - RNA, 16 nt, Pseudomonas aeruginosa PA01
gggcguagcgcggcag

SEQ ID NO: 1437033 - RNA, 17 nt, Pseudomonas aeruginosa PA01
gggcguagugcuccucg

SEQ ID NO: 1437034 - RNA, 19 nt, Pseudomonas aeruginosa PA01
gggcguagugcuccucguc

SEQ ID NO: 1437035 - RNA, 16 nt, Pseudomonas aeruginosa PA01
gggcgggucuggcgga

SEQ ID NO: 1437036 - RNA, 17 nt, Pseudomonas aeruginosa PA01
gggcggguaaagcgccc

SEQ ID NO: 1437037 - RNA, 19 nt, Pseudomonas aeruginosa PA01
gggcggguaaagcgcccgc

SEQ ID NO: 1437038 - RNA, 19 nt, Pseudomonas aeruginosa PA01
gggcgguagcgggccagca

SEQ ID NO: 1437039 - RNA, 22 nt, Pseudomonas aeruginosa PA01
gggcgguaugccggagugccgc

SEQ ID NO: 1437040 - RNA, 13 nt, Pseudomonas aeruginosa PA01
gggcggucgcgga

SEQ ID NO: 1437041 - RNA, 13 nt, Pseudomonas aeruginosa PA01
gggcggucggcca

SEQ ID NO: 1437042 - RNA, 15 nt, Pseudomonas aeruginosa PA01
gggcggucggccagg

SEQ ID NO: 1437043 - RNA, 19 nt, Pseudomonas aeruginosa PA01
gggcguaacggcucgccgg

SEQ ID NO: 1437044 - RNA, 14 nt, Pseudomonas aeruginosa PA01
gggcguaacggcuu

SEQ ID NO: 1437045 - RNA, 19 nt, Pseudomonas aeruginosa PA01
gggcugaagugggucgccg

SEQ ID NO: 1437046 - RNA, 15 nt, Pseudomonas aeruginosa PA01
gggcugccaccgagg

SEQ ID NO: 1437047 - RNA, 14 nt, Pseudomonas aeruginosa PA01
gggcugaucucggc

SEQ ID NO: 1437048 - RNA, 20 nt, Pseudomonas aeruginosa PA01
gggcugaucucggccauggu

SEQ ID NO: 1437049 - RNA, 17 nt, Pseudomonas aeruginosa PA01
gggcuggccaccagcac

SEQ ID NO: 1437050 - RNA, 23 nt, Pseudomonas aeruginosa PA01
gggcuggccaccgccaggaccuc

SEQ ID NO: 1437051 - RNA, 17 nt, Pseudomonas aeruginosa PA01
gggcugcgugccagcac

SEQ ID NO: 1437052 - RNA, 22 nt, Pseudomonas aeruginosa PA01
gggcugcccaccaccaggacca

SEQ ID NO: 1437053 - RNA, 17 nt, Pseudomonas aeruginosa PA01
gggcugccgaacaggcg

SEQ ID NO: 1437054 - RNA, 14 nt, Pseudomonas aeruginosa PA01
gggcugccgcccgg

SEQ ID NO: 1437055 - RNA, 12 nt, Pseudomonas aeruginosa PA01
gggcugccggcc

SEQ ID NO: 1437056 - RNA, 22 nt, Pseudomonas aeruginosa PA01
gggcuagguuuccccguggcgc

SEQ ID NO: 1437057 - RNA, 13 nt, Pseudomonas aeruginosa PA01
gggcuagucgcgc

SEQ ID NO: 1437058 - RNA, 16 nt, Pseudomonas aeruginosa PA01
gggcuagucgcgcagc

SEQ ID NO: 1437059 - RNA, 22 nt, Pseudomonas aeruginosa PA01
gggcuauucccgccgcuccggc

SEQ ID NO: 1437060 - RNA, 22 nt, Pseudomonas aeruginosa PA01
gggcucagcccaggcgccgcuc

SEQ ID NO: 1437061 - RNA, 15 nt, Pseudomonas aeruginosa PA01
gggcucagcgcgcgu

SEQ ID NO: 1437062 - RNA, 24 nt, Pseudomonas aeruginosa PA01
gggcucagcgcgcguagcgugccg

SEQ ID NO: 1437063 - RNA, 20 nt, Pseudomonas aeruginosa PA01
gggcuccgccgcgagcgaaa

SEQ ID NO: 1437064 - RNA, 12 nt, Pseudomonas aeruginosa PA01
gggcucgggcgc

SEQ ID NO: 1437065 - RNA, 14 nt, Pseudomonas aeruginosa PA01
gggcucggucgagc

SEQ ID NO: 1437066 - RNA, 14 nt, Pseudomonas aeruginosa PA01
gggcucggcgagcg

SEQ ID NO: 1437067 - RNA, 22 nt, Pseudomonas aeruginosa PA01
gggcucgcgcggggcgcgcugc

SEQ ID NO: 1437068 - RNA, 11 nt, Pseudomonas aeruginosa PA01
gggcucgccca

SEQ ID NO: 1437069 - RNA, 15 nt, Pseudomonas aeruginosa PA01
gggccugggcgccgc

SEQ ID NO: 1437070 - RNA, 15 nt, Pseudomonas aeruginosa PA01
gggccugggcaucgu

SEQ ID NO: 1437071 - RNA, 12 nt, Pseudomonas aeruginosa PA01
gggccuggcgca

SEQ ID NO: 1437072 - RNA, 20 nt, Pseudomonas aeruginosa PA01
gggccuggaggcacgaaccg

SEQ ID NO: 1437073 - RNA, 23 nt, Pseudomonas aeruginosa PA01
gggccugucgggggcugcgcauc

SEQ ID NO: 1437074 - RNA, 14 nt, Pseudomonas aeruginosa PA01
gggccuucaggcgc

SEQ ID NO: 1437075 - RNA, 15 nt, Pseudomonas aeruginosa PA01
gggccuucaggcugc

SEQ ID NO: 1437076 - RNA, 16 nt, Pseudomonas aeruginosa PA01
gggccuucaggcugcg

SEQ ID NO: 1437077 - RNA, 13 nt, Pseudomonas aeruginosa PA01
gggccuucgccag

SEQ ID NO: 1437078 - RNA, 20 nt, Pseudomonas aeruginosa PA01
gggccuucgccagcggccag

SEQ ID NO: 1437079 - RNA, 21 nt, Pseudomonas aeruginosa PA01
gggccuugagcaggcguuccg

SEQ ID NO: 1437080 - RNA, 21 nt, Pseudomonas aeruginosa PA01
gggccuugaccaccgccaggc

SEQ ID NO: 1437081 - RNA, 22 nt, Pseudomonas aeruginosa PA01
gggccuugaccaccgccaggcu

SEQ ID NO: 1437082 - RNA, 14 nt, Pseudomonas aeruginosa PA01
gggcgaacggcagc

SEQ ID NO: 1437083 - RNA, 15 nt, Pseudomonas aeruginosa PA01
gggcgaacagcgaga

SEQ ID NO: 1437084 - RNA, 16 nt, Pseudomonas aeruginosa PA01
gggcgaacagcgccgc

SEQ ID NO: 1437085 - RNA, 23 nt, Pseudomonas aeruginosa PA01
gggccuuuuucacuacaggaccu

SEQ ID NO: 1437086 - RNA, 19 nt, Pseudomonas aeruginosa PA01
gggcgaaacggcaggccag

SEQ ID NO: 1437087 - RNA, 20 nt, Pseudomonas aeruginosa PA01
gggcgaaagcgguaccgggc

SEQ ID NO: 1437088 - RNA, 14 nt, Pseudomonas aeruginosa PA01
gggcgaacagcacc

SEQ ID NO: 1437089 - RNA, 17 nt, Pseudomonas aeruginosa PA01
gggcgaauaacgccaca

SEQ ID NO: 1437090 - RNA, 20 nt, Pseudomonas aeruginosa PA01
gggcgaauaacgccaccggc

SEQ ID NO: 1437091 - RNA, 19 nt, Pseudomonas aeruginosa PA01
gggcgaauaccagugccgc

SEQ ID NO: 1437092 - RNA, 16 nt, Pseudomonas aeruginosa PA01
gggcgaauagcgccgc

SEQ ID NO: 1437093 - RNA, 22 nt, Pseudomonas aeruginosa PA01
gggcgaauagcgccgcaggcgc

SEQ ID NO: 1437094 - RNA, 16 nt, Pseudomonas aeruginosa PA01
gggcgaauaucgcggc

SEQ ID NO: 1437095 - RNA, 19 nt, Pseudomonas aeruginosa PA01
gggcgaauaucgcggcgcg

SEQ ID NO: 1437096 - RNA, 13 nt, Pseudomonas aeruginosa PA01
gggcgaagccggc

SEQ ID NO: 1437097 - RNA, 19 nt, Pseudomonas aeruginosa PA01
gggcgaagccggcggcgcg

SEQ ID NO: 1437098 - RNA, 21 nt, Pseudomonas aeruginosa PA01
gggcgaagccggcggcgcggc

SEQ ID NO: 1437099 - RNA, 17 nt, Pseudomonas aeruginosa PA01
gggcgaaggccaccauc

SEQ ID NO: 1437100 - RNA, 21 nt, Pseudomonas aeruginosa PA01
gggcgaaggccaccaucgcgg

SEQ ID NO: 1437101 - RNA, 17 nt, Pseudomonas aeruginosa PA01
gggcgaaggucugcccc

SEQ ID NO: 1437102 - RNA, 15 nt, Pseudomonas aeruginosa PA01
gggccuccuggcggc

SEQ ID NO: 1437103 - RNA, 17 nt, Pseudomonas aeruginosa PA01
gggccuccuggcggcgu

SEQ ID NO: 1437104 - RNA, 19 nt, Pseudomonas aeruginosa PA01
gggccuccuggcggcgugg

SEQ ID NO: 1437105 - RNA, 15 nt, Pseudomonas aeruginosa PA01
gggccguccgccagg

SEQ ID NO: 1437106 - RNA, 17 nt, Pseudomonas aeruginosa PA01
gggccguccgccagguc

SEQ ID NO: 1437107 - RNA, 19 nt, Pseudomonas aeruginosa PA01
gggccuacugcuggacggc

SEQ ID NO: 1437108 - RNA, 20 nt, Pseudomonas aeruginosa PA01
gggccuacugcuggacggcg

SEQ ID NO: 1437109 - RNA, 22 nt, Pseudomonas aeruginosa PA01
gggccuacugcuggacggcgga

SEQ ID NO: 1437110 - RNA, 21 nt, Pseudomonas aeruginosa PA01
gggccgucguuuuguccggcg

SEQ ID NO: 1437111 - RNA, 22 nt, Pseudomonas aeruginosa PA01
gggccucggggccguccgccag

SEQ ID NO: 1437112 - RNA, 14 nt, Pseudomonas aeruginosa PA01
gggccucggccagc

SEQ ID NO: 1437113 - RNA, 15 nt, Pseudomonas aeruginosa PA01
gggccucggccagcg

SEQ ID NO: 1437114 - RNA, 19 nt, Pseudomonas aeruginosa PA01
gggccucggccagcgccgc

SEQ ID NO: 1437115 - RNA, 14 nt, Pseudomonas aeruginosa PA01
gggccucggcgaag

SEQ ID NO: 1437116 - RNA, 17 nt, Pseudomonas aeruginosa PA01
gggccucgcugcgcaga

SEQ ID NO: 1437117 - RNA, 22 nt, Pseudomonas aeruginosa PA01
gggccucgcuguaguuguucgg

SEQ ID NO: 1437118 - RNA, 21 nt, Pseudomonas aeruginosa PA01
gggcgacggaaacgacaggcu

SEQ ID NO: 1437119 - RNA, 13 nt, Pseudomonas aeruginosa PA01
gggcgacgcccga

SEQ ID NO: 1437120 - RNA, 13 nt, Pseudomonas aeruginosa PA01
gggcgacgccgau

SEQ ID NO: 1437121 - RNA, 15 nt, Pseudomonas aeruginosa PA01
gggcgacgacgaacg

SEQ ID NO: 1437122 - RNA, 20 nt, Pseudomonas aeruginosa PA01
gggcgaccuucagcgggucg

SEQ ID NO: 1437123 - RNA, 18 nt, Pseudomonas aeruginosa PA01
gggcgagcagggcgcuga

SEQ ID NO: 1437124 - RNA, 18 nt, Pseudomonas aeruginosa PA01
gggcgagaaucgccgagg

SEQ ID NO: 1437125 - RNA, 11 nt, Pseudomonas aeruginosa PA01
gggcgaagccg

SEQ ID NO: 1437126 - RNA, 11 nt, Pseudomonas aeruginosa PA01
gggcgaccugc

SEQ ID NO: 1437127 - RNA, 16 nt, Pseudomonas aeruginosa PA01
gggcgaccgccaggcg

SEQ ID NO: 1437128 - RNA, 18 nt, Pseudomonas aeruginosa PA01
gggcgaccgccaggcggc

SEQ ID NO: 1437129 - RNA, 17 nt, Pseudomonas aeruginosa PA01
gggcgacccagcgcugg

SEQ ID NO: 1437130 - RNA, 14 nt, Pseudomonas aeruginosa PA01
gggcgaccagaagg

SEQ ID NO: 1437131 - RNA, 23 nt, Pseudomonas aeruginosa PA01
gggcgaucacgccgcgcaccagc

SEQ ID NO: 1437132 - RNA, 12 nt, Pseudomonas aeruginosa PA01
gggcgaucuccu

SEQ ID NO: 1437133 - RNA, 15 nt, Pseudomonas aeruginosa PA01
gggcgaucuccucga

SEQ ID NO: 1437134 - RNA, 17 nt, Pseudomonas aeruginosa PA01
gggcgaggucggccugc

SEQ ID NO: 1437135 - RNA, 20 nt, Pseudomonas aeruginosa PA01
gggcgaggcuaacgccgagg

SEQ ID NO: 1437136 - RNA, 16 nt, Pseudomonas aeruginosa PA01
gggcgagggcgcgcac

SEQ ID NO: 1437137 - RNA, 18 nt, Pseudomonas aeruginosa PA01
gggcgagggcggcgcggg

SEQ ID NO: 1437138 - RNA, 17 nt, Pseudomonas aeruginosa PA01
gggcgauuuccaccggc

SEQ ID NO: 1437139 - RNA, 13 nt, Pseudomonas aeruginosa PA01
gggcgauggcggu

SEQ ID NO: 1437140 - RNA, 19 nt, Pseudomonas aeruginosa PA01
gggcgaugcccuuggccag

SEQ ID NO: 1437141 - RNA, 20 nt, Pseudomonas aeruginosa PA01
gggcgaugcccuuggccagc

SEQ ID NO: 1437142 - RNA, 21 nt, Pseudomonas aeruginosa PA01
gggcgaugccgauggcgccgc

SEQ ID NO: 1437143 - RNA, 22 nt, Pseudomonas aeruginosa PA01
gggcgaugcgccgguccuuguc

SEQ ID NO: 1437144 - RNA, 23 nt, Pseudomonas aeruginosa PA01
gggcgaugcggucaugcccuugu

SEQ ID NO: 1437145 - RNA, 13 nt, Pseudomonas aeruginosa PA01
gggcgauggccag

SEQ ID NO: 1437146 - RNA, 15 nt, Pseudomonas aeruginosa PA01
gggcgauggccagcg

SEQ ID NO: 1437147 - RNA, 17 nt, Pseudomonas aeruginosa PA01
gggcgauggcccguucc

SEQ ID NO: 1437148 - RNA, 19 nt, Pseudomonas aeruginosa PA01
gggcgaucuugaucgccag

SEQ ID NO: 1437149 - RNA, 20 nt, Pseudomonas aeruginosa PA01
gggcgaucuugaucgccagc

SEQ ID NO: 1437150 - RNA, 19 nt, Pseudomonas aeruginosa PA01
gggcgcaaggccagcggca

SEQ ID NO: 1437151 - RNA, 21 nt, Pseudomonas aeruginosa PA01
gggcgcccgccaaggcccugc

SEQ ID NO: 1437152 - RNA, 16 nt, Pseudomonas aeruginosa PA01
gggcgccaggugcagg

SEQ ID NO: 1437153 - RNA, 13 nt, Pseudomonas aeruginosa PA01
gggcgccagccgc

SEQ ID NO: 1437154 - RNA, 13 nt, Pseudomonas aeruginosa PA01
gggcgccagcggu

SEQ ID NO: 1437155 - RNA, 15 nt, Pseudomonas aeruginosa PA01
gggcgcccucgccaa

SEQ ID NO: 1437156 - RNA, 18 nt, Pseudomonas aeruginosa PA01
gggcgcccuucagcgccu

SEQ ID NO: 1437157 - RNA, 14 nt, Pseudomonas aeruginosa PA01
gggcgccgccgagg

SEQ ID NO: 1437158 - RNA, 15 nt, Pseudomonas aeruginosa PA01
gggcgccgccgccga

SEQ ID NO: 1437159 - RNA, 16 nt, Pseudomonas aeruginosa PA01
gggcgccgccgcuggc

SEQ ID NO: 1437160 - RNA, 17 nt, Pseudomonas aeruginosa PA01
gggcgccuccagcgggc

SEQ ID NO: 1437161 - RNA, 17 nt, Pseudomonas aeruginosa PA01
gggcgccgucgggggcg

SEQ ID NO: 1437162 - RNA, 21 nt, Pseudomonas aeruginosa PA01
gggcgccgucgggggcgcgua

SEQ ID NO: 1437163 - RNA, 23 nt, Pseudomonas aeruginosa PA01
gggcgccuuuuucauggccuggc

SEQ ID NO: 1437164 - RNA, 12 nt, Pseudomonas aeruginosa PA01
gggcgcgcgccg

SEQ ID NO: 1437165 - RNA, 22 nt, Pseudomonas aeruginosa PA01
gggcgcgcgccucagcggcugg

SEQ ID NO: 1437166 - RNA, 12 nt, Pseudomonas aeruginosa PA01
gggcgcggcugg

SEQ ID NO: 1437167 - RNA, 13 nt, Pseudomonas aeruginosa PA01
gggcgcguccagc

SEQ ID NO: 1437168 - RNA, 14 nt, Pseudomonas aeruginosa PA01
gggcgcgggcgaag

SEQ ID NO: 1437169 - RNA, 17 nt, Pseudomonas aeruginosa PA01
gggcggcgccuggagca

SEQ ID NO: 1437170 - RNA, 14 nt, Pseudomonas aeruginosa PA01
gggcggcgccuggu

SEQ ID NO: 1437171 - RNA, 15 nt, Pseudomonas aeruginosa PA01
gggcggcgcaucggc

SEQ ID NO: 1437172 - RNA, 14 nt, Pseudomonas aeruginosa PA01
gggcggcggcgcua

SEQ ID NO: 1437173 - RNA, 12 nt, Pseudomonas aeruginosa PA01
gggcggcgcggc

SEQ ID NO: 1437174 - RNA, 14 nt, Pseudomonas aeruginosa PA01
gggcggcgggcgca

SEQ ID NO: 1437175 - RNA, 16 nt, Pseudomonas aeruginosa PA01
gggcggcggcuaccag

SEQ ID NO: 1437176 - RNA, 13 nt, Pseudomonas aeruginosa PA01
gggcggcggcuca

SEQ ID NO: 1437177 - RNA, 14 nt, Pseudomonas aeruginosa PA01
gggcggcggcucag

SEQ ID NO: 1437178 - RNA, 22 nt, Pseudomonas aeruginosa PA01
gggcggcuuccagguacggccc

SEQ ID NO: 1437179 - RNA, 13 nt, Pseudomonas aeruginosa PA01
gggcggcuggccg

SEQ ID NO: 1437180 - RNA, 16 nt, Pseudomonas aeruginosa PA01
gggcggcuggccgagg

SEQ ID NO: 1437181 - RNA, 12 nt, Pseudomonas aeruginosa PA01
gggcggccgccg

SEQ ID NO: 1437182 - RNA, 12 nt, Pseudomonas aeruginosa PA01
gggcggcgacca

SEQ ID NO: 1437183 - RNA, 20 nt, Pseudomonas aeruginosa PA01
gggcggcgaccgaacagcgc

SEQ ID NO: 1437184 - RNA, 18 nt, Pseudomonas aeruginosa PA01
gggcggcgaccggccuca

SEQ ID NO: 1437185 - RNA, 12 nt, Pseudomonas aeruginosa PA01
gggcggccggcc

SEQ ID NO: 1437186 - RNA, 15 nt, Pseudomonas aeruginosa PA01
gggcggauagcgcgc

SEQ ID NO: 1437187 - RNA, 13 nt, Pseudomonas aeruginosa PA01
gggcggaucagcu

SEQ ID NO: 1437188 - RNA, 14 nt, Pseudomonas aeruginosa PA01
gggcgcuuucgaga

SEQ ID NO: 1437189 - RNA, 16 nt, Pseudomonas aeruginosa PA01
gggcgcuuucgagaaa

SEQ ID NO: 1437190 - RNA, 15 nt, Pseudomonas aeruginosa PA01
gggcggcaggcgccg

SEQ ID NO: 1437191 - RNA, 14 nt, Pseudomonas aeruginosa PA01
gggcggcagcacga

SEQ ID NO: 1437192 - RNA, 11 nt, Pseudomonas aeruginosa PA01
gggcggcaacu

SEQ ID NO: 1437193 - RNA, 14 nt, Pseudomonas aeruginosa PA01
gggcggauucaggc

SEQ ID NO: 1437194 - RNA, 21 nt, Pseudomonas aeruginosa PA01
gggcgcucguugcgccgcucc

SEQ ID NO: 1437195 - RNA, 15 nt, Pseudomonas aeruginosa PA01
gggcgcucuggccgc

SEQ ID NO: 1437196 - RNA, 16 nt, Pseudomonas aeruginosa PA01
gggcgcucuggccgcg

SEQ ID NO: 1437197 - RNA, 16 nt, Pseudomonas aeruginosa PA01
gggcgcucgcccuugc

SEQ ID NO: 1437198 - RNA, 19 nt, Pseudomonas aeruginosa PA01
gggcgcucgcccuugcgcc

SEQ ID NO: 1437199 - RNA, 22 nt, Pseudomonas aeruginosa PA01
gggcgcucgcccuugcgccgcg

SEQ ID NO: 1437200 - RNA, 21 nt, Pseudomonas aeruginosa PA01
gggcgcucaccgaggcgaacg

SEQ ID NO: 1437201 - RNA, 13 nt, Pseudomonas aeruginosa PA01
gggcgcuuccggc

SEQ ID NO: 1437202 - RNA, 13 nt, Pseudomonas aeruginosa PA01
gggcgcugguccu

SEQ ID NO: 1437203 - RNA, 14 nt, Pseudomonas aeruginosa PA01
ggucaacaccagcg

SEQ ID NO: 1437204 - RNA, 16 nt, Pseudomonas aeruginosa PA01
ggucaacaccagcgcc

SEQ ID NO: 1437205 - RNA, 15 nt, Pseudomonas aeruginosa PA01
ggucaccacccagcc

SEQ ID NO: 1437206 - RNA, 14 nt, Pseudomonas aeruginosa PA01
gguauccagcggcc

SEQ ID NO: 1437207 - RNA, 17 nt, Pseudomonas aeruginosa PA01
gguauccagcggccgcg

SEQ ID NO: 1437208 - RNA, 14 nt, Pseudomonas aeruginosa PA01
gguauccgccggcc

SEQ ID NO: 1437209 - RNA, 15 nt, Pseudomonas aeruginosa PA01
gguauccgccggccg

SEQ ID NO: 1437210 - RNA, 19 nt, Pseudomonas aeruginosa PA01
gguauccgcuuacuggcga

SEQ ID NO: 1437211 - RNA, 16 nt, Pseudomonas aeruginosa PA01
gguauccgggcacuug

SEQ ID NO: 1437212 - RNA, 18 nt, Pseudomonas aeruginosa PA01
gguaucggcuugccggcg

SEQ ID NO: 1437213 - RNA, 18 nt, Pseudomonas aeruginosa PA01
gguaucggccauggccga

SEQ ID NO: 1437214 - RNA, 23 nt, Pseudomonas aeruginosa PA01
gguaugcgcggucaccaggguca

SEQ ID NO: 1437215 - RNA, 21 nt, Pseudomonas aeruginosa PA01
gguaugccgaucaugcucggc

SEQ ID NO: 1437216 - RNA, 14 nt, Pseudomonas aeruginosa PA01
gguaugcaggauca

SEQ ID NO: 1437217 - RNA, 21 nt, Pseudomonas aeruginosa PA01
gguauucgcgcucggcgaggc

SEQ ID NO: 1437218 - RNA, 21 nt, Pseudomonas aeruginosa PA01
gguauugcgcguggcgucggc

SEQ ID NO: 1437219 - RNA, 14 nt, Pseudomonas aeruginosa PA01
gguauucuccagca

SEQ ID NO: 1437220 - RNA, 13 nt, Pseudomonas aeruginosa PA01
gguagccauggcg

SEQ ID NO: 1437221 - RNA, 17 nt, Pseudomonas aeruginosa PA01
gguagcguugcgccaga

SEQ ID NO: 1437222 - RNA, 18 nt, Pseudomonas aeruginosa PA01
gguagcguugcgccagac

SEQ ID NO: 1437223 - RNA, 14 nt, Pseudomonas aeruginosa PA01
gguagcccaggccg

SEQ ID NO: 1437224 - RNA, 17 nt, Pseudomonas aeruginosa PA01
gguagcccaggccgaag

SEQ ID NO: 1437225 - RNA, 17 nt, Pseudomonas aeruginosa PA01
gguagccaggggucagg

SEQ ID NO: 1437226 - RNA, 15 nt, Pseudomonas aeruginosa PA01
gguaccggccaggcg

SEQ ID NO: 1437227 - RNA, 17 nt, Pseudomonas aeruginosa PA01
gguaccggccaggcggu

SEQ ID NO: 1437228 - RNA, 19 nt, Pseudomonas aeruginosa PA01
gguaccgcugcgugccagg

SEQ ID NO: 1437229 - RNA, 22 nt, Pseudomonas aeruginosa PA01
gguaccgcugcgugccagggcu

SEQ ID NO: 1437230 - RNA, 15 nt, Pseudomonas aeruginosa PA01
gguaccgcuggcgcu

SEQ ID NO: 1437231 - RNA, 13 nt, Pseudomonas aeruginosa PA01
gguagagggcgua

SEQ ID NO: 1437232 - RNA, 17 nt, Pseudomonas aeruginosa PA01
gguagaucugugcggug

SEQ ID NO: 1437233 - RNA, 15 nt, Pseudomonas aeruginosa PA01
gguaggacagggcca

SEQ ID NO: 1437234 - RNA, 16 nt, Pseudomonas aeruginosa PA01
gguaggccggcgugcc

SEQ ID NO: 1437235 - RNA, 20 nt, Pseudomonas aeruginosa PA01
gguaggcgacgaagcuggcg

SEQ ID NO: 1437236 - RNA, 17 nt, Pseudomonas aeruginosa PA01
gguagcugagcaggccg

SEQ ID NO: 1437237 - RNA, 15 nt, Pseudomonas aeruginosa PA01
gguagcugcgccgcc

SEQ ID NO: 1437238 - RNA, 15 nt, Pseudomonas aeruginosa PA01
gguagcugcggccga

SEQ ID NO: 1437239 - RNA, 16 nt, Pseudomonas aeruginosa PA01
gguagcugcuccagcc

SEQ ID NO: 1437240 - RNA, 20 nt, Pseudomonas aeruginosa PA01
gguauagaaaucgaucgagc

SEQ ID NO: 1437241 - RNA, 22 nt, Pseudomonas aeruginosa PA01
gguauagaccagcaccgccugc

SEQ ID NO: 1437242 - RNA, 14 nt, Pseudomonas aeruginosa PA01
gguaggcgguggcg

SEQ ID NO: 1437243 - RNA, 19 nt, Pseudomonas aeruginosa PA01
gguaggcgguggcgaucag

SEQ ID NO: 1437244 - RNA, 21 nt, Pseudomonas aeruginosa PA01
gguaggcgguggcgaucagcg

SEQ ID NO: 1437245 - RNA, 14 nt, Pseudomonas aeruginosa PA01
gguaggcggcgacg

SEQ ID NO: 1437246 - RNA, 14 nt, Pseudomonas aeruginosa PA01
gguaggcgcgggcg

SEQ ID NO: 1437247 - RNA, 16 nt, Pseudomonas aeruginosa PA01
gguaggcgcgggcgua

SEQ ID NO: 1437248 - RNA, 18 nt, Pseudomonas aeruginosa PA01
ggguucggcgaggaucgc

SEQ ID NO: 1437249 - RNA, 20 nt, Pseudomonas aeruginosa PA01
ggguucggggaacagcgcca

SEQ ID NO: 1437250 - RNA, 15 nt, Pseudomonas aeruginosa PA01
ggguucgacagcgcg

SEQ ID NO: 1437251 - RNA, 13 nt, Pseudomonas aeruginosa PA01
ggguucgacgcgc

SEQ ID NO: 1437252 - RNA, 15 nt, Pseudomonas aeruginosa PA01
ggguucgacgcgcca

SEQ ID NO: 1437253 - RNA, 21 nt, Pseudomonas aeruginosa PA01
ggguggucagccagccgagca

SEQ ID NO: 1437254 - RNA, 23 nt, Pseudomonas aeruginosa PA01
ggguguacuugacggcgccgaug

SEQ ID NO: 1437255 - RNA, 13 nt, Pseudomonas aeruginosa PA01
ggguucagcccgc

SEQ ID NO: 1437256 - RNA, 17 nt, Pseudomonas aeruginosa PA01
ggguucagcccgccgug

SEQ ID NO: 1437257 - RNA, 19 nt, Pseudomonas aeruginosa PA01
ggguucuugucgaccagcg

SEQ ID NO: 1437258 - RNA, 18 nt, Pseudomonas aeruginosa PA01
ggguugacccagagccgc

SEQ ID NO: 1437259 - RNA, 20 nt, Pseudomonas aeruginosa PA01
ggguugaguugcaggccggc

SEQ ID NO: 1437260 - RNA, 20 nt, Pseudomonas aeruginosa PA01
ggguugccguagcgaugcgg

SEQ ID NO: 1437261 - RNA, 15 nt, Pseudomonas aeruginosa PA01
ggguugcccggcucc

SEQ ID NO: 1437262 - RNA, 14 nt, Pseudomonas aeruginosa PA01
aaguaccgccggca

SEQ ID NO: 1437263 - RNA, 12 nt, Pseudomonas aeruginosa PA01
ggguggucgcgc

SEQ ID NO: 1437264 - RNA, 19 nt, Pseudomonas aeruginosa PA01
ggguggcgucgaucaggcg

SEQ ID NO: 1437265 - RNA, 20 nt, Pseudomonas aeruginosa PA01
gggugggucauggcguccgg

SEQ ID NO: 1437266 - RNA, 15 nt, Pseudomonas aeruginosa PA01
gggugggcggugcgg

SEQ ID NO: 1437267 - RNA, 14 nt, Pseudomonas aeruginosa PA01
gguaacccgcggcg

SEQ ID NO: 1437268 - RNA, 17 nt, Pseudomonas aeruginosa PA01
gguaacccgcggcgagg

SEQ ID NO: 1437269 - RNA, 17 nt, Pseudomonas aeruginosa PA01
gguaacuggccagggca

SEQ ID NO: 1437270 - RNA, 14 nt, Pseudomonas aeruginosa PA01
gguaaagcgcccgc

SEQ ID NO: 1437271 - RNA, 22 nt, Pseudomonas aeruginosa PA01
gguaaggcaccaccgccgccag

SEQ ID NO: 1437272 - RNA, 15 nt, Pseudomonas aeruginosa PA01
gguaauagccguuga

SEQ ID NO: 1437273 - RNA, 21 nt, Pseudomonas aeruginosa PA01
gguaagguugccgaucaggcu

SEQ ID NO: 1437274 - RNA, 22 nt, Pseudomonas aeruginosa PA01
gguaagguugccgaucaggcug

SEQ ID NO: 1437275 - RNA, 14 nt, Pseudomonas aeruginosa PA01
gguaauccacgcug

SEQ ID NO: 1437276 - RNA, 19 nt, Pseudomonas aeruginosa PA01
gguaccgacggucggcagg

SEQ ID NO: 1437277 - RNA, 20 nt, Pseudomonas aeruginosa PA01
gguacccgccggccaugccg

SEQ ID NO: 1437278 - RNA, 15 nt, Pseudomonas aeruginosa PA01
gguacccggcagggc

SEQ ID NO: 1437279 - RNA, 20 nt, Pseudomonas aeruginosa PA01
gguacccguacgcugccagg

SEQ ID NO: 1437280 - RNA, 16 nt, Pseudomonas aeruginosa PA01
ggucgccgcacaccgc

SEQ ID NO: 1437281 - RNA, 12 nt, Pseudomonas aeruginosa PA01
ggucgccgccag

SEQ ID NO: 1437282 - RNA, 13 nt, Pseudomonas aeruginosa PA01
ggucgccgccagc

SEQ ID NO: 1437283 - RNA, 20 nt, Pseudomonas aeruginosa PA01
ggucgccgccagcuaccggc

SEQ ID NO: 1437284 - RNA, 22 nt, Pseudomonas aeruginosa PA01
ggucgccgccagcuaccggcag

SEQ ID NO: 1437285 - RNA, 12 nt, Pseudomonas aeruginosa PA01
ggucgccgccca

SEQ ID NO: 1437286 - RNA, 19 nt, Pseudomonas aeruginosa PA01
ggucgccgccgccgggaaa

SEQ ID NO: 1437287 - RNA, 13 nt, Pseudomonas aeruginosa PA01
ggucgccgccggc

SEQ ID NO: 1437288 - RNA, 14 nt, Pseudomonas aeruginosa PA01
ggucgccgccggcg

SEQ ID NO: 1437289 - RNA, 15 nt, Pseudomonas aeruginosa PA01
ggucgccggcgcgca

SEQ ID NO: 1437290 - RNA, 13 nt, Pseudomonas aeruginosa PA01
ggucgccgcgcug

SEQ ID NO: 1437291 - RNA, 13 nt, Pseudomonas aeruginosa PA01
ggucgccgccgcc

SEQ ID NO: 1437292 - RNA, 12 nt, Pseudomonas aeruginosa PA01
ggucgccgcuca

SEQ ID NO: 1437293 - RNA, 18 nt, Pseudomonas aeruginosa PA01
ggucgccgcucauccgcu

SEQ ID NO: 1437294 - RNA, 20 nt, Pseudomonas aeruginosa PA01
ggucgccgcucauccgcugg

SEQ ID NO: 1437295 - RNA, 22 nt, Pseudomonas aeruginosa PA01
ggucgccgcucauccgcuggua

SEQ ID NO: 1437296 - RNA, 18 nt, Pseudomonas aeruginosa PA01
ggucgaugucgcggcccu

SEQ ID NO: 1437297 - RNA, 15 nt, Pseudomonas aeruginosa PA01
ggucgaugggccgua

SEQ ID NO: 1437298 - RNA, 14 nt, Pseudomonas aeruginosa PA01
ggucgauuccuguc

SEQ ID NO: 1437299 - RNA, 13 nt, Pseudomonas aeruginosa PA01
ggucgcaggggcu

SEQ ID NO: 1437300 - RNA, 15 nt, Pseudomonas aeruginosa PA01
ggucgcaccgccagc

SEQ ID NO: 1437301 - RNA, 16 nt, Pseudomonas aeruginosa PA01
ggucgcaccgccagca

SEQ ID NO: 1437302 - RNA, 16 nt, Pseudomonas aeruginosa PA01
ggucgcagcaggccgc

SEQ ID NO: 1437303 - RNA, 15 nt, Pseudomonas aeruginosa PA01
ggucgcagccgcgca

SEQ ID NO: 1437304 - RNA, 18 nt, Pseudomonas aeruginosa PA01
ggucgcagcguuccagcg

SEQ ID NO: 1437305 - RNA, 23 nt, Pseudomonas aeruginosa PA01
ggucgcagcguuccagcgcuggc

SEQ ID NO: 1437306 - RNA, 16 nt, Pseudomonas aeruginosa PA01
ggucgcagcuccagcg

SEQ ID NO: 1437307 - RNA, 18 nt, Pseudomonas aeruginosa PA01
ggucgagguucuccaggc

SEQ ID NO: 1437308 - RNA, 19 nt, Pseudomonas aeruginosa PA01
ggucgagguucuccaggcu

SEQ ID NO: 1437309 - RNA, 15 nt, Pseudomonas aeruginosa PA01
ggucgaggcugccga

SEQ ID NO: 1437310 - RNA, 17 nt, Pseudomonas aeruginosa PA01
ggucgagggcaugaccg

SEQ ID NO: 1437311 - RNA, 22 nt, Pseudomonas aeruginosa PA01
ggucgaggcgcuccaccgcccc

SEQ ID NO: 1437312 - RNA, 20 nt, Pseudomonas aeruginosa PA01
ggucgaggcggagaagccgc

SEQ ID NO: 1437313 - RNA, 17 nt, Pseudomonas aeruginosa PA01
ggucgaugcccucgcgg

SEQ ID NO: 1437314 - RNA, 19 nt, Pseudomonas aeruginosa PA01
ggucgaugcccucgcggcg

SEQ ID NO: 1437315 - RNA, 22 nt, Pseudomonas aeruginosa PA01
ggucgagggugguuuccaggcu

SEQ ID NO: 1437316 - RNA, 20 nt, Pseudomonas aeruginosa PA01
ggucgaggcaaucugcccgg

SEQ ID NO: 1437317 - RNA, 18 nt, Pseudomonas aeruginosa PA01
ggucgaggcccucggcgg

SEQ ID NO: 1437318 - RNA, 21 nt, Pseudomonas aeruginosa PA01
ggucgaggcccucggcggcga

SEQ ID NO: 1437319 - RNA, 14 nt, Pseudomonas aeruginosa PA01
ggucgaggccgcgg

SEQ ID NO: 1437320 - RNA, 15 nt, Pseudomonas aeruginosa PA01
ggucgaggccgcgga

SEQ ID NO: 1437321 - RNA, 14 nt, Pseudomonas aeruginosa PA01
ggucgaccaggcgu

SEQ ID NO: 1437322 - RNA, 21 nt, Pseudomonas aeruginosa PA01
ggucgaccagccagucggcgg

SEQ ID NO: 1437323 - RNA, 17 nt, Pseudomonas aeruginosa PA01
ggucgagcaguuccggc

SEQ ID NO: 1437324 - RNA, 13 nt, Pseudomonas aeruginosa PA01
ggucgagccaggc

SEQ ID NO: 1437325 - RNA, 15 nt, Pseudomonas aeruginosa PA01
ggucgagccaggcgu

SEQ ID NO: 1437326 - RNA, 15 nt, Pseudomonas aeruginosa PA01
ggucgaaggcgcggc

SEQ ID NO: 1437327 - RNA, 18 nt, Pseudomonas aeruginosa PA01
ggucgaaggcgcggcgga

SEQ ID NO: 1437328 - RNA, 12 nt, Pseudomonas aeruginosa PA01
ggucgaagcgga

SEQ ID NO: 1437329 - RNA, 20 nt, Pseudomonas aeruginosa PA01
ggucgacauagcgcagcacc

SEQ ID NO: 1437330 - RNA, 21 nt, Pseudomonas aeruginosa PA01
ggucgacauagcgcagcaccg

SEQ ID NO: 1437331 - RNA, 24 nt, Pseudomonas aeruginosa PA01
ggucgacauagcgcagcaccggcu

SEQ ID NO: 1437332 - RNA, 18 nt, Pseudomonas aeruginosa PA01
ggucgacaugcaccaggc

SEQ ID NO: 1437333 - RNA, 16 nt, Pseudomonas aeruginosa PA01
ggucgacaugcaggcc

SEQ ID NO: 1437334 - RNA, 17 nt, Pseudomonas aeruginosa PA01
ggucgacaugcaggccg

SEQ ID NO: 1437335 - RNA, 16 nt, Pseudomonas aeruginosa PA01
ggucgaccuugccgac

SEQ ID NO: 1437336 - RNA, 17 nt, Pseudomonas aeruginosa PA01
ggucgaccuugccgacg

SEQ ID NO: 1437337 - RNA, 19 nt, Pseudomonas aeruginosa PA01
ggucgaccuugccgacgcc

SEQ ID NO: 1437338 - RNA, 18 nt, Pseudomonas aeruginosa PA01
ggucgacgaccuugccca

SEQ ID NO: 1437339 - RNA, 22 nt, Pseudomonas aeruginosa PA01
gguccugcaacuggaaggccgc

SEQ ID NO: 1437340 - RNA, 24 nt, Pseudomonas aeruginosa PA01
gguccgguacugcugggccuugau

SEQ ID NO: 1437341 - RNA, 18 nt, Pseudomonas aeruginosa PA01
gguccgucgcgcgcccgu

SEQ ID NO: 1437342 - RNA, 22 nt, Pseudomonas aeruginosa PA01
gguccgucgcgcgcccguacca

SEQ ID NO: 1437343 - RNA, 15 nt, Pseudomonas aeruginosa PA01
gguccggcagcgccu

SEQ ID NO: 1437344 - RNA, 20 nt, Pseudomonas aeruginosa PA01
gguccgacggaaauaggcgu

SEQ ID NO: 1437345 - RNA, 22 nt, Pseudomonas aeruginosa PA01
ggucccuucgugggccugcucg

SEQ ID NO: 1437346 - RNA, 16 nt, Pseudomonas aeruginosa PA01
ggucccgggcuccggg

SEQ ID NO: 1437347 - RNA, 19 nt, Pseudomonas aeruginosa PA01
ggucccagguagcgcugcg

SEQ ID NO: 1437348 - RNA, 22 nt, Pseudomonas aeruginosa PA01
ggucccagguagcgcugcgcca

SEQ ID NO: 1437349 - RNA, 17 nt, Pseudomonas aeruginosa PA01
gguccagcacgcuggcg

SEQ ID NO: 1437350 - RNA, 18 nt, Pseudomonas aeruginosa PA01
ggucaccagguugcccgg

SEQ ID NO: 1437351 - RNA, 13 nt, Pseudomonas aeruginosa PA01
ggucaccagcgug

SEQ ID NO: 1437352 - RNA, 19 nt, Pseudomonas aeruginosa PA01
ggucaccacguugcgccgc

SEQ ID NO: 1437353 - RNA, 21 nt, Pseudomonas aeruginosa PA01
ggucaccacuggaaacgccca

SEQ ID NO: 1437354 - RNA, 14 nt, Pseudomonas aeruginosa PA01
ggucaccagcacca

SEQ ID NO: 1437355 - RNA, 15 nt, Pseudomonas aeruginosa PA01
ggucaccuugaccuu

SEQ ID NO: 1437356 - RNA, 21 nt, Pseudomonas aeruginosa PA01
ggucaccguggagaggucgcc

SEQ ID NO: 1437357 - RNA, 19 nt, Pseudomonas aeruginosa PA01
ggucaccguggucauggcg

SEQ ID NO: 1437358 - RNA, 14 nt, Pseudomonas aeruginosa PA01
ggucaccgcgccgg

SEQ ID NO: 1437359 - RNA, 14 nt, Pseudomonas aeruginosa PA01
ggucaccgccagcg

SEQ ID NO: 1437360 - RNA, 19 nt, Pseudomonas aeruginosa PA01
ggucaccgccagcgggacg

SEQ ID NO: 1437361 - RNA, 14 nt, Pseudomonas aeruginosa PA01
ggucacgcugggca

SEQ ID NO: 1437362 - RNA, 16 nt, Pseudomonas aeruginosa PA01
ggucacgcccugcacc

SEQ ID NO: 1437363 - RNA, 20 nt, Pseudomonas aeruginosa PA01
ggucacgccgagggcgcggc

SEQ ID NO: 1437364 - RNA, 18 nt, Pseudomonas aeruginosa PA01
ggucacgccgaucacccc

SEQ ID NO: 1437365 - RNA, 18 nt, Pseudomonas aeruginosa PA01
ggucacgccgcggcugau

SEQ ID NO: 1437366 - RNA, 21 nt, Pseudomonas aeruginosa PA01
ggucacgccgggaauccccag

SEQ ID NO: 1437367 - RNA, 19 nt, Pseudomonas aeruginosa PA01
ggucacgcaggcgcuggcc

SEQ ID NO: 1437368 - RNA, 20 nt, Pseudomonas aeruginosa PA01
ggucacgcaggcgcuggccg

SEQ ID NO: 1437369 - RNA, 17 nt, Pseudomonas aeruginosa PA01
ggucacggucagcucgg

SEQ ID NO: 1437370 - RNA, 14 nt, Pseudomonas aeruginosa PA01
ggucacggugacgg

SEQ ID NO: 1437371 - RNA, 19 nt, Pseudomonas aeruginosa PA01
ggucagagacagguacucg

SEQ ID NO: 1437372 - RNA, 19 nt, Pseudomonas aeruginosa PA01
ggucagaccagcccuggcg

SEQ ID NO: 1437373 - RNA, 23 nt, Pseudomonas aeruginosa PA01
ggucagaccagcccuggcgcggc

SEQ ID NO: 1437374 - RNA, 17 nt, Pseudomonas aeruginosa PA01
ggucagagggugaucag

SEQ ID NO: 1437375 - RNA, 18 nt, Pseudomonas aeruginosa PA01
ggucagagggugaucagc

SEQ ID NO: 1437376 - RNA, 19 nt, Pseudomonas aeruginosa PA01
ggucagagggugaucagcu

SEQ ID NO: 1437377 - RNA, 13 nt, Pseudomonas aeruginosa PA01
ggucagaucagcg

SEQ ID NO: 1437378 - RNA, 17 nt, Pseudomonas aeruginosa PA01
ggucagcaggcccgagc

SEQ ID NO: 1437379 - RNA, 15 nt, Pseudomonas aeruginosa PA01
ggucagcagcagggu

SEQ ID NO: 1437380 - RNA, 14 nt, Pseudomonas aeruginosa PA01
ggucagcagcaccg

SEQ ID NO: 1437381 - RNA, 16 nt, Pseudomonas aeruginosa PA01
ggucagccgcaggccg

SEQ ID NO: 1437382 - RNA, 20 nt, Pseudomonas aeruginosa PA01
ggucagcgccagcaacccgc

SEQ ID NO: 1437383 - RNA, 22 nt, Pseudomonas aeruginosa PA01
ggucagcccauacaccaggccg

SEQ ID NO: 1437384 - RNA, 13 nt, Pseudomonas aeruginosa PA01
ggucagcaggcug

SEQ ID NO: 1437385 - RNA, 15 nt, Pseudomonas aeruginosa PA01
ggucagcaggcugcc

SEQ ID NO: 1437386 - RNA, 16 nt, Pseudomonas aeruginosa PA01
ggucagcaggcugccg

SEQ ID NO: 1437387 - RNA, 22 nt, Pseudomonas aeruginosa PA01
ggucagcagugcggggcgcucg

SEQ ID NO: 1437388 - RNA, 16 nt, Pseudomonas aeruginosa PA01
gguccagaucgccacc

SEQ ID NO: 1437389 - RNA, 20 nt, Pseudomonas aeruginosa PA01
gguccagaucgccaccccgc

SEQ ID NO: 1437390 - RNA, 15 nt, Pseudomonas aeruginosa PA01
ggucauccgccggcg

SEQ ID NO: 1437391 - RNA, 20 nt, Pseudomonas aeruginosa PA01
ggucauagucggugaccucc

SEQ ID NO: 1437392 - RNA, 22 nt, Pseudomonas aeruginosa PA01
ggucaguuccaggucggcggca

SEQ ID NO: 1437393 - RNA, 21 nt, Pseudomonas aeruginosa PA01
ggucaguucggcccagcagcg

SEQ ID NO: 1437394 - RNA, 14 nt, Pseudomonas aeruginosa PA01
ggucaguucguuga

SEQ ID NO: 1437395 - RNA, 16 nt, Pseudomonas aeruginosa PA01
ggugacccacuccggc

SEQ ID NO: 1437396 - RNA, 14 nt, Pseudomonas aeruginosa PA01
ggugaccagcggca

SEQ ID NO: 1437397 - RNA, 13 nt, Pseudomonas aeruginosa PA01
ggugaccaccuug

SEQ ID NO: 1437398 - RNA, 16 nt, Pseudomonas aeruginosa PA01
ggugaccaccuugauc

SEQ ID NO: 1437399 - RNA, 19 nt, Pseudomonas aeruginosa PA01
ggugagcacgccgcgaccg

SEQ ID NO: 1437400 - RNA, 13 nt, Pseudomonas aeruginosa PA01
ggugagcauggcg

SEQ ID NO: 1437401 - RNA, 15 nt, Pseudomonas aeruginosa PA01
ggugagauggucgaa

SEQ ID NO: 1437402 - RNA, 13 nt, Pseudomonas aeruginosa PA01
ggugaccggcuug

SEQ ID NO: 1437403 - RNA, 14 nt, Pseudomonas aeruginosa PA01
ggugaccgcccagg

SEQ ID NO: 1437404 - RNA, 22 nt, Pseudomonas aeruginosa PA01
ggugaccgcccagggggccggg

SEQ ID NO: 1437405 - RNA, 17 nt, Pseudomonas aeruginosa PA01
ggugcaccgcgcuggag

SEQ ID NO: 1437406 - RNA, 12 nt, Pseudomonas aeruginosa PA01
ggugcacgcgcc

SEQ ID NO: 1437407 - RNA, 14 nt, Pseudomonas aeruginosa PA01
ggugcacgcgccgg

SEQ ID NO: 1437408 - RNA, 15 nt, Pseudomonas aeruginosa PA01
ggugcacggccaggc

SEQ ID NO: 1437409 - RNA, 22 nt, Pseudomonas aeruginosa PA01
ggugcaccaggcgaugcgccgg

SEQ ID NO: 1437410 - RNA, 20 nt, Pseudomonas aeruginosa PA01
ggugauuccgaugcgacgca

SEQ ID NO: 1437411 - RNA, 14 nt, Pseudomonas aeruginosa PA01
ggugagcgacccgc

SEQ ID NO: 1437412 - RNA, 20 nt, Pseudomonas aeruginosa PA01
ggugaucgaaaaaaggcgcc

SEQ ID NO: 1437413 - RNA, 22 nt, Pseudomonas aeruginosa PA01
ggugaucgaaaaaaggcgccuu

SEQ ID NO: 1437414 - RNA, 21 nt, Pseudomonas aeruginosa PA01
ggugaucgagccgccggggaa

SEQ ID NO: 1437415 - RNA, 17 nt, Pseudomonas aeruginosa PA01
ggugaucgagggccacg

SEQ ID NO: 1437416 - RNA, 20 nt, Pseudomonas aeruginosa PA01
ggugaucaucguccugccgg

SEQ ID NO: 1437417 - RNA, 14 nt, Pseudomonas aeruginosa PA01
ggugaucagcggcc

SEQ ID NO: 1437418 - RNA, 16 nt, Pseudomonas aeruginosa PA01
ggugaucagcggccga

SEQ ID NO: 1437419 - RNA, 15 nt, Pseudomonas aeruginosa PA01
ggugaugucgcggca

SEQ ID NO: 1437420 - RNA, 14 nt, Pseudomonas aeruginosa PA01
ggugaucucgcggc

SEQ ID NO: 1437421 - RNA, 16 nt, Pseudomonas aeruginosa PA01
ggugaucucgcggcgc

SEQ ID NO: 1437422 - RNA, 17 nt, Pseudomonas aeruginosa PA01
ggugaucucgcggcgcg

SEQ ID NO: 1437423 - RNA, 19 nt, Pseudomonas aeruginosa PA01
ggugaucucgcggcgcggc

SEQ ID NO: 1437424 - RNA, 19 nt, Pseudomonas aeruginosa PA01
ggucuuggcggcgaucgcc

SEQ ID NO: 1437425 - RNA, 14 nt, Pseudomonas aeruginosa PA01
ggucuuccgccgac

SEQ ID NO: 1437426 - RNA, 16 nt, Pseudomonas aeruginosa PA01
ggucuugccgauggcg

SEQ ID NO: 1437427 - RNA, 13 nt, Pseudomonas aeruginosa PA01
ggucuugccgacc

SEQ ID NO: 1437428 - RNA, 14 nt, Pseudomonas aeruginosa PA01
ggucuugccgaccu

SEQ ID NO: 1437429 - RNA, 20 nt, Pseudomonas aeruginosa PA01
ggucuugccggcugcgccgc

SEQ ID NO: 1437430 - RNA, 21 nt, Pseudomonas aeruginosa PA01
ggucuugcgcuugccggccgc

SEQ ID NO: 1437431 - RNA, 13 nt, Pseudomonas aeruginosa PA01
ggugaagcgcggc

SEQ ID NO: 1437432 - RNA, 14 nt, Pseudomonas aeruginosa PA01
ggugaagcgcggcg

SEQ ID NO: 1437433 - RNA, 20 nt, Pseudomonas aeruginosa PA01
ggugaagcgcggcggcgcgg

SEQ ID NO: 1437434 - RNA, 21 nt, Pseudomonas aeruginosa PA01
ggugaagcgcuccggcagguu

SEQ ID NO: 1437435 - RNA, 20 nt, Pseudomonas aeruginosa PA01
ggugaagcgcaggcggcugg

SEQ ID NO: 1437436 - RNA, 24 nt, Pseudomonas aeruginosa PA01
ggucugcugguagcugcugccggc

SEQ ID NO: 1437437 - RNA, 20 nt, Pseudomonas aeruginosa PA01
ggucugguaguaggcgcucu

SEQ ID NO: 1437438 - RNA, 14 nt, Pseudomonas aeruginosa PA01
ggucuucaggccgc

SEQ ID NO: 1437439 - RNA, 23 nt, Pseudomonas aeruginosa PA01
ggucuguugguggggcgccggcu

SEQ ID NO: 1437440 - RNA, 14 nt, Pseudomonas aeruginosa PA01
ggucuucaggcgcc

SEQ ID NO: 1437441 - RNA, 15 nt, Pseudomonas aeruginosa PA01
ggucuucaggcgccg

SEQ ID NO: 1437442 - RNA, 17 nt, Pseudomonas aeruginosa PA01
ggucuuccucggugucg

SEQ ID NO: 1437443 - RNA, 22 nt, Pseudomonas aeruginosa PA01
ggucuuccucggugucggccaa

SEQ ID NO: 1437444 - RNA, 16 nt, Pseudomonas aeruginosa PA01
ggucuucgcguuggcg

SEQ ID NO: 1437445 - RNA, 22 nt, Pseudomonas aeruginosa PA01
ggucuucgcguuggcggugccg

SEQ ID NO: 1437446 - RNA, 20 nt, Pseudomonas aeruginosa PA01
ggucuucguuuucaggcgac

SEQ ID NO: 1437447 - RNA, 22 nt, Pseudomonas aeruginosa PA01
ggucuucguuuucaggcgacgc

SEQ ID NO: 1437448 - RNA, 15 nt, Pseudomonas aeruginosa PA01
ggucugccucgccga

SEQ ID NO: 1437449 - RNA, 19 nt, Pseudomonas aeruginosa PA01
ggucugccccggcuuggcg

SEQ ID NO: 1437450 - RNA, 19 nt, Pseudomonas aeruginosa PA01
ggucuggccggcgaucaga

SEQ ID NO: 1437451 - RNA, 17 nt, Pseudomonas aeruginosa PA01
ggucugcucgcgcuucu

SEQ ID NO: 1437452 - RNA, 18 nt, Pseudomonas aeruginosa PA01
ggucugcugcgcgcacca

SEQ ID NO: 1437453 - RNA, 17 nt, Pseudomonas aeruginosa PA01
ggucugccagcucuggc

SEQ ID NO: 1437454 - RNA, 19 nt, Pseudomonas aeruginosa PA01
ggucugccagcucuggccg

SEQ ID NO: 1437455 - RNA, 20 nt, Pseudomonas aeruginosa PA01
ggucuagcgccccggccgcg

SEQ ID NO: 1437456 - RNA, 13 nt, Pseudomonas aeruginosa PA01
ggucucaccgccc

SEQ ID NO: 1437457 - RNA, 19 nt, Pseudomonas aeruginosa PA01
ggucucaccgcccugcgcg

SEQ ID NO: 1437458 - RNA, 20 nt, Pseudomonas aeruginosa PA01
ggucgccucgaacauggcca

SEQ ID NO: 1437459 - RNA, 15 nt, Pseudomonas aeruginosa PA01
ggucgccguccuugu

SEQ ID NO: 1437460 - RNA, 13 nt, Pseudomonas aeruginosa PA01
ggucgccggucgg

SEQ ID NO: 1437461 - RNA, 18 nt, Pseudomonas aeruginosa PA01
ggucgccgggcucacucc

SEQ ID NO: 1437462 - RNA, 18 nt, Pseudomonas aeruginosa PA01
ggucgccguagaacagca

SEQ ID NO: 1437463 - RNA, 16 nt, Pseudomonas aeruginosa PA01
ggucggccaggucgcg

SEQ ID NO: 1437464 - RNA, 22 nt, Pseudomonas aeruginosa PA01
ggucggccaguuccuucacggc

SEQ ID NO: 1437465 - RNA, 22 nt, Pseudomonas aeruginosa PA01
ggucggccaggggagcgccggc

SEQ ID NO: 1437466 - RNA, 23 nt, Pseudomonas aeruginosa PA01
ggucggccaggggagcgccggcg

SEQ ID NO: 1437467 - RNA, 20 nt, Pseudomonas aeruginosa PA01
ggucggccaggacgccacca

SEQ ID NO: 1437468 - RNA, 18 nt, Pseudomonas aeruginosa PA01
ggucggccggcagcuccg

SEQ ID NO: 1437469 - RNA, 15 nt, Pseudomonas aeruginosa PA01
ggucggccucggcga

SEQ ID NO: 1437470 - RNA, 21 nt, Pseudomonas aeruginosa PA01
ggucggccugcggguucggcg

SEQ ID NO: 1437471 - RNA, 23 nt, Pseudomonas aeruginosa PA01
ggucggccugcugcucgaccgcc

SEQ ID NO: 1437472 - RNA, 18 nt, Pseudomonas aeruginosa PA01
ggucggcgaacagggugg

SEQ ID NO: 1437473 - RNA, 17 nt, Pseudomonas aeruginosa PA01
ggucggccuggcugccg

SEQ ID NO: 1437474 - RNA, 18 nt, Pseudomonas aeruginosa PA01
ggucggccucggcgagga

SEQ ID NO: 1437475 - RNA, 20 nt, Pseudomonas aeruginosa PA01
ggucggcgaaguccaccagg

SEQ ID NO: 1437476 - RNA, 21 nt, Pseudomonas aeruginosa PA01
ggucggcgaaguccaccaggc

SEQ ID NO: 1437477 - RNA, 16 nt, Pseudomonas aeruginosa PA01
ggucggggcgcaaggc

SEQ ID NO: 1437478 - RNA, 22 nt, Pseudomonas aeruginosa PA01
ggucgggugaaggucugguagg

SEQ ID NO: 1437479 - RNA, 19 nt, Pseudomonas aeruginosa PA01
ggucgggucgagcuugccg

SEQ ID NO: 1437480 - RNA, 14 nt, Pseudomonas aeruginosa PA01
ggucgggcgccgcg

SEQ ID NO: 1437481 - RNA, 15 nt, Pseudomonas aeruginosa PA01
ggucggcuuccgccg

SEQ ID NO: 1437482 - RNA, 17 nt, Pseudomonas aeruginosa PA01
ggucggcuuccgccgcc

SEQ ID NO: 1437483 - RNA, 14 nt, Pseudomonas aeruginosa PA01
ggucgggauggcga

SEQ ID NO: 1437484 - RNA, 23 nt, Pseudomonas aeruginosa PA01
ggucguugcgcgccagcgccacg

SEQ ID NO: 1437485 - RNA, 16 nt, Pseudomonas aeruginosa PA01
ggucguggucgaaugg

SEQ ID NO: 1437486 - RNA, 17 nt, Pseudomonas aeruginosa PA01
ggucguggucgaaugga

SEQ ID NO: 1437487 - RNA, 22 nt, Pseudomonas aeruginosa PA01
ggucgugcuugcagucgcggaa

SEQ ID NO: 1437488 - RNA, 14 nt, Pseudomonas aeruginosa PA01
ggucgugcuggacu

SEQ ID NO: 1437489 - RNA, 19 nt, Pseudomonas aeruginosa PA01
ggucgugcugggacgccuu

SEQ ID NO: 1437490 - RNA, 13 nt, Pseudomonas aeruginosa PA01
ggugcgcgccacc

SEQ ID NO: 1437491 - RNA, 14 nt, Pseudomonas aeruginosa PA01
ggugcggccgagga

SEQ ID NO: 1437492 - RNA, 15 nt, Pseudomonas aeruginosa PA01
ggugcggccgaugau

SEQ ID NO: 1437493 - RNA, 12 nt, Pseudomonas aeruginosa PA01
ggugcgcuggcg

SEQ ID NO: 1437494 - RNA, 14 nt, Pseudomonas aeruginosa PA01
ggugcgcuggcgcc

SEQ ID NO: 1437495 - RNA, 22 nt, Pseudomonas aeruginosa PA01
ggugcgcuccuguugcuggccg

SEQ ID NO: 1437496 - RNA, 14 nt, Pseudomonas aeruginosa PA01
ggugcgcugguugg

SEQ ID NO: 1437497 - RNA, 19 nt, Pseudomonas aeruginosa PA01
ggugcgcuggaacggccag

SEQ ID NO: 1437498 - RNA, 14 nt, Pseudomonas aeruginosa PA01
ggugcgcaggcgcu

SEQ ID NO: 1437499 - RNA, 16 nt, Pseudomonas aeruginosa PA01
ggugcgcaggcgcucg

SEQ ID NO: 1437500 - RNA, 23 nt, Pseudomonas aeruginosa PA01
ggugcgcaggcgcucgcgggccg

SEQ ID NO: 1437501 - RNA, 19 nt, Pseudomonas aeruginosa PA01
ggugcgcaggcugccuucg

SEQ ID NO: 1437502 - RNA, 21 nt, Pseudomonas aeruginosa PA01
ggugcgcaugucguccaggcu

SEQ ID NO: 1437503 - RNA, 10 nt, Pseudomonas aeruginosa PA01
ggugcgccga

SEQ ID NO: 1437504 - RNA, 20 nt, Pseudomonas aeruginosa PA01
ggugcgccgagcgcucgccg

SEQ ID NO: 1437505 - RNA, 21 nt, Pseudomonas aeruginosa PA01
ggugcgccggcggccggcgca

SEQ ID NO: 1437506 - RNA, 20 nt, Pseudomonas aeruginosa PA01
ggugcgcacgcaauggcgca

SEQ ID NO: 1437507 - RNA, 21 nt, Pseudomonas aeruginosa PA01
ggugcguggugcauccgccgc

SEQ ID NO: 1437508 - RNA, 15 nt, Pseudomonas aeruginosa PA01
ggugcuaugcgccgg

SEQ ID NO: 1437509 - RNA, 22 nt, Pseudomonas aeruginosa PA01
ggugcucaggacguccuggccg

SEQ ID NO: 1437510 - RNA, 14 nt, Pseudomonas aeruginosa PA01
ggugcucaggcggc

SEQ ID NO: 1437511 - RNA, 15 nt, Pseudomonas aeruginosa PA01
gguggagaggcgugc

SEQ ID NO: 1437512 - RNA, 17 nt, Pseudomonas aeruginosa PA01
gguggagaucagcggac

SEQ ID NO: 1437513 - RNA, 20 nt, Pseudomonas aeruginosa PA01
gguggacgucgucggcgacc

SEQ ID NO: 1437514 - RNA, 19 nt, Pseudomonas aeruginosa PA01
gguggacggucucgccgcc

SEQ ID NO: 1437515 - RNA, 14 nt, Pseudomonas aeruginosa PA01
gguggaucgcggcg

SEQ ID NO: 1437516 - RNA, 15 nt, Pseudomonas aeruginosa PA01
gguggagcacgucga

SEQ ID NO: 1437517 - RNA, 17 nt, Pseudomonas aeruginosa PA01
gguggauguucgccgcc

SEQ ID NO: 1437518 - RNA, 15 nt, Pseudomonas aeruginosa PA01
gguggaggcgucggc

SEQ ID NO: 1437519 - RNA, 17 nt, Pseudomonas aeruginosa PA01
gguggaguaccaggcca

SEQ ID NO: 1437520 - RNA, 17 nt, Pseudomonas aeruginosa PA01
gguggaugccgguggcg

SEQ ID NO: 1437521 - RNA, 16 nt, Pseudomonas aeruginosa PA01
gguggcaacugccgcc

SEQ ID NO: 1437522 - RNA, 14 nt, Pseudomonas aeruginosa PA01
gguggcaggccugg

SEQ ID NO: 1437523 - RNA, 15 nt, Pseudomonas aeruginosa PA01
gguggcaugggccag

SEQ ID NO: 1437524 - RNA, 22 nt, Pseudomonas aeruginosa PA01
gguggcaugggccaguuccggc

SEQ ID NO: 1437525 - RNA, 18 nt, Pseudomonas aeruginosa PA01
gguggcaugguguccggc

SEQ ID NO: 1437526 - RNA, 17 nt, Pseudomonas aeruginosa PA01
ggugcgggcagacacca

SEQ ID NO: 1437527 - RNA, 16 nt, Pseudomonas aeruginosa PA01
ggugcgggcgcgggcg

SEQ ID NO: 1437528 - RNA, 18 nt, Pseudomonas aeruginosa PA01
ggugcggcaccagccagg

SEQ ID NO: 1437529 - RNA, 16 nt, Pseudomonas aeruginosa PA01
ggugcgguggcuggcg

SEQ ID NO: 1437530 - RNA, 18 nt, Pseudomonas aeruginosa PA01
ggugcgguggcuggcgua

SEQ ID NO: 1437531 - RNA, 16 nt, Pseudomonas aeruginosa PA01
ggugcggucggcgccu

SEQ ID NO: 1437532 - RNA, 15 nt, Pseudomonas aeruginosa PA01
ggugccggcggcgga

SEQ ID NO: 1437533 - RNA, 13 nt, Pseudomonas aeruginosa PA01
ggugccgccggcc

SEQ ID NO: 1437534 - RNA, 22 nt, Pseudomonas aeruginosa PA01
ggugccgccggccaccagcagc

SEQ ID NO: 1437535 - RNA, 16 nt, Pseudomonas aeruginosa PA01
ggugccgccggcgccg

SEQ ID NO: 1437536 - RNA, 18 nt, Pseudomonas aeruginosa PA01
ggugccgccggcgccgcc

SEQ ID NO: 1437537 - RNA, 19 nt, Pseudomonas aeruginosa PA01
ggugccgccggcgccgccg

SEQ ID NO: 1437538 - RNA, 21 nt, Pseudomonas aeruginosa PA01
ggugccgccagucggccuggc

SEQ ID NO: 1437539 - RNA, 23 nt, Pseudomonas aeruginosa PA01
ggugccgccagucggccuggcuc

SEQ ID NO: 1437540 - RNA, 13 nt, Pseudomonas aeruginosa PA01
ggugccgcccggc

SEQ ID NO: 1437541 - RNA, 19 nt, Pseudomonas aeruginosa PA01
ggugccgcccggcgccacc

SEQ ID NO: 1437542 - RNA, 19 nt, Pseudomonas aeruginosa PA01
ggugccgaucucguaggca

SEQ ID NO: 1437543 - RNA, 20 nt, Pseudomonas aeruginosa PA01
ggugcccuggaagccggcag

SEQ ID NO: 1437544 - RNA, 23 nt, Pseudomonas aeruginosa PA01
ggugccgaagaccaccauggucu

SEQ ID NO: 1437545 - RNA, 19 nt, Pseudomonas aeruginosa PA01
ggugccgaccuucaccacc

SEQ ID NO: 1437546 - RNA, 18 nt, Pseudomonas aeruginosa PA01
ggugcagguucaccgccu

SEQ ID NO: 1437547 - RNA, 17 nt, Pseudomonas aeruginosa PA01
ggugcauaggguccagu

SEQ ID NO: 1437548 - RNA, 22 nt, Pseudomonas aeruginosa PA01
ggugcauaggguccaguucagg

SEQ ID NO: 1437549 - RNA, 15 nt, Pseudomonas aeruginosa PA01
ggugcauccgccgca

SEQ ID NO: 1437550 - RNA, 19 nt, Pseudomonas aeruginosa PA01
ggugcauccgccgcagacc

SEQ ID NO: 1437551 - RNA, 16 nt, Pseudomonas aeruginosa PA01
ggugcaugaaggcgcu

SEQ ID NO: 1437552 - RNA, 21 nt, Pseudomonas aeruginosa PA01
ggugcaugaaggcgcugagcg

SEQ ID NO: 1437553 - RNA, 16 nt, Pseudomonas aeruginosa PA01
ggugcaggaagcgccg

SEQ ID NO: 1437554 - RNA, 14 nt, Pseudomonas aeruginosa PA01
ggugcaggucgcgc

SEQ ID NO: 1437555 - RNA, 19 nt, Pseudomonas aeruginosa PA01
ggugcagccacccagcagc

SEQ ID NO: 1437556 - RNA, 21 nt, Pseudomonas aeruginosa PA01
ggugcagcccuggcguggccg

SEQ ID NO: 1437557 - RNA, 22 nt, Pseudomonas aeruginosa PA01
ggugcagcggaagcccugcugg

SEQ ID NO: 1437558 - RNA, 20 nt, Pseudomonas aeruginosa PA01
ggugcagaugaccagcgcau

SEQ ID NO: 1437559 - RNA, 22 nt, Pseudomonas aeruginosa PA01
ggugccagggcggucggccagg

SEQ ID NO: 1437560 - RNA, 14 nt, Pseudomonas aeruginosa PA01
ggugcccagcggcg

SEQ ID NO: 1437561 - RNA, 16 nt, Pseudomonas aeruginosa PA01
ggugcccagcggcgcc

SEQ ID NO: 1437562 - RNA, 15 nt, Pseudomonas aeruginosa PA01
ggugccccgcuggcc

SEQ ID NO: 1437563 - RNA, 14 nt, Pseudomonas aeruginosa PA01
ggugcccucgcgga

SEQ ID NO: 1437564 - RNA, 22 nt, Pseudomonas aeruginosa PA01
ggugcccucgcggacgcuggcg

SEQ ID NO: 1437565 - RNA, 15 nt, Pseudomonas aeruginosa PA01
gucgauauagcccug

SEQ ID NO: 1437566 - RNA, 16 nt, Pseudomonas aeruginosa PA01
gucgauauugccgcgg

SEQ ID NO: 1437567 - RNA, 19 nt, Pseudomonas aeruginosa PA01
gucgauacgcaucugcucg

SEQ ID NO: 1437568 - RNA, 17 nt, Pseudomonas aeruginosa PA01
gucgaucagcagcagcg

SEQ ID NO: 1437569 - RNA, 23 nt, Pseudomonas aeruginosa PA01
gucgaucagcagcagcgccaugc

SEQ ID NO: 1437570 - RNA, 13 nt, Pseudomonas aeruginosa PA01
gucgcagccgagc

SEQ ID NO: 1437571 - RNA, 14 nt, Pseudomonas aeruginosa PA01
gucgcagccgagcc

SEQ ID NO: 1437572 - RNA, 18 nt, Pseudomonas aeruginosa PA01
gucgcagccgagccccca

SEQ ID NO: 1437573 - RNA, 14 nt, Pseudomonas aeruginosa PA01
gucgcagccgcgca

SEQ ID NO: 1437574 - RNA, 15 nt, Pseudomonas aeruginosa PA01
gucgcagcggccgua

SEQ ID NO: 1437575 - RNA, 14 nt, Pseudomonas aeruginosa PA01
gucgcagcgggcau

SEQ ID NO: 1437576 - RNA, 21 nt, Pseudomonas aeruginosa PA01
gucgcagcguuccagcgcugg

SEQ ID NO: 1437577 - RNA, 14 nt, Pseudomonas aeruginosa PA01
gucgcagcuccagc

SEQ ID NO: 1437578 - RNA, 19 nt, Pseudomonas aeruginosa PA01
gucgaucaggaacgcgcca

SEQ ID NO: 1437579 - RNA, 17 nt, Pseudomonas aeruginosa PA01
gucgaucaggcgcaugc

SEQ ID NO: 1437580 - RNA, 15 nt, Pseudomonas aeruginosa PA01
gucgaucaggcgggc

SEQ ID NO: 1437581 - RNA, 18 nt, Pseudomonas aeruginosa PA01
gucgaucaggcgggcguc

SEQ ID NO: 1437582 - RNA, 24 nt, Pseudomonas aeruginosa PA01
gucgaucagguaggccggcgugcc

SEQ ID NO: 1437583 - RNA, 23 nt, Pseudomonas aeruginosa PA01
gucgaucaggucgccgccgccgg

SEQ ID NO: 1437584 - RNA, 23 nt, Pseudomonas aeruginosa PA01
gucgccaggccguagaccaccag

SEQ ID NO: 1437585 - RNA, 15 nt, Pseudomonas aeruginosa PA01
gucgccaagcccggc

SEQ ID NO: 1437586 - RNA, 12 nt, Pseudomonas aeruginosa PA01
gucgccagcagg

SEQ ID NO: 1437587 - RNA, 10 nt, Pseudomonas aeruginosa PA01
gucgccagcc

SEQ ID NO: 1437588 - RNA, 16 nt, Pseudomonas aeruginosa PA01
gucgccaacgcgccgu

SEQ ID NO: 1437589 - RNA, 15 nt, Pseudomonas aeruginosa PA01
gucgcauccaccagc

SEQ ID NO: 1437590 - RNA, 19 nt, Pseudomonas aeruginosa PA01
gucgcaggcucaguucggc

SEQ ID NO: 1437591 - RNA, 21 nt, Pseudomonas aeruginosa PA01
gucgcaggcucaguucggcca

SEQ ID NO: 1437592 - RNA, 13 nt, Pseudomonas aeruginosa PA01
gucgcaggggcuu

SEQ ID NO: 1437593 - RNA, 20 nt, Pseudomonas aeruginosa PA01
gucgcagguaacccgcggcg

SEQ ID NO: 1437594 - RNA, 17 nt, Pseudomonas aeruginosa PA01
gucgcaggcgaugccga

SEQ ID NO: 1437595 - RNA, 24 nt, Pseudomonas aeruginosa PA01
gucgccgccgaggcgcgccacgca

SEQ ID NO: 1437596 - RNA, 16 nt, Pseudomonas aeruginosa PA01
gucgccgcccggcagc

SEQ ID NO: 1437597 - RNA, 19 nt, Pseudomonas aeruginosa PA01
gucgccgcccggcagcggc

SEQ ID NO: 1437598 - RNA, 21 nt, Pseudomonas aeruginosa PA01
gucgccgcccacgccuugcag

SEQ ID NO: 1437599 - RNA, 15 nt, Pseudomonas aeruginosa PA01
gucgccgcagguccg

SEQ ID NO: 1437600 - RNA, 14 nt, Pseudomonas aeruginosa PA01
gucgccgccagcau

SEQ ID NO: 1437601 - RNA, 21 nt, Pseudomonas aeruginosa PA01
gucgccgccagcgccggccau

SEQ ID NO: 1437602 - RNA, 15 nt, Pseudomonas aeruginosa PA01
gucgccgccagcuac

SEQ ID NO: 1437603 - RNA, 16 nt, Pseudomonas aeruginosa PA01
gucgccgccagcuacc

SEQ ID NO: 1437604 - RNA, 16 nt, Pseudomonas aeruginosa PA01
gucgccgccaguucgg

SEQ ID NO: 1437605 - RNA, 11 nt, Pseudomonas aeruginosa PA01
gucgccgccca

SEQ ID NO: 1437606 - RNA, 13 nt, Pseudomonas aeruginosa PA01
gucgccgcccacg

SEQ ID NO: 1437607 - RNA, 17 nt, Pseudomonas aeruginosa PA01
gucgccgcacaccgcgc

SEQ ID NO: 1437608 - RNA, 15 nt, Pseudomonas aeruginosa PA01
gucgccgcaccggcg

SEQ ID NO: 1437609 - RNA, 24 nt, Pseudomonas aeruginosa PA01
gucgccgcaccggcgauggccggc

SEQ ID NO: 1437610 - RNA, 16 nt, Pseudomonas aeruginosa PA01
gucgccgcgaccucgu

SEQ ID NO: 1437611 - RNA, 14 nt, Pseudomonas aeruginosa PA01
gucgccgccgcggg

SEQ ID NO: 1437612 - RNA, 21 nt, Pseudomonas aeruginosa PA01
gucgcccggauagacgccguc

SEQ ID NO: 1437613 - RNA, 19 nt, Pseudomonas aeruginosa PA01
gucgcccgugccucggcgg

SEQ ID NO: 1437614 - RNA, 22 nt, Pseudomonas aeruginosa PA01
gucgcccugcagcgcgcgcugg

SEQ ID NO: 1437615 - RNA, 15 nt, Pseudomonas aeruginosa PA01
gucgcccugcccggu

SEQ ID NO: 1437616 - RNA, 15 nt, Pseudomonas aeruginosa PA01
gucgcccucggcgcu

SEQ ID NO: 1437617 - RNA, 17 nt, Pseudomonas aeruginosa PA01
gucgcccucggcgcugg

SEQ ID NO: 1437618 - RNA, 21 nt, Pseudomonas aeruginosa PA01
gucgcccucggcgcuggccag

SEQ ID NO: 1437619 - RNA, 16 nt, Pseudomonas aeruginosa PA01
gucgcccgggcgccac

SEQ ID NO: 1437620 - RNA, 19 nt, Pseudomonas aeruginosa PA01
gucgcccgggcgccaccga

SEQ ID NO: 1437621 - RNA, 13 nt, Pseudomonas aeruginosa PA01
gucgccaugcggc

SEQ ID NO: 1437622 - RNA, 18 nt, Pseudomonas aeruginosa PA01
gucgccaugcggcaggcc

SEQ ID NO: 1437623 - RNA, 14 nt, Pseudomonas aeruginosa PA01
gucgcccgccggcg

SEQ ID NO: 1437624 - RNA, 18 nt, Pseudomonas aeruginosa PA01
gucgcccgccggcgugcc

SEQ ID NO: 1437625 - RNA, 20 nt, Pseudomonas aeruginosa PA01
gucgccccgguuggcgcccc

SEQ ID NO: 1437626 - RNA, 22 nt, Pseudomonas aeruginosa PA01
gucgccauccuggucgcguucc

SEQ ID NO: 1437627 - RNA, 21 nt, Pseudomonas aeruginosa PA01
gucgccaugcccgucgaccau

SEQ ID NO: 1437628 - RNA, 16 nt, Pseudomonas aeruginosa PA01
gucgcgaacucggcgc

SEQ ID NO: 1437629 - RNA, 17 nt, Pseudomonas aeruginosa PA01
gucgcgaacucggcgcc

SEQ ID NO: 1437630 - RNA, 21 nt, Pseudomonas aeruginosa PA01
gucgcgaacucggcgccgauc

SEQ ID NO: 1437631 - RNA, 17 nt, Pseudomonas aeruginosa PA01
gucgccggaggggcggc

SEQ ID NO: 1437632 - RNA, 22 nt, Pseudomonas aeruginosa PA01
gucgccggaggggcggccgccg

SEQ ID NO: 1437633 - RNA, 14 nt, Pseudomonas aeruginosa PA01
gucgccuugaccag

SEQ ID NO: 1437634 - RNA, 18 nt, Pseudomonas aeruginosa PA01
gucgccuugaccagcggc

SEQ ID NO: 1437635 - RNA, 20 nt, Pseudomonas aeruginosa PA01
gucgccuugaccagcggccc

SEQ ID NO: 1437636 - RNA, 22 nt, Pseudomonas aeruginosa PA01
gucgccuugaccagcggcccgg

SEQ ID NO: 1437637 - RNA, 23 nt, Pseudomonas aeruginosa PA01
gucgccgcugaauaccaccgggc

SEQ ID NO: 1437638 - RNA, 17 nt, Pseudomonas aeruginosa PA01
gucgccgcugaugcgcu

SEQ ID NO: 1437639 - RNA, 14 nt, Pseudomonas aeruginosa PA01
gucgccgcugggca

SEQ ID NO: 1437640 - RNA, 13 nt, Pseudomonas aeruginosa PA01
gucgccgcuggac

SEQ ID NO: 1437641 - RNA, 14 nt, Pseudomonas aeruginosa PA01
gucgcgauccaccg

SEQ ID NO: 1437642 - RNA, 16 nt, Pseudomonas aeruginosa PA01
gucgcgauccaccgcc

SEQ ID NO: 1437643 - RNA, 19 nt, Pseudomonas aeruginosa PA01
gucgcgagguuccgcggcg

SEQ ID NO: 1437644 - RNA, 21 nt, Pseudomonas aeruginosa PA01
gucgcgacugaccacgcagag

SEQ ID NO: 1437645 - RNA, 23 nt, Pseudomonas aeruginosa PA01
gucgcgagcagggcgaugccgau

SEQ ID NO: 1437646 - RNA, 21 nt, Pseudomonas aeruginosa PA01
gucgcgaccgguaacuggcca

SEQ ID NO: 1437647 - RNA, 15 nt, Pseudomonas aeruginosa PA01
gucgcgaucugcugg

SEQ ID NO: 1437648 - RNA, 16 nt, Pseudomonas aeruginosa PA01
gucgcgaucugcuggu

SEQ ID NO: 1437649 - RNA, 16 nt, Pseudomonas aeruginosa PA01
gucgcgcaccuggcgg

SEQ ID NO: 1437650 - RNA, 23 nt, Pseudomonas aeruginosa PA01
gucgcggagaauccgcucggugc

SEQ ID NO: 1437651 - RNA, 22 nt, Pseudomonas aeruginosa PA01
gucgcggacuccggaggcgcac

SEQ ID NO: 1437652 - RNA, 16 nt, Pseudomonas aeruginosa PA01
gucgcggaccuccagc

SEQ ID NO: 1437653 - RNA, 23 nt, Pseudomonas aeruginosa PA01
gucgcggaccuccagccggccau

SEQ ID NO: 1437654 - RNA, 19 nt, Pseudomonas aeruginosa PA01
gucgcggacgaggaugguc

SEQ ID NO: 1437655 - RNA, 18 nt, Pseudomonas aeruginosa PA01
gucgcgcaggcgggcggc

SEQ ID NO: 1437656 - RNA, 16 nt, Pseudomonas aeruginosa PA01
gucgcgcaggcggugg

SEQ ID NO: 1437657 - RNA, 20 nt, Pseudomonas aeruginosa PA01
gucgcgcagcgccuccagcg

SEQ ID NO: 1437658 - RNA, 14 nt, Pseudomonas aeruginosa PA01
gucgcgcagcggcu

SEQ ID NO: 1437659 - RNA, 15 nt, Pseudomonas aeruginosa PA01
gucgcgcagcggcuc

SEQ ID NO: 1437660 - RNA, 13 nt, Pseudomonas aeruginosa PA01
gucgcgggccugg

SEQ ID NO: 1437661 - RNA, 16 nt, Pseudomonas aeruginosa PA01
gucgcggccaucggcg

SEQ ID NO: 1437662 - RNA, 18 nt, Pseudomonas aeruginosa PA01
gucgcggccaucggcgaa

SEQ ID NO: 1437663 - RNA, 17 nt, Pseudomonas aeruginosa PA01
gucgcggcaggcggcgg

SEQ ID NO: 1437664 - RNA, 19 nt, Pseudomonas aeruginosa PA01
gucgcggauguucaccagg

SEQ ID NO: 1437665 - RNA, 17 nt, Pseudomonas aeruginosa PA01
gucgcgguacagccggu

SEQ ID NO: 1437666 - RNA, 17 nt, Pseudomonas aeruginosa PA01
gucgcggggcuugcgcc

SEQ ID NO: 1437667 - RNA, 16 nt, Pseudomonas aeruginosa PA01
gucgcgggcgauggcc

SEQ ID NO: 1437668 - RNA, 20 nt, Pseudomonas aeruginosa PA01
gucgcggucaucgccggcgc

SEQ ID NO: 1437669 - RNA, 20 nt, Pseudomonas aeruginosa PA01
gucgcggucuuccgccgacu

SEQ ID NO: 1437670 - RNA, 22 nt, Pseudomonas aeruginosa PA01
gucgcggucuuccgccgacugc

SEQ ID NO: 1437671 - RNA, 23 nt, Pseudomonas aeruginosa PA01
gucgcgguugccgaagcgcucgg

SEQ ID NO: 1437672 - RNA, 17 nt, Pseudomonas aeruginosa PA01
gucgcguacagcgggcc

SEQ ID NO: 1437673 - RNA, 20 nt, Pseudomonas aeruginosa PA01
gucgcguacagcgggccggg

SEQ ID NO: 1437674 - RNA, 16 nt, Pseudomonas aeruginosa PA01
gucgcgucggccuggc

SEQ ID NO: 1437675 - RNA, 18 nt, Pseudomonas aeruginosa PA01
gucgcgucggccuggcgc

SEQ ID NO: 1437676 - RNA, 13 nt, Pseudomonas aeruginosa PA01
gucgcguccggcc

SEQ ID NO: 1437677 - RNA, 16 nt, Pseudomonas aeruginosa PA01
gucgcguccggccagc

SEQ ID NO: 1437678 - RNA, 18 nt, Pseudomonas aeruginosa PA01
gucgcguccggccagccu

SEQ ID NO: 1437679 - RNA, 22 nt, Pseudomonas aeruginosa PA01
gucgcguccggccagccuggcc

SEQ ID NO: 1437680 - RNA, 23 nt, Pseudomonas aeruginosa PA01
gucgcguccggccagccuggcca

SEQ ID NO: 1437681 - RNA, 19 nt, Pseudomonas aeruginosa PA01
gucgcguucccacucgcga

SEQ ID NO: 1437682 - RNA, 20 nt, Pseudomonas aeruginosa PA01
gucgcguucccacucgcgac

SEQ ID NO: 1437683 - RNA, 15 nt, Pseudomonas aeruginosa PA01
gucgcguucgucggc

SEQ ID NO: 1437684 - RNA, 16 nt, Pseudomonas aeruginosa PA01
gucgcguucgucggcc

SEQ ID NO: 1437685 - RNA, 19 nt, Pseudomonas aeruginosa PA01
gucgcguucgucggccacc

SEQ ID NO: 1437686 - RNA, 21 nt, Pseudomonas aeruginosa PA01
gucgcguuggcgugcucgcgc

SEQ ID NO: 1437687 - RNA, 17 nt, Pseudomonas aeruginosa PA01
gucggaaagcagggcga

SEQ ID NO: 1437688 - RNA, 20 nt, Pseudomonas aeruginosa PA01
gucggaaagcagggcgaugg

SEQ ID NO: 1437689 - RNA, 18 nt, Pseudomonas aeruginosa PA01
gucgcuuccgcgcggcgc

SEQ ID NO: 1437690 - RNA, 14 nt, Pseudomonas aeruginosa PA01
gucgcuuccggcgc

SEQ ID NO: 1437691 - RNA, 15 nt, Pseudomonas aeruginosa PA01
gucgcuuccggcgcc

SEQ ID NO: 1437692 - RNA, 16 nt, Pseudomonas aeruginosa PA01
gucgcuuccggcgcca

SEQ ID NO: 1437693 - RNA, 17 nt, Pseudomonas aeruginosa PA01
gucgcuuccggcgccaa

SEQ ID NO: 1437694 - RNA, 19 nt, Pseudomonas aeruginosa PA01
gucgcuuccggcgccaacc

SEQ ID NO: 1437695 - RNA, 20 nt, Pseudomonas aeruginosa PA01
gucgcuuccggcgccaacca

SEQ ID NO: 1437696 - RNA, 20 nt, Pseudomonas aeruginosa PA01
gucgcuucgcccgccgccug

SEQ ID NO: 1437697 - RNA, 14 nt, Pseudomonas aeruginosa PA01
gucggaacgaccgg

SEQ ID NO: 1437698 - RNA, 24 nt, Pseudomonas aeruginosa PA01
gucggaagcgucagccgcggccgg

SEQ ID NO: 1437699 - RNA, 19 nt, Pseudomonas aeruginosa PA01
gucggagagauagucgccg

SEQ ID NO: 1437700 - RNA, 22 nt, Pseudomonas aeruginosa PA01
gucggagagggagcgccuggcg

SEQ ID NO: 1437701 - RNA, 17 nt, Pseudomonas aeruginosa PA01
gucggagauagccuccu

SEQ ID NO: 1437702 - RNA, 14 nt, Pseudomonas aeruginosa PA01
gucggcaccugcag

SEQ ID NO: 1437703 - RNA, 15 nt, Pseudomonas aeruginosa PA01
gucggcaccagggcu

SEQ ID NO: 1437704 - RNA, 18 nt, Pseudomonas aeruginosa PA01
gucggcaccgaucgcccg

SEQ ID NO: 1437705 - RNA, 21 nt, Pseudomonas aeruginosa PA01
gucggcagcagcuugccggca

SEQ ID NO: 1437706 - RNA, 17 nt, Pseudomonas aeruginosa PA01
gucggcaggaccgacuc

SEQ ID NO: 1437707 - RNA, 16 nt, Pseudomonas aeruginosa PA01
gucggcaaagccgcug

SEQ ID NO: 1437708 - RNA, 23 nt, Pseudomonas aeruginosa PA01
gucgcucugggucuuggucacgg

SEQ ID NO: 1437709 - RNA, 14 nt, Pseudomonas aeruginosa PA01
gucgcucgcgcagg

SEQ ID NO: 1437710 - RNA, 13 nt, Pseudomonas aeruginosa PA01
gucgcuccggcag

SEQ ID NO: 1437711 - RNA, 14 nt, Pseudomonas aeruginosa PA01
gucgcuccggcagc

SEQ ID NO: 1437712 - RNA, 13 nt, Pseudomonas aeruginosa PA01
gucgcucauggcg

SEQ ID NO: 1437713 - RNA, 14 nt, Pseudomonas aeruginosa PA01
gucgcucauggcgc

SEQ ID NO: 1437714 - RNA, 12 nt, Pseudomonas aeruginosa PA01
gucgcuccagac

SEQ ID NO: 1437715 - RNA, 13 nt, Pseudomonas aeruginosa PA01
gucgcuccagacc

SEQ ID NO: 1437716 - RNA, 15 nt, Pseudomonas aeruginosa PA01
gucgcucagcgggcc

SEQ ID NO: 1437717 - RNA, 17 nt, Pseudomonas aeruginosa PA01
gucgcucagcgggccga

SEQ ID NO: 1437718 - RNA, 19 nt, Pseudomonas aeruginosa PA01
gucgcucagcgggccgauc

SEQ ID NO: 1437719 - RNA, 22 nt, Pseudomonas aeruginosa PA01
gucgcugagcaguugcgggcgc

SEQ ID NO: 1437720 - RNA, 16 nt, Pseudomonas aeruginosa PA01
gucgcugagcggcugg

SEQ ID NO: 1437721 - RNA, 18 nt, Pseudomonas aeruginosa PA01
gucgcugaccacccggug

SEQ ID NO: 1437722 - RNA, 18 nt, Pseudomonas aeruginosa PA01
gucgcugaccagcccggc

SEQ ID NO: 1437723 - RNA, 21 nt, Pseudomonas aeruginosa PA01
gucgcugaccagcccggcggc

SEQ ID NO: 1437724 - RNA, 12 nt, Pseudomonas aeruginosa PA01
gucgcugaccgg

SEQ ID NO: 1437725 - RNA, 16 nt, Pseudomonas aeruginosa PA01
gucgcugaccggccgc

SEQ ID NO: 1437726 - RNA, 17 nt, Pseudomonas aeruginosa PA01
gucgcugaccggccgca

SEQ ID NO: 1437727 - RNA, 18 nt, Pseudomonas aeruginosa PA01
gucgcugaccggccgcag

SEQ ID NO: 1437728 - RNA, 17 nt, Pseudomonas aeruginosa PA01
gucgcugccgccgcgcc

SEQ ID NO: 1437729 - RNA, 14 nt, Pseudomonas aeruginosa PA01
gucgcugcgcaacu

SEQ ID NO: 1437730 - RNA, 22 nt, Pseudomonas aeruginosa PA01
gucgcugcccaucgccuccacg

SEQ ID NO: 1437731 - RNA, 17 nt, Pseudomonas aeruginosa PA01
gucgcugcucagggccg

SEQ ID NO: 1437732 - RNA, 15 nt, Pseudomonas aeruginosa PA01
gucgcugcucggccu

SEQ ID NO: 1437733 - RNA, 14 nt, Pseudomonas aeruginosa PA01
gucgcugcgcgggu

SEQ ID NO: 1437734 - RNA, 17 nt, Pseudomonas aeruginosa PA01
gucgcugcgcgggucgu

SEQ ID NO: 1437735 - RNA, 14 nt, Pseudomonas aeruginosa PA01
gucgcuggcaccgg

SEQ ID NO: 1437736 - RNA, 11 nt, Pseudomonas aeruginosa PA01
gucgcuggcca

SEQ ID NO: 1437737 - RNA, 12 nt, Pseudomonas aeruginosa PA01
gucgcuggccag

SEQ ID NO: 1437738 - RNA, 13 nt, Pseudomonas aeruginosa PA01
gucgcugcuggcg

SEQ ID NO: 1437739 - RNA, 14 nt, Pseudomonas aeruginosa PA01
gucgcugcuggcgc

SEQ ID NO: 1437740 - RNA, 15 nt, Pseudomonas aeruginosa PA01
gucgcugcuggcgcc

SEQ ID NO: 1437741 - RNA, 16 nt, Pseudomonas aeruginosa PA01
gucgcuucaccgggca

SEQ ID NO: 1437742 - RNA, 14 nt, Pseudomonas aeruginosa PA01
gucgcuguccucca

SEQ ID NO: 1437743 - RNA, 17 nt, Pseudomonas aeruginosa PA01
gucgcuguccuccagcg

SEQ ID NO: 1437744 - RNA, 20 nt, Pseudomonas aeruginosa PA01
gucgcuguccuccagcggcg

SEQ ID NO: 1437745 - RNA, 23 nt, Pseudomonas aeruginosa PA01
gucgcuguccuccagcggcggga

SEQ ID NO: 1437746 - RNA, 16 nt, Pseudomonas aeruginosa PA01
gucgcuggcgucgacc

SEQ ID NO: 1437747 - RNA, 21 nt, Pseudomonas aeruginosa PA01
gucgcuggcgucgaccgccug

SEQ ID NO: 1437748 - RNA, 11 nt, Pseudomonas aeruginosa PA01
gucgcuggccu

SEQ ID NO: 1437749 - RNA, 15 nt, Pseudomonas aeruginosa PA01
gucgcuggccugcag

SEQ ID NO: 1437750 - RNA, 17 nt, Pseudomonas aeruginosa PA01
gucgcuggccugcaggu

SEQ ID NO: 1437751 - RNA, 13 nt, Pseudomonas aeruginosa PA01
gucgcuggccugg

SEQ ID NO: 1437752 - RNA, 17 nt, Pseudomonas aeruginosa PA01
gucggccaucgccgucu

SEQ ID NO: 1437753 - RNA, 20 nt, Pseudomonas aeruginosa PA01
gucggccaucuggcugccga

SEQ ID NO: 1437754 - RNA, 15 nt, Pseudomonas aeruginosa PA01
gucggccaggcgcca

SEQ ID NO: 1437755 - RNA, 14 nt, Pseudomonas aeruginosa PA01
gucggccaggcggc

SEQ ID NO: 1437756 - RNA, 16 nt, Pseudomonas aeruginosa PA01
gucggccaggcggccg

SEQ ID NO: 1437757 - RNA, 17 nt, Pseudomonas aeruginosa PA01
gucggccaggcggccga

SEQ ID NO: 1437758 - RNA, 20 nt, Pseudomonas aeruginosa PA01
gucggccaggcggccgacga

SEQ ID NO: 1437759 - RNA, 14 nt, Pseudomonas aeruginosa PA01
gucggccaggcgcc

SEQ ID NO: 1437760 - RNA, 23 nt, Pseudomonas aeruginosa PA01
gucggcccuugugaaagggcggc

SEQ ID NO: 1437761 - RNA, 20 nt, Pseudomonas aeruginosa PA01
gucggcccggagaccgugcc

SEQ ID NO: 1437762 - RNA, 13 nt, Pseudomonas aeruginosa PA01
gucggcccgcgcc

SEQ ID NO: 1437763 - RNA, 14 nt, Pseudomonas aeruginosa PA01
gucggcccgcgcca

SEQ ID NO: 1437764 - RNA, 17 nt, Pseudomonas aeruginosa PA01
gucggcccgcgccaugu

SEQ ID NO: 1437765 - RNA, 14 nt, Pseudomonas aeruginosa PA01
gucggccgccaggg

SEQ ID NO: 1437766 - RNA, 12 nt, Pseudomonas aeruginosa PA01
gucggccgcucg

SEQ ID NO: 1437767 - RNA, 14 nt, Pseudomonas aeruginosa PA01
gucggccgcucggc

SEQ ID NO: 1437768 - RNA, 15 nt, Pseudomonas aeruginosa PA01
gucggccgcucggcc

SEQ ID NO: 1437769 - RNA, 20 nt, Pseudomonas aeruginosa PA01
gucggccaacugggccuuga

SEQ ID NO: 1437770 - RNA, 17 nt, Pseudomonas aeruginosa PA01
gucggcaucgaacucac

SEQ ID NO: 1437771 - RNA, 14 nt, Pseudomonas aeruginosa PA01
gucggcauccggca

SEQ ID NO: 1437772 - RNA, 23 nt, Pseudomonas aeruginosa PA01
gucggcauggcuguagggacagg

SEQ ID NO: 1437773 - RNA, 13 nt, Pseudomonas aeruginosa PA01
gucggccaccagg

SEQ ID NO: 1437774 - RNA, 14 nt, Pseudomonas aeruginosa PA01
gucggccagccccu

SEQ ID NO: 1437775 - RNA, 16 nt, Pseudomonas aeruginosa PA01
gucggccagccccugc

SEQ ID NO: 1437776 - RNA, 17 nt, Pseudomonas aeruginosa PA01
gucggccagccccugcg

SEQ ID NO: 1437777 - RNA, 18 nt, Pseudomonas aeruginosa PA01
gucggccagccccugcgg

SEQ ID NO: 1437778 - RNA, 12 nt, Pseudomonas aeruginosa PA01
gucggccagcag

SEQ ID NO: 1437779 - RNA, 13 nt, Pseudomonas aeruginosa PA01
gucggccagcagc

SEQ ID NO: 1437780 - RNA, 14 nt, Pseudomonas aeruginosa PA01
gucggccagcagca

SEQ ID NO: 1437781 - RNA, 13 nt, Pseudomonas aeruginosa PA01
gucggccaggcgc

SEQ ID NO: 1437782 - RNA, 14 nt, Pseudomonas aeruginosa PA01
gucggccgccucgg

SEQ ID NO: 1437783 - RNA, 18 nt, Pseudomonas aeruginosa PA01
gucggccugcaccagcca

SEQ ID NO: 1437784 - RNA, 13 nt, Pseudomonas aeruginosa PA01
gucggccucgccg

SEQ ID NO: 1437785 - RNA, 18 nt, Pseudomonas aeruginosa PA01
gucggccucgccgauguc

SEQ ID NO: 1437786 - RNA, 16 nt, Pseudomonas aeruginosa PA01
gucggcgagccggcgc

SEQ ID NO: 1437787 - RNA, 18 nt, Pseudomonas aeruginosa PA01
gucggccuugaggcgggc

SEQ ID NO: 1437788 - RNA, 20 nt, Pseudomonas aeruginosa PA01
gucggccuugaggcgggcca

SEQ ID NO: 1437789 - RNA, 21 nt, Pseudomonas aeruginosa PA01
gucggccuugaggcgggccag

SEQ ID NO: 1437790 - RNA, 22 nt, Pseudomonas aeruginosa PA01
gucggccuugaggcgggccagc

SEQ ID NO: 1437791 - RNA, 13 nt, Pseudomonas aeruginosa PA01
gucggccuggcgg

SEQ ID NO: 1437792 - RNA, 18 nt, Pseudomonas aeruginosa PA01
gucggccuggcgguugau

SEQ ID NO: 1437793 - RNA, 23 nt, Pseudomonas aeruginosa PA01
gucggccuggcucaugucgugga

SEQ ID NO: 1437794 - RNA, 17 nt, Pseudomonas aeruginosa PA01
gucggccuggcugccga

SEQ ID NO: 1437795 - RNA, 21 nt, Pseudomonas aeruginosa PA01
gucggccuggguacgcaccgg

SEQ ID NO: 1437796 - RNA, 17 nt, Pseudomonas aeruginosa PA01
gucggccugcgguucgc

SEQ ID NO: 1437797 - RNA, 23 nt, Pseudomonas aeruginosa PA01
gucggccugcugcucgaccgccu

SEQ ID NO: 1437798 - RNA, 12 nt, Pseudomonas aeruginosa PA01
gucggccuggcg

SEQ ID NO: 1437799 - RNA, 14 nt, Pseudomonas aeruginosa PA01
gucggccuggcgca

SEQ ID NO: 1437800 - RNA, 22 nt, Pseudomonas aeruginosa PA01
gucggccuggcgcagcggcagc

SEQ ID NO: 1437801 - RNA, 15 nt, Pseudomonas aeruginosa PA01
gucggcgaucaggcc

SEQ ID NO: 1437802 - RNA, 23 nt, Pseudomonas aeruginosa PA01
gucggcgaucaggccgaugcgca

SEQ ID NO: 1437803 - RNA, 22 nt, Pseudomonas aeruginosa PA01
gucggcgaucugugcgagcgcg

SEQ ID NO: 1437804 - RNA, 16 nt, Pseudomonas aeruginosa PA01
gucggcgcgccagaag

SEQ ID NO: 1437805 - RNA, 19 nt, Pseudomonas aeruginosa PA01
gucggcgcgcccggcgcag

SEQ ID NO: 1437806 - RNA, 20 nt, Pseudomonas aeruginosa PA01
gucggcgauucguucgagca

SEQ ID NO: 1437807 - RNA, 21 nt, Pseudomonas aeruginosa PA01
gucggcgauucguucgagcag

SEQ ID NO: 1437808 - RNA, 13 nt, Pseudomonas aeruginosa PA01
gucggcgcgggcg

SEQ ID NO: 1437809 - RNA, 15 nt, Pseudomonas aeruginosa PA01
gucggcgcgggcgcc

SEQ ID NO: 1437810 - RNA, 17 nt, Pseudomonas aeruginosa PA01
gucggcgcgggcgccga

SEQ ID NO: 1437811 - RNA, 15 nt, Pseudomonas aeruginosa PA01
gucggcgcggggcgu

SEQ ID NO: 1437812 - RNA, 18 nt, Pseudomonas aeruginosa PA01
gucggcgcuuugcugcac

SEQ ID NO: 1437813 - RNA, 21 nt, Pseudomonas aeruginosa PA01
gucggcgcuuugcugcacgcu

SEQ ID NO: 1437814 - RNA, 13 nt, Pseudomonas aeruginosa PA01
gucggcgcggcgc

SEQ ID NO: 1437815 - RNA, 17 nt, Pseudomonas aeruginosa PA01
gucggcgcggcgcucca

SEQ ID NO: 1437816 - RNA, 20 nt, Pseudomonas aeruginosa PA01
gucggcgcggcgcuccaggc

SEQ ID NO: 1437817 - RNA, 21 nt, Pseudomonas aeruginosa PA01
gucggcgcggcgcuccaggcg

SEQ ID NO: 1437818 - RNA, 16 nt, Pseudomonas aeruginosa PA01
gucggcgcggccggcg

SEQ ID NO: 1437819 - RNA, 17 nt, Pseudomonas aeruginosa PA01
gucggcgcggccggcgc

SEQ ID NO: 1437820 - RNA, 19 nt, Pseudomonas aeruginosa PA01
gucggcgcggccggcgccg

SEQ ID NO: 1437821 - RNA, 14 nt, Pseudomonas aeruginosa PA01
gucggcgcggccgg

SEQ ID NO: 1437822 - RNA, 12 nt, Pseudomonas aeruginosa PA01
gucggcgcgcgg

SEQ ID NO: 1437823 - RNA, 21 nt, Pseudomonas aeruginosa PA01
guccguaaugcaacccgccgc

SEQ ID NO: 1437824 - RNA, 20 nt, Pseudomonas aeruginosa PA01
guccgguugcuggcacaggu

SEQ ID NO: 1437825 - RNA, 14 nt, Pseudomonas aeruginosa PA01
guccggugacgucg

SEQ ID NO: 1437826 - RNA, 14 nt, Pseudomonas aeruginosa PA01
guccgucucgucga

SEQ ID NO: 1437827 - RNA, 12 nt, Pseudomonas aeruginosa PA01
guccguccagcg

SEQ ID NO: 1437828 - RNA, 14 nt, Pseudomonas aeruginosa PA01
guccguccagcgcg

SEQ ID NO: 1437829 - RNA, 16 nt, Pseudomonas aeruginosa PA01
guccguccagcgcgcc

SEQ ID NO: 1437830 - RNA, 18 nt, Pseudomonas aeruginosa PA01
guccgucccacaggccgg

SEQ ID NO: 1437831 - RNA, 14 nt, Pseudomonas aeruginosa PA01
guccguucggcgcc

SEQ ID NO: 1437832 - RNA, 17 nt, Pseudomonas aeruginosa PA01
guccguugaggcguucg

SEQ ID NO: 1437833 - RNA, 23 nt, Pseudomonas aeruginosa PA01
guccguugcgcagcaccacgaug

SEQ ID NO: 1437834 - RNA, 15 nt, Pseudomonas aeruginosa PA01
guccggccagccugg

SEQ ID NO: 1437835 - RNA, 20 nt, Pseudomonas aeruginosa PA01
guccggccagccuggccagc

SEQ ID NO: 1437836 - RNA, 22 nt, Pseudomonas aeruginosa PA01
guccggguugacccagagccgc

SEQ ID NO: 1437837 - RNA, 17 nt, Pseudomonas aeruginosa PA01
guccggguugagcaccc

SEQ ID NO: 1437838 - RNA, 18 nt, Pseudomonas aeruginosa PA01
guccggguuggcgcaggc

SEQ ID NO: 1437839 - RNA, 21 nt, Pseudomonas aeruginosa PA01
guccggguuggcgcaggccgg

SEQ ID NO: 1437840 - RNA, 22 nt, Pseudomonas aeruginosa PA01
guccggguugucguugcgcagc

SEQ ID NO: 1437841 - RNA, 14 nt, Pseudomonas aeruginosa PA01
guccgguagcgcgc

SEQ ID NO: 1437842 - RNA, 19 nt, Pseudomonas aeruginosa PA01
guccgguaggagcgagagc

SEQ ID NO: 1437843 - RNA, 21 nt, Pseudomonas aeruginosa PA01
guccgguaggagcgagagcgc

SEQ ID NO: 1437844 - RNA, 13 nt, Pseudomonas aeruginosa PA01
guccggcagggcc

SEQ ID NO: 1437845 - RNA, 19 nt, Pseudomonas aeruginosa PA01
guccggcagggccucgggc

SEQ ID NO: 1437846 - RNA, 13 nt, Pseudomonas aeruginosa PA01
guccggccgcccg

SEQ ID NO: 1437847 - RNA, 16 nt, Pseudomonas aeruginosa PA01
guccggccgcccgagc

SEQ ID NO: 1437848 - RNA, 21 nt, Pseudomonas aeruginosa PA01
guccggccgcccgagccgcug

SEQ ID NO: 1437849 - RNA, 18 nt, Pseudomonas aeruginosa PA01
guccggaccgggcggcag

SEQ ID NO: 1437850 - RNA, 19 nt, Pseudomonas aeruginosa PA01
guccgcuggccugcagcag

SEQ ID NO: 1437851 - RNA, 17 nt, Pseudomonas aeruginosa PA01
guccgcuucagcgcgcc

SEQ ID NO: 1437852 - RNA, 21 nt, Pseudomonas aeruginosa PA01
guccgcuucagcgcgccgagc

SEQ ID NO: 1437853 - RNA, 23 nt, Pseudomonas aeruginosa PA01
guccgcuucagcgcgccgagcca

SEQ ID NO: 1437854 - RNA, 15 nt, Pseudomonas aeruginosa PA01
guccggauugccgcg

SEQ ID NO: 1437855 - RNA, 16 nt, Pseudomonas aeruginosa PA01
guccggcaccaccagc

SEQ ID NO: 1437856 - RNA, 22 nt, Pseudomonas aeruginosa PA01
guccggcaccaccagcgcgcgc

SEQ ID NO: 1437857 - RNA, 16 nt, Pseudomonas aeruginosa PA01
guccggcagcacggcg

SEQ ID NO: 1437858 - RNA, 16 nt, Pseudomonas aeruginosa PA01
guccgacaaucagcgg

SEQ ID NO: 1437859 - RNA, 22 nt, Pseudomonas aeruginosa PA01
guccgacaaucagcggcgggcg

SEQ ID NO: 1437860 - RNA, 14 nt, Pseudomonas aeruginosa PA01
guccgacagcaggu

SEQ ID NO: 1437861 - RNA, 15 nt, Pseudomonas aeruginosa PA01
guccgacagcagguc

SEQ ID NO: 1437862 - RNA, 16 nt, Pseudomonas aeruginosa PA01
guccgacagcaggucg

SEQ ID NO: 1437863 - RNA, 17 nt, Pseudomonas aeruginosa PA01
guccgacagcaggucgu

SEQ ID NO: 1437864 - RNA, 22 nt, Pseudomonas aeruginosa PA01
gucccuugcggguacgcgggcc

SEQ ID NO: 1437865 - RNA, 20 nt, Pseudomonas aeruginosa PA01
gucccgggaaaccaccagga

SEQ ID NO: 1437866 - RNA, 23 nt, Pseudomonas aeruginosa PA01
guccgaacagaggaaggcgccgg

SEQ ID NO: 1437867 - RNA, 20 nt, Pseudomonas aeruginosa PA01
gucccuuguuuuccuggccc

SEQ ID NO: 1437868 - RNA, 22 nt, Pseudomonas aeruginosa PA01
gucccuuguuuuccuggcccug

SEQ ID NO: 1437869 - RNA, 17 nt, Pseudomonas aeruginosa PA01
guccgacccgcuccgga

SEQ ID NO: 1437870 - RNA, 20 nt, Pseudomonas aeruginosa PA01
guccgccgaggugcugcacc

SEQ ID NO: 1437871 - RNA, 12 nt, Pseudomonas aeruginosa PA01
guccgccgccgu

SEQ ID NO: 1437872 - RNA, 22 nt, Pseudomonas aeruginosa PA01
guccgcccuuuuucgucgccag

SEQ ID NO: 1437873 - RNA, 23 nt, Pseudomonas aeruginosa PA01
guccgcccuuuuucgucgccagc

SEQ ID NO: 1437874 - RNA, 20 nt, Pseudomonas aeruginosa PA01
guccgcccaguucgccggcc

SEQ ID NO: 1437875 - RNA, 13 nt, Pseudomonas aeruginosa PA01
guccgcggccugc

SEQ ID NO: 1437876 - RNA, 17 nt, Pseudomonas aeruginosa PA01
guccgcggccugcucgg

SEQ ID NO: 1437877 - RNA, 21 nt, Pseudomonas aeruginosa PA01
guccgccggguccaccgcggc

SEQ ID NO: 1437878 - RNA, 12 nt, Pseudomonas aeruginosa PA01
guccgccggccu

SEQ ID NO: 1437879 - RNA, 13 nt, Pseudomonas aeruginosa PA01
guccgccggccuc

SEQ ID NO: 1437880 - RNA, 15 nt, Pseudomonas aeruginosa PA01
guccgccgcgggacg

SEQ ID NO: 1437881 - RNA, 14 nt, Pseudomonas aeruginosa PA01
guccgccgccgcgg

SEQ ID NO: 1437882 - RNA, 15 nt, Pseudomonas aeruginosa PA01
guccgccgccgcggc

SEQ ID NO: 1437883 - RNA, 15 nt, Pseudomonas aeruginosa PA01
guccgcucuggauca

SEQ ID NO: 1437884 - RNA, 15 nt, Pseudomonas aeruginosa PA01
guccgcggugccgcc

SEQ ID NO: 1437885 - RNA, 17 nt, Pseudomonas aeruginosa PA01
guccgcggugccgccau

SEQ ID NO: 1437886 - RNA, 17 nt, Pseudomonas aeruginosa PA01
guccccucacggcgcga

SEQ ID NO: 1437887 - RNA, 18 nt, Pseudomonas aeruginosa PA01
gucccgaaaggggcucga

SEQ ID NO: 1437888 - RNA, 21 nt, Pseudomonas aeruginosa PA01
guccccuuccuccucgccgcu

SEQ ID NO: 1437889 - RNA, 23 nt, Pseudomonas aeruginosa PA01
guccccuuccuccucgccgcucc

SEQ ID NO: 1437890 - RNA, 22 nt, Pseudomonas aeruginosa PA01
gucccaugaccgucagccaggc

SEQ ID NO: 1437891 - RNA, 18 nt, Pseudomonas aeruginosa PA01
gucccauuccucggcguc

SEQ ID NO: 1437892 - RNA, 20 nt, Pseudomonas aeruginosa PA01
gucccauugcaucugcgccg

SEQ ID NO: 1437893 - RNA, 21 nt, Pseudomonas aeruginosa PA01
gucccauugcaucugcgccgg

SEQ ID NO: 1437894 - RNA, 17 nt, Pseudomonas aeruginosa PA01
gucccaucagcaguccg

SEQ ID NO: 1437895 - RNA, 20 nt, Pseudomonas aeruginosa PA01
gucccagucggcguccgccu

SEQ ID NO: 1437896 - RNA, 22 nt, Pseudomonas aeruginosa PA01
gucccagucggcguccgccucg

SEQ ID NO: 1437897 - RNA, 17 nt, Pseudomonas aeruginosa PA01
gucccaguucaacugga

SEQ ID NO: 1437898 - RNA, 15 nt, Pseudomonas aeruginosa PA01
gucccggcuugccgg

SEQ ID NO: 1437899 - RNA, 17 nt, Pseudomonas aeruginosa PA01
gucccggcuugccggca

SEQ ID NO: 1437900 - RNA, 19 nt, Pseudomonas aeruginosa PA01
gucccggcuugccggcagc

SEQ ID NO: 1437901 - RNA, 12 nt, Pseudomonas aeruginosa PA01
gucccgcgcggc

SEQ ID NO: 1437902 - RNA, 14 nt, Pseudomonas aeruginosa PA01
gucccgcgcggccc

SEQ ID NO: 1437903 - RNA, 20 nt, Pseudomonas aeruginosa PA01
gucccggacgggugcgcgcc

SEQ ID NO: 1437904 - RNA, 15 nt, Pseudomonas aeruginosa PA01
gucccgcuccagccg

SEQ ID NO: 1437905 - RNA, 17 nt, Pseudomonas aeruginosa PA01
gucccgcuccagccggc

SEQ ID NO: 1437906 - RNA, 21 nt, Pseudomonas aeruginosa PA01
gucccgcuccagccggcaagc

SEQ ID NO: 1437907 - RNA, 18 nt, Pseudomonas aeruginosa PA01
gucccgccgcgccgcuca

SEQ ID NO: 1437908 - RNA, 14 nt, Pseudomonas aeruginosa PA01
gucccgcgcgccga

SEQ ID NO: 1437909 - RNA, 16 nt, Pseudomonas aeruginosa PA01
gucccgcgcgccgagc

SEQ ID NO: 1437910 - RNA, 15 nt, Pseudomonas aeruginosa PA01
gucccgagcaccggc

SEQ ID NO: 1437911 - RNA, 17 nt, Pseudomonas aeruginosa PA01
gucccgcaaagcccgcu

SEQ ID NO: 1437912 - RNA, 16 nt, Pseudomonas aeruginosa PA01
guccagugcggcaguc

SEQ ID NO: 1437913 - RNA, 12 nt, Pseudomonas aeruginosa PA01
gucaucgcgccg

SEQ ID NO: 1437914 - RNA, 14 nt, Pseudomonas aeruginosa PA01
guccagucaccagg

SEQ ID NO: 1437915 - RNA, 14 nt, Pseudomonas aeruginosa PA01
gucaucgcugaccu

SEQ ID NO: 1437916 - RNA, 17 nt, Pseudomonas aeruginosa PA01
guccaguucagggcgag

SEQ ID NO: 1437917 - RNA, 18 nt, Pseudomonas aeruginosa PA01
guccaguucagggcgagc

SEQ ID NO: 1437918 - RNA, 16 nt, Pseudomonas aeruginosa PA01
guccaucagccgcgcg

SEQ ID NO: 1437919 - RNA, 18 nt, Pseudomonas aeruginosa PA01
guccaucagccgcgcgcu

SEQ ID NO: 1437920 - RNA, 20 nt, Pseudomonas aeruginosa PA01
guccaucagccgcgcgcugg

SEQ ID NO: 1437921 - RNA, 21 nt, Pseudomonas aeruginosa PA01
guccaucagccgcgcgcugga

SEQ ID NO: 1437922 - RNA, 14 nt, Pseudomonas aeruginosa PA01
guccaucgccgcgg

SEQ ID NO: 1437923 - RNA, 14 nt, Pseudomonas aeruginosa PA01
gucccacuugucca

SEQ ID NO: 1437924 - RNA, 17 nt, Pseudomonas aeruginosa PA01
gucccacuuguccagag

SEQ ID NO: 1437925 - RNA, 16 nt, Pseudomonas aeruginosa PA01
gucccagaaggccagg

SEQ ID NO: 1437926 - RNA, 14 nt, Pseudomonas aeruginosa PA01
gucccagaccaccc

SEQ ID NO: 1437927 - RNA, 17 nt, Pseudomonas aeruginosa PA01
gucccagaccacccggc

SEQ ID NO: 1437928 - RNA, 15 nt, Pseudomonas aeruginosa PA01
gucccagaccagcag

SEQ ID NO: 1437929 - RNA, 17 nt, Pseudomonas aeruginosa PA01
gucauccuggcccugga

SEQ ID NO: 1437930 - RNA, 22 nt, Pseudomonas aeruginosa PA01
gucaucgagcaguuccaggcgu

SEQ ID NO: 1437931 - RNA, 19 nt, Pseudomonas aeruginosa PA01
gucauccgcccugcgucgc

SEQ ID NO: 1437932 - RNA, 14 nt, Pseudomonas aeruginosa PA01
gucauccgccggcg

SEQ ID NO: 1437933 - RNA, 15 nt, Pseudomonas aeruginosa PA01
gucauccgccggcgc

SEQ ID NO: 1437934 - RNA, 12 nt, Pseudomonas aeruginosa PA01
gucauccgccuu

SEQ ID NO: 1437935 - RNA, 16 nt, Pseudomonas aeruginosa PA01
gucgaccaccgcgugg

SEQ ID NO: 1437936 - RNA, 23 nt, Pseudomonas aeruginosa PA01
gucgaccacgaagcuguuggcca

SEQ ID NO: 1437937 - RNA, 22 nt, Pseudomonas aeruginosa PA01
gucgacaucgauaacaccagga

SEQ ID NO: 1437938 - RNA, 22 nt, Pseudomonas aeruginosa PA01
gucgacaugcaccaggccgcca

SEQ ID NO: 1437939 - RNA, 17 nt, Pseudomonas aeruginosa PA01
gucgacaugcaggccgg

SEQ ID NO: 1437940 - RNA, 19 nt, Pseudomonas aeruginosa PA01
gucgacaugcaggccggcc

SEQ ID NO: 1437941 - RNA, 14 nt, Pseudomonas aeruginosa PA01
gucgaccgccugcc

SEQ ID NO: 1437942 - RNA, 22 nt, Pseudomonas aeruginosa PA01
gucgaccgccugccagaccgug

SEQ ID NO: 1437943 - RNA, 15 nt, Pseudomonas aeruginosa PA01
gucgacggccuuggu

SEQ ID NO: 1437944 - RNA, 18 nt, Pseudomonas aeruginosa PA01
gucgaccgucgccacgcu

SEQ ID NO: 1437945 - RNA, 23 nt, Pseudomonas aeruginosa PA01
gucgacggcuuccagggucgagg

SEQ ID NO: 1437946 - RNA, 19 nt, Pseudomonas aeruginosa PA01
gucgacguaggcggcgagg

SEQ ID NO: 1437947 - RNA, 22 nt, Pseudomonas aeruginosa PA01
gucgaggugcggcugccggugc

SEQ ID NO: 1437948 - RNA, 17 nt, Pseudomonas aeruginosa PA01
gucgagguucuccaggc

SEQ ID NO: 1437949 - RNA, 16 nt, Pseudomonas aeruginosa PA01
gucgagguugcgcggc

SEQ ID NO: 1437950 - RNA, 20 nt, Pseudomonas aeruginosa PA01
gucgagguuguagcccuggg

SEQ ID NO: 1437951 - RNA, 23 nt, Pseudomonas aeruginosa PA01
gucgagguuguagcccugggcga

SEQ ID NO: 1437952 - RNA, 20 nt, Pseudomonas aeruginosa PA01
gucgaguaccgcugcggccg

SEQ ID NO: 1437953 - RNA, 23 nt, Pseudomonas aeruginosa PA01
gucgaguaccgcugcggccggcg

SEQ ID NO: 1437954 - RNA, 23 nt, Pseudomonas aeruginosa PA01
gucgagcuuguuggccagcagcc

SEQ ID NO: 1437955 - RNA, 14 nt, Pseudomonas aeruginosa PA01
gucgagcugcucgg

SEQ ID NO: 1437956 - RNA, 17 nt, Pseudomonas aeruginosa PA01
gucgagcugcucggcgg

SEQ ID NO: 1437957 - RNA, 18 nt, Pseudomonas aeruginosa PA01
gucgagcugcucggcggu

SEQ ID NO: 1437958 - RNA, 13 nt, Pseudomonas aeruginosa PA01
gucgagcuggcgc

SEQ ID NO: 1437959 - RNA, 16 nt, Pseudomonas aeruginosa PA01
gucgagcuggcgcagg

SEQ ID NO: 1437960 - RNA, 23 nt, Pseudomonas aeruginosa PA01
gucgagcuggcgcaggccuucga

SEQ ID NO: 1437961 - RNA, 13 nt, Pseudomonas aeruginosa PA01
gucgagcgaagcg

SEQ ID NO: 1437962 - RNA, 13 nt, Pseudomonas aeruginosa PA01
gucgagcgcagcg

SEQ ID NO: 1437963 - RNA, 16 nt, Pseudomonas aeruginosa PA01
gucgagcgcagcgaca

SEQ ID NO: 1437964 - RNA, 18 nt, Pseudomonas aeruginosa PA01
gucgacuucgcaccagcc

SEQ ID NO: 1437965 - RNA, 23 nt, Pseudomonas aeruginosa PA01
gucgacuucgcaccagccggccg

SEQ ID NO: 1437966 - RNA, 14 nt, Pseudomonas aeruginosa PA01
gucgacuucgucga

SEQ ID NO: 1437967 - RNA, 12 nt, Pseudomonas aeruginosa PA01
gucgacugcugg

SEQ ID NO: 1437968 - RNA, 16 nt, Pseudomonas aeruginosa PA01
gucgacucagcgggcg

SEQ ID NO: 1437969 - RNA, 14 nt, Pseudomonas aeruginosa PA01
gucgaagcagccca

SEQ ID NO: 1437970 - RNA, 14 nt, Pseudomonas aeruginosa PA01
gucgaagccuucga

SEQ ID NO: 1437971 - RNA, 17 nt, Pseudomonas aeruginosa PA01
gucgaaggccucgucgc

SEQ ID NO: 1437972 - RNA, 19 nt, Pseudomonas aeruginosa PA01
gucgaaggccucgucgccc

SEQ ID NO: 1437973 - RNA, 20 nt, Pseudomonas aeruginosa PA01
gucgaaggccucgucgcccg

SEQ ID NO: 1437974 - RNA, 14 nt, Pseudomonas aeruginosa PA01
gucgaaggcgcggc

SEQ ID NO: 1437975 - RNA, 16 nt, Pseudomonas aeruginosa PA01
gucgaaggcgcggcgg

SEQ ID NO: 1437976 - RNA, 19 nt, Pseudomonas aeruginosa PA01
gucgaagcugucggcccgc

SEQ ID NO: 1437977 - RNA, 20 nt, Pseudomonas aeruginosa PA01
gucgaagcugucguaguccu

SEQ ID NO: 1437978 - RNA, 17 nt, Pseudomonas aeruginosa PA01
gucgaagcucggcgcga

SEQ ID NO: 1437979 - RNA, 13 nt, Pseudomonas aeruginosa PA01
gucgaacugcucg

SEQ ID NO: 1437980 - RNA, 14 nt, Pseudomonas aeruginosa PA01
gucgaacugcucga

SEQ ID NO: 1437981 - RNA, 23 nt, Pseudomonas aeruginosa PA01
guccuggcggcaaggcacacgcc

SEQ ID NO: 1437982 - RNA, 21 nt, Pseudomonas aeruginosa PA01
guccuggguauagaccagcac

SEQ ID NO: 1437983 - RNA, 22 nt, Pseudomonas aeruginosa PA01
guccuggguggcgacgccgguc

SEQ ID NO: 1437984 - RNA, 23 nt, Pseudomonas aeruginosa PA01
guccuggguggcgacgccggucg

SEQ ID NO: 1437985 - RNA, 13 nt, Pseudomonas aeruginosa PA01
guccugggugucg

SEQ ID NO: 1437986 - RNA, 17 nt, Pseudomonas aeruginosa PA01
guccugggccaccuggc

SEQ ID NO: 1437987 - RNA, 22 nt, Pseudomonas aeruginosa PA01
guccugggccgguugcggcgcc

SEQ ID NO: 1437988 - RNA, 16 nt, Pseudomonas aeruginosa PA01
guccuggaucggcagc

SEQ ID NO: 1437989 - RNA, 13 nt, Pseudomonas aeruginosa PA01
guccuggccgagc

SEQ ID NO: 1437990 - RNA, 22 nt, Pseudomonas aeruginosa PA01
gucgacaccgaucaccuggccg

SEQ ID NO: 1437991 - RNA, 23 nt, Pseudomonas aeruginosa PA01
gucgacaccgaucaccuggccgg

SEQ ID NO: 1437992 - RNA, 21 nt, Pseudomonas aeruginosa PA01
gucgaagucgaucaccgcauc

SEQ ID NO: 1437993 - RNA, 20 nt, Pseudomonas aeruginosa PA01
gucgaaguacaccuuggcgc

SEQ ID NO: 1437994 - RNA, 22 nt, Pseudomonas aeruginosa PA01
gucgaaguacaccuuggcgcga

SEQ ID NO: 1437995 - RNA, 23 nt, Pseudomonas aeruginosa PA01
gucgaaguacaccuuggcgcgac

SEQ ID NO: 1437996 - RNA, 14 nt, Pseudomonas aeruginosa PA01
gucgaaggcggcgc

SEQ ID NO: 1437997 - RNA, 16 nt, Pseudomonas aeruginosa PA01
gucgaaggcggcgcgg

SEQ ID NO: 1437998 - RNA, 17 nt, Pseudomonas aeruginosa PA01
gucgaaggcggcgcggc

SEQ ID NO: 1437999 - RNA, 18 nt, Pseudomonas aeruginosa PA01
gucgaaggcggcgcggcg

SEQ ID NO: 1438000 - RNA, 17 nt, Pseudomonas aeruginosa PA01
gucgaagggcacgccgc

SEQ ID NO: 1438001 - RNA, 18 nt, Pseudomonas aeruginosa PA01
gucgaagggcacgccgcu

SEQ ID NO: 1438002 - RNA, 20 nt, Pseudomonas aeruginosa PA01
gucgaagggcacgccgcucu

SEQ ID NO: 1438003 - RNA, 17 nt, Pseudomonas aeruginosa PA01
guccugcggcggcaggu

SEQ ID NO: 1438004 - RNA, 19 nt, Pseudomonas aeruginosa PA01
guccugcugcuggccuucg

SEQ ID NO: 1438005 - RNA, 17 nt, Pseudomonas aeruginosa PA01
guccuggacccguugcc

SEQ ID NO: 1438006 - RNA, 19 nt, Pseudomonas aeruginosa PA01
guccuggauaagccgcgcc

SEQ ID NO: 1438007 - RNA, 22 nt, Pseudomonas aeruginosa PA01
guccuggauaagccgcgccauc

SEQ ID NO: 1438008 - RNA, 23 nt, Pseudomonas aeruginosa PA01
guccuggauaagccgcgccaucg

SEQ ID NO: 1438009 - RNA, 22 nt, Pseudomonas aeruginosa PA01
guccugcggauucaucggcggc

SEQ ID NO: 1438010 - RNA, 24 nt, Pseudomonas aeruginosa PA01
guccugcggauucaucggcggcag

SEQ ID NO: 1438011 - RNA, 22 nt, Pseudomonas aeruginosa PA01
guccugcggccgcaaccagccc

SEQ ID NO: 1438012 - RNA, 19 nt, Pseudomonas aeruginosa PA01
guccugccggugcucggcc

SEQ ID NO: 1438013 - RNA, 20 nt, Pseudomonas aeruginosa PA01
guccugccggugcucggccu

SEQ ID NO: 1438014 - RNA, 18 nt, Pseudomonas aeruginosa PA01
guccugcaacugcucgau

SEQ ID NO: 1438015 - RNA, 21 nt, Pseudomonas aeruginosa PA01
guccugcaacuggaaggccgc

SEQ ID NO: 1438016 - RNA, 16 nt, Pseudomonas aeruginosa PA01
guccucggggaagcgc

SEQ ID NO: 1438017 - RNA, 13 nt, Pseudomonas aeruginosa PA01
guccucguggcgc

SEQ ID NO: 1438018 - RNA, 14 nt, Pseudomonas aeruginosa PA01
guccucgcgccgcu

SEQ ID NO: 1438019 - RNA, 17 nt, Pseudomonas aeruginosa PA01
guccucgaugcccgccu

SEQ ID NO: 1438020 - RNA, 16 nt, Pseudomonas aeruginosa PA01
guccucggcgccgucg

SEQ ID NO: 1438021 - RNA, 17 nt, Pseudomonas aeruginosa PA01
guccucggcgccgucga

SEQ ID NO: 1438022 - RNA, 20 nt, Pseudomonas aeruginosa PA01
guccucggcguagccggcca

SEQ ID NO: 1438023 - RNA, 23 nt, Pseudomonas aeruginosa PA01
guccucaauaccgaacaccagca

SEQ ID NO: 1438024 - RNA, 15 nt, Pseudomonas aeruginosa PA01
guccuccaccgcucc

SEQ ID NO: 1438025 - RNA, 18 nt, Pseudomonas aeruginosa PA01
guccuccaccgcuccggc

SEQ ID NO: 1438026 - RNA, 22 nt, Pseudomonas aeruginosa PA01
guccuacgaaggcauauccccu

SEQ ID NO: 1438027 - RNA, 13 nt, Pseudomonas aeruginosa PA01
guccuccgcgccc

SEQ ID NO: 1438028 - RNA, 17 nt, Pseudomonas aeruginosa PA01
guccuccgcgcccaggc

SEQ ID NO: 1438029 - RNA, 20 nt, Pseudomonas aeruginosa PA01
guccuccgcgcccaggcgca

SEQ ID NO: 1438030 - RNA, 19 nt, Pseudomonas aeruginosa PA01
guccuccucgaucacccgc

SEQ ID NO: 1438031 - RNA, 20 nt, Pseudomonas aeruginosa PA01
guccuccucgaucacccgcg

SEQ ID NO: 1438032 - RNA, 19 nt, Pseudomonas aeruginosa PA01
guccucgaaagccgccgcc

SEQ ID NO: 1438033 - RNA, 23 nt, Pseudomonas aeruginosa PA01
guccucgaaagccgccgccgcgc

SEQ ID NO: 1438034 - RNA, 21 nt, Pseudomonas aeruginosa PA01
guagucggugaagcgcggcgg

SEQ ID NO: 1438035 - RNA, 19 nt, Pseudomonas aeruginosa PA01
guagucuucgaugcgccgc

SEQ ID NO: 1438036 - RNA, 18 nt, Pseudomonas aeruginosa PA01
guagucgcugcuggcgcc

SEQ ID NO: 1438037 - RNA, 16 nt, Pseudomonas aeruginosa PA01
guagugcucggccagu

SEQ ID NO: 1438038 - RNA, 16 nt, Pseudomonas aeruginosa PA01
guagugcggcgggcgc

SEQ ID NO: 1438039 - RNA, 16 nt, Pseudomonas aeruginosa PA01
guagugcaacaccugg

SEQ ID NO: 1438040 - RNA, 18 nt, Pseudomonas aeruginosa PA01
guaguccugggccgguug

SEQ ID NO: 1438041 - RNA, 14 nt, Pseudomonas aeruginosa PA01
guagucgacgccgg

SEQ ID NO: 1438042 - RNA, 13 nt, Pseudomonas aeruginosa PA01
guagucgagccgg

SEQ ID NO: 1438043 - RNA, 14 nt, Pseudomonas aeruginosa PA01
guaguccaucaccg

SEQ ID NO: 1438044 - RNA, 14 nt, Pseudomonas aeruginosa PA01
guaguccagccagu

SEQ ID NO: 1438045 - RNA, 14 nt, Pseudomonas aeruginosa PA01
guaguccagcgccg

SEQ ID NO: 1438046 - RNA, 18 nt, Pseudomonas aeruginosa PA01
guaguccagcgccgcgcu

SEQ ID NO: 1438047 - RNA, 18 nt, Pseudomonas aeruginosa PA01
guagucgcccagcgccug

SEQ ID NO: 1438048 - RNA, 13 nt, Pseudomonas aeruginosa PA01
guagucgccccgg

SEQ ID NO: 1438049 - RNA, 15 nt, Pseudomonas aeruginosa PA01
guagucgcggggcgg

SEQ ID NO: 1438050 - RNA, 15 nt, Pseudomonas aeruginosa PA01
guagguuuucguugg

SEQ ID NO: 1438051 - RNA, 18 nt, Pseudomonas aeruginosa PA01
guaggugcgcuggcgcca

SEQ ID NO: 1438052 - RNA, 17 nt, Pseudomonas aeruginosa PA01
guagguggcgccgccgg

SEQ ID NO: 1438053 - RNA, 19 nt, Pseudomonas aeruginosa PA01
guagguggcgccgccggcg

SEQ ID NO: 1438054 - RNA, 15 nt, Pseudomonas aeruginosa PA01
guagucauggccagu

SEQ ID NO: 1438055 - RNA, 16 nt, Pseudomonas aeruginosa PA01
guaguaguggaagccg

SEQ ID NO: 1438056 - RNA, 23 nt, Pseudomonas aeruginosa PA01
guaguaccucgaagcccagcgcc

SEQ ID NO: 1438057 - RNA, 13 nt, Pseudomonas aeruginosa PA01
guaguagaucagc

SEQ ID NO: 1438058 - RNA, 18 nt, Pseudomonas aeruginosa PA01
aagucguuguacuggccg

SEQ ID NO: 1438059 - RNA, 16 nt, Pseudomonas aeruginosa PA01
guaggugcccggcggg

SEQ ID NO: 1438060 - RNA, 19 nt, Pseudomonas aeruginosa PA01
aagucgccauccuggucgc

SEQ ID NO: 1438061 - RNA, 13 nt, Pseudomonas aeruginosa PA01
aagucgccggcau

SEQ ID NO: 1438062 - RNA, 13 nt, Pseudomonas aeruginosa PA01
aagucggccgccc

SEQ ID NO: 1438063 - RNA, 14 nt, Pseudomonas aeruginosa PA01
aagucggcgagccg

SEQ ID NO: 1438064 - RNA, 17 nt, Pseudomonas aeruginosa PA01
aagucggcgagccggcg

SEQ ID NO: 1438065 - RNA, 14 nt, Pseudomonas aeruginosa PA01
guaggccuggccgc

SEQ ID NO: 1438066 - RNA, 11 nt, Pseudomonas aeruginosa PA01
guaggcgacga

SEQ ID NO: 1438067 - RNA, 20 nt, Pseudomonas aeruginosa PA01
guaggcgacgaagcuggcga

SEQ ID NO: 1438068 - RNA, 18 nt, Pseudomonas aeruginosa PA01
aaguccaccaggcgccgg

SEQ ID NO: 1438069 - RNA, 19 nt, Pseudomonas aeruginosa PA01
aaguccaccaggcgccggg

SEQ ID NO: 1438070 - RNA, 17 nt, Pseudomonas aeruginosa PA01
guaggcgaacacgucgg

SEQ ID NO: 1438071 - RNA, 19 nt, Pseudomonas aeruginosa PA01
guaggcgaacacgucggcg

SEQ ID NO: 1438072 - RNA, 15 nt, Pseudomonas aeruginosa PA01
guagcuccaggccga

SEQ ID NO: 1438073 - RNA, 13 nt, Pseudomonas aeruginosa PA01
guagcugaccacg

SEQ ID NO: 1438074 - RNA, 17 nt, Pseudomonas aeruginosa PA01
guagcugagcaggccga

SEQ ID NO: 1438075 - RNA, 14 nt, Pseudomonas aeruginosa PA01
guagcugccggcgu

SEQ ID NO: 1438076 - RNA, 15 nt, Pseudomonas aeruginosa PA01
guagcugccggcguc

SEQ ID NO: 1438077 - RNA, 15 nt, Pseudomonas aeruginosa PA01
guagcugcgccgccu

SEQ ID NO: 1438078 - RNA, 13 nt, Pseudomonas aeruginosa PA01
guagaccagcuug

SEQ ID NO: 1438079 - RNA, 17 nt, Pseudomonas aeruginosa PA01
guagaccaucgccggcg

SEQ ID NO: 1438080 - RNA, 21 nt, Pseudomonas aeruginosa PA01
guagaccaucgccggcgagcc

SEQ ID NO: 1438081 - RNA, 19 nt, Pseudomonas aeruginosa PA01
guacuuggccacgccuucg

SEQ ID NO: 1438082 - RNA, 14 nt, Pseudomonas aeruginosa PA01
guagaccaccagcg

SEQ ID NO: 1438083 - RNA, 16 nt, Pseudomonas aeruginosa PA01
guagaccaccagcgug

SEQ ID NO: 1438084 - RNA, 20 nt, Pseudomonas aeruginosa PA01
guagaccaccucgacggcga

SEQ ID NO: 1438085 - RNA, 21 nt, Pseudomonas aeruginosa PA01
guagaccacgcaggccagcgc

SEQ ID NO: 1438086 - RNA, 16 nt, Pseudomonas aeruginosa PA01
guagaccggcuccagg

SEQ ID NO: 1438087 - RNA, 16 nt, Pseudomonas aeruginosa PA01
guagaccuugcggccg

SEQ ID NO: 1438088 - RNA, 19 nt, Pseudomonas aeruginosa PA01
guagacgccucccaccgcg

SEQ ID NO: 1438089 - RNA, 19 nt, Pseudomonas aeruginosa PA01
guagaucggcagcaucagc

SEQ ID NO: 1438090 - RNA, 17 nt, Pseudomonas aeruginosa PA01
guacgguuggccagcga

SEQ ID NO: 1438091 - RNA, 14 nt, Pseudomonas aeruginosa PA01
guacguagcgcggu

SEQ ID NO: 1438092 - RNA, 19 nt, Pseudomonas aeruginosa PA01
guacucguguuccggcagg

SEQ ID NO: 1438093 - RNA, 20 nt, Pseudomonas aeruginosa PA01
guacucguguuccggcagga

SEQ ID NO: 1438094 - RNA, 22 nt, Pseudomonas aeruginosa PA01
guacucguguuccggcaggacc

SEQ ID NO: 1438095 - RNA, 23 nt, Pseudomonas aeruginosa PA01
guacugccgcuaucgcuggcgca

SEQ ID NO: 1438096 - RNA, 15 nt, Pseudomonas aeruginosa PA01
guacgucgagaccga

SEQ ID NO: 1438097 - RNA, 13 nt, Pseudomonas aeruginosa PA01
guacucuggccau

SEQ ID NO: 1438098 - RNA, 15 nt, Pseudomonas aeruginosa PA01
guacuucggcgcggu

SEQ ID NO: 1438099 - RNA, 23 nt, Pseudomonas aeruginosa PA01
guacuugccagggcagggagucc

SEQ ID NO: 1438100 - RNA, 20 nt, Pseudomonas aeruginosa PA01
guacuggcgccaggccgcgu

SEQ ID NO: 1438101 - RNA, 15 nt, Pseudomonas aeruginosa PA01
guagcagguccgcgc

SEQ ID NO: 1438102 - RNA, 19 nt, Pseudomonas aeruginosa PA01
guagcagccguccagcuug

SEQ ID NO: 1438103 - RNA, 18 nt, Pseudomonas aeruginosa PA01
guagcagggugcgggcgc

SEQ ID NO: 1438104 - RNA, 15 nt, Pseudomonas aeruginosa PA01
guagccggucaggcg

SEQ ID NO: 1438105 - RNA, 17 nt, Pseudomonas aeruginosa PA01
guagccggugccgaucu

SEQ ID NO: 1438106 - RNA, 16 nt, Pseudomonas aeruginosa PA01
guagccgucaagcaac

SEQ ID NO: 1438107 - RNA, 16 nt, Pseudomonas aeruginosa PA01
guagccgucguagcgc

SEQ ID NO: 1438108 - RNA, 18 nt, Pseudomonas aeruginosa PA01
guagccguucgacgcugc

SEQ ID NO: 1438109 - RNA, 17 nt, Pseudomonas aeruginosa PA01
guagccguugagcaccg

SEQ ID NO: 1438110 - RNA, 15 nt, Pseudomonas aeruginosa PA01
guagccucccgccgc

SEQ ID NO: 1438111 - RNA, 16 nt, Pseudomonas aeruginosa PA01
guagccugcggccagc

SEQ ID NO: 1438112 - RNA, 21 nt, Pseudomonas aeruginosa PA01
guagccuuccuucucgaagcc

SEQ ID NO: 1438113 - RNA, 21 nt, Pseudomonas aeruginosa PA01
guagcgaaucugcagggcauc

SEQ ID NO: 1438114 - RNA, 15 nt, Pseudomonas aeruginosa PA01
guagcgacaggcccu

SEQ ID NO: 1438115 - RNA, 18 nt, Pseudomonas aeruginosa PA01
guagcgcagcggcaggcc

SEQ ID NO: 1438116 - RNA, 21 nt, Pseudomonas aeruginosa PA01
guagcgcagcggcaggccacg

SEQ ID NO: 1438117 - RNA, 13 nt, Pseudomonas aeruginosa PA01
guagcgcaugccg

SEQ ID NO: 1438118 - RNA, 22 nt, Pseudomonas aeruginosa PA01
guagcgcaugccguuggccgag

SEQ ID NO: 1438119 - RNA, 13 nt, Pseudomonas aeruginosa PA01
guagcgcaggucg

SEQ ID NO: 1438120 - RNA, 20 nt, Pseudomonas aeruginosa PA01
guagcgcaguucgccgccga

SEQ ID NO: 1438121 - RNA, 21 nt, Pseudomonas aeruginosa PA01
guagcgccccuuggccagcac

SEQ ID NO: 1438122 - RNA, 22 nt, Pseudomonas aeruginosa PA01
guagcgccugguucugcuccgg

SEQ ID NO: 1438123 - RNA, 20 nt, Pseudomonas aeruginosa PA01
guagcgccgcgggccagccg

SEQ ID NO: 1438124 - RNA, 16 nt, Pseudomonas aeruginosa PA01
guagcggaucagccgg

SEQ ID NO: 1438125 - RNA, 22 nt, Pseudomonas aeruginosa PA01
guagcggaucagccggcccauc

SEQ ID NO: 1438126 - RNA, 14 nt, Pseudomonas aeruginosa PA01
guagcgcgccgagg

SEQ ID NO: 1438127 - RNA, 13 nt, Pseudomonas aeruginosa PA01
guagcgcggcagc

SEQ ID NO: 1438128 - RNA, 21 nt, Pseudomonas aeruginosa PA01
guagcgcucgauagcguccag

SEQ ID NO: 1438129 - RNA, 11 nt, Pseudomonas aeruginosa PA01
guagcgcucgc

SEQ ID NO: 1438130 - RNA, 21 nt, Pseudomonas aeruginosa PA01
guagcgcucgccuaccggcgc

SEQ ID NO: 1438131 - RNA, 23 nt, Pseudomonas aeruginosa PA01
guagcgcucgccuaccggcgccg

SEQ ID NO: 1438132 - RNA, 21 nt, Pseudomonas aeruginosa PA01
guagcggaagcacggcucggc

SEQ ID NO: 1438133 - RNA, 23 nt, Pseudomonas aeruginosa PA01
guagcggaagcacggcucggcga

SEQ ID NO: 1438134 - RNA, 17 nt, Pseudomonas aeruginosa PA01
guagcgcugcgcccgcu

SEQ ID NO: 1438135 - RNA, 18 nt, Pseudomonas aeruginosa PA01
guagcgcugcgcccgcuc

SEQ ID NO: 1438136 - RNA, 18 nt, Pseudomonas aeruginosa PA01
guagcgcuucccgcggcu

SEQ ID NO: 1438137 - RNA, 21 nt, Pseudomonas aeruginosa PA01
guagcgcuucgcgcagcucgg

SEQ ID NO: 1438138 - RNA, 16 nt, Pseudomonas aeruginosa PA01
guaccucgugggugcc

SEQ ID NO: 1438139 - RNA, 17 nt, Pseudomonas aeruginosa PA01
guaccucgugggugccg

SEQ ID NO: 1438140 - RNA, 14 nt, Pseudomonas aeruginosa PA01
guaccucgaagccc

SEQ ID NO: 1438141 - RNA, 17 nt, Pseudomonas aeruginosa PA01
guaccugccggcacgcu

SEQ ID NO: 1438142 - RNA, 19 nt, Pseudomonas aeruginosa PA01
guaccuggguugccgcgcc

SEQ ID NO: 1438143 - RNA, 21 nt, Pseudomonas aeruginosa PA01
guaccuggguugccgcgccga

SEQ ID NO: 1438144 - RNA, 20 nt, Pseudomonas aeruginosa PA01
guacgacuucggcgacagcc

SEQ ID NO: 1438145 - RNA, 21 nt, Pseudomonas aeruginosa PA01
guacggguuucgcugcugccg

SEQ ID NO: 1438146 - RNA, 11 nt, Pseudomonas aeruginosa PA01
guacggcgcgg

SEQ ID NO: 1438147 - RNA, 16 nt, Pseudomonas aeruginosa PA01
guacgaggggccgccg

SEQ ID NO: 1438148 - RNA, 17 nt, Pseudomonas aeruginosa PA01
guacgaggggccgccgu

SEQ ID NO: 1438149 - RNA, 20 nt, Pseudomonas aeruginosa PA01
guacgaggggccgccguaca

SEQ ID NO: 1438150 - RNA, 23 nt, Pseudomonas aeruginosa PA01
guacggcugagaccuuccugcca

SEQ ID NO: 1438151 - RNA, 20 nt, Pseudomonas aeruginosa PA01
guacccggcagggccagcgg

SEQ ID NO: 1438152 - RNA, 14 nt, Pseudomonas aeruginosa PA01
guacccggcggaca

SEQ ID NO: 1438153 - RNA, 22 nt, Pseudomonas aeruginosa PA01
guacccggcggacaaccaccau

SEQ ID NO: 1438154 - RNA, 16 nt, Pseudomonas aeruginosa PA01
guacccgccggccaug

SEQ ID NO: 1438155 - RNA, 14 nt, Pseudomonas aeruginosa PA01
guaccagucgcccg

SEQ ID NO: 1438156 - RNA, 17 nt, Pseudomonas aeruginosa PA01
guacccagcuugcuggc

SEQ ID NO: 1438157 - RNA, 16 nt, Pseudomonas aeruginosa PA01
guaccgugcuucaucg

SEQ ID NO: 1438158 - RNA, 15 nt, Pseudomonas aeruginosa PA01
guaccuacuguucgg

SEQ ID NO: 1438159 - RNA, 19 nt, Pseudomonas aeruginosa PA01
guaccuacuguucggucgg

SEQ ID NO: 1438160 - RNA, 14 nt, Pseudomonas aeruginosa PA01
guaccgacggucgg

SEQ ID NO: 1438161 - RNA, 18 nt, Pseudomonas aeruginosa PA01
guaccgaaacagggcgac

SEQ ID NO: 1438162 - RNA, 23 nt, Pseudomonas aeruginosa PA01
guacccguacgcugccagguugg

SEQ ID NO: 1438163 - RNA, 20 nt, Pseudomonas aeruginosa PA01
guacaccaggguggcgcgca

SEQ ID NO: 1438164 - RNA, 13 nt, Pseudomonas aeruginosa PA01
guacaaacgcucc

SEQ ID NO: 1438165 - RNA, 17 nt, Pseudomonas aeruginosa PA01
guaauccacgcugugcg

SEQ ID NO: 1438166 - RNA, 14 nt, Pseudomonas aeruginosa PA01
guacaccuuggcgc

SEQ ID NO: 1438167 - RNA, 15 nt, Pseudomonas aeruginosa PA01
guacaggccaccgcg

SEQ ID NO: 1438168 - RNA, 16 nt, Pseudomonas aeruginosa PA01
guacaggccccaggcg

SEQ ID NO: 1438169 - RNA, 22 nt, Pseudomonas aeruginosa PA01
guacaggcggauuuccugcggc

SEQ ID NO: 1438170 - RNA, 12 nt, Pseudomonas aeruginosa PA01
guacaggcgguu

SEQ ID NO: 1438171 - RNA, 19 nt, Pseudomonas aeruginosa PA01
guacauggccuucucgucg

SEQ ID NO: 1438172 - RNA, 18 nt, Pseudomonas aeruginosa PA01
guacagguuguucggcga

SEQ ID NO: 1438173 - RNA, 16 nt, Pseudomonas aeruginosa PA01
guacaguucaggcugg

SEQ ID NO: 1438174 - RNA, 20 nt, Pseudomonas aeruginosa PA01
gguggcccugggcggcgacc

SEQ ID NO: 1438175 - RNA, 14 nt, Pseudomonas aeruginosa PA01
gguggccaggacgc

SEQ ID NO: 1438176 - RNA, 21 nt, Pseudomonas aeruginosa PA01
gguggccaggacgcuggcgau

SEQ ID NO: 1438177 - RNA, 13 nt, Pseudomonas aeruginosa PA01
gguggccaggcgc

SEQ ID NO: 1438178 - RNA, 21 nt, Pseudomonas aeruginosa PA01
gguuuuuuuaugccucggcgg

SEQ ID NO: 1438179 - RNA, 11 nt, Pseudomonas aeruginosa PA01
guaagcggcgu

SEQ ID NO: 1438180 - RNA, 17 nt, Pseudomonas aeruginosa PA01
guaaggauguccgggug

SEQ ID NO: 1438181 - RNA, 17 nt, Pseudomonas aeruginosa PA01
guaaggcaccaccgccg

SEQ ID NO: 1438182 - RNA, 21 nt, Pseudomonas aeruginosa PA01
guaaggcaccaccgccgccag

SEQ ID NO: 1438183 - RNA, 13 nt, Pseudomonas aeruginosa PA01
guaagugccgacc

SEQ ID NO: 1438184 - RNA, 14 nt, Pseudomonas aeruginosa PA01
guaagugccgacca

SEQ ID NO: 1438185 - RNA, 23 nt, Pseudomonas aeruginosa PA01
gucagacacgaaaaagccggcgc

SEQ ID NO: 1438186 - RNA, 14 nt, Pseudomonas aeruginosa PA01
gucagaccagcccu

SEQ ID NO: 1438187 - RNA, 19 nt, Pseudomonas aeruginosa PA01
gucagaccagcccuggcgc

SEQ ID NO: 1438188 - RNA, 22 nt, Pseudomonas aeruginosa PA01
gucagaccagcccuggcgcggc

SEQ ID NO: 1438189 - RNA, 18 nt, Pseudomonas aeruginosa PA01
gucacucggccucggcgu

SEQ ID NO: 1438190 - RNA, 19 nt, Pseudomonas aeruginosa PA01
gucacuguuuuccauggcg

SEQ ID NO: 1438191 - RNA, 19 nt, Pseudomonas aeruginosa PA01
gucacuuccgucacgcccu

SEQ ID NO: 1438192 - RNA, 20 nt, Pseudomonas aeruginosa PA01
gucagcaacugccaaccgcg

SEQ ID NO: 1438193 - RNA, 21 nt, Pseudomonas aeruginosa PA01
gucagagacagguacucggcc

SEQ ID NO: 1438194 - RNA, 13 nt, Pseudomonas aeruginosa PA01
gucagaucagcgg

SEQ ID NO: 1438195 - RNA, 17 nt, Pseudomonas aeruginosa PA01
gucagaucugcgauugc

SEQ ID NO: 1438196 - RNA, 19 nt, Pseudomonas aeruginosa PA01
gucacggucuuggcggcga

SEQ ID NO: 1438197 - RNA, 19 nt, Pseudomonas aeruginosa PA01
gucacgcguugcgagggcu

SEQ ID NO: 1438198 - RNA, 15 nt, Pseudomonas aeruginosa PA01
gucacggcgugccgc

SEQ ID NO: 1438199 - RNA, 17 nt, Pseudomonas aeruginosa PA01
gucacucgacaggccau

SEQ ID NO: 1438200 - RNA, 18 nt, Pseudomonas aeruginosa PA01
gucacucccaggcuggcg

SEQ ID NO: 1438201 - RNA, 20 nt, Pseudomonas aeruginosa PA01
gucacucccaggcuggcggc

SEQ ID NO: 1438202 - RNA, 16 nt, Pseudomonas aeruginosa PA01
gucacguggccgccca

SEQ ID NO: 1438203 - RNA, 21 nt, Pseudomonas aeruginosa PA01
gucacgccgggaauccccagu

SEQ ID NO: 1438204 - RNA, 16 nt, Pseudomonas aeruginosa PA01
gucacgcucggcaugg

SEQ ID NO: 1438205 - RNA, 20 nt, Pseudomonas aeruginosa PA01
gucacggacccgcucggccu

SEQ ID NO: 1438206 - RNA, 18 nt, Pseudomonas aeruginosa PA01
gucacggccuccgguggc

SEQ ID NO: 1438207 - RNA, 22 nt, Pseudomonas aeruginosa PA01
gucacggcgaaaccggccagcg

SEQ ID NO: 1438208 - RNA, 16 nt, Pseudomonas aeruginosa PA01
gucacggcgaagcggc

SEQ ID NO: 1438209 - RNA, 14 nt, Pseudomonas aeruginosa PA01
gucacgcaggcgcu

SEQ ID NO: 1438210 - RNA, 13 nt, Pseudomonas aeruginosa PA01
gucacgccgcggc

SEQ ID NO: 1438211 - RNA, 18 nt, Pseudomonas aeruginosa PA01
gucacgccgagggcgcgg

SEQ ID NO: 1438212 - RNA, 21 nt, Pseudomonas aeruginosa PA01
gucacgccgagggcgcggcgc

SEQ ID NO: 1438213 - RNA, 22 nt, Pseudomonas aeruginosa PA01
gucacgccgagggcgcggcgcc

SEQ ID NO: 1438214 - RNA, 20 nt, Pseudomonas aeruginosa PA01
gucacgccgaucccggcggc

SEQ ID NO: 1438215 - RNA, 22 nt, Pseudomonas aeruginosa PA01
gucacgccgaucccggcggcga

SEQ ID NO: 1438216 - RNA, 22 nt, Pseudomonas aeruginosa PA01
gucaccguggagaggucgccga

SEQ ID NO: 1438217 - RNA, 23 nt, Pseudomonas aeruginosa PA01
gucaccguggagaggucgccgac

SEQ ID NO: 1438218 - RNA, 20 nt, Pseudomonas aeruginosa PA01
gucaccgucugcaccgcccu

SEQ ID NO: 1438219 - RNA, 16 nt, Pseudomonas aeruginosa PA01
gucaccuguucggcgc

SEQ ID NO: 1438220 - RNA, 17 nt, Pseudomonas aeruginosa PA01
gucaccuguucggcgcu

SEQ ID NO: 1438221 - RNA, 18 nt, Pseudomonas aeruginosa PA01
gucaccuguucggcgcug

SEQ ID NO: 1438222 - RNA, 13 nt, Pseudomonas aeruginosa PA01
gucaccucggcgc

SEQ ID NO: 1438223 - RNA, 16 nt, Pseudomonas aeruginosa PA01
gucaggccuugacgcg

SEQ ID NO: 1438224 - RNA, 21 nt, Pseudomonas aeruginosa PA01
gucaggccuugcgcggcgccg

SEQ ID NO: 1438225 - RNA, 22 nt, Pseudomonas aeruginosa PA01
gucaggccuugcgcggcgccgg

SEQ ID NO: 1438226 - RNA, 14 nt, Pseudomonas aeruginosa PA01
gucaggcgccagga

SEQ ID NO: 1438227 - RNA, 14 nt, Pseudomonas aeruginosa PA01
gucaggcgccggcc

SEQ ID NO: 1438228 - RNA, 12 nt, Pseudomonas aeruginosa PA01
gucaggcgcugg

SEQ ID NO: 1438229 - RNA, 16 nt, Pseudomonas aeruginosa PA01
gucaggcgcuggugau

SEQ ID NO: 1438230 - RNA, 13 nt, Pseudomonas aeruginosa PA01
gucaggccggcgc

SEQ ID NO: 1438231 - RNA, 13 nt, Pseudomonas aeruginosa PA01
gucaggcccugcu

SEQ ID NO: 1438232 - RNA, 12 nt, Pseudomonas aeruginosa PA01
gucaggccgacc

SEQ ID NO: 1438233 - RNA, 18 nt, Pseudomonas aeruginosa PA01
gucaggccgaccagcgcc

SEQ ID NO: 1438234 - RNA, 20 nt, Pseudomonas aeruginosa PA01
gucaggccgaccagcgccga

SEQ ID NO: 1438235 - RNA, 22 nt, Pseudomonas aeruginosa PA01
gucaggccgagaaaccgccauc

SEQ ID NO: 1438236 - RNA, 18 nt, Pseudomonas aeruginosa PA01
gucaggccgagcagcgcc

SEQ ID NO: 1438237 - RNA, 21 nt, Pseudomonas aeruginosa PA01
gucaggccgagcagcgccagc

SEQ ID NO: 1438238 - RNA, 12 nt, Pseudomonas aeruginosa PA01
gucaggccgagg

SEQ ID NO: 1438239 - RNA, 15 nt, Pseudomonas aeruginosa PA01
gucaggccgaggcgc

SEQ ID NO: 1438240 - RNA, 18 nt, Pseudomonas aeruginosa PA01
gucaggccgaggcgcuuc

SEQ ID NO: 1438241 - RNA, 13 nt, Pseudomonas aeruginosa PA01
gucaggccgaggg

SEQ ID NO: 1438242 - RNA, 23 nt, Pseudomonas aeruginosa PA01
gucaggccgagggcugccgcccg

SEQ ID NO: 1438243 - RNA, 21 nt, Pseudomonas aeruginosa PA01
gucaggccgaucaccaccagc

SEQ ID NO: 1438244 - RNA, 13 nt, Pseudomonas aeruginosa PA01
gucaggccgaugg

SEQ ID NO: 1438245 - RNA, 14 nt, Pseudomonas aeruginosa PA01
gucaggccgaugga

SEQ ID NO: 1438246 - RNA, 22 nt, Pseudomonas aeruginosa PA01
gucaggccgauggauucgaacc

SEQ ID NO: 1438247 - RNA, 13 nt, Pseudomonas aeruginosa PA01
gucagcgcgccag

SEQ ID NO: 1438248 - RNA, 17 nt, Pseudomonas aeruginosa PA01
gucagcgccuugaccuc

SEQ ID NO: 1438249 - RNA, 22 nt, Pseudomonas aeruginosa PA01
gucagcggcgcagccucgcgcu

SEQ ID NO: 1438250 - RNA, 15 nt, Pseudomonas aeruginosa PA01
gucagcggacaaccg

SEQ ID NO: 1438251 - RNA, 21 nt, Pseudomonas aeruginosa PA01
gucagcgaguugaccuuggcc

SEQ ID NO: 1438252 - RNA, 18 nt, Pseudomonas aeruginosa PA01
gucagcgguaugccgcag

SEQ ID NO: 1438253 - RNA, 15 nt, Pseudomonas aeruginosa PA01
gucagccggccgauc

SEQ ID NO: 1438254 - RNA, 23 nt, Pseudomonas aeruginosa PA01
gucagccggccgaucuucagcag

SEQ ID NO: 1438255 - RNA, 21 nt, Pseudomonas aeruginosa PA01
gucagcccguguucggccagc

SEQ ID NO: 1438256 - RNA, 15 nt, Pseudomonas aeruginosa PA01
gucagccgaugcucg

SEQ ID NO: 1438257 - RNA, 17 nt, Pseudomonas aeruginosa PA01
gucagccgaugcucgcg

SEQ ID NO: 1438258 - RNA, 18 nt, Pseudomonas aeruginosa PA01
gucagccgaugcucgcgc

SEQ ID NO: 1438259 - RNA, 20 nt, Pseudomonas aeruginosa PA01
gucagccgaugcucgcgcca

SEQ ID NO: 1438260 - RNA, 19 nt, Pseudomonas aeruginosa PA01
gucagcccauacaccaggc

SEQ ID NO: 1438261 - RNA, 17 nt, Pseudomonas aeruginosa PA01
gucagccaggcuggcug

SEQ ID NO: 1438262 - RNA, 17 nt, Pseudomonas aeruginosa PA01
gucagccagccgagcaa

SEQ ID NO: 1438263 - RNA, 22 nt, Pseudomonas aeruginosa PA01
gucagccagccgagcaacucgg

SEQ ID NO: 1438264 - RNA, 18 nt, Pseudomonas aeruginosa PA01
gucagcgacuggcccugg

SEQ ID NO: 1438265 - RNA, 18 nt, Pseudomonas aeruginosa PA01
gucagcgaggcgggcgcg

SEQ ID NO: 1438266 - RNA, 13 nt, Pseudomonas aeruginosa PA01
gucagcgccagca

SEQ ID NO: 1438267 - RNA, 16 nt, Pseudomonas aeruginosa PA01
gucagcagcagggucg

SEQ ID NO: 1438268 - RNA, 14 nt, Pseudomonas aeruginosa PA01
gucagcaccagggc

SEQ ID NO: 1438269 - RNA, 16 nt, Pseudomonas aeruginosa PA01
gucagcaccagggcca

SEQ ID NO: 1438270 - RNA, 22 nt, Pseudomonas aeruginosa PA01
gucagcaccagggccagggcga

SEQ ID NO: 1438271 - RNA, 16 nt, Pseudomonas aeruginosa PA01
gucagcaggcugccgu

SEQ ID NO: 1438272 - RNA, 17 nt, Pseudomonas aeruginosa PA01
gucagccaccugcucgc

SEQ ID NO: 1438273 - RNA, 20 nt, Pseudomonas aeruginosa PA01
guauucgccgaagauccgcu

SEQ ID NO: 1438274 - RNA, 13 nt, Pseudomonas aeruginosa PA01
guauuccaggcga

SEQ ID NO: 1438275 - RNA, 16 nt, Pseudomonas aeruginosa PA01
gucaaaccauggcgua

SEQ ID NO: 1438276 - RNA, 17 nt, Pseudomonas aeruginosa PA01
gucaacaccagcgccgc

SEQ ID NO: 1438277 - RNA, 22 nt, Pseudomonas aeruginosa PA01
gucaacaccagcgccgccaggc

SEQ ID NO: 1438278 - RNA, 16 nt, Pseudomonas aeruginosa PA01
guauccagcggccgcg

SEQ ID NO: 1438279 - RNA, 14 nt, Pseudomonas aeruginosa PA01
guauccaggcgguu

SEQ ID NO: 1438280 - RNA, 18 nt, Pseudomonas aeruginosa PA01
guauccaccggacccggc

SEQ ID NO: 1438281 - RNA, 16 nt, Pseudomonas aeruginosa PA01
guaucgcugggcgccu

SEQ ID NO: 1438282 - RNA, 22 nt, Pseudomonas aeruginosa PA01
guaucgcugggcgccucgucga

SEQ ID NO: 1438283 - RNA, 17 nt, Pseudomonas aeruginosa PA01
guaucgcuuagcgccag

SEQ ID NO: 1438284 - RNA, 17 nt, Pseudomonas aeruginosa PA01
guaucggcuugccggcg

SEQ ID NO: 1438285 - RNA, 13 nt, Pseudomonas aeruginosa PA01
guaucggcgcuca

SEQ ID NO: 1438286 - RNA, 16 nt, Pseudomonas aeruginosa PA01
guaucugggucuggcg

SEQ ID NO: 1438287 - RNA, 15 nt, Pseudomonas aeruginosa PA01
guauggcgggccuug

SEQ ID NO: 1438288 - RNA, 20 nt, Pseudomonas aeruginosa PA01
guauggcggucggccaggcg

SEQ ID NO: 1438289 - RNA, 23 nt, Pseudomonas aeruginosa PA01
guauggcggucggccaggcggcc

SEQ ID NO: 1438290 - RNA, 20 nt, Pseudomonas aeruginosa PA01
guaugccggagugccgcgga

SEQ ID NO: 1438291 - RNA, 21 nt, Pseudomonas aeruginosa PA01
gucaacccuugcucccgccgc

SEQ ID NO: 1438292 - RNA, 18 nt, Pseudomonas aeruginosa PA01
gucaacgaagucgcgagg

SEQ ID NO: 1438293 - RNA, 13 nt, Pseudomonas aeruginosa PA01
gucaccaggucgc

SEQ ID NO: 1438294 - RNA, 22 nt, Pseudomonas aeruginosa PA01
gucaccaggucgcggaucaggc

SEQ ID NO: 1438295 - RNA, 15 nt, Pseudomonas aeruginosa PA01
gucaccagcgugggc

SEQ ID NO: 1438296 - RNA, 23 nt, Pseudomonas aeruginosa PA01
gucacccauucgaugccgcgcgc

SEQ ID NO: 1438297 - RNA, 12 nt, Pseudomonas aeruginosa PA01
gucacccgcgcc

SEQ ID NO: 1438298 - RNA, 17 nt, Pseudomonas aeruginosa PA01
gucacccgcgccugcag

SEQ ID NO: 1438299 - RNA, 15 nt, Pseudomonas aeruginosa PA01
gucaccccgaccagc

SEQ ID NO: 1438300 - RNA, 20 nt, Pseudomonas aeruginosa PA01
gucaccccgaccagcgcgcu

SEQ ID NO: 1438301 - RNA, 19 nt, Pseudomonas aeruginosa PA01
gucaccagcaccacccggc

SEQ ID NO: 1438302 - RNA, 19 nt, Pseudomonas aeruginosa PA01
gucaccacccagccgcggc

SEQ ID NO: 1438303 - RNA, 22 nt, Pseudomonas aeruginosa PA01
gucaccacccagccgcggccgu

SEQ ID NO: 1438304 - RNA, 23 nt, Pseudomonas aeruginosa PA01
gucaccacccagccgcggccguu

SEQ ID NO: 1438305 - RNA, 13 nt, Pseudomonas aeruginosa PA01
gucaccgccagcg

SEQ ID NO: 1438306 - RNA, 16 nt, Pseudomonas aeruginosa PA01
gucaccgccagcggga

SEQ ID NO: 1438307 - RNA, 15 nt, Pseudomonas aeruginosa PA01
gucaccgcgucggga

SEQ ID NO: 1438308 - RNA, 14 nt, Pseudomonas aeruginosa PA01
gucaccgcucgcca

SEQ ID NO: 1438309 - RNA, 12 nt, Pseudomonas aeruginosa PA01
gucaccgcgccg

SEQ ID NO: 1438310 - RNA, 12 nt, Pseudomonas aeruginosa PA01
gucaccggcgcc

SEQ ID NO: 1438311 - RNA, 13 nt, Pseudomonas aeruginosa PA01
gucaccggcgcca

SEQ ID NO: 1438312 - RNA, 20 nt, Pseudomonas aeruginosa PA01
gucaccggcagggcgauccg

SEQ ID NO: 1438313 - RNA, 16 nt, Pseudomonas aeruginosa PA01
gcguucgcgggcgccg

SEQ ID NO: 1438314 - RNA, 16 nt, Pseudomonas aeruginosa PA01
gcguucgcggucggug

SEQ ID NO: 1438315 - RNA, 13 nt, Pseudomonas aeruginosa PA01
gcguucgccgaaa

SEQ ID NO: 1438316 - RNA, 19 nt, Pseudomonas aeruginosa PA01
gcguucgcgcgaggcgcuc

SEQ ID NO: 1438317 - RNA, 24 nt, Pseudomonas aeruginosa PA01
gcguucgaucuccucgcgcagcgg

SEQ ID NO: 1438318 - RNA, 12 nt, Pseudomonas aeruginosa PA01
gcguucgccgag

SEQ ID NO: 1438319 - RNA, 15 nt, Pseudomonas aeruginosa PA01
gcguuccuccucguc

SEQ ID NO: 1438320 - RNA, 21 nt, Pseudomonas aeruginosa PA01
gcguuccgggcagcggcgcaa

SEQ ID NO: 1438321 - RNA, 17 nt, Pseudomonas aeruginosa PA01
gcguuccgggucgcugc

SEQ ID NO: 1438322 - RNA, 19 nt, Pseudomonas aeruginosa PA01
gcguuccgggucgcugccc

SEQ ID NO: 1438323 - RNA, 18 nt, Pseudomonas aeruginosa PA01
gcguuccuguucgcugcc

SEQ ID NO: 1438324 - RNA, 23 nt, Pseudomonas aeruginosa PA01
gcguuccuggaagccgaucggca

SEQ ID NO: 1438325 - RNA, 20 nt, Pseudomonas aeruginosa PA01
gcguuccuggcgcgcggccg

SEQ ID NO: 1438326 - RNA, 21 nt, Pseudomonas aeruginosa PA01
gcguuccuggcgcgcggccgc

SEQ ID NO: 1438327 - RNA, 17 nt, Pseudomonas aeruginosa PA01
gcguucccacucgcgac

SEQ ID NO: 1438328 - RNA, 15 nt, Pseudomonas aeruginosa PA01
gcguuccagcucggc

SEQ ID NO: 1438329 - RNA, 19 nt, Pseudomonas aeruginosa PA01
gcguuccagcucggcgagg

SEQ ID NO: 1438330 - RNA, 16 nt, Pseudomonas aeruginosa PA01
gcguuccaggcggcgg

SEQ ID NO: 1438331 - RNA, 21 nt, Pseudomonas aeruginosa PA01
gcguguggcgaaacuccagca

SEQ ID NO: 1438332 - RNA, 22 nt, Pseudomonas aeruginosa PA01
gcguguggcgaaacuccagcag

SEQ ID NO: 1438333 - RNA, 21 nt, Pseudomonas aeruginosa PA01
gcguuccagcaccucgcggga

SEQ ID NO: 1438334 - RNA, 22 nt, Pseudomonas aeruginosa PA01
gcguuccaguacacccagggca

SEQ ID NO: 1438335 - RNA, 22 nt, Pseudomonas aeruginosa PA01
gcguucguguaggguucgcugc

SEQ ID NO: 1438336 - RNA, 14 nt, Pseudomonas aeruginosa PA01
gcguucgucggcca

SEQ ID NO: 1438337 - RNA, 13 nt, Pseudomonas aeruginosa PA01
gcguucggcgacc

SEQ ID NO: 1438338 - RNA, 22 nt, Pseudomonas aeruginosa PA01
gcguucucgaucaucgccagcg

SEQ ID NO: 1438339 - RNA, 23 nt, Pseudomonas aeruginosa PA01
gcguucucgaucaucgccagcgg

SEQ ID NO: 1438340 - RNA, 15 nt, Pseudomonas aeruginosa PA01
gcguucggcgcuggc

SEQ ID NO: 1438341 - RNA, 21 nt, Pseudomonas aeruginosa PA01
gcguucggcgaugccgcgcca

SEQ ID NO: 1438342 - RNA, 15 nt, Pseudomonas aeruginosa PA01
gcguucggcgauguc

SEQ ID NO: 1438343 - RNA, 20 nt, Pseudomonas aeruginosa PA01
gcguucggcgaugucgcggg

SEQ ID NO: 1438344 - RNA, 13 nt, Pseudomonas aeruginosa PA01
gcguucggucagg

SEQ ID NO: 1438345 - RNA, 15 nt, Pseudomonas aeruginosa PA01
gcguucggucaggcu

SEQ ID NO: 1438346 - RNA, 21 nt, Pseudomonas aeruginosa PA01
gcguucggggcccuccaggcg

SEQ ID NO: 1438347 - RNA, 21 nt, Pseudomonas aeruginosa PA01
gcguugaccgugaugcccagc

SEQ ID NO: 1438348 - RNA, 22 nt, Pseudomonas aeruginosa PA01
gcguucuucacccgcagcggca

SEQ ID NO: 1438349 - RNA, 14 nt, Pseudomonas aeruginosa PA01
gcguugaacugccc

SEQ ID NO: 1438350 - RNA, 22 nt, Pseudomonas aeruginosa PA01
gcguucugcgacaucuccaggc

SEQ ID NO: 1438351 - RNA, 22 nt, Pseudomonas aeruginosa PA01
gcguucugcugcuugcgccgug

SEQ ID NO: 1438352 - RNA, 23 nt, Pseudomonas aeruginosa PA01
gcguugacugccugcagguagcg

SEQ ID NO: 1438353 - RNA, 22 nt, Pseudomonas aeruginosa PA01
gcguugcccaugaucgccaccg

SEQ ID NO: 1438354 - RNA, 19 nt, Pseudomonas aeruginosa PA01
gcguugcagugcgccgcag

SEQ ID NO: 1438355 - RNA, 18 nt, Pseudomonas aeruginosa PA01
gcguugcauguccucggc

SEQ ID NO: 1438356 - RNA, 22 nt, Pseudomonas aeruginosa PA01
gcguugcauguccucggcgccg

SEQ ID NO: 1438357 - RNA, 14 nt, Pseudomonas aeruginosa PA01
gcguugcgccagac

SEQ ID NO: 1438358 - RNA, 15 nt, Pseudomonas aeruginosa PA01
gcguugcgcggcagg

SEQ ID NO: 1438359 - RNA, 16 nt, Pseudomonas aeruginosa PA01
gcguugcgcggcaggu

SEQ ID NO: 1438360 - RNA, 21 nt, Pseudomonas aeruginosa PA01
gcguuuuuucuuuccagcgcc

SEQ ID NO: 1438361 - RNA, 22 nt, Pseudomonas aeruginosa PA01
gcguuuuuucuuuccagcgccg

SEQ ID NO: 1438362 - RNA, 23 nt, Pseudomonas aeruginosa PA01
gcguuuuuucuuuccagcgccgu

SEQ ID NO: 1438363 - RNA, 18 nt, Pseudomonas aeruginosa PA01
gcguuuuucauuuccgcc

SEQ ID NO: 1438364 - RNA, 14 nt, Pseudomonas aeruginosa PA01
gcuaacgccgagga

SEQ ID NO: 1438365 - RNA, 16 nt, Pseudomonas aeruginosa PA01
gcuaaccgccuucgcg

SEQ ID NO: 1438366 - RNA, 14 nt, Pseudomonas aeruginosa PA01
gcuaaccgcgaagc

SEQ ID NO: 1438367 - RNA, 23 nt, Pseudomonas aeruginosa PA01
gcguuggccuggagaaacucgcg

SEQ ID NO: 1438368 - RNA, 13 nt, Pseudomonas aeruginosa PA01
gcguuggccagcg

SEQ ID NO: 1438369 - RNA, 18 nt, Pseudomonas aeruginosa PA01
gcguugcuuguguccgcc

SEQ ID NO: 1438370 - RNA, 20 nt, Pseudomonas aeruginosa PA01
gcguugggccucgcugcgca

SEQ ID NO: 1438371 - RNA, 15 nt, Pseudomonas aeruginosa PA01
gcguuggcuggcggg

SEQ ID NO: 1438372 - RNA, 17 nt, Pseudomonas aeruginosa PA01
gcguuggcggugccgca

SEQ ID NO: 1438373 - RNA, 16 nt, Pseudomonas aeruginosa PA01
gcguuggcgucgcugc

SEQ ID NO: 1438374 - RNA, 18 nt, Pseudomonas aeruginosa PA01
gcguuggcgucgcugccg

SEQ ID NO: 1438375 - RNA, 15 nt, Pseudomonas aeruginosa PA01
gcguuguuggucagg

SEQ ID NO: 1438376 - RNA, 13 nt, Pseudomonas aeruginosa PA01
gcguuguccaggc

SEQ ID NO: 1438377 - RNA, 19 nt, Pseudomonas aeruginosa PA01
gcguugucccugucccgcc

SEQ ID NO: 1438378 - RNA, 23 nt, Pseudomonas aeruginosa PA01
gcguugucccugucccgccgcgc

SEQ ID NO: 1438379 - RNA, 14 nt, Pseudomonas aeruginosa PA01
gcguugucggccag

SEQ ID NO: 1438380 - RNA, 17 nt, Pseudomonas aeruginosa PA01
gcguuucucagcgccgu

SEQ ID NO: 1438381 - RNA, 17 nt, Pseudomonas aeruginosa PA01
gcguuucgaagccgccg

SEQ ID NO: 1438382 - RNA, 15 nt, Pseudomonas aeruginosa PA01
gcguuucgccgggcc

SEQ ID NO: 1438383 - RNA, 14 nt, Pseudomonas aeruginosa PA01
gcguuuagcgcccg

SEQ ID NO: 1438384 - RNA, 16 nt, Pseudomonas aeruginosa PA01
gcuacguuccagggcc

SEQ ID NO: 1438385 - RNA, 21 nt, Pseudomonas aeruginosa PA01
gcuacguuccagggccuggua

SEQ ID NO: 1438386 - RNA, 19 nt, Pseudomonas aeruginosa PA01
gcuacggcaucaccggcgg

SEQ ID NO: 1438387 - RNA, 21 nt, Pseudomonas aeruginosa PA01
gcuagcccgucggcgacggga

SEQ ID NO: 1438388 - RNA, 14 nt, Pseudomonas aeruginosa PA01
gcuacuucgccggg

SEQ ID NO: 1438389 - RNA, 21 nt, Pseudomonas aeruginosa PA01
gcuacggaaggucgccgggcu

SEQ ID NO: 1438390 - RNA, 21 nt, Pseudomonas aeruginosa PA01
gcuagucuuccugcacgcugc

SEQ ID NO: 1438391 - RNA, 17 nt, Pseudomonas aeruginosa PA01
gcuacccagguggucga

SEQ ID NO: 1438392 - RNA, 22 nt, Pseudomonas aeruginosa PA01
gcuaccaggaagcucggcagca

SEQ ID NO: 1438393 - RNA, 18 nt, Pseudomonas aeruginosa PA01
gcuaccagcgcuucggcg

SEQ ID NO: 1438394 - RNA, 20 nt, Pseudomonas aeruginosa PA01
gcuaccagcgcuucggcggc

SEQ ID NO: 1438395 - RNA, 17 nt, Pseudomonas aeruginosa PA01
gcuaccgcaucgccacc

SEQ ID NO: 1438396 - RNA, 13 nt, Pseudomonas aeruginosa PA01
gcuaccggcaggg

SEQ ID NO: 1438397 - RNA, 20 nt, Pseudomonas aeruginosa PA01
gcuaccggcagggucacgcc

SEQ ID NO: 1438398 - RNA, 17 nt, Pseudomonas aeruginosa PA01
gcuaccgcgcauggcgg

SEQ ID NO: 1438399 - RNA, 22 nt, Pseudomonas aeruginosa PA01
gcuaccgcgcauggcggcgacc

SEQ ID NO: 1438400 - RNA, 12 nt, Pseudomonas aeruginosa PA01
gcuacgcggcgg

SEQ ID NO: 1438401 - RNA, 22 nt, Pseudomonas aeruginosa PA01
gcuacgcuccguagggcgacgc

SEQ ID NO: 1438402 - RNA, 13 nt, Pseudomonas aeruginosa PA01
gcuacgcucgccg

SEQ ID NO: 1438403 - RNA, 14 nt, Pseudomonas aeruginosa PA01
gcuacgcucgccga

SEQ ID NO: 1438404 - RNA, 16 nt, Pseudomonas aeruginosa PA01
gcuacgcucgccgacg

SEQ ID NO: 1438405 - RNA, 17 nt, Pseudomonas aeruginosa PA01
gcuacgcucgccgacgg

SEQ ID NO: 1438406 - RNA, 14 nt, Pseudomonas aeruginosa PA01
gcuacgcucggggu

SEQ ID NO: 1438407 - RNA, 23 nt, Pseudomonas aeruginosa PA01
gcuacgcucggggugcgcggcga

SEQ ID NO: 1438408 - RNA, 14 nt, Pseudomonas aeruginosa PA01
gcuaccgucggccu

SEQ ID NO: 1438409 - RNA, 13 nt, Pseudomonas aeruginosa PA01
gcuaucgccgccg

SEQ ID NO: 1438410 - RNA, 17 nt, Pseudomonas aeruginosa PA01
gcuaucgccgccgcagc

SEQ ID NO: 1438411 - RNA, 13 nt, Pseudomonas aeruginosa PA01
gcuaucgcuggcg

SEQ ID NO: 1438412 - RNA, 14 nt, Pseudomonas aeruginosa PA01
gcuaucgcuggcgc

SEQ ID NO: 1438413 - RNA, 15 nt, Pseudomonas aeruginosa PA01
gcuaucgcuggcgca

SEQ ID NO: 1438414 - RNA, 20 nt, Pseudomonas aeruginosa PA01
gcuaucgcuggcgcagccgc

SEQ ID NO: 1438415 - RNA, 21 nt, Pseudomonas aeruginosa PA01
gcuaucgcuggcgcagccgcu

SEQ ID NO: 1438416 - RNA, 21 nt, Pseudomonas aeruginosa PA01
gcuauccgccgcuacugcgcg

SEQ ID NO: 1438417 - RNA, 16 nt, Pseudomonas aeruginosa PA01
gcuaucccccggccga

SEQ ID NO: 1438418 - RNA, 17 nt, Pseudomonas aeruginosa PA01
gcuaucccccggccgau

SEQ ID NO: 1438419 - RNA, 16 nt, Pseudomonas aeruginosa PA01
gcuauccuccaggccg

SEQ ID NO: 1438420 - RNA, 20 nt, Pseudomonas aeruginosa PA01
gcuauccuccaggccgccgg

SEQ ID NO: 1438421 - RNA, 12 nt, Pseudomonas aeruginosa PA01
gcuauccaccgu

SEQ ID NO: 1438422 - RNA, 19 nt, Pseudomonas aeruginosa PA01
gcuaucaggugagggcgac

SEQ ID NO: 1438423 - RNA, 16 nt, Pseudomonas aeruginosa PA01
gcuaugggcaccgcgc

SEQ ID NO: 1438424 - RNA, 18 nt, Pseudomonas aeruginosa PA01
gcuaugggcaccgcgccg

SEQ ID NO: 1438425 - RNA, 17 nt, Pseudomonas aeruginosa PA01
gcuauguauucggcggu

SEQ ID NO: 1438426 - RNA, 18 nt, Pseudomonas aeruginosa PA01
gcuauguauucggcgguc

SEQ ID NO: 1438427 - RNA, 12 nt, Pseudomonas aeruginosa PA01
gcuauucccgcc

SEQ ID NO: 1438428 - RNA, 18 nt, Pseudomonas aeruginosa PA01
gcucaacgccucgcggcu

SEQ ID NO: 1438429 - RNA, 15 nt, Pseudomonas aeruginosa PA01
gcucaacggcgugcc

SEQ ID NO: 1438430 - RNA, 21 nt, Pseudomonas aeruginosa PA01
gcucaacgggaccguccaggu

SEQ ID NO: 1438431 - RNA, 15 nt, Pseudomonas aeruginosa PA01
gcucaacugguccug

SEQ ID NO: 1438432 - RNA, 19 nt, Pseudomonas aeruginosa PA01
gcucaagacggcccgcaga

SEQ ID NO: 1438433 - RNA, 13 nt, Pseudomonas aeruginosa PA01
gcucaccagguga

SEQ ID NO: 1438434 - RNA, 22 nt, Pseudomonas aeruginosa PA01
gcucacccacauggcgguccag

SEQ ID NO: 1438435 - RNA, 23 nt, Pseudomonas aeruginosa PA01
gcucacccacauggcgguccagg

SEQ ID NO: 1438436 - RNA, 20 nt, Pseudomonas aeruginosa PA01
gcucaccaaugccagugccu

SEQ ID NO: 1438437 - RNA, 19 nt, Pseudomonas aeruginosa PA01
gcucacauuaauugcgagc

SEQ ID NO: 1438438 - RNA, 12 nt, Pseudomonas aeruginosa PA01
gcucaccaggcc

SEQ ID NO: 1438439 - RNA, 12 nt, Pseudomonas aeruginosa PA01
gcucacccuguc

SEQ ID NO: 1438440 - RNA, 15 nt, Pseudomonas aeruginosa PA01
gcucaccgcgcuuga

SEQ ID NO: 1438441 - RNA, 17 nt, Pseudomonas aeruginosa PA01
gcucaccgccaccccgc

SEQ ID NO: 1438442 - RNA, 15 nt, Pseudomonas aeruginosa PA01
gcguauccucggcca

SEQ ID NO: 1438443 - RNA, 17 nt, Pseudomonas aeruginosa PA01
gcguaucgaugcgcgcg

SEQ ID NO: 1438444 - RNA, 18 nt, Pseudomonas aeruginosa PA01
gcguaucgaugcgcgcgg

SEQ ID NO: 1438445 - RNA, 21 nt, Pseudomonas aeruginosa PA01
gcguaucgaugcgcgcggcga

SEQ ID NO: 1438446 - RNA, 13 nt, Pseudomonas aeruginosa PA01
gcguaggccucgg

SEQ ID NO: 1438447 - RNA, 16 nt, Pseudomonas aeruginosa PA01
gcguaggccgucgcug

SEQ ID NO: 1438448 - RNA, 14 nt, Pseudomonas aeruginosa PA01
gcguaggcgucgcg

SEQ ID NO: 1438449 - RNA, 18 nt, Pseudomonas aeruginosa PA01
gcguaggcgucgcgaacc

SEQ ID NO: 1438450 - RNA, 21 nt, Pseudomonas aeruginosa PA01
gcguaggcuuggucgggcgcc

SEQ ID NO: 1438451 - RNA, 12 nt, Pseudomonas aeruginosa PA01
gcguagggcgaa

SEQ ID NO: 1438452 - RNA, 14 nt, Pseudomonas aeruginosa PA01
gcguauucgccgaa

SEQ ID NO: 1438453 - RNA, 16 nt, Pseudomonas aeruginosa PA01
gcguauucggcgacca

SEQ ID NO: 1438454 - RNA, 14 nt, Pseudomonas aeruginosa PA01
gcggucgaggcccu

SEQ ID NO: 1438455 - RNA, 15 nt, Pseudomonas aeruginosa PA01
gcguagcgccaggcc

SEQ ID NO: 1438456 - RNA, 23 nt, Pseudomonas aeruginosa PA01
gcguagcgccccuuggccagcac

SEQ ID NO: 1438457 - RNA, 19 nt, Pseudomonas aeruginosa PA01
gcguagcgcggcagcgcca

SEQ ID NO: 1438458 - RNA, 20 nt, Pseudomonas aeruginosa PA01
gcguagcgguccucgggcac

SEQ ID NO: 1438459 - RNA, 14 nt, Pseudomonas aeruginosa PA01
gcguagcgugccgc

SEQ ID NO: 1438460 - RNA, 15 nt, Pseudomonas aeruginosa PA01
gcguagcgugccgcc

SEQ ID NO: 1438461 - RNA, 18 nt, Pseudomonas aeruginosa PA01
gcguagcguugcgcgagc

SEQ ID NO: 1438462 - RNA, 23 nt, Pseudomonas aeruginosa PA01
gcgguccucgggcaccagcacgg

SEQ ID NO: 1438463 - RNA, 16 nt, Pseudomonas aeruginosa PA01
gcggucgagcagcgcc

SEQ ID NO: 1438464 - RNA, 17 nt, Pseudomonas aeruginosa PA01
gcggucgagcagcgccg

SEQ ID NO: 1438465 - RNA, 17 nt, Pseudomonas aeruginosa PA01
gcggucgagcucggcca

SEQ ID NO: 1438466 - RNA, 18 nt, Pseudomonas aeruginosa PA01
gcggucgagcucggccag

SEQ ID NO: 1438467 - RNA, 20 nt, Pseudomonas aeruginosa PA01
gcggucgagcucggccaggc

SEQ ID NO: 1438468 - RNA, 22 nt, Pseudomonas aeruginosa PA01
gcgucaguuccgcaucggccac

SEQ ID NO: 1438469 - RNA, 19 nt, Pseudomonas aeruginosa PA01
gcgucaucaggcucaggcc

SEQ ID NO: 1438470 - RNA, 17 nt, Pseudomonas aeruginosa PA01
gcgucauccgccaaccg

SEQ ID NO: 1438471 - RNA, 16 nt, Pseudomonas aeruginosa PA01
gcguccaccggcgccc

SEQ ID NO: 1438472 - RNA, 13 nt, Pseudomonas aeruginosa PA01
gcguccaccgcuu

SEQ ID NO: 1438473 - RNA, 19 nt, Pseudomonas aeruginosa PA01
gcgucacggacccgcucgg

SEQ ID NO: 1438474 - RNA, 23 nt, Pseudomonas aeruginosa PA01
gcgucacggacccgcucggccuu

SEQ ID NO: 1438475 - RNA, 15 nt, Pseudomonas aeruginosa PA01
gcgucgaagccggau

SEQ ID NO: 1438476 - RNA, 23 nt, Pseudomonas aeruginosa PA01
gcgucgaacagcgagucgucgga

SEQ ID NO: 1438477 - RNA, 14 nt, Pseudomonas aeruginosa PA01
gcgucgaaggcggc

SEQ ID NO: 1438478 - RNA, 16 nt, Pseudomonas aeruginosa PA01
gcgucgaaggcggcgc

SEQ ID NO: 1438479 - RNA, 17 nt, Pseudomonas aeruginosa PA01
gcgucgaaggcggcgcg

SEQ ID NO: 1438480 - RNA, 16 nt, Pseudomonas aeruginosa PA01
gcguccuucggcgcuc

SEQ ID NO: 1438481 - RNA, 18 nt, Pseudomonas aeruginosa PA01
gcguccgggugccccagg

SEQ ID NO: 1438482 - RNA, 19 nt, Pseudomonas aeruginosa PA01
gcgucgaaacgggcgcucu

SEQ ID NO: 1438483 - RNA, 16 nt, Pseudomonas aeruginosa PA01
gcgucgaaaugcucgu

SEQ ID NO: 1438484 - RNA, 19 nt, Pseudomonas aeruginosa PA01
gcgucgaaaugcucgugca

SEQ ID NO: 1438485 - RNA, 19 nt, Pseudomonas aeruginosa PA01
gcgucgaacaccggcgccg

SEQ ID NO: 1438486 - RNA, 17 nt, Pseudomonas aeruginosa PA01
gcguccuugggaucguc

SEQ ID NO: 1438487 - RNA, 19 nt, Pseudomonas aeruginosa PA01
gcguccuugcccggcgcca

SEQ ID NO: 1438488 - RNA, 20 nt, Pseudomonas aeruginosa PA01
gcguccuugcccggcgccag

SEQ ID NO: 1438489 - RNA, 14 nt, Pseudomonas aeruginosa PA01
gcguccgcgcaggc

SEQ ID NO: 1438490 - RNA, 18 nt, Pseudomonas aeruginosa PA01
gcguccgcgcaggcgguc

SEQ ID NO: 1438491 - RNA, 13 nt, Pseudomonas aeruginosa PA01
gcguccgccgccg

SEQ ID NO: 1438492 - RNA, 14 nt, Pseudomonas aeruginosa PA01
gcguccgccucgcu

SEQ ID NO: 1438493 - RNA, 14 nt, Pseudomonas aeruginosa PA01
gcguccgcuggccu

SEQ ID NO: 1438494 - RNA, 16 nt, Pseudomonas aeruginosa PA01
gcguccgcuggccugc

SEQ ID NO: 1438495 - RNA, 23 nt, Pseudomonas aeruginosa PA01
gcguccgcuggccugcagcaggu

SEQ ID NO: 1438496 - RNA, 21 nt, Pseudomonas aeruginosa PA01
gcguccggagugaugccgaug

SEQ ID NO: 1438497 - RNA, 15 nt, Pseudomonas aeruginosa PA01
gcguccggcagggcc

SEQ ID NO: 1438498 - RNA, 16 nt, Pseudomonas aeruginosa PA01
gcguccggcagggccu

SEQ ID NO: 1438499 - RNA, 14 nt, Pseudomonas aeruginosa PA01
gcguccggccagcc

SEQ ID NO: 1438500 - RNA, 16 nt, Pseudomonas aeruginosa PA01
gcguccggccagccug

SEQ ID NO: 1438501 - RNA, 18 nt, Pseudomonas aeruginosa PA01
gcguccggccagccuggc

SEQ ID NO: 1438502 - RNA, 22 nt, Pseudomonas aeruginosa PA01
gcguccggccagccuggccagc

SEQ ID NO: 1438503 - RNA, 17 nt, Pseudomonas aeruginosa PA01
gcguccagccgguaggg

SEQ ID NO: 1438504 - RNA, 12 nt, Pseudomonas aeruginosa PA01
gcguccgauguc

SEQ ID NO: 1438505 - RNA, 13 nt, Pseudomonas aeruginosa PA01
gcguccgaugucg

SEQ ID NO: 1438506 - RNA, 16 nt, Pseudomonas aeruginosa PA01
gcguccaccuggcggc

SEQ ID NO: 1438507 - RNA, 19 nt, Pseudomonas aeruginosa PA01
gcguccaccuggcggcuga

SEQ ID NO: 1438508 - RNA, 15 nt, Pseudomonas aeruginosa PA01
gcguccacuccggca

SEQ ID NO: 1438509 - RNA, 18 nt, Pseudomonas aeruginosa PA01
gcguccacuccggcagca

SEQ ID NO: 1438510 - RNA, 21 nt, Pseudomonas aeruginosa PA01
gcguccacuccggcagcaccc

SEQ ID NO: 1438511 - RNA, 18 nt, Pseudomonas aeruginosa PA01
gcgucgaguaccgcugcg

SEQ ID NO: 1438512 - RNA, 13 nt, Pseudomonas aeruginosa PA01
gcgucgagucgcg

SEQ ID NO: 1438513 - RNA, 17 nt, Pseudomonas aeruginosa PA01
gcgucgagucgcgcagc

SEQ ID NO: 1438514 - RNA, 18 nt, Pseudomonas aeruginosa PA01
gcgucgagucgcgcagcc

SEQ ID NO: 1438515 - RNA, 17 nt, Pseudomonas aeruginosa PA01
gcgucgagcuggcgcag

SEQ ID NO: 1438516 - RNA, 19 nt, Pseudomonas aeruginosa PA01
gcgucgagcuggcgcaggc

SEQ ID NO: 1438517 - RNA, 22 nt, Pseudomonas aeruginosa PA01
gcgucgagcguuucgcggaagg

SEQ ID NO: 1438518 - RNA, 22 nt, Pseudomonas aeruginosa PA01
gcgucgaucaucugcugcagca

SEQ ID NO: 1438519 - RNA, 21 nt, Pseudomonas aeruginosa PA01
gcgucgaucccggauucgccg

SEQ ID NO: 1438520 - RNA, 15 nt, Pseudomonas aeruginosa PA01
gcgucgaucaggcgg

SEQ ID NO: 1438521 - RNA, 21 nt, Pseudomonas aeruginosa PA01
gcgucgaugccgaauccgcug

SEQ ID NO: 1438522 - RNA, 20 nt, Pseudomonas aeruginosa PA01
gcgucgccgccagcgccggc

SEQ ID NO: 1438523 - RNA, 13 nt, Pseudomonas aeruginosa PA01
gcgucgccgaacg

SEQ ID NO: 1438524 - RNA, 15 nt, Pseudomonas aeruginosa PA01
gcgucgccgaacggc

SEQ ID NO: 1438525 - RNA, 19 nt, Pseudomonas aeruginosa PA01
gcgucgccgaacuccgagc

SEQ ID NO: 1438526 - RNA, 12 nt, Pseudomonas aeruginosa PA01
gcgucgccgccg

SEQ ID NO: 1438527 - RNA, 13 nt, Pseudomonas aeruginosa PA01
gcgucgcuguagc

SEQ ID NO: 1438528 - RNA, 18 nt, Pseudomonas aeruginosa PA01
gcgucgcuguagcggcuc

SEQ ID NO: 1438529 - RNA, 23 nt, Pseudomonas aeruginosa PA01
gcgucgcuguagcggcucgccga

SEQ ID NO: 1438530 - RNA, 15 nt, Pseudomonas aeruginosa PA01
gcgucgcugcgcaac

SEQ ID NO: 1438531 - RNA, 16 nt, Pseudomonas aeruginosa PA01
gcgucgcugcgcaacu

SEQ ID NO: 1438532 - RNA, 21 nt, Pseudomonas aeruginosa PA01
gcgucgcugcgcaacugccgg

SEQ ID NO: 1438533 - RNA, 22 nt, Pseudomonas aeruginosa PA01
gcgucgccgggcguaacggcuu

SEQ ID NO: 1438534 - RNA, 14 nt, Pseudomonas aeruginosa PA01
gcgucgccugccag

SEQ ID NO: 1438535 - RNA, 16 nt, Pseudomonas aeruginosa PA01
gcgucgccugccaggc

SEQ ID NO: 1438536 - RNA, 19 nt, Pseudomonas aeruginosa PA01
gcgucgccugccaggcggg

SEQ ID NO: 1438537 - RNA, 19 nt, Pseudomonas aeruginosa PA01
gcgucgccuuccaccacca

SEQ ID NO: 1438538 - RNA, 20 nt, Pseudomonas aeruginosa PA01
gcgucgccuuccaccaccag

SEQ ID NO: 1438539 - RNA, 13 nt, Pseudomonas aeruginosa PA01
gcgucgccggccg

SEQ ID NO: 1438540 - RNA, 16 nt, Pseudomonas aeruginosa PA01
gcgucgccggccgcug

SEQ ID NO: 1438541 - RNA, 20 nt, Pseudomonas aeruginosa PA01
gcgucggagagauagucgcc

SEQ ID NO: 1438542 - RNA, 12 nt, Pseudomonas aeruginosa PA01
gcguggcgucgg

SEQ ID NO: 1438543 - RNA, 16 nt, Pseudomonas aeruginosa PA01
gcguggucggcggccu

SEQ ID NO: 1438544 - RNA, 18 nt, Pseudomonas aeruginosa PA01
gcguggucuuccucggug

SEQ ID NO: 1438545 - RNA, 20 nt, Pseudomonas aeruginosa PA01
gcguggugagcacgaacagg

SEQ ID NO: 1438546 - RNA, 12 nt, Pseudomonas aeruginosa PA01
gcguggugaugu

SEQ ID NO: 1438547 - RNA, 20 nt, Pseudomonas aeruginosa PA01
gcguggugcauccgccgcag

SEQ ID NO: 1438548 - RNA, 21 nt, Pseudomonas aeruginosa PA01
gcguggugcauccgccgcaga

SEQ ID NO: 1438549 - RNA, 18 nt, Pseudomonas aeruginosa PA01
gcguggcgaacgcccggc

SEQ ID NO: 1438550 - RNA, 22 nt, Pseudomonas aeruginosa PA01
gcguggcgaucaggcagcgcgc

SEQ ID NO: 1438551 - RNA, 16 nt, Pseudomonas aeruginosa PA01
gcguggcggccgccgg

SEQ ID NO: 1438552 - RNA, 18 nt, Pseudomonas aeruginosa PA01
gcguggcggccgccggcg

SEQ ID NO: 1438553 - RNA, 19 nt, Pseudomonas aeruginosa PA01
gcguggcggccgccggcgc

SEQ ID NO: 1438554 - RNA, 15 nt, Pseudomonas aeruginosa PA01
gcgugcggccgauca

SEQ ID NO: 1438555 - RNA, 14 nt, Pseudomonas aeruginosa PA01
gcguggccgccagg

SEQ ID NO: 1438556 - RNA, 15 nt, Pseudomonas aeruginosa PA01
gcguggccgccaggg

SEQ ID NO: 1438557 - RNA, 16 nt, Pseudomonas aeruginosa PA01
gcgugcgcgcccucgg

SEQ ID NO: 1438558 - RNA, 12 nt, Pseudomonas aeruginosa PA01
gcgugcgcgccg

SEQ ID NO: 1438559 - RNA, 15 nt, Pseudomonas aeruginosa PA01
gcgugcgcgccgccg

SEQ ID NO: 1438560 - RNA, 23 nt, Pseudomonas aeruginosa PA01
gcgugcaguacuuggccagcagc

SEQ ID NO: 1438561 - RNA, 13 nt, Pseudomonas aeruginosa PA01
gcgugccagcacc

SEQ ID NO: 1438562 - RNA, 15 nt, Pseudomonas aeruginosa PA01
gcgugcauggccggg

SEQ ID NO: 1438563 - RNA, 16 nt, Pseudomonas aeruginosa PA01
gcgugcauggccgggc

SEQ ID NO: 1438564 - RNA, 19 nt, Pseudomonas aeruginosa PA01
gcgugccaggagcuugccg

SEQ ID NO: 1438565 - RNA, 17 nt, Pseudomonas aeruginosa PA01
gcgugccccguggcggg

SEQ ID NO: 1438566 - RNA, 13 nt, Pseudomonas aeruginosa PA01
gcgugcccauccg

SEQ ID NO: 1438567 - RNA, 22 nt, Pseudomonas aeruginosa PA01
gcgugcccauccgcucggcgag

SEQ ID NO: 1438568 - RNA, 23 nt, Pseudomonas aeruginosa PA01
gcgugcccauccgcucggcgagu

SEQ ID NO: 1438569 - RNA, 16 nt, Pseudomonas aeruginosa PA01
gcgugcaggccgauca

SEQ ID NO: 1438570 - RNA, 15 nt, Pseudomonas aeruginosa PA01
aaggacaggucgcgg

SEQ ID NO: 1438571 - RNA, 19 nt, Pseudomonas aeruginosa PA01
gcgugcaggcgcccuggcc

SEQ ID NO: 1438572 - RNA, 14 nt, Pseudomonas aeruginosa PA01
gcgugcaggccgcc

SEQ ID NO: 1438573 - RNA, 18 nt, Pseudomonas aeruginosa PA01
gcgugcaggccgccgagu

SEQ ID NO: 1438574 - RNA, 18 nt, Pseudomonas aeruginosa PA01
aaggaaucuucggcgccc

SEQ ID NO: 1438575 - RNA, 15 nt, Pseudomonas aeruginosa PA01
gcgugccgcaggccg

SEQ ID NO: 1438576 - RNA, 15 nt, Pseudomonas aeruginosa PA01
gcgugccgccaggcc

SEQ ID NO: 1438577 - RNA, 16 nt, Pseudomonas aeruginosa PA01
gcgugccgccaggccu

SEQ ID NO: 1438578 - RNA, 13 nt, Pseudomonas aeruginosa PA01
gcgugccgccgga

SEQ ID NO: 1438579 - RNA, 12 nt, Pseudomonas aeruginosa PA01
gcgugccgcugg

SEQ ID NO: 1438580 - RNA, 21 nt, Pseudomonas aeruginosa PA01
gcgugcccgcugcaugugcca

SEQ ID NO: 1438581 - RNA, 23 nt, Pseudomonas aeruginosa PA01
gcgugcccgcugcaugugccagg

SEQ ID NO: 1438582 - RNA, 15 nt, Pseudomonas aeruginosa PA01
gcgugccgggccggc

SEQ ID NO: 1438583 - RNA, 19 nt, Pseudomonas aeruginosa PA01
gcgugccgggccggccagg

SEQ ID NO: 1438584 - RNA, 17 nt, Pseudomonas aeruginosa PA01
gcgugcgcaugcccgcg

SEQ ID NO: 1438585 - RNA, 13 nt, Pseudomonas aeruginosa PA01
gcgucggcgaacc

SEQ ID NO: 1438586 - RNA, 19 nt, Pseudomonas aeruginosa PA01
gcgucggcgaacccggcgc

SEQ ID NO: 1438587 - RNA, 20 nt, Pseudomonas aeruginosa PA01
gcgucggcgaacccggcgcg

SEQ ID NO: 1438588 - RNA, 19 nt, Pseudomonas aeruginosa PA01
gcgucggcgaagccugcgg

SEQ ID NO: 1438589 - RNA, 14 nt, Pseudomonas aeruginosa PA01
gcgucggccgcucg

SEQ ID NO: 1438590 - RNA, 17 nt, Pseudomonas aeruginosa PA01
gcgucggccuggcgcag

SEQ ID NO: 1438591 - RNA, 22 nt, Pseudomonas aeruginosa PA01
gcgucggccuggcgcagcggca

SEQ ID NO: 1438592 - RNA, 12 nt, Pseudomonas aeruginosa PA01
gcgucggcgauc

SEQ ID NO: 1438593 - RNA, 15 nt, Pseudomonas aeruginosa PA01
gcgucggcgagcagg

SEQ ID NO: 1438594 - RNA, 13 nt, Pseudomonas aeruginosa PA01
gcgucggcgccuu

SEQ ID NO: 1438595 - RNA, 21 nt, Pseudomonas aeruginosa PA01
gcgucgucggggugccgccag

SEQ ID NO: 1438596 - RNA, 15 nt, Pseudomonas aeruginosa PA01
gcgucguugccgauc

SEQ ID NO: 1438597 - RNA, 16 nt, Pseudomonas aeruginosa PA01
gcgucguuggccggcu

SEQ ID NO: 1438598 - RNA, 22 nt, Pseudomonas aeruginosa PA01
gcgucguuggccggcugcuccg

SEQ ID NO: 1438599 - RNA, 19 nt, Pseudomonas aeruginosa PA01
gcgucguuguugcgggcga

SEQ ID NO: 1438600 - RNA, 15 nt, Pseudomonas aeruginosa PA01
gcgucgugcgccggc

SEQ ID NO: 1438601 - RNA, 16 nt, Pseudomonas aeruginosa PA01
gcgucgugcgccggcc

SEQ ID NO: 1438602 - RNA, 19 nt, Pseudomonas aeruginosa PA01
aagcuguucuugauccgcu

SEQ ID NO: 1438603 - RNA, 13 nt, Pseudomonas aeruginosa PA01
aagcuuccagcuu

SEQ ID NO: 1438604 - RNA, 14 nt, Pseudomonas aeruginosa PA01
aagcuucgucgcgc

SEQ ID NO: 1438605 - RNA, 14 nt, Pseudomonas aeruginosa PA01
gcgugaagcuggag

SEQ ID NO: 1438606 - RNA, 17 nt, Pseudomonas aeruginosa PA01
gcgugaaguagccgccg

SEQ ID NO: 1438607 - RNA, 14 nt, Pseudomonas aeruginosa PA01
gcgugaagccgccg

SEQ ID NO: 1438608 - RNA, 18 nt, Pseudomonas aeruginosa PA01
gcgugaagccgccgccca

SEQ ID NO: 1438609 - RNA, 22 nt, Pseudomonas aeruginosa PA01
gcgucugccgcucguuggcggc

SEQ ID NO: 1438610 - RNA, 13 nt, Pseudomonas aeruginosa PA01
gcgucugccgcug

SEQ ID NO: 1438611 - RNA, 18 nt, Pseudomonas aeruginosa PA01
gcgucugccgcuggcggc

SEQ ID NO: 1438612 - RNA, 18 nt, Pseudomonas aeruginosa PA01
gcgugaagaccuggucca

SEQ ID NO: 1438613 - RNA, 21 nt, Pseudomonas aeruginosa PA01
gcgugaagaccugguccaacg

SEQ ID NO: 1438614 - RNA, 18 nt, Pseudomonas aeruginosa PA01
gcgucucggagugaggcc

SEQ ID NO: 1438615 - RNA, 23 nt, Pseudomonas aeruginosa PA01
gcgucucggagugaggccgagcc

SEQ ID NO: 1438616 - RNA, 22 nt, Pseudomonas aeruginosa PA01
gcgucugaacgaagaagccggc

SEQ ID NO: 1438617 - RNA, 15 nt, Pseudomonas aeruginosa PA01
gcgucucagcccucg

SEQ ID NO: 1438618 - RNA, 19 nt, Pseudomonas aeruginosa PA01
gcgucucagcccucggccc

SEQ ID NO: 1438619 - RNA, 21 nt, Pseudomonas aeruginosa PA01
gcgucucauggaacagcagcc

SEQ ID NO: 1438620 - RNA, 14 nt, Pseudomonas aeruginosa PA01
gcugcgggcgccgc

SEQ ID NO: 1438621 - RNA, 16 nt, Pseudomonas aeruginosa PA01
gcugcgggcgccgccg

SEQ ID NO: 1438622 - RNA, 15 nt, Pseudomonas aeruginosa PA01
gcugcgggcgcugca

SEQ ID NO: 1438623 - RNA, 22 nt, Pseudomonas aeruginosa PA01
gcugcugaucaggaggaucgcc

SEQ ID NO: 1438624 - RNA, 15 nt, Pseudomonas aeruginosa PA01
gcugcgggcguagcg

SEQ ID NO: 1438625 - RNA, 12 nt, Pseudomonas aeruginosa PA01
gcugcggcggca

SEQ ID NO: 1438626 - RNA, 15 nt, Pseudomonas aeruginosa PA01
gcugcggcggcacca

SEQ ID NO: 1438627 - RNA, 15 nt, Pseudomonas aeruginosa PA01
gcugcggcgguccca

SEQ ID NO: 1438628 - RNA, 14 nt, Pseudomonas aeruginosa PA01
gcugcggcucgccg

SEQ ID NO: 1438629 - RNA, 15 nt, Pseudomonas aeruginosa PA01
gcugcggcuucgcgu

SEQ ID NO: 1438630 - RNA, 17 nt, Pseudomonas aeruginosa PA01
gcugcggcugcagggcc

SEQ ID NO: 1438631 - RNA, 18 nt, Pseudomonas aeruginosa PA01
gcugcugcgccuggccgc

SEQ ID NO: 1438632 - RNA, 14 nt, Pseudomonas aeruginosa PA01
gcugcugcggggcc

SEQ ID NO: 1438633 - RNA, 21 nt, Pseudomonas aeruginosa PA01
gcugcugcggggccggacgcg

SEQ ID NO: 1438634 - RNA, 13 nt, Pseudomonas aeruginosa PA01
gcugcugccggcc

SEQ ID NO: 1438635 - RNA, 13 nt, Pseudomonas aeruginosa PA01
gcugcugccgcgu

SEQ ID NO: 1438636 - RNA, 19 nt, Pseudomonas aeruginosa PA01
gcugcuugcgcgcggcguc

SEQ ID NO: 1438637 - RNA, 15 nt, Pseudomonas aeruginosa PA01
gcugcuugccggugc

SEQ ID NO: 1438638 - RNA, 15 nt, Pseudomonas aeruginosa PA01
gcugcuugaacaccu

SEQ ID NO: 1438639 - RNA, 16 nt, Pseudomonas aeruginosa PA01
gcugcuugaacaccuc

SEQ ID NO: 1438640 - RNA, 12 nt, Pseudomonas aeruginosa PA01
gcugcuucggca

SEQ ID NO: 1438641 - RNA, 15 nt, Pseudomonas aeruginosa PA01
gcugcuucggcagcc

SEQ ID NO: 1438642 - RNA, 20 nt, Pseudomonas aeruginosa PA01
gcuggaaauggcggucgccg

SEQ ID NO: 1438643 - RNA, 21 nt, Pseudomonas aeruginosa PA01
gcuggaaauggcggucgccga

SEQ ID NO: 1438644 - RNA, 17 nt, Pseudomonas aeruginosa PA01
gcugcuguccagcgcuc

SEQ ID NO: 1438645 - RNA, 15 nt, Pseudomonas aeruginosa PA01
gcugcugcucagcgc

SEQ ID NO: 1438646 - RNA, 19 nt, Pseudomonas aeruginosa PA01
gcugcugguagugcuggcg

SEQ ID NO: 1438647 - RNA, 21 nt, Pseudomonas aeruginosa PA01
gcugcugguagugcuggcgca

SEQ ID NO: 1438648 - RNA, 18 nt, Pseudomonas aeruginosa PA01
gcugcugggcggcgaccg

SEQ ID NO: 1438649 - RNA, 21 nt, Pseudomonas aeruginosa PA01
gcugcuggggaacugggcgag

SEQ ID NO: 1438650 - RNA, 22 nt, Pseudomonas aeruginosa PA01
gcugcuggccuucgucggcuuc

SEQ ID NO: 1438651 - RNA, 13 nt, Pseudomonas aeruginosa PA01
gcugcuggcgccg

SEQ ID NO: 1438652 - RNA, 14 nt, Pseudomonas aeruginosa PA01
gcugcuggcgccgc

SEQ ID NO: 1438653 - RNA, 15 nt, Pseudomonas aeruginosa PA01
gcugcuggcgccgcu

SEQ ID NO: 1438654 - RNA, 16 nt, Pseudomonas aeruginosa PA01
gcuggaacggccaggu

SEQ ID NO: 1438655 - RNA, 17 nt, Pseudomonas aeruginosa PA01
gcuggaagucguccagc

SEQ ID NO: 1438656 - RNA, 18 nt, Pseudomonas aeruginosa PA01
gcuggaagucguccagca

SEQ ID NO: 1438657 - RNA, 16 nt, Pseudomonas aeruginosa PA01
gcuggaagccgcgcuc

SEQ ID NO: 1438658 - RNA, 17 nt, Pseudomonas aeruginosa PA01
gcuggacacgguccagg

SEQ ID NO: 1438659 - RNA, 21 nt, Pseudomonas aeruginosa PA01
gcuggacaagguuugcgccgc

SEQ ID NO: 1438660 - RNA, 23 nt, Pseudomonas aeruginosa PA01
gcuggacaagguuugcgccgccg

SEQ ID NO: 1438661 - RNA, 16 nt, Pseudomonas aeruginosa PA01
gcuggacaggcgcagg

SEQ ID NO: 1438662 - RNA, 20 nt, Pseudomonas aeruginosa PA01
gcuggacaggcgcaggggcg

SEQ ID NO: 1438663 - RNA, 21 nt, Pseudomonas aeruginosa PA01
gcuggacaggcgcaggggcga

SEQ ID NO: 1438664 - RNA, 15 nt, Pseudomonas aeruginosa PA01
gcuggaccaggcggc

SEQ ID NO: 1438665 - RNA, 17 nt, Pseudomonas aeruginosa PA01
gcuggaccaggcggccg

SEQ ID NO: 1438666 - RNA, 21 nt, Pseudomonas aeruginosa PA01
gcuggaccaguucagcgcgcu

SEQ ID NO: 1438667 - RNA, 20 nt, Pseudomonas aeruginosa PA01
gcuggaccauggccggcgug

SEQ ID NO: 1438668 - RNA, 21 nt, Pseudomonas aeruginosa PA01
gcuggaccaccguggcgccgg

SEQ ID NO: 1438669 - RNA, 22 nt, Pseudomonas aeruginosa PA01
gcuggaccaccguggcgccggc

SEQ ID NO: 1438670 - RNA, 20 nt, Pseudomonas aeruginosa PA01
gcuggacccgcaccuggacc

SEQ ID NO: 1438671 - RNA, 21 nt, Pseudomonas aeruginosa PA01
gcuggacccgcaccuggaccg

SEQ ID NO: 1438672 - RNA, 18 nt, Pseudomonas aeruginosa PA01
gcuggaccuggccggcga

SEQ ID NO: 1438673 - RNA, 16 nt, Pseudomonas aeruginosa PA01
gcuggaucggcaggcu

SEQ ID NO: 1438674 - RNA, 15 nt, Pseudomonas aeruginosa PA01
gcuggaucuggugga

SEQ ID NO: 1438675 - RNA, 21 nt, Pseudomonas aeruginosa PA01
gcuggaucugguggaacagca

SEQ ID NO: 1438676 - RNA, 17 nt, Pseudomonas aeruginosa PA01
gcuggauccgugccagg

SEQ ID NO: 1438677 - RNA, 14 nt, Pseudomonas aeruginosa PA01
gcuggauccucgcc

SEQ ID NO: 1438678 - RNA, 16 nt, Pseudomonas aeruginosa PA01
gcuggauuucgccgag

SEQ ID NO: 1438679 - RNA, 23 nt, Pseudomonas aeruginosa PA01
gcuggauuucgccgaguggccgc

SEQ ID NO: 1438680 - RNA, 16 nt, Pseudomonas aeruginosa PA01
gcuggacucgcgccag

SEQ ID NO: 1438681 - RNA, 17 nt, Pseudomonas aeruginosa PA01
gcuggacucgcgccagu

SEQ ID NO: 1438682 - RNA, 20 nt, Pseudomonas aeruginosa PA01
gcuggacgacgcuggccugc

SEQ ID NO: 1438683 - RNA, 22 nt, Pseudomonas aeruginosa PA01
gcuggacgacgcuggccugccg

SEQ ID NO: 1438684 - RNA, 17 nt, Pseudomonas aeruginosa PA01
gcuggagcagcagcgcc

SEQ ID NO: 1438685 - RNA, 21 nt, Pseudomonas aeruginosa PA01
gcuggagcagcagcgccgcga

SEQ ID NO: 1438686 - RNA, 14 nt, Pseudomonas aeruginosa PA01
gcuggagcgcugcg

SEQ ID NO: 1438687 - RNA, 18 nt, Pseudomonas aeruginosa PA01
gcuggaguaucgcccugg

SEQ ID NO: 1438688 - RNA, 16 nt, Pseudomonas aeruginosa PA01
gcuggccgaggacccg

SEQ ID NO: 1438689 - RNA, 18 nt, Pseudomonas aeruginosa PA01
gcuggccgaggacccggc

SEQ ID NO: 1438690 - RNA, 18 nt, Pseudomonas aeruginosa PA01
gcuggccgccucgcgccg

SEQ ID NO: 1438691 - RNA, 19 nt, Pseudomonas aeruginosa PA01
gcuggccgccucgcgccgc

SEQ ID NO: 1438692 - RNA, 22 nt, Pseudomonas aeruginosa PA01
gcuggccgcccuugcggcccgc

SEQ ID NO: 1438693 - RNA, 21 nt, Pseudomonas aeruginosa PA01
gcuggccggugccauacagcg

SEQ ID NO: 1438694 - RNA, 14 nt, Pseudomonas aeruginosa PA01
gcuggccggugccg

SEQ ID NO: 1438695 - RNA, 15 nt, Pseudomonas aeruginosa PA01
gcuggccggugccgc

SEQ ID NO: 1438696 - RNA, 21 nt, Pseudomonas aeruginosa PA01
gcuggccgcggugggcuccag

SEQ ID NO: 1438697 - RNA, 21 nt, Pseudomonas aeruginosa PA01
gcuggccgcgcgaccgcggcg

SEQ ID NO: 1438698 - RNA, 15 nt, Pseudomonas aeruginosa PA01
gcuggcgaggacgcc

SEQ ID NO: 1438699 - RNA, 16 nt, Pseudomonas aeruginosa PA01
gcuggcgaggacgccg

SEQ ID NO: 1438700 - RNA, 19 nt, Pseudomonas aeruginosa PA01
gcuggcgaggacgccgggc

SEQ ID NO: 1438701 - RNA, 20 nt, Pseudomonas aeruginosa PA01
gcuggccuuguacagggcgc

SEQ ID NO: 1438702 - RNA, 21 nt, Pseudomonas aeruginosa PA01
gcuggcgaccggguccugcag

SEQ ID NO: 1438703 - RNA, 16 nt, Pseudomonas aeruginosa PA01
gcuggcgaucgaccug

SEQ ID NO: 1438704 - RNA, 17 nt, Pseudomonas aeruginosa PA01
gcuggcgaucgaccugc

SEQ ID NO: 1438705 - RNA, 22 nt, Pseudomonas aeruginosa PA01
gcuggcgauuuccucgcugcgg

SEQ ID NO: 1438706 - RNA, 18 nt, Pseudomonas aeruginosa PA01
gcuggcgaucaucgcgca

SEQ ID NO: 1438707 - RNA, 22 nt, Pseudomonas aeruginosa PA01
gcuggcgaucucggcgcgggca

SEQ ID NO: 1438708 - RNA, 19 nt, Pseudomonas aeruginosa PA01
gcuggcgauguagcugccg

SEQ ID NO: 1438709 - RNA, 20 nt, Pseudomonas aeruginosa PA01
gcuggcgauguagcugccgg

SEQ ID NO: 1438710 - RNA, 21 nt, Pseudomonas aeruginosa PA01
gcuggcgauguagcugccggc

SEQ ID NO: 1438711 - RNA, 23 nt, Pseudomonas aeruginosa PA01
gcuggcgauguagcugccggcgu

SEQ ID NO: 1438712 - RNA, 16 nt, Pseudomonas aeruginosa PA01
gcuggccucagggcgc

SEQ ID NO: 1438713 - RNA, 13 nt, Pseudomonas aeruginosa PA01
gcuggccucggcg

SEQ ID NO: 1438714 - RNA, 22 nt, Pseudomonas aeruginosa PA01
gcuggccucggcgaucgccagg

SEQ ID NO: 1438715 - RNA, 20 nt, Pseudomonas aeruginosa PA01
gcuggccugcagcaggucga

SEQ ID NO: 1438716 - RNA, 18 nt, Pseudomonas aeruginosa PA01
gcuggccugcagguccgg

SEQ ID NO: 1438717 - RNA, 12 nt, Pseudomonas aeruginosa PA01
gcuggccugccg

SEQ ID NO: 1438718 - RNA, 14 nt, Pseudomonas aeruginosa PA01
gcuggccugccgau

SEQ ID NO: 1438719 - RNA, 15 nt, Pseudomonas aeruginosa PA01
gcuggccugccgaug

SEQ ID NO: 1438720 - RNA, 22 nt, Pseudomonas aeruginosa PA01
gcuggcgaauuuccugcuggcg

SEQ ID NO: 1438721 - RNA, 20 nt, Pseudomonas aeruginosa PA01
gcuggcgacacucugguagc

SEQ ID NO: 1438722 - RNA, 15 nt, Pseudomonas aeruginosa PA01
gcuggcgaaccaguc

SEQ ID NO: 1438723 - RNA, 22 nt, Pseudomonas aeruginosa PA01
gcuggcgaacggcuggucggcu

SEQ ID NO: 1438724 - RNA, 14 nt, Pseudomonas aeruginosa PA01
gcuggccuuggcca

SEQ ID NO: 1438725 - RNA, 20 nt, Pseudomonas aeruginosa PA01
gcuggccuuggccaugccca

SEQ ID NO: 1438726 - RNA, 15 nt, Pseudomonas aeruginosa PA01
gcuggcgaaggcgcu

SEQ ID NO: 1438727 - RNA, 19 nt, Pseudomonas aeruginosa PA01
gcuggcgaaggcgcuccgg

SEQ ID NO: 1438728 - RNA, 20 nt, Pseudomonas aeruginosa PA01
gcuggcgaaggcgcuccgga

SEQ ID NO: 1438729 - RNA, 20 nt, Pseudomonas aeruginosa PA01
gcuggcgaauauccucgucg

SEQ ID NO: 1438730 - RNA, 24 nt, Pseudomonas aeruginosa PA01
gcuggcauacacaugcaggcucga

SEQ ID NO: 1438731 - RNA, 18 nt, Pseudomonas aeruginosa PA01
gcuggcagggcgcgucca

SEQ ID NO: 1438732 - RNA, 12 nt, Pseudomonas aeruginosa PA01
gcuggcaggugc

SEQ ID NO: 1438733 - RNA, 23 nt, Pseudomonas aeruginosa PA01
gcuggcagguugauccugggcgc

SEQ ID NO: 1438734 - RNA, 14 nt, Pseudomonas aeruginosa PA01
gcuggccaccagca

SEQ ID NO: 1438735 - RNA, 15 nt, Pseudomonas aeruginosa PA01
gcuggccaccagcac

SEQ ID NO: 1438736 - RNA, 19 nt, Pseudomonas aeruginosa PA01
gcuggccaccagcaccugc

SEQ ID NO: 1438737 - RNA, 21 nt, Pseudomonas aeruginosa PA01
gcuggccaccagcaccugcgg

SEQ ID NO: 1438738 - RNA, 16 nt, Pseudomonas aeruginosa PA01
gcuggcaacggcgggc

SEQ ID NO: 1438739 - RNA, 14 nt, Pseudomonas aeruginosa PA01
gcuggcagaacgcg

SEQ ID NO: 1438740 - RNA, 14 nt, Pseudomonas aeruginosa PA01
gcuggcacaggucc

SEQ ID NO: 1438741 - RNA, 18 nt, Pseudomonas aeruginosa PA01
gcuggcaccggccaggcg

SEQ ID NO: 1438742 - RNA, 20 nt, Pseudomonas aeruginosa PA01
gcuggcaccggccaggcgcu

SEQ ID NO: 1438743 - RNA, 19 nt, Pseudomonas aeruginosa PA01
gcuggccagaauuccagca

SEQ ID NO: 1438744 - RNA, 20 nt, Pseudomonas aeruginosa PA01
gcuggccagaauuccagcag

SEQ ID NO: 1438745 - RNA, 21 nt, Pseudomonas aeruginosa PA01
gcuggccagaauuccagcagg

SEQ ID NO: 1438746 - RNA, 22 nt, Pseudomonas aeruginosa PA01
gcuggccagaauuccagcaggu

SEQ ID NO: 1438747 - RNA, 20 nt, Pseudomonas aeruginosa PA01
gcuggccagcaggcuggcgg

SEQ ID NO: 1438748 - RNA, 21 nt, Pseudomonas aeruginosa PA01
gcuggccagcaggcuggcggc

SEQ ID NO: 1438749 - RNA, 18 nt, Pseudomonas aeruginosa PA01
gcuggccacgaacaggcu

SEQ ID NO: 1438750 - RNA, 18 nt, Pseudomonas aeruginosa PA01
gcuggccaccgccaggac

SEQ ID NO: 1438751 - RNA, 14 nt, Pseudomonas aeruginosa PA01
gcuggccaccgcgg

SEQ ID NO: 1438752 - RNA, 21 nt, Pseudomonas aeruginosa PA01
gcuggccaccgcggcguccgc

SEQ ID NO: 1438753 - RNA, 23 nt, Pseudomonas aeruginosa PA01
gcuggccaccgcggcguccgcgu

SEQ ID NO: 1438754 - RNA, 13 nt, Pseudomonas aeruginosa PA01
gcuggccacccuu

SEQ ID NO: 1438755 - RNA, 14 nt, Pseudomonas aeruginosa PA01
gcuggccacccuug

SEQ ID NO: 1438756 - RNA, 23 nt, Pseudomonas aeruginosa PA01
gcuggccacccuugcgcccggcu

SEQ ID NO: 1438757 - RNA, 20 nt, Pseudomonas aeruginosa PA01
gcuggcccaguugcccggcc

SEQ ID NO: 1438758 - RNA, 15 nt, Pseudomonas aeruginosa PA01
gcuggccauccgccc

SEQ ID NO: 1438759 - RNA, 20 nt, Pseudomonas aeruginosa PA01
gcuggccauccgcccugcgg

SEQ ID NO: 1438760 - RNA, 13 nt, Pseudomonas aeruginosa PA01
gcuggccagcgcu

SEQ ID NO: 1438761 - RNA, 11 nt, Pseudomonas aeruginosa PA01
gcugacggcgu

SEQ ID NO: 1438762 - RNA, 17 nt, Pseudomonas aeruginosa PA01
gcugacggcguggcgga

SEQ ID NO: 1438763 - RNA, 22 nt, Pseudomonas aeruginosa PA01
gcugacgcuggcgaaggcgcuc

SEQ ID NO: 1438764 - RNA, 14 nt, Pseudomonas aeruginosa PA01
gcugaugugccgca

SEQ ID NO: 1438765 - RNA, 20 nt, Pseudomonas aeruginosa PA01
gcugauugcgggccuuggcg

SEQ ID NO: 1438766 - RNA, 12 nt, Pseudomonas aeruginosa PA01
gcugcaccgcgc

SEQ ID NO: 1438767 - RNA, 16 nt, Pseudomonas aeruginosa PA01
gcugccauccgcgccg

SEQ ID NO: 1438768 - RNA, 20 nt, Pseudomonas aeruginosa PA01
gcugccauccgcgccgacca

SEQ ID NO: 1438769 - RNA, 22 nt, Pseudomonas aeruginosa PA01
gcugccauccgcgccgaccagc

SEQ ID NO: 1438770 - RNA, 17 nt, Pseudomonas aeruginosa PA01
gcugccagcgccgccgc

SEQ ID NO: 1438771 - RNA, 14 nt, Pseudomonas aeruginosa PA01
gcugccagguuggc

SEQ ID NO: 1438772 - RNA, 17 nt, Pseudomonas aeruginosa PA01
gcugccagugcucgaac

SEQ ID NO: 1438773 - RNA, 15 nt, Pseudomonas aeruginosa PA01
gcugccaguggcggc

SEQ ID NO: 1438774 - RNA, 19 nt, Pseudomonas aeruginosa PA01
gcugccagcaggccgagcc

SEQ ID NO: 1438775 - RNA, 19 nt, Pseudomonas aeruginosa PA01
gcugccagcgccgccgcgu

SEQ ID NO: 1438776 - RNA, 15 nt, Pseudomonas aeruginosa PA01
gcugcagggccucgc

SEQ ID NO: 1438777 - RNA, 16 nt, Pseudomonas aeruginosa PA01
gcugcagggcggcgcu

SEQ ID NO: 1438778 - RNA, 15 nt, Pseudomonas aeruginosa PA01
gcugcagguaggcgg

SEQ ID NO: 1438779 - RNA, 20 nt, Pseudomonas aeruginosa PA01
gcugcagguaggcgguggcg

SEQ ID NO: 1438780 - RNA, 16 nt, Pseudomonas aeruginosa PA01
gcugcaggccaccgga

SEQ ID NO: 1438781 - RNA, 20 nt, Pseudomonas aeruginosa PA01
gcugcacgcacgcgccugcu

SEQ ID NO: 1438782 - RNA, 13 nt, Pseudomonas aeruginosa PA01
gcugcacggcgac

SEQ ID NO: 1438783 - RNA, 16 nt, Pseudomonas aeruginosa PA01
gcugcacggcgacccg

SEQ ID NO: 1438784 - RNA, 23 nt, Pseudomonas aeruginosa PA01
gcugcacguuguucaccgugauc

SEQ ID NO: 1438785 - RNA, 18 nt, Pseudomonas aeruginosa PA01
gcugcacguuguugccca

SEQ ID NO: 1438786 - RNA, 21 nt, Pseudomonas aeruginosa PA01
gcugcccggcauaggcgccag

SEQ ID NO: 1438787 - RNA, 21 nt, Pseudomonas aeruginosa PA01
gcugccguagugguugcgcac

SEQ ID NO: 1438788 - RNA, 14 nt, Pseudomonas aeruginosa PA01
gcugccguccaggc

SEQ ID NO: 1438789 - RNA, 15 nt, Pseudomonas aeruginosa PA01
gcugcccggagcggc

SEQ ID NO: 1438790 - RNA, 20 nt, Pseudomonas aeruginosa PA01
gcugccguagaggucgccgu

SEQ ID NO: 1438791 - RNA, 15 nt, Pseudomonas aeruginosa PA01
gcugccguucgcccg

SEQ ID NO: 1438792 - RNA, 20 nt, Pseudomonas aeruginosa PA01
gcugccguucgcccgcggcg

SEQ ID NO: 1438793 - RNA, 13 nt, Pseudomonas aeruginosa PA01
gcugccguugcgg

SEQ ID NO: 1438794 - RNA, 19 nt, Pseudomonas aeruginosa PA01
gcugccguugcaggcccag

SEQ ID NO: 1438795 - RNA, 20 nt, Pseudomonas aeruginosa PA01
gcugccguugcaggcccagc

SEQ ID NO: 1438796 - RNA, 20 nt, Pseudomonas aeruginosa PA01
gcugccugucgcagcgggca

SEQ ID NO: 1438797 - RNA, 15 nt, Pseudomonas aeruginosa PA01
gcugccuucgaagcc

SEQ ID NO: 1438798 - RNA, 20 nt, Pseudomonas aeruginosa PA01
gcugcgagaacaggcggauc

SEQ ID NO: 1438799 - RNA, 21 nt, Pseudomonas aeruginosa PA01
gcugcgagaacaggcggaucu

SEQ ID NO: 1438800 - RNA, 19 nt, Pseudomonas aeruginosa PA01
gcugcgaccuggcgccgaa

SEQ ID NO: 1438801 - RNA, 15 nt, Pseudomonas aeruginosa PA01
gcugcgcaggccgag

SEQ ID NO: 1438802 - RNA, 16 nt, Pseudomonas aeruginosa PA01
gcugcgcaucgccugg

SEQ ID NO: 1438803 - RNA, 18 nt, Pseudomonas aeruginosa PA01
gcugcgcaucgccugggc

SEQ ID NO: 1438804 - RNA, 21 nt, Pseudomonas aeruginosa PA01
gcugcgcaucgccugggccgg

SEQ ID NO: 1438805 - RNA, 16 nt, Pseudomonas aeruginosa PA01
gcugcgcaccucggcc

SEQ ID NO: 1438806 - RNA, 17 nt, Pseudomonas aeruginosa PA01
gcugcgcagggcgccgu

SEQ ID NO: 1438807 - RNA, 16 nt, Pseudomonas aeruginosa PA01
gcugcgcagugucgcg

SEQ ID NO: 1438808 - RNA, 17 nt, Pseudomonas aeruginosa PA01
gcugcgauauggccgau

SEQ ID NO: 1438809 - RNA, 20 nt, Pseudomonas aeruginosa PA01
gcugcgaaucgucgccggag

SEQ ID NO: 1438810 - RNA, 23 nt, Pseudomonas aeruginosa PA01
gcugcgcaacugccggucggccu

SEQ ID NO: 1438811 - RNA, 17 nt, Pseudomonas aeruginosa PA01
gcugcgcugggcgccga

SEQ ID NO: 1438812 - RNA, 18 nt, Pseudomonas aeruginosa PA01
gcugcgcugggcgccgau

SEQ ID NO: 1438813 - RNA, 13 nt, Pseudomonas aeruginosa PA01
gcugcgcuccagg

SEQ ID NO: 1438814 - RNA, 14 nt, Pseudomonas aeruginosa PA01
gcugcgcucggcgc

SEQ ID NO: 1438815 - RNA, 19 nt, Pseudomonas aeruginosa PA01
gcugcgcugccagcgccgc

SEQ ID NO: 1438816 - RNA, 21 nt, Pseudomonas aeruginosa PA01
gcugcgcugccagcgccgccg

SEQ ID NO: 1438817 - RNA, 15 nt, Pseudomonas aeruginosa PA01
gcugcggagcgucgg

SEQ ID NO: 1438818 - RNA, 21 nt, Pseudomonas aeruginosa PA01
gcugcggaagagguacggccu

SEQ ID NO: 1438819 - RNA, 22 nt, Pseudomonas aeruginosa PA01
gcugcggaagagguacggccuu

SEQ ID NO: 1438820 - RNA, 13 nt, Pseudomonas aeruginosa PA01
gcugcggaaaccg

SEQ ID NO: 1438821 - RNA, 14 nt, Pseudomonas aeruginosa PA01
gcugcggcaacgac

SEQ ID NO: 1438822 - RNA, 20 nt, Pseudomonas aeruginosa PA01
gcugcggaugggcgacgacg

SEQ ID NO: 1438823 - RNA, 17 nt, Pseudomonas aeruginosa PA01
gcugcggcauucgcgcu

SEQ ID NO: 1438824 - RNA, 14 nt, Pseudomonas aeruginosa PA01
gcugcggccggcgc

SEQ ID NO: 1438825 - RNA, 23 nt, Pseudomonas aeruginosa PA01
gcucuugauacccaccggcucgc

SEQ ID NO: 1438826 - RNA, 20 nt, Pseudomonas aeruginosa PA01
gcucuugcccugccagcggg

SEQ ID NO: 1438827 - RNA, 17 nt, Pseudomonas aeruginosa PA01
gcucuugccgcgagcuu

SEQ ID NO: 1438828 - RNA, 21 nt, Pseudomonas aeruginosa PA01
gcucuugggcucugccuucag

SEQ ID NO: 1438829 - RNA, 14 nt, Pseudomonas aeruginosa PA01
gcucuucgccaguu

SEQ ID NO: 1438830 - RNA, 18 nt, Pseudomonas aeruginosa PA01
gcucuguagggucgcagc

SEQ ID NO: 1438831 - RNA, 21 nt, Pseudomonas aeruginosa PA01
gcucuucacuuccagcugcca

SEQ ID NO: 1438832 - RNA, 14 nt, Pseudomonas aeruginosa PA01
gcucuucagcgguc

SEQ ID NO: 1438833 - RNA, 17 nt, Pseudomonas aeruginosa PA01
gcucuucaggcugucgg

SEQ ID NO: 1438834 - RNA, 17 nt, Pseudomonas aeruginosa PA01
gcucuuccagcgggcgg

SEQ ID NO: 1438835 - RNA, 16 nt, Pseudomonas aeruginosa PA01
gcucuggcugcuggcg

SEQ ID NO: 1438836 - RNA, 18 nt, Pseudomonas aeruginosa PA01
gcucugggcauggcuggc

SEQ ID NO: 1438837 - RNA, 14 nt, Pseudomonas aeruginosa PA01
gcucugcuggccac

SEQ ID NO: 1438838 - RNA, 15 nt, Pseudomonas aeruginosa PA01
gcucuggccgcgcuc

SEQ ID NO: 1438839 - RNA, 19 nt, Pseudomonas aeruginosa PA01
gcucuggccgcgcuccaac

SEQ ID NO: 1438840 - RNA, 20 nt, Pseudomonas aeruginosa PA01
gcucuggccguucuccaggu

SEQ ID NO: 1438841 - RNA, 14 nt, Pseudomonas aeruginosa PA01
gcucuggcgcaggg

SEQ ID NO: 1438842 - RNA, 14 nt, Pseudomonas aeruginosa PA01
gcucugcgccaggc

SEQ ID NO: 1438843 - RNA, 14 nt, Pseudomonas aeruginosa PA01
gcucugcgccgcgg

SEQ ID NO: 1438844 - RNA, 14 nt, Pseudomonas aeruginosa PA01
gcucugcuccagca

SEQ ID NO: 1438845 - RNA, 13 nt, Pseudomonas aeruginosa PA01
gcucuggcccagc

SEQ ID NO: 1438846 - RNA, 20 nt, Pseudomonas aeruginosa PA01
gcucgugcagguagccgcgc

SEQ ID NO: 1438847 - RNA, 21 nt, Pseudomonas aeruginosa PA01
gcucgugcagguagccgcgcc

SEQ ID NO: 1438848 - RNA, 22 nt, Pseudomonas aeruginosa PA01
gcucgugcagguagccgcgccg

SEQ ID NO: 1438849 - RNA, 21 nt, Pseudomonas aeruginosa PA01
gcucugcgacuggaugcagcc

SEQ ID NO: 1438850 - RNA, 22 nt, Pseudomonas aeruginosa PA01
gcucugcgaucagggccucgcc

SEQ ID NO: 1438851 - RNA, 21 nt, Pseudomonas aeruginosa PA01
gcucugcccgaccggguugau

SEQ ID NO: 1438852 - RNA, 19 nt, Pseudomonas aeruginosa PA01
gcugaccuucgccgucaga

SEQ ID NO: 1438853 - RNA, 16 nt, Pseudomonas aeruginosa PA01
gcugaccggcaucgac

SEQ ID NO: 1438854 - RNA, 17 nt, Pseudomonas aeruginosa PA01
gcugaccggccgcagca

SEQ ID NO: 1438855 - RNA, 16 nt, Pseudomonas aeruginosa PA01
gcugacgaacaucgcc

SEQ ID NO: 1438856 - RNA, 22 nt, Pseudomonas aeruginosa PA01
gcugacgaacaucgccagcgcc

SEQ ID NO: 1438857 - RNA, 23 nt, Pseudomonas aeruginosa PA01
gcugaccucgagcuggacgcgcu

SEQ ID NO: 1438858 - RNA, 17 nt, Pseudomonas aeruginosa PA01
gcugacgaggacgccgc

SEQ ID NO: 1438859 - RNA, 20 nt, Pseudomonas aeruginosa PA01
gcugacgaggacgccgccgg

SEQ ID NO: 1438860 - RNA, 17 nt, Pseudomonas aeruginosa PA01
gcugaagauaucgccuu

SEQ ID NO: 1438861 - RNA, 14 nt, Pseudomonas aeruginosa PA01
gcugaagacccugc

SEQ ID NO: 1438862 - RNA, 17 nt, Pseudomonas aeruginosa PA01
gcugaagacccugcaca

SEQ ID NO: 1438863 - RNA, 14 nt, Pseudomonas aeruginosa PA01
gcugaagcccaggc

SEQ ID NO: 1438864 - RNA, 15 nt, Pseudomonas aeruginosa PA01
gcugaagcccaggcg

SEQ ID NO: 1438865 - RNA, 19 nt, Pseudomonas aeruginosa PA01
gcugaagcccaggcgucgc

SEQ ID NO: 1438866 - RNA, 20 nt, Pseudomonas aeruginosa PA01
gcugaagcccaggcgucgcg

SEQ ID NO: 1438867 - RNA, 24 nt, Pseudomonas aeruginosa PA01
gcugaagcccaggcgucgcgccag

SEQ ID NO: 1438868 - RNA, 16 nt, Pseudomonas aeruginosa PA01
gcugacccgcugcugg

SEQ ID NO: 1438869 - RNA, 16 nt, Pseudomonas aeruginosa PA01
gcugacccgcuguccg

SEQ ID NO: 1438870 - RNA, 17 nt, Pseudomonas aeruginosa PA01
gcugacccgcuguccgc

SEQ ID NO: 1438871 - RNA, 19 nt, Pseudomonas aeruginosa PA01
gcugacccgcuguccgccg

SEQ ID NO: 1438872 - RNA, 21 nt, Pseudomonas aeruginosa PA01
gcugacccgcuguccgccggc

SEQ ID NO: 1438873 - RNA, 13 nt, Pseudomonas aeruginosa PA01
gcugaagccccag

SEQ ID NO: 1438874 - RNA, 13 nt, Pseudomonas aeruginosa PA01
gcugaagcgccgc

SEQ ID NO: 1438875 - RNA, 14 nt, Pseudomonas aeruginosa PA01
gcugaagcgccgcg

SEQ ID NO: 1438876 - RNA, 15 nt, Pseudomonas aeruginosa PA01
gcugaagcgccgcgg

SEQ ID NO: 1438877 - RNA, 14 nt, Pseudomonas aeruginosa PA01
gcugaagcggccga

SEQ ID NO: 1438878 - RNA, 16 nt, Pseudomonas aeruginosa PA01
gcugaagcggccgaga

SEQ ID NO: 1438879 - RNA, 17 nt, Pseudomonas aeruginosa PA01
gcugaccgcucccaggc

SEQ ID NO: 1438880 - RNA, 20 nt, Pseudomonas aeruginosa PA01
gcugaccgcgugggccggca

SEQ ID NO: 1438881 - RNA, 21 nt, Pseudomonas aeruginosa PA01
gcugaccgcgugggccggcau

SEQ ID NO: 1438882 - RNA, 14 nt, Pseudomonas aeruginosa PA01
gcugaagccgggca

SEQ ID NO: 1438883 - RNA, 19 nt, Pseudomonas aeruginosa PA01
gcucggcgaguaaccaccg

SEQ ID NO: 1438884 - RNA, 20 nt, Pseudomonas aeruginosa PA01
gcucggcgaggccggcgauc

SEQ ID NO: 1438885 - RNA, 16 nt, Pseudomonas aeruginosa PA01
gcucggcgauccgcgc

SEQ ID NO: 1438886 - RNA, 18 nt, Pseudomonas aeruginosa PA01
gcucggcgaucucgccca

SEQ ID NO: 1438887 - RNA, 17 nt, Pseudomonas aeruginosa PA01
gcucggcgaugccgccg

SEQ ID NO: 1438888 - RNA, 17 nt, Pseudomonas aeruginosa PA01
gcucggccaucagcgcc

SEQ ID NO: 1438889 - RNA, 18 nt, Pseudomonas aeruginosa PA01
gcucggccaucagcgcca

SEQ ID NO: 1438890 - RNA, 22 nt, Pseudomonas aeruginosa PA01
gcucggccaucagcgccagggc

SEQ ID NO: 1438891 - RNA, 20 nt, Pseudomonas aeruginosa PA01
gcucggcgagccgccgggcg

SEQ ID NO: 1438892 - RNA, 17 nt, Pseudomonas aeruginosa PA01
gcucggcgauggcgcgc

SEQ ID NO: 1438893 - RNA, 19 nt, Pseudomonas aeruginosa PA01
gcucggcgauggcgcgcgg

SEQ ID NO: 1438894 - RNA, 16 nt, Pseudomonas aeruginosa PA01
gcucggcgcccuggcc

SEQ ID NO: 1438895 - RNA, 18 nt, Pseudomonas aeruginosa PA01
gcucggcgcccuggccgc

SEQ ID NO: 1438896 - RNA, 20 nt, Pseudomonas aeruginosa PA01
gcucggcgcccuggccgcca

SEQ ID NO: 1438897 - RNA, 14 nt, Pseudomonas aeruginosa PA01
gcucggcgcucggc

SEQ ID NO: 1438898 - RNA, 16 nt, Pseudomonas aeruginosa PA01
gcucgggcugccgcag

SEQ ID NO: 1438899 - RNA, 22 nt, Pseudomonas aeruginosa PA01
gcucggucagcucccugauccg

SEQ ID NO: 1438900 - RNA, 13 nt, Pseudomonas aeruginosa PA01
gcucggucagcgg

SEQ ID NO: 1438901 - RNA, 13 nt, Pseudomonas aeruginosa PA01
gcucggucgagcc

SEQ ID NO: 1438902 - RNA, 16 nt, Pseudomonas aeruginosa PA01
gcucgguccagaucgc

SEQ ID NO: 1438903 - RNA, 18 nt, Pseudomonas aeruginosa PA01
gcucgguccagaucgcca

SEQ ID NO: 1438904 - RNA, 18 nt, Pseudomonas aeruginosa PA01
gcucggugagcaggcgcc

SEQ ID NO: 1438905 - RNA, 20 nt, Pseudomonas aeruginosa PA01
gcucggugagcaggcgccgg

SEQ ID NO: 1438906 - RNA, 17 nt, Pseudomonas aeruginosa PA01
gcucggucucgaucggc

SEQ ID NO: 1438907 - RNA, 21 nt, Pseudomonas aeruginosa PA01
gcucggucucgaucggcccgg

SEQ ID NO: 1438908 - RNA, 18 nt, Pseudomonas aeruginosa PA01
gcucggggaacacgcgcu

SEQ ID NO: 1438909 - RNA, 21 nt, Pseudomonas aeruginosa PA01
gcucggggaacacgcgcugga

SEQ ID NO: 1438910 - RNA, 18 nt, Pseudomonas aeruginosa PA01
gcucggggauguccgccg

SEQ ID NO: 1438911 - RNA, 22 nt, Pseudomonas aeruginosa PA01
gcucggggauguccgccgccca

SEQ ID NO: 1438912 - RNA, 17 nt, Pseudomonas aeruginosa PA01
gcucggggugcgcggcg

SEQ ID NO: 1438913 - RNA, 19 nt, Pseudomonas aeruginosa PA01
gcucggggugcgcggcgaa

SEQ ID NO: 1438914 - RNA, 16 nt, Pseudomonas aeruginosa PA01
gcucgggguuuccucg

SEQ ID NO: 1438915 - RNA, 18 nt, Pseudomonas aeruginosa PA01
gcucgucuuucagguggg

SEQ ID NO: 1438916 - RNA, 16 nt, Pseudomonas aeruginosa PA01
gcucgucgagcugcuc

SEQ ID NO: 1438917 - RNA, 17 nt, Pseudomonas aeruginosa PA01
gcucgucgagcugcucg

SEQ ID NO: 1438918 - RNA, 18 nt, Pseudomonas aeruginosa PA01
gcucgucgagcugcucgg

SEQ ID NO: 1438919 - RNA, 20 nt, Pseudomonas aeruginosa PA01
gcucgguuccagcucgucga

SEQ ID NO: 1438920 - RNA, 21 nt, Pseudomonas aeruginosa PA01
gcucgguuccagcucgucgau

SEQ ID NO: 1438921 - RNA, 18 nt, Pseudomonas aeruginosa PA01
gcucgguucugcgcacca

SEQ ID NO: 1438922 - RNA, 15 nt, Pseudomonas aeruginosa PA01
gcucgguugccaggc

SEQ ID NO: 1438923 - RNA, 22 nt, Pseudomonas aeruginosa PA01
gcucgguugccaggccggcgca

SEQ ID NO: 1438924 - RNA, 19 nt, Pseudomonas aeruginosa PA01
gcucggugccuucccagcc

SEQ ID NO: 1438925 - RNA, 13 nt, Pseudomonas aeruginosa PA01
gcucguagccggc

SEQ ID NO: 1438926 - RNA, 14 nt, Pseudomonas aeruginosa PA01
gcucguccaggcaa

SEQ ID NO: 1438927 - RNA, 14 nt, Pseudomonas aeruginosa PA01
gcucguccaggccg

SEQ ID NO: 1438928 - RNA, 15 nt, Pseudomonas aeruginosa PA01
gcucguccaggccgc

SEQ ID NO: 1438929 - RNA, 18 nt, Pseudomonas aeruginosa PA01
gcucguccaggccgcagg

SEQ ID NO: 1438930 - RNA, 23 nt, Pseudomonas aeruginosa PA01
gcucguccaguuccagggucagc

SEQ ID NO: 1438931 - RNA, 21 nt, Pseudomonas aeruginosa PA01
gcucgucauggcgcacgccgc

SEQ ID NO: 1438932 - RNA, 14 nt, Pseudomonas aeruginosa PA01
gcucgucaggcgcu

SEQ ID NO: 1438933 - RNA, 17 nt, Pseudomonas aeruginosa PA01
gcucgcuaugcagcagg

SEQ ID NO: 1438934 - RNA, 17 nt, Pseudomonas aeruginosa PA01
gcucgcuacagccggga

SEQ ID NO: 1438935 - RNA, 15 nt, Pseudomonas aeruginosa PA01
gcucgcgcuuccggc

SEQ ID NO: 1438936 - RNA, 18 nt, Pseudomonas aeruginosa PA01
gcucgcgcuucucgacgu

SEQ ID NO: 1438937 - RNA, 14 nt, Pseudomonas aeruginosa PA01
gcucgcggaccagc

SEQ ID NO: 1438938 - RNA, 17 nt, Pseudomonas aeruginosa PA01
gcucgcggaccagcucc

SEQ ID NO: 1438939 - RNA, 13 nt, Pseudomonas aeruginosa PA01
gcucgcgcggcac

SEQ ID NO: 1438940 - RNA, 14 nt, Pseudomonas aeruginosa PA01
gcucgcgcggcacc

SEQ ID NO: 1438941 - RNA, 14 nt, Pseudomonas aeruginosa PA01
gcucgcgcggggcg

SEQ ID NO: 1438942 - RNA, 21 nt, Pseudomonas aeruginosa PA01
gcucgcgcggggcgcgcugcg

SEQ ID NO: 1438943 - RNA, 20 nt, Pseudomonas aeruginosa PA01
gcucgcgcaugaucgccucg

SEQ ID NO: 1438944 - RNA, 22 nt, Pseudomonas aeruginosa PA01
gcucgcgcaugaucgccucggc

SEQ ID NO: 1438945 - RNA, 19 nt, Pseudomonas aeruginosa PA01
gcucgccgucaucgagcag

SEQ ID NO: 1438946 - RNA, 15 nt, Pseudomonas aeruginosa PA01
gcucgcgcagggucg

SEQ ID NO: 1438947 - RNA, 12 nt, Pseudomonas aeruginosa PA01
gcucgcgccagc

SEQ ID NO: 1438948 - RNA, 14 nt, Pseudomonas aeruginosa PA01
gcucgcgccagccc

SEQ ID NO: 1438949 - RNA, 18 nt, Pseudomonas aeruginosa PA01
gcucgcgccagccccagg

SEQ ID NO: 1438950 - RNA, 12 nt, Pseudomonas aeruginosa PA01
gcucgcgccggc

SEQ ID NO: 1438951 - RNA, 13 nt, Pseudomonas aeruginosa PA01
gcucgcgccggcg

SEQ ID NO: 1438952 - RNA, 13 nt, Pseudomonas aeruginosa PA01
gcucgcugucgcc

SEQ ID NO: 1438953 - RNA, 16 nt, Pseudomonas aeruginosa PA01
gcucgcugucgccgag

SEQ ID NO: 1438954 - RNA, 20 nt, Pseudomonas aeruginosa PA01
gcucgcugaaauccaccagc

SEQ ID NO: 1438955 - RNA, 23 nt, Pseudomonas aeruginosa PA01
gcucgcugaaauccaccagcacg

SEQ ID NO: 1438956 - RNA, 13 nt, Pseudomonas aeruginosa PA01
gcucgcuccgagc

SEQ ID NO: 1438957 - RNA, 14 nt, Pseudomonas aeruginosa PA01
gcucgcuccgagca

SEQ ID NO: 1438958 - RNA, 15 nt, Pseudomonas aeruginosa PA01
gcucgcuccgagcag

SEQ ID NO: 1438959 - RNA, 14 nt, Pseudomonas aeruginosa PA01
gcucggccagggcc

SEQ ID NO: 1438960 - RNA, 16 nt, Pseudomonas aeruginosa PA01
gcucggccagggccgc

SEQ ID NO: 1438961 - RNA, 16 nt, Pseudomonas aeruginosa PA01
gcucggccaggucgcg

SEQ ID NO: 1438962 - RNA, 15 nt, Pseudomonas aeruginosa PA01
gcucggccaguucgc

SEQ ID NO: 1438963 - RNA, 22 nt, Pseudomonas aeruginosa PA01
gcucggccaguucgcggcgcag

SEQ ID NO: 1438964 - RNA, 18 nt, Pseudomonas aeruginosa PA01
gcucggccaguucgucga

SEQ ID NO: 1438965 - RNA, 13 nt, Pseudomonas aeruginosa PA01
gcucggccagcgu

SEQ ID NO: 1438966 - RNA, 22 nt, Pseudomonas aeruginosa PA01
gcucggccagcguccuucggcg

SEQ ID NO: 1438967 - RNA, 14 nt, Pseudomonas aeruginosa PA01
gcucggccagcucg

SEQ ID NO: 1438968 - RNA, 15 nt, Pseudomonas aeruginosa PA01
gcucggccagcucgc

SEQ ID NO: 1438969 - RNA, 17 nt, Pseudomonas aeruginosa PA01
gcucggccagcucgccg

SEQ ID NO: 1438970 - RNA, 18 nt, Pseudomonas aeruginosa PA01
gcucggccagcucgccga

SEQ ID NO: 1438971 - RNA, 19 nt, Pseudomonas aeruginosa PA01
gcucggccagcucgccgaa

SEQ ID NO: 1438972 - RNA, 17 nt, Pseudomonas aeruginosa PA01
gcucgcuucagcgagcg

SEQ ID NO: 1438973 - RNA, 22 nt, Pseudomonas aeruginosa PA01
gcucgcuucagcgagcggucgg

SEQ ID NO: 1438974 - RNA, 17 nt, Pseudomonas aeruginosa PA01
gcucgaucagccggcgc

SEQ ID NO: 1438975 - RNA, 14 nt, Pseudomonas aeruginosa PA01
gcucgauccagccg

SEQ ID NO: 1438976 - RNA, 17 nt, Pseudomonas aeruginosa PA01
gcucgauccagccggca

SEQ ID NO: 1438977 - RNA, 18 nt, Pseudomonas aeruginosa PA01
gcucgauccagccggcau

SEQ ID NO: 1438978 - RNA, 23 nt, Pseudomonas aeruginosa PA01
gcucgauccagccggcauccagc

SEQ ID NO: 1438979 - RNA, 18 nt, Pseudomonas aeruginosa PA01
gcucgaucggcagggcgc

SEQ ID NO: 1438980 - RNA, 20 nt, Pseudomonas aeruginosa PA01
gcucgaucggcagggcgccg

SEQ ID NO: 1438981 - RNA, 21 nt, Pseudomonas aeruginosa PA01
gcucgaucggcagggcgccga

SEQ ID NO: 1438982 - RNA, 19 nt, Pseudomonas aeruginosa PA01
gcucgaucucauggucggg

SEQ ID NO: 1438983 - RNA, 21 nt, Pseudomonas aeruginosa PA01
gcucgaucagguaggcgccgu

SEQ ID NO: 1438984 - RNA, 16 nt, Pseudomonas aeruginosa PA01
gcucgaugaucgacug

SEQ ID NO: 1438985 - RNA, 20 nt, Pseudomonas aeruginosa PA01
gcucgaugccaucgaggcca

SEQ ID NO: 1438986 - RNA, 22 nt, Pseudomonas aeruginosa PA01
gcucgaugccaucgaggccagg

SEQ ID NO: 1438987 - RNA, 15 nt, Pseudomonas aeruginosa PA01
gcucgaugcccgcca

SEQ ID NO: 1438988 - RNA, 17 nt, Pseudomonas aeruginosa PA01
gcucgaugcccgccagc

SEQ ID NO: 1438989 - RNA, 19 nt, Pseudomonas aeruginosa PA01
gcucgaugcccgccagcag

SEQ ID NO: 1438990 - RNA, 22 nt, Pseudomonas aeruginosa PA01
gcucgaugcccgccagcaggcg

SEQ ID NO: 1438991 - RNA, 14 nt, Pseudomonas aeruginosa PA01
gcucgccgauugca

SEQ ID NO: 1438992 - RNA, 12 nt, Pseudomonas aeruginosa PA01
gcucgccgccgg

SEQ ID NO: 1438993 - RNA, 14 nt, Pseudomonas aeruginosa PA01
gcucgccgccggcg

SEQ ID NO: 1438994 - RNA, 14 nt, Pseudomonas aeruginosa PA01
gcucgccgccgggc

SEQ ID NO: 1438995 - RNA, 18 nt, Pseudomonas aeruginosa PA01
gcucgccgccgggcgcgc

SEQ ID NO: 1438996 - RNA, 19 nt, Pseudomonas aeruginosa PA01
gcucgccgccgggcgcgcg

SEQ ID NO: 1438997 - RNA, 20 nt, Pseudomonas aeruginosa PA01
gcucgccgccgggcgcgcgc

SEQ ID NO: 1438998 - RNA, 14 nt, Pseudomonas aeruginosa PA01
gcucgccgccagca

SEQ ID NO: 1438999 - RNA, 17 nt, Pseudomonas aeruginosa PA01
gcucgccgccagcagga

SEQ ID NO: 1439000 - RNA, 16 nt, Pseudomonas aeruginosa PA01
gcucgccgacuuccag

SEQ ID NO: 1439001 - RNA, 21 nt, Pseudomonas aeruginosa PA01
gcucgccgacuuccaggcgca

SEQ ID NO: 1439002 - RNA, 21 nt, Pseudomonas aeruginosa PA01
gcucgccgaacaggaucuccu

SEQ ID NO: 1439003 - RNA, 15 nt, Pseudomonas aeruginosa PA01
gcucgcccuugcgcc

SEQ ID NO: 1439004 - RNA, 17 nt, Pseudomonas aeruginosa PA01
gcucgcccuugcgccgc

SEQ ID NO: 1439005 - RNA, 17 nt, Pseudomonas aeruginosa PA01
gcucgccgggucgccgc

SEQ ID NO: 1439006 - RNA, 21 nt, Pseudomonas aeruginosa PA01
gcucgccgggucgccgcagcc

SEQ ID NO: 1439007 - RNA, 15 nt, Pseudomonas aeruginosa PA01
gcucgccggguaggg

SEQ ID NO: 1439008 - RNA, 18 nt, Pseudomonas aeruginosa PA01
gcucgccggcgcgggcgg

SEQ ID NO: 1439009 - RNA, 20 nt, Pseudomonas aeruginosa PA01
gcucgccggcgcgggcggcc

SEQ ID NO: 1439010 - RNA, 16 nt, Pseudomonas aeruginosa PA01
gcucgcgcagcggcgc

SEQ ID NO: 1439011 - RNA, 17 nt, Pseudomonas aeruginosa PA01
gcucgcgcagcggcgcg

SEQ ID NO: 1439012 - RNA, 23 nt, Pseudomonas aeruginosa PA01
gcucgccgcugaaguccuggccg

SEQ ID NO: 1439013 - RNA, 23 nt, Pseudomonas aeruginosa PA01
gcuccuccgggcgugccaggagc

SEQ ID NO: 1439014 - RNA, 22 nt, Pseudomonas aeruginosa PA01
gcuccuccucgcucugcgccgc

SEQ ID NO: 1439015 - RNA, 16 nt, Pseudomonas aeruginosa PA01
gcuccucgauccgcuc

SEQ ID NO: 1439016 - RNA, 14 nt, Pseudomonas aeruginosa PA01
gcuccucgcgcugc

SEQ ID NO: 1439017 - RNA, 23 nt, Pseudomonas aeruginosa PA01
gcuccucgcgcugcccggcgcga

SEQ ID NO: 1439018 - RNA, 21 nt, Pseudomonas aeruginosa PA01
gcuccucggccugggcgcagg

SEQ ID NO: 1439019 - RNA, 21 nt, Pseudomonas aeruginosa PA01
gcuccucggccuugcuggcga

SEQ ID NO: 1439020 - RNA, 16 nt, Pseudomonas aeruginosa PA01
gcuccgugucggcggc

SEQ ID NO: 1439021 - RNA, 17 nt, Pseudomonas aeruginosa PA01
gcuccgugucggcggcg

SEQ ID NO: 1439022 - RNA, 19 nt, Pseudomonas aeruginosa PA01
gcuccgucuguucggccag

SEQ ID NO: 1439023 - RNA, 22 nt, Pseudomonas aeruginosa PA01
gcuccgucuguucggccaggga

SEQ ID NO: 1439024 - RNA, 13 nt, Pseudomonas aeruginosa PA01
gcuccuccagcag

SEQ ID NO: 1439025 - RNA, 15 nt, Pseudomonas aeruginosa PA01
gcuccuccagcagga

SEQ ID NO: 1439026 - RNA, 17 nt, Pseudomonas aeruginosa PA01
gcuccuccagccgcggg

SEQ ID NO: 1439027 - RNA, 12 nt, Pseudomonas aeruginosa PA01
gcuccuccagcg

SEQ ID NO: 1439028 - RNA, 19 nt, Pseudomonas aeruginosa PA01
gcuccuccagcgccgccag

SEQ ID NO: 1439029 - RNA, 18 nt, Pseudomonas aeruginosa PA01
gcuccuccagcguggcgg

SEQ ID NO: 1439030 - RNA, 19 nt, Pseudomonas aeruginosa PA01
gcuccguugaacucggcgc

SEQ ID NO: 1439031 - RNA, 21 nt, Pseudomonas aeruginosa PA01
gcuccguugaacucggcgccc

SEQ ID NO: 1439032 - RNA, 23 nt, Pseudomonas aeruginosa PA01
gcuccucagaggcgaccagccgg

SEQ ID NO: 1439033 - RNA, 17 nt, Pseudomonas aeruginosa PA01
gcucgaccuugcccuug

SEQ ID NO: 1439034 - RNA, 15 nt, Pseudomonas aeruginosa PA01
gcucgaccuugccga

SEQ ID NO: 1439035 - RNA, 18 nt, Pseudomonas aeruginosa PA01
gcucgaccuugccgagcg

SEQ ID NO: 1439036 - RNA, 20 nt, Pseudomonas aeruginosa PA01
gcuccugcaggcccugccag

SEQ ID NO: 1439037 - RNA, 24 nt, Pseudomonas aeruginosa PA01
gcucgaccgccugcucgcggcugg

SEQ ID NO: 1439038 - RNA, 14 nt, Pseudomonas aeruginosa PA01
gcucgacggcacca

SEQ ID NO: 1439039 - RNA, 14 nt, Pseudomonas aeruginosa PA01
gcucgacgaucagg

SEQ ID NO: 1439040 - RNA, 16 nt, Pseudomonas aeruginosa PA01
gcucgacgaucugucg

SEQ ID NO: 1439041 - RNA, 18 nt, Pseudomonas aeruginosa PA01
gcucgacgaucugucgau

SEQ ID NO: 1439042 - RNA, 14 nt, Pseudomonas aeruginosa PA01
gcucgacgagccgc

SEQ ID NO: 1439043 - RNA, 21 nt, Pseudomonas aeruginosa PA01
gcucgacgagccgcgacgcga

SEQ ID NO: 1439044 - RNA, 16 nt, Pseudomonas aeruginosa PA01
gcucgaucaccaccac

SEQ ID NO: 1439045 - RNA, 15 nt, Pseudomonas aeruginosa PA01
gcucgaucagcccgc

SEQ ID NO: 1439046 - RNA, 13 nt, Pseudomonas aeruginosa PA01
gcucgaucagccg

SEQ ID NO: 1439047 - RNA, 15 nt, Pseudomonas aeruginosa PA01
gcucgacgucgucga

SEQ ID NO: 1439048 - RNA, 17 nt, Pseudomonas aeruginosa PA01
gcucgacggucagcgga

SEQ ID NO: 1439049 - RNA, 20 nt, Pseudomonas aeruginosa PA01
gcuccgaugaagcaggcgga

SEQ ID NO: 1439050 - RNA, 13 nt, Pseudomonas aeruginosa PA01
gcuccgccgccgu

SEQ ID NO: 1439051 - RNA, 15 nt, Pseudomonas aeruginosa PA01
gcuccgccaggccgc

SEQ ID NO: 1439052 - RNA, 18 nt, Pseudomonas aeruginosa PA01
gcuccgccaggccgcgca

SEQ ID NO: 1439053 - RNA, 13 nt, Pseudomonas aeruginosa PA01
gcuccgccuggcg

SEQ ID NO: 1439054 - RNA, 14 nt, Pseudomonas aeruginosa PA01
gcuccgccuggcgg

SEQ ID NO: 1439055 - RNA, 15 nt, Pseudomonas aeruginosa PA01
gcuccgccuggcgga

SEQ ID NO: 1439056 - RNA, 19 nt, Pseudomonas aeruginosa PA01
gcuccgcgauguccccggc

SEQ ID NO: 1439057 - RNA, 21 nt, Pseudomonas aeruginosa PA01
gcuccgcgauguccccggcca

SEQ ID NO: 1439058 - RNA, 22 nt, Pseudomonas aeruginosa PA01
gcuccgcgauguccccggccag

SEQ ID NO: 1439059 - RNA, 17 nt, Pseudomonas aeruginosa PA01
gcuccgccugaccgcug

SEQ ID NO: 1439060 - RNA, 15 nt, Pseudomonas aeruginosa PA01
gcuccgagcaggccu

SEQ ID NO: 1439061 - RNA, 14 nt, Pseudomonas aeruginosa PA01
gcuccgcggccggc

SEQ ID NO: 1439062 - RNA, 15 nt, Pseudomonas aeruginosa PA01
gcuccgcggccggcu

SEQ ID NO: 1439063 - RNA, 18 nt, Pseudomonas aeruginosa PA01
gcuccggguugucgucgu

SEQ ID NO: 1439064 - RNA, 14 nt, Pseudomonas aeruginosa PA01
gcuccggugccagg

SEQ ID NO: 1439065 - RNA, 19 nt, Pseudomonas aeruginosa PA01
gcuccggugccagggcggu

SEQ ID NO: 1439066 - RNA, 14 nt, Pseudomonas aeruginosa PA01
gcuccgguggcgga

SEQ ID NO: 1439067 - RNA, 18 nt, Pseudomonas aeruginosa PA01
gcucacucccguccagcg

SEQ ID NO: 1439068 - RNA, 13 nt, Pseudomonas aeruginosa PA01
gcucacugcgagc

SEQ ID NO: 1439069 - RNA, 14 nt, Pseudomonas aeruginosa PA01
gcucacugcgagca

SEQ ID NO: 1439070 - RNA, 16 nt, Pseudomonas aeruginosa PA01
gcucagaaauccaccu

SEQ ID NO: 1439071 - RNA, 23 nt, Pseudomonas aeruginosa PA01
gcucacguagcccccgccgcuga

SEQ ID NO: 1439072 - RNA, 16 nt, Pseudomonas aeruginosa PA01
gcucacgcguucggcg

SEQ ID NO: 1439073 - RNA, 24 nt, Pseudomonas aeruginosa PA01
gcucacgccccagcgcaucgcgca

SEQ ID NO: 1439074 - RNA, 18 nt, Pseudomonas aeruginosa PA01
gcucacgcaccucgucga

SEQ ID NO: 1439075 - RNA, 14 nt, Pseudomonas aeruginosa PA01
gcucaccucgaagg

SEQ ID NO: 1439076 - RNA, 19 nt, Pseudomonas aeruginosa PA01
gcucaccgguagaggggga

SEQ ID NO: 1439077 - RNA, 19 nt, Pseudomonas aeruginosa PA01
gcucaccggucgagaggga

SEQ ID NO: 1439078 - RNA, 17 nt, Pseudomonas aeruginosa PA01
gcgcuuuuuucuugccg

SEQ ID NO: 1439079 - RNA, 14 nt, Pseudomonas aeruginosa PA01
gcggaaaacgccgc

SEQ ID NO: 1439080 - RNA, 19 nt, Pseudomonas aeruginosa PA01
gcggaaaacgccgcgaagc

SEQ ID NO: 1439081 - RNA, 20 nt, Pseudomonas aeruginosa PA01
gcggaaacccgugguccgcc

SEQ ID NO: 1439082 - RNA, 22 nt, Pseudomonas aeruginosa PA01
gcggaaacccgugguccgccag

SEQ ID NO: 1439083 - RNA, 23 nt, Pseudomonas aeruginosa PA01
gcggaaacccgugguccgccagc

SEQ ID NO: 1439084 - RNA, 22 nt, Pseudomonas aeruginosa PA01
gcggaaacccuuccagccgccc

SEQ ID NO: 1439085 - RNA, 17 nt, Pseudomonas aeruginosa PA01
gcggaaaccgcggccgg

SEQ ID NO: 1439086 - RNA, 19 nt, Pseudomonas aeruginosa PA01
gcggaaaccgcggccggcu

SEQ ID NO: 1439087 - RNA, 23 nt, Pseudomonas aeruginosa PA01
gcggaaaccugugcugcgcgccg

SEQ ID NO: 1439088 - RNA, 18 nt, Pseudomonas aeruginosa PA01
gcggaaaugaaaaaggcc

SEQ ID NO: 1439089 - RNA, 18 nt, Pseudomonas aeruginosa PA01
gcgcuuucaucaggcgcu

SEQ ID NO: 1439090 - RNA, 13 nt, Pseudomonas aeruginosa PA01
gcgcuuucccgcu

SEQ ID NO: 1439091 - RNA, 19 nt, Pseudomonas aeruginosa PA01
gcgcuuucgagaaagcgca

SEQ ID NO: 1439092 - RNA, 18 nt, Pseudomonas aeruginosa PA01
gcgcuuuuccucgaccca

SEQ ID NO: 1439093 - RNA, 18 nt, Pseudomonas aeruginosa PA01
gcgcuugcgaucgaagaa

SEQ ID NO: 1439094 - RNA, 14 nt, Pseudomonas aeruginosa PA01
gcgcuugccgcgcc

SEQ ID NO: 1439095 - RNA, 15 nt, Pseudomonas aeruginosa PA01
gcgcuugccgcgccc

SEQ ID NO: 1439096 - RNA, 17 nt, Pseudomonas aeruginosa PA01
gcgcuugccgcgcccgg

SEQ ID NO: 1439097 - RNA, 17 nt, Pseudomonas aeruginosa PA01
gcgcuugccggccgcca

SEQ ID NO: 1439098 - RNA, 20 nt, Pseudomonas aeruginosa PA01
gcgcuugccggccgccagca

SEQ ID NO: 1439099 - RNA, 21 nt, Pseudomonas aeruginosa PA01
gcgcuugccggccgccagcag

SEQ ID NO: 1439100 - RNA, 22 nt, Pseudomonas aeruginosa PA01
gcgcuugccgucgcggaagccg

SEQ ID NO: 1439101 - RNA, 20 nt, Pseudomonas aeruginosa PA01
gcgcuugccuuccugggcgu

SEQ ID NO: 1439102 - RNA, 16 nt, Pseudomonas aeruginosa PA01
gcgcuugcgguagucc

SEQ ID NO: 1439103 - RNA, 18 nt, Pseudomonas aeruginosa PA01
gcgcuugcugccauggcg

SEQ ID NO: 1439104 - RNA, 20 nt, Pseudomonas aeruginosa PA01
gcgcuugcugccauggcggc

SEQ ID NO: 1439105 - RNA, 22 nt, Pseudomonas aeruginosa PA01
gcgcuugcugccauggcggcgg

SEQ ID NO: 1439106 - RNA, 16 nt, Pseudomonas aeruginosa PA01
gcgcuugcuggcgcga

SEQ ID NO: 1439107 - RNA, 14 nt, Pseudomonas aeruginosa PA01
gcgcuuggacagcu

SEQ ID NO: 1439108 - RNA, 22 nt, Pseudomonas aeruginosa PA01
gcgcuuguagcccaggggcacg

SEQ ID NO: 1439109 - RNA, 16 nt, Pseudomonas aeruginosa PA01
gcgcuuguccgagacc

SEQ ID NO: 1439110 - RNA, 19 nt, Pseudomonas aeruginosa PA01
gcgcuuguccgagaccggc

SEQ ID NO: 1439111 - RNA, 20 nt, Pseudomonas aeruginosa PA01
gcgcuuguccgagaccggca

SEQ ID NO: 1439112 - RNA, 23 nt, Pseudomonas aeruginosa PA01
gcgcuuguccuccagcugcgccu

SEQ ID NO: 1439113 - RNA, 14 nt, Pseudomonas aeruginosa PA01
gcggaacucgauga

SEQ ID NO: 1439114 - RNA, 16 nt, Pseudomonas aeruginosa PA01
gcggaacggcucgcgg

SEQ ID NO: 1439115 - RNA, 20 nt, Pseudomonas aeruginosa PA01
gcggaacggcucgcggguca

SEQ ID NO: 1439116 - RNA, 19 nt, Pseudomonas aeruginosa PA01
gcggaacgggacgccuggc

SEQ ID NO: 1439117 - RNA, 16 nt, Pseudomonas aeruginosa PA01
gcggaacaucgcccgg

SEQ ID NO: 1439118 - RNA, 22 nt, Pseudomonas aeruginosa PA01
gcggaacgaaggacaggucgcg

SEQ ID NO: 1439119 - RNA, 19 nt, Pseudomonas aeruginosa PA01
gcggaagaauaccgccagc

SEQ ID NO: 1439120 - RNA, 20 nt, Pseudomonas aeruginosa PA01
gcggaagaauaccgccagcu

SEQ ID NO: 1439121 - RNA, 19 nt, Pseudomonas aeruginosa PA01
gcggaagaaucgcagccau

SEQ ID NO: 1439122 - RNA, 23 nt, Pseudomonas aeruginosa PA01
gcggaagacgaaguugagcaccg

SEQ ID NO: 1439123 - RNA, 15 nt, Pseudomonas aeruginosa PA01
gcggaagcacggcuc

SEQ ID NO: 1439124 - RNA, 23 nt, Pseudomonas aeruginosa PA01
gcggaagcacggcucggcgagga

SEQ ID NO: 1439125 - RNA, 20 nt, Pseudomonas aeruginosa PA01
gcggaagcccagcaggucga

SEQ ID NO: 1439126 - RNA, 18 nt, Pseudomonas aeruginosa PA01
gcggaacuugcgccgacc

SEQ ID NO: 1439127 - RNA, 15 nt, Pseudomonas aeruginosa PA01
gcggaacuugucgcc

SEQ ID NO: 1439128 - RNA, 16 nt, Pseudomonas aeruginosa PA01
gcggaacuugucgccg

SEQ ID NO: 1439129 - RNA, 17 nt, Pseudomonas aeruginosa PA01
gcggaacuugucgccgc

SEQ ID NO: 1439130 - RNA, 16 nt, Pseudomonas aeruginosa PA01
gcggaacaccgccugg

SEQ ID NO: 1439131 - RNA, 17 nt, Pseudomonas aeruginosa PA01
gcggacaacccggcgcu

SEQ ID NO: 1439132 - RNA, 23 nt, Pseudomonas aeruginosa PA01
gcggacaacccggcgcuggccgc

SEQ ID NO: 1439133 - RNA, 14 nt, Pseudomonas aeruginosa PA01
gcggacaaccgccg

SEQ ID NO: 1439134 - RNA, 20 nt, Pseudomonas aeruginosa PA01
gcggaauccuucgcggcggc

SEQ ID NO: 1439135 - RNA, 14 nt, Pseudomonas aeruginosa PA01
gcggaagucggcgg

SEQ ID NO: 1439136 - RNA, 19 nt, Pseudomonas aeruginosa PA01
gcggaauaacucagcauca

SEQ ID NO: 1439137 - RNA, 14 nt, Pseudomonas aeruginosa PA01
gcggaaggucaggu

SEQ ID NO: 1439138 - RNA, 16 nt, Pseudomonas aeruginosa PA01
gcggaaggugccuucg

SEQ ID NO: 1439139 - RNA, 20 nt, Pseudomonas aeruginosa PA01
gcggaaguaggcggcggagu

SEQ ID NO: 1439140 - RNA, 16 nt, Pseudomonas aeruginosa PA01
gcggaagugcgccggu

SEQ ID NO: 1439141 - RNA, 19 nt, Pseudomonas aeruginosa PA01
gcggaagugcgccgguugc

SEQ ID NO: 1439142 - RNA, 20 nt, Pseudomonas aeruginosa PA01
gcggaagugcggggugaucu

SEQ ID NO: 1439143 - RNA, 20 nt, Pseudomonas aeruginosa PA01
gcggaaggcccgcgagccgc

SEQ ID NO: 1439144 - RNA, 23 nt, Pseudomonas aeruginosa PA01
gcggaaggcccgcgagccgcgca

SEQ ID NO: 1439145 - RNA, 13 nt, Pseudomonas aeruginosa PA01
gcggaaggcggcg

SEQ ID NO: 1439146 - RNA, 14 nt, Pseudomonas aeruginosa PA01
gcggaaggcggcga

SEQ ID NO: 1439147 - RNA, 21 nt, Pseudomonas aeruginosa PA01
gcggaagccgggaagccgcuc

SEQ ID NO: 1439148 - RNA, 19 nt, Pseudomonas aeruginosa PA01
gcggaagccgucggcgauc

SEQ ID NO: 1439149 - RNA, 20 nt, Pseudomonas aeruginosa PA01
gcggaagccgugcaacuggg

SEQ ID NO: 1439150 - RNA, 14 nt, Pseudomonas aeruginosa PA01
gcggaagcggcaau

SEQ ID NO: 1439151 - RNA, 24 nt, Pseudomonas aeruginosa PA01
gcggaagcgcagccauucgccgcg

SEQ ID NO: 1439152 - RNA, 15 nt, Pseudomonas aeruginosa PA01
gcgcugggcgccgau

SEQ ID NO: 1439153 - RNA, 16 nt, Pseudomonas aeruginosa PA01
gcgcugggcgccgauu

SEQ ID NO: 1439154 - RNA, 14 nt, Pseudomonas aeruginosa PA01
gcgcuggcgccagu

SEQ ID NO: 1439155 - RNA, 19 nt, Pseudomonas aeruginosa PA01
gcgcugggcggcuggccga

SEQ ID NO: 1439156 - RNA, 13 nt, Pseudomonas aeruginosa PA01
gcgcugggcgcag

SEQ ID NO: 1439157 - RNA, 14 nt, Pseudomonas aeruginosa PA01
gcgcugggcgcagc

SEQ ID NO: 1439158 - RNA, 14 nt, Pseudomonas aeruginosa PA01
gcgcuggcgccgau

SEQ ID NO: 1439159 - RNA, 18 nt, Pseudomonas aeruginosa PA01
gcgcuggcgcuguaggcg

SEQ ID NO: 1439160 - RNA, 14 nt, Pseudomonas aeruginosa PA01
gcgcuggcgcggau

SEQ ID NO: 1439161 - RNA, 20 nt, Pseudomonas aeruginosa PA01
gcgcugguagcgcuccagcu

SEQ ID NO: 1439162 - RNA, 20 nt, Pseudomonas aeruginosa PA01
gcgcuggucguucagugcca

SEQ ID NO: 1439163 - RNA, 24 nt, Pseudomonas aeruginosa PA01
gcgcuggucucuuccagcaugcuc

SEQ ID NO: 1439164 - RNA, 13 nt, Pseudomonas aeruginosa PA01
gcgcuggugaucg

SEQ ID NO: 1439165 - RNA, 17 nt, Pseudomonas aeruginosa PA01
gcgcuggugcugcucca

SEQ ID NO: 1439166 - RNA, 16 nt, Pseudomonas aeruginosa PA01
gcgcugguugcccagg

SEQ ID NO: 1439167 - RNA, 14 nt, Pseudomonas aeruginosa PA01
gcgcugguuggcga

SEQ ID NO: 1439168 - RNA, 20 nt, Pseudomonas aeruginosa PA01
gcgcugguuuagcucggcga

SEQ ID NO: 1439169 - RNA, 15 nt, Pseudomonas aeruginosa PA01
gcgcugguccagcac

SEQ ID NO: 1439170 - RNA, 23 nt, Pseudomonas aeruginosa PA01
gcgcugguccagcacgcuggcga

SEQ ID NO: 1439171 - RNA, 20 nt, Pseudomonas aeruginosa PA01
gcgcugguccuucagcuggu

SEQ ID NO: 1439172 - RNA, 16 nt, Pseudomonas aeruginosa PA01
gcgcugguaccugccg

SEQ ID NO: 1439173 - RNA, 18 nt, Pseudomonas aeruginosa PA01
gcgcugguaccugccggc

SEQ ID NO: 1439174 - RNA, 19 nt, Pseudomonas aeruginosa PA01
gcgcugguaccugccggca

SEQ ID NO: 1439175 - RNA, 20 nt, Pseudomonas aeruginosa PA01
gcgcugguaccugccggcac

SEQ ID NO: 1439176 - RNA, 16 nt, Pseudomonas aeruginosa PA01
gcgcuugaacgcgcgc

SEQ ID NO: 1439177 - RNA, 16 nt, Pseudomonas aeruginosa PA01
gcgcuugaagccggcg

SEQ ID NO: 1439178 - RNA, 17 nt, Pseudomonas aeruginosa PA01
gcgcuugaagccggcgu

SEQ ID NO: 1439179 - RNA, 12 nt, Pseudomonas aeruginosa PA01
gcgcuugagcag

SEQ ID NO: 1439180 - RNA, 18 nt, Pseudomonas aeruginosa PA01
gcgcuugagcagccaggc

SEQ ID NO: 1439181 - RNA, 19 nt, Pseudomonas aeruginosa PA01
gcgcuugagcagccaggcg

SEQ ID NO: 1439182 - RNA, 20 nt, Pseudomonas aeruginosa PA01
gcgcuugagcagccaggcga

SEQ ID NO: 1439183 - RNA, 18 nt, Pseudomonas aeruginosa PA01
gcgcuucuugucgucgga

SEQ ID NO: 1439184 - RNA, 20 nt, Pseudomonas aeruginosa PA01
gcgcuucucgacguaggcgg

SEQ ID NO: 1439185 - RNA, 16 nt, Pseudomonas aeruginosa PA01
gcgcuucugcaggccg

SEQ ID NO: 1439186 - RNA, 21 nt, Pseudomonas aeruginosa PA01
gcgcuucagauaacgucgcag

SEQ ID NO: 1439187 - RNA, 18 nt, Pseudomonas aeruginosa PA01
gcgcuucauccugcgcgc

SEQ ID NO: 1439188 - RNA, 21 nt, Pseudomonas aeruginosa PA01
gcgcuuccaccgccugcccca

SEQ ID NO: 1439189 - RNA, 17 nt, Pseudomonas aeruginosa PA01
gcgcuuccgcaucggcc

SEQ ID NO: 1439190 - RNA, 13 nt, Pseudomonas aeruginosa PA01
gcgcuuccggcag

SEQ ID NO: 1439191 - RNA, 22 nt, Pseudomonas aeruginosa PA01
gcgcuuccaggguagcgccgcg

SEQ ID NO: 1439192 - RNA, 13 nt, Pseudomonas aeruginosa PA01
gcgcuucgcgcag

SEQ ID NO: 1439193 - RNA, 14 nt, Pseudomonas aeruginosa PA01
gcgcuucgcgcagc

SEQ ID NO: 1439194 - RNA, 16 nt, Pseudomonas aeruginosa PA01
gcgcuucgcgcagcuc

SEQ ID NO: 1439195 - RNA, 22 nt, Pseudomonas aeruginosa PA01
gcgcuucgcgcagcucggccaa

SEQ ID NO: 1439196 - RNA, 16 nt, Pseudomonas aeruginosa PA01
gcgcuguugccgcgcu

SEQ ID NO: 1439197 - RNA, 17 nt, Pseudomonas aeruginosa PA01
gcgcuguuccgccgugg

SEQ ID NO: 1439198 - RNA, 18 nt, Pseudomonas aeruginosa PA01
gcgcuguuccgccguggg

SEQ ID NO: 1439199 - RNA, 18 nt, Pseudomonas aeruginosa PA01
gcgcuguuugcggcgcag

SEQ ID NO: 1439200 - RNA, 14 nt, Pseudomonas aeruginosa PA01
gcgcugugcacggu

SEQ ID NO: 1439201 - RNA, 20 nt, Pseudomonas aeruginosa PA01
gcgcugucgcccgggcgcca

SEQ ID NO: 1439202 - RNA, 15 nt, Pseudomonas aeruginosa PA01
gcgcugucgccgguc

SEQ ID NO: 1439203 - RNA, 15 nt, Pseudomonas aeruginosa PA01
gcgcugucucgccag

SEQ ID NO: 1439204 - RNA, 17 nt, Pseudomonas aeruginosa PA01
gcgcuguccuguggcgc

SEQ ID NO: 1439205 - RNA, 15 nt, Pseudomonas aeruginosa PA01
gcgcuguagccggcg

SEQ ID NO: 1439206 - RNA, 20 nt, Pseudomonas aeruginosa PA01
gcgcuguagccggcgccguc

SEQ ID NO: 1439207 - RNA, 20 nt, Pseudomonas aeruginosa PA01
gcgcuguaggcgagcagcgg

SEQ ID NO: 1439208 - RNA, 23 nt, Pseudomonas aeruginosa PA01
gcgcuguaggcgagcagcggcac

SEQ ID NO: 1439209 - RNA, 15 nt, Pseudomonas aeruginosa PA01
gcgcuggccgagcug

SEQ ID NO: 1439210 - RNA, 12 nt, Pseudomonas aeruginosa PA01
gcgcuggccggc

SEQ ID NO: 1439211 - RNA, 13 nt, Pseudomonas aeruginosa PA01
gcgcuggccggca

SEQ ID NO: 1439212 - RNA, 15 nt, Pseudomonas aeruginosa PA01
gcgcuggccgcgcga

SEQ ID NO: 1439213 - RNA, 22 nt, Pseudomonas aeruginosa PA01
gcgcuggccgcgcgaccgcggc

SEQ ID NO: 1439214 - RNA, 18 nt, Pseudomonas aeruginosa PA01
gcgcuggcgaucaccagg

SEQ ID NO: 1439215 - RNA, 23 nt, Pseudomonas aeruginosa PA01
gcgcuggcgaucaccagggugcg

SEQ ID NO: 1439216 - RNA, 13 nt, Pseudomonas aeruginosa PA01
gcgcuggccagcg

SEQ ID NO: 1439217 - RNA, 15 nt, Pseudomonas aeruginosa PA01
gcgcuggccagguag

SEQ ID NO: 1439218 - RNA, 14 nt, Pseudomonas aeruginosa PA01
gcgcuggccagcgc

SEQ ID NO: 1439219 - RNA, 15 nt, Pseudomonas aeruginosa PA01
gcgcuggccagcgcu

SEQ ID NO: 1439220 - RNA, 16 nt, Pseudomonas aeruginosa PA01
gcgcuggccagcgcuu

SEQ ID NO: 1439221 - RNA, 17 nt, Pseudomonas aeruginosa PA01
gcgcuggaguaucgccc

SEQ ID NO: 1439222 - RNA, 19 nt, Pseudomonas aeruginosa PA01
gcgcuggaugcccuccugg

SEQ ID NO: 1439223 - RNA, 22 nt, Pseudomonas aeruginosa PA01
gcgcuggcagguugcacggccg

SEQ ID NO: 1439224 - RNA, 23 nt, Pseudomonas aeruginosa PA01
gcgcuggcagguugcacggccgg

SEQ ID NO: 1439225 - RNA, 16 nt, Pseudomonas aeruginosa PA01
gcgcugcucgaccacc

SEQ ID NO: 1439226 - RNA, 20 nt, Pseudomonas aeruginosa PA01
gcgcugcgguaccagcgcac

SEQ ID NO: 1439227 - RNA, 22 nt, Pseudomonas aeruginosa PA01
gcgcugcgguaccagcgcacca

SEQ ID NO: 1439228 - RNA, 17 nt, Pseudomonas aeruginosa PA01
gcgcugcguggguagcc

SEQ ID NO: 1439229 - RNA, 22 nt, Pseudomonas aeruginosa PA01
gcgcugcguggguagccgccca

SEQ ID NO: 1439230 - RNA, 18 nt, Pseudomonas aeruginosa PA01
gcgcugcgcccgcucgac

SEQ ID NO: 1439231 - RNA, 22 nt, Pseudomonas aeruginosa PA01
gcgcugcggaagaaacugcggu

SEQ ID NO: 1439232 - RNA, 21 nt, Pseudomonas aeruginosa PA01
gcgcugcggcaggguggcgca

SEQ ID NO: 1439233 - RNA, 12 nt, Pseudomonas aeruginosa PA01
gcgcugcgcggc

SEQ ID NO: 1439234 - RNA, 15 nt, Pseudomonas aeruginosa PA01
gcgcugcgcggccug

SEQ ID NO: 1439235 - RNA, 21 nt, Pseudomonas aeruginosa PA01
gcgcugcgcggccugcgccgg

SEQ ID NO: 1439236 - RNA, 20 nt, Pseudomonas aeruginosa PA01
gcgcugcgcggcgucggcga

SEQ ID NO: 1439237 - RNA, 20 nt, Pseudomonas aeruginosa PA01
gcgcugcugccauccgcgcc

SEQ ID NO: 1439238 - RNA, 15 nt, Pseudomonas aeruginosa PA01
gcgcugcugggcggc

SEQ ID NO: 1439239 - RNA, 17 nt, Pseudomonas aeruginosa PA01
gcgcugcugggcggcga

SEQ ID NO: 1439240 - RNA, 21 nt, Pseudomonas aeruginosa PA01
gcgcugcugguagugcuggcg

SEQ ID NO: 1439241 - RNA, 14 nt, Pseudomonas aeruginosa PA01
gcgcuggaccaugg

SEQ ID NO: 1439242 - RNA, 17 nt, Pseudomonas aeruginosa PA01
gcgcuggaccauggccg

SEQ ID NO: 1439243 - RNA, 20 nt, Pseudomonas aeruginosa PA01
gcgcuggaccauggccggcg

SEQ ID NO: 1439244 - RNA, 13 nt, Pseudomonas aeruginosa PA01
gcgcuggacccgc

SEQ ID NO: 1439245 - RNA, 17 nt, Pseudomonas aeruginosa PA01
gcgcuggacccgcaccu

SEQ ID NO: 1439246 - RNA, 15 nt, Pseudomonas aeruginosa PA01
gcgcuggaccuggcc

SEQ ID NO: 1439247 - RNA, 16 nt, Pseudomonas aeruginosa PA01
gcgcugccgaucagcc

SEQ ID NO: 1439248 - RNA, 12 nt, Pseudomonas aeruginosa PA01
gcgcugccggcc

SEQ ID NO: 1439249 - RNA, 15 nt, Pseudomonas aeruginosa PA01
gcgcugccggccagg

SEQ ID NO: 1439250 - RNA, 22 nt, Pseudomonas aeruginosa PA01
gcgcugccccuggcucaggcac

SEQ ID NO: 1439251 - RNA, 16 nt, Pseudomonas aeruginosa PA01
gcgcugcccggcgcga

SEQ ID NO: 1439252 - RNA, 21 nt, Pseudomonas aeruginosa PA01
gcgcugcccggcgcgacgcuc

SEQ ID NO: 1439253 - RNA, 22 nt, Pseudomonas aeruginosa PA01
gcgcugccuucgaagccggcac

SEQ ID NO: 1439254 - RNA, 12 nt, Pseudomonas aeruginosa PA01
gcgcugccugca

SEQ ID NO: 1439255 - RNA, 18 nt, Pseudomonas aeruginosa PA01
gcgcugccugcaccgggc

SEQ ID NO: 1439256 - RNA, 17 nt, Pseudomonas aeruginosa PA01
gcgcugcgaaucgucgc

SEQ ID NO: 1439257 - RNA, 18 nt, Pseudomonas aeruginosa PA01
gcgcugcgaaucgucgcc

SEQ ID NO: 1439258 - RNA, 13 nt, Pseudomonas aeruginosa PA01
gcgcugcgccagg

SEQ ID NO: 1439259 - RNA, 14 nt, Pseudomonas aeruginosa PA01
gcgcugcgccaggc

SEQ ID NO: 1439260 - RNA, 15 nt, Pseudomonas aeruginosa PA01
gcgcugcgccaggcc

SEQ ID NO: 1439261 - RNA, 15 nt, Pseudomonas aeruginosa PA01
gcgcugcaucggcgc

SEQ ID NO: 1439262 - RNA, 16 nt, Pseudomonas aeruginosa PA01
gcgcugcaucggcgcg

SEQ ID NO: 1439263 - RNA, 20 nt, Pseudomonas aeruginosa PA01
gcgcugcaucggcgcgccga

SEQ ID NO: 1439264 - RNA, 22 nt, Pseudomonas aeruginosa PA01
gcgcugcaucggcgcgccgaag

SEQ ID NO: 1439265 - RNA, 21 nt, Pseudomonas aeruginosa PA01
gcgcugccacaguuucauggu

SEQ ID NO: 1439266 - RNA, 13 nt, Pseudomonas aeruginosa PA01
gcgcugccagcgc

SEQ ID NO: 1439267 - RNA, 14 nt, Pseudomonas aeruginosa PA01
gcgcugccagcgcc

SEQ ID NO: 1439268 - RNA, 15 nt, Pseudomonas aeruginosa PA01
gcgcugccagcgccg

SEQ ID NO: 1439269 - RNA, 19 nt, Pseudomonas aeruginosa PA01
gcgcugccagcgccgccgc

SEQ ID NO: 1439270 - RNA, 23 nt, Pseudomonas aeruginosa PA01
gcgcugccagcgccgccgcgugg

SEQ ID NO: 1439271 - RNA, 23 nt, Pseudomonas aeruginosa PA01
gcgcugaggaagagcagcgcggc

SEQ ID NO: 1439272 - RNA, 22 nt, Pseudomonas aeruginosa PA01
gcgcugcaagggcacuucgucc

SEQ ID NO: 1439273 - RNA, 19 nt, Pseudomonas aeruginosa PA01
gcgcugcaaucgcugccgg

SEQ ID NO: 1439274 - RNA, 19 nt, Pseudomonas aeruginosa PA01
gcgcugaucacgaucggca

SEQ ID NO: 1439275 - RNA, 21 nt, Pseudomonas aeruginosa PA01
gcgcugaucacgaucggcacc

SEQ ID NO: 1439276 - RNA, 22 nt, Pseudomonas aeruginosa PA01
gcgcugaucacgaucggcacca

SEQ ID NO: 1439277 - RNA, 19 nt, Pseudomonas aeruginosa PA01
gcgcugaccgcucccaggc

SEQ ID NO: 1439278 - RNA, 17 nt, Pseudomonas aeruginosa PA01
gcgcugacgaaacggug

SEQ ID NO: 1439279 - RNA, 17 nt, Pseudomonas aeruginosa PA01
gcgcugaccucgauggc

SEQ ID NO: 1439280 - RNA, 14 nt, Pseudomonas aeruginosa PA01
gcgcugagcgccuc

SEQ ID NO: 1439281 - RNA, 15 nt, Pseudomonas aeruginosa PA01
gcgcugagcgccucg

SEQ ID NO: 1439282 - RNA, 23 nt, Pseudomonas aeruginosa PA01
gcgcugagcgccucgaucgccuc

SEQ ID NO: 1439283 - RNA, 13 nt, Pseudomonas aeruginosa PA01
gcgcugagcgcgg

SEQ ID NO: 1439284 - RNA, 14 nt, Pseudomonas aeruginosa PA01
gcgcugagcgcggu

SEQ ID NO: 1439285 - RNA, 14 nt, Pseudomonas aeruginosa PA01
gcgcugagcggaaa

SEQ ID NO: 1439286 - RNA, 14 nt, Pseudomonas aeruginosa PA01
gcgcugaagcggcc

SEQ ID NO: 1439287 - RNA, 17 nt, Pseudomonas aeruginosa PA01
gcgcugaacaagcccug

SEQ ID NO: 1439288 - RNA, 18 nt, Pseudomonas aeruginosa PA01
gcgcugaacaagcccugg

SEQ ID NO: 1439289 - RNA, 19 nt, Pseudomonas aeruginosa PA01
gcgcugaacaagcccuggu

SEQ ID NO: 1439290 - RNA, 22 nt, Pseudomonas aeruginosa PA01
gcgcugaacaagcccugguggu

SEQ ID NO: 1439291 - RNA, 21 nt, Pseudomonas aeruginosa PA01
gcgcugaacagcuggcgcguc

SEQ ID NO: 1439292 - RNA, 22 nt, Pseudomonas aeruginosa PA01
gcgcugaacagcuggcgcgucg

SEQ ID NO: 1439293 - RNA, 16 nt, Pseudomonas aeruginosa PA01
gcgcucuggccgcgcu

SEQ ID NO: 1439294 - RNA, 13 nt, Pseudomonas aeruginosa PA01
gcgcucuucaccg

SEQ ID NO: 1439295 - RNA, 22 nt, Pseudomonas aeruginosa PA01
gcgcucuucacuuccagcugcc

SEQ ID NO: 1439296 - RNA, 18 nt, Pseudomonas aeruginosa PA01
gcgcucuucagcacgccc

SEQ ID NO: 1439297 - RNA, 14 nt, Pseudomonas aeruginosa PA01
gcgcucggggucgu

SEQ ID NO: 1439298 - RNA, 23 nt, Pseudomonas aeruginosa PA01
gcgcucgguccagaucgccaccc

SEQ ID NO: 1439299 - RNA, 19 nt, Pseudomonas aeruginosa PA01
gcgcucggggauguccgcc

SEQ ID NO: 1439300 - RNA, 18 nt, Pseudomonas aeruginosa PA01
gcgcucggcgaggccggc

SEQ ID NO: 1439301 - RNA, 20 nt, Pseudomonas aeruginosa PA01
gcgcucggcgaggccggcga

SEQ ID NO: 1439302 - RNA, 19 nt, Pseudomonas aeruginosa PA01
gcgcucggcgacgcggaua

SEQ ID NO: 1439303 - RNA, 12 nt, Pseudomonas aeruginosa PA01
gcgcucggcgag

SEQ ID NO: 1439304 - RNA, 13 nt, Pseudomonas aeruginosa PA01
gcgcucggccugg

SEQ ID NO: 1439305 - RNA, 17 nt, Pseudomonas aeruginosa PA01
gcgcucggccuggugca

SEQ ID NO: 1439306 - RNA, 23 nt, Pseudomonas aeruginosa PA01
gcgcucggccuggugcaccuggc

SEQ ID NO: 1439307 - RNA, 21 nt, Pseudomonas aeruginosa PA01
gcgcucggcggccucgcgggu

SEQ ID NO: 1439308 - RNA, 14 nt, Pseudomonas aeruginosa PA01
gcgcucggcggcgc

SEQ ID NO: 1439309 - RNA, 15 nt, Pseudomonas aeruginosa PA01
gcgcucggcggcgcg

SEQ ID NO: 1439310 - RNA, 19 nt, Pseudomonas aeruginosa PA01
gcgcucggcggcgcgcagc

SEQ ID NO: 1439311 - RNA, 17 nt, Pseudomonas aeruginosa PA01
gcgcucggcggucaggc

SEQ ID NO: 1439312 - RNA, 18 nt, Pseudomonas aeruginosa PA01
gcgcucggcggucaggcc

SEQ ID NO: 1439313 - RNA, 21 nt, Pseudomonas aeruginosa PA01
gcgcucggcuccagccaggcc

SEQ ID NO: 1439314 - RNA, 20 nt, Pseudomonas aeruginosa PA01
gcgcucucgaacaccaggcg

SEQ ID NO: 1439315 - RNA, 13 nt, Pseudomonas aeruginosa PA01
gcgcucucgccgc

SEQ ID NO: 1439316 - RNA, 16 nt, Pseudomonas aeruginosa PA01
gcgcucucgccgccuu

SEQ ID NO: 1439317 - RNA, 23 nt, Pseudomonas aeruginosa PA01
gcgcucguugcgccgcuccuggc

SEQ ID NO: 1439318 - RNA, 22 nt, Pseudomonas aeruginosa PA01
gcgcucguugauccgcguggcg

SEQ ID NO: 1439319 - RNA, 15 nt, Pseudomonas aeruginosa PA01
gcgcucguagaacuc

SEQ ID NO: 1439320 - RNA, 17 nt, Pseudomonas aeruginosa PA01
gcgcucguagccggcgc

SEQ ID NO: 1439321 - RNA, 18 nt, Pseudomonas aeruginosa PA01
gcgcucguagccggcgcg

SEQ ID NO: 1439322 - RNA, 23 nt, Pseudomonas aeruginosa PA01
gcgcucguagccggcgcggcgca

SEQ ID NO: 1439323 - RNA, 13 nt, Pseudomonas aeruginosa PA01
gcgcucgcgggcc

SEQ ID NO: 1439324 - RNA, 18 nt, Pseudomonas aeruginosa PA01
gcgcucgcgggccgccug

SEQ ID NO: 1439325 - RNA, 19 nt, Pseudomonas aeruginosa PA01
gcgcucggauuccagcgcg

SEQ ID NO: 1439326 - RNA, 12 nt, Pseudomonas aeruginosa PA01
gcgcucgcugcg

SEQ ID NO: 1439327 - RNA, 16 nt, Pseudomonas aeruginosa PA01
gcgcucgcugcgugcg

SEQ ID NO: 1439328 - RNA, 14 nt, Pseudomonas aeruginosa PA01
gcgcucgcugucgc

SEQ ID NO: 1439329 - RNA, 15 nt, Pseudomonas aeruginosa PA01
gcgcucgcugucgcu

SEQ ID NO: 1439330 - RNA, 12 nt, Pseudomonas aeruginosa PA01
gcgcucggccac

SEQ ID NO: 1439331 - RNA, 15 nt, Pseudomonas aeruginosa PA01
gcgcucggccgccug

SEQ ID NO: 1439332 - RNA, 14 nt, Pseudomonas aeruginosa PA01
gcgcucggccaggu

SEQ ID NO: 1439333 - RNA, 17 nt, Pseudomonas aeruginosa PA01
gcgcucggccaggucgc

SEQ ID NO: 1439334 - RNA, 18 nt, Pseudomonas aeruginosa PA01
gcgcucggccaggucgcg

SEQ ID NO: 1439335 - RNA, 21 nt, Pseudomonas aeruginosa PA01
gcgcgcaguaggcgcugccgu

SEQ ID NO: 1439336 - RNA, 16 nt, Pseudomonas aeruginosa PA01
gcgcgcauagcaggcc

SEQ ID NO: 1439337 - RNA, 17 nt, Pseudomonas aeruginosa PA01
gcgcgcauagcaggccu

SEQ ID NO: 1439338 - RNA, 14 nt, Pseudomonas aeruginosa PA01
gcgcgcacggucuu

SEQ ID NO: 1439339 - RNA, 17 nt, Pseudomonas aeruginosa PA01
gcgcgcacuuccucggc

SEQ ID NO: 1439340 - RNA, 19 nt, Pseudomonas aeruginosa PA01
gcgcgcacuuccucggcga

SEQ ID NO: 1439341 - RNA, 12 nt, Pseudomonas aeruginosa PA01
gcgcgcagcggu

SEQ ID NO: 1439342 - RNA, 14 nt, Pseudomonas aeruginosa PA01
gcgcgcaggaccag

SEQ ID NO: 1439343 - RNA, 18 nt, Pseudomonas aeruginosa PA01
gcgcgcaggaccagacgc

SEQ ID NO: 1439344 - RNA, 15 nt, Pseudomonas aeruginosa PA01
gcgcgcagggugagc

SEQ ID NO: 1439345 - RNA, 23 nt, Pseudomonas aeruginosa PA01
gcgcgcagggugagcauggcguu

SEQ ID NO: 1439346 - RNA, 13 nt, Pseudomonas aeruginosa PA01
gcgcgcagggcca

SEQ ID NO: 1439347 - RNA, 15 nt, Pseudomonas aeruginosa PA01
gcgcgcagggccagc

SEQ ID NO: 1439348 - RNA, 15 nt, Pseudomonas aeruginosa PA01
gcgcgcagggccgcg

SEQ ID NO: 1439349 - RNA, 14 nt, Pseudomonas aeruginosa PA01
aagccggcggcgcg

SEQ ID NO: 1439350 - RNA, 16 nt, Pseudomonas aeruginosa PA01
aagccggggcaggcau

SEQ ID NO: 1439351 - RNA, 23 nt, Pseudomonas aeruginosa PA01
aagccggggcaggcaugcggccc

SEQ ID NO: 1439352 - RNA, 16 nt, Pseudomonas aeruginosa PA01
aagccgggaagccgcu

SEQ ID NO: 1439353 - RNA, 18 nt, Pseudomonas aeruginosa PA01
aagccggcgcgccccugc

SEQ ID NO: 1439354 - RNA, 22 nt, Pseudomonas aeruginosa PA01
aagccggcgcgccccugcgccc

SEQ ID NO: 1439355 - RNA, 19 nt, Pseudomonas aeruginosa PA01
aagccggcgcaugcgccgg

SEQ ID NO: 1439356 - RNA, 20 nt, Pseudomonas aeruginosa PA01
aagccggcgcaugcgccggc

SEQ ID NO: 1439357 - RNA, 21 nt, Pseudomonas aeruginosa PA01
aagccgcucggcguagccggc

SEQ ID NO: 1439358 - RNA, 16 nt, Pseudomonas aeruginosa PA01
aagccggaggcagcga

SEQ ID NO: 1439359 - RNA, 18 nt, Pseudomonas aeruginosa PA01
aagccggaagcgcucgcg

SEQ ID NO: 1439360 - RNA, 17 nt, Pseudomonas aeruginosa PA01
aagccgcgcccggccuc

SEQ ID NO: 1439361 - RNA, 18 nt, Pseudomonas aeruginosa PA01
aagccgcgccaucggucg

SEQ ID NO: 1439362 - RNA, 20 nt, Pseudomonas aeruginosa PA01
aagccgaugaaauagccggc

SEQ ID NO: 1439363 - RNA, 19 nt, Pseudomonas aeruginosa PA01
aagccgcacuuccaggcgc

SEQ ID NO: 1439364 - RNA, 15 nt, Pseudomonas aeruginosa PA01
gcggcaaguggguca

SEQ ID NO: 1439365 - RNA, 18 nt, Pseudomonas aeruginosa PA01
gcggcaagugggucacgg

SEQ ID NO: 1439366 - RNA, 22 nt, Pseudomonas aeruginosa PA01
aagccgaucaggucgcgcgccu

SEQ ID NO: 1439367 - RNA, 15 nt, Pseudomonas aeruginosa PA01
gcggcaaugcggcga

SEQ ID NO: 1439368 - RNA, 16 nt, Pseudomonas aeruginosa PA01
gcggcaaugcggcgau

SEQ ID NO: 1439369 - RNA, 13 nt, Pseudomonas aeruginosa PA01
gcggcacagcgug

SEQ ID NO: 1439370 - RNA, 17 nt, Pseudomonas aeruginosa PA01
gcggcacagcguggcca

SEQ ID NO: 1439371 - RNA, 18 nt, Pseudomonas aeruginosa PA01
gcggcacagcguggccag

SEQ ID NO: 1439372 - RNA, 20 nt, Pseudomonas aeruginosa PA01
gcggcacagcguggccagcg

SEQ ID NO: 1439373 - RNA, 19 nt, Pseudomonas aeruginosa PA01
aagccuccagcgccgccuc

SEQ ID NO: 1439374 - RNA, 12 nt, Pseudomonas aeruginosa PA01
aagccucgacga

SEQ ID NO: 1439375 - RNA, 22 nt, Pseudomonas aeruginosa PA01
aagccucaggcgcugcgcggcc

SEQ ID NO: 1439376 - RNA, 15 nt, Pseudomonas aeruginosa PA01
aagccguggcgggcc

SEQ ID NO: 1439377 - RNA, 15 nt, Pseudomonas aeruginosa PA01
gcggcaacgacggca

SEQ ID NO: 1439378 - RNA, 13 nt, Pseudomonas aeruginosa PA01
gcggcaacgucag

SEQ ID NO: 1439379 - RNA, 17 nt, Pseudomonas aeruginosa PA01
gcggcaacgucaggcug

SEQ ID NO: 1439380 - RNA, 16 nt, Pseudomonas aeruginosa PA01
aagccgacgccgagca

SEQ ID NO: 1439381 - RNA, 13 nt, Pseudomonas aeruginosa PA01
gcggcaaggccaa

SEQ ID NO: 1439382 - RNA, 22 nt, Pseudomonas aeruginosa PA01
gcggcaaggccaagucggccgc

SEQ ID NO: 1439383 - RNA, 22 nt, Pseudomonas aeruginosa PA01
gcggcaagggcacgugcagcgg

SEQ ID NO: 1439384 - RNA, 23 nt, Pseudomonas aeruginosa PA01
gcggcaagggcacgugcagcggc

SEQ ID NO: 1439385 - RNA, 17 nt, Pseudomonas aeruginosa PA01
gcggcaagggcgucugg

SEQ ID NO: 1439386 - RNA, 19 nt, Pseudomonas aeruginosa PA01
gcggauugacgauggccag

SEQ ID NO: 1439387 - RNA, 15 nt, Pseudomonas aeruginosa PA01
gcggauucaggcgcg

SEQ ID NO: 1439388 - RNA, 16 nt, Pseudomonas aeruginosa PA01
gcggauucaggcgcgc

SEQ ID NO: 1439389 - RNA, 15 nt, Pseudomonas aeruginosa PA01
gcggauucaucggcg

SEQ ID NO: 1439390 - RNA, 23 nt, Pseudomonas aeruginosa PA01
gcggauucaucggcggcaggccg

SEQ ID NO: 1439391 - RNA, 16 nt, Pseudomonas aeruginosa PA01
gcggauuacuccgccg

SEQ ID NO: 1439392 - RNA, 16 nt, Pseudomonas aeruginosa PA01
gcggauuggccgggcc

SEQ ID NO: 1439393 - RNA, 14 nt, Pseudomonas aeruginosa PA01
gcggauuugccgcc

SEQ ID NO: 1439394 - RNA, 15 nt, Pseudomonas aeruginosa PA01
gcggauuugccgccg

SEQ ID NO: 1439395 - RNA, 16 nt, Pseudomonas aeruginosa PA01
gcggauuugccgccga

SEQ ID NO: 1439396 - RNA, 18 nt, Pseudomonas aeruginosa PA01
gcggauuugccgccgagg

SEQ ID NO: 1439397 - RNA, 23 nt, Pseudomonas aeruginosa PA01
gcggauuugccgccgagggcgaa

SEQ ID NO: 1439398 - RNA, 16 nt, Pseudomonas aeruginosa PA01
gcggcaaaggcccggc

SEQ ID NO: 1439399 - RNA, 16 nt, Pseudomonas aeruginosa PA01
gcggcaaagugcgguc

SEQ ID NO: 1439400 - RNA, 14 nt, Pseudomonas aeruginosa PA01
gcggcaucgcguag

SEQ ID NO: 1439401 - RNA, 13 nt, Pseudomonas aeruginosa PA01
gcggcaucggccu

SEQ ID NO: 1439402 - RNA, 14 nt, Pseudomonas aeruginosa PA01
gcggcaucggccug

SEQ ID NO: 1439403 - RNA, 12 nt, Pseudomonas aeruginosa PA01
gcggcaucggcg

SEQ ID NO: 1439404 - RNA, 17 nt, Pseudomonas aeruginosa PA01
gcggcaguccucgccgu

SEQ ID NO: 1439405 - RNA, 14 nt, Pseudomonas aeruginosa PA01
gcggcaucggcgcc

SEQ ID NO: 1439406 - RNA, 16 nt, Pseudomonas aeruginosa PA01
gcggcaucggcgccgc

SEQ ID NO: 1439407 - RNA, 18 nt, Pseudomonas aeruginosa PA01
gcggcaucggcgccgcgc

SEQ ID NO: 1439408 - RNA, 23 nt, Pseudomonas aeruginosa PA01
gcggcagggggucuucgaagguc

SEQ ID NO: 1439409 - RNA, 17 nt, Pseudomonas aeruginosa PA01
gcggcagguagccgccu

SEQ ID NO: 1439410 - RNA, 19 nt, Pseudomonas aeruginosa PA01
gcggcagguagccgccuug

SEQ ID NO: 1439411 - RNA, 15 nt, Pseudomonas aeruginosa PA01
gcggcagguaguggc

SEQ ID NO: 1439412 - RNA, 13 nt, Pseudomonas aeruginosa PA01
gcggcagguggcu

SEQ ID NO: 1439413 - RNA, 18 nt, Pseudomonas aeruginosa PA01
gcggcagguggcuggcca

SEQ ID NO: 1439414 - RNA, 21 nt, Pseudomonas aeruginosa PA01
gcggcagcggugaagguccgc

SEQ ID NO: 1439415 - RNA, 16 nt, Pseudomonas aeruginosa PA01
gcggcagcggcucguc

SEQ ID NO: 1439416 - RNA, 22 nt, Pseudomonas aeruginosa PA01
gcggcagcgucucggcugccgc

SEQ ID NO: 1439417 - RNA, 12 nt, Pseudomonas aeruginosa PA01
gcggcagggcgg

SEQ ID NO: 1439418 - RNA, 13 nt, Pseudomonas aeruginosa PA01
gcggcagcgccag

SEQ ID NO: 1439419 - RNA, 14 nt, Pseudomonas aeruginosa PA01
gcggcagcgccagg

SEQ ID NO: 1439420 - RNA, 19 nt, Pseudomonas aeruginosa PA01
gcggcagcgccaucaggcc

SEQ ID NO: 1439421 - RNA, 14 nt, Pseudomonas aeruginosa PA01
aagccuucgucgau

SEQ ID NO: 1439422 - RNA, 22 nt, Pseudomonas aeruginosa PA01
gcggcagcaggcuguacagcag

SEQ ID NO: 1439423 - RNA, 21 nt, Pseudomonas aeruginosa PA01
gcggcagaucggugcgggcag

SEQ ID NO: 1439424 - RNA, 12 nt, Pseudomonas aeruginosa PA01
gcggcagcagcc

SEQ ID NO: 1439425 - RNA, 20 nt, Pseudomonas aeruginosa PA01
gcggcagcagccaaccgucg

SEQ ID NO: 1439426 - RNA, 11 nt, Pseudomonas aeruginosa PA01
gcggcagaucc

SEQ ID NO: 1439427 - RNA, 22 nt, Pseudomonas aeruginosa PA01
gcggcagaucccaucgcccugc

SEQ ID NO: 1439428 - RNA, 18 nt, Pseudomonas aeruginosa PA01
gcggcagauccgccguga

SEQ ID NO: 1439429 - RNA, 13 nt, Pseudomonas aeruginosa PA01
gcggcagcaccag

SEQ ID NO: 1439430 - RNA, 17 nt, Pseudomonas aeruginosa PA01
gcggcagcaccaggcca

SEQ ID NO: 1439431 - RNA, 17 nt, Pseudomonas aeruginosa PA01
gcggcaccucgauggcg

SEQ ID NO: 1439432 - RNA, 23 nt, Pseudomonas aeruginosa PA01
gcggcacgaccacaucggccagu

SEQ ID NO: 1439433 - RNA, 15 nt, Pseudomonas aeruginosa PA01
gcggcaccgacgccg

SEQ ID NO: 1439434 - RNA, 23 nt, Pseudomonas aeruginosa PA01
gcggcaccgagagcugcaaggcu

SEQ ID NO: 1439435 - RNA, 12 nt, Pseudomonas aeruginosa PA01
gcggcaccagca

SEQ ID NO: 1439436 - RNA, 17 nt, Pseudomonas aeruginosa PA01
gcggcacaggcggcugu

SEQ ID NO: 1439437 - RNA, 14 nt, Pseudomonas aeruginosa PA01
gcggcaccagccag

SEQ ID NO: 1439438 - RNA, 16 nt, Pseudomonas aeruginosa PA01
gcggcaccagccaggu

SEQ ID NO: 1439439 - RNA, 18 nt, Pseudomonas aeruginosa PA01
gcggauauagcuggucaa

SEQ ID NO: 1439440 - RNA, 15 nt, Pseudomonas aeruginosa PA01
gcggauaucgcgccg

SEQ ID NO: 1439441 - RNA, 18 nt, Pseudomonas aeruginosa PA01
gcggauaucgcgccgcga

SEQ ID NO: 1439442 - RNA, 14 nt, Pseudomonas aeruginosa PA01
gcggauaucgcgug

SEQ ID NO: 1439443 - RNA, 17 nt, Pseudomonas aeruginosa PA01
gcggaucaacgccgguc

SEQ ID NO: 1439444 - RNA, 22 nt, Pseudomonas aeruginosa PA01
gcggaucaacuccgccaggcgc

SEQ ID NO: 1439445 - RNA, 23 nt, Pseudomonas aeruginosa PA01
gcggaucaacuccgccaggcgcu

SEQ ID NO: 1439446 - RNA, 15 nt, Pseudomonas aeruginosa PA01
gcggauagccaacca

SEQ ID NO: 1439447 - RNA, 14 nt, Pseudomonas aeruginosa PA01
gcggauagccgcaa

SEQ ID NO: 1439448 - RNA, 18 nt, Pseudomonas aeruginosa PA01
gcggauagcgcgcaggcg

SEQ ID NO: 1439449 - RNA, 20 nt, Pseudomonas aeruginosa PA01
gcggauaagcaagcgcaacg

SEQ ID NO: 1439450 - RNA, 21 nt, Pseudomonas aeruginosa PA01
gcggauaagcaagcgcaacgc

SEQ ID NO: 1439451 - RNA, 14 nt, Pseudomonas aeruginosa PA01
gcggauaacgccag

SEQ ID NO: 1439452 - RNA, 17 nt, Pseudomonas aeruginosa PA01
gcggauaacgccaggac

SEQ ID NO: 1439453 - RNA, 20 nt, Pseudomonas aeruginosa PA01
gcggauaacgccgcuggcgu

SEQ ID NO: 1439454 - RNA, 14 nt, Pseudomonas aeruginosa PA01
gcggauaacgccgg

SEQ ID NO: 1439455 - RNA, 16 nt, Pseudomonas aeruginosa PA01
gcggauaacgccggug

SEQ ID NO: 1439456 - RNA, 17 nt, Pseudomonas aeruginosa PA01
gcggauaacgccggugg

SEQ ID NO: 1439457 - RNA, 19 nt, Pseudomonas aeruginosa PA01
gcggauaacgccugcggcg

SEQ ID NO: 1439458 - RNA, 16 nt, Pseudomonas aeruginosa PA01
gcggauaacgcuaccc

SEQ ID NO: 1439459 - RNA, 19 nt, Pseudomonas aeruginosa PA01
gcggauaacgcuucgcagc

SEQ ID NO: 1439460 - RNA, 20 nt, Pseudomonas aeruginosa PA01
gcggauaacgcuucgcagca

SEQ ID NO: 1439461 - RNA, 13 nt, Pseudomonas aeruginosa PA01
gcggagucgccgg

SEQ ID NO: 1439462 - RNA, 15 nt, Pseudomonas aeruginosa PA01
gcggagucgccgguu

SEQ ID NO: 1439463 - RNA, 16 nt, Pseudomonas aeruginosa PA01
gcggagucgccgguuc

SEQ ID NO: 1439464 - RNA, 20 nt, Pseudomonas aeruginosa PA01
gcggauccccucccgcgcca

SEQ ID NO: 1439465 - RNA, 22 nt, Pseudomonas aeruginosa PA01
gcggauccccucccgcgccagc

SEQ ID NO: 1439466 - RNA, 17 nt, Pseudomonas aeruginosa PA01
gcggaucgagcagcggc

SEQ ID NO: 1439467 - RNA, 20 nt, Pseudomonas aeruginosa PA01
gcggaucgagcagcggcgcc

SEQ ID NO: 1439468 - RNA, 13 nt, Pseudomonas aeruginosa PA01
gcggaucgaucag

SEQ ID NO: 1439469 - RNA, 15 nt, Pseudomonas aeruginosa PA01
gcggaucgaucagcg

SEQ ID NO: 1439470 - RNA, 21 nt, Pseudomonas aeruginosa PA01
gcggaucgaucgaucagccgu

SEQ ID NO: 1439471 - RNA, 17 nt, Pseudomonas aeruginosa PA01
gcggauccacgccuggc

SEQ ID NO: 1439472 - RNA, 21 nt, Pseudomonas aeruginosa PA01
gcggaucagucaggaucggcg

SEQ ID NO: 1439473 - RNA, 19 nt, Pseudomonas aeruginosa PA01
gcggaucaccggcuggccc

SEQ ID NO: 1439474 - RNA, 23 nt, Pseudomonas aeruginosa PA01
gcggaucaccacguaaucgccau

SEQ ID NO: 1439475 - RNA, 12 nt, Pseudomonas aeruginosa PA01
gcggaucagccg

SEQ ID NO: 1439476 - RNA, 16 nt, Pseudomonas aeruginosa PA01
gcggaucagccggccc

SEQ ID NO: 1439477 - RNA, 17 nt, Pseudomonas aeruginosa PA01
gcggaucagccggccca

SEQ ID NO: 1439478 - RNA, 22 nt, Pseudomonas aeruginosa PA01
gcggaugcguugcucgcaccag

SEQ ID NO: 1439479 - RNA, 14 nt, Pseudomonas aeruginosa PA01
gcggaugucgucgc

SEQ ID NO: 1439480 - RNA, 13 nt, Pseudomonas aeruginosa PA01
gcggauguucgcc

SEQ ID NO: 1439481 - RNA, 18 nt, Pseudomonas aeruginosa PA01
gcggauguucgccacgcu

SEQ ID NO: 1439482 - RNA, 21 nt, Pseudomonas aeruginosa PA01
gcggauguucgccacgcugcu

SEQ ID NO: 1439483 - RNA, 20 nt, Pseudomonas aeruginosa PA01
gcggaugucgggcucgacga

SEQ ID NO: 1439484 - RNA, 23 nt, Pseudomonas aeruginosa PA01
gcggauguaguccagcgccgcgc

SEQ ID NO: 1439485 - RNA, 14 nt, Pseudomonas aeruginosa PA01
gcggauggcgaucg

SEQ ID NO: 1439486 - RNA, 17 nt, Pseudomonas aeruginosa PA01
gcggaugacguucccgu

SEQ ID NO: 1439487 - RNA, 23 nt, Pseudomonas aeruginosa PA01
gcggaugcaguugagucgcgcgc

SEQ ID NO: 1439488 - RNA, 18 nt, Pseudomonas aeruginosa PA01
gcggaugcccuggucggc

SEQ ID NO: 1439489 - RNA, 13 nt, Pseudomonas aeruginosa PA01
gcggaugccggcg

SEQ ID NO: 1439490 - RNA, 19 nt, Pseudomonas aeruginosa PA01
gcggaugccggcgcugucu

SEQ ID NO: 1439491 - RNA, 23 nt, Pseudomonas aeruginosa PA01
gcggaugccggcgcugucucgcc

SEQ ID NO: 1439492 - RNA, 16 nt, Pseudomonas aeruginosa PA01
gcggaucucaggaccu

SEQ ID NO: 1439493 - RNA, 17 nt, Pseudomonas aeruginosa PA01
gcggaucucgucgccga

SEQ ID NO: 1439494 - RNA, 19 nt, Pseudomonas aeruginosa PA01
gcggaucucgucgccgacc

SEQ ID NO: 1439495 - RNA, 14 nt, Pseudomonas aeruginosa PA01
gcggaucugcucga

SEQ ID NO: 1439496 - RNA, 15 nt, Pseudomonas aeruginosa PA01
gcggaucgccaacca

SEQ ID NO: 1439497 - RNA, 17 nt, Pseudomonas aeruginosa PA01
gcggaucgcccggcgcu

SEQ ID NO: 1439498 - RNA, 12 nt, Pseudomonas aeruginosa PA01
gcggaucgccgc

SEQ ID NO: 1439499 - RNA, 14 nt, Pseudomonas aeruginosa PA01
gcggaucgccgccu

SEQ ID NO: 1439500 - RNA, 17 nt, Pseudomonas aeruginosa PA01
gcggaucgucgcggcgc

SEQ ID NO: 1439501 - RNA, 19 nt, Pseudomonas aeruginosa PA01
gcggaucgucgcggcgcga

SEQ ID NO: 1439502 - RNA, 13 nt, Pseudomonas aeruginosa PA01
gcggaucggcggu

SEQ ID NO: 1439503 - RNA, 20 nt, Pseudomonas aeruginosa PA01
gcggaccgggcggcgcggcg

SEQ ID NO: 1439504 - RNA, 14 nt, Pseudomonas aeruginosa PA01
gcggaccuccagcc

SEQ ID NO: 1439505 - RNA, 15 nt, Pseudomonas aeruginosa PA01
gcggaccuccagccg

SEQ ID NO: 1439506 - RNA, 22 nt, Pseudomonas aeruginosa PA01
gcggaccuccagccggccaucc

SEQ ID NO: 1439507 - RNA, 15 nt, Pseudomonas aeruginosa PA01
gcggaccuccgccag

SEQ ID NO: 1439508 - RNA, 16 nt, Pseudomonas aeruginosa PA01
gcggaccuccgccagg

SEQ ID NO: 1439509 - RNA, 23 nt, Pseudomonas aeruginosa PA01
gcggaccuccgccaggucgaucc

SEQ ID NO: 1439510 - RNA, 14 nt, Pseudomonas aeruginosa PA01
gcggacgcaggccg

SEQ ID NO: 1439511 - RNA, 21 nt, Pseudomonas aeruginosa PA01
gcggacgcaggccgaccucgg

SEQ ID NO: 1439512 - RNA, 16 nt, Pseudomonas aeruginosa PA01
gcggaccgcaaccggu

SEQ ID NO: 1439513 - RNA, 22 nt, Pseudomonas aeruginosa PA01
gcggaccgcagaaccagacgcu

SEQ ID NO: 1439514 - RNA, 16 nt, Pseudomonas aeruginosa PA01
gcggaccgccucgacc

SEQ ID NO: 1439515 - RNA, 18 nt, Pseudomonas aeruginosa PA01
gcggaccgccucgaccau

SEQ ID NO: 1439516 - RNA, 23 nt, Pseudomonas aeruginosa PA01
gcggaccgccucgaccaucggcg

SEQ ID NO: 1439517 - RNA, 15 nt, Pseudomonas aeruginosa PA01
gcggacccgcgccgg

SEQ ID NO: 1439518 - RNA, 16 nt, Pseudomonas aeruginosa PA01
gcggacacgcaggcgc

SEQ ID NO: 1439519 - RNA, 16 nt, Pseudomonas aeruginosa PA01
gcggaauuccugcucg

SEQ ID NO: 1439520 - RNA, 17 nt, Pseudomonas aeruginosa PA01
gcggaauuccugcucga

SEQ ID NO: 1439521 - RNA, 20 nt, Pseudomonas aeruginosa PA01
gcggaauuccugcucgagau

SEQ ID NO: 1439522 - RNA, 15 nt, Pseudomonas aeruginosa PA01
gcggacaggcagccg

SEQ ID NO: 1439523 - RNA, 23 nt, Pseudomonas aeruginosa PA01
gcggacaggcagccggccaugcu

SEQ ID NO: 1439524 - RNA, 19 nt, Pseudomonas aeruginosa PA01
gcggacauguugcaggguc

SEQ ID NO: 1439525 - RNA, 22 nt, Pseudomonas aeruginosa PA01
gcggacauguugcagggucgcc

SEQ ID NO: 1439526 - RNA, 23 nt, Pseudomonas aeruginosa PA01
gcggacauguugcagggucgccg

SEQ ID NO: 1439527 - RNA, 14 nt, Pseudomonas aeruginosa PA01
gcggagcugcauga

SEQ ID NO: 1439528 - RNA, 23 nt, Pseudomonas aeruginosa PA01
gcggagcuggaaauggcggucgc

SEQ ID NO: 1439529 - RNA, 17 nt, Pseudomonas aeruginosa PA01
gcggaggauucagcagg

SEQ ID NO: 1439530 - RNA, 18 nt, Pseudomonas aeruginosa PA01
gcggagcguccaccagcg

SEQ ID NO: 1439531 - RNA, 20 nt, Pseudomonas aeruginosa PA01
gcggagcguccaccagcgcc

SEQ ID NO: 1439532 - RNA, 21 nt, Pseudomonas aeruginosa PA01
gcggagcguccaccagcgccc

SEQ ID NO: 1439533 - RNA, 19 nt, Pseudomonas aeruginosa PA01
gcggagccgucggcuccgc

SEQ ID NO: 1439534 - RNA, 23 nt, Pseudomonas aeruginosa PA01
gcggagcaccgcgccuuccagcc

SEQ ID NO: 1439535 - RNA, 21 nt, Pseudomonas aeruginosa PA01
gcggacugguaggacagggcc

SEQ ID NO: 1439536 - RNA, 22 nt, Pseudomonas aeruginosa PA01
gcggagaaacuuucuucgccau

SEQ ID NO: 1439537 - RNA, 21 nt, Pseudomonas aeruginosa PA01
gcggagaagccgcugaccucg

SEQ ID NO: 1439538 - RNA, 20 nt, Pseudomonas aeruginosa PA01
gcggagaauccgcucggugc

SEQ ID NO: 1439539 - RNA, 20 nt, Pseudomonas aeruginosa PA01
gcggagaggaucagcgaacc

SEQ ID NO: 1439540 - RNA, 15 nt, Pseudomonas aeruginosa PA01
gcggacgcuuguccu

SEQ ID NO: 1439541 - RNA, 14 nt, Pseudomonas aeruginosa PA01
gcggacgggccgcg

SEQ ID NO: 1439542 - RNA, 18 nt, Pseudomonas aeruginosa PA01
gcggacgggccgcgccgc

SEQ ID NO: 1439543 - RNA, 21 nt, Pseudomonas aeruginosa PA01
gcggacgggccgcgccgcaag

SEQ ID NO: 1439544 - RNA, 13 nt, Pseudomonas aeruginosa PA01
gcggacgggccgc

SEQ ID NO: 1439545 - RNA, 20 nt, Pseudomonas aeruginosa PA01
gcggaccuucgacggcaggu

SEQ ID NO: 1439546 - RNA, 14 nt, Pseudomonas aeruginosa PA01
gcggacggccggcu

SEQ ID NO: 1439547 - RNA, 13 nt, Pseudomonas aeruginosa PA01
gcggacggccugc

SEQ ID NO: 1439548 - RNA, 17 nt, Pseudomonas aeruginosa PA01
gcggacgauggucgccg

SEQ ID NO: 1439549 - RNA, 20 nt, Pseudomonas aeruginosa PA01
gcggacgauggucgccgcga

SEQ ID NO: 1439550 - RNA, 18 nt, Pseudomonas aeruginosa PA01
gcggacugcucgccgccg

SEQ ID NO: 1439551 - RNA, 19 nt, Pseudomonas aeruginosa PA01
gcggacugcucgccgccgg

SEQ ID NO: 1439552 - RNA, 20 nt, Pseudomonas aeruginosa PA01
gcggacugcucgccgccggc

SEQ ID NO: 1439553 - RNA, 14 nt, Pseudomonas aeruginosa PA01
gcgggaauucuucc

SEQ ID NO: 1439554 - RNA, 22 nt, Pseudomonas aeruginosa PA01
gcggcuuucgguuugcgccgaa

SEQ ID NO: 1439555 - RNA, 18 nt, Pseudomonas aeruginosa PA01
gcggcuuguccuggcgca

SEQ ID NO: 1439556 - RNA, 14 nt, Pseudomonas aeruginosa PA01
gcggcuugccggcg

SEQ ID NO: 1439557 - RNA, 17 nt, Pseudomonas aeruginosa PA01
gcggcuugccggcgcgc

SEQ ID NO: 1439558 - RNA, 17 nt, Pseudomonas aeruginosa PA01
gcggcguugucggccag

SEQ ID NO: 1439559 - RNA, 22 nt, Pseudomonas aeruginosa PA01
gcggcguuuuucauugggcagc

SEQ ID NO: 1439560 - RNA, 18 nt, Pseudomonas aeruginosa PA01
aagcuggagcagcagcgc

SEQ ID NO: 1439561 - RNA, 13 nt, Pseudomonas aeruginosa PA01
gcggcucacgccc

SEQ ID NO: 1439562 - RNA, 20 nt, Pseudomonas aeruginosa PA01
gcggcucacgccccagcgca

SEQ ID NO: 1439563 - RNA, 14 nt, Pseudomonas aeruginosa PA01
gcggcucaggccgc

SEQ ID NO: 1439564 - RNA, 15 nt, Pseudomonas aeruginosa PA01
gcggcucaggccgcc

SEQ ID NO: 1439565 - RNA, 17 nt, Pseudomonas aeruginosa PA01
gcggcucaggccgccgc

SEQ ID NO: 1439566 - RNA, 19 nt, Pseudomonas aeruginosa PA01
gcggcucaggccgccgcgu

SEQ ID NO: 1439567 - RNA, 23 nt, Pseudomonas aeruginosa PA01
gcggcuaccagcgcuucggcggc

SEQ ID NO: 1439568 - RNA, 14 nt, Pseudomonas aeruginosa PA01
gcggcuacucgccc

SEQ ID NO: 1439569 - RNA, 15 nt, Pseudomonas aeruginosa PA01
gcggcuacucgcccg

SEQ ID NO: 1439570 - RNA, 17 nt, Pseudomonas aeruginosa PA01
gcggcuacucgcccgac

SEQ ID NO: 1439571 - RNA, 18 nt, Pseudomonas aeruginosa PA01
gcggcuacucgcccgacc

SEQ ID NO: 1439572 - RNA, 16 nt, Pseudomonas aeruginosa PA01
gcgggcagcagucgca

SEQ ID NO: 1439573 - RNA, 19 nt, Pseudomonas aeruginosa PA01
gcgggcagacaccaccagg

SEQ ID NO: 1439574 - RNA, 16 nt, Pseudomonas aeruginosa PA01
gcgggccagcuggcga

SEQ ID NO: 1439575 - RNA, 16 nt, Pseudomonas aeruginosa PA01
gcgggcaggucgaugu

SEQ ID NO: 1439576 - RNA, 17 nt, Pseudomonas aeruginosa PA01
gcgggcacgucgcggau

SEQ ID NO: 1439577 - RNA, 22 nt, Pseudomonas aeruginosa PA01
gcgggaucagccgcgacucggc

SEQ ID NO: 1439578 - RNA, 18 nt, Pseudomonas aeruginosa PA01
gcgggaucaggucgccag

SEQ ID NO: 1439579 - RNA, 14 nt, Pseudomonas aeruginosa PA01
gcgggaucgacgcc

SEQ ID NO: 1439580 - RNA, 16 nt, Pseudomonas aeruginosa PA01
gcgggaucgacgccgc

SEQ ID NO: 1439581 - RNA, 22 nt, Pseudomonas aeruginosa PA01
gcgggaucgacgccgcuggcgg

SEQ ID NO: 1439582 - RNA, 17 nt, Pseudomonas aeruginosa PA01
gcgggacgccgcaggaa

SEQ ID NO: 1439583 - RNA, 14 nt, Pseudomonas aeruginosa PA01
gcgggacggcgcau

SEQ ID NO: 1439584 - RNA, 22 nt, Pseudomonas aeruginosa PA01
gcgggacagcuugccguccagc

SEQ ID NO: 1439585 - RNA, 16 nt, Pseudomonas aeruginosa PA01
gcgggacaggaacgcc

SEQ ID NO: 1439586 - RNA, 18 nt, Pseudomonas aeruginosa PA01
gcgggaggcuacagccug

SEQ ID NO: 1439587 - RNA, 19 nt, Pseudomonas aeruginosa PA01
gcgggaggcuacagccuga

SEQ ID NO: 1439588 - RNA, 12 nt, Pseudomonas aeruginosa PA01
gcgggagcggcc

SEQ ID NO: 1439589 - RNA, 17 nt, Pseudomonas aeruginosa PA01
gcgggagagggcggcga

SEQ ID NO: 1439590 - RNA, 22 nt, Pseudomonas aeruginosa PA01
gcgggagagggcggcgaccggc

SEQ ID NO: 1439591 - RNA, 20 nt, Pseudomonas aeruginosa PA01
gcgggacuuguacucgccgg

SEQ ID NO: 1439592 - RNA, 21 nt, Pseudomonas aeruginosa PA01
gcgggacuuguacucgccggu

SEQ ID NO: 1439593 - RNA, 17 nt, Pseudomonas aeruginosa PA01
gcggggaggaagcuccc

SEQ ID NO: 1439594 - RNA, 19 nt, Pseudomonas aeruginosa PA01
gcggggaauuuccggcaac

SEQ ID NO: 1439595 - RNA, 18 nt, Pseudomonas aeruginosa PA01
gcggggaaaccuucggug

SEQ ID NO: 1439596 - RNA, 20 nt, Pseudomonas aeruginosa PA01
gcggggaaagcuccucggcc

SEQ ID NO: 1439597 - RNA, 13 nt, Pseudomonas aeruginosa PA01
gcggggaacagca

SEQ ID NO: 1439598 - RNA, 21 nt, Pseudomonas aeruginosa PA01
gcgggcuuuuucguuggccag

SEQ ID NO: 1439599 - RNA, 17 nt, Pseudomonas aeruginosa PA01
gcgggcugcgugccagc

SEQ ID NO: 1439600 - RNA, 14 nt, Pseudomonas aeruginosa PA01
gcgggcugucgucc

SEQ ID NO: 1439601 - RNA, 14 nt, Pseudomonas aeruginosa PA01
gcgggcugccgcgg

SEQ ID NO: 1439602 - RNA, 15 nt, Pseudomonas aeruginosa PA01
gcgggcugccgcgga

SEQ ID NO: 1439603 - RNA, 20 nt, Pseudomonas aeruginosa PA01
gcgggcuucggacuuuucgc

SEQ ID NO: 1439604 - RNA, 23 nt, Pseudomonas aeruginosa PA01
gcgggcguccguaaugcaacccg

SEQ ID NO: 1439605 - RNA, 20 nt, Pseudomonas aeruginosa PA01
gcgggcgugcuccagcaccg

SEQ ID NO: 1439606 - RNA, 16 nt, Pseudomonas aeruginosa PA01
gcgggcuaccaggaag

SEQ ID NO: 1439607 - RNA, 18 nt, Pseudomonas aeruginosa PA01
gcgggcguuguccacgga

SEQ ID NO: 1439608 - RNA, 23 nt, Pseudomonas aeruginosa PA01
gcgggcguuuucguuggcggcca

SEQ ID NO: 1439609 - RNA, 23 nt, Pseudomonas aeruginosa PA01
gcgggcggucgcggaccuccagc

SEQ ID NO: 1439610 - RNA, 22 nt, Pseudomonas aeruginosa PA01
gcgggcguagccuuccuucucg

SEQ ID NO: 1439611 - RNA, 15 nt, Pseudomonas aeruginosa PA01
gcgggcguagcgcgg

SEQ ID NO: 1439612 - RNA, 21 nt, Pseudomonas aeruginosa PA01
gcgggcguagcgcggcagcgc

SEQ ID NO: 1439613 - RNA, 18 nt, Pseudomonas aeruginosa PA01
gcgggcgucggcgucggc

SEQ ID NO: 1439614 - RNA, 22 nt, Pseudomonas aeruginosa PA01
gcgggcgucgucggggugccgc

SEQ ID NO: 1439615 - RNA, 20 nt, Pseudomonas aeruginosa PA01
gcgggcugaagugggucgcc

SEQ ID NO: 1439616 - RNA, 21 nt, Pseudomonas aeruginosa PA01
gcgggcuauucccgccgcucc

SEQ ID NO: 1439617 - RNA, 23 nt, Pseudomonas aeruginosa PA01
gcgggcgguagcgggccagcagc

SEQ ID NO: 1439618 - RNA, 14 nt, Pseudomonas aeruginosa PA01
gcgggcggcgucga

SEQ ID NO: 1439619 - RNA, 14 nt, Pseudomonas aeruginosa PA01
gcgggcggccucga

SEQ ID NO: 1439620 - RNA, 16 nt, Pseudomonas aeruginosa PA01
gcgggcggccucgaug

SEQ ID NO: 1439621 - RNA, 20 nt, Pseudomonas aeruginosa PA01
gcgggcggccucgauggcgg

SEQ ID NO: 1439622 - RNA, 13 nt, Pseudomonas aeruginosa PA01
gcgggcggccccu

SEQ ID NO: 1439623 - RNA, 18 nt, Pseudomonas aeruginosa PA01
gcgggcgcccgccaaggc

SEQ ID NO: 1439624 - RNA, 22 nt, Pseudomonas aeruginosa PA01
gcgggcgcccgccaaggcccug

SEQ ID NO: 1439625 - RNA, 14 nt, Pseudomonas aeruginosa PA01
gcgggcgccgaugc

SEQ ID NO: 1439626 - RNA, 14 nt, Pseudomonas aeruginosa PA01
gcgggcgauggccc

SEQ ID NO: 1439627 - RNA, 15 nt, Pseudomonas aeruginosa PA01
gcgggcgcaagccca

SEQ ID NO: 1439628 - RNA, 13 nt, Pseudomonas aeruginosa PA01
gcgggcgcagguu

SEQ ID NO: 1439629 - RNA, 20 nt, Pseudomonas aeruginosa PA01
gcgggccaggcccuugguca

SEQ ID NO: 1439630 - RNA, 16 nt, Pseudomonas aeruginosa PA01
gcgggccaggccgagc

SEQ ID NO: 1439631 - RNA, 18 nt, Pseudomonas aeruginosa PA01
gcgggccaggccgagcgu

SEQ ID NO: 1439632 - RNA, 13 nt, Pseudomonas aeruginosa PA01
gcgggccaggccc

SEQ ID NO: 1439633 - RNA, 12 nt, Pseudomonas aeruginosa PA01
gcgggccaggcc

SEQ ID NO: 1439634 - RNA, 20 nt, Pseudomonas aeruginosa PA01
gcgggcgaugaggcugucca

SEQ ID NO: 1439635 - RNA, 22 nt, Pseudomonas aeruginosa PA01
gcgggcgaucuccucgauccgc

SEQ ID NO: 1439636 - RNA, 22 nt, Pseudomonas aeruginosa PA01
gcgggcgaccggaugcuccagg

SEQ ID NO: 1439637 - RNA, 16 nt, Pseudomonas aeruginosa PA01
gcgggcgagggcggcg

SEQ ID NO: 1439638 - RNA, 12 nt, Pseudomonas aeruginosa PA01
gcgguccggcga

SEQ ID NO: 1439639 - RNA, 20 nt, Pseudomonas aeruginosa PA01
gcgguccggcgaaguccggg

SEQ ID NO: 1439640 - RNA, 20 nt, Pseudomonas aeruginosa PA01
gcggucaucgcgccgccgaa

SEQ ID NO: 1439641 - RNA, 22 nt, Pseudomonas aeruginosa PA01
gcggucaugcgcccuacgccac

SEQ ID NO: 1439642 - RNA, 20 nt, Pseudomonas aeruginosa PA01
gcggucaugcccuugucgcc

SEQ ID NO: 1439643 - RNA, 22 nt, Pseudomonas aeruginosa PA01
gcggucaugcccuugucgcccu

SEQ ID NO: 1439644 - RNA, 14 nt, Pseudomonas aeruginosa PA01
gcggucauccgccg

SEQ ID NO: 1439645 - RNA, 17 nt, Pseudomonas aeruginosa PA01
gcggucauccgccggcg

SEQ ID NO: 1439646 - RNA, 22 nt, Pseudomonas aeruginosa PA01
gcggucauccgccggcgcguag

SEQ ID NO: 1439647 - RNA, 13 nt, Pseudomonas aeruginosa PA01
gcggucaucgccg

SEQ ID NO: 1439648 - RNA, 16 nt, Pseudomonas aeruginosa PA01
gcggucaucgccggcg

SEQ ID NO: 1439649 - RNA, 17 nt, Pseudomonas aeruginosa PA01
gcgguagaucuccaccc

SEQ ID NO: 1439650 - RNA, 13 nt, Pseudomonas aeruginosa PA01
gcgguagcccggc

SEQ ID NO: 1439651 - RNA, 20 nt, Pseudomonas aeruginosa PA01
gcgguagcccggcagcuccc

SEQ ID NO: 1439652 - RNA, 14 nt, Pseudomonas aeruginosa PA01
gcgguagccgaggc

SEQ ID NO: 1439653 - RNA, 14 nt, Pseudomonas aeruginosa PA01
gcgguacgccgcgc

SEQ ID NO: 1439654 - RNA, 17 nt, Pseudomonas aeruginosa PA01
gcgguacgccgcgcugc

SEQ ID NO: 1439655 - RNA, 22 nt, Pseudomonas aeruginosa PA01
gcgguacgccgcgcugcgccag

SEQ ID NO: 1439656 - RNA, 14 nt, Pseudomonas aeruginosa PA01
gcgguagaacaggc

SEQ ID NO: 1439657 - RNA, 17 nt, Pseudomonas aeruginosa PA01
gcgguauucuccagcag

SEQ ID NO: 1439658 - RNA, 19 nt, Pseudomonas aeruginosa PA01
gcgguauucuccagcaggc

SEQ ID NO: 1439659 - RNA, 20 nt, Pseudomonas aeruginosa PA01
gcgguauugaagucgucguc

SEQ ID NO: 1439660 - RNA, 15 nt, Pseudomonas aeruginosa PA01
gcggguggcaaccga

SEQ ID NO: 1439661 - RNA, 18 nt, Pseudomonas aeruginosa PA01
gcggguggcaaccgacga

SEQ ID NO: 1439662 - RNA, 14 nt, Pseudomonas aeruginosa PA01
gcggguggcgcugu

SEQ ID NO: 1439663 - RNA, 17 nt, Pseudomonas aeruginosa PA01
gcggguucagcccgccg

SEQ ID NO: 1439664 - RNA, 18 nt, Pseudomonas aeruginosa PA01
gcggguucagcccgccgu

SEQ ID NO: 1439665 - RNA, 19 nt, Pseudomonas aeruginosa PA01
gcggguucagcccgccgug

SEQ ID NO: 1439666 - RNA, 21 nt, Pseudomonas aeruginosa PA01
gcggguucagcccgccgugcg

SEQ ID NO: 1439667 - RNA, 17 nt, Pseudomonas aeruginosa PA01
gcggguucagucggcca

SEQ ID NO: 1439668 - RNA, 18 nt, Pseudomonas aeruginosa PA01
gcggguucagucggccag

SEQ ID NO: 1439669 - RNA, 19 nt, Pseudomonas aeruginosa PA01
gcggguucagucggccagg

SEQ ID NO: 1439670 - RNA, 21 nt, Pseudomonas aeruginosa PA01
gcggguuccucacggcgcagc

SEQ ID NO: 1439671 - RNA, 23 nt, Pseudomonas aeruginosa PA01
gcggguucgagucccguccgcug

SEQ ID NO: 1439672 - RNA, 19 nt, Pseudomonas aeruginosa PA01
gcggguugaugucgucgaa

SEQ ID NO: 1439673 - RNA, 15 nt, Pseudomonas aeruginosa PA01
gcggguugcccggcu

SEQ ID NO: 1439674 - RNA, 18 nt, Pseudomonas aeruginosa PA01
gcggguugcccggcucca

SEQ ID NO: 1439675 - RNA, 21 nt, Pseudomonas aeruginosa PA01
gcggguucggcgagaggucgg

SEQ ID NO: 1439676 - RNA, 17 nt, Pseudomonas aeruginosa PA01
gcggguucgugccaggc

SEQ ID NO: 1439677 - RNA, 14 nt, Pseudomonas aeruginosa PA01
gcggguuggucggc

SEQ ID NO: 1439678 - RNA, 18 nt, Pseudomonas aeruginosa PA01
gcggguuggcuuccagcc

SEQ ID NO: 1439679 - RNA, 19 nt, Pseudomonas aeruginosa PA01
gcggguuggcuuccagcca

SEQ ID NO: 1439680 - RNA, 20 nt, Pseudomonas aeruginosa PA01
gcggguuggcuuccagccag

SEQ ID NO: 1439681 - RNA, 21 nt, Pseudomonas aeruginosa PA01
gcggguuggcuuccagccagc

SEQ ID NO: 1439682 - RNA, 19 nt, Pseudomonas aeruginosa PA01
gcggguuuccgugcgcugc

SEQ ID NO: 1439683 - RNA, 20 nt, Pseudomonas aeruginosa PA01
gcggguuuccgugcgcugcg

SEQ ID NO: 1439684 - RNA, 23 nt, Pseudomonas aeruginosa PA01
gcggguuuuuuuaugccucggcg

SEQ ID NO: 1439685 - RNA, 13 nt, Pseudomonas aeruginosa PA01
gcgguaccgggcc

SEQ ID NO: 1439686 - RNA, 16 nt, Pseudomonas aeruginosa PA01
gcgggucagaccacga

SEQ ID NO: 1439687 - RNA, 16 nt, Pseudomonas aeruginosa PA01
gcgggucauagucggu

SEQ ID NO: 1439688 - RNA, 20 nt, Pseudomonas aeruginosa PA01
gcgggucauagucggugacc

SEQ ID NO: 1439689 - RNA, 16 nt, Pseudomonas aeruginosa PA01
gcgggucaucggcccg

SEQ ID NO: 1439690 - RNA, 21 nt, Pseudomonas aeruginosa PA01
gcgggucaucggcccgacgcc

SEQ ID NO: 1439691 - RNA, 21 nt, Pseudomonas aeruginosa PA01
gcggguccuggguggcgacgc

SEQ ID NO: 1439692 - RNA, 24 nt, Pseudomonas aeruginosa PA01
gcggguccuggguggcgacgccgg

SEQ ID NO: 1439693 - RNA, 15 nt, Pseudomonas aeruginosa PA01
gcgggucgagccagg

SEQ ID NO: 1439694 - RNA, 19 nt, Pseudomonas aeruginosa PA01
gcgggucgagccaggcgua

SEQ ID NO: 1439695 - RNA, 20 nt, Pseudomonas aeruginosa PA01
gcgggucgaucaggcgcaug

SEQ ID NO: 1439696 - RNA, 13 nt, Pseudomonas aeruginosa PA01
gcgggucguccuc

SEQ ID NO: 1439697 - RNA, 14 nt, Pseudomonas aeruginosa PA01
gcgggucgucgaag

SEQ ID NO: 1439698 - RNA, 14 nt, Pseudomonas aeruginosa PA01
gcgggucgucgaug

SEQ ID NO: 1439699 - RNA, 17 nt, Pseudomonas aeruginosa PA01
gcgggucucgaucagcg

SEQ ID NO: 1439700 - RNA, 18 nt, Pseudomonas aeruginosa PA01
gcgggucucgaucagcgc

SEQ ID NO: 1439701 - RNA, 21 nt, Pseudomonas aeruginosa PA01
gcgggucucgaucagcgccgg

SEQ ID NO: 1439702 - RNA, 13 nt, Pseudomonas aeruginosa PA01
gcgggucugcucg

SEQ ID NO: 1439703 - RNA, 17 nt, Pseudomonas aeruginosa PA01
gcgggucugcucggcgc

SEQ ID NO: 1439704 - RNA, 18 nt, Pseudomonas aeruginosa PA01
gcgggucugcucggcgcc

SEQ ID NO: 1439705 - RNA, 15 nt, Pseudomonas aeruginosa PA01
gcgggucuugcgcag

SEQ ID NO: 1439706 - RNA, 23 nt, Pseudomonas aeruginosa PA01
gcgggucuugcgcagggcggcga

SEQ ID NO: 1439707 - RNA, 17 nt, Pseudomonas aeruginosa PA01
gcgggugaccuggccgc

SEQ ID NO: 1439708 - RNA, 19 nt, Pseudomonas aeruginosa PA01
gcgggugaccuggccgccg

SEQ ID NO: 1439709 - RNA, 22 nt, Pseudomonas aeruginosa PA01
gcgggugauacggcucuugaaa

SEQ ID NO: 1439710 - RNA, 14 nt, Pseudomonas aeruginosa PA01
gcgggugcgcaggc

SEQ ID NO: 1439711 - RNA, 18 nt, Pseudomonas aeruginosa PA01
gcgggugcgcaggcugcc

SEQ ID NO: 1439712 - RNA, 13 nt, Pseudomonas aeruginosa PA01
gcgggugccgaag

SEQ ID NO: 1439713 - RNA, 14 nt, Pseudomonas aeruginosa PA01
gcgggugccgaaga

SEQ ID NO: 1439714 - RNA, 16 nt, Pseudomonas aeruginosa PA01
gcgggugccgaagacc

SEQ ID NO: 1439715 - RNA, 23 nt, Pseudomonas aeruginosa PA01
gcggggcuuuuuuaugcgcagcg

SEQ ID NO: 1439716 - RNA, 20 nt, Pseudomonas aeruginosa PA01
gcggggcuuuuuuucgccug

SEQ ID NO: 1439717 - RNA, 21 nt, Pseudomonas aeruginosa PA01
gcggggcggcgucccggcgcc

SEQ ID NO: 1439718 - RNA, 14 nt, Pseudomonas aeruginosa PA01
gcggggcgaccagc

SEQ ID NO: 1439719 - RNA, 18 nt, Pseudomonas aeruginosa PA01
gcggggcgaggucggccu

SEQ ID NO: 1439720 - RNA, 12 nt, Pseudomonas aeruginosa PA01
gcggggccccgg

SEQ ID NO: 1439721 - RNA, 13 nt, Pseudomonas aeruginosa PA01
gcggggccccggc

SEQ ID NO: 1439722 - RNA, 21 nt, Pseudomonas aeruginosa PA01
gcgggguucgacgcgccacgc

SEQ ID NO: 1439723 - RNA, 21 nt, Pseudomonas aeruginosa PA01
gcgggguagggguggccaggc

SEQ ID NO: 1439724 - RNA, 21 nt, Pseudomonas aeruginosa PA01
gcggggugaucagucgucguc

SEQ ID NO: 1439725 - RNA, 18 nt, Pseudomonas aeruginosa PA01
gcgggguauuaccccgcc

SEQ ID NO: 1439726 - RNA, 15 nt, Pseudomonas aeruginosa PA01
gcggggugcgcugga

SEQ ID NO: 1439727 - RNA, 21 nt, Pseudomonas aeruginosa PA01
gcggguagagucgcucgcgca

SEQ ID NO: 1439728 - RNA, 20 nt, Pseudomonas aeruginosa PA01
gcggguagaugccacugacg

SEQ ID NO: 1439729 - RNA, 15 nt, Pseudomonas aeruginosa PA01
gcggguauccgccgg

SEQ ID NO: 1439730 - RNA, 18 nt, Pseudomonas aeruginosa PA01
gcggguauccgccgggcc

SEQ ID NO: 1439731 - RNA, 16 nt, Pseudomonas aeruginosa PA01
gcggguagcgccggua

SEQ ID NO: 1439732 - RNA, 15 nt, Pseudomonas aeruginosa PA01
gcggguagcugcugg

SEQ ID NO: 1439733 - RNA, 13 nt, Pseudomonas aeruginosa PA01
gcgggucaccagc

SEQ ID NO: 1439734 - RNA, 16 nt, Pseudomonas aeruginosa PA01
gcgggucaccagcgcc

SEQ ID NO: 1439735 - RNA, 17 nt, Pseudomonas aeruginosa PA01
gcgggucaccagcgccg

SEQ ID NO: 1439736 - RNA, 16 nt, Pseudomonas aeruginosa PA01
gcgggucacgccgagg

SEQ ID NO: 1439737 - RNA, 19 nt, Pseudomonas aeruginosa PA01
gcggcgcguaggcgaacac

SEQ ID NO: 1439738 - RNA, 13 nt, Pseudomonas aeruginosa PA01
gcggcgcggcgua

SEQ ID NO: 1439739 - RNA, 16 nt, Pseudomonas aeruginosa PA01
gcggcgcgggcgcgcg

SEQ ID NO: 1439740 - RNA, 12 nt, Pseudomonas aeruginosa PA01
gcggcgcggcgg

SEQ ID NO: 1439741 - RNA, 13 nt, Pseudomonas aeruginosa PA01
gcggcgcggcgca

SEQ ID NO: 1439742 - RNA, 22 nt, Pseudomonas aeruginosa PA01
gcggcgcuguuugcggcgcagg

SEQ ID NO: 1439743 - RNA, 17 nt, Pseudomonas aeruginosa PA01
gcggcgcuuguagccca

SEQ ID NO: 1439744 - RNA, 19 nt, Pseudomonas aeruginosa PA01
gcggcgcuuguagcccagg

SEQ ID NO: 1439745 - RNA, 22 nt, Pseudomonas aeruginosa PA01
gcggcgcuuguagcccaggggc

SEQ ID NO: 1439746 - RNA, 15 nt, Pseudomonas aeruginosa PA01
gcggcggaaggcggc

SEQ ID NO: 1439747 - RNA, 16 nt, Pseudomonas aeruginosa PA01
gcggcggaaggcggcg

SEQ ID NO: 1439748 - RNA, 16 nt, Pseudomonas aeruginosa PA01
gcggcggaacuugucg

SEQ ID NO: 1439749 - RNA, 20 nt, Pseudomonas aeruginosa PA01
gcggcggaacuugucgccgc

SEQ ID NO: 1439750 - RNA, 22 nt, Pseudomonas aeruginosa PA01
gcggcggaacuugucgccgcug

SEQ ID NO: 1439751 - RNA, 24 nt, Pseudomonas aeruginosa PA01
gcggcggaacuugucgccgcugga

SEQ ID NO: 1439752 - RNA, 15 nt, Pseudomonas aeruginosa PA01
gcggcggacagcgga

SEQ ID NO: 1439753 - RNA, 18 nt, Pseudomonas aeruginosa PA01
gcggcggacaggcagccg

SEQ ID NO: 1439754 - RNA, 16 nt, Pseudomonas aeruginosa PA01
gcggcgcggagcugca

SEQ ID NO: 1439755 - RNA, 21 nt, Pseudomonas aeruginosa PA01
gcggcgcggauguucgccacg

SEQ ID NO: 1439756 - RNA, 18 nt, Pseudomonas aeruginosa PA01
gcggcgcgcgucguccag

SEQ ID NO: 1439757 - RNA, 18 nt, Pseudomonas aeruginosa PA01
gcggcgcgcugcggguca

SEQ ID NO: 1439758 - RNA, 23 nt, Pseudomonas aeruginosa PA01
gcggcgcggaauacguacucguc

SEQ ID NO: 1439759 - RNA, 22 nt, Pseudomonas aeruginosa PA01
gcggcgcggacauggcgcucga

SEQ ID NO: 1439760 - RNA, 17 nt, Pseudomonas aeruginosa PA01
gcggcgccgaacagggc

SEQ ID NO: 1439761 - RNA, 23 nt, Pseudomonas aeruginosa PA01
gcggcgccgaacagggcgagcag

SEQ ID NO: 1439762 - RNA, 14 nt, Pseudomonas aeruginosa PA01
gcggcgcccucugc

SEQ ID NO: 1439763 - RNA, 18 nt, Pseudomonas aeruginosa PA01
gcggcgcccucugccggu

SEQ ID NO: 1439764 - RNA, 19 nt, Pseudomonas aeruginosa PA01
gcggcgcccucugccgguc

SEQ ID NO: 1439765 - RNA, 13 nt, Pseudomonas aeruginosa PA01
gcggcgcccuggc

SEQ ID NO: 1439766 - RNA, 18 nt, Pseudomonas aeruginosa PA01
gcggcgccaacucggccu

SEQ ID NO: 1439767 - RNA, 19 nt, Pseudomonas aeruginosa PA01
gcggcgccaacucggccug

SEQ ID NO: 1439768 - RNA, 20 nt, Pseudomonas aeruginosa PA01
gcggcgccaacucggccugg

SEQ ID NO: 1439769 - RNA, 12 nt, Pseudomonas aeruginosa PA01
gcggcgccgagg

SEQ ID NO: 1439770 - RNA, 21 nt, Pseudomonas aeruginosa PA01
gcggcgcgauauccgccaggg

SEQ ID NO: 1439771 - RNA, 15 nt, Pseudomonas aeruginosa PA01
gcggcgccggcaggu

SEQ ID NO: 1439772 - RNA, 19 nt, Pseudomonas aeruginosa PA01
gcggcgcaggcugucggcc

SEQ ID NO: 1439773 - RNA, 22 nt, Pseudomonas aeruginosa PA01
gcggcgcaggcugucggccagc

SEQ ID NO: 1439774 - RNA, 23 nt, Pseudomonas aeruginosa PA01
gcggcgcaggcggaucgcccggc

SEQ ID NO: 1439775 - RNA, 19 nt, Pseudomonas aeruginosa PA01
gcggcgcaaucagggcugg

SEQ ID NO: 1439776 - RNA, 15 nt, Pseudomonas aeruginosa PA01
gcggcgucggcgaag

SEQ ID NO: 1439777 - RNA, 15 nt, Pseudomonas aeruginosa PA01
gcggcgucgcggaga

SEQ ID NO: 1439778 - RNA, 14 nt, Pseudomonas aeruginosa PA01
gcggcgucgucgcu

SEQ ID NO: 1439779 - RNA, 17 nt, Pseudomonas aeruginosa PA01
gcggcgucgucgcugcg

SEQ ID NO: 1439780 - RNA, 20 nt, Pseudomonas aeruginosa PA01
gcggcgucgucgcugcgcgg

SEQ ID NO: 1439781 - RNA, 14 nt, Pseudomonas aeruginosa PA01
aagcugaagcgccg

SEQ ID NO: 1439782 - RNA, 19 nt, Pseudomonas aeruginosa PA01
aagcugccuuccagcaggu

SEQ ID NO: 1439783 - RNA, 13 nt, Pseudomonas aeruginosa PA01
aagcucgaucacc

SEQ ID NO: 1439784 - RNA, 16 nt, Pseudomonas aeruginosa PA01
aagcucgucacccgcg

SEQ ID NO: 1439785 - RNA, 11 nt, Pseudomonas aeruginosa PA01
aagcucggcgc

SEQ ID NO: 1439786 - RNA, 18 nt, Pseudomonas aeruginosa PA01
gcggcgucgaccacggcc

SEQ ID NO: 1439787 - RNA, 19 nt, Pseudomonas aeruginosa PA01
gcggcgucgaccacggccu

SEQ ID NO: 1439788 - RNA, 18 nt, Pseudomonas aeruginosa PA01
gcggcguaaucgcgccag

SEQ ID NO: 1439789 - RNA, 23 nt, Pseudomonas aeruginosa PA01
gcggcguaaucgcgccaggccgc

SEQ ID NO: 1439790 - RNA, 14 nt, Pseudomonas aeruginosa PA01
aagcuccagcgugc

SEQ ID NO: 1439791 - RNA, 22 nt, Pseudomonas aeruginosa PA01
aagcucaccuugaagccuucgc

SEQ ID NO: 1439792 - RNA, 16 nt, Pseudomonas aeruginosa PA01
gcggcggugcgccggc

SEQ ID NO: 1439793 - RNA, 14 nt, Pseudomonas aeruginosa PA01
gcggcggccagcag

SEQ ID NO: 1439794 - RNA, 14 nt, Pseudomonas aeruginosa PA01
gcggcggcucaggc

SEQ ID NO: 1439795 - RNA, 15 nt, Pseudomonas aeruginosa PA01
gcggcggcucaggcc

SEQ ID NO: 1439796 - RNA, 18 nt, Pseudomonas aeruginosa PA01
gcggcggcucaggccgcc

SEQ ID NO: 1439797 - RNA, 19 nt, Pseudomonas aeruginosa PA01
gcggcggcucaggccgccg

SEQ ID NO: 1439798 - RNA, 16 nt, Pseudomonas aeruginosa PA01
gcggcggcuccggcgc

SEQ ID NO: 1439799 - RNA, 17 nt, Pseudomonas aeruginosa PA01
gcggcggcuccggcgcc

SEQ ID NO: 1439800 - RNA, 20 nt, Pseudomonas aeruginosa PA01
gcggcggcuccggcgccagg

SEQ ID NO: 1439801 - RNA, 21 nt, Pseudomonas aeruginosa PA01
gcggcggcuccggcgccaggc

SEQ ID NO: 1439802 - RNA, 23 nt, Pseudomonas aeruginosa PA01
gcggcggcuccggcgccaggccg

SEQ ID NO: 1439803 - RNA, 14 nt, Pseudomonas aeruginosa PA01
gcggcggccgccuc

SEQ ID NO: 1439804 - RNA, 19 nt, Pseudomonas aeruginosa PA01
gcggcggccugcucgcgca

SEQ ID NO: 1439805 - RNA, 17 nt, Pseudomonas aeruginosa PA01
gcggcggugcagaacgc

SEQ ID NO: 1439806 - RNA, 18 nt, Pseudomonas aeruginosa PA01
gcggcggucgcgaucugc

SEQ ID NO: 1439807 - RNA, 22 nt, Pseudomonas aeruginosa PA01
gcggcggucccaucagcagucc

SEQ ID NO: 1439808 - RNA, 22 nt, Pseudomonas aeruginosa PA01
gcggcggucccuucgugggccu

SEQ ID NO: 1439809 - RNA, 22 nt, Pseudomonas aeruginosa PA01
gcggcggucaucgcgccgccga

SEQ ID NO: 1439810 - RNA, 23 nt, Pseudomonas aeruginosa PA01
gcggcggucaucgcgccgccgaa

SEQ ID NO: 1439811 - RNA, 20 nt, Pseudomonas aeruginosa PA01
gcggcgggacuggggcaugg

SEQ ID NO: 1439812 - RNA, 19 nt, Pseudomonas aeruginosa PA01
gcggcgaacccucggugcg

SEQ ID NO: 1439813 - RNA, 14 nt, Pseudomonas aeruginosa PA01
gcggccugcgccgg

SEQ ID NO: 1439814 - RNA, 16 nt, Pseudomonas aeruginosa PA01
gcggcgaagcgcaggc

SEQ ID NO: 1439815 - RNA, 14 nt, Pseudomonas aeruginosa PA01
gcggcgaagcgcuc

SEQ ID NO: 1439816 - RNA, 15 nt, Pseudomonas aeruginosa PA01
gcggcgaagcgcucg

SEQ ID NO: 1439817 - RNA, 20 nt, Pseudomonas aeruginosa PA01
gcggcgaagcguugcagcgu

SEQ ID NO: 1439818 - RNA, 23 nt, Pseudomonas aeruginosa PA01
gcggcgaagcguugcagcgucug

SEQ ID NO: 1439819 - RNA, 16 nt, Pseudomonas aeruginosa PA01
gcggccugagcugccg

SEQ ID NO: 1439820 - RNA, 16 nt, Pseudomonas aeruginosa PA01
gcggccugcagcgacu

SEQ ID NO: 1439821 - RNA, 22 nt, Pseudomonas aeruginosa PA01
gcggccucggccucgucgagca

SEQ ID NO: 1439822 - RNA, 20 nt, Pseudomonas aeruginosa PA01
gcggccucguucggcgacca

SEQ ID NO: 1439823 - RNA, 15 nt, Pseudomonas aeruginosa PA01
gcggccugagccggc

SEQ ID NO: 1439824 - RNA, 14 nt, Pseudomonas aeruginosa PA01
gcggccucuucguc

SEQ ID NO: 1439825 - RNA, 17 nt, Pseudomonas aeruginosa PA01
gcggccucuucgucggc

SEQ ID NO: 1439826 - RNA, 20 nt, Pseudomonas aeruginosa PA01
gcggccucuucgucggcgaa

SEQ ID NO: 1439827 - RNA, 19 nt, Pseudomonas aeruginosa PA01
gcggcgaccauccagccug

SEQ ID NO: 1439828 - RNA, 21 nt, Pseudomonas aeruginosa PA01
gcggcgaccauguucaccagc

SEQ ID NO: 1439829 - RNA, 15 nt, Pseudomonas aeruginosa PA01
gcggcgacccagacc

SEQ ID NO: 1439830 - RNA, 13 nt, Pseudomonas aeruginosa PA01
gcggcgaccccga

SEQ ID NO: 1439831 - RNA, 20 nt, Pseudomonas aeruginosa PA01
gcggcgaccccgaucaccgg

SEQ ID NO: 1439832 - RNA, 20 nt, Pseudomonas aeruginosa PA01
gcggcgaccgcaucguuggc

SEQ ID NO: 1439833 - RNA, 21 nt, Pseudomonas aeruginosa PA01
gcggcgaccggccucacgggu

SEQ ID NO: 1439834 - RNA, 13 nt, Pseudomonas aeruginosa PA01
gcggcgagaacuc

SEQ ID NO: 1439835 - RNA, 18 nt, Pseudomonas aeruginosa PA01
gcggcgacaccgccagca

SEQ ID NO: 1439836 - RNA, 23 nt, Pseudomonas aeruginosa PA01
gcggcgacaccgccagcaccugg

SEQ ID NO: 1439837 - RNA, 20 nt, Pseudomonas aeruginosa PA01
gcggcgaagggcgcuucggc

SEQ ID NO: 1439838 - RNA, 22 nt, Pseudomonas aeruginosa PA01
gcggcgaagggcgcuucggcgg

SEQ ID NO: 1439839 - RNA, 23 nt, Pseudomonas aeruginosa PA01
gcggcgaagguggcgaccuggua

SEQ ID NO: 1439840 - RNA, 16 nt, Pseudomonas aeruginosa PA01
gcggcgaagucugccu

SEQ ID NO: 1439841 - RNA, 21 nt, Pseudomonas aeruginosa PA01
gcggcgagaucuucaggccga

SEQ ID NO: 1439842 - RNA, 23 nt, Pseudomonas aeruginosa PA01
gcggcgagaucuucaggccgaag

SEQ ID NO: 1439843 - RNA, 14 nt, Pseudomonas aeruginosa PA01
gcggcgagcagcgg

SEQ ID NO: 1439844 - RNA, 14 nt, Pseudomonas aeruginosa PA01
gcggcgagcaucuc

SEQ ID NO: 1439845 - RNA, 17 nt, Pseudomonas aeruginosa PA01
gcggcgagcaucucggc

SEQ ID NO: 1439846 - RNA, 19 nt, Pseudomonas aeruginosa PA01
gcggcgagcaucucggcca

SEQ ID NO: 1439847 - RNA, 20 nt, Pseudomonas aeruginosa PA01
gcggcgagcaucucggccag

SEQ ID NO: 1439848 - RNA, 21 nt, Pseudomonas aeruginosa PA01
gcggcgagcaucucggccagg

SEQ ID NO: 1439849 - RNA, 22 nt, Pseudomonas aeruginosa PA01
gcggcgagcaucucggccaggc

SEQ ID NO: 1439850 - RNA, 23 nt, Pseudomonas aeruginosa PA01
gcggcgagcauuccucagcgccg

SEQ ID NO: 1439851 - RNA, 13 nt, Pseudomonas aeruginosa PA01
gcggcgagcugga

SEQ ID NO: 1439852 - RNA, 22 nt, Pseudomonas aeruginosa PA01
gcggcgagcuggaucggcaggc

SEQ ID NO: 1439853 - RNA, 23 nt, Pseudomonas aeruginosa PA01
gcggcgagcuggaucggcaggcu

SEQ ID NO: 1439854 - RNA, 20 nt, Pseudomonas aeruginosa PA01
gcggcgagcgggucgauggc

SEQ ID NO: 1439855 - RNA, 17 nt, Pseudomonas aeruginosa PA01
gcggcgagcguucggau

SEQ ID NO: 1439856 - RNA, 16 nt, Pseudomonas aeruginosa PA01
gcggcgauaggcgcgc

SEQ ID NO: 1439857 - RNA, 17 nt, Pseudomonas aeruginosa PA01
gcggcgauaggcgcgca

SEQ ID NO: 1439858 - RNA, 17 nt, Pseudomonas aeruginosa PA01
gcggcgaguugcgcgag

SEQ ID NO: 1439859 - RNA, 18 nt, Pseudomonas aeruginosa PA01
gcggcgaguugcgcgagg

SEQ ID NO: 1439860 - RNA, 14 nt, Pseudomonas aeruginosa PA01
gcggcgagggcgcc

SEQ ID NO: 1439861 - RNA, 15 nt, Pseudomonas aeruginosa PA01
gcggcgagggcgccg

SEQ ID NO: 1439862 - RNA, 16 nt, Pseudomonas aeruginosa PA01
gcggcgagggcgccgg

SEQ ID NO: 1439863 - RNA, 19 nt, Pseudomonas aeruginosa PA01
gcggcgauggccgccagca

SEQ ID NO: 1439864 - RNA, 16 nt, Pseudomonas aeruginosa PA01
gcggcgauggcgucca

SEQ ID NO: 1439865 - RNA, 18 nt, Pseudomonas aeruginosa PA01
gcggcgauggacucgauc

SEQ ID NO: 1439866 - RNA, 21 nt, Pseudomonas aeruginosa PA01
gcggcgaugaccaggguggcg

SEQ ID NO: 1439867 - RNA, 17 nt, Pseudomonas aeruginosa PA01
gcggcgaugaucggcag

SEQ ID NO: 1439868 - RNA, 18 nt, Pseudomonas aeruginosa PA01
gcggcgaugaucggcagc

SEQ ID NO: 1439869 - RNA, 16 nt, Pseudomonas aeruginosa PA01
gcggcgaugcgcaugc

SEQ ID NO: 1439870 - RNA, 20 nt, Pseudomonas aeruginosa PA01
gcggcgaugcgcaugcgcag

SEQ ID NO: 1439871 - RNA, 13 nt, Pseudomonas aeruginosa PA01
gcggcgaugaagc

SEQ ID NO: 1439872 - RNA, 17 nt, Pseudomonas aeruginosa PA01
gcggcgacagcaccacg

SEQ ID NO: 1439873 - RNA, 21 nt, Pseudomonas aeruginosa PA01
gcggcgaguuuguugcgcgag

SEQ ID NO: 1439874 - RNA, 22 nt, Pseudomonas aeruginosa PA01
gcggcgaguuuguugcgcgagg

SEQ ID NO: 1439875 - RNA, 15 nt, Pseudomonas aeruginosa PA01
gcggcgaucgccugg

SEQ ID NO: 1439876 - RNA, 22 nt, Pseudomonas aeruginosa PA01
gcggccggggaacagguucggc

SEQ ID NO: 1439877 - RNA, 15 nt, Pseudomonas aeruginosa PA01
gcggccguagccguc

SEQ ID NO: 1439878 - RNA, 23 nt, Pseudomonas aeruginosa PA01
gcggccguagccgucgaacagca

SEQ ID NO: 1439879 - RNA, 23 nt, Pseudomonas aeruginosa PA01
gcggccggugccuucggcggcgc

SEQ ID NO: 1439880 - RNA, 17 nt, Pseudomonas aeruginosa PA01
gcggccucgaggucggc

SEQ ID NO: 1439881 - RNA, 20 nt, Pseudomonas aeruginosa PA01
gcggccucgaggucggccug

SEQ ID NO: 1439882 - RNA, 23 nt, Pseudomonas aeruginosa PA01
gcggccucgaggucggccuggcu

SEQ ID NO: 1439883 - RNA, 14 nt, Pseudomonas aeruginosa PA01
gcggccucgauggc

SEQ ID NO: 1439884 - RNA, 15 nt, Pseudomonas aeruginosa PA01
gcggccguccucggg

SEQ ID NO: 1439885 - RNA, 13 nt, Pseudomonas aeruginosa PA01
gcggccgucggcc

SEQ ID NO: 1439886 - RNA, 15 nt, Pseudomonas aeruginosa PA01
gcggccgucggccug

SEQ ID NO: 1439887 - RNA, 14 nt, Pseudomonas aeruginosa PA01
gcggccgcuggcga

SEQ ID NO: 1439888 - RNA, 17 nt, Pseudomonas aeruginosa PA01
gcggccgccggcgcccu

SEQ ID NO: 1439889 - RNA, 13 nt, Pseudomonas aeruginosa PA01
gcggccgccuuga

SEQ ID NO: 1439890 - RNA, 13 nt, Pseudomonas aeruginosa PA01
gcggccgccgcgc

SEQ ID NO: 1439891 - RNA, 17 nt, Pseudomonas aeruginosa PA01
gcggccgccgccgacag

SEQ ID NO: 1439892 - RNA, 22 nt, Pseudomonas aeruginosa PA01
gcggccgccgccgacaggucgc

SEQ ID NO: 1439893 - RNA, 13 nt, Pseudomonas aeruginosa PA01
gcggccggauggc

SEQ ID NO: 1439894 - RNA, 17 nt, Pseudomonas aeruginosa PA01
gcggccggauggccgcc

SEQ ID NO: 1439895 - RNA, 19 nt, Pseudomonas aeruginosa PA01
gcggccggauggccgccgu

SEQ ID NO: 1439896 - RNA, 23 nt, Pseudomonas aeruginosa PA01
gcggccggauggccgccguucuc

SEQ ID NO: 1439897 - RNA, 16 nt, Pseudomonas aeruginosa PA01
aagcgcggcucgggga

SEQ ID NO: 1439898 - RNA, 14 nt, Pseudomonas aeruginosa PA01
gcggcaugcccugc

SEQ ID NO: 1439899 - RNA, 18 nt, Pseudomonas aeruginosa PA01
gcggcaugcccugccggc

SEQ ID NO: 1439900 - RNA, 20 nt, Pseudomonas aeruginosa PA01
gcggcaugccguugggccag

SEQ ID NO: 1439901 - RNA, 15 nt, Pseudomonas aeruginosa PA01
gcggccaaccucucc

SEQ ID NO: 1439902 - RNA, 22 nt, Pseudomonas aeruginosa PA01
gcggccaaccucuccccagacc

SEQ ID NO: 1439903 - RNA, 20 nt, Pseudomonas aeruginosa PA01
gcggcaugaugcgcccgucc

SEQ ID NO: 1439904 - RNA, 16 nt, Pseudomonas aeruginosa PA01
gcggcauucgcgcugg

SEQ ID NO: 1439905 - RNA, 17 nt, Pseudomonas aeruginosa PA01
gcggcauugagcgccag

SEQ ID NO: 1439906 - RNA, 18 nt, Pseudomonas aeruginosa PA01
gcggcauugagcgccagc

SEQ ID NO: 1439907 - RNA, 20 nt, Pseudomonas aeruginosa PA01
gcggcauugagcgccagcag

SEQ ID NO: 1439908 - RNA, 18 nt, Pseudomonas aeruginosa PA01
gcggcauugagggcgagg

SEQ ID NO: 1439909 - RNA, 19 nt, Pseudomonas aeruginosa PA01
gcggccgaguucgcgcagg

SEQ ID NO: 1439910 - RNA, 22 nt, Pseudomonas aeruginosa PA01
gcggccgaguucgcgcaggcgc

SEQ ID NO: 1439911 - RNA, 23 nt, Pseudomonas aeruginosa PA01
gcggccgaguucgcgcaggcgcu

SEQ ID NO: 1439912 - RNA, 14 nt, Pseudomonas aeruginosa PA01
gcggccgagggcga

SEQ ID NO: 1439913 - RNA, 18 nt, Pseudomonas aeruginosa PA01
gcggccgagcaggcgcgc

SEQ ID NO: 1439914 - RNA, 24 nt, Pseudomonas aeruginosa PA01
gcggccgagcauguaggcgcacca

SEQ ID NO: 1439915 - RNA, 23 nt, Pseudomonas aeruginosa PA01
gcggccgaggaacuccuccucgc

SEQ ID NO: 1439916 - RNA, 19 nt, Pseudomonas aeruginosa PA01
gcggccgaggaaggcgcug

SEQ ID NO: 1439917 - RNA, 20 nt, Pseudomonas aeruginosa PA01
gcggccgaggaaggcgcugg

SEQ ID NO: 1439918 - RNA, 18 nt, Pseudomonas aeruginosa PA01
gcggccgcaaccagcccu

SEQ ID NO: 1439919 - RNA, 21 nt, Pseudomonas aeruginosa PA01
gcggccgcaaccagcccuggc

SEQ ID NO: 1439920 - RNA, 24 nt, Pseudomonas aeruginosa PA01
gcggccgcaaccagcccuggcgca

SEQ ID NO: 1439921 - RNA, 21 nt, Pseudomonas aeruginosa PA01
gcggccgaugaucuccgcgcc

SEQ ID NO: 1439922 - RNA, 18 nt, Pseudomonas aeruginosa PA01
gcggccgaucaucggcug

SEQ ID NO: 1439923 - RNA, 19 nt, Pseudomonas aeruginosa PA01
gcggccgaucaucggcugg

SEQ ID NO: 1439924 - RNA, 16 nt, Pseudomonas aeruginosa PA01
gcggccgccauuccgg

SEQ ID NO: 1439925 - RNA, 20 nt, Pseudomonas aeruginosa PA01
gcggccgccauuccggaacu

SEQ ID NO: 1439926 - RNA, 12 nt, Pseudomonas aeruginosa PA01
gcggccgccgag

SEQ ID NO: 1439927 - RNA, 13 nt, Pseudomonas aeruginosa PA01
gcggccgccgagc

SEQ ID NO: 1439928 - RNA, 13 nt, Pseudomonas aeruginosa PA01
gcggccgccgaaa

SEQ ID NO: 1439929 - RNA, 14 nt, Pseudomonas aeruginosa PA01
gccgcuuacgcggc

SEQ ID NO: 1439930 - RNA, 16 nt, Pseudomonas aeruginosa PA01
gccgcuuacgcggccu

SEQ ID NO: 1439931 - RNA, 15 nt, Pseudomonas aeruginosa PA01
gccgcuucaagcggc

SEQ ID NO: 1439932 - RNA, 17 nt, Pseudomonas aeruginosa PA01
gccgcuucaagcggcca

SEQ ID NO: 1439933 - RNA, 17 nt, Pseudomonas aeruginosa PA01
gccgcugugugccucug

SEQ ID NO: 1439934 - RNA, 18 nt, Pseudomonas aeruginosa PA01
gccgcugugcagggucag

SEQ ID NO: 1439935 - RNA, 20 nt, Pseudomonas aeruginosa PA01
gccgcugucgucuucggcca

SEQ ID NO: 1439936 - RNA, 22 nt, Pseudomonas aeruginosa PA01
gccgcugucuaucugcgccgaa

SEQ ID NO: 1439937 - RNA, 15 nt, Pseudomonas aeruginosa PA01
gccgcugucguccag

SEQ ID NO: 1439938 - RNA, 22 nt, Pseudomonas aeruginosa PA01
gccgcugucguccagcggguag

SEQ ID NO: 1439939 - RNA, 12 nt, Pseudomonas aeruginosa PA01
gccgcuucggcu

SEQ ID NO: 1439940 - RNA, 22 nt, Pseudomonas aeruginosa PA01
gccgcuucgcgguagacgcagg

SEQ ID NO: 1439941 - RNA, 16 nt, Pseudomonas aeruginosa PA01
gccgcuucgccgcccu

SEQ ID NO: 1439942 - RNA, 15 nt, Pseudomonas aeruginosa PA01
gccgcuuccgccagg

SEQ ID NO: 1439943 - RNA, 22 nt, Pseudomonas aeruginosa PA01
gccgcuuccgccaggcgcagcc

SEQ ID NO: 1439944 - RNA, 14 nt, Pseudomonas aeruginosa PA01
gccgcuuccgccgg

SEQ ID NO: 1439945 - RNA, 19 nt, Pseudomonas aeruginosa PA01
gccgcuuccgccggcgccg

SEQ ID NO: 1439946 - RNA, 20 nt, Pseudomonas aeruginosa PA01
gccgcuuccgccggcgccgc

SEQ ID NO: 1439947 - RNA, 19 nt, Pseudomonas aeruginosa PA01
gccgcuguuacugagcgug

SEQ ID NO: 1439948 - RNA, 16 nt, Pseudomonas aeruginosa PA01
gccgcuuccggcccgg

SEQ ID NO: 1439949 - RNA, 15 nt, Pseudomonas aeruginosa PA01
gccgcuuccggcgcu

SEQ ID NO: 1439950 - RNA, 13 nt, Pseudomonas aeruginosa PA01
gccgcuggcgauc

SEQ ID NO: 1439951 - RNA, 15 nt, Pseudomonas aeruginosa PA01
gccgcuggccgacca

SEQ ID NO: 1439952 - RNA, 12 nt, Pseudomonas aeruginosa PA01
gccgcuggcggc

SEQ ID NO: 1439953 - RNA, 15 nt, Pseudomonas aeruginosa PA01
gccgcuggcggcaug

SEQ ID NO: 1439954 - RNA, 16 nt, Pseudomonas aeruginosa PA01
gccgcuggcggcaugc

SEQ ID NO: 1439955 - RNA, 13 nt, Pseudomonas aeruginosa PA01
gccgcuggcggcc

SEQ ID NO: 1439956 - RNA, 18 nt, Pseudomonas aeruginosa PA01
gccgcuggcgaucucggc

SEQ ID NO: 1439957 - RNA, 20 nt, Pseudomonas aeruginosa PA01
gccgcuggcgaucucggcgc

SEQ ID NO: 1439958 - RNA, 12 nt, Pseudomonas aeruginosa PA01
gccgcuggcgug

SEQ ID NO: 1439959 - RNA, 22 nt, Pseudomonas aeruginosa PA01
gccgcuggcgugguggaugacc

SEQ ID NO: 1439960 - RNA, 22 nt, Pseudomonas aeruginosa PA01
gccgcuggcguuguugccgccg

SEQ ID NO: 1439961 - RNA, 14 nt, Pseudomonas aeruginosa PA01
gccgcuggcggccu

SEQ ID NO: 1439962 - RNA, 16 nt, Pseudomonas aeruginosa PA01
gccgcuggcggccuuc

SEQ ID NO: 1439963 - RNA, 21 nt, Pseudomonas aeruginosa PA01
gccgcuggcggccuucggcgu

SEQ ID NO: 1439964 - RNA, 14 nt, Pseudomonas aeruginosa PA01
gccgcuggcggcga

SEQ ID NO: 1439965 - RNA, 22 nt, Pseudomonas aeruginosa PA01
gccgcuggcggcgacgaagguc

SEQ ID NO: 1439966 - RNA, 20 nt, Pseudomonas aeruginosa PA01
gccgcugguccagcuggcgc

SEQ ID NO: 1439967 - RNA, 16 nt, Pseudomonas aeruginosa PA01
gccgcuggugaucgac

SEQ ID NO: 1439968 - RNA, 17 nt, Pseudomonas aeruginosa PA01
gccgcuggugaucgacc

SEQ ID NO: 1439969 - RNA, 24 nt, Pseudomonas aeruginosa PA01
gccgcugguagcuaccgucggccu

SEQ ID NO: 1439970 - RNA, 12 nt, Pseudomonas aeruginosa PA01
gccgcuggcgcu

SEQ ID NO: 1439971 - RNA, 13 nt, Pseudomonas aeruginosa PA01
gccgcugggcagc

SEQ ID NO: 1439972 - RNA, 14 nt, Pseudomonas aeruginosa PA01
gccgcugccgccgc

SEQ ID NO: 1439973 - RNA, 17 nt, Pseudomonas aeruginosa PA01
gccgcugccgccgcgca

SEQ ID NO: 1439974 - RNA, 19 nt, Pseudomonas aeruginosa PA01
gccgcugccguugcaggcc

SEQ ID NO: 1439975 - RNA, 15 nt, Pseudomonas aeruginosa PA01
gccgcugccugucgc

SEQ ID NO: 1439976 - RNA, 16 nt, Pseudomonas aeruginosa PA01
gccgcugccgcucugg

SEQ ID NO: 1439977 - RNA, 16 nt, Pseudomonas aeruginosa PA01
gccgcugcgcaggccg

SEQ ID NO: 1439978 - RNA, 17 nt, Pseudomonas aeruginosa PA01
gccgcugcgcaggccga

SEQ ID NO: 1439979 - RNA, 19 nt, Pseudomonas aeruginosa PA01
gccgcugcgcaggccgaga

SEQ ID NO: 1439980 - RNA, 16 nt, Pseudomonas aeruginosa PA01
gccgcugcgcaucagg

SEQ ID NO: 1439981 - RNA, 15 nt, Pseudomonas aeruginosa PA01
gccgcuggaaccggc

SEQ ID NO: 1439982 - RNA, 20 nt, Pseudomonas aeruginosa PA01
gccgcuggaaccggccggca

SEQ ID NO: 1439983 - RNA, 14 nt, Pseudomonas aeruginosa PA01
gccgcugcgcgcag

SEQ ID NO: 1439984 - RNA, 13 nt, Pseudomonas aeruginosa PA01
gccgcugcuggca

SEQ ID NO: 1439985 - RNA, 13 nt, Pseudomonas aeruginosa PA01
gccgcugcggcgg

SEQ ID NO: 1439986 - RNA, 14 nt, Pseudomonas aeruginosa PA01
gccgcugcggcucg

SEQ ID NO: 1439987 - RNA, 19 nt, Pseudomonas aeruginosa PA01
gccgcugcggcucgccgau

SEQ ID NO: 1439988 - RNA, 20 nt, Pseudomonas aeruginosa PA01
gccgcugcggcucgccgauu

SEQ ID NO: 1439989 - RNA, 14 nt, Pseudomonas aeruginosa PA01
gccgcugcggcugc

SEQ ID NO: 1439990 - RNA, 17 nt, Pseudomonas aeruginosa PA01
gccgcugcggcugcagg

SEQ ID NO: 1439991 - RNA, 20 nt, Pseudomonas aeruginosa PA01
gccgcugcggcugcagggcc

SEQ ID NO: 1439992 - RNA, 21 nt, Pseudomonas aeruginosa PA01
gccgcugcgucgucgcggcgc

SEQ ID NO: 1439993 - RNA, 23 nt, Pseudomonas aeruginosa PA01
gccgcugcgucgucgcggcgccu

SEQ ID NO: 1439994 - RNA, 13 nt, Pseudomonas aeruginosa PA01
gccgccgcgcagg

SEQ ID NO: 1439995 - RNA, 14 nt, Pseudomonas aeruginosa PA01
gccgccgcgcaggc

SEQ ID NO: 1439996 - RNA, 17 nt, Pseudomonas aeruginosa PA01
gccgccgcgcaggcggu

SEQ ID NO: 1439997 - RNA, 15 nt, Pseudomonas aeruginosa PA01
gccgccgcgccggcg

SEQ ID NO: 1439998 - RNA, 12 nt, Pseudomonas aeruginosa PA01
gccgccgcgccu

SEQ ID NO: 1439999 - RNA, 15 nt, Pseudomonas aeruginosa PA01
gccgccgcgccuuga

SEQ ID NO: 1440000 - RNA, 13 nt, Pseudomonas aeruginosa PA01
gccgccgcgcgcg

SEQ ID NO: 1440001 - RNA, 22 nt, Pseudomonas aeruginosa PA01
gccgccgcgcccggcgccaggc

SEQ ID NO: 1440002 - RNA, 12 nt, Pseudomonas aeruginosa PA01
gccgccgcgccg

SEQ ID NO: 1440003 - RNA, 14 nt, Pseudomonas aeruginosa PA01
gccgccgcgcugca

SEQ ID NO: 1440004 - RNA, 16 nt, Pseudomonas aeruginosa PA01
gccgcugcccagaucc

SEQ ID NO: 1440005 - RNA, 13 nt, Pseudomonas aeruginosa PA01
gccgccgcgccgg

SEQ ID NO: 1440006 - RNA, 22 nt, Pseudomonas aeruginosa PA01
gccgcuugagaccuucgcgggu

SEQ ID NO: 1440007 - RNA, 20 nt, Pseudomonas aeruginosa PA01
gccgcuuggagcgggcgccg

SEQ ID NO: 1440008 - RNA, 19 nt, Pseudomonas aeruginosa PA01
gccgcuuggccauggcgcu

SEQ ID NO: 1440009 - RNA, 20 nt, Pseudomonas aeruginosa PA01
gccgcuugcccucgcgcccg

SEQ ID NO: 1440010 - RNA, 21 nt, Pseudomonas aeruginosa PA01
gccgcuugcccucgcgcccgg

SEQ ID NO: 1440011 - RNA, 16 nt, Pseudomonas aeruginosa PA01
gccgcuucuucccgcc

SEQ ID NO: 1440012 - RNA, 20 nt, Pseudomonas aeruginosa PA01
gccgcuucuucccgcccauc

SEQ ID NO: 1440013 - RNA, 17 nt, Pseudomonas aeruginosa PA01
gccggaaagcaguucgc

SEQ ID NO: 1440014 - RNA, 18 nt, Pseudomonas aeruginosa PA01
gccggaaagcaguucgcc

SEQ ID NO: 1440015 - RNA, 15 nt, Pseudomonas aeruginosa PA01
gccggaaagccuggc

SEQ ID NO: 1440016 - RNA, 18 nt, Pseudomonas aeruginosa PA01
gccggaaagccuggccgg

SEQ ID NO: 1440017 - RNA, 19 nt, Pseudomonas aeruginosa PA01
gccggaaagccuggccggc

SEQ ID NO: 1440018 - RNA, 20 nt, Pseudomonas aeruginosa PA01
gccggaaagccuggccggcg

SEQ ID NO: 1440019 - RNA, 20 nt, Pseudomonas aeruginosa PA01
gccgcuuugcagggucacgc

SEQ ID NO: 1440020 - RNA, 18 nt, Pseudomonas aeruginosa PA01
gccggacaacaggccggg

SEQ ID NO: 1440021 - RNA, 20 nt, Pseudomonas aeruginosa PA01
gccggacaacaggccgggcg

SEQ ID NO: 1440022 - RNA, 13 nt, Pseudomonas aeruginosa PA01
gccggaaucacgc

SEQ ID NO: 1440023 - RNA, 19 nt, Pseudomonas aeruginosa PA01
gccggaaucacgcugcucg

SEQ ID NO: 1440024 - RNA, 14 nt, Pseudomonas aeruginosa PA01
gccggaaagcagaa

SEQ ID NO: 1440025 - RNA, 23 nt, Pseudomonas aeruginosa PA01
gccggaagcuucaggcucggccu

SEQ ID NO: 1440026 - RNA, 21 nt, Pseudomonas aeruginosa PA01
gccggaaguggcagcgccguu

SEQ ID NO: 1440027 - RNA, 11 nt, Pseudomonas aeruginosa PA01
gccggaagcgc

SEQ ID NO: 1440028 - RNA, 18 nt, Pseudomonas aeruginosa PA01
gccggaagacggaaacgc

SEQ ID NO: 1440029 - RNA, 23 nt, Pseudomonas aeruginosa PA01
gccggacaggaaaaagcccgcgu

SEQ ID NO: 1440030 - RNA, 18 nt, Pseudomonas aeruginosa PA01
gccggacaggccacccgc

SEQ ID NO: 1440031 - RNA, 22 nt, Pseudomonas aeruginosa PA01
gccggacaggccacccgccucg

SEQ ID NO: 1440032 - RNA, 18 nt, Pseudomonas aeruginosa PA01
gccggaccagaucggcgc

SEQ ID NO: 1440033 - RNA, 22 nt, Pseudomonas aeruginosa PA01
gccggagggaaugaagaagccc

SEQ ID NO: 1440034 - RNA, 20 nt, Pseudomonas aeruginosa PA01
gccggaggggcggccgccga

SEQ ID NO: 1440035 - RNA, 24 nt, Pseudomonas aeruginosa PA01
gccggaggggcggccgccgagcaa

SEQ ID NO: 1440036 - RNA, 18 nt, Pseudomonas aeruginosa PA01
gccggagccaccgggauc

SEQ ID NO: 1440037 - RNA, 13 nt, Pseudomonas aeruginosa PA01
gccggacccugcc

SEQ ID NO: 1440038 - RNA, 13 nt, Pseudomonas aeruginosa PA01
gccggacgcacca

SEQ ID NO: 1440039 - RNA, 16 nt, Pseudomonas aeruginosa PA01
gccggacgcaccagca

SEQ ID NO: 1440040 - RNA, 15 nt, Pseudomonas aeruginosa PA01
gccggacgcgacugc

SEQ ID NO: 1440041 - RNA, 17 nt, Pseudomonas aeruginosa PA01
gccggacguuuccagcg

SEQ ID NO: 1440042 - RNA, 17 nt, Pseudomonas aeruginosa PA01
gccggacuccgacgcgu

SEQ ID NO: 1440043 - RNA, 13 nt, Pseudomonas aeruginosa PA01
gccggacggcggc

SEQ ID NO: 1440044 - RNA, 15 nt, Pseudomonas aeruginosa PA01
gccggacggcggcgu

SEQ ID NO: 1440045 - RNA, 21 nt, Pseudomonas aeruginosa PA01
gccggcaccgucgagcaccag

SEQ ID NO: 1440046 - RNA, 14 nt, Pseudomonas aeruginosa PA01
gccggcacggcauc

SEQ ID NO: 1440047 - RNA, 16 nt, Pseudomonas aeruginosa PA01
gccggcacgcucaggc

SEQ ID NO: 1440048 - RNA, 20 nt, Pseudomonas aeruginosa PA01
gccggcacgcucaggcgcag

SEQ ID NO: 1440049 - RNA, 13 nt, Pseudomonas aeruginosa PA01
gccggcagcagcg

SEQ ID NO: 1440050 - RNA, 14 nt, Pseudomonas aeruginosa PA01
gccggcagcagcgc

SEQ ID NO: 1440051 - RNA, 15 nt, Pseudomonas aeruginosa PA01
gccggcagcagcgcc

SEQ ID NO: 1440052 - RNA, 18 nt, Pseudomonas aeruginosa PA01
gccggcagcagcgccagg

SEQ ID NO: 1440053 - RNA, 19 nt, Pseudomonas aeruginosa PA01
gccggcagcagcgccagga

SEQ ID NO: 1440054 - RNA, 16 nt, Pseudomonas aeruginosa PA01
gccggcagcuccggcg

SEQ ID NO: 1440055 - RNA, 13 nt, Pseudomonas aeruginosa PA01
gccggcagcucgg

SEQ ID NO: 1440056 - RNA, 18 nt, Pseudomonas aeruginosa PA01
gccggcagcucggccgag

SEQ ID NO: 1440057 - RNA, 19 nt, Pseudomonas aeruginosa PA01
gccggcagcucggccgagg

SEQ ID NO: 1440058 - RNA, 21 nt, Pseudomonas aeruginosa PA01
gccggcagcucggccgagggc

SEQ ID NO: 1440059 - RNA, 20 nt, Pseudomonas aeruginosa PA01
gccggcaggaggaucgcggc

SEQ ID NO: 1440060 - RNA, 22 nt, Pseudomonas aeruginosa PA01
gccggcaggaggaucgcggccu

SEQ ID NO: 1440061 - RNA, 12 nt, Pseudomonas aeruginosa PA01
gccggcaggccg

SEQ ID NO: 1440062 - RNA, 14 nt, Pseudomonas aeruginosa PA01
gccggcaggccgau

SEQ ID NO: 1440063 - RNA, 17 nt, Pseudomonas aeruginosa PA01
gccggcaggccgauggc

SEQ ID NO: 1440064 - RNA, 18 nt, Pseudomonas aeruginosa PA01
gccggcaggccgauggcc

SEQ ID NO: 1440065 - RNA, 22 nt, Pseudomonas aeruginosa PA01
gccggcaggccgauggccccgg

SEQ ID NO: 1440066 - RNA, 13 nt, Pseudomonas aeruginosa PA01
gccggcagcgccg

SEQ ID NO: 1440067 - RNA, 17 nt, Pseudomonas aeruginosa PA01
gccggcagcgccgcgcg

SEQ ID NO: 1440068 - RNA, 17 nt, Pseudomonas aeruginosa PA01
gccggcagugugccgcc

SEQ ID NO: 1440069 - RNA, 22 nt, Pseudomonas aeruginosa PA01
gccggcauagccgaacuccgcc

SEQ ID NO: 1440070 - RNA, 17 nt, Pseudomonas aeruginosa PA01
gccggcaggcugugcca

SEQ ID NO: 1440071 - RNA, 12 nt, Pseudomonas aeruginosa PA01
gccggcaggccu

SEQ ID NO: 1440072 - RNA, 18 nt, Pseudomonas aeruginosa PA01
gccggcaggccuucggcg

SEQ ID NO: 1440073 - RNA, 21 nt, Pseudomonas aeruginosa PA01
gccggcaggccuucggcgccg

SEQ ID NO: 1440074 - RNA, 12 nt, Pseudomonas aeruginosa PA01
gccggcagcagc

SEQ ID NO: 1440075 - RNA, 15 nt, Pseudomonas aeruginosa PA01
gccggcaucgccaug

SEQ ID NO: 1440076 - RNA, 17 nt, Pseudomonas aeruginosa PA01
gccggcaucgccauggc

SEQ ID NO: 1440077 - RNA, 19 nt, Pseudomonas aeruginosa PA01
gccggcaucgccauggcgc

SEQ ID NO: 1440078 - RNA, 20 nt, Pseudomonas aeruginosa PA01
gccggcaucgccauggcgcu

SEQ ID NO: 1440079 - RNA, 15 nt, Pseudomonas aeruginosa PA01
gccggcauccagcau

SEQ ID NO: 1440080 - RNA, 22 nt, Pseudomonas aeruginosa PA01
gccggcauccuguggcugcagg

SEQ ID NO: 1440081 - RNA, 14 nt, Pseudomonas aeruginosa PA01
gccggcaucguggc

SEQ ID NO: 1440082 - RNA, 16 nt, Pseudomonas aeruginosa PA01
gccggcauugcacuuc

SEQ ID NO: 1440083 - RNA, 20 nt, Pseudomonas aeruginosa PA01
gccggcaugcucagccgcgc

SEQ ID NO: 1440084 - RNA, 21 nt, Pseudomonas aeruginosa PA01
gccggcaugcucagccgcgcc

SEQ ID NO: 1440085 - RNA, 22 nt, Pseudomonas aeruginosa PA01
gccggcaugcucagccgcgccg

SEQ ID NO: 1440086 - RNA, 17 nt, Pseudomonas aeruginosa PA01
gccggccaaccaccggc

SEQ ID NO: 1440087 - RNA, 20 nt, Pseudomonas aeruginosa PA01
gccggccaaccaccggcgca

SEQ ID NO: 1440088 - RNA, 21 nt, Pseudomonas aeruginosa PA01
gccggccaccaucacgucgcg

SEQ ID NO: 1440089 - RNA, 14 nt, Pseudomonas aeruginosa PA01
gccggccaccaggc

SEQ ID NO: 1440090 - RNA, 15 nt, Pseudomonas aeruginosa PA01
gccggccaccaggcu

SEQ ID NO: 1440091 - RNA, 18 nt, Pseudomonas aeruginosa PA01
gccggccacgcgaccagc

SEQ ID NO: 1440092 - RNA, 21 nt, Pseudomonas aeruginosa PA01
gccggccacgcgaccagcgcc

SEQ ID NO: 1440093 - RNA, 19 nt, Pseudomonas aeruginosa PA01
gccggccagcaccuucacc

SEQ ID NO: 1440094 - RNA, 22 nt, Pseudomonas aeruginosa PA01
gccggccagcaccuucaccgug

SEQ ID NO: 1440095 - RNA, 16 nt, Pseudomonas aeruginosa PA01
gccggccagccgcgcc

SEQ ID NO: 1440096 - RNA, 23 nt, Pseudomonas aeruginosa PA01
gccggagucguagcgcgcggcga

SEQ ID NO: 1440097 - RNA, 14 nt, Pseudomonas aeruginosa PA01
gccggagugccgcg

SEQ ID NO: 1440098 - RNA, 17 nt, Pseudomonas aeruginosa PA01
gccggaucggccuuggc

SEQ ID NO: 1440099 - RNA, 19 nt, Pseudomonas aeruginosa PA01
gccggaucggccuuggcga

SEQ ID NO: 1440100 - RNA, 21 nt, Pseudomonas aeruginosa PA01
gccggaucggccuuggcgaug

SEQ ID NO: 1440101 - RNA, 18 nt, Pseudomonas aeruginosa PA01
gccggaucggcugaccgg

SEQ ID NO: 1440102 - RNA, 23 nt, Pseudomonas aeruginosa PA01
gccggauucgcgcagcaggcggc

SEQ ID NO: 1440103 - RNA, 14 nt, Pseudomonas aeruginosa PA01
gccggauuggccga

SEQ ID NO: 1440104 - RNA, 17 nt, Pseudomonas aeruginosa PA01
gccggauuggccgaggu

SEQ ID NO: 1440105 - RNA, 15 nt, Pseudomonas aeruginosa PA01
gccggcaaacgccgc

SEQ ID NO: 1440106 - RNA, 16 nt, Pseudomonas aeruginosa PA01
gccggcaaacgccgcc

SEQ ID NO: 1440107 - RNA, 17 nt, Pseudomonas aeruginosa PA01
gccggcaaacgccgcca

SEQ ID NO: 1440108 - RNA, 18 nt, Pseudomonas aeruginosa PA01
gccggcaaacgccgccac

SEQ ID NO: 1440109 - RNA, 23 nt, Pseudomonas aeruginosa PA01
gccggcaaacgccgccaccaacc

SEQ ID NO: 1440110 - RNA, 15 nt, Pseudomonas aeruginosa PA01
gccggaugccaccgc

SEQ ID NO: 1440111 - RNA, 13 nt, Pseudomonas aeruginosa PA01
gccggauggccgc

SEQ ID NO: 1440112 - RNA, 22 nt, Pseudomonas aeruginosa PA01
gccggcaacgaacuucagggcu

SEQ ID NO: 1440113 - RNA, 17 nt, Pseudomonas aeruginosa PA01
gccggcaagcgugcccc

SEQ ID NO: 1440114 - RNA, 19 nt, Pseudomonas aeruginosa PA01
gccggcaagcgugccccga

SEQ ID NO: 1440115 - RNA, 13 nt, Pseudomonas aeruginosa PA01
gccggcaccagca

SEQ ID NO: 1440116 - RNA, 12 nt, Pseudomonas aeruginosa PA01
gccggcaccagc

SEQ ID NO: 1440117 - RNA, 14 nt, Pseudomonas aeruginosa PA01
gccggcacccugac

SEQ ID NO: 1440118 - RNA, 16 nt, Pseudomonas aeruginosa PA01
gccggcacccggagga

SEQ ID NO: 1440119 - RNA, 17 nt, Pseudomonas aeruginosa PA01
gccggcgaugccgccca

SEQ ID NO: 1440120 - RNA, 19 nt, Pseudomonas aeruginosa PA01
gccggcgaugccgcccagc

SEQ ID NO: 1440121 - RNA, 20 nt, Pseudomonas aeruginosa PA01
gccggcgaugccgcccagca

SEQ ID NO: 1440122 - RNA, 13 nt, Pseudomonas aeruginosa PA01
gccggcgaugcgu

SEQ ID NO: 1440123 - RNA, 17 nt, Pseudomonas aeruginosa PA01
gccggcgauggccgccu

SEQ ID NO: 1440124 - RNA, 20 nt, Pseudomonas aeruginosa PA01
gccggcgauggccgccugca

SEQ ID NO: 1440125 - RNA, 22 nt, Pseudomonas aeruginosa PA01
gccggcgaugugcggcguggcg

SEQ ID NO: 1440126 - RNA, 20 nt, Pseudomonas aeruginosa PA01
gccggcgaucuccgccaggc

SEQ ID NO: 1440127 - RNA, 22 nt, Pseudomonas aeruginosa PA01
gccggcgaucuccgccaggcgg

SEQ ID NO: 1440128 - RNA, 14 nt, Pseudomonas aeruginosa PA01
gccggcgaucagcg

SEQ ID NO: 1440129 - RNA, 15 nt, Pseudomonas aeruginosa PA01
gccggcgaucaucca

SEQ ID NO: 1440130 - RNA, 18 nt, Pseudomonas aeruginosa PA01
gccggcgaucauccagcc

SEQ ID NO: 1440131 - RNA, 19 nt, Pseudomonas aeruginosa PA01
gccggcgaucauccagccc

SEQ ID NO: 1440132 - RNA, 13 nt, Pseudomonas aeruginosa PA01
gccggcgauccgc

SEQ ID NO: 1440133 - RNA, 22 nt, Pseudomonas aeruginosa PA01
gccggcgaugcccaggccgccg

SEQ ID NO: 1440134 - RNA, 16 nt, Pseudomonas aeruginosa PA01
gccggcgcaucgucga

SEQ ID NO: 1440135 - RNA, 15 nt, Pseudomonas aeruginosa PA01
gccggcgcaugcgcc

SEQ ID NO: 1440136 - RNA, 18 nt, Pseudomonas aeruginosa PA01
gccggcgcaugcgccggc

SEQ ID NO: 1440137 - RNA, 19 nt, Pseudomonas aeruginosa PA01
gccggcgcaugcgccggcu

SEQ ID NO: 1440138 - RNA, 22 nt, Pseudomonas aeruginosa PA01
gccggcgcagaucgcggcgcag

SEQ ID NO: 1440139 - RNA, 19 nt, Pseudomonas aeruginosa PA01
gccggcgcaucagcgccgg

SEQ ID NO: 1440140 - RNA, 21 nt, Pseudomonas aeruginosa PA01
gccggcgcaucagcgccgguu

SEQ ID NO: 1440141 - RNA, 21 nt, Pseudomonas aeruginosa PA01
gccggcgccaucgaucagcag

SEQ ID NO: 1440142 - RNA, 23 nt, Pseudomonas aeruginosa PA01
gccggcgccaucgaucagcagcg

SEQ ID NO: 1440143 - RNA, 13 nt, Pseudomonas aeruginosa PA01
gccggcgccagca

SEQ ID NO: 1440144 - RNA, 16 nt, Pseudomonas aeruginosa PA01
gccggcgccagcaggc

SEQ ID NO: 1440145 - RNA, 15 nt, Pseudomonas aeruginosa PA01
gccggcgccgaugcg

SEQ ID NO: 1440146 - RNA, 13 nt, Pseudomonas aeruginosa PA01
gccggcgcccugc

SEQ ID NO: 1440147 - RNA, 14 nt, Pseudomonas aeruginosa PA01
gccggcgcccugcu

SEQ ID NO: 1440148 - RNA, 17 nt, Pseudomonas aeruginosa PA01
gccggcgcccugggcgc

SEQ ID NO: 1440149 - RNA, 13 nt, Pseudomonas aeruginosa PA01
gccggcgccgccg

SEQ ID NO: 1440150 - RNA, 15 nt, Pseudomonas aeruginosa PA01
gccggcgccgccgaa

SEQ ID NO: 1440151 - RNA, 20 nt, Pseudomonas aeruginosa PA01
gccggcgccgccgaacaugc

SEQ ID NO: 1440152 - RNA, 15 nt, Pseudomonas aeruginosa PA01
gccggcgccgauucc

SEQ ID NO: 1440153 - RNA, 13 nt, Pseudomonas aeruginosa PA01
gccggcgccgccu

SEQ ID NO: 1440154 - RNA, 21 nt, Pseudomonas aeruginosa PA01
gccggcgccgccucgggcagc

SEQ ID NO: 1440155 - RNA, 14 nt, Pseudomonas aeruginosa PA01
gccggcgccgcggu

SEQ ID NO: 1440156 - RNA, 19 nt, Pseudomonas aeruginosa PA01
gccggcgccuucaucgcca

SEQ ID NO: 1440157 - RNA, 20 nt, Pseudomonas aeruginosa PA01
gccggcgccuugcgccaggc

SEQ ID NO: 1440158 - RNA, 13 nt, Pseudomonas aeruginosa PA01
gccggcgccgucg

SEQ ID NO: 1440159 - RNA, 14 nt, Pseudomonas aeruginosa PA01
gccggcgccgucga

SEQ ID NO: 1440160 - RNA, 19 nt, Pseudomonas aeruginosa PA01
gccggcgcgauccuggcgg

SEQ ID NO: 1440161 - RNA, 20 nt, Pseudomonas aeruginosa PA01
gccggcgcgauccuggcggc

SEQ ID NO: 1440162 - RNA, 16 nt, Pseudomonas aeruginosa PA01
gccggcgcgcacggag

SEQ ID NO: 1440163 - RNA, 21 nt, Pseudomonas aeruginosa PA01
gccggcgcgcacggaggcgcu

SEQ ID NO: 1440164 - RNA, 18 nt, Pseudomonas aeruginosa PA01
gccggcgcgccccugcgc

SEQ ID NO: 1440165 - RNA, 14 nt, Pseudomonas aeruginosa PA01
gccggcgcgcccgg

SEQ ID NO: 1440166 - RNA, 15 nt, Pseudomonas aeruginosa PA01
gccggcgcgcccggc

SEQ ID NO: 1440167 - RNA, 20 nt, Pseudomonas aeruginosa PA01
gccggcgcgcccggcgcccu

SEQ ID NO: 1440168 - RNA, 14 nt, Pseudomonas aeruginosa PA01
gccggcgcgcccag

SEQ ID NO: 1440169 - RNA, 15 nt, Pseudomonas aeruginosa PA01
gccggcgcgcccagg

SEQ ID NO: 1440170 - RNA, 18 nt, Pseudomonas aeruginosa PA01
gccggcgcgcccaggccc

SEQ ID NO: 1440171 - RNA, 12 nt, Pseudomonas aeruginosa PA01
gccggcgcgcgg

SEQ ID NO: 1440172 - RNA, 24 nt, Pseudomonas aeruginosa PA01
gccggcgcguucacuccacgagga

SEQ ID NO: 1440173 - RNA, 15 nt, Pseudomonas aeruginosa PA01
gccggcgcucggcca

SEQ ID NO: 1440174 - RNA, 17 nt, Pseudomonas aeruginosa PA01
gccggcgcucggccagg

SEQ ID NO: 1440175 - RNA, 15 nt, Pseudomonas aeruginosa PA01
gccggcgcuucugcg

SEQ ID NO: 1440176 - RNA, 20 nt, Pseudomonas aeruginosa PA01
gccggcgcugucucgccagc

SEQ ID NO: 1440177 - RNA, 12 nt, Pseudomonas aeruginosa PA01
gccggcgcugcg

SEQ ID NO: 1440178 - RNA, 16 nt, Pseudomonas aeruginosa PA01
gccggcgcugcgagcg

SEQ ID NO: 1440179 - RNA, 17 nt, Pseudomonas aeruginosa PA01
gccggcgcugcgagcgc

SEQ ID NO: 1440180 - RNA, 15 nt, Pseudomonas aeruginosa PA01
gccggcgcggcguuc

SEQ ID NO: 1440181 - RNA, 14 nt, Pseudomonas aeruginosa PA01
gccggcgcgcggcg

SEQ ID NO: 1440182 - RNA, 13 nt, Pseudomonas aeruginosa PA01
gccggcgcgcggu

SEQ ID NO: 1440183 - RNA, 16 nt, Pseudomonas aeruginosa PA01
gccggcgcgggcggcc

SEQ ID NO: 1440184 - RNA, 19 nt, Pseudomonas aeruginosa PA01
gccggcgcgucgcugcgca

SEQ ID NO: 1440185 - RNA, 24 nt, Pseudomonas aeruginosa PA01
gccggcgcgucgcugcgcaacugc

SEQ ID NO: 1440186 - RNA, 15 nt, Pseudomonas aeruginosa PA01
gccggcggccggcgc

SEQ ID NO: 1440187 - RNA, 19 nt, Pseudomonas aeruginosa PA01
gccggcggccugagccggc

SEQ ID NO: 1440188 - RNA, 17 nt, Pseudomonas aeruginosa PA01
gccggcggcggacgcag

SEQ ID NO: 1440189 - RNA, 22 nt, Pseudomonas aeruginosa PA01
gccggcggcggacgcaggccga

SEQ ID NO: 1440190 - RNA, 17 nt, Pseudomonas aeruginosa PA01
gccggcggcgcggcagu

SEQ ID NO: 1440191 - RNA, 23 nt, Pseudomonas aeruginosa PA01
gccggcggcgcguccaccuggcg

SEQ ID NO: 1440192 - RNA, 12 nt, Pseudomonas aeruginosa PA01
gccggcggccga

SEQ ID NO: 1440193 - RNA, 12 nt, Pseudomonas aeruginosa PA01
gccggcggcauc

SEQ ID NO: 1440194 - RNA, 17 nt, Pseudomonas aeruginosa PA01
gccggcggaucacaggc

SEQ ID NO: 1440195 - RNA, 18 nt, Pseudomonas aeruginosa PA01
gccggcggaucacaggcu

SEQ ID NO: 1440196 - RNA, 19 nt, Pseudomonas aeruginosa PA01
gccggcggaucagcccgcu

SEQ ID NO: 1440197 - RNA, 20 nt, Pseudomonas aeruginosa PA01
gccggcggaucagcccgcug

SEQ ID NO: 1440198 - RNA, 21 nt, Pseudomonas aeruginosa PA01
gccggcggaucagcccgcuga

SEQ ID NO: 1440199 - RNA, 23 nt, Pseudomonas aeruginosa PA01
gccggcggaucagcccgcugacc

SEQ ID NO: 1440200 - RNA, 11 nt, Pseudomonas aeruginosa PA01
gccggcggcgu

SEQ ID NO: 1440201 - RNA, 15 nt, Pseudomonas aeruginosa PA01
gccggcgggcgcgag

SEQ ID NO: 1440202 - RNA, 17 nt, Pseudomonas aeruginosa PA01
gccggcgggcgcgaggc

SEQ ID NO: 1440203 - RNA, 22 nt, Pseudomonas aeruginosa PA01
gccggcgggcgcgaggcgcccg

SEQ ID NO: 1440204 - RNA, 21 nt, Pseudomonas aeruginosa PA01
gccggcggggaagccuucgcc

SEQ ID NO: 1440205 - RNA, 17 nt, Pseudomonas aeruginosa PA01
gccggcgucguccugcg

SEQ ID NO: 1440206 - RNA, 19 nt, Pseudomonas aeruginosa PA01
gccggcgucguccugcgcg

SEQ ID NO: 1440207 - RNA, 18 nt, Pseudomonas aeruginosa PA01
gccggcgguggacgucgg

SEQ ID NO: 1440208 - RNA, 19 nt, Pseudomonas aeruginosa PA01
gccggcgguggacgucggc

SEQ ID NO: 1440209 - RNA, 21 nt, Pseudomonas aeruginosa PA01
gccggcgguggacgucggcgu

SEQ ID NO: 1440210 - RNA, 23 nt, Pseudomonas aeruginosa PA01
gccggcggugagggcgacggcgg

SEQ ID NO: 1440211 - RNA, 15 nt, Pseudomonas aeruginosa PA01
gccggcgugcccauc

SEQ ID NO: 1440212 - RNA, 13 nt, Pseudomonas aeruginosa PA01
gccggcgugcccu

SEQ ID NO: 1440213 - RNA, 12 nt, Pseudomonas aeruginosa PA01
gccggcgugccg

SEQ ID NO: 1440214 - RNA, 14 nt, Pseudomonas aeruginosa PA01
gccggcgugaacgc

SEQ ID NO: 1440215 - RNA, 19 nt, Pseudomonas aeruginosa PA01
gccggcgugaacgcggcga

SEQ ID NO: 1440216 - RNA, 20 nt, Pseudomonas aeruginosa PA01
gccggcgugaacgcggcgag

SEQ ID NO: 1440217 - RNA, 15 nt, Pseudomonas aeruginosa PA01
gccggcguucgacgc

SEQ ID NO: 1440218 - RNA, 17 nt, Pseudomonas aeruginosa PA01
gccggcguuauccgccg

SEQ ID NO: 1440219 - RNA, 19 nt, Pseudomonas aeruginosa PA01
gccggcguuauccgccgau

SEQ ID NO: 1440220 - RNA, 20 nt, Pseudomonas aeruginosa PA01
gccggcguuauccgccgaua

SEQ ID NO: 1440221 - RNA, 17 nt, Pseudomonas aeruginosa PA01
gccgggauaugggugau

SEQ ID NO: 1440222 - RNA, 20 nt, Pseudomonas aeruginosa PA01
gccgggaucuccucgacggc

SEQ ID NO: 1440223 - RNA, 13 nt, Pseudomonas aeruginosa PA01
gccgggaucaccu

SEQ ID NO: 1440224 - RNA, 14 nt, Pseudomonas aeruginosa PA01
gccgggaucaccuc

SEQ ID NO: 1440225 - RNA, 17 nt, Pseudomonas aeruginosa PA01
gccgggaucaccucgaa

SEQ ID NO: 1440226 - RNA, 17 nt, Pseudomonas aeruginosa PA01
gccgggauacagcagcc

SEQ ID NO: 1440227 - RNA, 14 nt, Pseudomonas aeruginosa PA01
gccggcugccgcgc

SEQ ID NO: 1440228 - RNA, 15 nt, Pseudomonas aeruginosa PA01
gccggcugccgcgcg

SEQ ID NO: 1440229 - RNA, 15 nt, Pseudomonas aeruginosa PA01
gccgggauauccagg

SEQ ID NO: 1440230 - RNA, 14 nt, Pseudomonas aeruginosa PA01
gccggcugccgaag

SEQ ID NO: 1440231 - RNA, 17 nt, Pseudomonas aeruginosa PA01
gccggcugaugcccggg

SEQ ID NO: 1440232 - RNA, 20 nt, Pseudomonas aeruginosa PA01
gccggcugaugcccgggucg

SEQ ID NO: 1440233 - RNA, 14 nt, Pseudomonas aeruginosa PA01
gccggcuccuugcg

SEQ ID NO: 1440234 - RNA, 19 nt, Pseudomonas aeruginosa PA01
gccggcuccuugcgccguu

SEQ ID NO: 1440235 - RNA, 13 nt, Pseudomonas aeruginosa PA01
gccggcucgccca

SEQ ID NO: 1440236 - RNA, 15 nt, Pseudomonas aeruginosa PA01
gccggcucgcccagc

SEQ ID NO: 1440237 - RNA, 16 nt, Pseudomonas aeruginosa PA01
gccggcucgcccagca

SEQ ID NO: 1440238 - RNA, 21 nt, Pseudomonas aeruginosa PA01
gccggcucgcccagcaggcgc

SEQ ID NO: 1440239 - RNA, 16 nt, Pseudomonas aeruginosa PA01
gccggcgaccuugucc

SEQ ID NO: 1440240 - RNA, 17 nt, Pseudomonas aeruginosa PA01
gccggcgaccuugucca

SEQ ID NO: 1440241 - RNA, 19 nt, Pseudomonas aeruginosa PA01
gccggcgaccagcgucgcg

SEQ ID NO: 1440242 - RNA, 20 nt, Pseudomonas aeruginosa PA01
gccggcgaccagcucgaagc

SEQ ID NO: 1440243 - RNA, 17 nt, Pseudomonas aeruginosa PA01
gccggcgacgacgaucc

SEQ ID NO: 1440244 - RNA, 18 nt, Pseudomonas aeruginosa PA01
gccggcgacgacgauccc

SEQ ID NO: 1440245 - RNA, 20 nt, Pseudomonas aeruginosa PA01
gccggcgacgacgaucccgg

SEQ ID NO: 1440246 - RNA, 20 nt, Pseudomonas aeruginosa PA01
gccggcgacgcaggacgucg

SEQ ID NO: 1440247 - RNA, 15 nt, Pseudomonas aeruginosa PA01
gccggcgagccaggu

SEQ ID NO: 1440248 - RNA, 15 nt, Pseudomonas aeruginosa PA01
gccggcgagccgcug

SEQ ID NO: 1440249 - RNA, 16 nt, Pseudomonas aeruginosa PA01
gccggcgagccgcugg

SEQ ID NO: 1440250 - RNA, 18 nt, Pseudomonas aeruginosa PA01
gccggcgagccgcuggca

SEQ ID NO: 1440251 - RNA, 22 nt, Pseudomonas aeruginosa PA01
gccggcgacggucagcaggccc

SEQ ID NO: 1440252 - RNA, 24 nt, Pseudomonas aeruginosa PA01
gccggcgacggucagcaggcccga

SEQ ID NO: 1440253 - RNA, 20 nt, Pseudomonas aeruginosa PA01
gccggcgaggaucgcgcugg

SEQ ID NO: 1440254 - RNA, 16 nt, Pseudomonas aeruginosa PA01
gccggcgaggcguucc

SEQ ID NO: 1440255 - RNA, 12 nt, Pseudomonas aeruginosa PA01
gccggcgaucgc

SEQ ID NO: 1440256 - RNA, 13 nt, Pseudomonas aeruginosa PA01
gccggcgaucgcc

SEQ ID NO: 1440257 - RNA, 19 nt, Pseudomonas aeruginosa PA01
gccggcgaucgccaggcga

SEQ ID NO: 1440258 - RNA, 23 nt, Pseudomonas aeruginosa PA01
gccggcgaucgccaggcgaucca

SEQ ID NO: 1440259 - RNA, 14 nt, Pseudomonas aeruginosa PA01
gccggcgaucgccg

SEQ ID NO: 1440260 - RNA, 15 nt, Pseudomonas aeruginosa PA01
gccggcgaucgccgg

SEQ ID NO: 1440261 - RNA, 16 nt, Pseudomonas aeruginosa PA01
gccggcgaucgccggc

SEQ ID NO: 1440262 - RNA, 17 nt, Pseudomonas aeruginosa PA01
gccggcgaucgccggcg

SEQ ID NO: 1440263 - RNA, 15 nt, Pseudomonas aeruginosa PA01
aagcauucagcgcgc

SEQ ID NO: 1440264 - RNA, 22 nt, Pseudomonas aeruginosa PA01
gccggcgaacucguagacgaau

SEQ ID NO: 1440265 - RNA, 17 nt, Pseudomonas aeruginosa PA01
gccggcgaacucguugu

SEQ ID NO: 1440266 - RNA, 18 nt, Pseudomonas aeruginosa PA01
gccggcgaacagccagcg

SEQ ID NO: 1440267 - RNA, 19 nt, Pseudomonas aeruginosa PA01
gccggcgaacagccagcgg

SEQ ID NO: 1440268 - RNA, 13 nt, Pseudomonas aeruginosa PA01
gccggcgaacagg

SEQ ID NO: 1440269 - RNA, 22 nt, Pseudomonas aeruginosa PA01
gccggcgaaccaggcggccgaa

SEQ ID NO: 1440270 - RNA, 19 nt, Pseudomonas aeruginosa PA01
gccggcgaagggcaggccg

SEQ ID NO: 1440271 - RNA, 20 nt, Pseudomonas aeruginosa PA01
gccggcgaagggcaggccga

SEQ ID NO: 1440272 - RNA, 21 nt, Pseudomonas aeruginosa PA01
gccggcgaagucguagucgua

SEQ ID NO: 1440273 - RNA, 23 nt, Pseudomonas aeruginosa PA01
gccggccgucccagucggcgucc

SEQ ID NO: 1440274 - RNA, 16 nt, Pseudomonas aeruginosa PA01
gccggccggggcgcgc

SEQ ID NO: 1440275 - RNA, 13 nt, Pseudomonas aeruginosa PA01
gccggccgucgcg

SEQ ID NO: 1440276 - RNA, 15 nt, Pseudomonas aeruginosa PA01
gccggccgucgcgca

SEQ ID NO: 1440277 - RNA, 16 nt, Pseudomonas aeruginosa PA01
gccggccuccagcacu

SEQ ID NO: 1440278 - RNA, 20 nt, Pseudomonas aeruginosa PA01
gccggccuccagcacucgcu

SEQ ID NO: 1440279 - RNA, 13 nt, Pseudomonas aeruginosa PA01
gccggccucggcg

SEQ ID NO: 1440280 - RNA, 14 nt, Pseudomonas aeruginosa PA01
gccggccucggcgg

SEQ ID NO: 1440281 - RNA, 15 nt, Pseudomonas aeruginosa PA01
gccggccucggcggc

SEQ ID NO: 1440282 - RNA, 16 nt, Pseudomonas aeruginosa PA01
gccggccucggcggcg

SEQ ID NO: 1440283 - RNA, 17 nt, Pseudomonas aeruginosa PA01
gccggccucggcggcgc

SEQ ID NO: 1440284 - RNA, 11 nt, Pseudomonas aeruginosa PA01
gccggccucga

SEQ ID NO: 1440285 - RNA, 18 nt, Pseudomonas aeruginosa PA01
gccggccucgacgcagag

SEQ ID NO: 1440286 - RNA, 22 nt, Pseudomonas aeruginosa PA01
gccggccucgacgcagagcgcc

SEQ ID NO: 1440287 - RNA, 13 nt, Pseudomonas aeruginosa PA01
gccggccucgagg

SEQ ID NO: 1440288 - RNA, 21 nt, Pseudomonas aeruginosa PA01
gccggccuccagcgccucgcc

SEQ ID NO: 1440289 - RNA, 19 nt, Pseudomonas aeruginosa PA01
gccggccuccagcgccugg

SEQ ID NO: 1440290 - RNA, 20 nt, Pseudomonas aeruginosa PA01
gccggccuccagcgccuggc

SEQ ID NO: 1440291 - RNA, 13 nt, Pseudomonas aeruginosa PA01
gccggccucgcgc

SEQ ID NO: 1440292 - RNA, 15 nt, Pseudomonas aeruginosa PA01
gccggccucgcugcc

SEQ ID NO: 1440293 - RNA, 16 nt, Pseudomonas aeruginosa PA01
gccggccucgcugccg

SEQ ID NO: 1440294 - RNA, 20 nt, Pseudomonas aeruginosa PA01
gccggccucgcugccgccgc

SEQ ID NO: 1440295 - RNA, 21 nt, Pseudomonas aeruginosa PA01
gccggccucgcugccgccgca

SEQ ID NO: 1440296 - RNA, 12 nt, Pseudomonas aeruginosa PA01
gccggccugcgc

SEQ ID NO: 1440297 - RNA, 22 nt, Pseudomonas aeruginosa PA01
gccggccugggccccggcgccg

SEQ ID NO: 1440298 - RNA, 13 nt, Pseudomonas aeruginosa PA01
gccggccugcgcg

SEQ ID NO: 1440299 - RNA, 15 nt, Pseudomonas aeruginosa PA01
gccggccugcgcgca

SEQ ID NO: 1440300 - RNA, 16 nt, Pseudomonas aeruginosa PA01
gccggccugcgcgcac

SEQ ID NO: 1440301 - RNA, 19 nt, Pseudomonas aeruginosa PA01
gccggccugcgcgcaccag

SEQ ID NO: 1440302 - RNA, 20 nt, Pseudomonas aeruginosa PA01
gccggccugcgcgcaccagg

SEQ ID NO: 1440303 - RNA, 21 nt, Pseudomonas aeruginosa PA01
gccggccugcgcgcaccaggc

SEQ ID NO: 1440304 - RNA, 22 nt, Pseudomonas aeruginosa PA01
gccggccugcgcgcaccaggcc

SEQ ID NO: 1440305 - RNA, 14 nt, Pseudomonas aeruginosa PA01
aagcaggacggcga

SEQ ID NO: 1440306 - RNA, 16 nt, Pseudomonas aeruginosa PA01
aagcagagggucggcg

SEQ ID NO: 1440307 - RNA, 21 nt, Pseudomonas aeruginosa PA01
aagcaggcggaguagccggcg

SEQ ID NO: 1440308 - RNA, 14 nt, Pseudomonas aeruginosa PA01
gccggccaggucgu

SEQ ID NO: 1440309 - RNA, 14 nt, Pseudomonas aeruginosa PA01
gccggccagggagc

SEQ ID NO: 1440310 - RNA, 12 nt, Pseudomonas aeruginosa PA01
gccggccagggc

SEQ ID NO: 1440311 - RNA, 13 nt, Pseudomonas aeruginosa PA01
gccggccaggaag

SEQ ID NO: 1440312 - RNA, 19 nt, Pseudomonas aeruginosa PA01
gccggccaggaaggccgcu

SEQ ID NO: 1440313 - RNA, 23 nt, Pseudomonas aeruginosa PA01
gccggccagggcgaacagcgccg

SEQ ID NO: 1440314 - RNA, 14 nt, Pseudomonas aeruginosa PA01
gccggccagggcgc

SEQ ID NO: 1440315 - RNA, 17 nt, Pseudomonas aeruginosa PA01
gccggccaggggcugaa

SEQ ID NO: 1440316 - RNA, 19 nt, Pseudomonas aeruginosa PA01
gccggccaggggcugaaca

SEQ ID NO: 1440317 - RNA, 15 nt, Pseudomonas aeruginosa PA01
gccggccagggucgc

SEQ ID NO: 1440318 - RNA, 19 nt, Pseudomonas aeruginosa PA01
gccggccagggucgccagc

SEQ ID NO: 1440319 - RNA, 20 nt, Pseudomonas aeruginosa PA01
gccggccagggucgccagca

SEQ ID NO: 1440320 - RNA, 21 nt, Pseudomonas aeruginosa PA01
gccggccagggucgccagcag

SEQ ID NO: 1440321 - RNA, 23 nt, Pseudomonas aeruginosa PA01
gccggccagguagcggaccccgg

SEQ ID NO: 1440322 - RNA, 16 nt, Pseudomonas aeruginosa PA01
gccggccauucgcugu

SEQ ID NO: 1440323 - RNA, 22 nt, Pseudomonas aeruginosa PA01
gccggccauucgcugucgagca

SEQ ID NO: 1440324 - RNA, 16 nt, Pseudomonas aeruginosa PA01
gccggccaugcuggcg

SEQ ID NO: 1440325 - RNA, 14 nt, Pseudomonas aeruginosa PA01
gccggcccagcagg

SEQ ID NO: 1440326 - RNA, 16 nt, Pseudomonas aeruginosa PA01
gccggcccagcaggcc

SEQ ID NO: 1440327 - RNA, 23 nt, Pseudomonas aeruginosa PA01
gccggcccagcaggccggccagc

SEQ ID NO: 1440328 - RNA, 19 nt, Pseudomonas aeruginosa PA01
gccggccaugcaggccagg

SEQ ID NO: 1440329 - RNA, 21 nt, Pseudomonas aeruginosa PA01
gccggccaugcaggccagggc

SEQ ID NO: 1440330 - RNA, 23 nt, Pseudomonas aeruginosa PA01
gccggccaugcaggccagggcgg

SEQ ID NO: 1440331 - RNA, 15 nt, Pseudomonas aeruginosa PA01
gccggccaguuggug

SEQ ID NO: 1440332 - RNA, 14 nt, Pseudomonas aeruginosa PA01
gccggccauccagc

SEQ ID NO: 1440333 - RNA, 17 nt, Pseudomonas aeruginosa PA01
gccggccauccagccag

SEQ ID NO: 1440334 - RNA, 21 nt, Pseudomonas aeruginosa PA01
gccggccauccagccaggcgc

SEQ ID NO: 1440335 - RNA, 14 nt, Pseudomonas aeruginosa PA01
gccggccccugggc

SEQ ID NO: 1440336 - RNA, 15 nt, Pseudomonas aeruginosa PA01
gccggccccugggcc

SEQ ID NO: 1440337 - RNA, 18 nt, Pseudomonas aeruginosa PA01
gccggccccugggccggc

SEQ ID NO: 1440338 - RNA, 20 nt, Pseudomonas aeruginosa PA01
gccggcccgcgcggcaacgu

SEQ ID NO: 1440339 - RNA, 22 nt, Pseudomonas aeruginosa PA01
gccggcccgggucacggucagc

SEQ ID NO: 1440340 - RNA, 18 nt, Pseudomonas aeruginosa PA01
gccggccgaucuucagca

SEQ ID NO: 1440341 - RNA, 22 nt, Pseudomonas aeruginosa PA01
gccggccgaucuucagcagcag

SEQ ID NO: 1440342 - RNA, 19 nt, Pseudomonas aeruginosa PA01
gccggcccgugcccguccu

SEQ ID NO: 1440343 - RNA, 13 nt, Pseudomonas aeruginosa PA01
gccggcccucgcg

SEQ ID NO: 1440344 - RNA, 13 nt, Pseudomonas aeruginosa PA01
gccggccgccagc

SEQ ID NO: 1440345 - RNA, 17 nt, Pseudomonas aeruginosa PA01
gccggccgccagcaggu

SEQ ID NO: 1440346 - RNA, 17 nt, Pseudomonas aeruginosa PA01
gccggccggggccggca

SEQ ID NO: 1440347 - RNA, 18 nt, Pseudomonas aeruginosa PA01
gccggccggcucagcgcu

SEQ ID NO: 1440348 - RNA, 14 nt, Pseudomonas aeruginosa PA01
gccugcggccagcg

SEQ ID NO: 1440349 - RNA, 16 nt, Pseudomonas aeruginosa PA01
gccugcggccagcgcc

SEQ ID NO: 1440350 - RNA, 18 nt, Pseudomonas aeruginosa PA01
gccugcggccagcgccag

SEQ ID NO: 1440351 - RNA, 19 nt, Pseudomonas aeruginosa PA01
gccugcggccagcgccagg

SEQ ID NO: 1440352 - RNA, 17 nt, Pseudomonas aeruginosa PA01
gccugcggcuugcccug

SEQ ID NO: 1440353 - RNA, 19 nt, Pseudomonas aeruginosa PA01
gccugcggcuugcccugcu

SEQ ID NO: 1440354 - RNA, 13 nt, Pseudomonas aeruginosa PA01
gccugcgguucgc

SEQ ID NO: 1440355 - RNA, 21 nt, Pseudomonas aeruginosa PA01
gccugcgucagcgaggcgggc

SEQ ID NO: 1440356 - RNA, 15 nt, Pseudomonas aeruginosa PA01
gccugcguuucgccg

SEQ ID NO: 1440357 - RNA, 17 nt, Pseudomonas aeruginosa PA01
gccugcguuucgccggg

SEQ ID NO: 1440358 - RNA, 16 nt, Pseudomonas aeruginosa PA01
gccugcucgaacggcg

SEQ ID NO: 1440359 - RNA, 23 nt, Pseudomonas aeruginosa PA01
gccugcuccagcggagcgaccgg

SEQ ID NO: 1440360 - RNA, 13 nt, Pseudomonas aeruginosa PA01
gccugcuccucgg

SEQ ID NO: 1440361 - RNA, 16 nt, Pseudomonas aeruginosa PA01
gccugcuccucggcag

SEQ ID NO: 1440362 - RNA, 21 nt, Pseudomonas aeruginosa PA01
gccugcuccucggcagcgcug

SEQ ID NO: 1440363 - RNA, 21 nt, Pseudomonas aeruginosa PA01
gccugcucgcgcagccaggcg

SEQ ID NO: 1440364 - RNA, 20 nt, Pseudomonas aeruginosa PA01
gccugcucgcggcuggccgc

SEQ ID NO: 1440365 - RNA, 21 nt, Pseudomonas aeruginosa PA01
gccugcucgcggcuggccgcc

SEQ ID NO: 1440366 - RNA, 13 nt, Pseudomonas aeruginosa PA01
gccugcucgccgc

SEQ ID NO: 1440367 - RNA, 15 nt, Pseudomonas aeruginosa PA01
gccugcucgccgcug

SEQ ID NO: 1440368 - RNA, 16 nt, Pseudomonas aeruginosa PA01
gccugcucgccgcuga

SEQ ID NO: 1440369 - RNA, 23 nt, Pseudomonas aeruginosa PA01
gccugcgcccucaagucuccagc

SEQ ID NO: 1440370 - RNA, 14 nt, Pseudomonas aeruginosa PA01
gccugcgcgcacca

SEQ ID NO: 1440371 - RNA, 20 nt, Pseudomonas aeruginosa PA01
gccugcgcgcaccaggccuc

SEQ ID NO: 1440372 - RNA, 23 nt, Pseudomonas aeruginosa PA01
gccugcgccucggcccuggcggc

SEQ ID NO: 1440373 - RNA, 12 nt, Pseudomonas aeruginosa PA01
gccugcggccag

SEQ ID NO: 1440374 - RNA, 21 nt, Pseudomonas aeruginosa PA01
gccugcggcguaguggugcca

SEQ ID NO: 1440375 - RNA, 15 nt, Pseudomonas aeruginosa PA01
gccugcgcuguucgg

SEQ ID NO: 1440376 - RNA, 20 nt, Pseudomonas aeruginosa PA01
gccugcgcuuccggcagcca

SEQ ID NO: 1440377 - RNA, 16 nt, Pseudomonas aeruginosa PA01
gccuggcaaccgucga

SEQ ID NO: 1440378 - RNA, 18 nt, Pseudomonas aeruginosa PA01
gccuggaucucggcggcc

SEQ ID NO: 1440379 - RNA, 23 nt, Pseudomonas aeruginosa PA01
gccuggaugaucgcgugggccac

SEQ ID NO: 1440380 - RNA, 16 nt, Pseudomonas aeruginosa PA01
gccuggaccaggucga

SEQ ID NO: 1440381 - RNA, 21 nt, Pseudomonas aeruginosa PA01
gccuggagcagaaccgccagc

SEQ ID NO: 1440382 - RNA, 15 nt, Pseudomonas aeruginosa PA01
gccuggagcgccucg

SEQ ID NO: 1440383 - RNA, 17 nt, Pseudomonas aeruginosa PA01
gccuggaguugugccag

SEQ ID NO: 1440384 - RNA, 18 nt, Pseudomonas aeruginosa PA01
gccuggaguugugccagc

SEQ ID NO: 1440385 - RNA, 17 nt, Pseudomonas aeruginosa PA01
gccuggauacgggcgcc

SEQ ID NO: 1440386 - RNA, 18 nt, Pseudomonas aeruginosa PA01
gccuggauacgggcgcca

SEQ ID NO: 1440387 - RNA, 19 nt, Pseudomonas aeruginosa PA01
gccuggauacgggcgccag

SEQ ID NO: 1440388 - RNA, 22 nt, Pseudomonas aeruginosa PA01
gccuggaauucaggcuuccucg

SEQ ID NO: 1440389 - RNA, 17 nt, Pseudomonas aeruginosa PA01
gccuggaauaccccgcg

SEQ ID NO: 1440390 - RNA, 14 nt, Pseudomonas aeruginosa PA01
gccuggaaggcgcu

SEQ ID NO: 1440391 - RNA, 18 nt, Pseudomonas aeruginosa PA01
gccuggaaguauucggcg

SEQ ID NO: 1440392 - RNA, 20 nt, Pseudomonas aeruginosa PA01
gccuggagaaacucgcgggc

SEQ ID NO: 1440393 - RNA, 13 nt, Pseudomonas aeruginosa PA01
gccuggccgcgca

SEQ ID NO: 1440394 - RNA, 14 nt, Pseudomonas aeruginosa PA01
gccuggcccuggac

SEQ ID NO: 1440395 - RNA, 15 nt, Pseudomonas aeruginosa PA01
gccuggcccuggacc

SEQ ID NO: 1440396 - RNA, 16 nt, Pseudomonas aeruginosa PA01
gccuggcccuggcgca

SEQ ID NO: 1440397 - RNA, 22 nt, Pseudomonas aeruginosa PA01
gccuggcccuggcgcaggcggc

SEQ ID NO: 1440398 - RNA, 15 nt, Pseudomonas aeruginosa PA01
gccuggcccuggcgg

SEQ ID NO: 1440399 - RNA, 16 nt, Pseudomonas aeruginosa PA01
gccuggccacccuugu

SEQ ID NO: 1440400 - RNA, 14 nt, Pseudomonas aeruginosa PA01
gccuggccacgcca

SEQ ID NO: 1440401 - RNA, 17 nt, Pseudomonas aeruginosa PA01
gccuggccagcgcuucg

SEQ ID NO: 1440402 - RNA, 16 nt, Pseudomonas aeruginosa PA01
gccuggccagcgucgc

SEQ ID NO: 1440403 - RNA, 12 nt, Pseudomonas aeruginosa PA01
gccuggccaggc

SEQ ID NO: 1440404 - RNA, 15 nt, Pseudomonas aeruginosa PA01
gccuggccaggcgcu

SEQ ID NO: 1440405 - RNA, 13 nt, Pseudomonas aeruginosa PA01
gccugcucggccu

SEQ ID NO: 1440406 - RNA, 16 nt, Pseudomonas aeruginosa PA01
gccugcucggcucgcg

SEQ ID NO: 1440407 - RNA, 14 nt, Pseudomonas aeruginosa PA01
gccugcucuucggc

SEQ ID NO: 1440408 - RNA, 18 nt, Pseudomonas aeruginosa PA01
gccugcucuucggcggcc

SEQ ID NO: 1440409 - RNA, 21 nt, Pseudomonas aeruginosa PA01
gccugcucuucggcggccagc

SEQ ID NO: 1440410 - RNA, 23 nt, Pseudomonas aeruginosa PA01
gccugcucuucggcggccagcgg

SEQ ID NO: 1440411 - RNA, 20 nt, Pseudomonas aeruginosa PA01
gccugcugcgggucgcgggu

SEQ ID NO: 1440412 - RNA, 12 nt, Pseudomonas aeruginosa PA01
gccugcugcgcg

SEQ ID NO: 1440413 - RNA, 15 nt, Pseudomonas aeruginosa PA01
gccugcugcgcgggu

SEQ ID NO: 1440414 - RNA, 15 nt, Pseudomonas aeruginosa PA01
gccugcuggccggug

SEQ ID NO: 1440415 - RNA, 17 nt, Pseudomonas aeruginosa PA01
gccugcuggccggugcc

SEQ ID NO: 1440416 - RNA, 21 nt, Pseudomonas aeruginosa PA01
gccugcuggccugggacggcg

SEQ ID NO: 1440417 - RNA, 23 nt, Pseudomonas aeruginosa PA01
gccugcuggcugcccaguugcgc

SEQ ID NO: 1440418 - RNA, 18 nt, Pseudomonas aeruginosa PA01
gccugcuuggcggcggug

SEQ ID NO: 1440419 - RNA, 14 nt, Pseudomonas aeruginosa PA01
gccugcuugcagga

SEQ ID NO: 1440420 - RNA, 19 nt, Pseudomonas aeruginosa PA01
gccugcuguguccggcgga

SEQ ID NO: 1440421 - RNA, 18 nt, Pseudomonas aeruginosa PA01
gccugcuucagcccggca

SEQ ID NO: 1440422 - RNA, 22 nt, Pseudomonas aeruginosa PA01
gccugcuugaaauggcggacga

SEQ ID NO: 1440423 - RNA, 18 nt, Pseudomonas aeruginosa PA01
gccugcuuucccugcugc

SEQ ID NO: 1440424 - RNA, 19 nt, Pseudomonas aeruginosa PA01
gccugcuuucccugcugcg

SEQ ID NO: 1440425 - RNA, 20 nt, Pseudomonas aeruginosa PA01
gccugcuuucccugcugcgg

SEQ ID NO: 1440426 - RNA, 17 nt, Pseudomonas aeruginosa PA01
gccuggaacaccaggcc

SEQ ID NO: 1440427 - RNA, 19 nt, Pseudomonas aeruginosa PA01
gccuggaacaccaggccgc

SEQ ID NO: 1440428 - RNA, 21 nt, Pseudomonas aeruginosa PA01
gccuggaacaccaggccgcaa

SEQ ID NO: 1440429 - RNA, 22 nt, Pseudomonas aeruginosa PA01
gccuggaacaccaggccgcaag

SEQ ID NO: 1440430 - RNA, 13 nt, Pseudomonas aeruginosa PA01
gccuggaaccgcu

SEQ ID NO: 1440431 - RNA, 16 nt, Pseudomonas aeruginosa PA01
gccuggaacuggucgg

SEQ ID NO: 1440432 - RNA, 21 nt, Pseudomonas aeruginosa PA01
gccuggaacuggucggggcgc

SEQ ID NO: 1440433 - RNA, 20 nt, Pseudomonas aeruginosa PA01
gccuuagcgguugcggguca

SEQ ID NO: 1440434 - RNA, 21 nt, Pseudomonas aeruginosa PA01
gccuguaccgcuuccugggcu

SEQ ID NO: 1440435 - RNA, 14 nt, Pseudomonas aeruginosa PA01
gccuggucgaaagc

SEQ ID NO: 1440436 - RNA, 20 nt, Pseudomonas aeruginosa PA01
gccuggucgaaagccugccg

SEQ ID NO: 1440437 - RNA, 17 nt, Pseudomonas aeruginosa PA01
gccuggucauccuggcc

SEQ ID NO: 1440438 - RNA, 16 nt, Pseudomonas aeruginosa PA01
gccugguccagcaggu

SEQ ID NO: 1440439 - RNA, 15 nt, Pseudomonas aeruginosa PA01
gccuggucgccggga

SEQ ID NO: 1440440 - RNA, 18 nt, Pseudomonas aeruginosa PA01
gccuggugcccgaugccg

SEQ ID NO: 1440441 - RNA, 22 nt, Pseudomonas aeruginosa PA01
gccuggugcccgaugccgcgcc

SEQ ID NO: 1440442 - RNA, 15 nt, Pseudomonas aeruginosa PA01
gccuggugccgggcu

SEQ ID NO: 1440443 - RNA, 15 nt, Pseudomonas aeruginosa PA01
gccuggucggcggcc

SEQ ID NO: 1440444 - RNA, 16 nt, Pseudomonas aeruginosa PA01
gccuggucggcggccu

SEQ ID NO: 1440445 - RNA, 19 nt, Pseudomonas aeruginosa PA01
gccuggucggggccggcga

SEQ ID NO: 1440446 - RNA, 17 nt, Pseudomonas aeruginosa PA01
gccuggucgucguagug

SEQ ID NO: 1440447 - RNA, 18 nt, Pseudomonas aeruginosa PA01
gccuggucgucguagugg

SEQ ID NO: 1440448 - RNA, 19 nt, Pseudomonas aeruginosa PA01
gccuggucgucguaguggc

SEQ ID NO: 1440449 - RNA, 23 nt, Pseudomonas aeruginosa PA01
gccuggucgucguaguggccguc

SEQ ID NO: 1440450 - RNA, 13 nt, Pseudomonas aeruginosa PA01
gccuggcuggccu

SEQ ID NO: 1440451 - RNA, 20 nt, Pseudomonas aeruginosa PA01
gccuggcucaugucguggac

SEQ ID NO: 1440452 - RNA, 17 nt, Pseudomonas aeruginosa PA01
gccugggccgaaggcca

SEQ ID NO: 1440453 - RNA, 15 nt, Pseudomonas aeruginosa PA01
gccugggcaagcugc

SEQ ID NO: 1440454 - RNA, 20 nt, Pseudomonas aeruginosa PA01
gccugggcaagcugcacggc

SEQ ID NO: 1440455 - RNA, 14 nt, Pseudomonas aeruginosa PA01
gccugggccggcgu

SEQ ID NO: 1440456 - RNA, 23 nt, Pseudomonas aeruginosa PA01
gccugggcguagaguucgcugcg

SEQ ID NO: 1440457 - RNA, 16 nt, Pseudomonas aeruginosa PA01
gccugggcgcaggccg

SEQ ID NO: 1440458 - RNA, 17 nt, Pseudomonas aeruginosa PA01
gccugggcgcaggccga

SEQ ID NO: 1440459 - RNA, 15 nt, Pseudomonas aeruginosa PA01
gccugggcgccgcca

SEQ ID NO: 1440460 - RNA, 20 nt, Pseudomonas aeruginosa PA01
gccugggcgccgccagccag

SEQ ID NO: 1440461 - RNA, 13 nt, Pseudomonas aeruginosa PA01
gccugggcgcuca

SEQ ID NO: 1440462 - RNA, 16 nt, Pseudomonas aeruginosa PA01
gccugguagaaacgcu

SEQ ID NO: 1440463 - RNA, 21 nt, Pseudomonas aeruginosa PA01
gccugguagaucugugcggug

SEQ ID NO: 1440464 - RNA, 19 nt, Pseudomonas aeruginosa PA01
gccuggcgcgacgaggcgc

SEQ ID NO: 1440465 - RNA, 22 nt, Pseudomonas aeruginosa PA01
gccugggugaacagcggcccga

SEQ ID NO: 1440466 - RNA, 17 nt, Pseudomonas aeruginosa PA01
gccugguagucgccggu

SEQ ID NO: 1440467 - RNA, 15 nt, Pseudomonas aeruginosa PA01
gccugggucaccagc

SEQ ID NO: 1440468 - RNA, 18 nt, Pseudomonas aeruginosa PA01
gccugggguagccggccg

SEQ ID NO: 1440469 - RNA, 19 nt, Pseudomonas aeruginosa PA01
gccugggguagccggccga

SEQ ID NO: 1440470 - RNA, 17 nt, Pseudomonas aeruginosa PA01
gccuggguacgcaccgg

SEQ ID NO: 1440471 - RNA, 21 nt, Pseudomonas aeruginosa PA01
gccuggcucgaucggcagggc

SEQ ID NO: 1440472 - RNA, 23 nt, Pseudomonas aeruginosa PA01
gccuggcucgaucggcagggcgc

SEQ ID NO: 1440473 - RNA, 14 nt, Pseudomonas aeruginosa PA01
gccuggcugcaacg

SEQ ID NO: 1440474 - RNA, 13 nt, Pseudomonas aeruginosa PA01
gccuggcugccga

SEQ ID NO: 1440475 - RNA, 14 nt, Pseudomonas aeruginosa PA01
gccuggcugccgag

SEQ ID NO: 1440476 - RNA, 21 nt, Pseudomonas aeruginosa PA01
gccuggcugccgagcaggugc

SEQ ID NO: 1440477 - RNA, 15 nt, Pseudomonas aeruginosa PA01
gccuggcuggccagc

SEQ ID NO: 1440478 - RNA, 13 nt, Pseudomonas aeruginosa PA01
gccuggcggcugg

SEQ ID NO: 1440479 - RNA, 16 nt, Pseudomonas aeruginosa PA01
gccuggcggcuggcgu

SEQ ID NO: 1440480 - RNA, 18 nt, Pseudomonas aeruginosa PA01
gccuggcggauaucgcgu

SEQ ID NO: 1440481 - RNA, 19 nt, Pseudomonas aeruginosa PA01
gccuggcggauaucgcgug

SEQ ID NO: 1440482 - RNA, 22 nt, Pseudomonas aeruginosa PA01
gccuggcgguugaugccgacgu

SEQ ID NO: 1440483 - RNA, 17 nt, Pseudomonas aeruginosa PA01
gccuggcgucgaugccg

SEQ ID NO: 1440484 - RNA, 13 nt, Pseudomonas aeruginosa PA01
gccuggcgugccg

SEQ ID NO: 1440485 - RNA, 15 nt, Pseudomonas aeruginosa PA01
gccuggcgugccgcc

SEQ ID NO: 1440486 - RNA, 16 nt, Pseudomonas aeruginosa PA01
gccuggcgugccgcca

SEQ ID NO: 1440487 - RNA, 18 nt, Pseudomonas aeruginosa PA01
gccuggccuggaacuggu

SEQ ID NO: 1440488 - RNA, 20 nt, Pseudomonas aeruginosa PA01
gccuggccuggaacuggucg

SEQ ID NO: 1440489 - RNA, 18 nt, Pseudomonas aeruginosa PA01
gccuggcgcaacaggcgc

SEQ ID NO: 1440490 - RNA, 22 nt, Pseudomonas aeruginosa PA01
gccuggcgcaacgccggcaggu

SEQ ID NO: 1440491 - RNA, 16 nt, Pseudomonas aeruginosa PA01
gccuggcgcacggccu

SEQ ID NO: 1440492 - RNA, 18 nt, Pseudomonas aeruginosa PA01
gccuggcgcagcggcagc

SEQ ID NO: 1440493 - RNA, 16 nt, Pseudomonas aeruginosa PA01
gccuggccgucuucca

SEQ ID NO: 1440494 - RNA, 22 nt, Pseudomonas aeruginosa PA01
gccuggccguugcgcaggcggu

SEQ ID NO: 1440495 - RNA, 13 nt, Pseudomonas aeruginosa PA01
gccuggccggcga

SEQ ID NO: 1440496 - RNA, 17 nt, Pseudomonas aeruginosa PA01
gccuggcgcauggcgcu

SEQ ID NO: 1440497 - RNA, 12 nt, Pseudomonas aeruginosa PA01
gccuggcgcuca

SEQ ID NO: 1440498 - RNA, 16 nt, Pseudomonas aeruginosa PA01
gccuggcgcucagcgc

SEQ ID NO: 1440499 - RNA, 20 nt, Pseudomonas aeruginosa PA01
gccuggcgcucagcgccgcu

SEQ ID NO: 1440500 - RNA, 23 nt, Pseudomonas aeruginosa PA01
gccuggcgcgcgcgccaggucga

SEQ ID NO: 1440501 - RNA, 13 nt, Pseudomonas aeruginosa PA01
gccucgcgacugc

SEQ ID NO: 1440502 - RNA, 17 nt, Pseudomonas aeruginosa PA01
gccucgcgacugcugau

SEQ ID NO: 1440503 - RNA, 19 nt, Pseudomonas aeruginosa PA01
gccucgcgacugcugauca

SEQ ID NO: 1440504 - RNA, 18 nt, Pseudomonas aeruginosa PA01
gccucgcgcaacugcucg

SEQ ID NO: 1440505 - RNA, 19 nt, Pseudomonas aeruginosa PA01
gccucgcgccagagaucgc

SEQ ID NO: 1440506 - RNA, 20 nt, Pseudomonas aeruginosa PA01
gccucgcgccagagaucgcc

SEQ ID NO: 1440507 - RNA, 15 nt, Pseudomonas aeruginosa PA01
gccucgcgccgcgcc

SEQ ID NO: 1440508 - RNA, 16 nt, Pseudomonas aeruginosa PA01
gccucgcgccgcgcca

SEQ ID NO: 1440509 - RNA, 19 nt, Pseudomonas aeruginosa PA01
gccucgcgccgcgccagca

SEQ ID NO: 1440510 - RNA, 20 nt, Pseudomonas aeruginosa PA01
gccucgcgccgcgccagcag

SEQ ID NO: 1440511 - RNA, 19 nt, Pseudomonas aeruginosa PA01
gccucgaggaacaggucga

SEQ ID NO: 1440512 - RNA, 21 nt, Pseudomonas aeruginosa PA01
gccucgaggaacaggucgacg

SEQ ID NO: 1440513 - RNA, 13 nt, Pseudomonas aeruginosa PA01
gccucgaggucgg

SEQ ID NO: 1440514 - RNA, 17 nt, Pseudomonas aeruginosa PA01
gccucgaggucggccug

SEQ ID NO: 1440515 - RNA, 22 nt, Pseudomonas aeruginosa PA01
gccucgaggucggccuggcugc

SEQ ID NO: 1440516 - RNA, 19 nt, Pseudomonas aeruginosa PA01
gccucgagguucucgaccc

SEQ ID NO: 1440517 - RNA, 20 nt, Pseudomonas aeruginosa PA01
gccucgagguucucgacccg

SEQ ID NO: 1440518 - RNA, 21 nt, Pseudomonas aeruginosa PA01
gccucgaccagcgccgcggcg

SEQ ID NO: 1440519 - RNA, 21 nt, Pseudomonas aeruginosa PA01
aagccccagagcccgccgaac

SEQ ID NO: 1440520 - RNA, 14 nt, Pseudomonas aeruginosa PA01
gccucgaccuggcc

SEQ ID NO: 1440521 - RNA, 17 nt, Pseudomonas aeruginosa PA01
gccucgaccuggccacg

SEQ ID NO: 1440522 - RNA, 23 nt, Pseudomonas aeruginosa PA01
gccucgaccuggccacgcccggu

SEQ ID NO: 1440523 - RNA, 23 nt, Pseudomonas aeruginosa PA01
gccucgacgagguugcucugggc

SEQ ID NO: 1440524 - RNA, 15 nt, Pseudomonas aeruginosa PA01
gccucgaccucggcc

SEQ ID NO: 1440525 - RNA, 16 nt, Pseudomonas aeruginosa PA01
gccucgaccucggccg

SEQ ID NO: 1440526 - RNA, 19 nt, Pseudomonas aeruginosa PA01
gccucgagcaucuccggca

SEQ ID NO: 1440527 - RNA, 18 nt, Pseudomonas aeruginosa PA01
gccucggagaacagcagc

SEQ ID NO: 1440528 - RNA, 21 nt, Pseudomonas aeruginosa PA01
gccucgcugagcaccgggacg

SEQ ID NO: 1440529 - RNA, 21 nt, Pseudomonas aeruginosa PA01
gccucgcugggcgggcguccg

SEQ ID NO: 1440530 - RNA, 22 nt, Pseudomonas aeruginosa PA01
gccucgcugggcgggcguccgu

SEQ ID NO: 1440531 - RNA, 12 nt, Pseudomonas aeruginosa PA01
gccucgcugccg

SEQ ID NO: 1440532 - RNA, 16 nt, Pseudomonas aeruginosa PA01
gccucgcugccgccgc

SEQ ID NO: 1440533 - RNA, 18 nt, Pseudomonas aeruginosa PA01
gccucgcugccgccgcag

SEQ ID NO: 1440534 - RNA, 16 nt, Pseudomonas aeruginosa PA01
gccucgcugcgcagau

SEQ ID NO: 1440535 - RNA, 14 nt, Pseudomonas aeruginosa PA01
gccucgcggcgcuc

SEQ ID NO: 1440536 - RNA, 12 nt, Pseudomonas aeruginosa PA01
gccucgcggcgu

SEQ ID NO: 1440537 - RNA, 23 nt, Pseudomonas aeruginosa PA01
gccucgaucgccucgggcgagcg

SEQ ID NO: 1440538 - RNA, 17 nt, Pseudomonas aeruginosa PA01
gccucggcccuggcggc

SEQ ID NO: 1440539 - RNA, 16 nt, Pseudomonas aeruginosa PA01
gccucggccagcgccg

SEQ ID NO: 1440540 - RNA, 11 nt, Pseudomonas aeruginosa PA01
gccucggcgaa

SEQ ID NO: 1440541 - RNA, 21 nt, Pseudomonas aeruginosa PA01
gccucggcgaagucgccgucg

SEQ ID NO: 1440542 - RNA, 16 nt, Pseudomonas aeruginosa PA01
gccucggccucgucga

SEQ ID NO: 1440543 - RNA, 14 nt, Pseudomonas aeruginosa PA01
gccucggaggccuu

SEQ ID NO: 1440544 - RNA, 15 nt, Pseudomonas aeruginosa PA01
gccucggcagggcgc

SEQ ID NO: 1440545 - RNA, 16 nt, Pseudomonas aeruginosa PA01
gccucggcagggcgcc

SEQ ID NO: 1440546 - RNA, 18 nt, Pseudomonas aeruginosa PA01
gccucggcagggcgcccg

SEQ ID NO: 1440547 - RNA, 22 nt, Pseudomonas aeruginosa PA01
gccucggcagggcgcccgcccg

SEQ ID NO: 1440548 - RNA, 17 nt, Pseudomonas aeruginosa PA01
gccucggcauccucgcc

SEQ ID NO: 1440549 - RNA, 21 nt, Pseudomonas aeruginosa PA01
gccucggcaucgaccagggcc

SEQ ID NO: 1440550 - RNA, 18 nt, Pseudomonas aeruginosa PA01
gccguuggccagcaggcg

SEQ ID NO: 1440551 - RNA, 21 nt, Pseudomonas aeruginosa PA01
gccguuggccagcaggcgccg

SEQ ID NO: 1440552 - RNA, 13 nt, Pseudomonas aeruginosa PA01
gccguuggcgucg

SEQ ID NO: 1440553 - RNA, 15 nt, Pseudomonas aeruginosa PA01
gccguuggcgucgcg

SEQ ID NO: 1440554 - RNA, 20 nt, Pseudomonas aeruginosa PA01
gccguuggcgucgcgcacga

SEQ ID NO: 1440555 - RNA, 22 nt, Pseudomonas aeruginosa PA01
gccguuggcgucgcgcacgagg

SEQ ID NO: 1440556 - RNA, 16 nt, Pseudomonas aeruginosa PA01
gccguuggcgaacuuc

SEQ ID NO: 1440557 - RNA, 22 nt, Pseudomonas aeruginosa PA01
gccguuggcgaacuucaggccg

SEQ ID NO: 1440558 - RNA, 23 nt, Pseudomonas aeruginosa PA01
gccguuggcgaacuucaggccgg

SEQ ID NO: 1440559 - RNA, 15 nt, Pseudomonas aeruginosa PA01
gccguuggccgagcg

SEQ ID NO: 1440560 - RNA, 19 nt, Pseudomonas aeruginosa PA01
gccguugcucacgccgaac

SEQ ID NO: 1440561 - RNA, 20 nt, Pseudomonas aeruginosa PA01
gccguugcucacgccgaacu

SEQ ID NO: 1440562 - RNA, 14 nt, Pseudomonas aeruginosa PA01
gccguugggccagg

SEQ ID NO: 1440563 - RNA, 17 nt, Pseudomonas aeruginosa PA01
gccguugggccagggcc

SEQ ID NO: 1440564 - RNA, 20 nt, Pseudomonas aeruginosa PA01
aagccagcaaacccgggccc

SEQ ID NO: 1440565 - RNA, 16 nt, Pseudomonas aeruginosa PA01
gccuacccgcgcuucu

SEQ ID NO: 1440566 - RNA, 23 nt, Pseudomonas aeruginosa PA01
gccuaccagaccgcagccggcga

SEQ ID NO: 1440567 - RNA, 18 nt, Pseudomonas aeruginosa PA01
aagccaugcccagacgcc

SEQ ID NO: 1440568 - RNA, 14 nt, Pseudomonas aeruginosa PA01
aagccaggcaccgg

SEQ ID NO: 1440569 - RNA, 16 nt, Pseudomonas aeruginosa PA01
aagccaggcaccggac

SEQ ID NO: 1440570 - RNA, 20 nt, Pseudomonas aeruginosa PA01
aagcccagcgagccgaucac

SEQ ID NO: 1440571 - RNA, 14 nt, Pseudomonas aeruginosa PA01
aagcccagcgccug

SEQ ID NO: 1440572 - RNA, 19 nt, Pseudomonas aeruginosa PA01
aagcccaggcgcucggcgg

SEQ ID NO: 1440573 - RNA, 22 nt, Pseudomonas aeruginosa PA01
aagcccaggcgcucggcggcgc

SEQ ID NO: 1440574 - RNA, 15 nt, Pseudomonas aeruginosa PA01
gccucggcgcaguag

SEQ ID NO: 1440575 - RNA, 17 nt, Pseudomonas aeruginosa PA01
gccucggcgaugccgga

SEQ ID NO: 1440576 - RNA, 19 nt, Pseudomonas aeruginosa PA01
gccucggcgaucgccaggu

SEQ ID NO: 1440577 - RNA, 11 nt, Pseudomonas aeruginosa PA01
gccucggcggc

SEQ ID NO: 1440578 - RNA, 18 nt, Pseudomonas aeruginosa PA01
gccucggcgcgcgccccc

SEQ ID NO: 1440579 - RNA, 16 nt, Pseudomonas aeruginosa PA01
gccucggcgcgggccu

SEQ ID NO: 1440580 - RNA, 14 nt, Pseudomonas aeruginosa PA01
gccucgggcagccc

SEQ ID NO: 1440581 - RNA, 16 nt, Pseudomonas aeruginosa PA01
gccucgggccggagca

SEQ ID NO: 1440582 - RNA, 21 nt, Pseudomonas aeruginosa PA01
gccucgggccggagcaggcca

SEQ ID NO: 1440583 - RNA, 15 nt, Pseudomonas aeruginosa PA01
gccucggcgucgcgc

SEQ ID NO: 1440584 - RNA, 12 nt, Pseudomonas aeruginosa PA01
gccucggcggga

SEQ ID NO: 1440585 - RNA, 20 nt, Pseudomonas aeruginosa PA01
gccucggcgggagagggcgg

SEQ ID NO: 1440586 - RNA, 23 nt, Pseudomonas aeruginosa PA01
gccucggcgggagagggcggcga

SEQ ID NO: 1440587 - RNA, 13 nt, Pseudomonas aeruginosa PA01
gccucggcggcgc

SEQ ID NO: 1440588 - RNA, 14 nt, Pseudomonas aeruginosa PA01
gccucggcggcgcg

SEQ ID NO: 1440589 - RNA, 14 nt, Pseudomonas aeruginosa PA01
gccucggcggcggc

SEQ ID NO: 1440590 - RNA, 16 nt, Pseudomonas aeruginosa PA01
gccucggcggcggccu

SEQ ID NO: 1440591 - RNA, 12 nt, Pseudomonas aeruginosa PA01
gccucggcggcg

SEQ ID NO: 1440592 - RNA, 19 nt, Pseudomonas aeruginosa PA01
gccugacgcaagcgcucgg

SEQ ID NO: 1440593 - RNA, 22 nt, Pseudomonas aeruginosa PA01
gccugacgcaagcgcucggccu

SEQ ID NO: 1440594 - RNA, 16 nt, Pseudomonas aeruginosa PA01
gccugacguugccgcg

SEQ ID NO: 1440595 - RNA, 18 nt, Pseudomonas aeruginosa PA01
gccugacguugccgcgcg

SEQ ID NO: 1440596 - RNA, 19 nt, Pseudomonas aeruginosa PA01
gccugaccgcugaugaucg

SEQ ID NO: 1440597 - RNA, 14 nt, Pseudomonas aeruginosa PA01
gccucgggcgagcg

SEQ ID NO: 1440598 - RNA, 16 nt, Pseudomonas aeruginosa PA01
gccucgggcgagcgca

SEQ ID NO: 1440599 - RNA, 20 nt, Pseudomonas aeruginosa PA01
gccugccagaccguggcgcu

SEQ ID NO: 1440600 - RNA, 14 nt, Pseudomonas aeruginosa PA01
gccugcaaagaggc

SEQ ID NO: 1440601 - RNA, 18 nt, Pseudomonas aeruginosa PA01
gccugcaacacccaggcc

SEQ ID NO: 1440602 - RNA, 23 nt, Pseudomonas aeruginosa PA01
gccugcaacacccaggccugggu

SEQ ID NO: 1440603 - RNA, 17 nt, Pseudomonas aeruginosa PA01
gccugcaacgccagcag

SEQ ID NO: 1440604 - RNA, 16 nt, Pseudomonas aeruginosa PA01
gccugcaacgccgcca

SEQ ID NO: 1440605 - RNA, 19 nt, Pseudomonas aeruginosa PA01
gccugcaacgccgccaacu

SEQ ID NO: 1440606 - RNA, 14 nt, Pseudomonas aeruginosa PA01
gccugcaacucguc

SEQ ID NO: 1440607 - RNA, 16 nt, Pseudomonas aeruginosa PA01
gccugcaacucgucgu

SEQ ID NO: 1440608 - RNA, 17 nt, Pseudomonas aeruginosa PA01
gccugcaacucgucguc

SEQ ID NO: 1440609 - RNA, 20 nt, Pseudomonas aeruginosa PA01
gccugcaacucgucguccag

SEQ ID NO: 1440610 - RNA, 22 nt, Pseudomonas aeruginosa PA01
gccugcaacucgucguccagcg

SEQ ID NO: 1440611 - RNA, 23 nt, Pseudomonas aeruginosa PA01
gccugccguuuuacucgucgcca

SEQ ID NO: 1440612 - RNA, 12 nt, Pseudomonas aeruginosa PA01
gccugccgggca

SEQ ID NO: 1440613 - RNA, 22 nt, Pseudomonas aeruginosa PA01
gccugccgggcaagcucgacga

SEQ ID NO: 1440614 - RNA, 13 nt, Pseudomonas aeruginosa PA01
gccgucuuccucg

SEQ ID NO: 1440615 - RNA, 19 nt, Pseudomonas aeruginosa PA01
gccgucuuccucgaagguc

SEQ ID NO: 1440616 - RNA, 16 nt, Pseudomonas aeruginosa PA01
gccgucuugccgcugc

SEQ ID NO: 1440617 - RNA, 19 nt, Pseudomonas aeruginosa PA01
gccgucuugccgcugcgcg

SEQ ID NO: 1440618 - RNA, 20 nt, Pseudomonas aeruginosa PA01
gccgucuuccagggcggcgc

SEQ ID NO: 1440619 - RNA, 13 nt, Pseudomonas aeruginosa PA01
gccgugccgugga

SEQ ID NO: 1440620 - RNA, 15 nt, Pseudomonas aeruginosa PA01
gccgugagcacgagg

SEQ ID NO: 1440621 - RNA, 22 nt, Pseudomonas aeruginosa PA01
gccgugcuccucauggaacugc

SEQ ID NO: 1440622 - RNA, 18 nt, Pseudomonas aeruginosa PA01
gccgugcggcguucgccg

SEQ ID NO: 1440623 - RNA, 19 nt, Pseudomonas aeruginosa PA01
gccgugcggcguucgccgc

SEQ ID NO: 1440624 - RNA, 13 nt, Pseudomonas aeruginosa PA01
gccgugcgcuccg

SEQ ID NO: 1440625 - RNA, 15 nt, Pseudomonas aeruginosa PA01
gccgugcgcuccgcc

SEQ ID NO: 1440626 - RNA, 16 nt, Pseudomonas aeruginosa PA01
gccgugcgcuccgcca

SEQ ID NO: 1440627 - RNA, 17 nt, Pseudomonas aeruginosa PA01
gccgugcgcuccgccag

SEQ ID NO: 1440628 - RNA, 18 nt, Pseudomonas aeruginosa PA01
gccgugcgcuccgccagg

SEQ ID NO: 1440629 - RNA, 19 nt, Pseudomonas aeruginosa PA01
gccgugcgcuccgccaggc

SEQ ID NO: 1440630 - RNA, 22 nt, Pseudomonas aeruginosa PA01
gccgugcgcuccgccaggccgc

SEQ ID NO: 1440631 - RNA, 19 nt, Pseudomonas aeruginosa PA01
gccgugcggagggucaggc

SEQ ID NO: 1440632 - RNA, 21 nt, Pseudomonas aeruginosa PA01
gccgugcggagggucaggccg

SEQ ID NO: 1440633 - RNA, 22 nt, Pseudomonas aeruginosa PA01
gccguggaccaacagccggcgg

SEQ ID NO: 1440634 - RNA, 17 nt, Pseudomonas aeruginosa PA01
gccguggaccaggauca

SEQ ID NO: 1440635 - RNA, 23 nt, Pseudomonas aeruginosa PA01
gccguggaugucgaggaacaggu

SEQ ID NO: 1440636 - RNA, 14 nt, Pseudomonas aeruginosa PA01
gccguggcucggcg

SEQ ID NO: 1440637 - RNA, 16 nt, Pseudomonas aeruginosa PA01
gccguggcucggcggc

SEQ ID NO: 1440638 - RNA, 18 nt, Pseudomonas aeruginosa PA01
gccguggcucggcggcag

SEQ ID NO: 1440639 - RNA, 23 nt, Pseudomonas aeruginosa PA01
gccgugggaacgcgaggagaucg

SEQ ID NO: 1440640 - RNA, 14 nt, Pseudomonas aeruginosa PA01
gccguggaucgccc

SEQ ID NO: 1440641 - RNA, 13 nt, Pseudomonas aeruginosa PA01
gccguggcaccag

SEQ ID NO: 1440642 - RNA, 18 nt, Pseudomonas aeruginosa PA01
gccguggcacccaggcca

SEQ ID NO: 1440643 - RNA, 19 nt, Pseudomonas aeruginosa PA01
gccguggcacccaggccac

SEQ ID NO: 1440644 - RNA, 13 nt, Pseudomonas aeruginosa PA01
gccguugcccucg

SEQ ID NO: 1440645 - RNA, 20 nt, Pseudomonas aeruginosa PA01
gccguugcccucgcgcugga

SEQ ID NO: 1440646 - RNA, 20 nt, Pseudomonas aeruginosa PA01
gccguugaugucgaccacga

SEQ ID NO: 1440647 - RNA, 15 nt, Pseudomonas aeruginosa PA01
gccguugaugacgaa

SEQ ID NO: 1440648 - RNA, 16 nt, Pseudomonas aeruginosa PA01
gccguugaccagcgcg

SEQ ID NO: 1440649 - RNA, 23 nt, Pseudomonas aeruginosa PA01
gccguugccgguacucgccgggc

SEQ ID NO: 1440650 - RNA, 16 nt, Pseudomonas aeruginosa PA01
gccguugccuucgccg

SEQ ID NO: 1440651 - RNA, 17 nt, Pseudomonas aeruginosa PA01
gccguugccuucgccgu

SEQ ID NO: 1440652 - RNA, 13 nt, Pseudomonas aeruginosa PA01
gccguugcggcag

SEQ ID NO: 1440653 - RNA, 15 nt, Pseudomonas aeruginosa PA01
gccguugcggcagca

SEQ ID NO: 1440654 - RNA, 22 nt, Pseudomonas aeruginosa PA01
gccguucuuguugagcuggccg

SEQ ID NO: 1440655 - RNA, 14 nt, Pseudomonas aeruginosa PA01
gccguugaaacgcu

SEQ ID NO: 1440656 - RNA, 17 nt, Pseudomonas aeruginosa PA01
gccguugaaacgcucgg

SEQ ID NO: 1440657 - RNA, 19 nt, Pseudomonas aeruginosa PA01
gccgugguggccguggcgc

SEQ ID NO: 1440658 - RNA, 17 nt, Pseudomonas aeruginosa PA01
gccguucucggugacca

SEQ ID NO: 1440659 - RNA, 19 nt, Pseudomonas aeruginosa PA01
gccguucucggugaccacc

SEQ ID NO: 1440660 - RNA, 16 nt, Pseudomonas aeruginosa PA01
gccguggucgcgcagg

SEQ ID NO: 1440661 - RNA, 18 nt, Pseudomonas aeruginosa PA01
gccguggucgcgcaggcg

SEQ ID NO: 1440662 - RNA, 14 nt, Pseudomonas aeruginosa PA01
gccgugggucgccu

SEQ ID NO: 1440663 - RNA, 19 nt, Pseudomonas aeruginosa PA01
gccgugggcgccgccggug

SEQ ID NO: 1440664 - RNA, 20 nt, Pseudomonas aeruginosa PA01
gccgugggcgccgccgguga

SEQ ID NO: 1440665 - RNA, 15 nt, Pseudomonas aeruginosa PA01
gccgugggccgccga

SEQ ID NO: 1440666 - RNA, 16 nt, Pseudomonas aeruginosa PA01
gccgugggccgccgaa

SEQ ID NO: 1440667 - RNA, 17 nt, Pseudomonas aeruginosa PA01
gccgugggccgccgaac

SEQ ID NO: 1440668 - RNA, 18 nt, Pseudomonas aeruginosa PA01
gccgugggccgccgaacg

SEQ ID NO: 1440669 - RNA, 14 nt, Pseudomonas aeruginosa PA01
gccgugggccggcg

SEQ ID NO: 1440670 - RNA, 15 nt, Pseudomonas aeruginosa PA01
gccgugggccggcgc

SEQ ID NO: 1440671 - RNA, 16 nt, Pseudomonas aeruginosa PA01
gccgugggccggcgcg

SEQ ID NO: 1440672 - RNA, 13 nt, Pseudomonas aeruginosa PA01
gccgucgccgcug

SEQ ID NO: 1440673 - RNA, 18 nt, Pseudomonas aeruginosa PA01
gccgucgccgcugaugcg

SEQ ID NO: 1440674 - RNA, 16 nt, Pseudomonas aeruginosa PA01
gccgucguccggguuc

SEQ ID NO: 1440675 - RNA, 20 nt, Pseudomonas aeruginosa PA01
gccgucguagcgcagcggca

SEQ ID NO: 1440676 - RNA, 21 nt, Pseudomonas aeruginosa PA01
gccgucguagcgcagcggcag

SEQ ID NO: 1440677 - RNA, 15 nt, Pseudomonas aeruginosa PA01
gccgucgguguccgc

SEQ ID NO: 1440678 - RNA, 13 nt, Pseudomonas aeruginosa PA01
gccguccgucggc

SEQ ID NO: 1440679 - RNA, 14 nt, Pseudomonas aeruginosa PA01
gccguccuccagca

SEQ ID NO: 1440680 - RNA, 19 nt, Pseudomonas aeruginosa PA01
gccguccugcaacugcucg

SEQ ID NO: 1440681 - RNA, 21 nt, Pseudomonas aeruginosa PA01
gccguccgcccaguucgccgg

SEQ ID NO: 1440682 - RNA, 24 nt, Pseudomonas aeruginosa PA01
gccguccgcccaguucgccggcca

SEQ ID NO: 1440683 - RNA, 20 nt, Pseudomonas aeruginosa PA01
gccgucccggaguuccagcg

SEQ ID NO: 1440684 - RNA, 15 nt, Pseudomonas aeruginosa PA01
gccgucccugaccag

SEQ ID NO: 1440685 - RNA, 18 nt, Pseudomonas aeruginosa PA01
gccgucccugaccagcag

SEQ ID NO: 1440686 - RNA, 17 nt, Pseudomonas aeruginosa PA01
gccgucgaacagcagcu

SEQ ID NO: 1440687 - RNA, 23 nt, Pseudomonas aeruginosa PA01
gccguccuugaguagcuggcgca

SEQ ID NO: 1440688 - RNA, 19 nt, Pseudomonas aeruginosa PA01
gccgucgaagggcacgccg

SEQ ID NO: 1440689 - RNA, 20 nt, Pseudomonas aeruginosa PA01
gccgucgaagggcacgccgc

SEQ ID NO: 1440690 - RNA, 21 nt, Pseudomonas aeruginosa PA01
gccgucgaagggcacgccgcu

SEQ ID NO: 1440691 - RNA, 14 nt, Pseudomonas aeruginosa PA01
gccgucgaccugcg

SEQ ID NO: 1440692 - RNA, 16 nt, Pseudomonas aeruginosa PA01
gccguauccgcggcag

SEQ ID NO: 1440693 - RNA, 21 nt, Pseudomonas aeruginosa PA01
gccguaguggcguuccaggcg

SEQ ID NO: 1440694 - RNA, 13 nt, Pseudomonas aeruginosa PA01
gccguagaugguc

SEQ ID NO: 1440695 - RNA, 17 nt, Pseudomonas aeruginosa PA01
gccguagaggucgccgu

SEQ ID NO: 1440696 - RNA, 18 nt, Pseudomonas aeruginosa PA01
gccguagaggucgccguc

SEQ ID NO: 1440697 - RNA, 16 nt, Pseudomonas aeruginosa PA01
gccguagaguucggcu

SEQ ID NO: 1440698 - RNA, 16 nt, Pseudomonas aeruginosa PA01
gccgguguagcgacgg

SEQ ID NO: 1440699 - RNA, 22 nt, Pseudomonas aeruginosa PA01
gccguacuugaaggugcccagg

SEQ ID NO: 1440700 - RNA, 20 nt, Pseudomonas aeruginosa PA01
gccguagaacagcacgucga

SEQ ID NO: 1440701 - RNA, 20 nt, Pseudomonas aeruginosa PA01
gccguagaacgccaggaucg

SEQ ID NO: 1440702 - RNA, 15 nt, Pseudomonas aeruginosa PA01
gccguagaccaccag

SEQ ID NO: 1440703 - RNA, 18 nt, Pseudomonas aeruginosa PA01
gccguagacguagucggc

SEQ ID NO: 1440704 - RNA, 20 nt, Pseudomonas aeruginosa PA01
gccgguggucgguucgucga

SEQ ID NO: 1440705 - RNA, 16 nt, Pseudomonas aeruginosa PA01
gccgguggccaggacg

SEQ ID NO: 1440706 - RNA, 12 nt, Pseudomonas aeruginosa PA01
gccgguggcgcc

SEQ ID NO: 1440707 - RNA, 13 nt, Pseudomonas aeruginosa PA01
gccgguggcgccc

SEQ ID NO: 1440708 - RNA, 16 nt, Pseudomonas aeruginosa PA01
gccgguggcgcccagc

SEQ ID NO: 1440709 - RNA, 17 nt, Pseudomonas aeruginosa PA01
gccgguggucuucagca

SEQ ID NO: 1440710 - RNA, 16 nt, Pseudomonas aeruginosa PA01
gccgucaagcaacggc

SEQ ID NO: 1440711 - RNA, 17 nt, Pseudomonas aeruginosa PA01
gccgucaagcaacggcg

SEQ ID NO: 1440712 - RNA, 13 nt, Pseudomonas aeruginosa PA01
gccgucaccagca

SEQ ID NO: 1440713 - RNA, 16 nt, Pseudomonas aeruginosa PA01
gccgucaccagcagcc

SEQ ID NO: 1440714 - RNA, 17 nt, Pseudomonas aeruginosa PA01
gccgucaccagcagccc

SEQ ID NO: 1440715 - RNA, 15 nt, Pseudomonas aeruginosa PA01
gccgucaggcaccuc

SEQ ID NO: 1440716 - RNA, 20 nt, Pseudomonas aeruginosa PA01
gccgucaggcaccucgucca

SEQ ID NO: 1440717 - RNA, 21 nt, Pseudomonas aeruginosa PA01
gccgucaugcacuucgaccag

SEQ ID NO: 1440718 - RNA, 15 nt, Pseudomonas aeruginosa PA01
gccguccaccagcca

SEQ ID NO: 1440719 - RNA, 17 nt, Pseudomonas aeruginosa PA01
gccguccaccagccagc

SEQ ID NO: 1440720 - RNA, 21 nt, Pseudomonas aeruginosa PA01
gccguccaccagccagcucgg

SEQ ID NO: 1440721 - RNA, 24 nt, Pseudomonas aeruginosa PA01
gccguccaccagccagcucggcga

SEQ ID NO: 1440722 - RNA, 17 nt, Pseudomonas aeruginosa PA01
gccguccagccggcgcu

SEQ ID NO: 1440723 - RNA, 18 nt, Pseudomonas aeruginosa PA01
gccguccagccggcgcuu

SEQ ID NO: 1440724 - RNA, 19 nt, Pseudomonas aeruginosa PA01
gccguccagccggcgcuuc

SEQ ID NO: 1440725 - RNA, 20 nt, Pseudomonas aeruginosa PA01
gccguccagccggcgcuucu

SEQ ID NO: 1440726 - RNA, 23 nt, Pseudomonas aeruginosa PA01
gccguccagcgagaacuugccgg

SEQ ID NO: 1440727 - RNA, 22 nt, Pseudomonas aeruginosa PA01
gccguccagcuugagguaggcc

SEQ ID NO: 1440728 - RNA, 14 nt, Pseudomonas aeruginosa PA01
gccguccaggcgcg

SEQ ID NO: 1440729 - RNA, 16 nt, Pseudomonas aeruginosa PA01
gccguccaggcugccg

SEQ ID NO: 1440730 - RNA, 19 nt, Pseudomonas aeruginosa PA01
gccguccaggcugccgccu

SEQ ID NO: 1440731 - RNA, 20 nt, Pseudomonas aeruginosa PA01
gccgucccagucggcguccg

SEQ ID NO: 1440732 - RNA, 22 nt, Pseudomonas aeruginosa PA01
gccgucccagucggcguccgcc

SEQ ID NO: 1440733 - RNA, 16 nt, Pseudomonas aeruginosa PA01
gccgucccauuccucg

SEQ ID NO: 1440734 - RNA, 18 nt, Pseudomonas aeruginosa PA01
gccgucccauuccucggc

SEQ ID NO: 1440735 - RNA, 17 nt, Pseudomonas aeruginosa PA01
gccggucagagacaggu

SEQ ID NO: 1440736 - RNA, 16 nt, Pseudomonas aeruginosa PA01
gccggucccgggcucc

SEQ ID NO: 1440737 - RNA, 21 nt, Pseudomonas aeruginosa PA01
gccggucaccacuggaaacgc

SEQ ID NO: 1440738 - RNA, 18 nt, Pseudomonas aeruginosa PA01
gccgguagugcuucaggu

SEQ ID NO: 1440739 - RNA, 14 nt, Pseudomonas aeruginosa PA01
gccgguaucgcgcu

SEQ ID NO: 1440740 - RNA, 21 nt, Pseudomonas aeruginosa PA01
gccgguaaugaaaagccccgc

SEQ ID NO: 1440741 - RNA, 23 nt, Pseudomonas aeruginosa PA01
gccgguaaugaaaagccccgcga

SEQ ID NO: 1440742 - RNA, 17 nt, Pseudomonas aeruginosa PA01
gccgguaggggccgacg

SEQ ID NO: 1440743 - RNA, 17 nt, Pseudomonas aeruginosa PA01
gccgguaggucaccagg

SEQ ID NO: 1440744 - RNA, 18 nt, Pseudomonas aeruginosa PA01
gccgguaggucaccaggu

SEQ ID NO: 1440745 - RNA, 22 nt, Pseudomonas aeruginosa PA01
gccgguaguagcgauugcagcg

SEQ ID NO: 1440746 - RNA, 19 nt, Pseudomonas aeruginosa PA01
gccggguugccgcuggccu

SEQ ID NO: 1440747 - RNA, 20 nt, Pseudomonas aeruginosa PA01
gccggguugccgcuggccuc

SEQ ID NO: 1440748 - RNA, 15 nt, Pseudomonas aeruginosa PA01
gccggguugcgccgc

SEQ ID NO: 1440749 - RNA, 22 nt, Pseudomonas aeruginosa PA01
gccggguuuuucuuugccugga

SEQ ID NO: 1440750 - RNA, 17 nt, Pseudomonas aeruginosa PA01
gccgggcaagcucgacg

SEQ ID NO: 1440751 - RNA, 18 nt, Pseudomonas aeruginosa PA01
gccgggcaagcucgacga

SEQ ID NO: 1440752 - RNA, 21 nt, Pseudomonas aeruginosa PA01
gccgggcaacgauucgacgca

SEQ ID NO: 1440753 - RNA, 18 nt, Pseudomonas aeruginosa PA01
gccgggcaacgccaggcc

SEQ ID NO: 1440754 - RNA, 22 nt, Pseudomonas aeruginosa PA01
gccgggauuguugcggcggguc

SEQ ID NO: 1440755 - RNA, 18 nt, Pseudomonas aeruginosa PA01
gccgguccuuguccgggu

SEQ ID NO: 1440756 - RNA, 19 nt, Pseudomonas aeruginosa PA01
gccggugaacagguagcug

SEQ ID NO: 1440757 - RNA, 20 nt, Pseudomonas aeruginosa PA01
gccggugacccacuccggca

SEQ ID NO: 1440758 - RNA, 21 nt, Pseudomonas aeruginosa PA01
gccggugacccacuccggcag

SEQ ID NO: 1440759 - RNA, 20 nt, Pseudomonas aeruginosa PA01
gccggugacgcugcucacca

SEQ ID NO: 1440760 - RNA, 22 nt, Pseudomonas aeruginosa PA01
gccggugacgaaaccggcgucc

SEQ ID NO: 1440761 - RNA, 21 nt, Pseudomonas aeruginosa PA01
gccggugacgaacgaagcgcc

SEQ ID NO: 1440762 - RNA, 16 nt, Pseudomonas aeruginosa PA01
gccggugccaggacca

SEQ ID NO: 1440763 - RNA, 20 nt, Pseudomonas aeruginosa PA01
gccggugccauacagcgccc

SEQ ID NO: 1440764 - RNA, 14 nt, Pseudomonas aeruginosa PA01
gccggugcuggcga

SEQ ID NO: 1440765 - RNA, 20 nt, Pseudomonas aeruginosa PA01
gccggugcuggugcggccga

SEQ ID NO: 1440766 - RNA, 22 nt, Pseudomonas aeruginosa PA01
gccggugcagaagacgcccagc

SEQ ID NO: 1440767 - RNA, 16 nt, Pseudomonas aeruginosa PA01
gccggugaugucggcg

SEQ ID NO: 1440768 - RNA, 16 nt, Pseudomonas aeruginosa PA01
gccggugcaccaggcg

SEQ ID NO: 1440769 - RNA, 22 nt, Pseudomonas aeruginosa PA01
gccggugcaccaggcgaugcgc

SEQ ID NO: 1440770 - RNA, 19 nt, Pseudomonas aeruginosa PA01
gccggugauguaggacgcc

SEQ ID NO: 1440771 - RNA, 20 nt, Pseudomonas aeruginosa PA01
gccggugaucgagccgccgg

SEQ ID NO: 1440772 - RNA, 18 nt, Pseudomonas aeruginosa PA01
gccggugaucucgcggcg

SEQ ID NO: 1440773 - RNA, 22 nt, Pseudomonas aeruginosa PA01
gccggugaucucgcggcgcggc

SEQ ID NO: 1440774 - RNA, 19 nt, Pseudomonas aeruginosa PA01
gcgcaacgaaaagccgccc

SEQ ID NO: 1440775 - RNA, 20 nt, Pseudomonas aeruginosa PA01
gcgcaacgaaaagccgcccc

SEQ ID NO: 1440776 - RNA, 22 nt, Pseudomonas aeruginosa PA01
gcgcaaccgguuucccucgagc

SEQ ID NO: 1440777 - RNA, 17 nt, Pseudomonas aeruginosa PA01
gcgcaaccguuccagcg

SEQ ID NO: 1440778 - RNA, 20 nt, Pseudomonas aeruginosa PA01
gcgcaaccguuccagcgccu

SEQ ID NO: 1440779 - RNA, 14 nt, Pseudomonas aeruginosa PA01
gcgcaacgccgacg

SEQ ID NO: 1440780 - RNA, 20 nt, Pseudomonas aeruginosa PA01
gcgcaacgccgacggcgugc

SEQ ID NO: 1440781 - RNA, 14 nt, Pseudomonas aeruginosa PA01
gcgcaacgccggca

SEQ ID NO: 1440782 - RNA, 13 nt, Pseudomonas aeruginosa PA01
gcgcaacggcagc

SEQ ID NO: 1440783 - RNA, 16 nt, Pseudomonas aeruginosa PA01
gcgcaacgcgcgcagg

SEQ ID NO: 1440784 - RNA, 17 nt, Pseudomonas aeruginosa PA01
gcgcaacgcuuccagca

SEQ ID NO: 1440785 - RNA, 22 nt, Pseudomonas aeruginosa PA01
gcgcaacgcuuccagcaccucc

SEQ ID NO: 1440786 - RNA, 18 nt, Pseudomonas aeruginosa PA01
gcgcaacgggacgccagg

SEQ ID NO: 1440787 - RNA, 22 nt, Pseudomonas aeruginosa PA01
gcgcaacugcggggcgcucagg

SEQ ID NO: 1440788 - RNA, 23 nt, Pseudomonas aeruginosa PA01
gcgcaacugcucgaacugcuccu

SEQ ID NO: 1440789 - RNA, 17 nt, Pseudomonas aeruginosa PA01
gcgcaacuggucgcggc

SEQ ID NO: 1440790 - RNA, 20 nt, Pseudomonas aeruginosa PA01
gcgcaacuggucgcggcugc

SEQ ID NO: 1440791 - RNA, 13 nt, Pseudomonas aeruginosa PA01
gcgcaagcggcgg

SEQ ID NO: 1440792 - RNA, 23 nt, Pseudomonas aeruginosa PA01
gcgcaagcucgucacccgcgccu

SEQ ID NO: 1440793 - RNA, 23 nt, Pseudomonas aeruginosa PA01
gcgcaagcgcccggcgaacagcg

SEQ ID NO: 1440794 - RNA, 14 nt, Pseudomonas aeruginosa PA01
gcgcaaggcagcgu

SEQ ID NO: 1440795 - RNA, 15 nt, Pseudomonas aeruginosa PA01
gcgcaaggcagcguc

SEQ ID NO: 1440796 - RNA, 22 nt, Pseudomonas aeruginosa PA01
gcgcaagucggccugcaccagc

SEQ ID NO: 1440797 - RNA, 14 nt, Pseudomonas aeruginosa PA01
gcgcaaggugccga

SEQ ID NO: 1440798 - RNA, 20 nt, Pseudomonas aeruginosa PA01
gcgcaaggugccgaggucgu

SEQ ID NO: 1440799 - RNA, 17 nt, Pseudomonas aeruginosa PA01
gcgcaauacaccgcugc

SEQ ID NO: 1440800 - RNA, 22 nt, Pseudomonas aeruginosa PA01
gcgcaauacaccgcugcgccgc

SEQ ID NO: 1440801 - RNA, 23 nt, Pseudomonas aeruginosa PA01
gcgcaccaccgagagcggcgcca

SEQ ID NO: 1440802 - RNA, 15 nt, Pseudomonas aeruginosa PA01
gcgcaaucagggcug

SEQ ID NO: 1440803 - RNA, 20 nt, Pseudomonas aeruginosa PA01
gcgcaaucagggcugggcgc

SEQ ID NO: 1440804 - RNA, 21 nt, Pseudomonas aeruginosa PA01
gcgcacgccgcggaaggcccg

SEQ ID NO: 1440805 - RNA, 13 nt, Pseudomonas aeruginosa PA01
gcgcaccuuggcu

SEQ ID NO: 1440806 - RNA, 21 nt, Pseudomonas aeruginosa PA01
gcgcacgaggauuuccgcgcc

SEQ ID NO: 1440807 - RNA, 22 nt, Pseudomonas aeruginosa PA01
gcgcacgaggauuuccgcgccc

SEQ ID NO: 1440808 - RNA, 18 nt, Pseudomonas aeruginosa PA01
gcgcacgcaauggcgcag

SEQ ID NO: 1440809 - RNA, 19 nt, Pseudomonas aeruginosa PA01
gcgcacgcaauggcgcagc

SEQ ID NO: 1440810 - RNA, 22 nt, Pseudomonas aeruginosa PA01
gcgcacgcaauggcgcagccgc

SEQ ID NO: 1440811 - RNA, 19 nt, Pseudomonas aeruginosa PA01
gcgcaccgcggcgagccgg

SEQ ID NO: 1440812 - RNA, 19 nt, Pseudomonas aeruginosa PA01
gcgcaccuguuucagcggg

SEQ ID NO: 1440813 - RNA, 15 nt, Pseudomonas aeruginosa PA01
gcgcaccaggccagg

SEQ ID NO: 1440814 - RNA, 22 nt, Pseudomonas aeruginosa PA01
gcgcaccaggccaggcugcgcu

SEQ ID NO: 1440815 - RNA, 13 nt, Pseudomonas aeruginosa PA01
gcgcaccaggccu

SEQ ID NO: 1440816 - RNA, 17 nt, Pseudomonas aeruginosa PA01
gcgcaccaggccuccca

SEQ ID NO: 1440817 - RNA, 21 nt, Pseudomonas aeruginosa PA01
gcgcaccaggccucccagccg

SEQ ID NO: 1440818 - RNA, 15 nt, Pseudomonas aeruginosa PA01
gcgcaccagcggguc

SEQ ID NO: 1440819 - RNA, 17 nt, Pseudomonas aeruginosa PA01
gcgcaccacucccggcg

SEQ ID NO: 1440820 - RNA, 22 nt, Pseudomonas aeruginosa PA01
gcgcaccagcacuuccggcgcg

SEQ ID NO: 1440821 - RNA, 14 nt, Pseudomonas aeruginosa PA01
gcgcaccaccuggc

SEQ ID NO: 1440822 - RNA, 13 nt, Pseudomonas aeruginosa PA01
gcgcaccgccucg

SEQ ID NO: 1440823 - RNA, 14 nt, Pseudomonas aeruginosa PA01
gcgcaccgccucga

SEQ ID NO: 1440824 - RNA, 16 nt, Pseudomonas aeruginosa PA01
gcgcaccgccucgugc

SEQ ID NO: 1440825 - RNA, 14 nt, Pseudomonas aeruginosa PA01
gcgcaccgccugca

SEQ ID NO: 1440826 - RNA, 19 nt, Pseudomonas aeruginosa PA01
gcgcaccgccugcagcacc

SEQ ID NO: 1440827 - RNA, 20 nt, Pseudomonas aeruginosa PA01
gcgcaccgccugcagcacca

SEQ ID NO: 1440828 - RNA, 11 nt, Pseudomonas aeruginosa PA01
gcgcaccgcgc

SEQ ID NO: 1440829 - RNA, 14 nt, Pseudomonas aeruginosa PA01
gcgcaccgcgccgg

SEQ ID NO: 1440830 - RNA, 16 nt, Pseudomonas aeruginosa PA01
gcgcaccgcgccggga

SEQ ID NO: 1440831 - RNA, 16 nt, Pseudomonas aeruginosa PA01
gcgauggaguaggcgu

SEQ ID NO: 1440832 - RNA, 22 nt, Pseudomonas aeruginosa PA01
gcgauggaugacccgcucgccg

SEQ ID NO: 1440833 - RNA, 23 nt, Pseudomonas aeruginosa PA01
gcgauggaugacccgcucgccgg

SEQ ID NO: 1440834 - RNA, 22 nt, Pseudomonas aeruginosa PA01
gcgauggaaguugcgcacccgc

SEQ ID NO: 1440835 - RNA, 15 nt, Pseudomonas aeruginosa PA01
gcgaugcucagcgcc

SEQ ID NO: 1440836 - RNA, 21 nt, Pseudomonas aeruginosa PA01
gcgaugcucagcgccggccag

SEQ ID NO: 1440837 - RNA, 21 nt, Pseudomonas aeruginosa PA01
gcgauggcccagaugaucagg

SEQ ID NO: 1440838 - RNA, 13 nt, Pseudomonas aeruginosa PA01
gcgauggccagcg

SEQ ID NO: 1440839 - RNA, 15 nt, Pseudomonas aeruginosa PA01
gcgauggccagcgcg

SEQ ID NO: 1440840 - RNA, 17 nt, Pseudomonas aeruginosa PA01
gcgauggccgccagcag

SEQ ID NO: 1440841 - RNA, 21 nt, Pseudomonas aeruginosa PA01
gcgauggccgccagcaggccg

SEQ ID NO: 1440842 - RNA, 14 nt, Pseudomonas aeruginosa PA01
gcgauggccgccug

SEQ ID NO: 1440843 - RNA, 21 nt, Pseudomonas aeruginosa PA01
gcgauggcccguuccaccgcc

SEQ ID NO: 1440844 - RNA, 18 nt, Pseudomonas aeruginosa PA01
gcgaugggugccgcgcag

SEQ ID NO: 1440845 - RNA, 23 nt, Pseudomonas aeruginosa PA01
gcgaugguaguccgcugcgagca

SEQ ID NO: 1440846 - RNA, 20 nt, Pseudomonas aeruginosa PA01
gcgauggcgugaaguagccg

SEQ ID NO: 1440847 - RNA, 16 nt, Pseudomonas aeruginosa PA01
gcgauggcucgcggcg

SEQ ID NO: 1440848 - RNA, 16 nt, Pseudomonas aeruginosa PA01
gcgauggccuggucgg

SEQ ID NO: 1440849 - RNA, 14 nt, Pseudomonas aeruginosa PA01
gcgauggcgcgcgg

SEQ ID NO: 1440850 - RNA, 15 nt, Pseudomonas aeruginosa PA01
gcgaugguauggcgg

SEQ ID NO: 1440851 - RNA, 15 nt, Pseudomonas aeruginosa PA01
gcgauguccaggccg

SEQ ID NO: 1440852 - RNA, 16 nt, Pseudomonas aeruginosa PA01
gcgauguccccggcca

SEQ ID NO: 1440853 - RNA, 20 nt, Pseudomonas aeruginosa PA01
gcgauguccccggccagcag

SEQ ID NO: 1440854 - RNA, 16 nt, Pseudomonas aeruginosa PA01
gcgaugguugccguac

SEQ ID NO: 1440855 - RNA, 19 nt, Pseudomonas aeruginosa PA01
gcgauguaggucaccgcgc

SEQ ID NO: 1440856 - RNA, 21 nt, Pseudomonas aeruginosa PA01
gcgauguaggucaccgcgccg

SEQ ID NO: 1440857 - RNA, 22 nt, Pseudomonas aeruginosa PA01
gcgauguaggucaccgcgccgg

SEQ ID NO: 1440858 - RNA, 20 nt, Pseudomonas aeruginosa PA01
gcgauguucaccgcggccuu

SEQ ID NO: 1440859 - RNA, 21 nt, Pseudomonas aeruginosa PA01
gcgauguugaacagcgccgga

SEQ ID NO: 1440860 - RNA, 17 nt, Pseudomonas aeruginosa PA01
gcgcaaccagccggaga

SEQ ID NO: 1440861 - RNA, 20 nt, Pseudomonas aeruginosa PA01
gcgcaaccagaccagcagga

SEQ ID NO: 1440862 - RNA, 16 nt, Pseudomonas aeruginosa PA01
gcgauuucgcugcgca

SEQ ID NO: 1440863 - RNA, 19 nt, Pseudomonas aeruginosa PA01
gcgauuccaugggcagacg

SEQ ID NO: 1440864 - RNA, 15 nt, Pseudomonas aeruginosa PA01
gcgauugcagcuccu

SEQ ID NO: 1440865 - RNA, 17 nt, Pseudomonas aeruginosa PA01
gcgauucguucgagcag

SEQ ID NO: 1440866 - RNA, 15 nt, Pseudomonas aeruginosa PA01
gcgauucgccgggcu

SEQ ID NO: 1440867 - RNA, 13 nt, Pseudomonas aeruginosa PA01
gcgaucgccccgu

SEQ ID NO: 1440868 - RNA, 18 nt, Pseudomonas aeruginosa PA01
gcgaucgccccguuggug

SEQ ID NO: 1440869 - RNA, 21 nt, Pseudomonas aeruginosa PA01
gcgaucgccaguuccgugucg

SEQ ID NO: 1440870 - RNA, 19 nt, Pseudomonas aeruginosa PA01
gcgaucgccaggcgaucca

SEQ ID NO: 1440871 - RNA, 14 nt, Pseudomonas aeruginosa PA01
gcgaucgccggcgu

SEQ ID NO: 1440872 - RNA, 13 nt, Pseudomonas aeruginosa PA01
gcgaucgccgcgg

SEQ ID NO: 1440873 - RNA, 16 nt, Pseudomonas aeruginosa PA01
gcgaucgccgcggcga

SEQ ID NO: 1440874 - RNA, 13 nt, Pseudomonas aeruginosa PA01
gcgaucgccgcca

SEQ ID NO: 1440875 - RNA, 13 nt, Pseudomonas aeruginosa PA01
gcgaucggcgucc

SEQ ID NO: 1440876 - RNA, 20 nt, Pseudomonas aeruginosa PA01
gcgaucggcguccgcggccu

SEQ ID NO: 1440877 - RNA, 22 nt, Pseudomonas aeruginosa PA01
gcgauccuccgccagccccagg

SEQ ID NO: 1440878 - RNA, 14 nt, Pseudomonas aeruginosa PA01
gcgauccuggcggc

SEQ ID NO: 1440879 - RNA, 13 nt, Pseudomonas aeruginosa PA01
gcgaucgaccugc

SEQ ID NO: 1440880 - RNA, 20 nt, Pseudomonas aeruginosa PA01
gcgaucgaccugccgguagu

SEQ ID NO: 1440881 - RNA, 14 nt, Pseudomonas aeruginosa PA01
gcgaucgacgccuc

SEQ ID NO: 1440882 - RNA, 22 nt, Pseudomonas aeruginosa PA01
gcgaucgaggaugaucggcucc

SEQ ID NO: 1440883 - RNA, 22 nt, Pseudomonas aeruginosa PA01
gcgaucgaggccuacccgcgcu

SEQ ID NO: 1440884 - RNA, 19 nt, Pseudomonas aeruginosa PA01
gcgaucgaaggaucgccuu

SEQ ID NO: 1440885 - RNA, 17 nt, Pseudomonas aeruginosa PA01
gcgaucgagcuguccau

SEQ ID NO: 1440886 - RNA, 13 nt, Pseudomonas aeruginosa PA01
gcgauccgcgcgg

SEQ ID NO: 1440887 - RNA, 12 nt, Pseudomonas aeruginosa PA01
gcgaucaucgcc

SEQ ID NO: 1440888 - RNA, 15 nt, Pseudomonas aeruginosa PA01
gcgaucaucgccacc

SEQ ID NO: 1440889 - RNA, 13 nt, Pseudomonas aeruginosa PA01
gcgaucaucgcgc

SEQ ID NO: 1440890 - RNA, 16 nt, Pseudomonas aeruginosa PA01
gcgaucaugccuucga

SEQ ID NO: 1440891 - RNA, 15 nt, Pseudomonas aeruginosa PA01
gcgaucaggccgaug

SEQ ID NO: 1440892 - RNA, 22 nt, Pseudomonas aeruginosa PA01
gcgaucaggccgaugcgcaacg

SEQ ID NO: 1440893 - RNA, 18 nt, Pseudomonas aeruginosa PA01
gcgaucagggccucgcca

SEQ ID NO: 1440894 - RNA, 20 nt, Pseudomonas aeruginosa PA01
gcgaucagggccucgccacg

SEQ ID NO: 1440895 - RNA, 16 nt, Pseudomonas aeruginosa PA01
gcgaucauccagcccc

SEQ ID NO: 1440896 - RNA, 19 nt, Pseudomonas aeruginosa PA01
gcgaucccaggucggcggg

SEQ ID NO: 1440897 - RNA, 13 nt, Pseudomonas aeruginosa PA01
gcgauccaccgcc

SEQ ID NO: 1440898 - RNA, 15 nt, Pseudomonas aeruginosa PA01
gcgauccaccgccag

SEQ ID NO: 1440899 - RNA, 17 nt, Pseudomonas aeruginosa PA01
gcgauccaccgccaggg

SEQ ID NO: 1440900 - RNA, 21 nt, Pseudomonas aeruginosa PA01
gcgauccaccgccagggcgcu

SEQ ID NO: 1440901 - RNA, 19 nt, Pseudomonas aeruginosa PA01
gcgauccagaagaucagcg

SEQ ID NO: 1440902 - RNA, 20 nt, Pseudomonas aeruginosa PA01
gcgauccagaagaucagcgc

SEQ ID NO: 1440903 - RNA, 20 nt, Pseudomonas aeruginosa PA01
gcgaucacccggcgaagcuc

SEQ ID NO: 1440904 - RNA, 23 nt, Pseudomonas aeruginosa PA01
gcgaucacauagcuguagcggcu

SEQ ID NO: 1440905 - RNA, 14 nt, Pseudomonas aeruginosa PA01
gcgaucaccgcguc

SEQ ID NO: 1440906 - RNA, 16 nt, Pseudomonas aeruginosa PA01
gcgaucaccgcgucca

SEQ ID NO: 1440907 - RNA, 19 nt, Pseudomonas aeruginosa PA01
gcgaucaccgcguccaucc

SEQ ID NO: 1440908 - RNA, 21 nt, Pseudomonas aeruginosa PA01
gcgaucaccgcguccaucccc

SEQ ID NO: 1440909 - RNA, 16 nt, Pseudomonas aeruginosa PA01
gcgaucaggcagcgcg

SEQ ID NO: 1440910 - RNA, 17 nt, Pseudomonas aeruginosa PA01
gcgaucaggcagcgcgc

SEQ ID NO: 1440911 - RNA, 19 nt, Pseudomonas aeruginosa PA01
gcgaucagcgaaaugguca

SEQ ID NO: 1440912 - RNA, 18 nt, Pseudomonas aeruginosa PA01
gcgaucacgucguacucg

SEQ ID NO: 1440913 - RNA, 18 nt, Pseudomonas aeruginosa PA01
gcgaucagcaccagcgga

SEQ ID NO: 1440914 - RNA, 14 nt, Pseudomonas aeruginosa PA01
gcgaugcccaggcc

SEQ ID NO: 1440915 - RNA, 18 nt, Pseudomonas aeruginosa PA01
gcgaugcccaggccgccg

SEQ ID NO: 1440916 - RNA, 19 nt, Pseudomonas aeruginosa PA01
gcgaugcccaggccgccga

SEQ ID NO: 1440917 - RNA, 20 nt, Pseudomonas aeruginosa PA01
gcgaugcccaggccgccgau

SEQ ID NO: 1440918 - RNA, 13 nt, Pseudomonas aeruginosa PA01
gcgaugccgccgg

SEQ ID NO: 1440919 - RNA, 13 nt, Pseudomonas aeruginosa PA01
gcgaugccgcgcc

SEQ ID NO: 1440920 - RNA, 15 nt, Pseudomonas aeruginosa PA01
gcgaugccgcgccag

SEQ ID NO: 1440921 - RNA, 17 nt, Pseudomonas aeruginosa PA01
gcgaugccgcgccaggc

SEQ ID NO: 1440922 - RNA, 19 nt, Pseudomonas aeruginosa PA01
gcgaugccgaugccgccga

SEQ ID NO: 1440923 - RNA, 22 nt, Pseudomonas aeruginosa PA01
gcgaugccgauggcgccgccga

SEQ ID NO: 1440924 - RNA, 13 nt, Pseudomonas aeruginosa PA01
gcgaugccgccca

SEQ ID NO: 1440925 - RNA, 15 nt, Pseudomonas aeruginosa PA01
gcgaugccgcccagc

SEQ ID NO: 1440926 - RNA, 16 nt, Pseudomonas aeruginosa PA01
gcgaugccgcccagca

SEQ ID NO: 1440927 - RNA, 18 nt, Pseudomonas aeruginosa PA01
gcgaugcccuggccgcug

SEQ ID NO: 1440928 - RNA, 19 nt, Pseudomonas aeruginosa PA01
gcgaugcccuggccgcugc

SEQ ID NO: 1440929 - RNA, 21 nt, Pseudomonas aeruginosa PA01
gcgaugcccuggccgcugccg

SEQ ID NO: 1440930 - RNA, 23 nt, Pseudomonas aeruginosa PA01
gcgaugcccuggccgcugccgcu

SEQ ID NO: 1440931 - RNA, 20 nt, Pseudomonas aeruginosa PA01
gcgaugcccuggcuuuccag

SEQ ID NO: 1440932 - RNA, 19 nt, Pseudomonas aeruginosa PA01
gcgaugcccuuggccagcg

SEQ ID NO: 1440933 - RNA, 16 nt, Pseudomonas aeruginosa PA01
gcgaugaggcugucca

SEQ ID NO: 1440934 - RNA, 14 nt, Pseudomonas aeruginosa PA01
gcgaugaugccgcc

SEQ ID NO: 1440935 - RNA, 16 nt, Pseudomonas aeruginosa PA01
gcgaugaugccgccgu

SEQ ID NO: 1440936 - RNA, 15 nt, Pseudomonas aeruginosa PA01
gcgaugaucuggcca

SEQ ID NO: 1440937 - RNA, 15 nt, Pseudomonas aeruginosa PA01
gcgaugcgcaggccg

SEQ ID NO: 1440938 - RNA, 14 nt, Pseudomonas aeruginosa PA01
gcgaugcgcuggaa

SEQ ID NO: 1440939 - RNA, 15 nt, Pseudomonas aeruginosa PA01
gcgaugcgcuggaag

SEQ ID NO: 1440940 - RNA, 16 nt, Pseudomonas aeruginosa PA01
gcgaugcggcggaacu

SEQ ID NO: 1440941 - RNA, 14 nt, Pseudomonas aeruginosa PA01
gcgaugcgccgguc

SEQ ID NO: 1440942 - RNA, 17 nt, Pseudomonas aeruginosa PA01
gcgaugcugucagcgcc

SEQ ID NO: 1440943 - RNA, 22 nt, Pseudomonas aeruginosa PA01
gcgaugcugucagcgcccggcu

SEQ ID NO: 1440944 - RNA, 21 nt, Pseudomonas aeruginosa PA01
gcgauggaacgagcgcgacuc

SEQ ID NO: 1440945 - RNA, 17 nt, Pseudomonas aeruginosa PA01
gcgaugcguuccagggc

SEQ ID NO: 1440946 - RNA, 13 nt, Pseudomonas aeruginosa PA01
gcgaucuucuccg

SEQ ID NO: 1440947 - RNA, 22 nt, Pseudomonas aeruginosa PA01
gcgaucuucuccgccgcgugcg

SEQ ID NO: 1440948 - RNA, 18 nt, Pseudomonas aeruginosa PA01
gcgaucuugaucgccagc

SEQ ID NO: 1440949 - RNA, 12 nt, Pseudomonas aeruginosa PA01
gcgaucugcugg

SEQ ID NO: 1440950 - RNA, 20 nt, Pseudomonas aeruginosa PA01
gcgaugaccaggguggcggc

SEQ ID NO: 1440951 - RNA, 16 nt, Pseudomonas aeruginosa PA01
gcgaucuccgggagca

SEQ ID NO: 1440952 - RNA, 14 nt, Pseudomonas aeruginosa PA01
gcgaucuccugccg

SEQ ID NO: 1440953 - RNA, 19 nt, Pseudomonas aeruginosa PA01
gcgaucuccugccgcggcg

SEQ ID NO: 1440954 - RNA, 13 nt, Pseudomonas aeruginosa PA01
gcgaucucggcgc

SEQ ID NO: 1440955 - RNA, 20 nt, Pseudomonas aeruginosa PA01
gcgaucucuacuaccgccag

SEQ ID NO: 1440956 - RNA, 16 nt, Pseudomonas aeruginosa PA01
gcgaucucucagucca

SEQ ID NO: 1440957 - RNA, 21 nt, Pseudomonas aeruginosa PA01
gcgaucgucgagaugcugcgg

SEQ ID NO: 1440958 - RNA, 18 nt, Pseudomonas aeruginosa PA01
gcgaucuaccugcgugcg

SEQ ID NO: 1440959 - RNA, 15 nt, Pseudomonas aeruginosa PA01
gcgaucuccgccagg

SEQ ID NO: 1440960 - RNA, 17 nt, Pseudomonas aeruginosa PA01
gcgaucuccgccaggcg

SEQ ID NO: 1440961 - RNA, 21 nt, Pseudomonas aeruginosa PA01
gcgaucuccgccaggcggccg

SEQ ID NO: 1440962 - RNA, 22 nt, Pseudomonas aeruginosa PA01
gcgaucuccgccaggcggccga

SEQ ID NO: 1440963 - RNA, 22 nt, Pseudomonas aeruginosa PA01
gcgaucggguagagcgcggcgc

SEQ ID NO: 1440964 - RNA, 15 nt, Pseudomonas aeruginosa PA01
aagccgaccggcgcc

SEQ ID NO: 1440965 - RNA, 17 nt, Pseudomonas aeruginosa PA01
aagccgaccggcgccgg

SEQ ID NO: 1440966 - RNA, 13 nt, Pseudomonas aeruginosa PA01
gcgaccagccggg

SEQ ID NO: 1440967 - RNA, 13 nt, Pseudomonas aeruginosa PA01
gcgaccagcccgc

SEQ ID NO: 1440968 - RNA, 13 nt, Pseudomonas aeruginosa PA01
gcgaccagcgcca

SEQ ID NO: 1440969 - RNA, 16 nt, Pseudomonas aeruginosa PA01
gcgaccagcgccaggc

SEQ ID NO: 1440970 - RNA, 17 nt, Pseudomonas aeruginosa PA01
gcgaccagcgccaggcg

SEQ ID NO: 1440971 - RNA, 18 nt, Pseudomonas aeruginosa PA01
gcgaccagcgccaggcgc

SEQ ID NO: 1440972 - RNA, 14 nt, Pseudomonas aeruginosa PA01
gcgaccaccaccag

SEQ ID NO: 1440973 - RNA, 17 nt, Pseudomonas aeruginosa PA01
gcgaccaccaccagguc

SEQ ID NO: 1440974 - RNA, 19 nt, Pseudomonas aeruginosa PA01
gcgaccaccaccaggucgg

SEQ ID NO: 1440975 - RNA, 13 nt, Pseudomonas aeruginosa PA01
gcgaccaccacgu

SEQ ID NO: 1440976 - RNA, 20 nt, Pseudomonas aeruginosa PA01
gcgaccaccacgucgaugcc

SEQ ID NO: 1440977 - RNA, 16 nt, Pseudomonas aeruginosa PA01
gcgaccaccgccggga

SEQ ID NO: 1440978 - RNA, 23 nt, Pseudomonas aeruginosa PA01
gcgaccaccgccgggaccacgcu

SEQ ID NO: 1440979 - RNA, 13 nt, Pseudomonas aeruginosa PA01
gcgaccaccgcga

SEQ ID NO: 1440980 - RNA, 21 nt, Pseudomonas aeruginosa PA01
gcgaccaccgcgaauccgcgg

SEQ ID NO: 1440981 - RNA, 17 nt, Pseudomonas aeruginosa PA01
gcgaccacccggcgguc

SEQ ID NO: 1440982 - RNA, 18 nt, Pseudomonas aeruginosa PA01
gcgaccacccggcggucc

SEQ ID NO: 1440983 - RNA, 21 nt, Pseudomonas aeruginosa PA01
gcgaccacccggcgguccgcc

SEQ ID NO: 1440984 - RNA, 15 nt, Pseudomonas aeruginosa PA01
gcgacauagcggcug

SEQ ID NO: 1440985 - RNA, 15 nt, Pseudomonas aeruginosa PA01
gcgacauagccggcg

SEQ ID NO: 1440986 - RNA, 16 nt, Pseudomonas aeruginosa PA01
gcgacauagccggcga

SEQ ID NO: 1440987 - RNA, 13 nt, Pseudomonas aeruginosa PA01
gcgaccacaggcg

SEQ ID NO: 1440988 - RNA, 15 nt, Pseudomonas aeruginosa PA01
gcgaccacaggcggc

SEQ ID NO: 1440989 - RNA, 16 nt, Pseudomonas aeruginosa PA01
gcgaccacaggcggcg

SEQ ID NO: 1440990 - RNA, 18 nt, Pseudomonas aeruginosa PA01
gcgacaguucgccgcccg

SEQ ID NO: 1440991 - RNA, 13 nt, Pseudomonas aeruginosa PA01
gcgacaguucgcg

SEQ ID NO: 1440992 - RNA, 19 nt, Pseudomonas aeruginosa PA01
gcgacagguucaggacgcu

SEQ ID NO: 1440993 - RNA, 13 nt, Pseudomonas aeruginosa PA01
gcgacaggcgauc

SEQ ID NO: 1440994 - RNA, 16 nt, Pseudomonas aeruginosa PA01
gcgacaggcgaucgac

SEQ ID NO: 1440995 - RNA, 16 nt, Pseudomonas aeruginosa PA01
gcgacacgaugucgcg

SEQ ID NO: 1440996 - RNA, 15 nt, Pseudomonas aeruginosa PA01
gcgacaccgggccuu

SEQ ID NO: 1440997 - RNA, 14 nt, Pseudomonas aeruginosa PA01
gcgacaggauggac

SEQ ID NO: 1440998 - RNA, 23 nt, Pseudomonas aeruginosa PA01
gcgacagcucguggcuggcgccg

SEQ ID NO: 1440999 - RNA, 16 nt, Pseudomonas aeruginosa PA01
gcgacagcuuccagug

SEQ ID NO: 1441000 - RNA, 19 nt, Pseudomonas aeruginosa PA01
gcgacaggcccuugaacag

SEQ ID NO: 1441001 - RNA, 23 nt, Pseudomonas aeruginosa PA01
gcgacaggcccuugaacaggcug

SEQ ID NO: 1441002 - RNA, 18 nt, Pseudomonas aeruginosa PA01
gcgacaccaugcuccgcc

SEQ ID NO: 1441003 - RNA, 22 nt, Pseudomonas aeruginosa PA01
gcgacaccaugcuccgccuggc

SEQ ID NO: 1441004 - RNA, 13 nt, Pseudomonas aeruginosa PA01
gcgacaccgccag

SEQ ID NO: 1441005 - RNA, 18 nt, Pseudomonas aeruginosa PA01
gcgacaccgccagcaccu

SEQ ID NO: 1441006 - RNA, 18 nt, Pseudomonas aeruginosa PA01
gcgacacauggucggcca

SEQ ID NO: 1441007 - RNA, 18 nt, Pseudomonas aeruginosa PA01
gccuucgcugagaccgau

SEQ ID NO: 1441008 - RNA, 21 nt, Pseudomonas aeruginosa PA01
gccuucggcaggaaggccugg

SEQ ID NO: 1441009 - RNA, 20 nt, Pseudomonas aeruginosa PA01
gccuucgcgggccaggccga

SEQ ID NO: 1441010 - RNA, 14 nt, Pseudomonas aeruginosa PA01
gccuucgccagcgg

SEQ ID NO: 1441011 - RNA, 12 nt, Pseudomonas aeruginosa PA01
gccuucgcccag

SEQ ID NO: 1441012 - RNA, 12 nt, Pseudomonas aeruginosa PA01
gccuucgccgac

SEQ ID NO: 1441013 - RNA, 16 nt, Pseudomonas aeruginosa PA01
gccuucgagccacucg

SEQ ID NO: 1441014 - RNA, 17 nt, Pseudomonas aeruginosa PA01
gccuucgacuucgacga

SEQ ID NO: 1441015 - RNA, 18 nt, Pseudomonas aeruginosa PA01
gccuucgacuucgacgaa

SEQ ID NO: 1441016 - RNA, 16 nt, Pseudomonas aeruginosa PA01
gccuucgaagccggca

SEQ ID NO: 1441017 - RNA, 16 nt, Pseudomonas aeruginosa PA01
gccuucgacgguucgc

SEQ ID NO: 1441018 - RNA, 18 nt, Pseudomonas aeruginosa PA01
gccuucgacgguucgcga

SEQ ID NO: 1441019 - RNA, 14 nt, Pseudomonas aeruginosa PA01
gccuuccucggccg

SEQ ID NO: 1441020 - RNA, 21 nt, Pseudomonas aeruginosa PA01
gccuuccucggccgccaggcg

SEQ ID NO: 1441021 - RNA, 14 nt, Pseudomonas aeruginosa PA01
gccuuccucggcga

SEQ ID NO: 1441022 - RNA, 14 nt, Pseudomonas aeruginosa PA01
gccuuccugggcgu

SEQ ID NO: 1441023 - RNA, 17 nt, Pseudomonas aeruginosa PA01
gccuuccugggcgugcu

SEQ ID NO: 1441024 - RNA, 17 nt, Pseudomonas aeruginosa PA01
gccuuccuucucgaagc

SEQ ID NO: 1441025 - RNA, 19 nt, Pseudomonas aeruginosa PA01
gccuuccuucucgaagccg

SEQ ID NO: 1441026 - RNA, 17 nt, Pseudomonas aeruginosa PA01
gccuuccgacgccgcgu

SEQ ID NO: 1441027 - RNA, 19 nt, Pseudomonas aeruginosa PA01
gcgacgaagacgcugcgca

SEQ ID NO: 1441028 - RNA, 22 nt, Pseudomonas aeruginosa PA01
gcgacgaagacgcugcgcacgu

SEQ ID NO: 1441029 - RNA, 16 nt, Pseudomonas aeruginosa PA01
gcgacgaagcuggcga

SEQ ID NO: 1441030 - RNA, 17 nt, Pseudomonas aeruginosa PA01
gcgacgaagcuggcgau

SEQ ID NO: 1441031 - RNA, 16 nt, Pseudomonas aeruginosa PA01
gcgacgaaggccuggu

SEQ ID NO: 1441032 - RNA, 20 nt, Pseudomonas aeruginosa PA01
gcgacgaagguaucgaaguc

SEQ ID NO: 1441033 - RNA, 14 nt, Pseudomonas aeruginosa PA01
gcgacgaaggucgg

SEQ ID NO: 1441034 - RNA, 17 nt, Pseudomonas aeruginosa PA01
gcgacgaaggucggcgg

SEQ ID NO: 1441035 - RNA, 15 nt, Pseudomonas aeruginosa PA01
gcgacgaagcccagg

SEQ ID NO: 1441036 - RNA, 16 nt, Pseudomonas aeruginosa PA01
gcgacgaagcccaggc

SEQ ID NO: 1441037 - RNA, 18 nt, Pseudomonas aeruginosa PA01
gcgacgaagcccaggcug

SEQ ID NO: 1441038 - RNA, 18 nt, Pseudomonas aeruginosa PA01
gcgacgaagcccucgcga

SEQ ID NO: 1441039 - RNA, 20 nt, Pseudomonas aeruginosa PA01
gcgacgaagcccucgcgacg

SEQ ID NO: 1441040 - RNA, 16 nt, Pseudomonas aeruginosa PA01
gcgacgaugcgcccca

SEQ ID NO: 1441041 - RNA, 14 nt, Pseudomonas aeruginosa PA01
gcgacgaugccgcc

SEQ ID NO: 1441042 - RNA, 15 nt, Pseudomonas aeruginosa PA01
gcgacgaugccgccg

SEQ ID NO: 1441043 - RNA, 16 nt, Pseudomonas aeruginosa PA01
gcgacgaugccgccgc

SEQ ID NO: 1441044 - RNA, 20 nt, Pseudomonas aeruginosa PA01
gcgacgauguucuccacguc

SEQ ID NO: 1441045 - RNA, 23 nt, Pseudomonas aeruginosa PA01
gcgacgaucucuucccggcucgg

SEQ ID NO: 1441046 - RNA, 13 nt, Pseudomonas aeruginosa PA01
gcgacgcagcaga

SEQ ID NO: 1441047 - RNA, 21 nt, Pseudomonas aeruginosa PA01
gcgacgcaggacgucguagcc

SEQ ID NO: 1441048 - RNA, 23 nt, Pseudomonas aeruginosa PA01
gcgacgccacccgcaucgaggcc

SEQ ID NO: 1441049 - RNA, 15 nt, Pseudomonas aeruginosa PA01
gcgacggaccgcgac

SEQ ID NO: 1441050 - RNA, 18 nt, Pseudomonas aeruginosa PA01
gcgacggaaacgacaggc

SEQ ID NO: 1441051 - RNA, 13 nt, Pseudomonas aeruginosa PA01
gcgaccugcucga

SEQ ID NO: 1441052 - RNA, 16 nt, Pseudomonas aeruginosa PA01
gcgaccgugaggcgca

SEQ ID NO: 1441053 - RNA, 17 nt, Pseudomonas aeruginosa PA01
gcgaccuccggcgccag

SEQ ID NO: 1441054 - RNA, 19 nt, Pseudomonas aeruginosa PA01
gcgaccuccggcgccaggc

SEQ ID NO: 1441055 - RNA, 20 nt, Pseudomonas aeruginosa PA01
gcgaccuccggcgccaggcc

SEQ ID NO: 1441056 - RNA, 22 nt, Pseudomonas aeruginosa PA01
gcgaccuccggcgccaggcccu

SEQ ID NO: 1441057 - RNA, 23 nt, Pseudomonas aeruginosa PA01
gcgaccgcccgccucaggccggg

SEQ ID NO: 1441058 - RNA, 16 nt, Pseudomonas aeruginosa PA01
gcgaccccgaucaccg

SEQ ID NO: 1441059 - RNA, 22 nt, Pseudomonas aeruginosa PA01
gcgacccaggccgacagcggcu

SEQ ID NO: 1441060 - RNA, 14 nt, Pseudomonas aeruginosa PA01
gcgacccaucgccg

SEQ ID NO: 1441061 - RNA, 13 nt, Pseudomonas aeruginosa PA01
gcgacccagcgcu

SEQ ID NO: 1441062 - RNA, 23 nt, Pseudomonas aeruginosa PA01
gcgaccgcaucguuggcgccguc

SEQ ID NO: 1441063 - RNA, 14 nt, Pseudomonas aeruginosa PA01
gcgaccgccaggcg

SEQ ID NO: 1441064 - RNA, 18 nt, Pseudomonas aeruginosa PA01
gcgaccgccaggcggccg

SEQ ID NO: 1441065 - RNA, 21 nt, Pseudomonas aeruginosa PA01
gcgaccgagaugcucgcgcag

SEQ ID NO: 1441066 - RNA, 14 nt, Pseudomonas aeruginosa PA01
gcgaccgaucaugc

SEQ ID NO: 1441067 - RNA, 19 nt, Pseudomonas aeruginosa PA01
gcgaccgaucaugcccuug

SEQ ID NO: 1441068 - RNA, 15 nt, Pseudomonas aeruginosa PA01
gcgagacgggcgagg

SEQ ID NO: 1441069 - RNA, 16 nt, Pseudomonas aeruginosa PA01
gcgagacgggcgaggc

SEQ ID NO: 1441070 - RNA, 18 nt, Pseudomonas aeruginosa PA01
gcgagagcgccgaccagc

SEQ ID NO: 1441071 - RNA, 22 nt, Pseudomonas aeruginosa PA01
gcgagagcguccggcagggccu

SEQ ID NO: 1441072 - RNA, 21 nt, Pseudomonas aeruginosa PA01
gcgagagcuguccggcgcuga

SEQ ID NO: 1441073 - RNA, 22 nt, Pseudomonas aeruginosa PA01
gcgagaggggcgcucguugcgc

SEQ ID NO: 1441074 - RNA, 21 nt, Pseudomonas aeruginosa PA01
gcgagaggucggcgcgcccgg

SEQ ID NO: 1441075 - RNA, 23 nt, Pseudomonas aeruginosa PA01
gcgagaggucggcgcgcccggcg

SEQ ID NO: 1441076 - RNA, 20 nt, Pseudomonas aeruginosa PA01
gcgagacuaccgaucggcug

SEQ ID NO: 1441077 - RNA, 12 nt, Pseudomonas aeruginosa PA01
gcgagaccucgc

SEQ ID NO: 1441078 - RNA, 15 nt, Pseudomonas aeruginosa PA01
gcgagaccucgccca

SEQ ID NO: 1441079 - RNA, 16 nt, Pseudomonas aeruginosa PA01
gcgagaccucgcccau

SEQ ID NO: 1441080 - RNA, 23 nt, Pseudomonas aeruginosa PA01
gcgagaccucgcccaucgccagg

SEQ ID NO: 1441081 - RNA, 22 nt, Pseudomonas aeruginosa PA01
gcgacuguucucuacgccguag

SEQ ID NO: 1441082 - RNA, 14 nt, Pseudomonas aeruginosa PA01
gcgacuggcccugg

SEQ ID NO: 1441083 - RNA, 23 nt, Pseudomonas aeruginosa PA01
gcgacuucgcauuccaccuuggc

SEQ ID NO: 1441084 - RNA, 18 nt, Pseudomonas aeruginosa PA01
gcgagaccaucuggauca

SEQ ID NO: 1441085 - RNA, 21 nt, Pseudomonas aeruginosa PA01
gcgagacccgguacuccucca

SEQ ID NO: 1441086 - RNA, 15 nt, Pseudomonas aeruginosa PA01
gcgagaccggggauc

SEQ ID NO: 1441087 - RNA, 19 nt, Pseudomonas aeruginosa PA01
gcgagaccggggaucagcu

SEQ ID NO: 1441088 - RNA, 21 nt, Pseudomonas aeruginosa PA01
gcgagcaucucggccaggccc

SEQ ID NO: 1441089 - RNA, 22 nt, Pseudomonas aeruginosa PA01
gcgagcaucucggccaggcccu

SEQ ID NO: 1441090 - RNA, 13 nt, Pseudomonas aeruginosa PA01
gcgagcagguaga

SEQ ID NO: 1441091 - RNA, 15 nt, Pseudomonas aeruginosa PA01
gcgagcagguccugu

SEQ ID NO: 1441092 - RNA, 17 nt, Pseudomonas aeruginosa PA01
gcgagcagggcgaugcc

SEQ ID NO: 1441093 - RNA, 20 nt, Pseudomonas aeruginosa PA01
gcgagcagggcgaugccgau

SEQ ID NO: 1441094 - RNA, 24 nt, Pseudomonas aeruginosa PA01
gcgagcagggcgcugagcgcgguc

SEQ ID NO: 1441095 - RNA, 14 nt, Pseudomonas aeruginosa PA01
gcgagcagcggcac

SEQ ID NO: 1441096 - RNA, 19 nt, Pseudomonas aeruginosa PA01
gcgagcagcggcacgcucu

SEQ ID NO: 1441097 - RNA, 15 nt, Pseudomonas aeruginosa PA01
gcgagcagcggcgcu

SEQ ID NO: 1441098 - RNA, 17 nt, Pseudomonas aeruginosa PA01
gcgacugguggucgagg

SEQ ID NO: 1441099 - RNA, 18 nt, Pseudomonas aeruginosa PA01
gcgacugguggucgaggg

SEQ ID NO: 1441100 - RNA, 20 nt, Pseudomonas aeruginosa PA01
gcgacugucgagcagggucg

SEQ ID NO: 1441101 - RNA, 13 nt, Pseudomonas aeruginosa PA01
gcgacuaccaggu

SEQ ID NO: 1441102 - RNA, 17 nt, Pseudomonas aeruginosa PA01
gcgacugcugaucagcu

SEQ ID NO: 1441103 - RNA, 14 nt, Pseudomonas aeruginosa PA01
gcgacugcugcugc

SEQ ID NO: 1441104 - RNA, 15 nt, Pseudomonas aeruginosa PA01
gcgacugcugcugcg

SEQ ID NO: 1441105 - RNA, 18 nt, Pseudomonas aeruginosa PA01
gcgacuggaugaacagcg

SEQ ID NO: 1441106 - RNA, 15 nt, Pseudomonas aeruginosa PA01
gcgacugcgcuggcc

SEQ ID NO: 1441107 - RNA, 18 nt, Pseudomonas aeruginosa PA01
gcgacugcgcuggccgag

SEQ ID NO: 1441108 - RNA, 13 nt, Pseudomonas aeruginosa PA01
gcgacugccgucg

SEQ ID NO: 1441109 - RNA, 19 nt, Pseudomonas aeruginosa PA01
gcgacugccgucggcgccc

SEQ ID NO: 1441110 - RNA, 14 nt, Pseudomonas aeruginosa PA01
gcgacguugcgcag

SEQ ID NO: 1441111 - RNA, 23 nt, Pseudomonas aeruginosa PA01
gcgacgugggccugcuccucggc

SEQ ID NO: 1441112 - RNA, 23 nt, Pseudomonas aeruginosa PA01
gcgaggcauucucgcgacccugg

SEQ ID NO: 1441113 - RNA, 15 nt, Pseudomonas aeruginosa PA01
gcgaggggcggagca

SEQ ID NO: 1441114 - RNA, 16 nt, Pseudomonas aeruginosa PA01
gcgagggcucgggcgc

SEQ ID NO: 1441115 - RNA, 13 nt, Pseudomonas aeruginosa PA01
gcgaggcccgcgc

SEQ ID NO: 1441116 - RNA, 15 nt, Pseudomonas aeruginosa PA01
gcgaggcccgcgccg

SEQ ID NO: 1441117 - RNA, 16 nt, Pseudomonas aeruginosa PA01
gcgaggcccgcgccgc

SEQ ID NO: 1441118 - RNA, 19 nt, Pseudomonas aeruginosa PA01
gcgaggaucgcgcuggcca

SEQ ID NO: 1441119 - RNA, 20 nt, Pseudomonas aeruginosa PA01
gcgaggaucgcgcuggccag

SEQ ID NO: 1441120 - RNA, 21 nt, Pseudomonas aeruginosa PA01
gcgaggaucgcgcuggccagu

SEQ ID NO: 1441121 - RNA, 23 nt, Pseudomonas aeruginosa PA01
gcgaggauuuccggcuugccgau

SEQ ID NO: 1441122 - RNA, 19 nt, Pseudomonas aeruginosa PA01
gcgaggauuuccucgcgca

SEQ ID NO: 1441123 - RNA, 19 nt, Pseudomonas aeruginosa PA01
gcgaggaucacgcagcagg

SEQ ID NO: 1441124 - RNA, 23 nt, Pseudomonas aeruginosa PA01
gcgaggaucacgcagcaggcgac

SEQ ID NO: 1441125 - RNA, 14 nt, Pseudomonas aeruginosa PA01
gcgaggaucgccag

SEQ ID NO: 1441126 - RNA, 16 nt, Pseudomonas aeruginosa PA01
gcgaggaucgccagca

SEQ ID NO: 1441127 - RNA, 21 nt, Pseudomonas aeruginosa PA01
gcgaggagguuggucugcucg

SEQ ID NO: 1441128 - RNA, 22 nt, Pseudomonas aeruginosa PA01
gcgaggagguuggucugcucgg

SEQ ID NO: 1441129 - RNA, 20 nt, Pseudomonas aeruginosa PA01
gcgaggaaaaggaucgccgc

SEQ ID NO: 1441130 - RNA, 12 nt, Pseudomonas aeruginosa PA01
gcgaggacgccg

SEQ ID NO: 1441131 - RNA, 13 nt, Pseudomonas aeruginosa PA01
gcgaggacgccgg

SEQ ID NO: 1441132 - RNA, 17 nt, Pseudomonas aeruginosa PA01
gcgagcgaaacggcgcu

SEQ ID NO: 1441133 - RNA, 19 nt, Pseudomonas aeruginosa PA01
gcgagcgaaacggcgcuga

SEQ ID NO: 1441134 - RNA, 13 nt, Pseudomonas aeruginosa PA01
gcgagcuucgccg

SEQ ID NO: 1441135 - RNA, 20 nt, Pseudomonas aeruginosa PA01
gcgagcuucgccgcgcaagc

SEQ ID NO: 1441136 - RNA, 21 nt, Pseudomonas aeruginosa PA01
gcgagcuugcaauccgugcgc

SEQ ID NO: 1441137 - RNA, 18 nt, Pseudomonas aeruginosa PA01
gcgagcgcacaacgccuu

SEQ ID NO: 1441138 - RNA, 19 nt, Pseudomonas aeruginosa PA01
gcgagcgcacaacgccuuc

SEQ ID NO: 1441139 - RNA, 14 nt, Pseudomonas aeruginosa PA01
gcgagccguccugc

SEQ ID NO: 1441140 - RNA, 19 nt, Pseudomonas aeruginosa PA01
gcgagccguccugcggccg

SEQ ID NO: 1441141 - RNA, 12 nt, Pseudomonas aeruginosa PA01
gcgagccgccgg

SEQ ID NO: 1441142 - RNA, 14 nt, Pseudomonas aeruginosa PA01
gcgagccgccgggc

SEQ ID NO: 1441143 - RNA, 18 nt, Pseudomonas aeruginosa PA01
gcgagccgcgacggcugc

SEQ ID NO: 1441144 - RNA, 14 nt, Pseudomonas aeruginosa PA01
gcgagccgcgcagc

SEQ ID NO: 1441145 - RNA, 12 nt, Pseudomonas aeruginosa PA01
gcgagccgcgcg

SEQ ID NO: 1441146 - RNA, 14 nt, Pseudomonas aeruginosa PA01
gcgagccgcgcugc

SEQ ID NO: 1441147 - RNA, 18 nt, Pseudomonas aeruginosa PA01
gcgagccgaucaccagca

SEQ ID NO: 1441148 - RNA, 20 nt, Pseudomonas aeruginosa PA01
gcgagccgaucaccagcaau

SEQ ID NO: 1441149 - RNA, 14 nt, Pseudomonas aeruginosa PA01
gcgagccagccgug

SEQ ID NO: 1441150 - RNA, 19 nt, Pseudomonas aeruginosa PA01
gcgagccagccguggcagg

SEQ ID NO: 1441151 - RNA, 22 nt, Pseudomonas aeruginosa PA01
gcgagccagccguggcaggcgc

SEQ ID NO: 1441152 - RNA, 15 nt, Pseudomonas aeruginosa PA01
gcgagccacauccag

SEQ ID NO: 1441153 - RNA, 21 nt, Pseudomonas aeruginosa PA01
gcgagcauuccucagcgccgg

SEQ ID NO: 1441154 - RNA, 13 nt, Pseudomonas aeruginosa PA01
gcgaggguggcgc

SEQ ID NO: 1441155 - RNA, 19 nt, Pseudomonas aeruginosa PA01
gcgaggguggcgcccaugc

SEQ ID NO: 1441156 - RNA, 19 nt, Pseudomonas aeruginosa PA01
gcgagguggaugaacagcg

SEQ ID NO: 1441157 - RNA, 15 nt, Pseudomonas aeruginosa PA01
gcgaggucucgaugg

SEQ ID NO: 1441158 - RNA, 17 nt, Pseudomonas aeruginosa PA01
gcgaggucgccggggcc

SEQ ID NO: 1441159 - RNA, 16 nt, Pseudomonas aeruginosa PA01
gcgaggucugugccgu

SEQ ID NO: 1441160 - RNA, 18 nt, Pseudomonas aeruginosa PA01
gcgaggugaucgagggcc

SEQ ID NO: 1441161 - RNA, 19 nt, Pseudomonas aeruginosa PA01
gcgagguuccgcggcgacg

SEQ ID NO: 1441162 - RNA, 19 nt, Pseudomonas aeruginosa PA01
gcgagguugcccacggcca

SEQ ID NO: 1441163 - RNA, 15 nt, Pseudomonas aeruginosa PA01
gcgaguaaccaccgc

SEQ ID NO: 1441164 - RNA, 18 nt, Pseudomonas aeruginosa PA01
gcgaguaaccaccgcucu

SEQ ID NO: 1441165 - RNA, 23 nt, Pseudomonas aeruginosa PA01
gcgauacaccugcaacucggcgu

SEQ ID NO: 1441166 - RNA, 14 nt, Pseudomonas aeruginosa PA01
gcgauacaggcggu

SEQ ID NO: 1441167 - RNA, 15 nt, Pseudomonas aeruginosa PA01
gcgauacccaggccg

SEQ ID NO: 1441168 - RNA, 16 nt, Pseudomonas aeruginosa PA01
gcgauacccaggccgu

SEQ ID NO: 1441169 - RNA, 22 nt, Pseudomonas aeruginosa PA01
gcgauacccaggccgucgaggg

SEQ ID NO: 1441170 - RNA, 14 nt, Pseudomonas aeruginosa PA01
gcgauacccuggcc

SEQ ID NO: 1441171 - RNA, 24 nt, Pseudomonas aeruginosa PA01
gcgauacccuggccggccucggcg

SEQ ID NO: 1441172 - RNA, 19 nt, Pseudomonas aeruginosa PA01
gcgauacucgugggccggu

SEQ ID NO: 1441173 - RNA, 17 nt, Pseudomonas aeruginosa PA01
gcgauaucccgccgccg

SEQ ID NO: 1441174 - RNA, 13 nt, Pseudomonas aeruginosa PA01
gcgauauccgcca

SEQ ID NO: 1441175 - RNA, 17 nt, Pseudomonas aeruginosa PA01
gcgauauccgccaggcg

SEQ ID NO: 1441176 - RNA, 16 nt, Pseudomonas aeruginosa PA01
gcgauauccgccaggg

SEQ ID NO: 1441177 - RNA, 14 nt, Pseudomonas aeruginosa PA01
gcgauauucgcccu

SEQ ID NO: 1441178 - RNA, 17 nt, Pseudomonas aeruginosa PA01
gcgauaucgcaggccag

SEQ ID NO: 1441179 - RNA, 19 nt, Pseudomonas aeruginosa PA01
gcgccucggcaucgaccag

SEQ ID NO: 1441180 - RNA, 18 nt, Pseudomonas aeruginosa PA01
gcgccucggcccuggcgg

SEQ ID NO: 1441181 - RNA, 21 nt, Pseudomonas aeruginosa PA01
gcgccucggcccuggcggcga

SEQ ID NO: 1441182 - RNA, 16 nt, Pseudomonas aeruginosa PA01
gcgccucgccgcggca

SEQ ID NO: 1441183 - RNA, 13 nt, Pseudomonas aeruginosa PA01
gcgccucggcgca

SEQ ID NO: 1441184 - RNA, 14 nt, Pseudomonas aeruginosa PA01
gcgccucggcgcag

SEQ ID NO: 1441185 - RNA, 16 nt, Pseudomonas aeruginosa PA01
gcgccucgucgcgcca

SEQ ID NO: 1441186 - RNA, 22 nt, Pseudomonas aeruginosa PA01
gcgccucgucgcgccaggcgaa

SEQ ID NO: 1441187 - RNA, 20 nt, Pseudomonas aeruginosa PA01
gcgccucguggaacagcgcg

SEQ ID NO: 1441188 - RNA, 23 nt, Pseudomonas aeruginosa PA01
gcgccucguggaacagcgcgucg

SEQ ID NO: 1441189 - RNA, 23 nt, Pseudomonas aeruginosa PA01
gcgccucuucgcaggagucgacg

SEQ ID NO: 1441190 - RNA, 14 nt, Pseudomonas aeruginosa PA01
gcgccugagcagcg

SEQ ID NO: 1441191 - RNA, 16 nt, Pseudomonas aeruginosa PA01
gcgccugagcagcgcu

SEQ ID NO: 1441192 - RNA, 14 nt, Pseudomonas aeruginosa PA01
gcgccugagcuggc

SEQ ID NO: 1441193 - RNA, 21 nt, Pseudomonas aeruginosa PA01
gcgccugcaggucgaggcgcu

SEQ ID NO: 1441194 - RNA, 18 nt, Pseudomonas aeruginosa PA01
gcgccugcaacgccagca

SEQ ID NO: 1441195 - RNA, 21 nt, Pseudomonas aeruginosa PA01
gcgccugcaacgccagcaggc

SEQ ID NO: 1441196 - RNA, 16 nt, Pseudomonas aeruginosa PA01
gcgccugcaacguccu

SEQ ID NO: 1441197 - RNA, 18 nt, Pseudomonas aeruginosa PA01
gcgccuggaucagcgccu

SEQ ID NO: 1441198 - RNA, 19 nt, Pseudomonas aeruginosa PA01
gcgccuggaucagcgccuc

SEQ ID NO: 1441199 - RNA, 21 nt, Pseudomonas aeruginosa PA01
gcgccugcucuucggcggcca

SEQ ID NO: 1441200 - RNA, 21 nt, Pseudomonas aeruginosa PA01
gcgccugcugcgcgggugucg

SEQ ID NO: 1441201 - RNA, 20 nt, Pseudomonas aeruginosa PA01
gcgccugcgcuucguuggcg

SEQ ID NO: 1441202 - RNA, 19 nt, Pseudomonas aeruginosa PA01
gcgccuucugcaccuuggc

SEQ ID NO: 1441203 - RNA, 21 nt, Pseudomonas aeruginosa PA01
gcgccuucugcaccuuggcca

SEQ ID NO: 1441204 - RNA, 15 nt, Pseudomonas aeruginosa PA01
gcgccuugaccucga

SEQ ID NO: 1441205 - RNA, 19 nt, Pseudomonas aeruginosa PA01
gcgccuugaccucgacgcc

SEQ ID NO: 1441206 - RNA, 22 nt, Pseudomonas aeruginosa PA01
gcgccuugaccucgacgccgag

SEQ ID NO: 1441207 - RNA, 21 nt, Pseudomonas aeruginosa PA01
gcgccuugaaaccggcgaacc

SEQ ID NO: 1441208 - RNA, 14 nt, Pseudomonas aeruginosa PA01
gcgccuucggcgac

SEQ ID NO: 1441209 - RNA, 23 nt, Pseudomonas aeruginosa PA01
gcgccuucggcgacacagacgca

SEQ ID NO: 1441210 - RNA, 17 nt, Pseudomonas aeruginosa PA01
gcgccuucgggcgccuu

SEQ ID NO: 1441211 - RNA, 20 nt, Pseudomonas aeruginosa PA01
gcgccuucccagauaccggc

SEQ ID NO: 1441212 - RNA, 23 nt, Pseudomonas aeruginosa PA01
gcgccuucccagauaccggcguu

SEQ ID NO: 1441213 - RNA, 21 nt, Pseudomonas aeruginosa PA01
gcgccuucaccguucccagca

SEQ ID NO: 1441214 - RNA, 22 nt, Pseudomonas aeruginosa PA01
gcgccuucaccguucccagcag

SEQ ID NO: 1441215 - RNA, 18 nt, Pseudomonas aeruginosa PA01
gcgccuucagccccagca

SEQ ID NO: 1441216 - RNA, 19 nt, Pseudomonas aeruginosa PA01
gcgccuucagccccagcac

SEQ ID NO: 1441217 - RNA, 20 nt, Pseudomonas aeruginosa PA01
gcgccuucagccccagcacg

SEQ ID NO: 1441218 - RNA, 14 nt, Pseudomonas aeruginosa PA01
gcgccuucagcgcc

SEQ ID NO: 1441219 - RNA, 19 nt, Pseudomonas aeruginosa PA01
gcgccuucagcgccagcag

SEQ ID NO: 1441220 - RNA, 21 nt, Pseudomonas aeruginosa PA01
gcgccuucagcgccagcaggc

SEQ ID NO: 1441221 - RNA, 15 nt, Pseudomonas aeruginosa PA01
gcgccuucagcgccg

SEQ ID NO: 1441222 - RNA, 21 nt, Pseudomonas aeruginosa PA01
gcgccuucagcgccgccaggc

SEQ ID NO: 1441223 - RNA, 16 nt, Pseudomonas aeruginosa PA01
gcgccuucagcgccuc

SEQ ID NO: 1441224 - RNA, 18 nt, Pseudomonas aeruginosa PA01
gcgccuucagcgccucca

SEQ ID NO: 1441225 - RNA, 14 nt, Pseudomonas aeruginosa PA01
gcgccuguuccagg

SEQ ID NO: 1441226 - RNA, 15 nt, Pseudomonas aeruginosa PA01
gcgccuguuccaggg

SEQ ID NO: 1441227 - RNA, 16 nt, Pseudomonas aeruginosa PA01
gcgccuguuccagggc

SEQ ID NO: 1441228 - RNA, 18 nt, Pseudomonas aeruginosa PA01
gcgccuguuccagggccu

SEQ ID NO: 1441229 - RNA, 23 nt, Pseudomonas aeruginosa PA01
gcgccuguuccagggccugcucc

SEQ ID NO: 1441230 - RNA, 21 nt, Pseudomonas aeruginosa PA01
gcgccuguccgggaaugcuca

SEQ ID NO: 1441231 - RNA, 19 nt, Pseudomonas aeruginosa PA01
gcgccuguaccccguagcg

SEQ ID NO: 1441232 - RNA, 23 nt, Pseudomonas aeruginosa PA01
gcgccuguaccccguagcgcucg

SEQ ID NO: 1441233 - RNA, 18 nt, Pseudomonas aeruginosa PA01
gcgccuggucggcggccu

SEQ ID NO: 1441234 - RNA, 15 nt, Pseudomonas aeruginosa PA01
gcgccuggcuggcca

SEQ ID NO: 1441235 - RNA, 19 nt, Pseudomonas aeruginosa PA01
gcgccuggcuggccagcag

SEQ ID NO: 1441236 - RNA, 21 nt, Pseudomonas aeruginosa PA01
gcgccuggcuggccagcaggc

SEQ ID NO: 1441237 - RNA, 22 nt, Pseudomonas aeruginosa PA01
gcgccuggcgucgaugccgaau

SEQ ID NO: 1441238 - RNA, 14 nt, Pseudomonas aeruginosa PA01
gcgccugggccgcg

SEQ ID NO: 1441239 - RNA, 17 nt, Pseudomonas aeruginosa PA01
gcgccugggccgcgagg

SEQ ID NO: 1441240 - RNA, 16 nt, Pseudomonas aeruginosa PA01
gcgccugggccgcgcu

SEQ ID NO: 1441241 - RNA, 14 nt, Pseudomonas aeruginosa PA01
gcgccuggcccugg

SEQ ID NO: 1441242 - RNA, 21 nt, Pseudomonas aeruginosa PA01
gcgccuggcgcaacgccggca

SEQ ID NO: 1441243 - RNA, 12 nt, Pseudomonas aeruginosa PA01
gcgccuggccgu

SEQ ID NO: 1441244 - RNA, 13 nt, Pseudomonas aeruginosa PA01
gcgccuggccguc

SEQ ID NO: 1441245 - RNA, 13 nt, Pseudomonas aeruginosa PA01
gcgccuggccugg

SEQ ID NO: 1441246 - RNA, 15 nt, Pseudomonas aeruginosa PA01
gcgccuggccgcgca

SEQ ID NO: 1441247 - RNA, 16 nt, Pseudomonas aeruginosa PA01
gcgccuggccgcgcag

SEQ ID NO: 1441248 - RNA, 18 nt, Pseudomonas aeruginosa PA01
gcgccugcuucagcccgg

SEQ ID NO: 1441249 - RNA, 21 nt, Pseudomonas aeruginosa PA01
gcgccugcuucagcccggcac

SEQ ID NO: 1441250 - RNA, 22 nt, Pseudomonas aeruginosa PA01
gcgccuggagcagaaccgccag

SEQ ID NO: 1441251 - RNA, 20 nt, Pseudomonas aeruginosa PA01
gcgccuggaugaucgcgugg

SEQ ID NO: 1441252 - RNA, 20 nt, Pseudomonas aeruginosa PA01
gcgccuggauguggcuaucc

SEQ ID NO: 1441253 - RNA, 21 nt, Pseudomonas aeruginosa PA01
gcgcgaccgcggcgcucggca

SEQ ID NO: 1441254 - RNA, 14 nt, Pseudomonas aeruginosa PA01
gcgcgaccgucggc

SEQ ID NO: 1441255 - RNA, 13 nt, Pseudomonas aeruginosa PA01
gcgcgaccgcggc

SEQ ID NO: 1441256 - RNA, 15 nt, Pseudomonas aeruginosa PA01
gcgcgaccgcccgcc

SEQ ID NO: 1441257 - RNA, 17 nt, Pseudomonas aeruginosa PA01
gcgcgaccgcccgccuc

SEQ ID NO: 1441258 - RNA, 13 nt, Pseudomonas aeruginosa PA01
gcgcgaggggcgg

SEQ ID NO: 1441259 - RNA, 14 nt, Pseudomonas aeruginosa PA01
gcgcgaggggcgga

SEQ ID NO: 1441260 - RNA, 17 nt, Pseudomonas aeruginosa PA01
gcgcgaggggcggagca

SEQ ID NO: 1441261 - RNA, 19 nt, Pseudomonas aeruginosa PA01
gcgcgagggggccucggcc

SEQ ID NO: 1441262 - RNA, 21 nt, Pseudomonas aeruginosa PA01
gcgcgagggggccucggccag

SEQ ID NO: 1441263 - RNA, 12 nt, Pseudomonas aeruginosa PA01
gcgcgaggcgag

SEQ ID NO: 1441264 - RNA, 14 nt, Pseudomonas aeruginosa PA01
gcgcgaggcgagua

SEQ ID NO: 1441265 - RNA, 13 nt, Pseudomonas aeruginosa PA01
gcgcgaggcgcag

SEQ ID NO: 1441266 - RNA, 15 nt, Pseudomonas aeruginosa PA01
gcgcgaggcgcaggc

SEQ ID NO: 1441267 - RNA, 17 nt, Pseudomonas aeruginosa PA01
gcgcgaggcgcccgccg

SEQ ID NO: 1441268 - RNA, 12 nt, Pseudomonas aeruginosa PA01
gcgcgaggcgcu

SEQ ID NO: 1441269 - RNA, 14 nt, Pseudomonas aeruginosa PA01
gcgcgagugcagcg

SEQ ID NO: 1441270 - RNA, 22 nt, Pseudomonas aeruginosa PA01
gcgcgauaaaaagccccgcuuc

SEQ ID NO: 1441271 - RNA, 21 nt, Pseudomonas aeruginosa PA01
gcgcgauggaguaggcgucgu

SEQ ID NO: 1441272 - RNA, 14 nt, Pseudomonas aeruginosa PA01
gcgcgauggccggc

SEQ ID NO: 1441273 - RNA, 17 nt, Pseudomonas aeruginosa PA01
gcgcgauggccggcgga

SEQ ID NO: 1441274 - RNA, 19 nt, Pseudomonas aeruginosa PA01
gcgcgauggccggcggaga

SEQ ID NO: 1441275 - RNA, 17 nt, Pseudomonas aeruginosa PA01
gcgcgauuuugggcuca

SEQ ID NO: 1441276 - RNA, 20 nt, Pseudomonas aeruginosa PA01
gcgcgaugccccauccgacg

SEQ ID NO: 1441277 - RNA, 23 nt, Pseudomonas aeruginosa PA01
gcgcgaucucuacuaccgccagc

SEQ ID NO: 1441278 - RNA, 17 nt, Pseudomonas aeruginosa PA01
gcgcgaugcucccgagc

SEQ ID NO: 1441279 - RNA, 18 nt, Pseudomonas aeruginosa PA01
gcgcgaugcucccgagca

SEQ ID NO: 1441280 - RNA, 19 nt, Pseudomonas aeruginosa PA01
gcgcgaugcucccgagcaa

SEQ ID NO: 1441281 - RNA, 18 nt, Pseudomonas aeruginosa PA01
gcgcgauauccgccaggg

SEQ ID NO: 1441282 - RNA, 20 nt, Pseudomonas aeruginosa PA01
gcgcgauauccgccagggag

SEQ ID NO: 1441283 - RNA, 15 nt, Pseudomonas aeruginosa PA01
gcgcgauaucgcagg

SEQ ID NO: 1441284 - RNA, 16 nt, Pseudomonas aeruginosa PA01
gcgcgauaucgcaggc

SEQ ID NO: 1441285 - RNA, 23 nt, Pseudomonas aeruginosa PA01
gcgcgauaucgcaggccaggccc

SEQ ID NO: 1441286 - RNA, 18 nt, Pseudomonas aeruginosa PA01
gcgccuugcucaggucgu

SEQ ID NO: 1441287 - RNA, 17 nt, Pseudomonas aeruginosa PA01
gcgccuugcgccaggcc

SEQ ID NO: 1441288 - RNA, 18 nt, Pseudomonas aeruginosa PA01
gcgccuugcgccaggccu

SEQ ID NO: 1441289 - RNA, 18 nt, Pseudomonas aeruginosa PA01
gcgccuuuuucauuucgc

SEQ ID NO: 1441290 - RNA, 14 nt, Pseudomonas aeruginosa PA01
gcgccuuucgcuca

SEQ ID NO: 1441291 - RNA, 18 nt, Pseudomonas aeruginosa PA01
gcgccuuucgcucaggcc

SEQ ID NO: 1441292 - RNA, 19 nt, Pseudomonas aeruginosa PA01
gcgccuuucgcucaggccu

SEQ ID NO: 1441293 - RNA, 18 nt, Pseudomonas aeruginosa PA01
gcgcgaaagcgccccggg

SEQ ID NO: 1441294 - RNA, 20 nt, Pseudomonas aeruginosa PA01
gcgcgaaggcgccuuccagg

SEQ ID NO: 1441295 - RNA, 22 nt, Pseudomonas aeruginosa PA01
gcgcgaaggcgccuuccaggcg

SEQ ID NO: 1441296 - RNA, 23 nt, Pseudomonas aeruginosa PA01
gcgcgaacgcucccagccgacgu

SEQ ID NO: 1441297 - RNA, 19 nt, Pseudomonas aeruginosa PA01
gcgcgacaucggcgauggc

SEQ ID NO: 1441298 - RNA, 19 nt, Pseudomonas aeruginosa PA01
gcgccgcauuggccaggcc

SEQ ID NO: 1441299 - RNA, 21 nt, Pseudomonas aeruginosa PA01
gcgccgccagcaggucggccu

SEQ ID NO: 1441300 - RNA, 22 nt, Pseudomonas aeruginosa PA01
gcgccgccagcaggucggccug

SEQ ID NO: 1441301 - RNA, 23 nt, Pseudomonas aeruginosa PA01
gcgccgccagcaggucggccugc

SEQ ID NO: 1441302 - RNA, 19 nt, Pseudomonas aeruginosa PA01
gcgccgccacgugcacgcc

SEQ ID NO: 1441303 - RNA, 12 nt, Pseudomonas aeruginosa PA01
gcgccgccaggc

SEQ ID NO: 1441304 - RNA, 13 nt, Pseudomonas aeruginosa PA01
gcgccgccaggca

SEQ ID NO: 1441305 - RNA, 13 nt, Pseudomonas aeruginosa PA01
gcgccgccaggcc

SEQ ID NO: 1441306 - RNA, 17 nt, Pseudomonas aeruginosa PA01
gcgccgccaggcccugg

SEQ ID NO: 1441307 - RNA, 14 nt, Pseudomonas aeruginosa PA01
gcgccgcggugucg

SEQ ID NO: 1441308 - RNA, 19 nt, Pseudomonas aeruginosa PA01
gcgccgcgggucaccagcg

SEQ ID NO: 1441309 - RNA, 22 nt, Pseudomonas aeruginosa PA01
gcgccgcgggucaccagcgccg

SEQ ID NO: 1441310 - RNA, 18 nt, Pseudomonas aeruginosa PA01
gcgccgcggucgaugucg

SEQ ID NO: 1441311 - RNA, 18 nt, Pseudomonas aeruginosa PA01
gcgccgcgucgccgccag

SEQ ID NO: 1441312 - RNA, 15 nt, Pseudomonas aeruginosa PA01
gcgccgcuaugggca

SEQ ID NO: 1441313 - RNA, 18 nt, Pseudomonas aeruginosa PA01
gcgccgcuaugggcaccg

SEQ ID NO: 1441314 - RNA, 19 nt, Pseudomonas aeruginosa PA01
gcgccgcuaugggcaccgc

SEQ ID NO: 1441315 - RNA, 21 nt, Pseudomonas aeruginosa PA01
gcgccgcuaugggcaccgcgc

SEQ ID NO: 1441316 - RNA, 17 nt, Pseudomonas aeruginosa PA01
gcgccgcuagggcgccc

SEQ ID NO: 1441317 - RNA, 16 nt, Pseudomonas aeruginosa PA01
gcgccgcucggcgagc

SEQ ID NO: 1441318 - RNA, 16 nt, Pseudomonas aeruginosa PA01
gcgccgcucgaugccc

SEQ ID NO: 1441319 - RNA, 20 nt, Pseudomonas aeruginosa PA01
gcgccgcucgaugcccgcca

SEQ ID NO: 1441320 - RNA, 21 nt, Pseudomonas aeruginosa PA01
gcgccgcucgaugcccgccag

SEQ ID NO: 1441321 - RNA, 23 nt, Pseudomonas aeruginosa PA01
gcgccgcucgaugcccgccagca

SEQ ID NO: 1441322 - RNA, 18 nt, Pseudomonas aeruginosa PA01
gcgccgcuccuggcaggc

SEQ ID NO: 1441323 - RNA, 19 nt, Pseudomonas aeruginosa PA01
gcgccgcuccuggcaggcu

SEQ ID NO: 1441324 - RNA, 18 nt, Pseudomonas aeruginosa PA01
gcgccgcugcggcugcag

SEQ ID NO: 1441325 - RNA, 23 nt, Pseudomonas aeruginosa PA01
gcgccgcugucuaucugcgccga

SEQ ID NO: 1441326 - RNA, 14 nt, Pseudomonas aeruginosa PA01
gcgccgcuggcgug

SEQ ID NO: 1441327 - RNA, 17 nt, Pseudomonas aeruginosa PA01
gcgccgcuuugcagggu

SEQ ID NO: 1441328 - RNA, 21 nt, Pseudomonas aeruginosa PA01
gcgccggaaguggcagcgccg

SEQ ID NO: 1441329 - RNA, 13 nt, Pseudomonas aeruginosa PA01
gcgccggccagag

SEQ ID NO: 1441330 - RNA, 15 nt, Pseudomonas aeruginosa PA01
gcgccggccagagcu

SEQ ID NO: 1441331 - RNA, 15 nt, Pseudomonas aeruginosa PA01
gcgccggacaggcca

SEQ ID NO: 1441332 - RNA, 19 nt, Pseudomonas aeruginosa PA01
gcgccggacaggccacccg

SEQ ID NO: 1441333 - RNA, 22 nt, Pseudomonas aeruginosa PA01
gcgccggacaggccacccgccu

SEQ ID NO: 1441334 - RNA, 15 nt, Pseudomonas aeruginosa PA01
gcgccggcaucgcca

SEQ ID NO: 1441335 - RNA, 21 nt, Pseudomonas aeruginosa PA01
gcgccggcaucgccauggcgc

SEQ ID NO: 1441336 - RNA, 18 nt, Pseudomonas aeruginosa PA01
gcgccggcagcucggccg

SEQ ID NO: 1441337 - RNA, 23 nt, Pseudomonas aeruginosa PA01
gcgccggcaggaacgcccgcggc

SEQ ID NO: 1441338 - RNA, 15 nt, Pseudomonas aeruginosa PA01
gcgccggcaggccuu

SEQ ID NO: 1441339 - RNA, 23 nt, Pseudomonas aeruginosa PA01
gcgccggcaggccuucggcgccg

SEQ ID NO: 1441340 - RNA, 13 nt, Pseudomonas aeruginosa PA01
gcgccggcccagc

SEQ ID NO: 1441341 - RNA, 17 nt, Pseudomonas aeruginosa PA01
gcgccggcccagcaggc

SEQ ID NO: 1441342 - RNA, 21 nt, Pseudomonas aeruginosa PA01
gcgccggcccagcaggccggc

SEQ ID NO: 1441343 - RNA, 17 nt, Pseudomonas aeruginosa PA01
gcgccggcgaucgccag

SEQ ID NO: 1441344 - RNA, 19 nt, Pseudomonas aeruginosa PA01
gcgccggcgaucgccaggc

SEQ ID NO: 1441345 - RNA, 12 nt, Pseudomonas aeruginosa PA01
gcgccggccguc

SEQ ID NO: 1441346 - RNA, 14 nt, Pseudomonas aeruginosa PA01
gcgccggccguccc

SEQ ID NO: 1441347 - RNA, 16 nt, Pseudomonas aeruginosa PA01
gcgccggcucccugca

SEQ ID NO: 1441348 - RNA, 14 nt, Pseudomonas aeruginosa PA01
gcgccggcugccgc

SEQ ID NO: 1441349 - RNA, 17 nt, Pseudomonas aeruginosa PA01
gcgccggcugccgcgcg

SEQ ID NO: 1441350 - RNA, 17 nt, Pseudomonas aeruginosa PA01
gcgccggcucgcccagc

SEQ ID NO: 1441351 - RNA, 19 nt, Pseudomonas aeruginosa PA01
gcgccggcucgcccagcag

SEQ ID NO: 1441352 - RNA, 17 nt, Pseudomonas aeruginosa PA01
gcgccgguccuuguccg

SEQ ID NO: 1441353 - RNA, 23 nt, Pseudomonas aeruginosa PA01
gcgccgguaguucgcugaccgcg

SEQ ID NO: 1441354 - RNA, 16 nt, Pseudomonas aeruginosa PA01
gcgccgguagcggcgc

SEQ ID NO: 1441355 - RNA, 16 nt, Pseudomonas aeruginosa PA01
gcgccgguaauaggcu

SEQ ID NO: 1441356 - RNA, 22 nt, Pseudomonas aeruginosa PA01
gcgccgguaaugacgaucucga

SEQ ID NO: 1441357 - RNA, 15 nt, Pseudomonas aeruginosa PA01
gcgccgggaugcuca

SEQ ID NO: 1441358 - RNA, 21 nt, Pseudomonas aeruginosa PA01
gcgccgggaagcaccgacucg

SEQ ID NO: 1441359 - RNA, 18 nt, Pseudomonas aeruginosa PA01
gcgccgggcauucgcagc

SEQ ID NO: 1441360 - RNA, 19 nt, Pseudomonas aeruginosa PA01
gcgccgggcauucgcagcg

SEQ ID NO: 1441361 - RNA, 12 nt, Pseudomonas aeruginosa PA01
gcgccgggccgc

SEQ ID NO: 1441362 - RNA, 17 nt, Pseudomonas aeruginosa PA01
gcgccggguugcgccgc

SEQ ID NO: 1441363 - RNA, 18 nt, Pseudomonas aeruginosa PA01
gcgccggguugcgccgca

SEQ ID NO: 1441364 - RNA, 21 nt, Pseudomonas aeruginosa PA01
gcgccgucgaucagguaggcc

SEQ ID NO: 1441365 - RNA, 16 nt, Pseudomonas aeruginosa PA01
gcgccgucgcuggcga

SEQ ID NO: 1441366 - RNA, 19 nt, Pseudomonas aeruginosa PA01
gcgccguggaucgcccggc

SEQ ID NO: 1441367 - RNA, 20 nt, Pseudomonas aeruginosa PA01
gcgccguggaucgcccggcu

SEQ ID NO: 1441368 - RNA, 14 nt, Pseudomonas aeruginosa PA01
gcgccguggcacca

SEQ ID NO: 1441369 - RNA, 15 nt, Pseudomonas aeruginosa PA01
gcgccguuacgccgg

SEQ ID NO: 1441370 - RNA, 16 nt, Pseudomonas aeruginosa PA01
gcgccguuacgccggg

SEQ ID NO: 1441371 - RNA, 18 nt, Pseudomonas aeruginosa PA01
gcgccguucacgccuggc

SEQ ID NO: 1441372 - RNA, 20 nt, Pseudomonas aeruginosa PA01
gcgccguucacgccuggcgg

SEQ ID NO: 1441373 - RNA, 21 nt, Pseudomonas aeruginosa PA01
gcgccguucacgccuggcggc

SEQ ID NO: 1441374 - RNA, 22 nt, Pseudomonas aeruginosa PA01
gcgccguucacgccuggcggcu

SEQ ID NO: 1441375 - RNA, 15 nt, Pseudomonas aeruginosa PA01
gcgccguuucgacga

SEQ ID NO: 1441376 - RNA, 18 nt, Pseudomonas aeruginosa PA01
gcgccguuucgacgaugc

SEQ ID NO: 1441377 - RNA, 14 nt, Pseudomonas aeruginosa PA01
gcgccguugccggu

SEQ ID NO: 1441378 - RNA, 15 nt, Pseudomonas aeruginosa PA01
gcgccguugcggcag

SEQ ID NO: 1441379 - RNA, 16 nt, Pseudomonas aeruginosa PA01
gcgccguugcggcagc

SEQ ID NO: 1441380 - RNA, 20 nt, Pseudomonas aeruginosa PA01
gcgccguuguucaggcgcgc

SEQ ID NO: 1441381 - RNA, 14 nt, Pseudomonas aeruginosa PA01
gcgccguugccgau

SEQ ID NO: 1441382 - RNA, 17 nt, Pseudomonas aeruginosa PA01
gcgccguugccgaugcc

SEQ ID NO: 1441383 - RNA, 12 nt, Pseudomonas aeruginosa PA01
gcgccuccagca

SEQ ID NO: 1441384 - RNA, 15 nt, Pseudomonas aeruginosa PA01
gcgccuccagcgggc

SEQ ID NO: 1441385 - RNA, 23 nt, Pseudomonas aeruginosa PA01
gcgccuccagcgggccuucgcca

SEQ ID NO: 1441386 - RNA, 14 nt, Pseudomonas aeruginosa PA01
gcgccuccagcguc

SEQ ID NO: 1441387 - RNA, 15 nt, Pseudomonas aeruginosa PA01
gcgccuccaggcgcg

SEQ ID NO: 1441388 - RNA, 16 nt, Pseudomonas aeruginosa PA01
gcgccuccaggcgcgc

SEQ ID NO: 1441389 - RNA, 19 nt, Pseudomonas aeruginosa PA01
gcgccuagacccugggcca

SEQ ID NO: 1441390 - RNA, 20 nt, Pseudomonas aeruginosa PA01
gcgccuagacccugggccaa

SEQ ID NO: 1441391 - RNA, 17 nt, Pseudomonas aeruginosa PA01
gcgccucacggucgcag

SEQ ID NO: 1441392 - RNA, 22 nt, Pseudomonas aeruginosa PA01
gcgccucacggucgcaggggcu

SEQ ID NO: 1441393 - RNA, 15 nt, Pseudomonas aeruginosa PA01
gcgccucagcggccu

SEQ ID NO: 1441394 - RNA, 14 nt, Pseudomonas aeruginosa PA01
gcgccucagcggcu

SEQ ID NO: 1441395 - RNA, 18 nt, Pseudomonas aeruginosa PA01
gcgccucagcggcuggcg

SEQ ID NO: 1441396 - RNA, 22 nt, Pseudomonas aeruginosa PA01
gcgccucagcggcuggcgaugc

SEQ ID NO: 1441397 - RNA, 13 nt, Pseudomonas aeruginosa PA01
gcgccucccgcug

SEQ ID NO: 1441398 - RNA, 13 nt, Pseudomonas aeruginosa PA01
gcgccuccagcac

SEQ ID NO: 1441399 - RNA, 16 nt, Pseudomonas aeruginosa PA01
gcgccuccggcagcgu

SEQ ID NO: 1441400 - RNA, 16 nt, Pseudomonas aeruginosa PA01
gcgccuccucggcggc

SEQ ID NO: 1441401 - RNA, 18 nt, Pseudomonas aeruginosa PA01
gcgccuccucggcggccu

SEQ ID NO: 1441402 - RNA, 19 nt, Pseudomonas aeruginosa PA01
gcgccuccucuaccaggcg

SEQ ID NO: 1441403 - RNA, 22 nt, Pseudomonas aeruginosa PA01
gcgccucgaaggccucggucag

SEQ ID NO: 1441404 - RNA, 16 nt, Pseudomonas aeruginosa PA01
gcgccucgaccucggc

SEQ ID NO: 1441405 - RNA, 14 nt, Pseudomonas aeruginosa PA01
gcgccucgaccugg

SEQ ID NO: 1441406 - RNA, 15 nt, Pseudomonas aeruginosa PA01
gcgccucgaccuggc

SEQ ID NO: 1441407 - RNA, 16 nt, Pseudomonas aeruginosa PA01
gcgccucgaccuggcc

SEQ ID NO: 1441408 - RNA, 18 nt, Pseudomonas aeruginosa PA01
gcgccucgaccuggccac

SEQ ID NO: 1441409 - RNA, 22 nt, Pseudomonas aeruginosa PA01
gcgccucgaccuggccacgccc

SEQ ID NO: 1441410 - RNA, 21 nt, Pseudomonas aeruginosa PA01
gcgccucgcaaaggucggcga

SEQ ID NO: 1441411 - RNA, 22 nt, Pseudomonas aeruginosa PA01
gcgccucgcaaaggucggcgaa

SEQ ID NO: 1441412 - RNA, 21 nt, Pseudomonas aeruginosa PA01
gcgccucgccuucguccaugc

SEQ ID NO: 1441413 - RNA, 21 nt, Pseudomonas aeruginosa PA01
gcgccucgcgcaacgccgacg

SEQ ID NO: 1441414 - RNA, 22 nt, Pseudomonas aeruginosa PA01
gcgccucgcgcaacgccgacgg

SEQ ID NO: 1441415 - RNA, 12 nt, Pseudomonas aeruginosa PA01
gcgccucgcggc

SEQ ID NO: 1441416 - RNA, 22 nt, Pseudomonas aeruginosa PA01
gcgccucgcgggucugcgccuc

SEQ ID NO: 1441417 - RNA, 14 nt, Pseudomonas aeruginosa PA01
gcgcaucaggucgg

SEQ ID NO: 1441418 - RNA, 22 nt, Pseudomonas aeruginosa PA01
gcgcaucaggucggucuggcgg

SEQ ID NO: 1441419 - RNA, 13 nt, Pseudomonas aeruginosa PA01
gcgcaucagcgcc

SEQ ID NO: 1441420 - RNA, 18 nt, Pseudomonas aeruginosa PA01
gcgcaucaccccgcaacc

SEQ ID NO: 1441421 - RNA, 15 nt, Pseudomonas aeruginosa PA01
gcgcaucagcgccgg

SEQ ID NO: 1441422 - RNA, 17 nt, Pseudomonas aeruginosa PA01
gcgcauacggaugcuga

SEQ ID NO: 1441423 - RNA, 15 nt, Pseudomonas aeruginosa PA01
gcgcauagcaggccu

SEQ ID NO: 1441424 - RNA, 13 nt, Pseudomonas aeruginosa PA01
gcgcauagcggcc

SEQ ID NO: 1441425 - RNA, 21 nt, Pseudomonas aeruginosa PA01
gcgcaguagucgaccggaauc

SEQ ID NO: 1441426 - RNA, 17 nt, Pseudomonas aeruginosa PA01
gcgcagucccgcgcggc

SEQ ID NO: 1441427 - RNA, 22 nt, Pseudomonas aeruginosa PA01
gcgcaguccgguagcgcgccug

SEQ ID NO: 1441428 - RNA, 15 nt, Pseudomonas aeruginosa PA01
gcgcaggucggccuc

SEQ ID NO: 1441429 - RNA, 22 nt, Pseudomonas aeruginosa PA01
gcgcacuccgggcagaccagca

SEQ ID NO: 1441430 - RNA, 16 nt, Pseudomonas aeruginosa PA01
gcgcaggugcuuggca

SEQ ID NO: 1441431 - RNA, 23 nt, Pseudomonas aeruginosa PA01
gcgcaggugcuuggcaccgcgca

SEQ ID NO: 1441432 - RNA, 18 nt, Pseudomonas aeruginosa PA01
gcgcaggugcuugucacg

SEQ ID NO: 1441433 - RNA, 14 nt, Pseudomonas aeruginosa PA01
gcgcaggugcaccg

SEQ ID NO: 1441434 - RNA, 18 nt, Pseudomonas aeruginosa PA01
gcgcaggugcaccgcgcu

SEQ ID NO: 1441435 - RNA, 18 nt, Pseudomonas aeruginosa PA01
gcgcagguugagggccgc

SEQ ID NO: 1441436 - RNA, 15 nt, Pseudomonas aeruginosa PA01
gcgcacuuccucggc

SEQ ID NO: 1441437 - RNA, 20 nt, Pseudomonas aeruginosa PA01
gcgcagguucaucgccgcca

SEQ ID NO: 1441438 - RNA, 17 nt, Pseudomonas aeruginosa PA01
gcgcaguacccggccgc

SEQ ID NO: 1441439 - RNA, 19 nt, Pseudomonas aeruginosa PA01
gcgcaguacgaucagccag

SEQ ID NO: 1441440 - RNA, 16 nt, Pseudomonas aeruginosa PA01
gcgcaugcgcagcgcg

SEQ ID NO: 1441441 - RNA, 19 nt, Pseudomonas aeruginosa PA01
gcgcaugcgcagcgcguug

SEQ ID NO: 1441442 - RNA, 14 nt, Pseudomonas aeruginosa PA01
gcgcaugcgccggc

SEQ ID NO: 1441443 - RNA, 15 nt, Pseudomonas aeruginosa PA01
gcgcaugcgccggcu

SEQ ID NO: 1441444 - RNA, 15 nt, Pseudomonas aeruginosa PA01
gcgcaugcagggcgu

SEQ ID NO: 1441445 - RNA, 13 nt, Pseudomonas aeruginosa PA01
gcgcaugcccagg

SEQ ID NO: 1441446 - RNA, 17 nt, Pseudomonas aeruginosa PA01
gcgcaugcccagggcca

SEQ ID NO: 1441447 - RNA, 21 nt, Pseudomonas aeruginosa PA01
gcgcaugcccagggccagcag

SEQ ID NO: 1441448 - RNA, 18 nt, Pseudomonas aeruginosa PA01
gcgcaugaggccuggucc

SEQ ID NO: 1441449 - RNA, 17 nt, Pseudomonas aeruginosa PA01
gcgcaugaggcuggcca

SEQ ID NO: 1441450 - RNA, 18 nt, Pseudomonas aeruginosa PA01
gcgcaugaggcuggccag

SEQ ID NO: 1441451 - RNA, 13 nt, Pseudomonas aeruginosa PA01
gcgcaugaucgcc

SEQ ID NO: 1441452 - RNA, 14 nt, Pseudomonas aeruginosa PA01
gcgccaacucggcc

SEQ ID NO: 1441453 - RNA, 15 nt, Pseudomonas aeruginosa PA01
gcgccaacuggcgca

SEQ ID NO: 1441454 - RNA, 21 nt, Pseudomonas aeruginosa PA01
gcgccaacuggcgcaacugca

SEQ ID NO: 1441455 - RNA, 13 nt, Pseudomonas aeruginosa PA01
gcgccaagguucc

SEQ ID NO: 1441456 - RNA, 19 nt, Pseudomonas aeruginosa PA01
gcgccaaggccgccaggcc

SEQ ID NO: 1441457 - RNA, 22 nt, Pseudomonas aeruginosa PA01
gcgccaaccaugguuuccgccg

SEQ ID NO: 1441458 - RNA, 15 nt, Pseudomonas aeruginosa PA01
gcgccaaccgggcag

SEQ ID NO: 1441459 - RNA, 17 nt, Pseudomonas aeruginosa PA01
gcgccaaccgggcagca

SEQ ID NO: 1441460 - RNA, 20 nt, Pseudomonas aeruginosa PA01
gcgccaaccgggcagcagcc

SEQ ID NO: 1441461 - RNA, 20 nt, Pseudomonas aeruginosa PA01
gcgcauggcgaccugguggc

SEQ ID NO: 1441462 - RNA, 22 nt, Pseudomonas aeruginosa PA01
gcgcauggcgaccugguggcgc

SEQ ID NO: 1441463 - RNA, 13 nt, Pseudomonas aeruginosa PA01
gcgcaugccguug

SEQ ID NO: 1441464 - RNA, 20 nt, Pseudomonas aeruginosa PA01
gcgcaugccguuggccgagc

SEQ ID NO: 1441465 - RNA, 17 nt, Pseudomonas aeruginosa PA01
gcgcauggacaggucga

SEQ ID NO: 1441466 - RNA, 22 nt, Pseudomonas aeruginosa PA01
gcgccagccuacugggcguggc

SEQ ID NO: 1441467 - RNA, 13 nt, Pseudomonas aeruginosa PA01
gcgccagcgagac

SEQ ID NO: 1441468 - RNA, 22 nt, Pseudomonas aeruginosa PA01
gcgccagcgagacgggcgaggc

SEQ ID NO: 1441469 - RNA, 12 nt, Pseudomonas aeruginosa PA01
gcgccagccgac

SEQ ID NO: 1441470 - RNA, 18 nt, Pseudomonas aeruginosa PA01
gcgccagccgccaucacc

SEQ ID NO: 1441471 - RNA, 16 nt, Pseudomonas aeruginosa PA01
gcgccagcgccgccag

SEQ ID NO: 1441472 - RNA, 12 nt, Pseudomonas aeruginosa PA01
gcgccagcgccg

SEQ ID NO: 1441473 - RNA, 11 nt, Pseudomonas aeruginosa PA01
gcgccagcgcc

SEQ ID NO: 1441474 - RNA, 16 nt, Pseudomonas aeruginosa PA01
gcgccagcgccccacc

SEQ ID NO: 1441475 - RNA, 21 nt, Pseudomonas aeruginosa PA01
gcgccagcgccacggcgaucg

SEQ ID NO: 1441476 - RNA, 13 nt, Pseudomonas aeruginosa PA01
gcgccagcgccac

SEQ ID NO: 1441477 - RNA, 24 nt, Pseudomonas aeruginosa PA01
gcgccaggaccauuugcgccucgu

SEQ ID NO: 1441478 - RNA, 23 nt, Pseudomonas aeruginosa PA01
gcgccaggacucgccaucggccu

SEQ ID NO: 1441479 - RNA, 18 nt, Pseudomonas aeruginosa PA01
gcgccaggagcagggcgc

SEQ ID NO: 1441480 - RNA, 21 nt, Pseudomonas aeruginosa PA01
gcgccaggagcagggcgccga

SEQ ID NO: 1441481 - RNA, 23 nt, Pseudomonas aeruginosa PA01
gcgccaggaacgccucugcgcug

SEQ ID NO: 1441482 - RNA, 23 nt, Pseudomonas aeruginosa PA01
gcgccagcucggacaagggccag

SEQ ID NO: 1441483 - RNA, 18 nt, Pseudomonas aeruginosa PA01
gcgccagcuccagcgccc

SEQ ID NO: 1441484 - RNA, 12 nt, Pseudomonas aeruginosa PA01
gcgccagcggcc

SEQ ID NO: 1441485 - RNA, 20 nt, Pseudomonas aeruginosa PA01
gcgccagcgguucaggucga

SEQ ID NO: 1441486 - RNA, 21 nt, Pseudomonas aeruginosa PA01
gcgccagcgguucaggucgag

SEQ ID NO: 1441487 - RNA, 14 nt, Pseudomonas aeruginosa PA01
gcgccagcggcagc

SEQ ID NO: 1441488 - RNA, 16 nt, Pseudomonas aeruginosa PA01
gcgccagcggcagcgg

SEQ ID NO: 1441489 - RNA, 15 nt, Pseudomonas aeruginosa PA01
gcgccagcaacgccu

SEQ ID NO: 1441490 - RNA, 18 nt, Pseudomonas aeruginosa PA01
gcgccagcaccagcagga

SEQ ID NO: 1441491 - RNA, 19 nt, Pseudomonas aeruginosa PA01
gcgccagcaccguggucag

SEQ ID NO: 1441492 - RNA, 16 nt, Pseudomonas aeruginosa PA01
gcgccagcacggcgca

SEQ ID NO: 1441493 - RNA, 17 nt, Pseudomonas aeruginosa PA01
gcgccagcacggcgcag

SEQ ID NO: 1441494 - RNA, 15 nt, Pseudomonas aeruginosa PA01
gcgccagcaggcgca

SEQ ID NO: 1441495 - RNA, 19 nt, Pseudomonas aeruginosa PA01
gcgccagcaggcgcagcag

SEQ ID NO: 1441496 - RNA, 12 nt, Pseudomonas aeruginosa PA01
gcgccagcaucg

SEQ ID NO: 1441497 - RNA, 14 nt, Pseudomonas aeruginosa PA01
gcgccagcaucgca

SEQ ID NO: 1441498 - RNA, 19 nt, Pseudomonas aeruginosa PA01
gcgccagcagguacagcag

SEQ ID NO: 1441499 - RNA, 15 nt, Pseudomonas aeruginosa PA01
gcgccagcaggucgc

SEQ ID NO: 1441500 - RNA, 16 nt, Pseudomonas aeruginosa PA01
gcgccagcaggucgcg

SEQ ID NO: 1441501 - RNA, 20 nt, Pseudomonas aeruginosa PA01
gcgccagcaggucgcgcugg

SEQ ID NO: 1441502 - RNA, 15 nt, Pseudomonas aeruginosa PA01
gcgccagccagcccg

SEQ ID NO: 1441503 - RNA, 16 nt, Pseudomonas aeruginosa PA01
gcgccagccagcccgg

SEQ ID NO: 1441504 - RNA, 17 nt, Pseudomonas aeruginosa PA01
gcgccagccagcccggc

SEQ ID NO: 1441505 - RNA, 12 nt, Pseudomonas aeruginosa PA01
gcgccagcccca

SEQ ID NO: 1441506 - RNA, 15 nt, Pseudomonas aeruginosa PA01
gcgccagccccaggc

SEQ ID NO: 1441507 - RNA, 17 nt, Pseudomonas aeruginosa PA01
gcgccagccccaggcgc

SEQ ID NO: 1441508 - RNA, 19 nt, Pseudomonas aeruginosa PA01
gcgccagccccaggcgcgg

SEQ ID NO: 1441509 - RNA, 20 nt, Pseudomonas aeruginosa PA01
gcgccagccccaggcgcggc

SEQ ID NO: 1441510 - RNA, 21 nt, Pseudomonas aeruginosa PA01
gcgccagccccaggcgcggcg

SEQ ID NO: 1441511 - RNA, 13 nt, Pseudomonas aeruginosa PA01
gcgccagccacuc

SEQ ID NO: 1441512 - RNA, 21 nt, Pseudomonas aeruginosa PA01
gcgccagccacucccggcccu

SEQ ID NO: 1441513 - RNA, 14 nt, Pseudomonas aeruginosa PA01
gcgccagccagggu

SEQ ID NO: 1441514 - RNA, 22 nt, Pseudomonas aeruginosa PA01
gcgccacgcaggaacagcuccu

SEQ ID NO: 1441515 - RNA, 18 nt, Pseudomonas aeruginosa PA01
gcgccacggcgaucgccg

SEQ ID NO: 1441516 - RNA, 17 nt, Pseudomonas aeruginosa PA01
gcgccacggaaggccac

SEQ ID NO: 1441517 - RNA, 23 nt, Pseudomonas aeruginosa PA01
gcgccacggaugcagucccgcca

SEQ ID NO: 1441518 - RNA, 21 nt, Pseudomonas aeruginosa PA01
gcgccacgcugaucaucagca

SEQ ID NO: 1441519 - RNA, 21 nt, Pseudomonas aeruginosa PA01
gcgccauguuccacaugcgcu

SEQ ID NO: 1441520 - RNA, 21 nt, Pseudomonas aeruginosa PA01
gcgcccacuccuccgccugca

SEQ ID NO: 1441521 - RNA, 18 nt, Pseudomonas aeruginosa PA01
gcgcccagcaccacagca

SEQ ID NO: 1441522 - RNA, 15 nt, Pseudomonas aeruginosa PA01
gcgcccaugccgccc

SEQ ID NO: 1441523 - RNA, 21 nt, Pseudomonas aeruginosa PA01
gcgcccaugccgcccggccgc

SEQ ID NO: 1441524 - RNA, 20 nt, Pseudomonas aeruginosa PA01
gcgcccccacgacgcacuca

SEQ ID NO: 1441525 - RNA, 14 nt, Pseudomonas aeruginosa PA01
gcgccccaggugca

SEQ ID NO: 1441526 - RNA, 17 nt, Pseudomonas aeruginosa PA01
gcgccccaggugcagcg

SEQ ID NO: 1441527 - RNA, 15 nt, Pseudomonas aeruginosa PA01
gcgccccacggcgcg

SEQ ID NO: 1441528 - RNA, 22 nt, Pseudomonas aeruginosa PA01
gcgccccagaucgccagcgcca

SEQ ID NO: 1441529 - RNA, 23 nt, Pseudomonas aeruginosa PA01
gcgccccagaucgccagcgccag

SEQ ID NO: 1441530 - RNA, 12 nt, Pseudomonas aeruginosa PA01
gcgccccagcac

SEQ ID NO: 1441531 - RNA, 16 nt, Pseudomonas aeruginosa PA01
gcgccccagcgccugg

SEQ ID NO: 1441532 - RNA, 22 nt, Pseudomonas aeruginosa PA01
gcgccccagcgccugggccgcg

SEQ ID NO: 1441533 - RNA, 19 nt, Pseudomonas aeruginosa PA01
gcgccccagcggcaggcac

SEQ ID NO: 1441534 - RNA, 22 nt, Pseudomonas aeruginosa PA01
gcgccccagcucagcaggucgc

SEQ ID NO: 1441535 - RNA, 14 nt, Pseudomonas aeruginosa PA01
gcgccccaggcgcc

SEQ ID NO: 1441536 - RNA, 19 nt, Pseudomonas aeruginosa PA01
gcgccccaggcgcccaggc

SEQ ID NO: 1441537 - RNA, 21 nt, Pseudomonas aeruginosa PA01
gcgccccaggcgcccaggcag

SEQ ID NO: 1441538 - RNA, 19 nt, Pseudomonas aeruginosa PA01
gcgccccaggcgggcacgu

SEQ ID NO: 1441539 - RNA, 15 nt, Pseudomonas aeruginosa PA01
gcgcccccagcgccc

SEQ ID NO: 1441540 - RNA, 13 nt, Pseudomonas aeruginosa PA01
gcgcccgccggcc

SEQ ID NO: 1441541 - RNA, 18 nt, Pseudomonas aeruginosa PA01
gcgcccccaucugcacgu

SEQ ID NO: 1441542 - RNA, 22 nt, Pseudomonas aeruginosa PA01
gcgcccgccuuguucgccagca

SEQ ID NO: 1441543 - RNA, 12 nt, Pseudomonas aeruginosa PA01
gcgccaggccgc

SEQ ID NO: 1441544 - RNA, 14 nt, Pseudomonas aeruginosa PA01
gcgccaggccgccg

SEQ ID NO: 1441545 - RNA, 15 nt, Pseudomonas aeruginosa PA01
gcgccaggccgccga

SEQ ID NO: 1441546 - RNA, 12 nt, Pseudomonas aeruginosa PA01
gcgccaggcccg

SEQ ID NO: 1441547 - RNA, 14 nt, Pseudomonas aeruginosa PA01
gcgccaggcccggc

SEQ ID NO: 1441548 - RNA, 21 nt, Pseudomonas aeruginosa PA01
gcgccaggcccucggcgacca

SEQ ID NO: 1441549 - RNA, 16 nt, Pseudomonas aeruginosa PA01
gcgccaggccggcgag

SEQ ID NO: 1441550 - RNA, 13 nt, Pseudomonas aeruginosa PA01
gcgccaggccggc

SEQ ID NO: 1441551 - RNA, 19 nt, Pseudomonas aeruginosa PA01
gcgccaggccggagccgcg

SEQ ID NO: 1441552 - RNA, 20 nt, Pseudomonas aeruginosa PA01
gcgccaggccggagccgcgu

SEQ ID NO: 1441553 - RNA, 13 nt, Pseudomonas aeruginosa PA01
gcgccaggcgcgg

SEQ ID NO: 1441554 - RNA, 14 nt, Pseudomonas aeruginosa PA01
gcgccaggcgcggu

SEQ ID NO: 1441555 - RNA, 23 nt, Pseudomonas aeruginosa PA01
gcgccaggcgcgguugccgcugc

SEQ ID NO: 1441556 - RNA, 14 nt, Pseudomonas aeruginosa PA01
gcgccaggcgcaag

SEQ ID NO: 1441557 - RNA, 15 nt, Pseudomonas aeruginosa PA01
gcgccaggccucaga

SEQ ID NO: 1441558 - RNA, 13 nt, Pseudomonas aeruginosa PA01
gcgccagggccgg

SEQ ID NO: 1441559 - RNA, 16 nt, Pseudomonas aeruginosa PA01
gcgccagggccggguc

SEQ ID NO: 1441560 - RNA, 21 nt, Pseudomonas aeruginosa PA01
gcgccaggcuuuccgccgagc

SEQ ID NO: 1441561 - RNA, 14 nt, Pseudomonas aeruginosa PA01
gcgccagggacgcg

SEQ ID NO: 1441562 - RNA, 17 nt, Pseudomonas aeruginosa PA01
gcgccagggacgcgcag

SEQ ID NO: 1441563 - RNA, 12 nt, Pseudomonas aeruginosa PA01
gcgccagggcau

SEQ ID NO: 1441564 - RNA, 20 nt, Pseudomonas aeruginosa PA01
gcgccagggcauguuccucc

SEQ ID NO: 1441565 - RNA, 17 nt, Pseudomonas aeruginosa PA01
gcgccaggcugaccgcg

SEQ ID NO: 1441566 - RNA, 17 nt, Pseudomonas aeruginosa PA01
gcgccaugcucuucagg

SEQ ID NO: 1441567 - RNA, 20 nt, Pseudomonas aeruginosa PA01
gcgccaugcucuucaggcug

SEQ ID NO: 1441568 - RNA, 12 nt, Pseudomonas aeruginosa PA01
gcgccaugggga

SEQ ID NO: 1441569 - RNA, 18 nt, Pseudomonas aeruginosa PA01
gcgccauggggaucaccg

SEQ ID NO: 1441570 - RNA, 12 nt, Pseudomonas aeruginosa PA01
gcgccauggccg

SEQ ID NO: 1441571 - RNA, 14 nt, Pseudomonas aeruginosa PA01
gcgccaugccggcg

SEQ ID NO: 1441572 - RNA, 16 nt, Pseudomonas aeruginosa PA01
gcgccaugccggcgcc

SEQ ID NO: 1441573 - RNA, 20 nt, Pseudomonas aeruginosa PA01
gcgccaugccguucaggccg

SEQ ID NO: 1441574 - RNA, 21 nt, Pseudomonas aeruginosa PA01
gcgccaugccguucaggccgg

SEQ ID NO: 1441575 - RNA, 23 nt, Pseudomonas aeruginosa PA01
gcgccaugccguucaggccggcg

SEQ ID NO: 1441576 - RNA, 12 nt, Pseudomonas aeruginosa PA01
gcgccaggugcg

SEQ ID NO: 1441577 - RNA, 19 nt, Pseudomonas aeruginosa PA01
gcgccagguuggccuggcc

SEQ ID NO: 1441578 - RNA, 21 nt, Pseudomonas aeruginosa PA01
gcgccagguuggccuggcccg

SEQ ID NO: 1441579 - RNA, 22 nt, Pseudomonas aeruginosa PA01
gcgccagguaguccagcgguac

SEQ ID NO: 1441580 - RNA, 17 nt, Pseudomonas aeruginosa PA01
gcgccagguagugccgc

SEQ ID NO: 1441581 - RNA, 17 nt, Pseudomonas aeruginosa PA01
gcgccaguacuccgagg

SEQ ID NO: 1441582 - RNA, 14 nt, Pseudomonas aeruginosa PA01
gcgccgaugcugua

SEQ ID NO: 1441583 - RNA, 15 nt, Pseudomonas aeruginosa PA01
gcgccgauggcuguc

SEQ ID NO: 1441584 - RNA, 22 nt, Pseudomonas aeruginosa PA01
gcgccgauggcugucggcgccc

SEQ ID NO: 1441585 - RNA, 13 nt, Pseudomonas aeruginosa PA01
gcgccgaggcccu

SEQ ID NO: 1441586 - RNA, 15 nt, Pseudomonas aeruginosa PA01
gcgccgaugcccagg

SEQ ID NO: 1441587 - RNA, 17 nt, Pseudomonas aeruginosa PA01
gcgccgaugcccaggcc

SEQ ID NO: 1441588 - RNA, 21 nt, Pseudomonas aeruginosa PA01
gcgccgaugcccaggccgaug

SEQ ID NO: 1441589 - RNA, 22 nt, Pseudomonas aeruginosa PA01
gcgccgagggcuguaaucgccg

SEQ ID NO: 1441590 - RNA, 22 nt, Pseudomonas aeruginosa PA01
gcgccgcaacgaaaaagggcgg

SEQ ID NO: 1441591 - RNA, 17 nt, Pseudomonas aeruginosa PA01
gcgccgauuccugggcg

SEQ ID NO: 1441592 - RNA, 18 nt, Pseudomonas aeruginosa PA01
gcgccgauguacggcacc

SEQ ID NO: 1441593 - RNA, 21 nt, Pseudomonas aeruginosa PA01
gcgccgauguacggcaccacc

SEQ ID NO: 1441594 - RNA, 12 nt, Pseudomonas aeruginosa PA01
gcgccgcaagcu

SEQ ID NO: 1441595 - RNA, 16 nt, Pseudomonas aeruginosa PA01
gcgccgcaaguggcgg

SEQ ID NO: 1441596 - RNA, 14 nt, Pseudomonas aeruginosa PA01
gcgccgagauagcg

SEQ ID NO: 1441597 - RNA, 17 nt, Pseudomonas aeruginosa PA01
gcgccgagcuggcgcgc

SEQ ID NO: 1441598 - RNA, 13 nt, Pseudomonas aeruginosa PA01
gcgccgagcgcuc

SEQ ID NO: 1441599 - RNA, 14 nt, Pseudomonas aeruginosa PA01
gcgccgagcgcucg

SEQ ID NO: 1441600 - RNA, 14 nt, Pseudomonas aeruginosa PA01
gcgccgagccaggu

SEQ ID NO: 1441601 - RNA, 16 nt, Pseudomonas aeruginosa PA01
gcgccgagccagguac

SEQ ID NO: 1441602 - RNA, 14 nt, Pseudomonas aeruginosa PA01
gcgccgagccggcu

SEQ ID NO: 1441603 - RNA, 21 nt, Pseudomonas aeruginosa PA01
gcgccgagccggcugccgaag

SEQ ID NO: 1441604 - RNA, 22 nt, Pseudomonas aeruginosa PA01
gcgccgagccggcugccgaaga

SEQ ID NO: 1441605 - RNA, 22 nt, Pseudomonas aeruginosa PA01
gcgccgacaggcaucgcucgca

SEQ ID NO: 1441606 - RNA, 13 nt, Pseudomonas aeruginosa PA01
gcgccgaccacga

SEQ ID NO: 1441607 - RNA, 20 nt, Pseudomonas aeruginosa PA01
gcgccgaauccaggccgacg

SEQ ID NO: 1441608 - RNA, 21 nt, Pseudomonas aeruginosa PA01
gcgccgaauccaggccgacga

SEQ ID NO: 1441609 - RNA, 22 nt, Pseudomonas aeruginosa PA01
gcgccgaaggcgauauggccga

SEQ ID NO: 1441610 - RNA, 15 nt, Pseudomonas aeruginosa PA01
gcgccgaaggcguca

SEQ ID NO: 1441611 - RNA, 23 nt, Pseudomonas aeruginosa PA01
gcgccgacagcacgauggcgagg

SEQ ID NO: 1441612 - RNA, 16 nt, Pseudomonas aeruginosa PA01
gcgcccgccuggaagg

SEQ ID NO: 1441613 - RNA, 16 nt, Pseudomonas aeruginosa PA01
gcgcccgcucgacccg

SEQ ID NO: 1441614 - RNA, 19 nt, Pseudomonas aeruginosa PA01
gcgcccgcugugcggggaa

SEQ ID NO: 1441615 - RNA, 12 nt, Pseudomonas aeruginosa PA01
gcgcccggcugg

SEQ ID NO: 1441616 - RNA, 14 nt, Pseudomonas aeruginosa PA01
gcgcccggcuggcc

SEQ ID NO: 1441617 - RNA, 15 nt, Pseudomonas aeruginosa PA01
gcgcccggcuggcca

SEQ ID NO: 1441618 - RNA, 12 nt, Pseudomonas aeruginosa PA01
gcgcccggcgcg

SEQ ID NO: 1441619 - RNA, 22 nt, Pseudomonas aeruginosa PA01
gcgcccggaaaaaaaagcccgc

SEQ ID NO: 1441620 - RNA, 16 nt, Pseudomonas aeruginosa PA01
gcgcccguucgaucaa

SEQ ID NO: 1441621 - RNA, 21 nt, Pseudomonas aeruginosa PA01
gcgcccuagucgaggggaacc

SEQ ID NO: 1441622 - RNA, 13 nt, Pseudomonas aeruginosa PA01
gcgcccguccucc

SEQ ID NO: 1441623 - RNA, 20 nt, Pseudomonas aeruginosa PA01
gcgcccgguggaggucugcc

SEQ ID NO: 1441624 - RNA, 17 nt, Pseudomonas aeruginosa PA01
gcgcccguagcacaugg

SEQ ID NO: 1441625 - RNA, 18 nt, Pseudomonas aeruginosa PA01
gcgcccggcuucggcggc

SEQ ID NO: 1441626 - RNA, 22 nt, Pseudomonas aeruginosa PA01
gcgccgaacucgaacgcgugaa

SEQ ID NO: 1441627 - RNA, 13 nt, Pseudomonas aeruginosa PA01
gcgcccuggccgu

SEQ ID NO: 1441628 - RNA, 18 nt, Pseudomonas aeruginosa PA01
gcgcccuggccgucggcc

SEQ ID NO: 1441629 - RNA, 21 nt, Pseudomonas aeruginosa PA01
gcgcccuggccgucggccugc

SEQ ID NO: 1441630 - RNA, 23 nt, Pseudomonas aeruginosa PA01
gcgcccugcucugguucggcguc

SEQ ID NO: 1441631 - RNA, 14 nt, Pseudomonas aeruginosa PA01
gcgcccuggccgcc

SEQ ID NO: 1441632 - RNA, 10 nt, Pseudomonas aeruginosa PA01
gcgcccuggg

SEQ ID NO: 1441633 - RNA, 17 nt, Pseudomonas aeruginosa PA01
gcgcccugacgaugcag

SEQ ID NO: 1441634 - RNA, 20 nt, Pseudomonas aeruginosa PA01
gcgcccucaagucuccagcg

SEQ ID NO: 1441635 - RNA, 21 nt, Pseudomonas aeruginosa PA01
gcgcccucggugauaccgccg

SEQ ID NO: 1441636 - RNA, 23 nt, Pseudomonas aeruginosa PA01
gcgcccucggugauaccgccggc

SEQ ID NO: 1441637 - RNA, 14 nt, Pseudomonas aeruginosa PA01
gcgcccucccgcga

SEQ ID NO: 1441638 - RNA, 14 nt, Pseudomonas aeruginosa PA01
gcgcccucgcugag

SEQ ID NO: 1441639 - RNA, 16 nt, Pseudomonas aeruginosa PA01
gcgcccucgcugagca

SEQ ID NO: 1441640 - RNA, 17 nt, Pseudomonas aeruginosa PA01
cgcccucagcagcgccg

SEQ ID NO: 1441641 - RNA, 20 nt, Pseudomonas aeruginosa PA01
cgcccucagcagcgccgccc

SEQ ID NO: 1441642 - RNA, 22 nt, Pseudomonas aeruginosa PA01
cgcccucagcagcgccgcccug

SEQ ID NO: 1441643 - RNA, 15 nt, Pseudomonas aeruginosa PA01
cgcccuccaucagcg

SEQ ID NO: 1441644 - RNA, 13 nt, Pseudomonas aeruginosa PA01
cgcccuccagcac

SEQ ID NO: 1441645 - RNA, 15 nt, Pseudomonas aeruginosa PA01
cgcccuccagcaccg

SEQ ID NO: 1441646 - RNA, 17 nt, Pseudomonas aeruginosa PA01
cgcccuccagcaccgcc

SEQ ID NO: 1441647 - RNA, 21 nt, Pseudomonas aeruginosa PA01
cgcccuaccguccgcagcaca

SEQ ID NO: 1441648 - RNA, 23 nt, Pseudomonas aeruginosa PA01
cgcccuacggggacaugucgagg

SEQ ID NO: 1441649 - RNA, 23 nt, Pseudomonas aeruginosa PA01
cgcccuacgggggcgugucgagg

SEQ ID NO: 1441650 - RNA, 15 nt, Pseudomonas aeruginosa PA01
cgcccgugccgacua

SEQ ID NO: 1441651 - RNA, 13 nt, Pseudomonas aeruginosa PA01
cgcccgugccucg

SEQ ID NO: 1441652 - RNA, 16 nt, Pseudomonas aeruginosa PA01
cgcccgugccucggcg

SEQ ID NO: 1441653 - RNA, 18 nt, Pseudomonas aeruginosa PA01
cgcccgugccucggcgga

SEQ ID NO: 1441654 - RNA, 23 nt, Pseudomonas aeruginosa PA01
cgcccgugccucggcggacagcc

SEQ ID NO: 1441655 - RNA, 18 nt, Pseudomonas aeruginosa PA01
cgcccgucgucguggcga

SEQ ID NO: 1441656 - RNA, 21 nt, Pseudomonas aeruginosa PA01
cgcccgucgccauucggcgac

SEQ ID NO: 1441657 - RNA, 22 nt, Pseudomonas aeruginosa PA01
cgcccgucgccauucggcgacg

SEQ ID NO: 1441658 - RNA, 23 nt, Pseudomonas aeruginosa PA01
cgcccgucacuucacgacaggcg

SEQ ID NO: 1441659 - RNA, 17 nt, Pseudomonas aeruginosa PA01
cgcccgucaugaccaga

SEQ ID NO: 1441660 - RNA, 16 nt, Pseudomonas aeruginosa PA01
cgcccgguugccuucg

SEQ ID NO: 1441661 - RNA, 16 nt, Pseudomonas aeruginosa PA01
cgcccgguguucaccg

SEQ ID NO: 1441662 - RNA, 20 nt, Pseudomonas aeruginosa PA01
cgcccggucuagcgccccgg

SEQ ID NO: 1441663 - RNA, 19 nt, Pseudomonas aeruginosa PA01
cgcccggucucagccggcg

SEQ ID NO: 1441664 - RNA, 21 nt, Pseudomonas aeruginosa PA01
cgcccugcccgguggggcggg

SEQ ID NO: 1441665 - RNA, 15 nt, Pseudomonas aeruginosa PA01
cgcccugcagcgcgc

SEQ ID NO: 1441666 - RNA, 23 nt, Pseudomonas aeruginosa PA01
cgcccugcagcgcgcgcuggucg

SEQ ID NO: 1441667 - RNA, 22 nt, Pseudomonas aeruginosa PA01
cgcccugcaccuugggaucguc

SEQ ID NO: 1441668 - RNA, 18 nt, Pseudomonas aeruginosa PA01
cgcccugcggauggcgcg

SEQ ID NO: 1441669 - RNA, 20 nt, Pseudomonas aeruginosa PA01
cgcccugcggauggcgcggg

SEQ ID NO: 1441670 - RNA, 12 nt, Pseudomonas aeruginosa PA01
cgcccugcggca

SEQ ID NO: 1441671 - RNA, 14 nt, Pseudomonas aeruginosa PA01
cgcccugcggcagg

SEQ ID NO: 1441672 - RNA, 17 nt, Pseudomonas aeruginosa PA01
cgcccugcggcaggcgc

SEQ ID NO: 1441673 - RNA, 18 nt, Pseudomonas aeruginosa PA01
cgcccugcggcaggcgcc

SEQ ID NO: 1441674 - RNA, 15 nt, Pseudomonas aeruginosa PA01
cgcccugcgccagca

SEQ ID NO: 1441675 - RNA, 21 nt, Pseudomonas aeruginosa PA01
cgcccugcgcagcuaggcgag

SEQ ID NO: 1441676 - RNA, 11 nt, Pseudomonas aeruginosa PA01
cgcccugcgcc

SEQ ID NO: 1441677 - RNA, 17 nt, Pseudomonas aeruginosa PA01
cgcccugcgucgcagag

SEQ ID NO: 1441678 - RNA, 14 nt, Pseudomonas aeruginosa PA01
cgcccugcgcgauc

SEQ ID NO: 1441679 - RNA, 16 nt, Pseudomonas aeruginosa PA01
cgcccugcgcgauccc

SEQ ID NO: 1441680 - RNA, 22 nt, Pseudomonas aeruginosa PA01
cgcccucggugauaccgccggc

SEQ ID NO: 1441681 - RNA, 15 nt, Pseudomonas aeruginosa PA01
cgcccucggcgcugg

SEQ ID NO: 1441682 - RNA, 16 nt, Pseudomonas aeruginosa PA01
cgcccucggcgcuggc

SEQ ID NO: 1441683 - RNA, 17 nt, Pseudomonas aeruginosa PA01
cgcccucggcgcuggcc

SEQ ID NO: 1441684 - RNA, 18 nt, Pseudomonas aeruginosa PA01
cgcccucggcgcuggcca

SEQ ID NO: 1441685 - RNA, 17 nt, Pseudomonas aeruginosa PA01
cgcccucgggccgcagg

SEQ ID NO: 1441686 - RNA, 18 nt, Pseudomonas aeruginosa PA01
cgcccucgggccgcaggg

SEQ ID NO: 1441687 - RNA, 17 nt, Pseudomonas aeruginosa PA01
cgcccucggggccgagg

SEQ ID NO: 1441688 - RNA, 21 nt, Pseudomonas aeruginosa PA01
cgcccucucaggagcgccgcg

SEQ ID NO: 1441689 - RNA, 16 nt, Pseudomonas aeruginosa PA01
cgcccucugccggucg

SEQ ID NO: 1441690 - RNA, 14 nt, Pseudomonas aeruginosa PA01
cgcccucgaagccc

SEQ ID NO: 1441691 - RNA, 16 nt, Pseudomonas aeruginosa PA01
cgcccucgaagcccug

SEQ ID NO: 1441692 - RNA, 17 nt, Pseudomonas aeruginosa PA01
cgcccucgaagcccugc

SEQ ID NO: 1441693 - RNA, 14 nt, Pseudomonas aeruginosa PA01
cgcccucggcgacg

SEQ ID NO: 1441694 - RNA, 15 nt, Pseudomonas aeruginosa PA01
cgcccucggcgacga

SEQ ID NO: 1441695 - RNA, 18 nt, Pseudomonas aeruginosa PA01
cgcccucggcgacgagga

SEQ ID NO: 1441696 - RNA, 20 nt, Pseudomonas aeruginosa PA01
cgcccucggcgacgaggacg

SEQ ID NO: 1441697 - RNA, 13 nt, Pseudomonas aeruginosa PA01
cgcccucgcggag

SEQ ID NO: 1441698 - RNA, 19 nt, Pseudomonas aeruginosa PA01
cgcccucgcuccaacgcag

SEQ ID NO: 1441699 - RNA, 16 nt, Pseudomonas aeruginosa PA01
cgcccucgcugagcag

SEQ ID NO: 1441700 - RNA, 14 nt, Pseudomonas aeruginosa PA01
cgcccucggccagg

SEQ ID NO: 1441701 - RNA, 22 nt, Pseudomonas aeruginosa PA01
cgcccuugaggauuuucuccgg

SEQ ID NO: 1441702 - RNA, 16 nt, Pseudomonas aeruginosa PA01
cgcccuugcggcccgc

SEQ ID NO: 1441703 - RNA, 19 nt, Pseudomonas aeruginosa PA01
cgcccuugcggcgcggccc

SEQ ID NO: 1441704 - RNA, 13 nt, Pseudomonas aeruginosa PA01
cgcccuuggcggc

SEQ ID NO: 1441705 - RNA, 20 nt, Pseudomonas aeruginosa PA01
cgccgaaaaauucagcgcag

SEQ ID NO: 1441706 - RNA, 23 nt, Pseudomonas aeruginosa PA01
cgcccuuuuucgucgccagcccg

SEQ ID NO: 1441707 - RNA, 20 nt, Pseudomonas aeruginosa PA01
cgcccuucgagaaacugcag

SEQ ID NO: 1441708 - RNA, 23 nt, Pseudomonas aeruginosa PA01
cgcccuugaacuuguagcuggug

SEQ ID NO: 1441709 - RNA, 22 nt, Pseudomonas aeruginosa PA01
cgcccuugacccgguacagcgc

SEQ ID NO: 1441710 - RNA, 19 nt, Pseudomonas aeruginosa PA01
cgcccuugccauccuccag

SEQ ID NO: 1441711 - RNA, 14 nt, Pseudomonas aeruginosa PA01
cgcccuucagcgcc

SEQ ID NO: 1441712 - RNA, 15 nt, Pseudomonas aeruginosa PA01
cgcccuucagcgccu

SEQ ID NO: 1441713 - RNA, 18 nt, Pseudomonas aeruginosa PA01
cgcccuucagcgccucga

SEQ ID NO: 1441714 - RNA, 19 nt, Pseudomonas aeruginosa PA01
cgcccuugagcacgucgcc

SEQ ID NO: 1441715 - RNA, 13 nt, Pseudomonas aeruginosa PA01
cgcccuggccgau

SEQ ID NO: 1441716 - RNA, 22 nt, Pseudomonas aeruginosa PA01
cgcccuggccgaucagcuuggc

SEQ ID NO: 1441717 - RNA, 23 nt, Pseudomonas aeruginosa PA01
cgcccuggccgaucagcuuggcc

SEQ ID NO: 1441718 - RNA, 16 nt, Pseudomonas aeruginosa PA01
cgcccuggccucggcg

SEQ ID NO: 1441719 - RNA, 18 nt, Pseudomonas aeruginosa PA01
cgcccuggccucggcguc

SEQ ID NO: 1441720 - RNA, 12 nt, Pseudomonas aeruginosa PA01
cgcccuggcgcc

SEQ ID NO: 1441721 - RNA, 16 nt, Pseudomonas aeruginosa PA01
cgcccuggcgccagcg

SEQ ID NO: 1441722 - RNA, 19 nt, Pseudomonas aeruginosa PA01
cgcccuggcucugggccau

SEQ ID NO: 1441723 - RNA, 19 nt, Pseudomonas aeruginosa PA01
cgcccuggcucuugccgcg

SEQ ID NO: 1441724 - RNA, 17 nt, Pseudomonas aeruginosa PA01
cgcccuguucggcggga

SEQ ID NO: 1441725 - RNA, 20 nt, Pseudomonas aeruginosa PA01
cgcccuguuucggguccagg

SEQ ID NO: 1441726 - RNA, 22 nt, Pseudomonas aeruginosa PA01
cgcccuguuucggguccaggcg

SEQ ID NO: 1441727 - RNA, 17 nt, Pseudomonas aeruginosa PA01
cgcccugguccaaccgg

SEQ ID NO: 1441728 - RNA, 13 nt, Pseudomonas aeruginosa PA01
cgcccugggcgcg

SEQ ID NO: 1441729 - RNA, 18 nt, Pseudomonas aeruginosa PA01
cgcccugggcgacgcgga

SEQ ID NO: 1441730 - RNA, 21 nt, Pseudomonas aeruginosa PA01
cgcccugggguuucugcuggc

SEQ ID NO: 1441731 - RNA, 14 nt, Pseudomonas aeruginosa PA01
cgcccugggugguc

SEQ ID NO: 1441732 - RNA, 22 nt, Pseudomonas aeruginosa PA01
cgcccuggguggucugcacggc

SEQ ID NO: 1441733 - RNA, 16 nt, Pseudomonas aeruginosa PA01
cgccgaacagccgccc

SEQ ID NO: 1441734 - RNA, 23 nt, Pseudomonas aeruginosa PA01
cgccgaacagccgccccaccacc

SEQ ID NO: 1441735 - RNA, 20 nt, Pseudomonas aeruginosa PA01
cgccgaacaggaucuccucg

SEQ ID NO: 1441736 - RNA, 23 nt, Pseudomonas aeruginosa PA01
cgccgaacaggaucuccucggcc

SEQ ID NO: 1441737 - RNA, 15 nt, Pseudomonas aeruginosa PA01
cgccgaacgccacca

SEQ ID NO: 1441738 - RNA, 14 nt, Pseudomonas aeruginosa PA01
cgccgaaaggccgu

SEQ ID NO: 1441739 - RNA, 21 nt, Pseudomonas aeruginosa PA01
cgccgaaauagcgcgcccagu

SEQ ID NO: 1441740 - RNA, 16 nt, Pseudomonas aeruginosa PA01
cgccgaaacgccgacg

SEQ ID NO: 1441741 - RNA, 16 nt, Pseudomonas aeruginosa PA01
cgccgaaagcacgcgc

SEQ ID NO: 1441742 - RNA, 19 nt, Pseudomonas aeruginosa PA01
cgccgaaagcacgcgcauc

SEQ ID NO: 1441743 - RNA, 22 nt, Pseudomonas aeruginosa PA01
cgccgaaaugcugcaggccgag

SEQ ID NO: 1441744 - RNA, 18 nt, Pseudomonas aeruginosa PA01
cgccgaacgccaccaggg

SEQ ID NO: 1441745 - RNA, 20 nt, Pseudomonas aeruginosa PA01
cgccgaacgccaccagggcc

SEQ ID NO: 1441746 - RNA, 22 nt, Pseudomonas aeruginosa PA01
cgccgaacgccaccagggccuu

SEQ ID NO: 1441747 - RNA, 20 nt, Pseudomonas aeruginosa PA01
cgccgaacaugccgaagagc

SEQ ID NO: 1441748 - RNA, 15 nt, Pseudomonas aeruginosa PA01
cgccgaacggcagcu

SEQ ID NO: 1441749 - RNA, 15 nt, Pseudomonas aeruginosa PA01
cgccgaacggaucgc

SEQ ID NO: 1441750 - RNA, 17 nt, Pseudomonas aeruginosa PA01
cgccgaacggaucgcgu

SEQ ID NO: 1441751 - RNA, 22 nt, Pseudomonas aeruginosa PA01
cgccgaacggaucgcgucgcag

SEQ ID NO: 1441752 - RNA, 18 nt, Pseudomonas aeruginosa PA01
cgccgaagaacucggcgc

SEQ ID NO: 1441753 - RNA, 20 nt, Pseudomonas aeruginosa PA01
cgccgaagaacucggcgcug

SEQ ID NO: 1441754 - RNA, 19 nt, Pseudomonas aeruginosa PA01
cgccgaacuccgagcagga

SEQ ID NO: 1441755 - RNA, 19 nt, Pseudomonas aeruginosa PA01
cgccgaagcccgugucgcc

SEQ ID NO: 1441756 - RNA, 19 nt, Pseudomonas aeruginosa PA01
cgccgaagccgacgccgag

SEQ ID NO: 1441757 - RNA, 20 nt, Pseudomonas aeruginosa PA01
cgccgaagccgacgccgagc

SEQ ID NO: 1441758 - RNA, 13 nt, Pseudomonas aeruginosa PA01
cgccgaccgcgcg

SEQ ID NO: 1441759 - RNA, 16 nt, Pseudomonas aeruginosa PA01
cgccgaccgcgcgccu

SEQ ID NO: 1441760 - RNA, 18 nt, Pseudomonas aeruginosa PA01
cgccgaccgcgcgccugc

SEQ ID NO: 1441761 - RNA, 22 nt, Pseudomonas aeruginosa PA01
cgccgaccggacuccgcggaga

SEQ ID NO: 1441762 - RNA, 16 nt, Pseudomonas aeruginosa PA01
cgccgaccucggccgc

SEQ ID NO: 1441763 - RNA, 12 nt, Pseudomonas aeruginosa PA01
cgccgaccucca

SEQ ID NO: 1441764 - RNA, 14 nt, Pseudomonas aeruginosa PA01
cgccgaccgacugg

SEQ ID NO: 1441765 - RNA, 20 nt, Pseudomonas aeruginosa PA01
cgccgaccgcaccgccagcg

SEQ ID NO: 1441766 - RNA, 21 nt, Pseudomonas aeruginosa PA01
cgccgacccugcacccuuggc

SEQ ID NO: 1441767 - RNA, 16 nt, Pseudomonas aeruginosa PA01
cgccgacccagagcgc

SEQ ID NO: 1441768 - RNA, 19 nt, Pseudomonas aeruginosa PA01
cgccgacccagagcgcgcc

SEQ ID NO: 1441769 - RNA, 15 nt, Pseudomonas aeruginosa PA01
cgccgacgccaccag

SEQ ID NO: 1441770 - RNA, 16 nt, Pseudomonas aeruginosa PA01
cgccgacgccaccagc

SEQ ID NO: 1441771 - RNA, 13 nt, Pseudomonas aeruginosa PA01
cgccgacgccgga

SEQ ID NO: 1441772 - RNA, 14 nt, Pseudomonas aeruginosa PA01
cgccgacgacccgg

SEQ ID NO: 1441773 - RNA, 20 nt, Pseudomonas aeruginosa PA01
cgccgaaggacaggccguag

SEQ ID NO: 1441774 - RNA, 21 nt, Pseudomonas aeruginosa PA01
cgccgaaguccugcaacaggg

SEQ ID NO: 1441775 - RNA, 16 nt, Pseudomonas aeruginosa PA01
cgccgaagucggcgag

SEQ ID NO: 1441776 - RNA, 17 nt, Pseudomonas aeruginosa PA01
cgccgaagucggcgagc

SEQ ID NO: 1441777 - RNA, 21 nt, Pseudomonas aeruginosa PA01
cgccgaagucggcgagccggc

SEQ ID NO: 1441778 - RNA, 14 nt, Pseudomonas aeruginosa PA01
cgccgaagugaucu

SEQ ID NO: 1441779 - RNA, 15 nt, Pseudomonas aeruginosa PA01
cgccgaaggcgauau

SEQ ID NO: 1441780 - RNA, 22 nt, Pseudomonas aeruginosa PA01
cgccgaaggcgauauggccgau

SEQ ID NO: 1441781 - RNA, 22 nt, Pseudomonas aeruginosa PA01
cgccgaaggcgucaguuccgca

SEQ ID NO: 1441782 - RNA, 21 nt, Pseudomonas aeruginosa PA01
cgccgaaggugaaguccggcg

SEQ ID NO: 1441783 - RNA, 23 nt, Pseudomonas aeruginosa PA01
cgccgaaggugaaguccggcgcg

SEQ ID NO: 1441784 - RNA, 18 nt, Pseudomonas aeruginosa PA01
cgccgaaggugcaggccg

SEQ ID NO: 1441785 - RNA, 20 nt, Pseudomonas aeruginosa PA01
cgccgaaggugcaggccgcg

SEQ ID NO: 1441786 - RNA, 21 nt, Pseudomonas aeruginosa PA01
cgccgaaggugcaggccgcgc

SEQ ID NO: 1441787 - RNA, 23 nt, Pseudomonas aeruginosa PA01
cgccgaaggugcaggccgcgcga

SEQ ID NO: 1441788 - RNA, 17 nt, Pseudomonas aeruginosa PA01
cgccgaauccaggccga

SEQ ID NO: 1441789 - RNA, 13 nt, Pseudomonas aeruginosa PA01
cgccgacacccgc

SEQ ID NO: 1441790 - RNA, 21 nt, Pseudomonas aeruginosa PA01
cgccgaccacuuccagguagc

SEQ ID NO: 1441791 - RNA, 15 nt, Pseudomonas aeruginosa PA01
cgccgaccagcaaca

SEQ ID NO: 1441792 - RNA, 14 nt, Pseudomonas aeruginosa PA01
cgccgaccagcacg

SEQ ID NO: 1441793 - RNA, 20 nt, Pseudomonas aeruginosa PA01
cgccgaccagcacggcgaau

SEQ ID NO: 1441794 - RNA, 13 nt, Pseudomonas aeruginosa PA01
cgccgaccacgac

SEQ ID NO: 1441795 - RNA, 17 nt, Pseudomonas aeruginosa PA01
cgccgaccacgaccgcg

SEQ ID NO: 1441796 - RNA, 23 nt, Pseudomonas aeruginosa PA01
cgccgaccaggcggccgucggcc

SEQ ID NO: 1441797 - RNA, 12 nt, Pseudomonas aeruginosa PA01
cgccgaccagcu

SEQ ID NO: 1441798 - RNA, 14 nt, Pseudomonas aeruginosa PA01
cgccgaccagccgc

SEQ ID NO: 1441799 - RNA, 22 nt, Pseudomonas aeruginosa PA01
cgccgacaggcaucgcucgcaa

SEQ ID NO: 1441800 - RNA, 14 nt, Pseudomonas aeruginosa PA01
cgccgacaggccgg

SEQ ID NO: 1441801 - RNA, 17 nt, Pseudomonas aeruginosa PA01
cgccgacacgggugccg

SEQ ID NO: 1441802 - RNA, 21 nt, Pseudomonas aeruginosa PA01
cgccgacacgggugccggaga

SEQ ID NO: 1441803 - RNA, 14 nt, Pseudomonas aeruginosa PA01
cgccgacagcacga

SEQ ID NO: 1441804 - RNA, 15 nt, Pseudomonas aeruginosa PA01
cgccgacaggccggu

SEQ ID NO: 1441805 - RNA, 19 nt, Pseudomonas aeruginosa PA01
cgccgacaggccggugccg

SEQ ID NO: 1441806 - RNA, 14 nt, Pseudomonas aeruginosa PA01
cgccgacaggucgc

SEQ ID NO: 1441807 - RNA, 17 nt, Pseudomonas aeruginosa PA01
cgccgacaggucggccg

SEQ ID NO: 1441808 - RNA, 20 nt, Pseudomonas aeruginosa PA01
cgccgacaggucggccggca

SEQ ID NO: 1441809 - RNA, 21 nt, Pseudomonas aeruginosa PA01
cgccgacaggucggccggcag

SEQ ID NO: 1441810 - RNA, 23 nt, Pseudomonas aeruginosa PA01
cgccgacaucggagugcaugccg

SEQ ID NO: 1441811 - RNA, 12 nt, Pseudomonas aeruginosa PA01
cgccgagccggc

SEQ ID NO: 1441812 - RNA, 13 nt, Pseudomonas aeruginosa PA01
cgccgagcgccgc

SEQ ID NO: 1441813 - RNA, 19 nt, Pseudomonas aeruginosa PA01
cgccgagcgccgccaggca

SEQ ID NO: 1441814 - RNA, 18 nt, Pseudomonas aeruginosa PA01
cgccgagcuggcgcgcgu

SEQ ID NO: 1441815 - RNA, 14 nt, Pseudomonas aeruginosa PA01
cgccgagcugacca

SEQ ID NO: 1441816 - RNA, 20 nt, Pseudomonas aeruginosa PA01
cgccgagcugaccaccaggg

SEQ ID NO: 1441817 - RNA, 23 nt, Pseudomonas aeruginosa PA01
cgccgagcugaccaccagggcga

SEQ ID NO: 1441818 - RNA, 18 nt, Pseudomonas aeruginosa PA01
cgccgaggagacgcggca

SEQ ID NO: 1441819 - RNA, 20 nt, Pseudomonas aeruginosa PA01
cgccgaggaggaucucgcgc

SEQ ID NO: 1441820 - RNA, 13 nt, Pseudomonas aeruginosa PA01
cgccgaggauacg

SEQ ID NO: 1441821 - RNA, 19 nt, Pseudomonas aeruginosa PA01
cgccgaggauagcguccag

SEQ ID NO: 1441822 - RNA, 23 nt, Pseudomonas aeruginosa PA01
cgccgaggaacuucaugaugcgc

SEQ ID NO: 1441823 - RNA, 24 nt, Pseudomonas aeruginosa PA01
cgccgaggaacuucaugaugcgcc

SEQ ID NO: 1441824 - RNA, 13 nt, Pseudomonas aeruginosa PA01
cgccgaggaagcc

SEQ ID NO: 1441825 - RNA, 16 nt, Pseudomonas aeruginosa PA01
cgccgaggaagccgac

SEQ ID NO: 1441826 - RNA, 18 nt, Pseudomonas aeruginosa PA01
cgccgaggaagccgaccg

SEQ ID NO: 1441827 - RNA, 21 nt, Pseudomonas aeruginosa PA01
cgccgaggaagccgaccggcg

SEQ ID NO: 1441828 - RNA, 14 nt, Pseudomonas aeruginosa PA01
cgccgagcauccag

SEQ ID NO: 1441829 - RNA, 18 nt, Pseudomonas aeruginosa PA01
cgccgagcaugcgggcga

SEQ ID NO: 1441830 - RNA, 21 nt, Pseudomonas aeruginosa PA01
cgccgagcaugcgggcgaucu

SEQ ID NO: 1441831 - RNA, 18 nt, Pseudomonas aeruginosa PA01
cgccgagcauuccgacaa

SEQ ID NO: 1441832 - RNA, 12 nt, Pseudomonas aeruginosa PA01
cgccgagccagg

SEQ ID NO: 1441833 - RNA, 13 nt, Pseudomonas aeruginosa PA01
cgccgagccaggu

SEQ ID NO: 1441834 - RNA, 22 nt, Pseudomonas aeruginosa PA01
cgccgagcccccggcgcccaga

SEQ ID NO: 1441835 - RNA, 13 nt, Pseudomonas aeruginosa PA01
cgccgagccggcu

SEQ ID NO: 1441836 - RNA, 15 nt, Pseudomonas aeruginosa PA01
cgccgagccggcugc

SEQ ID NO: 1441837 - RNA, 22 nt, Pseudomonas aeruginosa PA01
cgccgacgucacggauaggcgg

SEQ ID NO: 1441838 - RNA, 19 nt, Pseudomonas aeruginosa PA01
cgccgacguccuccaggac

SEQ ID NO: 1441839 - RNA, 22 nt, Pseudomonas aeruginosa PA01
cgccgacggcuucgaccacgac

SEQ ID NO: 1441840 - RNA, 12 nt, Pseudomonas aeruginosa PA01
cgccgacggcgu

SEQ ID NO: 1441841 - RNA, 14 nt, Pseudomonas aeruginosa PA01
cgccgacggcgugc

SEQ ID NO: 1441842 - RNA, 15 nt, Pseudomonas aeruginosa PA01
cgccgaugcccaggc

SEQ ID NO: 1441843 - RNA, 18 nt, Pseudomonas aeruginosa PA01
cgccgaugcccaggccga

SEQ ID NO: 1441844 - RNA, 20 nt, Pseudomonas aeruginosa PA01
cgccgaugcccaggccgaug

SEQ ID NO: 1441845 - RNA, 14 nt, Pseudomonas aeruginosa PA01
cgccgaugcccggg

SEQ ID NO: 1441846 - RNA, 12 nt, Pseudomonas aeruginosa PA01
cgccgaugccga

SEQ ID NO: 1441847 - RNA, 14 nt, Pseudomonas aeruginosa PA01
cgccgaugccgacg

SEQ ID NO: 1441848 - RNA, 18 nt, Pseudomonas aeruginosa PA01
cgccgaugccgacgucga

SEQ ID NO: 1441849 - RNA, 20 nt, Pseudomonas aeruginosa PA01
cgccgaugaaagagcccgcg

SEQ ID NO: 1441850 - RNA, 14 nt, Pseudomonas aeruginosa PA01
cgccgaucugcagg

SEQ ID NO: 1441851 - RNA, 14 nt, Pseudomonas aeruginosa PA01
cgccgaguggccgc

SEQ ID NO: 1441852 - RNA, 16 nt, Pseudomonas aeruginosa PA01
cgccgaguggccgcug

SEQ ID NO: 1441853 - RNA, 17 nt, Pseudomonas aeruginosa PA01
cgccgaguggccgcuga

SEQ ID NO: 1441854 - RNA, 13 nt, Pseudomonas aeruginosa PA01
cgccgagguugcg

SEQ ID NO: 1441855 - RNA, 14 nt, Pseudomonas aeruginosa PA01
cgccgagguugcgc

SEQ ID NO: 1441856 - RNA, 17 nt, Pseudomonas aeruginosa PA01
cgccgaggucaguucgg

SEQ ID NO: 1441857 - RNA, 11 nt, Pseudomonas aeruginosa PA01
cgccgaggccc

SEQ ID NO: 1441858 - RNA, 19 nt, Pseudomonas aeruginosa PA01
cgccgaggucuuggccagc

SEQ ID NO: 1441859 - RNA, 20 nt, Pseudomonas aeruginosa PA01
cgccgaggucuuggccagcc

SEQ ID NO: 1441860 - RNA, 21 nt, Pseudomonas aeruginosa PA01
cgccgaggucuuggccagccg

SEQ ID NO: 1441861 - RNA, 22 nt, Pseudomonas aeruginosa PA01
cgccgaggucuuggccagccgc

SEQ ID NO: 1441862 - RNA, 19 nt, Pseudomonas aeruginosa PA01
cgcccgcgagccguccugc

SEQ ID NO: 1441863 - RNA, 20 nt, Pseudomonas aeruginosa PA01
cgcccgcgagccguccugcg

SEQ ID NO: 1441864 - RNA, 21 nt, Pseudomonas aeruginosa PA01
cgcccgccuuguucgccagca

SEQ ID NO: 1441865 - RNA, 15 nt, Pseudomonas aeruginosa PA01
cgcccgcgcauggag

SEQ ID NO: 1441866 - RNA, 18 nt, Pseudomonas aeruginosa PA01
cgcccgcgcauggagacg

SEQ ID NO: 1441867 - RNA, 16 nt, Pseudomonas aeruginosa PA01
cgcccgcgccuccagg

SEQ ID NO: 1441868 - RNA, 16 nt, Pseudomonas aeruginosa PA01
cgcccgcggcggcgac

SEQ ID NO: 1441869 - RNA, 17 nt, Pseudomonas aeruginosa PA01
cgcccgcggcggcgacg

SEQ ID NO: 1441870 - RNA, 18 nt, Pseudomonas aeruginosa PA01
cgcccgcggcggcgacgc

SEQ ID NO: 1441871 - RNA, 23 nt, Pseudomonas aeruginosa PA01
cgcccgcggcggcgacgcuggcg

SEQ ID NO: 1441872 - RNA, 21 nt, Pseudomonas aeruginosa PA01
cgcccgcggaccgggcggcgc

SEQ ID NO: 1441873 - RNA, 23 nt, Pseudomonas aeruginosa PA01
cgcccgcggaccgggcggcgcgg

SEQ ID NO: 1441874 - RNA, 13 nt, Pseudomonas aeruginosa PA01
cgcccgcggcagc

SEQ ID NO: 1441875 - RNA, 17 nt, Pseudomonas aeruginosa PA01
cgcccgcggcagcagcc

SEQ ID NO: 1441876 - RNA, 18 nt, Pseudomonas aeruginosa PA01
cgcccgcggcagcagcca

SEQ ID NO: 1441877 - RNA, 15 nt, Pseudomonas aeruginosa PA01
cgcccgccgcgagcg

SEQ ID NO: 1441878 - RNA, 21 nt, Pseudomonas aeruginosa PA01
cgcccgccgcgagcgccgccg

SEQ ID NO: 1441879 - RNA, 13 nt, Pseudomonas aeruginosa PA01
cgcccgccggcgu

SEQ ID NO: 1441880 - RNA, 12 nt, Pseudomonas aeruginosa PA01
cgcccgccggcg

SEQ ID NO: 1441881 - RNA, 15 nt, Pseudomonas aeruginosa PA01
cgcccgccguccucc

SEQ ID NO: 1441882 - RNA, 18 nt, Pseudomonas aeruginosa PA01
cgcccgccguccuccagc

SEQ ID NO: 1441883 - RNA, 14 nt, Pseudomonas aeruginosa PA01
cgcccgccguggcg

SEQ ID NO: 1441884 - RNA, 15 nt, Pseudomonas aeruginosa PA01
cgcccgccucaggcc

SEQ ID NO: 1441885 - RNA, 20 nt, Pseudomonas aeruginosa PA01
cgcccgccuggaaggcgcug

SEQ ID NO: 1441886 - RNA, 17 nt, Pseudomonas aeruginosa PA01
cgcccgccucaggccgg

SEQ ID NO: 1441887 - RNA, 17 nt, Pseudomonas aeruginosa PA01
cgcccgccauguuggcc

SEQ ID NO: 1441888 - RNA, 16 nt, Pseudomonas aeruginosa PA01
cgcccgcaccacccgc

SEQ ID NO: 1441889 - RNA, 13 nt, Pseudomonas aeruginosa PA01
cgcccgcccggaa

SEQ ID NO: 1441890 - RNA, 13 nt, Pseudomonas aeruginosa PA01
cgcccgcccucgu

SEQ ID NO: 1441891 - RNA, 18 nt, Pseudomonas aeruginosa PA01
cgcccgcccucgucgcac

SEQ ID NO: 1441892 - RNA, 12 nt, Pseudomonas aeruginosa PA01
cgcccgccgccu

SEQ ID NO: 1441893 - RNA, 12 nt, Pseudomonas aeruginosa PA01
cgcccgacggcu

SEQ ID NO: 1441894 - RNA, 15 nt, Pseudomonas aeruginosa PA01
cgcccgacggcucga

SEQ ID NO: 1441895 - RNA, 17 nt, Pseudomonas aeruginosa PA01
cgcccgagagggugguc

SEQ ID NO: 1441896 - RNA, 21 nt, Pseudomonas aeruginosa PA01
cgcccgagaggguggucgcgc

SEQ ID NO: 1441897 - RNA, 15 nt, Pseudomonas aeruginosa PA01
cgcccgagccgcugc

SEQ ID NO: 1441898 - RNA, 17 nt, Pseudomonas aeruginosa PA01
cgcccgagcuuugcgca

SEQ ID NO: 1441899 - RNA, 21 nt, Pseudomonas aeruginosa PA01
cgcccgagcuuugcgcagcca

SEQ ID NO: 1441900 - RNA, 18 nt, Pseudomonas aeruginosa PA01
cgcccgaugaucgagcgc

SEQ ID NO: 1441901 - RNA, 21 nt, Pseudomonas aeruginosa PA01
cgcccgaugaucgagcgcacg

SEQ ID NO: 1441902 - RNA, 13 nt, Pseudomonas aeruginosa PA01
cgcccgaucgccu

SEQ ID NO: 1441903 - RNA, 20 nt, Pseudomonas aeruginosa PA01
cgcccgaucgccucgucgag

SEQ ID NO: 1441904 - RNA, 21 nt, Pseudomonas aeruginosa PA01
cgcccgaucgccucgucgagc

SEQ ID NO: 1441905 - RNA, 23 nt, Pseudomonas aeruginosa PA01
cgcccgaucgccucgucgagcgc

SEQ ID NO: 1441906 - RNA, 14 nt, Pseudomonas aeruginosa PA01
cgcccgccaggucg

SEQ ID NO: 1441907 - RNA, 16 nt, Pseudomonas aeruginosa PA01
cgcccgcaguuccucg

SEQ ID NO: 1441908 - RNA, 18 nt, Pseudomonas aeruginosa PA01
cgcccgcaguuccucgcc

SEQ ID NO: 1441909 - RNA, 23 nt, Pseudomonas aeruginosa PA01
cgcccgcaguuccucgccgcugc

SEQ ID NO: 1441910 - RNA, 17 nt, Pseudomonas aeruginosa PA01
cgcccgcagccacaggc

SEQ ID NO: 1441911 - RNA, 18 nt, Pseudomonas aeruginosa PA01
cgcccgcagccacaggcg

SEQ ID NO: 1441912 - RNA, 19 nt, Pseudomonas aeruginosa PA01
cgcccgcagccacaggcgc

SEQ ID NO: 1441913 - RNA, 21 nt, Pseudomonas aeruginosa PA01
cgcccgcagccacaggcgcca

SEQ ID NO: 1441914 - RNA, 17 nt, Pseudomonas aeruginosa PA01
cgcccgcagccacggca

SEQ ID NO: 1441915 - RNA, 16 nt, Pseudomonas aeruginosa PA01
cgcccgauaggcgccg

SEQ ID NO: 1441916 - RNA, 17 nt, Pseudomonas aeruginosa PA01
cgcccgauaggcgccgg

SEQ ID NO: 1441917 - RNA, 20 nt, Pseudomonas aeruginosa PA01
cgcccggcgcuccaacagca

SEQ ID NO: 1441918 - RNA, 12 nt, Pseudomonas aeruginosa PA01
cgcccggcucgc

SEQ ID NO: 1441919 - RNA, 20 nt, Pseudomonas aeruginosa PA01
cgcccggcucgcccaugcgc

SEQ ID NO: 1441920 - RNA, 14 nt, Pseudomonas aeruginosa PA01
cgcccggcucgccg

SEQ ID NO: 1441921 - RNA, 19 nt, Pseudomonas aeruginosa PA01
cgcccggcucgccgccggg

SEQ ID NO: 1441922 - RNA, 22 nt, Pseudomonas aeruginosa PA01
cgcccggcucgccgccgggcgc

SEQ ID NO: 1441923 - RNA, 18 nt, Pseudomonas aeruginosa PA01
cgcccggcucggccgugu

SEQ ID NO: 1441924 - RNA, 20 nt, Pseudomonas aeruginosa PA01
cgcccggcgcaugccgcagg

SEQ ID NO: 1441925 - RNA, 14 nt, Pseudomonas aeruginosa PA01
cgcccggccgcugg

SEQ ID NO: 1441926 - RNA, 19 nt, Pseudomonas aeruginosa PA01
cgcccggccuucaccgcgc

SEQ ID NO: 1441927 - RNA, 16 nt, Pseudomonas aeruginosa PA01
cgcccggcgaacagcg

SEQ ID NO: 1441928 - RNA, 18 nt, Pseudomonas aeruginosa PA01
cgcccggcgaacagcgcu

SEQ ID NO: 1441929 - RNA, 12 nt, Pseudomonas aeruginosa PA01
cgcccggcgcca

SEQ ID NO: 1441930 - RNA, 14 nt, Pseudomonas aeruginosa PA01
cgcccggcgccacc

SEQ ID NO: 1441931 - RNA, 20 nt, Pseudomonas aeruginosa PA01
cgcccggcgccaccccgccg

SEQ ID NO: 1441932 - RNA, 24 nt, Pseudomonas aeruginosa PA01
cgcccggcgccaccccgccgcgca

SEQ ID NO: 1441933 - RNA, 24 nt, Pseudomonas aeruginosa PA01
cgcccggcgccaccgcguugacgc

SEQ ID NO: 1441934 - RNA, 14 nt, Pseudomonas aeruginosa PA01
cgcccggcgccagg

SEQ ID NO: 1441935 - RNA, 15 nt, Pseudomonas aeruginosa PA01
cgcccggcgccaggc

SEQ ID NO: 1441936 - RNA, 12 nt, Pseudomonas aeruginosa PA01
cgcccggcgcga

SEQ ID NO: 1441937 - RNA, 21 nt, Pseudomonas aeruginosa PA01
cgcccggcgcgaccgucggcc

SEQ ID NO: 1441938 - RNA, 17 nt, Pseudomonas aeruginosa PA01
cgcccggcuucggcggc

SEQ ID NO: 1441939 - RNA, 18 nt, Pseudomonas aeruginosa PA01
cgcccggcuucggcggcg

SEQ ID NO: 1441940 - RNA, 21 nt, Pseudomonas aeruginosa PA01
cgcccggcuucggcggcgcgc

SEQ ID NO: 1441941 - RNA, 13 nt, Pseudomonas aeruginosa PA01
cgcccggcuggcc

SEQ ID NO: 1441942 - RNA, 14 nt, Pseudomonas aeruginosa PA01
cgcccggcuggcca

SEQ ID NO: 1441943 - RNA, 18 nt, Pseudomonas aeruginosa PA01
cgcccggcuggccaucca

SEQ ID NO: 1441944 - RNA, 18 nt, Pseudomonas aeruginosa PA01
cgcccggcugugcucgac

SEQ ID NO: 1441945 - RNA, 16 nt, Pseudomonas aeruginosa PA01
cgcccggucagguugg

SEQ ID NO: 1441946 - RNA, 14 nt, Pseudomonas aeruginosa PA01
cgcccgcgggcgcc

SEQ ID NO: 1441947 - RNA, 23 nt, Pseudomonas aeruginosa PA01
cgcccgcgguauucuccagcagg

SEQ ID NO: 1441948 - RNA, 16 nt, Pseudomonas aeruginosa PA01
cgcccggaaccaccgg

SEQ ID NO: 1441949 - RNA, 19 nt, Pseudomonas aeruginosa PA01
cgcccggaaccaccgguca

SEQ ID NO: 1441950 - RNA, 20 nt, Pseudomonas aeruginosa PA01
cgcccggaaccaccggucaa

SEQ ID NO: 1441951 - RNA, 14 nt, Pseudomonas aeruginosa PA01
cgcccgcugugcgg

SEQ ID NO: 1441952 - RNA, 13 nt, Pseudomonas aeruginosa PA01
cgcccgcuugcgc

SEQ ID NO: 1441953 - RNA, 15 nt, Pseudomonas aeruginosa PA01
cgcccgcuugcgccg

SEQ ID NO: 1441954 - RNA, 18 nt, Pseudomonas aeruginosa PA01
cgcccgcuugcgccgccu

SEQ ID NO: 1441955 - RNA, 23 nt, Pseudomonas aeruginosa PA01
cgcccgcuugcgccgccucgcgc

SEQ ID NO: 1441956 - RNA, 21 nt, Pseudomonas aeruginosa PA01
cgcccgcugaaggacugugcc

SEQ ID NO: 1441957 - RNA, 17 nt, Pseudomonas aeruginosa PA01
cgcccgcugcgcugcca

SEQ ID NO: 1441958 - RNA, 15 nt, Pseudomonas aeruginosa PA01
cgcccggccuccccg

SEQ ID NO: 1441959 - RNA, 13 nt, Pseudomonas aeruginosa PA01
cgcccggcgcaga

SEQ ID NO: 1441960 - RNA, 16 nt, Pseudomonas aeruginosa PA01
cgcccggcgcagaacu

SEQ ID NO: 1441961 - RNA, 21 nt, Pseudomonas aeruginosa PA01
cgcccggagcgcgaaagcgcc

SEQ ID NO: 1441962 - RNA, 23 nt, Pseudomonas aeruginosa PA01
cgcccggauagacgccguccacc

SEQ ID NO: 1441963 - RNA, 16 nt, Pseudomonas aeruginosa PA01
cgcccggcaucugccg

SEQ ID NO: 1441964 - RNA, 17 nt, Pseudomonas aeruginosa PA01
cgcccggcagcaggccg

SEQ ID NO: 1441965 - RNA, 18 nt, Pseudomonas aeruginosa PA01
cgcccggcagcaggccgc

SEQ ID NO: 1441966 - RNA, 21 nt, Pseudomonas aeruginosa PA01
cgcccggcagcaggccgccgc

SEQ ID NO: 1441967 - RNA, 22 nt, Pseudomonas aeruginosa PA01
cgcccggcagcaggccgccgcg

SEQ ID NO: 1441968 - RNA, 19 nt, Pseudomonas aeruginosa PA01
cgcccggcagcggcuggcc

SEQ ID NO: 1441969 - RNA, 21 nt, Pseudomonas aeruginosa PA01
cgcccggcagcggcuggccgu

SEQ ID NO: 1441970 - RNA, 15 nt, Pseudomonas aeruginosa PA01
cgcccggcacucgcc

SEQ ID NO: 1441971 - RNA, 12 nt, Pseudomonas aeruginosa PA01
cgcccggcagau

SEQ ID NO: 1441972 - RNA, 16 nt, Pseudomonas aeruginosa PA01
cgcccggcaaucaggc

SEQ ID NO: 1441973 - RNA, 17 nt, Pseudomonas aeruginosa PA01
cgcccggcaaucaggcg

SEQ ID NO: 1441974 - RNA, 16 nt, Pseudomonas aeruginosa PA01
cgcccggcaccaccgg

SEQ ID NO: 1441975 - RNA, 19 nt, Pseudomonas aeruginosa PA01
cgcccggcaccaccgguca

SEQ ID NO: 1441976 - RNA, 14 nt, Pseudomonas aeruginosa PA01
cgcccaggcaggcg

SEQ ID NO: 1441977 - RNA, 13 nt, Pseudomonas aeruginosa PA01
cgcccaggcccag

SEQ ID NO: 1441978 - RNA, 15 nt, Pseudomonas aeruginosa PA01
cgcccaggcccagcg

SEQ ID NO: 1441979 - RNA, 14 nt, Pseudomonas aeruginosa PA01
cgcccaggcccagc

SEQ ID NO: 1441980 - RNA, 17 nt, Pseudomonas aeruginosa PA01
cgcccaggccgcuggcg

SEQ ID NO: 1441981 - RNA, 19 nt, Pseudomonas aeruginosa PA01
cgcccaggccgcuggcggc

SEQ ID NO: 1441982 - RNA, 12 nt, Pseudomonas aeruginosa PA01
cgcccaggccgg

SEQ ID NO: 1441983 - RNA, 14 nt, Pseudomonas aeruginosa PA01
cgcccaggccgggu

SEQ ID NO: 1441984 - RNA, 16 nt, Pseudomonas aeruginosa PA01
cgcccaggccgggucg

SEQ ID NO: 1441985 - RNA, 17 nt, Pseudomonas aeruginosa PA01
cgcccaggccgggucgc

SEQ ID NO: 1441986 - RNA, 14 nt, Pseudomonas aeruginosa PA01
cgcccaggcgcacc

SEQ ID NO: 1441987 - RNA, 15 nt, Pseudomonas aeruginosa PA01
cgcccaggcgcaccu

SEQ ID NO: 1441988 - RNA, 22 nt, Pseudomonas aeruginosa PA01
cgcccagggcguggucggcggc

SEQ ID NO: 1441989 - RNA, 13 nt, Pseudomonas aeruginosa PA01
cgcccagggggcc

SEQ ID NO: 1441990 - RNA, 18 nt, Pseudomonas aeruginosa PA01
cgcccagggggccgggcc

SEQ ID NO: 1441991 - RNA, 13 nt, Pseudomonas aeruginosa PA01
cgcccaggcgcuc

SEQ ID NO: 1441992 - RNA, 14 nt, Pseudomonas aeruginosa PA01
cgcccaggcgcucg

SEQ ID NO: 1441993 - RNA, 17 nt, Pseudomonas aeruginosa PA01
cgcccaggcgcucggcg

SEQ ID NO: 1441994 - RNA, 19 nt, Pseudomonas aeruginosa PA01
cgcccaggcgcucggcgac

SEQ ID NO: 1441995 - RNA, 16 nt, Pseudomonas aeruginosa PA01
cgcccaggcugccgcc

SEQ ID NO: 1441996 - RNA, 18 nt, Pseudomonas aeruginosa PA01
cgcccaggcugccgccgc

SEQ ID NO: 1441997 - RNA, 18 nt, Pseudomonas aeruginosa PA01
cgcccaggcugccggcca

SEQ ID NO: 1441998 - RNA, 20 nt, Pseudomonas aeruginosa PA01
cgcccagggacgcgccggcg

SEQ ID NO: 1441999 - RNA, 15 nt, Pseudomonas aeruginosa PA01
cgcccaguucgccgg

SEQ ID NO: 1442000 - RNA, 16 nt, Pseudomonas aeruginosa PA01
cgcccaguucgccggc

SEQ ID NO: 1442001 - RNA, 20 nt, Pseudomonas aeruginosa PA01
cgcccaguucgccggccagc

SEQ ID NO: 1442002 - RNA, 17 nt, Pseudomonas aeruginosa PA01
cgcccaguucgcgcgga

SEQ ID NO: 1442003 - RNA, 21 nt, Pseudomonas aeruginosa PA01
cgcccaguucuucgccgcccg

SEQ ID NO: 1442004 - RNA, 20 nt, Pseudomonas aeruginosa PA01
cgcccaguugcgccgccugc

SEQ ID NO: 1442005 - RNA, 21 nt, Pseudomonas aeruginosa PA01
cgcccaguugcgccgccugcg

SEQ ID NO: 1442006 - RNA, 21 nt, Pseudomonas aeruginosa PA01
cgcccaguugguaaucguaga

SEQ ID NO: 1442007 - RNA, 19 nt, Pseudomonas aeruginosa PA01
cgcccaguccugggugucg

SEQ ID NO: 1442008 - RNA, 16 nt, Pseudomonas aeruginosa PA01
cgcccaucgagguauu

SEQ ID NO: 1442009 - RNA, 16 nt, Pseudomonas aeruginosa PA01
cgcccaucgccaccag

SEQ ID NO: 1442010 - RNA, 17 nt, Pseudomonas aeruginosa PA01
cgcccaucgccaccagc

SEQ ID NO: 1442011 - RNA, 14 nt, Pseudomonas aeruginosa PA01
cgcccaucgccagg

SEQ ID NO: 1442012 - RNA, 15 nt, Pseudomonas aeruginosa PA01
cgcccaucgccaggg

SEQ ID NO: 1442013 - RNA, 17 nt, Pseudomonas aeruginosa PA01
cgcccaucggcgucggc

SEQ ID NO: 1442014 - RNA, 19 nt, Pseudomonas aeruginosa PA01
cgcccaucggcgucggcug

SEQ ID NO: 1442015 - RNA, 23 nt, Pseudomonas aeruginosa PA01
cgcccaucggcgucggcuggucg

SEQ ID NO: 1442016 - RNA, 17 nt, Pseudomonas aeruginosa PA01
cgcccaucaacgagccg

SEQ ID NO: 1442017 - RNA, 19 nt, Pseudomonas aeruginosa PA01
cgcccaucaacgagccgag

SEQ ID NO: 1442018 - RNA, 23 nt, Pseudomonas aeruginosa PA01
cgcccauagcgaguaggcgaagc

SEQ ID NO: 1442019 - RNA, 15 nt, Pseudomonas aeruginosa PA01
cgcccaucuucaggc

SEQ ID NO: 1442020 - RNA, 22 nt, Pseudomonas aeruginosa PA01
cgcccaucuucaggccguucag

SEQ ID NO: 1442021 - RNA, 20 nt, Pseudomonas aeruginosa PA01
cgcccaugaaaaauggccgc

SEQ ID NO: 1442022 - RNA, 22 nt, Pseudomonas aeruginosa PA01
cgcccaugaaaaauggccgcuu

SEQ ID NO: 1442023 - RNA, 15 nt, Pseudomonas aeruginosa PA01
cgcccaugccgcccg

SEQ ID NO: 1442024 - RNA, 16 nt, Pseudomonas aeruginosa PA01
cgcccaugccgcccgg

SEQ ID NO: 1442025 - RNA, 20 nt, Pseudomonas aeruginosa PA01
cgcccaugccgcccggccgc

SEQ ID NO: 1442026 - RNA, 17 nt, Pseudomonas aeruginosa PA01
cgcccagcucgccgcuc

SEQ ID NO: 1442027 - RNA, 15 nt, Pseudomonas aeruginosa PA01
cgcccagcggcuggc

SEQ ID NO: 1442028 - RNA, 21 nt, Pseudomonas aeruginosa PA01
cgcccagcggcuggcgggcga

SEQ ID NO: 1442029 - RNA, 12 nt, Pseudomonas aeruginosa PA01
cgcccagcgccu

SEQ ID NO: 1442030 - RNA, 13 nt, Pseudomonas aeruginosa PA01
cgcccagcgccug

SEQ ID NO: 1442031 - RNA, 12 nt, Pseudomonas aeruginosa PA01
cgcccagcgcag

SEQ ID NO: 1442032 - RNA, 12 nt, Pseudomonas aeruginosa PA01
cgcccagccgag

SEQ ID NO: 1442033 - RNA, 12 nt, Pseudomonas aeruginosa PA01
cgcccagccaga

SEQ ID NO: 1442034 - RNA, 14 nt, Pseudomonas aeruginosa PA01
cgccaccgauucgc

SEQ ID NO: 1442035 - RNA, 17 nt, Pseudomonas aeruginosa PA01
cgccaccgauucgccgg

SEQ ID NO: 1442036 - RNA, 18 nt, Pseudomonas aeruginosa PA01
cgccaccgauucgccggc

SEQ ID NO: 1442037 - RNA, 20 nt, Pseudomonas aeruginosa PA01
cgccaccgauucgccggcca

SEQ ID NO: 1442038 - RNA, 16 nt, Pseudomonas aeruginosa PA01
cgccaccgcgcgcccu

SEQ ID NO: 1442039 - RNA, 15 nt, Pseudomonas aeruginosa PA01
cgccaccgcggaucc

SEQ ID NO: 1442040 - RNA, 16 nt, Pseudomonas aeruginosa PA01
cgccaccgccuggucg

SEQ ID NO: 1442041 - RNA, 13 nt, Pseudomonas aeruginosa PA01
cgccaccgccgga

SEQ ID NO: 1442042 - RNA, 15 nt, Pseudomonas aeruginosa PA01
cgccaccgccggaac

SEQ ID NO: 1442043 - RNA, 15 nt, Pseudomonas aeruginosa PA01
cgccccaggugcagc

SEQ ID NO: 1442044 - RNA, 22 nt, Pseudomonas aeruginosa PA01
cgccccaggugcagcgagggga

SEQ ID NO: 1442045 - RNA, 19 nt, Pseudomonas aeruginosa PA01
cgccccagccucggcaggg

SEQ ID NO: 1442046 - RNA, 12 nt, Pseudomonas aeruginosa PA01
cgccccagcgca

SEQ ID NO: 1442047 - RNA, 13 nt, Pseudomonas aeruginosa PA01
cgccccagcgccu

SEQ ID NO: 1442048 - RNA, 14 nt, Pseudomonas aeruginosa PA01
cgccccagcgccug

SEQ ID NO: 1442049 - RNA, 14 nt, Pseudomonas aeruginosa PA01
cgccccagcggucg

SEQ ID NO: 1442050 - RNA, 22 nt, Pseudomonas aeruginosa PA01
cgccccacggcgcggccgugcc

SEQ ID NO: 1442051 - RNA, 20 nt, Pseudomonas aeruginosa PA01
cgccccagaucgccagcgcc

SEQ ID NO: 1442052 - RNA, 19 nt, Pseudomonas aeruginosa PA01
cgccccagacccaggugcg

SEQ ID NO: 1442053 - RNA, 21 nt, Pseudomonas aeruginosa PA01
cgccccagcaccucgccgucg

SEQ ID NO: 1442054 - RNA, 21 nt, Pseudomonas aeruginosa PA01
cgcccauugcccggccaggcg

SEQ ID NO: 1442055 - RNA, 15 nt, Pseudomonas aeruginosa PA01
cgcccauugccgggc

SEQ ID NO: 1442056 - RNA, 21 nt, Pseudomonas aeruginosa PA01
cgcccauguagaccaccagcg

SEQ ID NO: 1442057 - RNA, 20 nt, Pseudomonas aeruginosa PA01
cgcccaugugcuugaccgcc

SEQ ID NO: 1442058 - RNA, 12 nt, Pseudomonas aeruginosa PA01
cgccccacagcg

SEQ ID NO: 1442059 - RNA, 19 nt, Pseudomonas aeruginosa PA01
cgccccaccaccaucgccg

SEQ ID NO: 1442060 - RNA, 23 nt, Pseudomonas aeruginosa PA01
cgcccccuggccguugaccagcg

SEQ ID NO: 1442061 - RNA, 22 nt, Pseudomonas aeruginosa PA01
cgccccgaaaaaaaaggccgca

SEQ ID NO: 1442062 - RNA, 11 nt, Pseudomonas aeruginosa PA01
cgccccaggcg

SEQ ID NO: 1442063 - RNA, 12 nt, Pseudomonas aeruginosa PA01
cgccccaggcgg

SEQ ID NO: 1442064 - RNA, 19 nt, Pseudomonas aeruginosa PA01
cgccccaggcgggcacguc

SEQ ID NO: 1442065 - RNA, 12 nt, Pseudomonas aeruginosa PA01
cgccccauccgg

SEQ ID NO: 1442066 - RNA, 13 nt, Pseudomonas aeruginosa PA01
cgcccccagcgcc

SEQ ID NO: 1442067 - RNA, 19 nt, Pseudomonas aeruginosa PA01
cgcccccagcgcgccgccg

SEQ ID NO: 1442068 - RNA, 22 nt, Pseudomonas aeruginosa PA01
cgcccccagcgcgccgccgagg

SEQ ID NO: 1442069 - RNA, 23 nt, Pseudomonas aeruginosa PA01
cgcccccaacggaaaaaggcgcc

SEQ ID NO: 1442070 - RNA, 15 nt, Pseudomonas aeruginosa PA01
cgccccgcaaggugc

SEQ ID NO: 1442071 - RNA, 12 nt, Pseudomonas aeruginosa PA01
cgccccgccgcc

SEQ ID NO: 1442072 - RNA, 13 nt, Pseudomonas aeruginosa PA01
cgccccgccgcca

SEQ ID NO: 1442073 - RNA, 14 nt, Pseudomonas aeruginosa PA01
cgccccgccgccag

SEQ ID NO: 1442074 - RNA, 15 nt, Pseudomonas aeruginosa PA01
cgccccgccgccagg

SEQ ID NO: 1442075 - RNA, 12 nt, Pseudomonas aeruginosa PA01
cgccccgccggg

SEQ ID NO: 1442076 - RNA, 13 nt, Pseudomonas aeruginosa PA01
cgccccgccgggg

SEQ ID NO: 1442077 - RNA, 14 nt, Pseudomonas aeruginosa PA01
cgccccgccaggag

SEQ ID NO: 1442078 - RNA, 12 nt, Pseudomonas aeruginosa PA01
cgccccggccca

SEQ ID NO: 1442079 - RNA, 17 nt, Pseudomonas aeruginosa PA01
cgccccggcccagccgc

SEQ ID NO: 1442080 - RNA, 19 nt, Pseudomonas aeruginosa PA01
cgccccggcccagccgcgg

SEQ ID NO: 1442081 - RNA, 17 nt, Pseudomonas aeruginosa PA01
cgccccggcaagcgccg

SEQ ID NO: 1442082 - RNA, 17 nt, Pseudomonas aeruginosa PA01
cgccccggcagccacca

SEQ ID NO: 1442083 - RNA, 19 nt, Pseudomonas aeruginosa PA01
cgccccggcagccaccagg

SEQ ID NO: 1442084 - RNA, 12 nt, Pseudomonas aeruginosa PA01
cgccccggccgc

SEQ ID NO: 1442085 - RNA, 14 nt, Pseudomonas aeruginosa PA01
cgccccggccgcgc

SEQ ID NO: 1442086 - RNA, 17 nt, Pseudomonas aeruginosa PA01
cgccccgcuugccgucg

SEQ ID NO: 1442087 - RNA, 13 nt, Pseudomonas aeruginosa PA01
cgccccgucgacg

SEQ ID NO: 1442088 - RNA, 20 nt, Pseudomonas aeruginosa PA01
cgccccgucgacgcaucgac

SEQ ID NO: 1442089 - RNA, 16 nt, Pseudomonas aeruginosa PA01
cgccccggucucgcgc

SEQ ID NO: 1442090 - RNA, 19 nt, Pseudomonas aeruginosa PA01
cgccccgggucgcugcuca

SEQ ID NO: 1442091 - RNA, 19 nt, Pseudomonas aeruginosa PA01
cgccccguuugccgucggc

SEQ ID NO: 1442092 - RNA, 21 nt, Pseudomonas aeruginosa PA01
cgccccguuugccgucggcgc

SEQ ID NO: 1442093 - RNA, 22 nt, Pseudomonas aeruginosa PA01
cgccccguuugccgucggcgcg

SEQ ID NO: 1442094 - RNA, 17 nt, Pseudomonas aeruginosa PA01
cgccccguuggcgcggg

SEQ ID NO: 1442095 - RNA, 20 nt, Pseudomonas aeruginosa PA01
cgccccguuggcgcgggcga

SEQ ID NO: 1442096 - RNA, 19 nt, Pseudomonas aeruginosa PA01
cgccccuccaguuccugcu

SEQ ID NO: 1442097 - RNA, 15 nt, Pseudomonas aeruginosa PA01
cgccccuccuucgag

SEQ ID NO: 1442098 - RNA, 14 nt, Pseudomonas aeruginosa PA01
cgcccgaacgccga

SEQ ID NO: 1442099 - RNA, 18 nt, Pseudomonas aeruginosa PA01
cgcccgaacgccgaccga

SEQ ID NO: 1442100 - RNA, 16 nt, Pseudomonas aeruginosa PA01
cgccccugcggcgccg

SEQ ID NO: 1442101 - RNA, 15 nt, Pseudomonas aeruginosa PA01
cgccccugcuccucg

SEQ ID NO: 1442102 - RNA, 17 nt, Pseudomonas aeruginosa PA01
cgccccugcuccucgcc

SEQ ID NO: 1442103 - RNA, 19 nt, Pseudomonas aeruginosa PA01
cgccccuuggccagcacca

SEQ ID NO: 1442104 - RNA, 22 nt, Pseudomonas aeruginosa PA01
cgccccuuuuuuuugccugccg

SEQ ID NO: 1442105 - RNA, 11 nt, Pseudomonas aeruginosa PA01
cgcccgacgaa

SEQ ID NO: 1442106 - RNA, 21 nt, Pseudomonas aeruginosa PA01
cgcccgacgaaauagucgcgg

SEQ ID NO: 1442107 - RNA, 16 nt, Pseudomonas aeruginosa PA01
cgcccgaccccacgcc

SEQ ID NO: 1442108 - RNA, 17 nt, Pseudomonas aeruginosa PA01
cgcccgaccccacgccg

SEQ ID NO: 1442109 - RNA, 20 nt, Pseudomonas aeruginosa PA01
cgcccgaccccacgccggcc

SEQ ID NO: 1442110 - RNA, 22 nt, Pseudomonas aeruginosa PA01
cgcccgaccccacgccggccgg

SEQ ID NO: 1442111 - RNA, 20 nt, Pseudomonas aeruginosa PA01
cgccggucuucacgccuugc

SEQ ID NO: 1442112 - RNA, 17 nt, Pseudomonas aeruginosa PA01
cgccggugacgcugcuc

SEQ ID NO: 1442113 - RNA, 23 nt, Pseudomonas aeruginosa PA01
cgccggugacgcugcucaccagg

SEQ ID NO: 1442114 - RNA, 14 nt, Pseudomonas aeruginosa PA01
cgccggugcuggcg

SEQ ID NO: 1442115 - RNA, 21 nt, Pseudomonas aeruginosa PA01
cgccggugacccacuccggca

SEQ ID NO: 1442116 - RNA, 13 nt, Pseudomonas aeruginosa PA01
cgccggucgggca

SEQ ID NO: 1442117 - RNA, 17 nt, Pseudomonas aeruginosa PA01
cgccggucucgauggca

SEQ ID NO: 1442118 - RNA, 22 nt, Pseudomonas aeruginosa PA01
cgccggucucgauggcagccuu

SEQ ID NO: 1442119 - RNA, 17 nt, Pseudomonas aeruginosa PA01
cgccggucucggcgaug

SEQ ID NO: 1442120 - RNA, 15 nt, Pseudomonas aeruginosa PA01
cgccgggcaacgcca

SEQ ID NO: 1442121 - RNA, 17 nt, Pseudomonas aeruginosa PA01
cgccgggcaacgccagg

SEQ ID NO: 1442122 - RNA, 18 nt, Pseudomonas aeruginosa PA01
cgccgggcaacgccaggc

SEQ ID NO: 1442123 - RNA, 19 nt, Pseudomonas aeruginosa PA01
cgccgggcaacgccaggcc

SEQ ID NO: 1442124 - RNA, 21 nt, Pseudomonas aeruginosa PA01
cgccgggcaacgccaggccgc

SEQ ID NO: 1442125 - RNA, 19 nt, Pseudomonas aeruginosa PA01
cgccgggauuguugcggcg

SEQ ID NO: 1442126 - RNA, 15 nt, Pseudomonas aeruginosa PA01
cgccgggaagcaccg

SEQ ID NO: 1442127 - RNA, 13 nt, Pseudomonas aeruginosa PA01
cgccgggacccug

SEQ ID NO: 1442128 - RNA, 18 nt, Pseudomonas aeruginosa PA01
cgccgggacccugguagu

SEQ ID NO: 1442129 - RNA, 18 nt, Pseudomonas aeruginosa PA01
cgccgggagcggccgugc

SEQ ID NO: 1442130 - RNA, 16 nt, Pseudomonas aeruginosa PA01
cgccgggaucaccucg

SEQ ID NO: 1442131 - RNA, 22 nt, Pseudomonas aeruginosa PA01
cgccgggcaugaaaaaacccgc

SEQ ID NO: 1442132 - RNA, 20 nt, Pseudomonas aeruginosa PA01
cgccgguugcgucucagcgg

SEQ ID NO: 1442133 - RNA, 13 nt, Pseudomonas aeruginosa PA01
cgccgucaccagc

SEQ ID NO: 1442134 - RNA, 20 nt, Pseudomonas aeruginosa PA01
cgccgucaccagcagccccg

SEQ ID NO: 1442135 - RNA, 21 nt, Pseudomonas aeruginosa PA01
cgccgucaccagcagccccga

SEQ ID NO: 1442136 - RNA, 21 nt, Pseudomonas aeruginosa PA01
cgccgguucaguucagccggu

SEQ ID NO: 1442137 - RNA, 23 nt, Pseudomonas aeruginosa PA01
cgccgguucaguucagccgguac

SEQ ID NO: 1442138 - RNA, 21 nt, Pseudomonas aeruginosa PA01
cgccgguucgcaggccaggcg

SEQ ID NO: 1442139 - RNA, 15 nt, Pseudomonas aeruginosa PA01
cgccgguggccaggc

SEQ ID NO: 1442140 - RNA, 21 nt, Pseudomonas aeruginosa PA01
cgccgucgcggccaucggcga

SEQ ID NO: 1442141 - RNA, 14 nt, Pseudomonas aeruginosa PA01
cgccgucgcuggcg

SEQ ID NO: 1442142 - RNA, 16 nt, Pseudomonas aeruginosa PA01
cgccguccgcgaugcg

SEQ ID NO: 1442143 - RNA, 17 nt, Pseudomonas aeruginosa PA01
cgccguccgcgaugcgu

SEQ ID NO: 1442144 - RNA, 23 nt, Pseudomonas aeruginosa PA01
cgccguccuggagaacguugccc

SEQ ID NO: 1442145 - RNA, 14 nt, Pseudomonas aeruginosa PA01
cgccguccugugga

SEQ ID NO: 1442146 - RNA, 18 nt, Pseudomonas aeruginosa PA01
cgccguccuugucgcagc

SEQ ID NO: 1442147 - RNA, 13 nt, Pseudomonas aeruginosa PA01
cgccgucggcggu

SEQ ID NO: 1442148 - RNA, 15 nt, Pseudomonas aeruginosa PA01
cgccgucggcgguca

SEQ ID NO: 1442149 - RNA, 16 nt, Pseudomonas aeruginosa PA01
cgccgucuccgccgcu

SEQ ID NO: 1442150 - RNA, 14 nt, Pseudomonas aeruginosa PA01
cgccgucguccggg

SEQ ID NO: 1442151 - RNA, 13 nt, Pseudomonas aeruginosa PA01
cgccgucucguag

SEQ ID NO: 1442152 - RNA, 18 nt, Pseudomonas aeruginosa PA01
cgccgucuuccucgaagg

SEQ ID NO: 1442153 - RNA, 15 nt, Pseudomonas aeruginosa PA01
cgccgucuugccgcu

SEQ ID NO: 1442154 - RNA, 24 nt, Pseudomonas aeruginosa PA01
cgccgucuugccgcugcgcgcagu

SEQ ID NO: 1442155 - RNA, 16 nt, Pseudomonas aeruginosa PA01
cgccgucuuauucgac

SEQ ID NO: 1442156 - RNA, 17 nt, Pseudomonas aeruginosa PA01
cgccgucuuauucgacg

SEQ ID NO: 1442157 - RNA, 14 nt, Pseudomonas aeruginosa PA01
cgccgucuuccacc

SEQ ID NO: 1442158 - RNA, 17 nt, Pseudomonas aeruginosa PA01
cgccguggaucgcccgg

SEQ ID NO: 1442159 - RNA, 18 nt, Pseudomonas aeruginosa PA01
cgccguggaucgcccggc

SEQ ID NO: 1442160 - RNA, 14 nt, Pseudomonas aeruginosa PA01
cgccguggaugucg

SEQ ID NO: 1442161 - RNA, 14 nt, Pseudomonas aeruginosa PA01
cgccgugcggcguu

SEQ ID NO: 1442162 - RNA, 17 nt, Pseudomonas aeruginosa PA01
cgccgugcggcguucgc

SEQ ID NO: 1442163 - RNA, 20 nt, Pseudomonas aeruginosa PA01
cgccgugcuugugguagugg

SEQ ID NO: 1442164 - RNA, 19 nt, Pseudomonas aeruginosa PA01
cgccgugggaacgcgagga

SEQ ID NO: 1442165 - RNA, 21 nt, Pseudomonas aeruginosa PA01
cgccgugggaacgcgaggaga

SEQ ID NO: 1442166 - RNA, 17 nt, Pseudomonas aeruginosa PA01
cgccgugggaguccagg

SEQ ID NO: 1442167 - RNA, 20 nt, Pseudomonas aeruginosa PA01
cgccgugggaguccagguac

SEQ ID NO: 1442168 - RNA, 20 nt, Pseudomonas aeruginosa PA01
cgccgugguggccguggcgc

SEQ ID NO: 1442169 - RNA, 13 nt, Pseudomonas aeruginosa PA01
cgccgugacgagg

SEQ ID NO: 1442170 - RNA, 16 nt, Pseudomonas aeruginosa PA01
cgccgugacgaggggc

SEQ ID NO: 1442171 - RNA, 17 nt, Pseudomonas aeruginosa PA01
cgccgugaggcgcgcgc

SEQ ID NO: 1442172 - RNA, 21 nt, Pseudomonas aeruginosa PA01
cgccgugaggcgcgcgccgaa

SEQ ID NO: 1442173 - RNA, 15 nt, Pseudomonas aeruginosa PA01
cgccgugcgcuccgc

SEQ ID NO: 1442174 - RNA, 23 nt, Pseudomonas aeruginosa PA01
cgccgugcgcuccgccaggccgc

SEQ ID NO: 1442175 - RNA, 17 nt, Pseudomonas aeruginosa PA01
cgccgugcaucaccggc

SEQ ID NO: 1442176 - RNA, 20 nt, Pseudomonas aeruginosa PA01
cgccgugcaucaccggcagc

SEQ ID NO: 1442177 - RNA, 22 nt, Pseudomonas aeruginosa PA01
cgccgugcaucaccggcagcag

SEQ ID NO: 1442178 - RNA, 16 nt, Pseudomonas aeruginosa PA01
cgccgugcagggucag

SEQ ID NO: 1442179 - RNA, 19 nt, Pseudomonas aeruginosa PA01
cgccucuaugaaccggggc

SEQ ID NO: 1442180 - RNA, 12 nt, Pseudomonas aeruginosa PA01
cgccugcagcuc

SEQ ID NO: 1442181 - RNA, 13 nt, Pseudomonas aeruginosa PA01
cgccugcagcucg

SEQ ID NO: 1442182 - RNA, 17 nt, Pseudomonas aeruginosa PA01
cgccugcaggaaggcuu

SEQ ID NO: 1442183 - RNA, 13 nt, Pseudomonas aeruginosa PA01
cgccucuucgcag

SEQ ID NO: 1442184 - RNA, 13 nt, Pseudomonas aeruginosa PA01
cgccugccagacc

SEQ ID NO: 1442185 - RNA, 20 nt, Pseudomonas aeruginosa PA01
cgccugccagaccguggcgc

SEQ ID NO: 1442186 - RNA, 19 nt, Pseudomonas aeruginosa PA01
cgccugcaggucgaggcgc

SEQ ID NO: 1442187 - RNA, 13 nt, Pseudomonas aeruginosa PA01
cgccugccaggcg

SEQ ID NO: 1442188 - RNA, 16 nt, Pseudomonas aeruginosa PA01
cgccugccaggcgggg

SEQ ID NO: 1442189 - RNA, 17 nt, Pseudomonas aeruginosa PA01
cgccugccaggcgggga

SEQ ID NO: 1442190 - RNA, 18 nt, Pseudomonas aeruginosa PA01
cgccugccaggcggggau

SEQ ID NO: 1442191 - RNA, 18 nt, Pseudomonas aeruginosa PA01
cgccucggcaucgaccag

SEQ ID NO: 1442192 - RNA, 22 nt, Pseudomonas aeruginosa PA01
cgccucggcaucgaccagggcc

SEQ ID NO: 1442193 - RNA, 12 nt, Pseudomonas aeruginosa PA01
cgccucggcauc

SEQ ID NO: 1442194 - RNA, 16 nt, Pseudomonas aeruginosa PA01
cgccucggcccuggcg

SEQ ID NO: 1442195 - RNA, 17 nt, Pseudomonas aeruginosa PA01
cgccucggagaacagca

SEQ ID NO: 1442196 - RNA, 18 nt, Pseudomonas aeruginosa PA01
cgccucggagaacagcag

SEQ ID NO: 1442197 - RNA, 23 nt, Pseudomonas aeruginosa PA01
cgccucggagaacagcagcggca

SEQ ID NO: 1442198 - RNA, 12 nt, Pseudomonas aeruginosa PA01
cgccucggcggc

SEQ ID NO: 1442199 - RNA, 11 nt, Pseudomonas aeruginosa PA01
cgccucggcgg

SEQ ID NO: 1442200 - RNA, 17 nt, Pseudomonas aeruginosa PA01
cgccucggcgcgauccu

SEQ ID NO: 1442201 - RNA, 13 nt, Pseudomonas aeruginosa PA01
cgccucggcgcgc

SEQ ID NO: 1442202 - RNA, 17 nt, Pseudomonas aeruginosa PA01
cgccucggcgcgcgccc

SEQ ID NO: 1442203 - RNA, 17 nt, Pseudomonas aeruginosa PA01
cgccucggcgcaguagu

SEQ ID NO: 1442204 - RNA, 12 nt, Pseudomonas aeruginosa PA01
cgccucuuccug

SEQ ID NO: 1442205 - RNA, 17 nt, Pseudomonas aeruginosa PA01
cgccucguggaacagcg

SEQ ID NO: 1442206 - RNA, 17 nt, Pseudomonas aeruginosa PA01
cgccucguucagcagca

SEQ ID NO: 1442207 - RNA, 22 nt, Pseudomonas aeruginosa PA01
cgccucguucgucgccgacugc

SEQ ID NO: 1442208 - RNA, 15 nt, Pseudomonas aeruginosa PA01
cgccuccaccagcgc

SEQ ID NO: 1442209 - RNA, 16 nt, Pseudomonas aeruginosa PA01
cgccuccaccagcgcc

SEQ ID NO: 1442210 - RNA, 15 nt, Pseudomonas aeruginosa PA01
cgccucgaucgccuc

SEQ ID NO: 1442211 - RNA, 20 nt, Pseudomonas aeruginosa PA01
cgccucgaucuucuuccccg

SEQ ID NO: 1442212 - RNA, 16 nt, Pseudomonas aeruginosa PA01
cgccucgcagagcgcc

SEQ ID NO: 1442213 - RNA, 22 nt, Pseudomonas aeruginosa PA01
cgccucgcagagcgccagccag

SEQ ID NO: 1442214 - RNA, 23 nt, Pseudomonas aeruginosa PA01
cgccucgcagagcgccagccagc

SEQ ID NO: 1442215 - RNA, 23 nt, Pseudomonas aeruginosa PA01
cgccucgcgcaacgccgacggcg

SEQ ID NO: 1442216 - RNA, 22 nt, Pseudomonas aeruginosa PA01
cgccucgcgcaacugcucgaac

SEQ ID NO: 1442217 - RNA, 20 nt, Pseudomonas aeruginosa PA01
cgccucgcuagucuuccugc

SEQ ID NO: 1442218 - RNA, 19 nt, Pseudomonas aeruginosa PA01
cgccucgcugagcaccggg

SEQ ID NO: 1442219 - RNA, 13 nt, Pseudomonas aeruginosa PA01
cgccucgcugggc

SEQ ID NO: 1442220 - RNA, 22 nt, Pseudomonas aeruginosa PA01
cgccucgcugggcgggcguccg

SEQ ID NO: 1442221 - RNA, 21 nt, Pseudomonas aeruginosa PA01
cgccucgcggaccucgggcag

SEQ ID NO: 1442222 - RNA, 15 nt, Pseudomonas aeruginosa PA01
cgccucgccgagcau

SEQ ID NO: 1442223 - RNA, 15 nt, Pseudomonas aeruginosa PA01
cgccucgccgcggca

SEQ ID NO: 1442224 - RNA, 12 nt, Pseudomonas aeruginosa PA01
cgccucgcgcca

SEQ ID NO: 1442225 - RNA, 14 nt, Pseudomonas aeruginosa PA01
cgccucgcgccaga

SEQ ID NO: 1442226 - RNA, 15 nt, Pseudomonas aeruginosa PA01
cgccucgcgccagag

SEQ ID NO: 1442227 - RNA, 22 nt, Pseudomonas aeruginosa PA01
cgccucgcgccagagaucgccc

SEQ ID NO: 1442228 - RNA, 14 nt, Pseudomonas aeruginosa PA01
cgccucgcgccgcg

SEQ ID NO: 1442229 - RNA, 15 nt, Pseudomonas aeruginosa PA01
cgccucgcgccgcgc

SEQ ID NO: 1442230 - RNA, 16 nt, Pseudomonas aeruginosa PA01
cgccucgcgccgcgcc

SEQ ID NO: 1442231 - RNA, 17 nt, Pseudomonas aeruginosa PA01
cgccucgcgccgcgcca

SEQ ID NO: 1442232 - RNA, 14 nt, Pseudomonas aeruginosa PA01
cgccucgcgccguc

SEQ ID NO: 1442233 - RNA, 20 nt, Pseudomonas aeruginosa PA01
cgccucacggucgcaggggc

SEQ ID NO: 1442234 - RNA, 20 nt, Pseudomonas aeruginosa PA01
cgccucagcggccuucgacg

SEQ ID NO: 1442235 - RNA, 24 nt, Pseudomonas aeruginosa PA01
cgccucagcggccuucgacgaugc

SEQ ID NO: 1442236 - RNA, 13 nt, Pseudomonas aeruginosa PA01
cgccucagcggcu

SEQ ID NO: 1442237 - RNA, 16 nt, Pseudomonas aeruginosa PA01
cgccucagcggcuggc

SEQ ID NO: 1442238 - RNA, 17 nt, Pseudomonas aeruginosa PA01
cgccucagcggcuggcg

SEQ ID NO: 1442239 - RNA, 18 nt, Pseudomonas aeruginosa PA01
cgccucagcggcuggcga

SEQ ID NO: 1442240 - RNA, 12 nt, Pseudomonas aeruginosa PA01
cgccucaggccg

SEQ ID NO: 1442241 - RNA, 13 nt, Pseudomonas aeruginosa PA01
cgccucaggccgg

SEQ ID NO: 1442242 - RNA, 15 nt, Pseudomonas aeruginosa PA01
cgccuauccacgacg

SEQ ID NO: 1442243 - RNA, 22 nt, Pseudomonas aeruginosa PA01
cgccuauccacgacgucggcgg

SEQ ID NO: 1442244 - RNA, 23 nt, Pseudomonas aeruginosa PA01
cgccuauccgugacgucggcggc

SEQ ID NO: 1442245 - RNA, 20 nt, Pseudomonas aeruginosa PA01
cgccuagacccugggccaac

SEQ ID NO: 1442246 - RNA, 21 nt, Pseudomonas aeruginosa PA01
cgccuagacccugggccaacg

SEQ ID NO: 1442247 - RNA, 13 nt, Pseudomonas aeruginosa PA01
cgccuaccggggc

SEQ ID NO: 1442248 - RNA, 15 nt, Pseudomonas aeruginosa PA01
cgccuaccggggcgc

SEQ ID NO: 1442249 - RNA, 21 nt, Pseudomonas aeruginosa PA01
cgccuaccggggcgcgggcga

SEQ ID NO: 1442250 - RNA, 18 nt, Pseudomonas aeruginosa PA01
cgccguucacgccuggcg

SEQ ID NO: 1442251 - RNA, 16 nt, Pseudomonas aeruginosa PA01
cgccguuacgccggau

SEQ ID NO: 1442252 - RNA, 21 nt, Pseudomonas aeruginosa PA01
cgccguguugaugccgaucag

SEQ ID NO: 1442253 - RNA, 17 nt, Pseudomonas aeruginosa PA01
cgccguucucauugcgc

SEQ ID NO: 1442254 - RNA, 14 nt, Pseudomonas aeruginosa PA01
cgccguucucgauc

SEQ ID NO: 1442255 - RNA, 17 nt, Pseudomonas aeruginosa PA01
cgccguucucgaucaac

SEQ ID NO: 1442256 - RNA, 12 nt, Pseudomonas aeruginosa PA01
cgccguucgccc

SEQ ID NO: 1442257 - RNA, 17 nt, Pseudomonas aeruginosa PA01
cgccguuccuccucgcc

SEQ ID NO: 1442258 - RNA, 18 nt, Pseudomonas aeruginosa PA01
cgccguuccuccucgccg

SEQ ID NO: 1442259 - RNA, 20 nt, Pseudomonas aeruginosa PA01
cgccguuccuccucgccgcc

SEQ ID NO: 1442260 - RNA, 21 nt, Pseudomonas aeruginosa PA01
cgccguuccuccucgccgccg

SEQ ID NO: 1442261 - RNA, 22 nt, Pseudomonas aeruginosa PA01
cgccguuccuccucgccgccga

SEQ ID NO: 1442262 - RNA, 23 nt, Pseudomonas aeruginosa PA01
cgccguugccgguacucgccggg

SEQ ID NO: 1442263 - RNA, 14 nt, Pseudomonas aeruginosa PA01
cgccguugccgaug

SEQ ID NO: 1442264 - RNA, 17 nt, Pseudomonas aeruginosa PA01
cgccguugccgaugccg

SEQ ID NO: 1442265 - RNA, 23 nt, Pseudomonas aeruginosa PA01
cgccguucuuguugagcuggccg

SEQ ID NO: 1442266 - RNA, 17 nt, Pseudomonas aeruginosa PA01
cgccguugaugacgaac

SEQ ID NO: 1442267 - RNA, 22 nt, Pseudomonas aeruginosa PA01
cgccguugaugacgaacugcac

SEQ ID NO: 1442268 - RNA, 24 nt, Pseudomonas aeruginosa PA01
cgccguugaugacgaacugcacgc

SEQ ID NO: 1442269 - RNA, 18 nt, Pseudomonas aeruginosa PA01
cgccguugacgaucagga

SEQ ID NO: 1442270 - RNA, 14 nt, Pseudomonas aeruginosa PA01
cgccguuggccuuc

SEQ ID NO: 1442271 - RNA, 14 nt, Pseudomonas aeruginosa PA01
cgccguuggcgagg

SEQ ID NO: 1442272 - RNA, 17 nt, Pseudomonas aeruginosa PA01
cgccguuggcgaggacu

SEQ ID NO: 1442273 - RNA, 20 nt, Pseudomonas aeruginosa PA01
cgccguugcggcagcauccg

SEQ ID NO: 1442274 - RNA, 21 nt, Pseudomonas aeruginosa PA01
cgccguuguucaggcgcgcgg

SEQ ID NO: 1442275 - RNA, 15 nt, Pseudomonas aeruginosa PA01
cgccuaccggcgccg

SEQ ID NO: 1442276 - RNA, 15 nt, Pseudomonas aeruginosa PA01
cgccuaccagaccgc

SEQ ID NO: 1442277 - RNA, 20 nt, Pseudomonas aeruginosa PA01
aacacguagcgcaggucgcu

SEQ ID NO: 1442278 - RNA, 15 nt, Pseudomonas aeruginosa PA01
cgccggagcugguca

SEQ ID NO: 1442279 - RNA, 20 nt, Pseudomonas aeruginosa PA01
cgccggauuucacggcggau

SEQ ID NO: 1442280 - RNA, 15 nt, Pseudomonas aeruginosa PA01
cgccggcaacagcag

SEQ ID NO: 1442281 - RNA, 17 nt, Pseudomonas aeruginosa PA01
cgccggcaacagcagca

SEQ ID NO: 1442282 - RNA, 18 nt, Pseudomonas aeruginosa PA01
cgccggcaccgaggagaa

SEQ ID NO: 1442283 - RNA, 20 nt, Pseudomonas aeruginosa PA01
cgccggcaucgccauggcgc

SEQ ID NO: 1442284 - RNA, 11 nt, Pseudomonas aeruginosa PA01
cgccggcaucc

SEQ ID NO: 1442285 - RNA, 17 nt, Pseudomonas aeruginosa PA01
cgccggcaucguggcca

SEQ ID NO: 1442286 - RNA, 22 nt, Pseudomonas aeruginosa PA01
cgccggcaucguggccaugggu

SEQ ID NO: 1442287 - RNA, 19 nt, Pseudomonas aeruginosa PA01
cgccggcauuggcacccug

SEQ ID NO: 1442288 - RNA, 15 nt, Pseudomonas aeruginosa PA01
cgccggccaccagca

SEQ ID NO: 1442289 - RNA, 18 nt, Pseudomonas aeruginosa PA01
cgccggccaccagcagca

SEQ ID NO: 1442290 - RNA, 14 nt, Pseudomonas aeruginosa PA01
cgccggccagccgc

SEQ ID NO: 1442291 - RNA, 16 nt, Pseudomonas aeruginosa PA01
cgccggccagccgcgc

SEQ ID NO: 1442292 - RNA, 13 nt, Pseudomonas aeruginosa PA01
cgccggccaggug

SEQ ID NO: 1442293 - RNA, 14 nt, Pseudomonas aeruginosa PA01
cgccggccaggugg

SEQ ID NO: 1442294 - RNA, 14 nt, Pseudomonas aeruginosa PA01
cgccggccaggggc

SEQ ID NO: 1442295 - RNA, 19 nt, Pseudomonas aeruginosa PA01
cgccggccagguagcggcg

SEQ ID NO: 1442296 - RNA, 20 nt, Pseudomonas aeruginosa PA01
cgccggccagguagcggcgu

SEQ ID NO: 1442297 - RNA, 18 nt, Pseudomonas aeruginosa PA01
cgccggagacuucagcgc

SEQ ID NO: 1442298 - RNA, 19 nt, Pseudomonas aeruginosa PA01
cgccggagacuucagcgca

SEQ ID NO: 1442299 - RNA, 20 nt, Pseudomonas aeruginosa PA01
cgccggauuagcucagucgg

SEQ ID NO: 1442300 - RNA, 15 nt, Pseudomonas aeruginosa PA01
cgccggacccugccg

SEQ ID NO: 1442301 - RNA, 16 nt, Pseudomonas aeruginosa PA01
cgccggacccugccgu

SEQ ID NO: 1442302 - RNA, 17 nt, Pseudomonas aeruginosa PA01
cgccggacgcaccagca

SEQ ID NO: 1442303 - RNA, 18 nt, Pseudomonas aeruginosa PA01
cgccggacgcaccagcag

SEQ ID NO: 1442304 - RNA, 22 nt, Pseudomonas aeruginosa PA01
cgccggacgcaccagcaggccg

SEQ ID NO: 1442305 - RNA, 24 nt, Pseudomonas aeruginosa PA01
cgccggacgcaccagcaggccgau

SEQ ID NO: 1442306 - RNA, 18 nt, Pseudomonas aeruginosa PA01
cgccgcuugagaccuucg

SEQ ID NO: 1442307 - RNA, 20 nt, Pseudomonas aeruginosa PA01
cgccgcuugagaccuucgcg

SEQ ID NO: 1442308 - RNA, 13 nt, Pseudomonas aeruginosa PA01
cgccgcuucgcgg

SEQ ID NO: 1442309 - RNA, 23 nt, Pseudomonas aeruginosa PA01
cgccgcgugggcuucgccgccgc

SEQ ID NO: 1442310 - RNA, 16 nt, Pseudomonas aeruginosa PA01
cgccgcugucguccag

SEQ ID NO: 1442311 - RNA, 18 nt, Pseudomonas aeruginosa PA01
cgccgcugucguccagcg

SEQ ID NO: 1442312 - RNA, 22 nt, Pseudomonas aeruginosa PA01
cgccgcugucuaucugcgccga

SEQ ID NO: 1442313 - RNA, 12 nt, Pseudomonas aeruginosa PA01
cgccgcuuccgc

SEQ ID NO: 1442314 - RNA, 15 nt, Pseudomonas aeruginosa PA01
cgccgcuuccgccag

SEQ ID NO: 1442315 - RNA, 16 nt, Pseudomonas aeruginosa PA01
cgccgcuuccgccagg

SEQ ID NO: 1442316 - RNA, 17 nt, Pseudomonas aeruginosa PA01
cgccgcuuccgccaggc

SEQ ID NO: 1442317 - RNA, 18 nt, Pseudomonas aeruginosa PA01
cgccgcuuccgccaggcg

SEQ ID NO: 1442318 - RNA, 20 nt, Pseudomonas aeruginosa PA01
cgccgcuuccgccaggcgca

SEQ ID NO: 1442319 - RNA, 15 nt, Pseudomonas aeruginosa PA01
cgccgcuuccgccgg

SEQ ID NO: 1442320 - RNA, 17 nt, Pseudomonas aeruginosa PA01
cgccgcuuccgccggcg

SEQ ID NO: 1442321 - RNA, 14 nt, Pseudomonas aeruginosa PA01
cgccggccaugccg

SEQ ID NO: 1442322 - RNA, 22 nt, Pseudomonas aeruginosa PA01
cgccggcccgggucacggucag

SEQ ID NO: 1442323 - RNA, 13 nt, Pseudomonas aeruginosa PA01
cgccggccgcugu

SEQ ID NO: 1442324 - RNA, 14 nt, Pseudomonas aeruginosa PA01
cgccggcgccgauu

SEQ ID NO: 1442325 - RNA, 14 nt, Pseudomonas aeruginosa PA01
cgccggcgcccugc

SEQ ID NO: 1442326 - RNA, 18 nt, Pseudomonas aeruginosa PA01
cgccggcgcccugggcgc

SEQ ID NO: 1442327 - RNA, 21 nt, Pseudomonas aeruginosa PA01
cgccggcggaucagcccgcug

SEQ ID NO: 1442328 - RNA, 15 nt, Pseudomonas aeruginosa PA01
cgccggcgccgccuc

SEQ ID NO: 1442329 - RNA, 20 nt, Pseudomonas aeruginosa PA01
cgccggcgccgccucgggca

SEQ ID NO: 1442330 - RNA, 16 nt, Pseudomonas aeruginosa PA01
cgccggcgccgccggg

SEQ ID NO: 1442331 - RNA, 17 nt, Pseudomonas aeruginosa PA01
cgccggcggccggcgca

SEQ ID NO: 1442332 - RNA, 13 nt, Pseudomonas aeruginosa PA01
cgccggcggccag

SEQ ID NO: 1442333 - RNA, 12 nt, Pseudomonas aeruginosa PA01
cgccggcggcga

SEQ ID NO: 1442334 - RNA, 14 nt, Pseudomonas aeruginosa PA01
cgccggcggcgaug

SEQ ID NO: 1442335 - RNA, 13 nt, Pseudomonas aeruginosa PA01
cgccggcggcgau

SEQ ID NO: 1442336 - RNA, 15 nt, Pseudomonas aeruginosa PA01
cgccggcggcgcguc

SEQ ID NO: 1442337 - RNA, 17 nt, Pseudomonas aeruginosa PA01
cgccggcguuauccgcc

SEQ ID NO: 1442338 - RNA, 20 nt, Pseudomonas aeruginosa PA01
cgccggcguuauccgccgau

SEQ ID NO: 1442339 - RNA, 20 nt, Pseudomonas aeruginosa PA01
cgccggcguucgacgccuug

SEQ ID NO: 1442340 - RNA, 21 nt, Pseudomonas aeruginosa PA01
cgccggcguucgacgccuugc

SEQ ID NO: 1442341 - RNA, 23 nt, Pseudomonas aeruginosa PA01
cgccggcguucgacgccuugccc

SEQ ID NO: 1442342 - RNA, 15 nt, Pseudomonas aeruginosa PA01
cgccggcgugccgac

SEQ ID NO: 1442343 - RNA, 16 nt, Pseudomonas aeruginosa PA01
cgccggcgugccgacc

SEQ ID NO: 1442344 - RNA, 22 nt, Pseudomonas aeruginosa PA01
cgccggcugugcagggcagcgg

SEQ ID NO: 1442345 - RNA, 21 nt, Pseudomonas aeruginosa PA01
cgccggcuuccaccagacgca

SEQ ID NO: 1442346 - RNA, 22 nt, Pseudomonas aeruginosa PA01
cgccggcuuccaccagacgcag

SEQ ID NO: 1442347 - RNA, 16 nt, Pseudomonas aeruginosa PA01
cgccggcugccgcgcg

SEQ ID NO: 1442348 - RNA, 18 nt, Pseudomonas aeruginosa PA01
cgccggcugacgcuggcg

SEQ ID NO: 1442349 - RNA, 20 nt, Pseudomonas aeruginosa PA01
cgccggcugacgcuggcgaa

SEQ ID NO: 1442350 - RNA, 16 nt, Pseudomonas aeruginosa PA01
cgccgggaaacagggc

SEQ ID NO: 1442351 - RNA, 15 nt, Pseudomonas aeruginosa PA01
cgccggcucgugcga

SEQ ID NO: 1442352 - RNA, 11 nt, Pseudomonas aeruginosa PA01
cgccggcucgc

SEQ ID NO: 1442353 - RNA, 15 nt, Pseudomonas aeruginosa PA01
cgccggcucgcccag

SEQ ID NO: 1442354 - RNA, 16 nt, Pseudomonas aeruginosa PA01
cgccggcucgcccagc

SEQ ID NO: 1442355 - RNA, 21 nt, Pseudomonas aeruginosa PA01
cgccggcucgcccagcaggcg

SEQ ID NO: 1442356 - RNA, 20 nt, Pseudomonas aeruginosa PA01
cgccgccgucuugccgcugc

SEQ ID NO: 1442357 - RNA, 14 nt, Pseudomonas aeruginosa PA01
cgccgccgugaucu

SEQ ID NO: 1442358 - RNA, 12 nt, Pseudomonas aeruginosa PA01
cgccgccguggc

SEQ ID NO: 1442359 - RNA, 21 nt, Pseudomonas aeruginosa PA01
cgccgccguggcugugcuggc

SEQ ID NO: 1442360 - RNA, 21 nt, Pseudomonas aeruginosa PA01
cgccgccucgcugggcgggcg

SEQ ID NO: 1442361 - RNA, 13 nt, Pseudomonas aeruginosa PA01
cgccgccucgcgc

SEQ ID NO: 1442362 - RNA, 15 nt, Pseudomonas aeruginosa PA01
cgccgccucgcgcaa

SEQ ID NO: 1442363 - RNA, 22 nt, Pseudomonas aeruginosa PA01
cgccgccucgcgcaacgccuug

SEQ ID NO: 1442364 - RNA, 15 nt, Pseudomonas aeruginosa PA01
cgccgccucgaaggc

SEQ ID NO: 1442365 - RNA, 15 nt, Pseudomonas aeruginosa PA01
cgccgccucgauggc

SEQ ID NO: 1442366 - RNA, 16 nt, Pseudomonas aeruginosa PA01
cgccgccucgauggcg

SEQ ID NO: 1442367 - RNA, 17 nt, Pseudomonas aeruginosa PA01
cgccgccucgauggcgg

SEQ ID NO: 1442368 - RNA, 18 nt, Pseudomonas aeruginosa PA01
cgccgccucgauggcggc

SEQ ID NO: 1442369 - RNA, 19 nt, Pseudomonas aeruginosa PA01
cgccgccucgauggcggca

SEQ ID NO: 1442370 - RNA, 13 nt, Pseudomonas aeruginosa PA01
cgccgcgauggcu

SEQ ID NO: 1442371 - RNA, 18 nt, Pseudomonas aeruginosa PA01
cgccgcgauggcucgcgg

SEQ ID NO: 1442372 - RNA, 13 nt, Pseudomonas aeruginosa PA01
cgccgcgauggua

SEQ ID NO: 1442373 - RNA, 16 nt, Pseudomonas aeruginosa PA01
cgccgccucgggcagc

SEQ ID NO: 1442374 - RNA, 19 nt, Pseudomonas aeruginosa PA01
cgccgcgcaccucgaccgc

SEQ ID NO: 1442375 - RNA, 22 nt, Pseudomonas aeruginosa PA01
cgccgcgcaccucgaccgcgcc

SEQ ID NO: 1442376 - RNA, 23 nt, Pseudomonas aeruginosa PA01
cgccgcgcaagcucgucacccgc

SEQ ID NO: 1442377 - RNA, 14 nt, Pseudomonas aeruginosa PA01
cgccgcgcaccagc

SEQ ID NO: 1442378 - RNA, 15 nt, Pseudomonas aeruginosa PA01
cgccgcgcaccagca

SEQ ID NO: 1442379 - RNA, 16 nt, Pseudomonas aeruginosa PA01
cgccgcgcaccagcac

SEQ ID NO: 1442380 - RNA, 13 nt, Pseudomonas aeruginosa PA01
cgccgcgcacguc

SEQ ID NO: 1442381 - RNA, 18 nt, Pseudomonas aeruginosa PA01
cgccgcgcacgucgaggu

SEQ ID NO: 1442382 - RNA, 15 nt, Pseudomonas aeruginosa PA01
cgccgcgcagcgcgg

SEQ ID NO: 1442383 - RNA, 22 nt, Pseudomonas aeruginosa PA01
cgccgcgcagcgcggcgcuggg

SEQ ID NO: 1442384 - RNA, 15 nt, Pseudomonas aeruginosa PA01
cgccgcgccagcagg

SEQ ID NO: 1442385 - RNA, 16 nt, Pseudomonas aeruginosa PA01
cgccgcgccagcaggc

SEQ ID NO: 1442386 - RNA, 17 nt, Pseudomonas aeruginosa PA01
cgccgcgccagcaggcg

SEQ ID NO: 1442387 - RNA, 20 nt, Pseudomonas aeruginosa PA01
cgccgcgccagcaggcgcag

SEQ ID NO: 1442388 - RNA, 13 nt, Pseudomonas aeruginosa PA01
cgccgcgcaggcg

SEQ ID NO: 1442389 - RNA, 14 nt, Pseudomonas aeruginosa PA01
cgccgcgcaggcgg

SEQ ID NO: 1442390 - RNA, 20 nt, Pseudomonas aeruginosa PA01
cgccgcgcaguucguccauc

SEQ ID NO: 1442391 - RNA, 18 nt, Pseudomonas aeruginosa PA01
cgccgcgcaucaccccgc

SEQ ID NO: 1442392 - RNA, 15 nt, Pseudomonas aeruginosa PA01
cgccgcgcauccucg

SEQ ID NO: 1442393 - RNA, 15 nt, Pseudomonas aeruginosa PA01
cgccgcgccaacugg

SEQ ID NO: 1442394 - RNA, 11 nt, Pseudomonas aeruginosa PA01
cgccgccgggc

SEQ ID NO: 1442395 - RNA, 15 nt, Pseudomonas aeruginosa PA01
cgccgccgcugcguc

SEQ ID NO: 1442396 - RNA, 12 nt, Pseudomonas aeruginosa PA01
cgccgccgcugg

SEQ ID NO: 1442397 - RNA, 16 nt, Pseudomonas aeruginosa PA01
cgccgccgcgccggcg

SEQ ID NO: 1442398 - RNA, 17 nt, Pseudomonas aeruginosa PA01
cgccgccgggcgcgcgc

SEQ ID NO: 1442399 - RNA, 13 nt, Pseudomonas aeruginosa PA01
cgccgccgggcgu

SEQ ID NO: 1442400 - RNA, 21 nt, Pseudomonas aeruginosa PA01
cgccgccggggcgggccgcgc

SEQ ID NO: 1442401 - RNA, 20 nt, Pseudomonas aeruginosa PA01
cgccgccggugcaccaggcg

SEQ ID NO: 1442402 - RNA, 21 nt, Pseudomonas aeruginosa PA01
cgccgaugucguagccgcgcg

SEQ ID NO: 1442403 - RNA, 12 nt, Pseudomonas aeruginosa PA01
cgccgccgccga

SEQ ID NO: 1442404 - RNA, 13 nt, Pseudomonas aeruginosa PA01
cgccgccgccggg

SEQ ID NO: 1442405 - RNA, 14 nt, Pseudomonas aeruginosa PA01
cgccgccgccggga

SEQ ID NO: 1442406 - RNA, 19 nt, Pseudomonas aeruginosa PA01
cgccgaugcgccgacgcca

SEQ ID NO: 1442407 - RNA, 15 nt, Pseudomonas aeruginosa PA01
cgccgaugcuguuca

SEQ ID NO: 1442408 - RNA, 15 nt, Pseudomonas aeruginosa PA01
cgccgaugccggccg

SEQ ID NO: 1442409 - RNA, 19 nt, Pseudomonas aeruginosa PA01
cgccgcggugucggcgauu

SEQ ID NO: 1442410 - RNA, 12 nt, Pseudomonas aeruginosa PA01
cgccgcgugcgc

SEQ ID NO: 1442411 - RNA, 17 nt, Pseudomonas aeruginosa PA01
cgccgcgugcgcgcccu

SEQ ID NO: 1442412 - RNA, 14 nt, Pseudomonas aeruginosa PA01
cgccgcgucgucgg

SEQ ID NO: 1442413 - RNA, 15 nt, Pseudomonas aeruginosa PA01
cgccgcgucgucggc

SEQ ID NO: 1442414 - RNA, 18 nt, Pseudomonas aeruginosa PA01
cgccgcgucgucggcgac

SEQ ID NO: 1442415 - RNA, 19 nt, Pseudomonas aeruginosa PA01
cgccgcgucgucggcgacg

SEQ ID NO: 1442416 - RNA, 22 nt, Pseudomonas aeruginosa PA01
cgccgcgucgaagcugucggcc

SEQ ID NO: 1442417 - RNA, 18 nt, Pseudomonas aeruginosa PA01
cgccgcgucgccgccagc

SEQ ID NO: 1442418 - RNA, 19 nt, Pseudomonas aeruginosa PA01
cgccgcgucgccgccagcg

SEQ ID NO: 1442419 - RNA, 12 nt, Pseudomonas aeruginosa PA01
cgccgcgggacg

SEQ ID NO: 1442420 - RNA, 18 nt, Pseudomonas aeruginosa PA01
cgccgcgggacgccgcag

SEQ ID NO: 1442421 - RNA, 15 nt, Pseudomonas aeruginosa PA01
cgccgcgggcaaccg

SEQ ID NO: 1442422 - RNA, 16 nt, Pseudomonas aeruginosa PA01
cgccgcgggcaaccgc

SEQ ID NO: 1442423 - RNA, 17 nt, Pseudomonas aeruginosa PA01
cgccgcgggcaaccgcg

SEQ ID NO: 1442424 - RNA, 20 nt, Pseudomonas aeruginosa PA01
cgccgcgggcaaccgcggcg

SEQ ID NO: 1442425 - RNA, 22 nt, Pseudomonas aeruginosa PA01
cgccgcgggcaaccgcggcggc

SEQ ID NO: 1442426 - RNA, 13 nt, Pseudomonas aeruginosa PA01
cgccgcggcugau

SEQ ID NO: 1442427 - RNA, 17 nt, Pseudomonas aeruginosa PA01
cgccgcggcugaugccg

SEQ ID NO: 1442428 - RNA, 20 nt, Pseudomonas aeruginosa PA01
cgccgcggcugaugccgcgg

SEQ ID NO: 1442429 - RNA, 14 nt, Pseudomonas aeruginosa PA01
cgccgcggcuggcc

SEQ ID NO: 1442430 - RNA, 22 nt, Pseudomonas aeruginosa PA01
cgccgcggcggcggacagcgga

SEQ ID NO: 1442431 - RNA, 14 nt, Pseudomonas aeruginosa PA01
cgccgcggcggcgu

SEQ ID NO: 1442432 - RNA, 13 nt, Pseudomonas aeruginosa PA01
cgccgcggcguag

SEQ ID NO: 1442433 - RNA, 16 nt, Pseudomonas aeruginosa PA01
cgccgcggcguaggcg

SEQ ID NO: 1442434 - RNA, 16 nt, Pseudomonas aeruginosa PA01
cgccgcggcguugcgc

SEQ ID NO: 1442435 - RNA, 12 nt, Pseudomonas aeruginosa PA01
cgccgcgggcgc

SEQ ID NO: 1442436 - RNA, 17 nt, Pseudomonas aeruginosa PA01
cgccgcgggcguugcgc

SEQ ID NO: 1442437 - RNA, 21 nt, Pseudomonas aeruginosa PA01
cgccgcgggccagccguucgc

SEQ ID NO: 1442438 - RNA, 15 nt, Pseudomonas aeruginosa PA01
cgccgcgggcgaacg

SEQ ID NO: 1442439 - RNA, 20 nt, Pseudomonas aeruginosa PA01
cgccgcgggcgaacggcagc

SEQ ID NO: 1442440 - RNA, 21 nt, Pseudomonas aeruginosa PA01
cgccgcgggcgaacggcagcg

SEQ ID NO: 1442441 - RNA, 19 nt, Pseudomonas aeruginosa PA01
cgccgcgggucaccagcgc

SEQ ID NO: 1442442 - RNA, 23 nt, Pseudomonas aeruginosa PA01
cgccgcgggucaccagcgccggg

SEQ ID NO: 1442443 - RNA, 15 nt, Pseudomonas aeruginosa PA01
cgccgcgggucugcu

SEQ ID NO: 1442444 - RNA, 21 nt, Pseudomonas aeruginosa PA01
cgccgcgggucugcucggcgc

SEQ ID NO: 1442445 - RNA, 17 nt, Pseudomonas aeruginosa PA01
cgccgcggucgaugucg

SEQ ID NO: 1442446 - RNA, 13 nt, Pseudomonas aeruginosa PA01
cgccgcggcccgg

SEQ ID NO: 1442447 - RNA, 13 nt, Pseudomonas aeruginosa PA01
cgccgcggccggc

SEQ ID NO: 1442448 - RNA, 12 nt, Pseudomonas aeruginosa PA01
cgccgcggccgg

SEQ ID NO: 1442449 - RNA, 14 nt, Pseudomonas aeruginosa PA01
cgccgcggcgaaca

SEQ ID NO: 1442450 - RNA, 13 nt, Pseudomonas aeruginosa PA01
cgccgcggcgaag

SEQ ID NO: 1442451 - RNA, 15 nt, Pseudomonas aeruginosa PA01
cgccgcggcgaagcg

SEQ ID NO: 1442452 - RNA, 18 nt, Pseudomonas aeruginosa PA01
cgccgcggcgaagcgcuc

SEQ ID NO: 1442453 - RNA, 20 nt, Pseudomonas aeruginosa PA01
cgccgcggcgaagcgcucga

SEQ ID NO: 1442454 - RNA, 17 nt, Pseudomonas aeruginosa PA01
cgccgcggcgaccagcg

SEQ ID NO: 1442455 - RNA, 13 nt, Pseudomonas aeruginosa PA01
cgccgcggcggcg

SEQ ID NO: 1442456 - RNA, 12 nt, Pseudomonas aeruginosa PA01
cgccgcggcggc

SEQ ID NO: 1442457 - RNA, 15 nt, Pseudomonas aeruginosa PA01
cgccgcggccggcga

SEQ ID NO: 1442458 - RNA, 13 nt, Pseudomonas aeruginosa PA01
cgccgcggcgacc

SEQ ID NO: 1442459 - RNA, 12 nt, Pseudomonas aeruginosa PA01
cgccgcggcgag

SEQ ID NO: 1442460 - RNA, 13 nt, Pseudomonas aeruginosa PA01
cgccgcggcgagc

SEQ ID NO: 1442461 - RNA, 15 nt, Pseudomonas aeruginosa PA01
cgccgcggcgagcau

SEQ ID NO: 1442462 - RNA, 22 nt, Pseudomonas aeruginosa PA01
cgccgcggcgagcaucucggcc

SEQ ID NO: 1442463 - RNA, 16 nt, Pseudomonas aeruginosa PA01
cgccgcgcggucgagc

SEQ ID NO: 1442464 - RNA, 16 nt, Pseudomonas aeruginosa PA01
cgccgcgcggcaacac

SEQ ID NO: 1442465 - RNA, 21 nt, Pseudomonas aeruginosa PA01
cgccgcgcguucgcgcgaggc

SEQ ID NO: 1442466 - RNA, 22 nt, Pseudomonas aeruginosa PA01
cgccgcggccagcccccucgcc

SEQ ID NO: 1442467 - RNA, 15 nt, Pseudomonas aeruginosa PA01
cgccgcgcugcaagg

SEQ ID NO: 1442468 - RNA, 15 nt, Pseudomonas aeruginosa PA01
cgccgcgcugcaggc

SEQ ID NO: 1442469 - RNA, 16 nt, Pseudomonas aeruginosa PA01
cgccgcgcugcaggcg

SEQ ID NO: 1442470 - RNA, 13 nt, Pseudomonas aeruginosa PA01
cgccgcgcugcau

SEQ ID NO: 1442471 - RNA, 18 nt, Pseudomonas aeruginosa PA01
cgccgcgcugcgccaggc

SEQ ID NO: 1442472 - RNA, 15 nt, Pseudomonas aeruginosa PA01
cgccgcgcugcgugg

SEQ ID NO: 1442473 - RNA, 14 nt, Pseudomonas aeruginosa PA01
cgccgcgcucgcgc

SEQ ID NO: 1442474 - RNA, 12 nt, Pseudomonas aeruginosa PA01
cgccgcgcucgc

SEQ ID NO: 1442475 - RNA, 20 nt, Pseudomonas aeruginosa PA01
cgcgggaggccgccucgacc

SEQ ID NO: 1442476 - RNA, 17 nt, Pseudomonas aeruginosa PA01
cgcgggacgccgcagga

SEQ ID NO: 1442477 - RNA, 14 nt, Pseudomonas aeruginosa PA01
cgcgggacgcggcg

SEQ ID NO: 1442478 - RNA, 12 nt, Pseudomonas aeruginosa PA01
cgcgggaacggc

SEQ ID NO: 1442479 - RNA, 20 nt, Pseudomonas aeruginosa PA01
cgcgggacuuguacucgccg

SEQ ID NO: 1442480 - RNA, 18 nt, Pseudomonas aeruginosa PA01
cgcgggcaugcaccuacc

SEQ ID NO: 1442481 - RNA, 14 nt, Pseudomonas aeruginosa PA01
cgcgggccagccgu

SEQ ID NO: 1442482 - RNA, 13 nt, Pseudomonas aeruginosa PA01
cgcgggccgacgg

SEQ ID NO: 1442483 - RNA, 13 nt, Pseudomonas aeruginosa PA01
cgcgggccaggcc

SEQ ID NO: 1442484 - RNA, 15 nt, Pseudomonas aeruginosa PA01
cgcgggccaggcccu

SEQ ID NO: 1442485 - RNA, 14 nt, Pseudomonas aeruginosa PA01
cgcgggccaggccg

SEQ ID NO: 1442486 - RNA, 19 nt, Pseudomonas aeruginosa PA01
cgcggcguuagccgccugc

SEQ ID NO: 1442487 - RNA, 15 nt, Pseudomonas aeruginosa PA01
cgcggcguucaucgc

SEQ ID NO: 1442488 - RNA, 21 nt, Pseudomonas aeruginosa PA01
cgcggcguucaucgcucaugu

SEQ ID NO: 1442489 - RNA, 14 nt, Pseudomonas aeruginosa PA01
cgcggcguucgccc

SEQ ID NO: 1442490 - RNA, 15 nt, Pseudomonas aeruginosa PA01
cgcggcguucgcccu

SEQ ID NO: 1442491 - RNA, 23 nt, Pseudomonas aeruginosa PA01
cgcggcguggccggcgaccagcu

SEQ ID NO: 1442492 - RNA, 14 nt, Pseudomonas aeruginosa PA01
cgcggcguggcgga

SEQ ID NO: 1442493 - RNA, 19 nt, Pseudomonas aeruginosa PA01
cgcggcuuucuuccagcac

SEQ ID NO: 1442494 - RNA, 16 nt, Pseudomonas aeruginosa PA01
cgcggcguugucggcc

SEQ ID NO: 1442495 - RNA, 17 nt, Pseudomonas aeruginosa PA01
cgcggcguugucggcca

SEQ ID NO: 1442496 - RNA, 18 nt, Pseudomonas aeruginosa PA01
cgcggcguugucggccag

SEQ ID NO: 1442497 - RNA, 17 nt, Pseudomonas aeruginosa PA01
cgcggcggacaggcagc

SEQ ID NO: 1442498 - RNA, 20 nt, Pseudomonas aeruginosa PA01
cgcggcggacaggcagccgg

SEQ ID NO: 1442499 - RNA, 13 nt, Pseudomonas aeruginosa PA01
cgcggcggcgugc

SEQ ID NO: 1442500 - RNA, 20 nt, Pseudomonas aeruginosa PA01
cgcggcggcgugcaggccga

SEQ ID NO: 1442501 - RNA, 15 nt, Pseudomonas aeruginosa PA01
cgcggcgcuuggcga

SEQ ID NO: 1442502 - RNA, 16 nt, Pseudomonas aeruginosa PA01
cgcggcgcuuggcgaa

SEQ ID NO: 1442503 - RNA, 23 nt, Pseudomonas aeruginosa PA01
cgcggcggauaacgcccgcggcg

SEQ ID NO: 1442504 - RNA, 23 nt, Pseudomonas aeruginosa PA01
cgcggcggaugccggcgcugucu

SEQ ID NO: 1442505 - RNA, 23 nt, Pseudomonas aeruginosa PA01
cgcggcggcuccggcgccaggcc

SEQ ID NO: 1442506 - RNA, 22 nt, Pseudomonas aeruginosa PA01
cgcggcggguggcgcugucgcc

SEQ ID NO: 1442507 - RNA, 19 nt, Pseudomonas aeruginosa PA01
aacagcaccgagcaggcac

SEQ ID NO: 1442508 - RNA, 15 nt, Pseudomonas aeruginosa PA01
cgcggcgccugcugc

SEQ ID NO: 1442509 - RNA, 21 nt, Pseudomonas aeruginosa PA01
cgcggcgccuucagcgccgcc

SEQ ID NO: 1442510 - RNA, 13 nt, Pseudomonas aeruginosa PA01
cgcggcgcgagau

SEQ ID NO: 1442511 - RNA, 21 nt, Pseudomonas aeruginosa PA01
cgcggcgcgagaugaagcgcc

SEQ ID NO: 1442512 - RNA, 18 nt, Pseudomonas aeruginosa PA01
cgcggcgcgauauccgcc

SEQ ID NO: 1442513 - RNA, 21 nt, Pseudomonas aeruginosa PA01
cgcggcgcgauauccgccagg

SEQ ID NO: 1442514 - RNA, 14 nt, Pseudomonas aeruginosa PA01
cgcggcgcucgagg

SEQ ID NO: 1442515 - RNA, 14 nt, Pseudomonas aeruginosa PA01
cgcggcgcucggca

SEQ ID NO: 1442516 - RNA, 19 nt, Pseudomonas aeruginosa PA01
cgcggcgcucggcaucgac

SEQ ID NO: 1442517 - RNA, 21 nt, Pseudomonas aeruginosa PA01
cgcggcgcucggcaucgacca

SEQ ID NO: 1442518 - RNA, 20 nt, Pseudomonas aeruginosa PA01
cgcggcgcggacauggcgcu

SEQ ID NO: 1442519 - RNA, 15 nt, Pseudomonas aeruginosa PA01
cgcggcgcguuccgg

SEQ ID NO: 1442520 - RNA, 13 nt, Pseudomonas aeruginosa PA01
cgcggacccgcgc

SEQ ID NO: 1442521 - RNA, 15 nt, Pseudomonas aeruginosa PA01
cgcggacccgcgccg

SEQ ID NO: 1442522 - RNA, 16 nt, Pseudomonas aeruginosa PA01
cgcggacccgcgccgg

SEQ ID NO: 1442523 - RNA, 17 nt, Pseudomonas aeruginosa PA01
cgcggacccgcgccggc

SEQ ID NO: 1442524 - RNA, 17 nt, Pseudomonas aeruginosa PA01
cgcggaccacgucccag

SEQ ID NO: 1442525 - RNA, 18 nt, Pseudomonas aeruginosa PA01
cgcggaccacgucccagu

SEQ ID NO: 1442526 - RNA, 15 nt, Pseudomonas aeruginosa PA01
cgcggaccuccagcc

SEQ ID NO: 1442527 - RNA, 19 nt, Pseudomonas aeruginosa PA01
cgcggaccuccagccggcc

SEQ ID NO: 1442528 - RNA, 23 nt, Pseudomonas aeruginosa PA01
cgcggaccuccagccggccaucc

SEQ ID NO: 1442529 - RNA, 17 nt, Pseudomonas aeruginosa PA01
cgcggaccucgggcagc

SEQ ID NO: 1442530 - RNA, 23 nt, Pseudomonas aeruginosa PA01
cgcggaccucgggcagcuuggcg

SEQ ID NO: 1442531 - RNA, 23 nt, Pseudomonas aeruginosa PA01
cgcggaccucugcguucugcugc

SEQ ID NO: 1442532 - RNA, 18 nt, Pseudomonas aeruginosa PA01
cgcggaccuucgacggca

SEQ ID NO: 1442533 - RNA, 22 nt, Pseudomonas aeruginosa PA01
cgcggaccuucgacggcaggug

SEQ ID NO: 1442534 - RNA, 20 nt, Pseudomonas aeruginosa PA01
cgcggaccgaaggcaacagc

SEQ ID NO: 1442535 - RNA, 14 nt, Pseudomonas aeruginosa PA01
cgcggcccggcgcu

SEQ ID NO: 1442536 - RNA, 21 nt, Pseudomonas aeruginosa PA01
cgcggcccggcgcugcccggg

SEQ ID NO: 1442537 - RNA, 18 nt, Pseudomonas aeruginosa PA01
cgcggcccugcgccgcag

SEQ ID NO: 1442538 - RNA, 20 nt, Pseudomonas aeruginosa PA01
cgcggcccugcgccgcagcg

SEQ ID NO: 1442539 - RNA, 22 nt, Pseudomonas aeruginosa PA01
cgcggcccugcgccgcagcggc

SEQ ID NO: 1442540 - RNA, 18 nt, Pseudomonas aeruginosa PA01
cgcggcccugcucgccgg

SEQ ID NO: 1442541 - RNA, 23 nt, Pseudomonas aeruginosa PA01
cgcggcccugcucgccggcgcgg

SEQ ID NO: 1442542 - RNA, 14 nt, Pseudomonas aeruginosa PA01
cgcggcccguccgc

SEQ ID NO: 1442543 - RNA, 16 nt, Pseudomonas aeruginosa PA01
cgcggcccguccgcgc

SEQ ID NO: 1442544 - RNA, 11 nt, Pseudomonas aeruginosa PA01
cgcggccggca

SEQ ID NO: 1442545 - RNA, 17 nt, Pseudomonas aeruginosa PA01
cgcggccggcaggccga

SEQ ID NO: 1442546 - RNA, 22 nt, Pseudomonas aeruginosa PA01
cgcggccggcaggccgauggcc

SEQ ID NO: 1442547 - RNA, 15 nt, Pseudomonas aeruginosa PA01
cgcggccggcgccgc

SEQ ID NO: 1442548 - RNA, 13 nt, Pseudomonas aeruginosa PA01
cgcggcgccccag

SEQ ID NO: 1442549 - RNA, 14 nt, Pseudomonas aeruginosa PA01
cgcggcgaugcgca

SEQ ID NO: 1442550 - RNA, 23 nt, Pseudomonas aeruginosa PA01
cgcggcgaugcgcaugcgcagcg

SEQ ID NO: 1442551 - RNA, 18 nt, Pseudomonas aeruginosa PA01
cgcggcgcccucugccgg

SEQ ID NO: 1442552 - RNA, 24 nt, Pseudomonas aeruginosa PA01
cgcggcgcccucugccggucggaa

SEQ ID NO: 1442553 - RNA, 13 nt, Pseudomonas aeruginosa PA01
cgcggcgcccugc

SEQ ID NO: 1442554 - RNA, 12 nt, Pseudomonas aeruginosa PA01
cgcggcgcccuc

SEQ ID NO: 1442555 - RNA, 23 nt, Pseudomonas aeruginosa PA01
aacagcaccuuggccaugggcac

SEQ ID NO: 1442556 - RNA, 13 nt, Pseudomonas aeruginosa PA01
cgcggccggggaa

SEQ ID NO: 1442557 - RNA, 14 nt, Pseudomonas aeruginosa PA01
cgcggcgaguugcg

SEQ ID NO: 1442558 - RNA, 20 nt, Pseudomonas aeruginosa PA01
cgcggcgaguugcgcgaggc

SEQ ID NO: 1442559 - RNA, 14 nt, Pseudomonas aeruginosa PA01
cgcggccucgcugg

SEQ ID NO: 1442560 - RNA, 16 nt, Pseudomonas aeruginosa PA01
cgcggccucgcuggcg

SEQ ID NO: 1442561 - RNA, 14 nt, Pseudomonas aeruginosa PA01
cgcggcgagggcgc

SEQ ID NO: 1442562 - RNA, 18 nt, Pseudomonas aeruginosa PA01
cgcggcgagcagcggcgc

SEQ ID NO: 1442563 - RNA, 20 nt, Pseudomonas aeruginosa PA01
cgcggcgagcaucucggcca

SEQ ID NO: 1442564 - RNA, 19 nt, Pseudomonas aeruginosa PA01
cgcgggcgugcuccagcac

SEQ ID NO: 1442565 - RNA, 21 nt, Pseudomonas aeruginosa PA01
cgcgggcgugcuccagcaccg

SEQ ID NO: 1442566 - RNA, 19 nt, Pseudomonas aeruginosa PA01
cgcgggcuauucccgccgc

SEQ ID NO: 1442567 - RNA, 14 nt, Pseudomonas aeruginosa PA01
cgcgggccggcgau

SEQ ID NO: 1442568 - RNA, 18 nt, Pseudomonas aeruginosa PA01
cgcgggccggcgauggcc

SEQ ID NO: 1442569 - RNA, 22 nt, Pseudomonas aeruginosa PA01
cgcgggccuucaggcugcgcgc

SEQ ID NO: 1442570 - RNA, 19 nt, Pseudomonas aeruginosa PA01
cgcgggccgccuggucggg

SEQ ID NO: 1442571 - RNA, 15 nt, Pseudomonas aeruginosa PA01
cgcgggccgcggcga

SEQ ID NO: 1442572 - RNA, 18 nt, Pseudomonas aeruginosa PA01
cgcgggccgcggcgacca

SEQ ID NO: 1442573 - RNA, 13 nt, Pseudomonas aeruginosa PA01
cgcggggcgaggu

SEQ ID NO: 1442574 - RNA, 17 nt, Pseudomonas aeruginosa PA01
cgcgggggcucggucga

SEQ ID NO: 1442575 - RNA, 19 nt, Pseudomonas aeruginosa PA01
cgcgggggcucggucgagc

SEQ ID NO: 1442576 - RNA, 19 nt, Pseudomonas aeruginosa PA01
cgcgggguagggguggcca

SEQ ID NO: 1442577 - RNA, 21 nt, Pseudomonas aeruginosa PA01
cgcgggguagggguggccagg

SEQ ID NO: 1442578 - RNA, 16 nt, Pseudomonas aeruginosa PA01
cgcggggucuggccgg

SEQ ID NO: 1442579 - RNA, 19 nt, Pseudomonas aeruginosa PA01
cgcggggucuggccggcga

SEQ ID NO: 1442580 - RNA, 22 nt, Pseudomonas aeruginosa PA01
cgcgggggucggaugcagcgcu

SEQ ID NO: 1442581 - RNA, 19 nt, Pseudomonas aeruginosa PA01
aacagccguuugugaaagg

SEQ ID NO: 1442582 - RNA, 18 nt, Pseudomonas aeruginosa PA01
cgcgggucuugcgcaggg

SEQ ID NO: 1442583 - RNA, 16 nt, Pseudomonas aeruginosa PA01
cgcgggucguccucca

SEQ ID NO: 1442584 - RNA, 19 nt, Pseudomonas aeruginosa PA01
cgcgggucuucaggccgca

SEQ ID NO: 1442585 - RNA, 19 nt, Pseudomonas aeruginosa PA01
cgcggguaucgauccagcc

SEQ ID NO: 1442586 - RNA, 21 nt, Pseudomonas aeruginosa PA01
cgcggguaucgauccagccgg

SEQ ID NO: 1442587 - RNA, 16 nt, Pseudomonas aeruginosa PA01
cgcgggucaccaccgg

SEQ ID NO: 1442588 - RNA, 16 nt, Pseudomonas aeruginosa PA01
cgcgggucaccagcgc

SEQ ID NO: 1442589 - RNA, 19 nt, Pseudomonas aeruginosa PA01
cgcgggucucgaucagcgc

SEQ ID NO: 1442590 - RNA, 20 nt, Pseudomonas aeruginosa PA01
cgcgggucucgaucagcgcc

SEQ ID NO: 1442591 - RNA, 18 nt, Pseudomonas aeruginosa PA01
cgcgggucugcgccucgc

SEQ ID NO: 1442592 - RNA, 13 nt, Pseudomonas aeruginosa PA01
cgcgggucugcuc

SEQ ID NO: 1442593 - RNA, 15 nt, Pseudomonas aeruginosa PA01
cgcgggucugcucgc

SEQ ID NO: 1442594 - RNA, 16 nt, Pseudomonas aeruginosa PA01
cgcgggucugcucggc

SEQ ID NO: 1442595 - RNA, 17 nt, Pseudomonas aeruginosa PA01
cgcggguggcaaccgac

SEQ ID NO: 1442596 - RNA, 18 nt, Pseudomonas aeruginosa PA01
cgcggguaccgcaaugac

SEQ ID NO: 1442597 - RNA, 18 nt, Pseudomonas aeruginosa PA01
aacagcggcuggcccucg

SEQ ID NO: 1442598 - RNA, 22 nt, Pseudomonas aeruginosa PA01
aacagcgggucgcggcuggccg

SEQ ID NO: 1442599 - RNA, 21 nt, Pseudomonas aeruginosa PA01
aacagcggugugcucaggcga

SEQ ID NO: 1442600 - RNA, 13 nt, Pseudomonas aeruginosa PA01
aacagcgcggcgg

SEQ ID NO: 1442601 - RNA, 15 nt, Pseudomonas aeruginosa PA01
aacagcgccgcggcu

SEQ ID NO: 1442602 - RNA, 12 nt, Pseudomonas aeruginosa PA01
aacagcgccgga

SEQ ID NO: 1442603 - RNA, 13 nt, Pseudomonas aeruginosa PA01
aacagcgccggaa

SEQ ID NO: 1442604 - RNA, 15 nt, Pseudomonas aeruginosa PA01
aacaggacccagcca

SEQ ID NO: 1442605 - RNA, 18 nt, Pseudomonas aeruginosa PA01
cgcgggucguacaccgcg

SEQ ID NO: 1442606 - RNA, 19 nt, Pseudomonas aeruginosa PA01
cgcgggucguacaccgcgc

SEQ ID NO: 1442607 - RNA, 15 nt, Pseudomonas aeruginosa PA01
cgcguacaucccgcc

SEQ ID NO: 1442608 - RNA, 16 nt, Pseudomonas aeruginosa PA01
cgcguacaucccgccg

SEQ ID NO: 1442609 - RNA, 16 nt, Pseudomonas aeruginosa PA01
cgcguaauaggcgaag

SEQ ID NO: 1442610 - RNA, 14 nt, Pseudomonas aeruginosa PA01
cgcgguuucgcagc

SEQ ID NO: 1442611 - RNA, 15 nt, Pseudomonas aeruginosa PA01
cgcgguuucgcagcg

SEQ ID NO: 1442612 - RNA, 16 nt, Pseudomonas aeruginosa PA01
cgcgguuggcgccucg

SEQ ID NO: 1442613 - RNA, 22 nt, Pseudomonas aeruginosa PA01
cgcgguucugcuccuggguccg

SEQ ID NO: 1442614 - RNA, 19 nt, Pseudomonas aeruginosa PA01
cgcgguugccgcugcggcg

SEQ ID NO: 1442615 - RNA, 14 nt, Pseudomonas aeruginosa PA01
cgcgguugcgcugc

SEQ ID NO: 1442616 - RNA, 17 nt, Pseudomonas aeruginosa PA01
cgcgguuauccgccggc

SEQ ID NO: 1442617 - RNA, 18 nt, Pseudomonas aeruginosa PA01
cgcgguuauccgccggcu

SEQ ID NO: 1442618 - RNA, 21 nt, Pseudomonas aeruginosa PA01
cgcgguuccacucccaugcca

SEQ ID NO: 1442619 - RNA, 14 nt, Pseudomonas aeruginosa PA01
cgcgguuccagcuc

SEQ ID NO: 1442620 - RNA, 14 nt, Pseudomonas aeruginosa PA01
cgcggugucggcga

SEQ ID NO: 1442621 - RNA, 22 nt, Pseudomonas aeruginosa PA01
cgcggugucggugcccucgcgg

SEQ ID NO: 1442622 - RNA, 14 nt, Pseudomonas aeruginosa PA01
cgcggucggugagc

SEQ ID NO: 1442623 - RNA, 20 nt, Pseudomonas aeruginosa PA01
cgcggucggugagcacgccg

SEQ ID NO: 1442624 - RNA, 13 nt, Pseudomonas aeruginosa PA01
cgcggugccgugg

SEQ ID NO: 1442625 - RNA, 20 nt, Pseudomonas aeruginosa PA01
cgcggugccgugggucgccu

SEQ ID NO: 1442626 - RNA, 23 nt, Pseudomonas aeruginosa PA01
cgcggugccgugggucgccucga

SEQ ID NO: 1442627 - RNA, 19 nt, Pseudomonas aeruginosa PA01
cgcggucgaugucgcggcc

SEQ ID NO: 1442628 - RNA, 19 nt, Pseudomonas aeruginosa PA01
cgcggucgagcucggccag

SEQ ID NO: 1442629 - RNA, 14 nt, Pseudomonas aeruginosa PA01
cgcggucacucggc

SEQ ID NO: 1442630 - RNA, 21 nt, Pseudomonas aeruginosa PA01
cgcggucacucggccucggcg

SEQ ID NO: 1442631 - RNA, 22 nt, Pseudomonas aeruginosa PA01
cgcggucacccauucgaugccg

SEQ ID NO: 1442632 - RNA, 19 nt, Pseudomonas aeruginosa PA01
cgcgguagggaucgucgcc

SEQ ID NO: 1442633 - RNA, 19 nt, Pseudomonas aeruginosa PA01
cgcgguagcugcgcagggc

SEQ ID NO: 1442634 - RNA, 20 nt, Pseudomonas aeruginosa PA01
cgcgguagcugcgcagggcg

SEQ ID NO: 1442635 - RNA, 20 nt, Pseudomonas aeruginosa PA01
cgcucguagaacucgcccuc

SEQ ID NO: 1442636 - RNA, 21 nt, Pseudomonas aeruginosa PA01
cgcucguagaacucgcccucg

SEQ ID NO: 1442637 - RNA, 22 nt, Pseudomonas aeruginosa PA01
cgcucguagaacucgcccucga

SEQ ID NO: 1442638 - RNA, 17 nt, Pseudomonas aeruginosa PA01
cgcucguagagcuugcu

SEQ ID NO: 1442639 - RNA, 14 nt, Pseudomonas aeruginosa PA01
cgcucgucaggcgc

SEQ ID NO: 1442640 - RNA, 20 nt, Pseudomonas aeruginosa PA01
cgcucgucauggcgcacgcc

SEQ ID NO: 1442641 - RNA, 14 nt, Pseudomonas aeruginosa PA01
cgcucguagccggc

SEQ ID NO: 1442642 - RNA, 18 nt, Pseudomonas aeruginosa PA01
cgcucguagccggcgcgg

SEQ ID NO: 1442643 - RNA, 19 nt, Pseudomonas aeruginosa PA01
cgcucguagccggcgcggc

SEQ ID NO: 1442644 - RNA, 22 nt, Pseudomonas aeruginosa PA01
cgcucguagccggcgcggcgca

SEQ ID NO: 1442645 - RNA, 13 nt, Pseudomonas aeruginosa PA01
cgcucgucgagga

SEQ ID NO: 1442646 - RNA, 16 nt, Pseudomonas aeruginosa PA01
cgcucguuggcggcca

SEQ ID NO: 1442647 - RNA, 15 nt, Pseudomonas aeruginosa PA01
cgcucguugauccgc

SEQ ID NO: 1442648 - RNA, 20 nt, Pseudomonas aeruginosa PA01
cgcucguugauccgcguggc

SEQ ID NO: 1442649 - RNA, 16 nt, Pseudomonas aeruginosa PA01
cgcucggcgucgucga

SEQ ID NO: 1442650 - RNA, 20 nt, Pseudomonas aeruginosa PA01
cgcucggcuccagccaggcc

SEQ ID NO: 1442651 - RNA, 15 nt, Pseudomonas aeruginosa PA01
cgcucggcguagccg

SEQ ID NO: 1442652 - RNA, 18 nt, Pseudomonas aeruginosa PA01
cgcucggcguagccggcg

SEQ ID NO: 1442653 - RNA, 19 nt, Pseudomonas aeruginosa PA01
cgcucggcguagccggcga

SEQ ID NO: 1442654 - RNA, 21 nt, Pseudomonas aeruginosa PA01
cgcucggcguagccggcgauc

SEQ ID NO: 1442655 - RNA, 22 nt, Pseudomonas aeruginosa PA01
cgcucggcggucaggccaagcu

SEQ ID NO: 1442656 - RNA, 19 nt, Pseudomonas aeruginosa PA01
cgcucggcggcgcgcagcg

SEQ ID NO: 1442657 - RNA, 12 nt, Pseudomonas aeruginosa PA01
cgcucggcggcg

SEQ ID NO: 1442658 - RNA, 18 nt, Pseudomonas aeruginosa PA01
cgcucggcggccucgcgg

SEQ ID NO: 1442659 - RNA, 19 nt, Pseudomonas aeruginosa PA01
cgcucggcggccucgcggg

SEQ ID NO: 1442660 - RNA, 15 nt, Pseudomonas aeruginosa PA01
cgcucggucagcucc

SEQ ID NO: 1442661 - RNA, 14 nt, Pseudomonas aeruginosa PA01
cgcucggcuucgcg

SEQ ID NO: 1442662 - RNA, 16 nt, Pseudomonas aeruginosa PA01
cgcucggcuucgcguu

SEQ ID NO: 1442663 - RNA, 18 nt, Pseudomonas aeruginosa PA01
cgcucggggauguccgcc

SEQ ID NO: 1442664 - RNA, 20 nt, Pseudomonas aeruginosa PA01
cgcucggggauguccgccgc

SEQ ID NO: 1442665 - RNA, 23 nt, Pseudomonas aeruginosa PA01
cgcucggggauguccgccgccca

SEQ ID NO: 1442666 - RNA, 18 nt, Pseudomonas aeruginosa PA01
cgcucggggugcgcggcg

SEQ ID NO: 1442667 - RNA, 19 nt, Pseudomonas aeruginosa PA01
cgcucggggugcgcggcga

SEQ ID NO: 1442668 - RNA, 20 nt, Pseudomonas aeruginosa PA01
cgcucggggugcgcggcgaa

SEQ ID NO: 1442669 - RNA, 17 nt, Pseudomonas aeruginosa PA01
cgcugaccagcccggcg

SEQ ID NO: 1442670 - RNA, 20 nt, Pseudomonas aeruginosa PA01
cgcugaccagcccggcggcg

SEQ ID NO: 1442671 - RNA, 21 nt, Pseudomonas aeruginosa PA01
cgcugaccagcccggcggcgg

SEQ ID NO: 1442672 - RNA, 17 nt, Pseudomonas aeruginosa PA01
cgcugacccagcgcacg

SEQ ID NO: 1442673 - RNA, 21 nt, Pseudomonas aeruginosa PA01
cgcugacccaggcuucggcgc

SEQ ID NO: 1442674 - RNA, 16 nt, Pseudomonas aeruginosa PA01
cgcugaaguccuggcc

SEQ ID NO: 1442675 - RNA, 18 nt, Pseudomonas aeruginosa PA01
cgcugaagaucgccacga

SEQ ID NO: 1442676 - RNA, 20 nt, Pseudomonas aeruginosa PA01
cgcugaagcggccgagaucc

SEQ ID NO: 1442677 - RNA, 21 nt, Pseudomonas aeruginosa PA01
cgcugaaggacugugccugga

SEQ ID NO: 1442678 - RNA, 14 nt, Pseudomonas aeruginosa PA01
cgcugaaggcggug

SEQ ID NO: 1442679 - RNA, 15 nt, Pseudomonas aeruginosa PA01
cgcugaacagcuggc

SEQ ID NO: 1442680 - RNA, 16 nt, Pseudomonas aeruginosa PA01
cgcugaacagcuggcg

SEQ ID NO: 1442681 - RNA, 21 nt, Pseudomonas aeruginosa PA01
cgcugaaccgcgucaugcucu

SEQ ID NO: 1442682 - RNA, 20 nt, Pseudomonas aeruginosa PA01
cgcugaaauagcgcgucauc

SEQ ID NO: 1442683 - RNA, 12 nt, Pseudomonas aeruginosa PA01
cgcugaaaucgg

SEQ ID NO: 1442684 - RNA, 19 nt, Pseudomonas aeruginosa PA01
cgcucuucugguaggccag

SEQ ID NO: 1442685 - RNA, 20 nt, Pseudomonas aeruginosa PA01
cgcucuugauacccaccggc

SEQ ID NO: 1442686 - RNA, 13 nt, Pseudomonas aeruginosa PA01
cgcucuucgccgc

SEQ ID NO: 1442687 - RNA, 18 nt, Pseudomonas aeruginosa PA01
cgcucuguuucgggucgc

SEQ ID NO: 1442688 - RNA, 22 nt, Pseudomonas aeruginosa PA01
cgcucuguagggucgcagcagg

SEQ ID NO: 1442689 - RNA, 14 nt, Pseudomonas aeruginosa PA01
cgcucugcgccgcg

SEQ ID NO: 1442690 - RNA, 17 nt, Pseudomonas aeruginosa PA01
cgcucuggcccagcuug

SEQ ID NO: 1442691 - RNA, 15 nt, Pseudomonas aeruginosa PA01
cgcucuggccgcgcu

SEQ ID NO: 1442692 - RNA, 14 nt, Pseudomonas aeruginosa PA01
cgcucuggcgcaua

SEQ ID NO: 1442693 - RNA, 14 nt, Pseudomonas aeruginosa PA01
cgcucugcuggccg

SEQ ID NO: 1442694 - RNA, 18 nt, Pseudomonas aeruginosa PA01
cgcucugcuggccgcccu

SEQ ID NO: 1442695 - RNA, 17 nt, Pseudomonas aeruginosa PA01
cgcucucggugaccacc

SEQ ID NO: 1442696 - RNA, 22 nt, Pseudomonas aeruginosa PA01
cgcucugcaccgucauggugcg

SEQ ID NO: 1442697 - RNA, 14 nt, Pseudomonas aeruginosa PA01
cgcucucgccgccu

SEQ ID NO: 1442698 - RNA, 19 nt, Pseudomonas aeruginosa PA01
cgcucucgaacaccaggcg

SEQ ID NO: 1442699 - RNA, 20 nt, Pseudomonas aeruginosa PA01
cgcucucgaacaccaggcgc

SEQ ID NO: 1442700 - RNA, 17 nt, Pseudomonas aeruginosa PA01
cgcucucgaacaccggc

SEQ ID NO: 1442701 - RNA, 14 nt, Pseudomonas aeruginosa PA01
cgcucucgaacagc

SEQ ID NO: 1442702 - RNA, 17 nt, Pseudomonas aeruginosa PA01
cgcucucgaacagcagc

SEQ ID NO: 1442703 - RNA, 18 nt, Pseudomonas aeruginosa PA01
cgcucucgaacagcagca

SEQ ID NO: 1442704 - RNA, 21 nt, Pseudomonas aeruginosa PA01
cgcucucgaacagcagcaagc

SEQ ID NO: 1442705 - RNA, 19 nt, Pseudomonas aeruginosa PA01
cgcucggcgaggccggcga

SEQ ID NO: 1442706 - RNA, 23 nt, Pseudomonas aeruginosa PA01
cgcucggcgaggccggcgaucag

SEQ ID NO: 1442707 - RNA, 14 nt, Pseudomonas aeruginosa PA01
cgcucggcgagccg

SEQ ID NO: 1442708 - RNA, 13 nt, Pseudomonas aeruginosa PA01
cgcucggccuugu

SEQ ID NO: 1442709 - RNA, 12 nt, Pseudomonas aeruginosa PA01
cgcucggccugc

SEQ ID NO: 1442710 - RNA, 13 nt, Pseudomonas aeruginosa PA01
cgcucggccugcg

SEQ ID NO: 1442711 - RNA, 15 nt, Pseudomonas aeruginosa PA01
cgcucggccuuagcg

SEQ ID NO: 1442712 - RNA, 20 nt, Pseudomonas aeruginosa PA01
cgcucggccuugagcgccga

SEQ ID NO: 1442713 - RNA, 12 nt, Pseudomonas aeruginosa PA01
cgcucggccgcc

SEQ ID NO: 1442714 - RNA, 16 nt, Pseudomonas aeruginosa PA01
cgcucggccgccagca

SEQ ID NO: 1442715 - RNA, 17 nt, Pseudomonas aeruginosa PA01
cgcucggccgccuggcg

SEQ ID NO: 1442716 - RNA, 18 nt, Pseudomonas aeruginosa PA01
cgcucggccgccuggcgu

SEQ ID NO: 1442717 - RNA, 12 nt, Pseudomonas aeruginosa PA01
cgcucggccagc

SEQ ID NO: 1442718 - RNA, 15 nt, Pseudomonas aeruginosa PA01
cgcucggccagcguc

SEQ ID NO: 1442719 - RNA, 23 nt, Pseudomonas aeruginosa PA01
cgcucggccagcguccuucggcg

SEQ ID NO: 1442720 - RNA, 16 nt, Pseudomonas aeruginosa PA01
cgcucggccaggucgc

SEQ ID NO: 1442721 - RNA, 23 nt, Pseudomonas aeruginosa PA01
cgcucggccaguucgucgagcau

SEQ ID NO: 1442722 - RNA, 15 nt, Pseudomonas aeruginosa PA01
cgcucggaucaggcg

SEQ ID NO: 1442723 - RNA, 14 nt, Pseudomonas aeruginosa PA01
cgcucgcugcgugc

SEQ ID NO: 1442724 - RNA, 22 nt, Pseudomonas aeruginosa PA01
cgcucgcugucgcucagcgggc

SEQ ID NO: 1442725 - RNA, 16 nt, Pseudomonas aeruginosa PA01
cgcucggacagcuucu

SEQ ID NO: 1442726 - RNA, 21 nt, Pseudomonas aeruginosa PA01
cgcucggauuccagcgcggug

SEQ ID NO: 1442727 - RNA, 20 nt, Pseudomonas aeruginosa PA01
cgcucgccgggucgccgcag

SEQ ID NO: 1442728 - RNA, 16 nt, Pseudomonas aeruginosa PA01
cgcucgccgucaucga

SEQ ID NO: 1442729 - RNA, 15 nt, Pseudomonas aeruginosa PA01
cgcucgcgcacggcg

SEQ ID NO: 1442730 - RNA, 20 nt, Pseudomonas aeruginosa PA01
cgcucgcgcagccacuggcg

SEQ ID NO: 1442731 - RNA, 20 nt, Pseudomonas aeruginosa PA01
cgcucgcccuugcgccgcgg

SEQ ID NO: 1442732 - RNA, 22 nt, Pseudomonas aeruginosa PA01
cgcucgccgggaaucgccagca

SEQ ID NO: 1442733 - RNA, 12 nt, Pseudomonas aeruginosa PA01
cgcucgcggcau

SEQ ID NO: 1442734 - RNA, 14 nt, Pseudomonas aeruginosa PA01
cgcucgcggcaucc

SEQ ID NO: 1442735 - RNA, 16 nt, Pseudomonas aeruginosa PA01
cgcucgcggcaucccg

SEQ ID NO: 1442736 - RNA, 21 nt, Pseudomonas aeruginosa PA01
cgcucgcggcaucccgcccgg

SEQ ID NO: 1442737 - RNA, 12 nt, Pseudomonas aeruginosa PA01
cgcucgcguccg

SEQ ID NO: 1442738 - RNA, 13 nt, Pseudomonas aeruginosa PA01
cgcucgcgggccg

SEQ ID NO: 1442739 - RNA, 21 nt, Pseudomonas aeruginosa PA01
cgcucgcgguuauccgccgcc

SEQ ID NO: 1442740 - RNA, 22 nt, Pseudomonas aeruginosa PA01
cgcucgcgguuauccgccgccg

SEQ ID NO: 1442741 - RNA, 18 nt, Pseudomonas aeruginosa PA01
cgcuccagaccuccaggu

SEQ ID NO: 1442742 - RNA, 13 nt, Pseudomonas aeruginosa PA01
cgcuccagccggc

SEQ ID NO: 1442743 - RNA, 14 nt, Pseudomonas aeruginosa PA01
cgcuccagccggca

SEQ ID NO: 1442744 - RNA, 21 nt, Pseudomonas aeruginosa PA01
cgcuccagccggcaagcgugc

SEQ ID NO: 1442745 - RNA, 11 nt, Pseudomonas aeruginosa PA01
cgcuccagcgc

SEQ ID NO: 1442746 - RNA, 12 nt, Pseudomonas aeruginosa PA01
cgcuccagcgcc

SEQ ID NO: 1442747 - RNA, 13 nt, Pseudomonas aeruginosa PA01
cgcuccagcgccu

SEQ ID NO: 1442748 - RNA, 15 nt, Pseudomonas aeruginosa PA01
cgcuccagcgccucg

SEQ ID NO: 1442749 - RNA, 20 nt, Pseudomonas aeruginosa PA01
cgcuccagcgccucgaccag

SEQ ID NO: 1442750 - RNA, 16 nt, Pseudomonas aeruginosa PA01
cgcuccaccgcccccg

SEQ ID NO: 1442751 - RNA, 17 nt, Pseudomonas aeruginosa PA01
cgcuccaccgcccccgg

SEQ ID NO: 1442752 - RNA, 20 nt, Pseudomonas aeruginosa PA01
cgcuccaccgcccccggcgc

SEQ ID NO: 1442753 - RNA, 16 nt, Pseudomonas aeruginosa PA01
cgcuccaggaucgccu

SEQ ID NO: 1442754 - RNA, 17 nt, Pseudomonas aeruginosa PA01
cgcuccaggaucgccuc

SEQ ID NO: 1442755 - RNA, 17 nt, Pseudomonas aeruginosa PA01
cgcuccaggcccggcag

SEQ ID NO: 1442756 - RNA, 16 nt, Pseudomonas aeruginosa PA01
cgcuccaggcgguagu

SEQ ID NO: 1442757 - RNA, 23 nt, Pseudomonas aeruginosa PA01
cgcuccaggcugugggcgacuuc

SEQ ID NO: 1442758 - RNA, 13 nt, Pseudomonas aeruginosa PA01
cgcuccagggcgc

SEQ ID NO: 1442759 - RNA, 16 nt, Pseudomonas aeruginosa PA01
cgcuccagggcgcuga

SEQ ID NO: 1442760 - RNA, 15 nt, Pseudomonas aeruginosa PA01
cgcucgaccuugccg

SEQ ID NO: 1442761 - RNA, 22 nt, Pseudomonas aeruginosa PA01
cgcucgaccuugccgagcgcga

SEQ ID NO: 1442762 - RNA, 17 nt, Pseudomonas aeruginosa PA01
cgcucgacgaucaggug

SEQ ID NO: 1442763 - RNA, 22 nt, Pseudomonas aeruginosa PA01
cgcucgacgaucaggugcagga

SEQ ID NO: 1442764 - RNA, 18 nt, Pseudomonas aeruginosa PA01
cgcucgaugcccgccagc

SEQ ID NO: 1442765 - RNA, 19 nt, Pseudomonas aeruginosa PA01
cgcucgaugcccgccagca

SEQ ID NO: 1442766 - RNA, 13 nt, Pseudomonas aeruginosa PA01
cgcuccagcccca

SEQ ID NO: 1442767 - RNA, 22 nt, Pseudomonas aeruginosa PA01
cgcucgaucagguagucgcccg

SEQ ID NO: 1442768 - RNA, 19 nt, Pseudomonas aeruginosa PA01
cgcucgauagcguccaggu

SEQ ID NO: 1442769 - RNA, 23 nt, Pseudomonas aeruginosa PA01
cgcucgauagcguccaggugcgg

SEQ ID NO: 1442770 - RNA, 16 nt, Pseudomonas aeruginosa PA01
cgcucgagggcgaccg

SEQ ID NO: 1442771 - RNA, 20 nt, Pseudomonas aeruginosa PA01
cgcucgagccggcugaugcc

SEQ ID NO: 1442772 - RNA, 14 nt, Pseudomonas aeruginosa PA01
cgcucgagcuugag

SEQ ID NO: 1442773 - RNA, 23 nt, Pseudomonas aeruginosa PA01
cgcucgagcuugaggucggccuc

SEQ ID NO: 1442774 - RNA, 16 nt, Pseudomonas aeruginosa PA01
cgcucgccagaugacg

SEQ ID NO: 1442775 - RNA, 17 nt, Pseudomonas aeruginosa PA01
cgcucgcaacgcugucc

SEQ ID NO: 1442776 - RNA, 21 nt, Pseudomonas aeruginosa PA01
cgcgucgcggccucuucgucg

SEQ ID NO: 1442777 - RNA, 13 nt, Pseudomonas aeruginosa PA01
cgcgucgccuucg

SEQ ID NO: 1442778 - RNA, 12 nt, Pseudomonas aeruginosa PA01
cgcgucgcugcg

SEQ ID NO: 1442779 - RNA, 16 nt, Pseudomonas aeruginosa PA01
cgcgucgcugcgcaac

SEQ ID NO: 1442780 - RNA, 14 nt, Pseudomonas aeruginosa PA01
cgcgucguccgagg

SEQ ID NO: 1442781 - RNA, 18 nt, Pseudomonas aeruginosa PA01
cgcgucguccgaggcgga

SEQ ID NO: 1442782 - RNA, 15 nt, Pseudomonas aeruginosa PA01
cgcgucggugccgcc

SEQ ID NO: 1442783 - RNA, 17 nt, Pseudomonas aeruginosa PA01
cgcgucggugccgcccg

SEQ ID NO: 1442784 - RNA, 20 nt, Pseudomonas aeruginosa PA01
cgcgucggugccgcccggcg

SEQ ID NO: 1442785 - RNA, 14 nt, Pseudomonas aeruginosa PA01
cgcgucgucggcga

SEQ ID NO: 1442786 - RNA, 15 nt, Pseudomonas aeruginosa PA01
cgcgucgucggcgac

SEQ ID NO: 1442787 - RNA, 19 nt, Pseudomonas aeruginosa PA01
cgcgucgucggcgacgcug

SEQ ID NO: 1442788 - RNA, 19 nt, Pseudomonas aeruginosa PA01
cgcguagguggcgccgccg

SEQ ID NO: 1442789 - RNA, 21 nt, Pseudomonas aeruginosa PA01
cgcguagguggcgccgccggc

SEQ ID NO: 1442790 - RNA, 22 nt, Pseudomonas aeruginosa PA01
cgcguagguggcgccgccggcg

SEQ ID NO: 1442791 - RNA, 16 nt, Pseudomonas aeruginosa PA01
cgcguaccaguagcga

SEQ ID NO: 1442792 - RNA, 19 nt, Pseudomonas aeruginosa PA01
cgcguaccaguagcgacag

SEQ ID NO: 1442793 - RNA, 14 nt, Pseudomonas aeruginosa PA01
cgcgucgcccaggc

SEQ ID NO: 1442794 - RNA, 17 nt, Pseudomonas aeruginosa PA01
cgcgucgcccaggccgc

SEQ ID NO: 1442795 - RNA, 20 nt, Pseudomonas aeruginosa PA01
cgcgucgcccaggccgcugg

SEQ ID NO: 1442796 - RNA, 12 nt, Pseudomonas aeruginosa PA01
cgcgucgccgcc

SEQ ID NO: 1442797 - RNA, 14 nt, Pseudomonas aeruginosa PA01
cgcgucgccgccag

SEQ ID NO: 1442798 - RNA, 22 nt, Pseudomonas aeruginosa PA01
cgcgugguaucggcgcucaccg

SEQ ID NO: 1442799 - RNA, 23 nt, Pseudomonas aeruginosa PA01
cgcgugguaucggcgcucaccgc

SEQ ID NO: 1442800 - RNA, 16 nt, Pseudomonas aeruginosa PA01
cgcguguucgcggcuc

SEQ ID NO: 1442801 - RNA, 12 nt, Pseudomonas aeruginosa PA01
cgcguggcgucg

SEQ ID NO: 1442802 - RNA, 13 nt, Pseudomonas aeruginosa PA01
cgcguggcgucgg

SEQ ID NO: 1442803 - RNA, 16 nt, Pseudomonas aeruginosa PA01
cgcguggcgucggcgc

SEQ ID NO: 1442804 - RNA, 17 nt, Pseudomonas aeruginosa PA01
cgcguggcgugcucggc

SEQ ID NO: 1442805 - RNA, 13 nt, Pseudomonas aeruginosa PA01
cgcgugggccagg

SEQ ID NO: 1442806 - RNA, 17 nt, Pseudomonas aeruginosa PA01
cgcgugggcuucgccgc

SEQ ID NO: 1442807 - RNA, 19 nt, Pseudomonas aeruginosa PA01
cgcgugggcuucgccgccg

SEQ ID NO: 1442808 - RNA, 22 nt, Pseudomonas aeruginosa PA01
cgcgugggcuucgccgccgcgc

SEQ ID NO: 1442809 - RNA, 13 nt, Pseudomonas aeruginosa PA01
cgcgucuccagcu

SEQ ID NO: 1442810 - RNA, 21 nt, Pseudomonas aeruginosa PA01
cgcgucuccagcucggcgauc

SEQ ID NO: 1442811 - RNA, 23 nt, Pseudomonas aeruginosa PA01
cgcgucugaacgaagaagccggc

SEQ ID NO: 1442812 - RNA, 16 nt, Pseudomonas aeruginosa PA01
cgcgucguccagggcg

SEQ ID NO: 1442813 - RNA, 13 nt, Pseudomonas aeruginosa PA01
cgcguggccgcca

SEQ ID NO: 1442814 - RNA, 15 nt, Pseudomonas aeruginosa PA01
cgcgugaagcuggag

SEQ ID NO: 1442815 - RNA, 15 nt, Pseudomonas aeruginosa PA01
cgcguugcaggcgac

SEQ ID NO: 1442816 - RNA, 16 nt, Pseudomonas aeruginosa PA01
cgcguugcaggcgacg

SEQ ID NO: 1442817 - RNA, 23 nt, Pseudomonas aeruginosa PA01
cgcguugcauguccucggcgccg

SEQ ID NO: 1442818 - RNA, 19 nt, Pseudomonas aeruginosa PA01
cgcguugcgagggcucggg

SEQ ID NO: 1442819 - RNA, 15 nt, Pseudomonas aeruginosa PA01
cgcuacgcggcggga

SEQ ID NO: 1442820 - RNA, 20 nt, Pseudomonas aeruginosa PA01
cgcuacgcggcgggagguca

SEQ ID NO: 1442821 - RNA, 20 nt, Pseudomonas aeruginosa PA01
cgcguucaccguggcgcugg

SEQ ID NO: 1442822 - RNA, 22 nt, Pseudomonas aeruginosa PA01
cgcguucaccguggcgcuggcc

SEQ ID NO: 1442823 - RNA, 14 nt, Pseudomonas aeruginosa PA01
cgcguucagccacg

SEQ ID NO: 1442824 - RNA, 14 nt, Pseudomonas aeruginosa PA01
cgcuagcgcauggc

SEQ ID NO: 1442825 - RNA, 15 nt, Pseudomonas aeruginosa PA01
cgcuacgcucgccga

SEQ ID NO: 1442826 - RNA, 23 nt, Pseudomonas aeruginosa PA01
cgcuacguuccagggccugguag

SEQ ID NO: 1442827 - RNA, 15 nt, Pseudomonas aeruginosa PA01
cgcuacggcaucacc

SEQ ID NO: 1442828 - RNA, 13 nt, Pseudomonas aeruginosa PA01
cgcuauccaccgu

SEQ ID NO: 1442829 - RNA, 18 nt, Pseudomonas aeruginosa PA01
cgcuauccaccgucgcgg

SEQ ID NO: 1442830 - RNA, 21 nt, Pseudomonas aeruginosa PA01
cgcuagucuuccugcacgcug

SEQ ID NO: 1442831 - RNA, 21 nt, Pseudomonas aeruginosa PA01
cgcuauucugauugcguaacg

SEQ ID NO: 1442832 - RNA, 15 nt, Pseudomonas aeruginosa PA01
cgcucaacggcgugc

SEQ ID NO: 1442833 - RNA, 16 nt, Pseudomonas aeruginosa PA01
cgcucaacggcgugcc

SEQ ID NO: 1442834 - RNA, 17 nt, Pseudomonas aeruginosa PA01
cgcuaugggcaccgcgc

SEQ ID NO: 1442835 - RNA, 13 nt, Pseudomonas aeruginosa PA01
cgcuaugcagcag

SEQ ID NO: 1442836 - RNA, 15 nt, Pseudomonas aeruginosa PA01
cgcuaucgccgccgc

SEQ ID NO: 1442837 - RNA, 21 nt, Pseudomonas aeruginosa PA01
cgcuaucgccgccgcagccgu

SEQ ID NO: 1442838 - RNA, 15 nt, Pseudomonas aeruginosa PA01
cgcuaucgcuggcgc

SEQ ID NO: 1442839 - RNA, 14 nt, Pseudomonas aeruginosa PA01
cgcuauccgccgcu

SEQ ID NO: 1442840 - RNA, 21 nt, Pseudomonas aeruginosa PA01
cgcuauccgccgcuacugcgc

SEQ ID NO: 1442841 - RNA, 19 nt, Pseudomonas aeruginosa PA01
cgcuccaacagcagguaga

SEQ ID NO: 1442842 - RNA, 14 nt, Pseudomonas aeruginosa PA01
cgcuccaacgcagg

SEQ ID NO: 1442843 - RNA, 18 nt, Pseudomonas aeruginosa PA01
cgcuccaacgcaggcgca

SEQ ID NO: 1442844 - RNA, 16 nt, Pseudomonas aeruginosa PA01
cgcucauggcgccgcc

SEQ ID NO: 1442845 - RNA, 17 nt, Pseudomonas aeruginosa PA01
cgcucauggcgccgcca

SEQ ID NO: 1442846 - RNA, 23 nt, Pseudomonas aeruginosa PA01
cgcucaugugggcuaccgcaucg

SEQ ID NO: 1442847 - RNA, 20 nt, Pseudomonas aeruginosa PA01
cgcucaugagauccgccagc

SEQ ID NO: 1442848 - RNA, 15 nt, Pseudomonas aeruginosa PA01
cgcucaucugcacca

SEQ ID NO: 1442849 - RNA, 16 nt, Pseudomonas aeruginosa PA01
cgcucaccaccaccgc

SEQ ID NO: 1442850 - RNA, 14 nt, Pseudomonas aeruginosa PA01
cgcucaccaggccc

SEQ ID NO: 1442851 - RNA, 15 nt, Pseudomonas aeruginosa PA01
cgcucagugcgccgg

SEQ ID NO: 1442852 - RNA, 19 nt, Pseudomonas aeruginosa PA01
cgcucagucgaccgucgcc

SEQ ID NO: 1442853 - RNA, 16 nt, Pseudomonas aeruginosa PA01
cgcgccguccaucagg

SEQ ID NO: 1442854 - RNA, 15 nt, Pseudomonas aeruginosa PA01
cgcgccgucgcuggc

SEQ ID NO: 1442855 - RNA, 23 nt, Pseudomonas aeruginosa PA01
cgcgccggugaucgagccgccgg

SEQ ID NO: 1442856 - RNA, 13 nt, Pseudomonas aeruginosa PA01
cgcgccgguggcg

SEQ ID NO: 1442857 - RNA, 18 nt, Pseudomonas aeruginosa PA01
cgcgccgguuucgaccgg

SEQ ID NO: 1442858 - RNA, 22 nt, Pseudomonas aeruginosa PA01
cgcgccgguuucgaccggcgcg

SEQ ID NO: 1442859 - RNA, 19 nt, Pseudomonas aeruginosa PA01
cgcgccucgucgcgccagg

SEQ ID NO: 1442860 - RNA, 20 nt, Pseudomonas aeruginosa PA01
cgcgccucgucgcgccaggc

SEQ ID NO: 1442861 - RNA, 13 nt, Pseudomonas aeruginosa PA01
cgcgccugagcug

SEQ ID NO: 1442862 - RNA, 16 nt, Pseudomonas aeruginosa PA01
cgcgccugagcuggcc

SEQ ID NO: 1442863 - RNA, 15 nt, Pseudomonas aeruginosa PA01
cgcgccuggaucagc

SEQ ID NO: 1442864 - RNA, 18 nt, Pseudomonas aeruginosa PA01
cgcgccuggaucagcgcc

SEQ ID NO: 1442865 - RNA, 21 nt, Pseudomonas aeruginosa PA01
cgcgccuggaucagcgccucg

SEQ ID NO: 1442866 - RNA, 23 nt, Pseudomonas aeruginosa PA01
cgcgccuggaucagcgccucgac

SEQ ID NO: 1442867 - RNA, 14 nt, Pseudomonas aeruginosa PA01
cgcgccuggcuggc

SEQ ID NO: 1442868 - RNA, 15 nt, Pseudomonas aeruginosa PA01
cgcgccuggcuggcc

SEQ ID NO: 1442869 - RNA, 16 nt, Pseudomonas aeruginosa PA01
cgcgccuggcuggcca

SEQ ID NO: 1442870 - RNA, 20 nt, Pseudomonas aeruginosa PA01
cgcgccuggcuggccagcag

SEQ ID NO: 1442871 - RNA, 20 nt, Pseudomonas aeruginosa PA01
cgcgccugggccgcgagguc

SEQ ID NO: 1442872 - RNA, 15 nt, Pseudomonas aeruginosa PA01
cgcgccucagcggcu

SEQ ID NO: 1442873 - RNA, 16 nt, Pseudomonas aeruginosa PA01
cgcgccucagcggcug

SEQ ID NO: 1442874 - RNA, 13 nt, Pseudomonas aeruginosa PA01
cgcgccuccaggc

SEQ ID NO: 1442875 - RNA, 16 nt, Pseudomonas aeruginosa PA01
cgcgccuccaggcgcg

SEQ ID NO: 1442876 - RNA, 18 nt, Pseudomonas aeruginosa PA01
cgcgccuccaggcgcgcc

SEQ ID NO: 1442877 - RNA, 21 nt, Pseudomonas aeruginosa PA01
cgcgccuccaggcgcgccugg

SEQ ID NO: 1442878 - RNA, 15 nt, Pseudomonas aeruginosa PA01
cgcgccucgcgcaac

SEQ ID NO: 1442879 - RNA, 17 nt, Pseudomonas aeruginosa PA01
cgcgccucgcgcaacgc

SEQ ID NO: 1442880 - RNA, 19 nt, Pseudomonas aeruginosa PA01
cgcgccucgcgcaacgccg

SEQ ID NO: 1442881 - RNA, 21 nt, Pseudomonas aeruginosa PA01
cgcgccucgcgcaacgccgac

SEQ ID NO: 1442882 - RNA, 12 nt, Pseudomonas aeruginosa PA01
cgcgccuccggc

SEQ ID NO: 1442883 - RNA, 19 nt, Pseudomonas aeruginosa PA01
cgcgccuccggcagcgucg

SEQ ID NO: 1442884 - RNA, 19 nt, Pseudomonas aeruginosa PA01
cgcgcgauaaaaagccccg

SEQ ID NO: 1442885 - RNA, 18 nt, Pseudomonas aeruginosa PA01
cgcgcgauaccgacaagc

SEQ ID NO: 1442886 - RNA, 18 nt, Pseudomonas aeruginosa PA01
cgcgcgcaaggccgaaga

SEQ ID NO: 1442887 - RNA, 15 nt, Pseudomonas aeruginosa PA01
cgcgcgauggccggc

SEQ ID NO: 1442888 - RNA, 20 nt, Pseudomonas aeruginosa PA01
cgcgcgacacauggucggcc

SEQ ID NO: 1442889 - RNA, 21 nt, Pseudomonas aeruginosa PA01
cgcgccuuucgcucaggccuc

SEQ ID NO: 1442890 - RNA, 22 nt, Pseudomonas aeruginosa PA01
cgcgccuuuuuuuauacgcucg

SEQ ID NO: 1442891 - RNA, 12 nt, Pseudomonas aeruginosa PA01
cgcgcgaccgcg

SEQ ID NO: 1442892 - RNA, 16 nt, Pseudomonas aeruginosa PA01
cgcgcgaaagggucag

SEQ ID NO: 1442893 - RNA, 23 nt, Pseudomonas aeruginosa PA01
cgcgcgaaagggucaggccuuga

SEQ ID NO: 1442894 - RNA, 15 nt, Pseudomonas aeruginosa PA01
cgcgccuugaaaccg

SEQ ID NO: 1442895 - RNA, 21 nt, Pseudomonas aeruginosa PA01
cgcgccuugaaaccggcgaac

SEQ ID NO: 1442896 - RNA, 14 nt, Pseudomonas aeruginosa PA01
cgcgccuuccagcc

SEQ ID NO: 1442897 - RNA, 19 nt, Pseudomonas aeruginosa PA01
cgcgccuuccagcccuucg

SEQ ID NO: 1442898 - RNA, 22 nt, Pseudomonas aeruginosa PA01
cgcgccuuccagcccuucgacg

SEQ ID NO: 1442899 - RNA, 18 nt, Pseudomonas aeruginosa PA01
cgcgccuucagcgccagc

SEQ ID NO: 1442900 - RNA, 19 nt, Pseudomonas aeruginosa PA01
cgcgccuucagcgccagca

SEQ ID NO: 1442901 - RNA, 20 nt, Pseudomonas aeruginosa PA01
cgcgccuucagcgccagcag

SEQ ID NO: 1442902 - RNA, 20 nt, Pseudomonas aeruginosa PA01
cgcgccuucagcgccuccag

SEQ ID NO: 1442903 - RNA, 13 nt, Pseudomonas aeruginosa PA01
cgcgcgccucagc

SEQ ID NO: 1442904 - RNA, 16 nt, Pseudomonas aeruginosa PA01
cgcgcgccucagcggc

SEQ ID NO: 1442905 - RNA, 13 nt, Pseudomonas aeruginosa PA01
cgcgcgcgccagg

SEQ ID NO: 1442906 - RNA, 14 nt, Pseudomonas aeruginosa PA01
cgcgcgcgccaggu

SEQ ID NO: 1442907 - RNA, 21 nt, Pseudomonas aeruginosa PA01
cgcgcgccuggcuggccagca

SEQ ID NO: 1442908 - RNA, 16 nt, Pseudomonas aeruginosa PA01
cgcgcgcgccugcaac

SEQ ID NO: 1442909 - RNA, 14 nt, Pseudomonas aeruginosa PA01
cgcgcgcggccagc

SEQ ID NO: 1442910 - RNA, 11 nt, Pseudomonas aeruginosa PA01
cgcgcgcggcc

SEQ ID NO: 1442911 - RNA, 16 nt, Pseudomonas aeruginosa PA01
cgcgcgcgcuccucga

SEQ ID NO: 1442912 - RNA, 13 nt, Pseudomonas aeruginosa PA01
cgcgcgcgcgcuc

SEQ ID NO: 1442913 - RNA, 14 nt, Pseudomonas aeruginosa PA01
cgcgcgcccguacc

SEQ ID NO: 1442914 - RNA, 16 nt, Pseudomonas aeruginosa PA01
cgcgcgcccucgcucg

SEQ ID NO: 1442915 - RNA, 12 nt, Pseudomonas aeruginosa PA01
cgcgcgccgcau

SEQ ID NO: 1442916 - RNA, 13 nt, Pseudomonas aeruginosa PA01
cgcgcgccgagca

SEQ ID NO: 1442917 - RNA, 11 nt, Pseudomonas aeruginosa PA01
cgcgcgcagga

SEQ ID NO: 1442918 - RNA, 15 nt, Pseudomonas aeruginosa PA01
cgcgcgccagcaacg

SEQ ID NO: 1442919 - RNA, 16 nt, Pseudomonas aeruginosa PA01
cgcgcgccagcaacgc

SEQ ID NO: 1442920 - RNA, 16 nt, Pseudomonas aeruginosa PA01
cgcgcgccauggccug

SEQ ID NO: 1442921 - RNA, 14 nt, Pseudomonas aeruginosa PA01
cgcgcggcccacca

SEQ ID NO: 1442922 - RNA, 14 nt, Pseudomonas aeruginosa PA01
cgcgcggcccuucg

SEQ ID NO: 1442923 - RNA, 12 nt, Pseudomonas aeruginosa PA01
cgcgcggccagc

SEQ ID NO: 1442924 - RNA, 15 nt, Pseudomonas aeruginosa PA01
cgcgcggccagcgcg

SEQ ID NO: 1442925 - RNA, 16 nt, Pseudomonas aeruginosa PA01
cgcgcggccagcgcgg

SEQ ID NO: 1442926 - RNA, 20 nt, Pseudomonas aeruginosa PA01
cgcgcggccagcgcggccgc

SEQ ID NO: 1442927 - RNA, 13 nt, Pseudomonas aeruginosa PA01
cgcgcggccaguu

SEQ ID NO: 1442928 - RNA, 17 nt, Pseudomonas aeruginosa PA01
cgcgcggccaguucggg

SEQ ID NO: 1442929 - RNA, 20 nt, Pseudomonas aeruginosa PA01
cgcgcggcgagggcgccggg

SEQ ID NO: 1442930 - RNA, 12 nt, Pseudomonas aeruginosa PA01
cgcgcggcgccc

SEQ ID NO: 1442931 - RNA, 11 nt, Pseudomonas aeruginosa PA01
cgcgcggcgag

SEQ ID NO: 1442932 - RNA, 19 nt, Pseudomonas aeruginosa PA01
cgcgcggcgcccugccggg

SEQ ID NO: 1442933 - RNA, 13 nt, Pseudomonas aeruginosa PA01
cgcgcggcgucga

SEQ ID NO: 1442934 - RNA, 15 nt, Pseudomonas aeruginosa PA01
cgcgcggcgucgacc

SEQ ID NO: 1442935 - RNA, 22 nt, Pseudomonas aeruginosa PA01
cgcgcggaccgaaggcaacagc

SEQ ID NO: 1442936 - RNA, 17 nt, Pseudomonas aeruginosa PA01
cgcgcggaccuucgacg

SEQ ID NO: 1442937 - RNA, 19 nt, Pseudomonas aeruginosa PA01
cgcgcggaccuucgacggc

SEQ ID NO: 1442938 - RNA, 22 nt, Pseudomonas aeruginosa PA01
cgcgcggaccuucgacggcagg

SEQ ID NO: 1442939 - RNA, 16 nt, Pseudomonas aeruginosa PA01
cgcgcgcuuguggcga

SEQ ID NO: 1442940 - RNA, 21 nt, Pseudomonas aeruginosa PA01
cgcgcggauauagcuggucaa

SEQ ID NO: 1442941 - RNA, 18 nt, Pseudomonas aeruginosa PA01
cgcgcggauccccucccg

SEQ ID NO: 1442942 - RNA, 23 nt, Pseudomonas aeruginosa PA01
cgcgcggauccccucccgcgcca

SEQ ID NO: 1442943 - RNA, 17 nt, Pseudomonas aeruginosa PA01
cgcgcgcuuuuccggcg

SEQ ID NO: 1442944 - RNA, 20 nt, Pseudomonas aeruginosa PA01
cgcgcgcuuuuccggcgccg

SEQ ID NO: 1442945 - RNA, 22 nt, Pseudomonas aeruginosa PA01
cgcgcgcuuuuccggcgccggc

SEQ ID NO: 1442946 - RNA, 21 nt, Pseudomonas aeruginosa PA01
cgcgcgcuggauuucgccgag

SEQ ID NO: 1442947 - RNA, 14 nt, Pseudomonas aeruginosa PA01
cgcgcgcuggcgca

SEQ ID NO: 1442948 - RNA, 22 nt, Pseudomonas aeruginosa PA01
cgcgcgcuggucguaggcgcgg

SEQ ID NO: 1442949 - RNA, 16 nt, Pseudomonas aeruginosa PA01
cgcgcgcuuccaggca

SEQ ID NO: 1442950 - RNA, 14 nt, Pseudomonas aeruginosa PA01
cgcgcgcucucgcc

SEQ ID NO: 1442951 - RNA, 21 nt, Pseudomonas aeruginosa PA01
cgcgcgcucucgccggccugg

SEQ ID NO: 1442952 - RNA, 14 nt, Pseudomonas aeruginosa PA01
cgcgcgcuccucga

SEQ ID NO: 1442953 - RNA, 22 nt, Pseudomonas aeruginosa PA01
cgcgcugaccuggucguugcgc

SEQ ID NO: 1442954 - RNA, 13 nt, Pseudomonas aeruginosa PA01
cgcgcucuggccc

SEQ ID NO: 1442955 - RNA, 22 nt, Pseudomonas aeruginosa PA01
cgcgcucgguccagaucgccac

SEQ ID NO: 1442956 - RNA, 12 nt, Pseudomonas aeruginosa PA01
cgcgcucucgcc

SEQ ID NO: 1442957 - RNA, 15 nt, Pseudomonas aeruginosa PA01
cgcgcucucgccggc

SEQ ID NO: 1442958 - RNA, 18 nt, Pseudomonas aeruginosa PA01
cgcgcucucgccggccug

SEQ ID NO: 1442959 - RNA, 12 nt, Pseudomonas aeruginosa PA01
cgcgcucggcga

SEQ ID NO: 1442960 - RNA, 13 nt, Pseudomonas aeruginosa PA01
cgcgcucggcggc

SEQ ID NO: 1442961 - RNA, 13 nt, Pseudomonas aeruginosa PA01
cgcgcucggcggu

SEQ ID NO: 1442962 - RNA, 17 nt, Pseudomonas aeruginosa PA01
cgcgcucuuccuucagu

SEQ ID NO: 1442963 - RNA, 14 nt, Pseudomonas aeruginosa PA01
cgcgcucuucgccg

SEQ ID NO: 1442964 - RNA, 18 nt, Pseudomonas aeruginosa PA01
cgcgcucuucgccgcggc

SEQ ID NO: 1442965 - RNA, 13 nt, Pseudomonas aeruginosa PA01
cgcgcugacggca

SEQ ID NO: 1442966 - RNA, 15 nt, Pseudomonas aeruginosa PA01
cgcgcugacggcaag

SEQ ID NO: 1442967 - RNA, 16 nt, Pseudomonas aeruginosa PA01
cgcgcugacggcaagg

SEQ ID NO: 1442968 - RNA, 21 nt, Pseudomonas aeruginosa PA01
cgcgcugcaugaaccaaccga

SEQ ID NO: 1442969 - RNA, 19 nt, Pseudomonas aeruginosa PA01
cgcgcugcccggcgcgacg

SEQ ID NO: 1442970 - RNA, 20 nt, Pseudomonas aeruginosa PA01
cgcgcugcccggcgcgacgc

SEQ ID NO: 1442971 - RNA, 21 nt, Pseudomonas aeruginosa PA01
cgcgcucggccaguucgucga

SEQ ID NO: 1442972 - RNA, 12 nt, Pseudomonas aeruginosa PA01
cgcgcucggccg

SEQ ID NO: 1442973 - RNA, 14 nt, Pseudomonas aeruginosa PA01
cgcgcucggccgcc

SEQ ID NO: 1442974 - RNA, 19 nt, Pseudomonas aeruginosa PA01
cgcgcucggccgccuggcg

SEQ ID NO: 1442975 - RNA, 21 nt, Pseudomonas aeruginosa PA01
cgcgcucggccgccuggcgug

SEQ ID NO: 1442976 - RNA, 12 nt, Pseudomonas aeruginosa PA01
cgcgcucggccu

SEQ ID NO: 1442977 - RNA, 14 nt, Pseudomonas aeruginosa PA01
cgcgcucggccugg

SEQ ID NO: 1442978 - RNA, 14 nt, Pseudomonas aeruginosa PA01
cgcgcuccaggccc

SEQ ID NO: 1442979 - RNA, 16 nt, Pseudomonas aeruginosa PA01
cgcgcuccaggcccgg

SEQ ID NO: 1442980 - RNA, 19 nt, Pseudomonas aeruginosa PA01
cgcgcuccaguucguugac

SEQ ID NO: 1442981 - RNA, 17 nt, Pseudomonas aeruginosa PA01
cgcgcuccucgauccgc

SEQ ID NO: 1442982 - RNA, 14 nt, Pseudomonas aeruginosa PA01
cgcgcuccggcgcg

SEQ ID NO: 1442983 - RNA, 15 nt, Pseudomonas aeruginosa PA01
cgcgcuccggcgcgc

SEQ ID NO: 1442984 - RNA, 17 nt, Pseudomonas aeruginosa PA01
cgcgcuccggcgcgcca

SEQ ID NO: 1442985 - RNA, 15 nt, Pseudomonas aeruginosa PA01
cgcgcugcgccaggc

SEQ ID NO: 1442986 - RNA, 22 nt, Pseudomonas aeruginosa PA01
cgcgcugcgaaucgucgccgga

SEQ ID NO: 1442987 - RNA, 23 nt, Pseudomonas aeruginosa PA01
cgcgcugcgaaucgucgccggag

SEQ ID NO: 1442988 - RNA, 21 nt, Pseudomonas aeruginosa PA01
cgcgcugcugguagugcuggc

SEQ ID NO: 1442989 - RNA, 18 nt, Pseudomonas aeruginosa PA01
cgcgcugcgugcgccgcu

SEQ ID NO: 1442990 - RNA, 17 nt, Pseudomonas aeruginosa PA01
cgcgcuggaccauggcc

SEQ ID NO: 1442991 - RNA, 21 nt, Pseudomonas aeruginosa PA01
cgcgcuggaccauggccggcg

SEQ ID NO: 1442992 - RNA, 13 nt, Pseudomonas aeruginosa PA01
cgcgcuggaccug

SEQ ID NO: 1442993 - RNA, 18 nt, Pseudomonas aeruginosa PA01
cgcgcuggaccuggccgg

SEQ ID NO: 1442994 - RNA, 17 nt, Pseudomonas aeruginosa PA01
cgcgcuggagaccuugu

SEQ ID NO: 1442995 - RNA, 19 nt, Pseudomonas aeruginosa PA01
cgcgcuggaguaucgcccu

SEQ ID NO: 1442996 - RNA, 17 nt, Pseudomonas aeruginosa PA01
cgcgcuggcgcagcggg

SEQ ID NO: 1442997 - RNA, 12 nt, Pseudomonas aeruginosa PA01
cgcgcuggcgca

SEQ ID NO: 1442998 - RNA, 13 nt, Pseudomonas aeruginosa PA01
cgcgcuggccagu

SEQ ID NO: 1442999 - RNA, 13 nt, Pseudomonas aeruginosa PA01
cgcgcuggaugaa

SEQ ID NO: 1443000 - RNA, 17 nt, Pseudomonas aeruginosa PA01
cgcgcuggauuucgccg

SEQ ID NO: 1443001 - RNA, 19 nt, Pseudomonas aeruginosa PA01
cgcgcuggauuucgccgag

SEQ ID NO: 1443002 - RNA, 22 nt, Pseudomonas aeruginosa PA01
cgcggacaugaaaaagccggag

SEQ ID NO: 1443003 - RNA, 14 nt, Pseudomonas aeruginosa PA01
cgcggacauggcgc

SEQ ID NO: 1443004 - RNA, 16 nt, Pseudomonas aeruginosa PA01
cgcggacauggcgcuc

SEQ ID NO: 1443005 - RNA, 21 nt, Pseudomonas aeruginosa PA01
cgcggacauggcgcucgagcu

SEQ ID NO: 1443006 - RNA, 19 nt, Pseudomonas aeruginosa PA01
cgcgcuuuccggcgcggcc

SEQ ID NO: 1443007 - RNA, 16 nt, Pseudomonas aeruginosa PA01
cgcggaaaacgccgcg

SEQ ID NO: 1443008 - RNA, 17 nt, Pseudomonas aeruginosa PA01
cgcggaaaacgccgcga

SEQ ID NO: 1443009 - RNA, 22 nt, Pseudomonas aeruginosa PA01
cgcggaaaccugcaacucggcg

SEQ ID NO: 1443010 - RNA, 23 nt, Pseudomonas aeruginosa PA01
cgcggaaaccugcaacucggcgc

SEQ ID NO: 1443011 - RNA, 18 nt, Pseudomonas aeruginosa PA01
cgcggaacaucgcccggc

SEQ ID NO: 1443012 - RNA, 22 nt, Pseudomonas aeruginosa PA01
cgcggaaccagugcgcgguccg

SEQ ID NO: 1443013 - RNA, 18 nt, Pseudomonas aeruginosa PA01
cgcgcuuuuccggcgccg

SEQ ID NO: 1443014 - RNA, 16 nt, Pseudomonas aeruginosa PA01
cgcgcguuucagcgcu

SEQ ID NO: 1443015 - RNA, 17 nt, Pseudomonas aeruginosa PA01
cgcgcguuucagcgcuu

SEQ ID NO: 1443016 - RNA, 18 nt, Pseudomonas aeruginosa PA01
cgcgcguuucagcgcuug

SEQ ID NO: 1443017 - RNA, 15 nt, Pseudomonas aeruginosa PA01
cgcgcgucguccagg

SEQ ID NO: 1443018 - RNA, 19 nt, Pseudomonas aeruginosa PA01
cgcgcgucguccagggcgc

SEQ ID NO: 1443019 - RNA, 17 nt, Pseudomonas aeruginosa PA01
cgcgcgucggcgaaccc

SEQ ID NO: 1443020 - RNA, 13 nt, Pseudomonas aeruginosa PA01
cgcgcgucggcgg

SEQ ID NO: 1443021 - RNA, 15 nt, Pseudomonas aeruginosa PA01
cgcgcgucggucagg

SEQ ID NO: 1443022 - RNA, 20 nt, Pseudomonas aeruginosa PA01
cgcgcgucggucaggacagc

SEQ ID NO: 1443023 - RNA, 21 nt, Pseudomonas aeruginosa PA01
cgcgcguggcuucguccagcg

SEQ ID NO: 1443024 - RNA, 14 nt, Pseudomonas aeruginosa PA01
cgcgcucagcgcga

SEQ ID NO: 1443025 - RNA, 21 nt, Pseudomonas aeruginosa PA01
cgcgcucagcgcgagggggcc

SEQ ID NO: 1443026 - RNA, 23 nt, Pseudomonas aeruginosa PA01
cgcgcucaggcgcagcguccugc

SEQ ID NO: 1443027 - RNA, 21 nt, Pseudomonas aeruginosa PA01
cgcgcggcugcuugccgcuca

SEQ ID NO: 1443028 - RNA, 20 nt, Pseudomonas aeruginosa PA01
cgcgcgggccuucgccuucg

SEQ ID NO: 1443029 - RNA, 13 nt, Pseudomonas aeruginosa PA01
cgcgcgggccggc

SEQ ID NO: 1443030 - RNA, 14 nt, Pseudomonas aeruginosa PA01
cgcgcgggccggcg

SEQ ID NO: 1443031 - RNA, 15 nt, Pseudomonas aeruginosa PA01
cgcgcgggccggcga

SEQ ID NO: 1443032 - RNA, 15 nt, Pseudomonas aeruginosa PA01
cgcgcgggccgaggu

SEQ ID NO: 1443033 - RNA, 19 nt, Pseudomonas aeruginosa PA01
cgcgcggcuugccggcgcg

SEQ ID NO: 1443034 - RNA, 15 nt, Pseudomonas aeruginosa PA01
cgcgcgggguggccg

SEQ ID NO: 1443035 - RNA, 16 nt, Pseudomonas aeruginosa PA01
cgcgcggggucuggcc

SEQ ID NO: 1443036 - RNA, 20 nt, Pseudomonas aeruginosa PA01
cgcgcggggucuggccggcg

SEQ ID NO: 1443037 - RNA, 14 nt, Pseudomonas aeruginosa PA01
cgcgcggggcgcgc

SEQ ID NO: 1443038 - RNA, 18 nt, Pseudomonas aeruginosa PA01
cgcgcggggcgcgcugcg

SEQ ID NO: 1443039 - RNA, 19 nt, Pseudomonas aeruginosa PA01
cgcgcggguuuccgugcgc

SEQ ID NO: 1443040 - RNA, 12 nt, Pseudomonas aeruginosa PA01
cgcgcgggucgu

SEQ ID NO: 1443041 - RNA, 14 nt, Pseudomonas aeruginosa PA01
cgcgcgggucgucg

SEQ ID NO: 1443042 - RNA, 13 nt, Pseudomonas aeruginosa PA01
cgcgcggucgagc

SEQ ID NO: 1443043 - RNA, 15 nt, Pseudomonas aeruginosa PA01
cgcgcggucgagcag

SEQ ID NO: 1443044 - RNA, 20 nt, Pseudomonas aeruginosa PA01
cgcgcggucgagcagcgccg

SEQ ID NO: 1443045 - RNA, 22 nt, Pseudomonas aeruginosa PA01
cgcgcggucgagcagcgccgcg

SEQ ID NO: 1443046 - RNA, 16 nt, Pseudomonas aeruginosa PA01
cgcgcguagcgugccg

SEQ ID NO: 1443047 - RNA, 19 nt, Pseudomonas aeruginosa PA01
cgcgccaaggccgccaggc

SEQ ID NO: 1443048 - RNA, 19 nt, Pseudomonas aeruginosa PA01
cgcgccaagguuccagccc

SEQ ID NO: 1443049 - RNA, 15 nt, Pseudomonas aeruginosa PA01
cgcgccaccgccugg

SEQ ID NO: 1443050 - RNA, 13 nt, Pseudomonas aeruginosa PA01
cgcgccaccaccg

SEQ ID NO: 1443051 - RNA, 13 nt, Pseudomonas aeruginosa PA01
cgcgcauggcggc

SEQ ID NO: 1443052 - RNA, 15 nt, Pseudomonas aeruginosa PA01
cgcgcauggcggcga

SEQ ID NO: 1443053 - RNA, 17 nt, Pseudomonas aeruginosa PA01
cgcgcauggcggcgacc

SEQ ID NO: 1443054 - RNA, 19 nt, Pseudomonas aeruginosa PA01
cgcgcauggcggcgaccgc

SEQ ID NO: 1443055 - RNA, 15 nt, Pseudomonas aeruginosa PA01
cgcgcaugucgaggu

SEQ ID NO: 1443056 - RNA, 14 nt, Pseudomonas aeruginosa PA01
cgcgcaugcagggc

SEQ ID NO: 1443057 - RNA, 21 nt, Pseudomonas aeruginosa PA01
cgcgcaugaaaaagccgccca

SEQ ID NO: 1443058 - RNA, 15 nt, Pseudomonas aeruginosa PA01
cgcgcaugaccuuca

SEQ ID NO: 1443059 - RNA, 19 nt, Pseudomonas aeruginosa PA01
cgcgcaugaccuucagcac

SEQ ID NO: 1443060 - RNA, 23 nt, Pseudomonas aeruginosa PA01
cgcgcaugaccuucagcaccugc

SEQ ID NO: 1443061 - RNA, 21 nt, Pseudomonas aeruginosa PA01
cgcgcaugaucgccucggcgc

SEQ ID NO: 1443062 - RNA, 22 nt, Pseudomonas aeruginosa PA01
cgcgcaugaucgccucggcgcg

SEQ ID NO: 1443063 - RNA, 19 nt, Pseudomonas aeruginosa PA01
cgcgcauggagacggcccg

SEQ ID NO: 1443064 - RNA, 20 nt, Pseudomonas aeruginosa PA01
cgcgcauggagacggcccgc

SEQ ID NO: 1443065 - RNA, 21 nt, Pseudomonas aeruginosa PA01
cgcgcauggagacggcccgcc

SEQ ID NO: 1443066 - RNA, 13 nt, Pseudomonas aeruginosa PA01
cgcgccagggcgg

SEQ ID NO: 1443067 - RNA, 15 nt, Pseudomonas aeruginosa PA01
cgcgccaggucgaga

SEQ ID NO: 1443068 - RNA, 14 nt, Pseudomonas aeruginosa PA01
cgcgccaggcgcag

SEQ ID NO: 1443069 - RNA, 14 nt, Pseudomonas aeruginosa PA01
cgcgccacgcagga

SEQ ID NO: 1443070 - RNA, 13 nt, Pseudomonas aeruginosa PA01
cgcgccaggccgc

SEQ ID NO: 1443071 - RNA, 14 nt, Pseudomonas aeruginosa PA01
cgcgccagcgccgc

SEQ ID NO: 1443072 - RNA, 15 nt, Pseudomonas aeruginosa PA01
cgcgcacgucgaggu

SEQ ID NO: 1443073 - RNA, 21 nt, Pseudomonas aeruginosa PA01
cgcgcacuuccggacugccca

SEQ ID NO: 1443074 - RNA, 16 nt, Pseudomonas aeruginosa PA01
cgcgcacuuccucggc

SEQ ID NO: 1443075 - RNA, 20 nt, Pseudomonas aeruginosa PA01
cgcgcacuuccucggcgacc

SEQ ID NO: 1443076 - RNA, 16 nt, Pseudomonas aeruginosa PA01
cgcgcagcgccgccgc

SEQ ID NO: 1443077 - RNA, 13 nt, Pseudomonas aeruginosa PA01
cgcgcagcgacuc

SEQ ID NO: 1443078 - RNA, 14 nt, Pseudomonas aeruginosa PA01
cgcgcagcgccgcc

SEQ ID NO: 1443079 - RNA, 14 nt, Pseudomonas aeruginosa PA01
cgcgcagcgcggcg

SEQ ID NO: 1443080 - RNA, 13 nt, Pseudomonas aeruginosa PA01
cgcgcagcggcgc

SEQ ID NO: 1443081 - RNA, 14 nt, Pseudomonas aeruginosa PA01
cgcgcagcggcgcc

SEQ ID NO: 1443082 - RNA, 15 nt, Pseudomonas aeruginosa PA01
cgcgcagcggcgccg

SEQ ID NO: 1443083 - RNA, 15 nt, Pseudomonas aeruginosa PA01
cgcgcagcggcgcgu

SEQ ID NO: 1443084 - RNA, 19 nt, Pseudomonas aeruginosa PA01
cgcgcagcggcgcgucgcu

SEQ ID NO: 1443085 - RNA, 12 nt, Pseudomonas aeruginosa PA01
cgcgcagcggcu

SEQ ID NO: 1443086 - RNA, 17 nt, Pseudomonas aeruginosa PA01
cgcgcagggcagcgcga

SEQ ID NO: 1443087 - RNA, 18 nt, Pseudomonas aeruginosa PA01
cgcgcaggcggucgccga

SEQ ID NO: 1443088 - RNA, 21 nt, Pseudomonas aeruginosa PA01
cgcgcaggcggucggaaagca

SEQ ID NO: 1443089 - RNA, 22 nt, Pseudomonas aeruginosa PA01
cgcgcagggccagggcggcggc

SEQ ID NO: 1443090 - RNA, 15 nt, Pseudomonas aeruginosa PA01
cgcgcagggccgcgg

SEQ ID NO: 1443091 - RNA, 16 nt, Pseudomonas aeruginosa PA01
cgcgcagggccgcggc

SEQ ID NO: 1443092 - RNA, 17 nt, Pseudomonas aeruginosa PA01
cgcgcagggccgcggcg

SEQ ID NO: 1443093 - RNA, 14 nt, Pseudomonas aeruginosa PA01
cgcgcagggcaucg

SEQ ID NO: 1443094 - RNA, 22 nt, Pseudomonas aeruginosa PA01
cgcgcagggccagcaacaggca

SEQ ID NO: 1443095 - RNA, 13 nt, Pseudomonas aeruginosa PA01
cgcgcagggucga

SEQ ID NO: 1443096 - RNA, 16 nt, Pseudomonas aeruginosa PA01
cgcgcaucuggcugcg

SEQ ID NO: 1443097 - RNA, 19 nt, Pseudomonas aeruginosa PA01
cgcgcaucuggugcgcguc

SEQ ID NO: 1443098 - RNA, 16 nt, Pseudomonas aeruginosa PA01
cgcgcagucccgcgcg

SEQ ID NO: 1443099 - RNA, 15 nt, Pseudomonas aeruginosa PA01
cgcgcaucggugccg

SEQ ID NO: 1443100 - RNA, 20 nt, Pseudomonas aeruginosa PA01
cgcgcaucggugccggcagg

SEQ ID NO: 1443101 - RNA, 19 nt, Pseudomonas aeruginosa PA01
cgcgcaguaggcgcugccg

SEQ ID NO: 1443102 - RNA, 21 nt, Pseudomonas aeruginosa PA01
cgcgcaguacgaucagccagg

SEQ ID NO: 1443103 - RNA, 24 nt, Pseudomonas aeruginosa PA01
cgcgcaguacgaucagccagggca

SEQ ID NO: 1443104 - RNA, 17 nt, Pseudomonas aeruginosa PA01
cgcgcaucgcggacacc

SEQ ID NO: 1443105 - RNA, 18 nt, Pseudomonas aeruginosa PA01
cgcgcaucgcggacaccg

SEQ ID NO: 1443106 - RNA, 17 nt, Pseudomonas aeruginosa PA01
cgcgcagguucaucgcc

SEQ ID NO: 1443107 - RNA, 18 nt, Pseudomonas aeruginosa PA01
cgcgcagguucaucgccg

SEQ ID NO: 1443108 - RNA, 20 nt, Pseudomonas aeruginosa PA01
cgcgcagguucaucgccgcc

SEQ ID NO: 1443109 - RNA, 21 nt, Pseudomonas aeruginosa PA01
cgcgcagguucaucgccgcca

SEQ ID NO: 1443110 - RNA, 21 nt, Pseudomonas aeruginosa PA01
cgcgccggccauucgcugucg

SEQ ID NO: 1443111 - RNA, 21 nt, Pseudomonas aeruginosa PA01
cgcgccggaucgaaguagucg

SEQ ID NO: 1443112 - RNA, 13 nt, Pseudomonas aeruginosa PA01
cgcgccggcagcu

SEQ ID NO: 1443113 - RNA, 22 nt, Pseudomonas aeruginosa PA01
cgcgccggcagcucggccgagg

SEQ ID NO: 1443114 - RNA, 15 nt, Pseudomonas aeruginosa PA01
cgcgccgggucggau

SEQ ID NO: 1443115 - RNA, 21 nt, Pseudomonas aeruginosa PA01
cgcgccggguugcgccgcaag

SEQ ID NO: 1443116 - RNA, 19 nt, Pseudomonas aeruginosa PA01
cgcgccgguaaugacgauc

SEQ ID NO: 1443117 - RNA, 14 nt, Pseudomonas aeruginosa PA01
cgcgccgcucaggc

SEQ ID NO: 1443118 - RNA, 16 nt, Pseudomonas aeruginosa PA01
cgcgccggacaggcca

SEQ ID NO: 1443119 - RNA, 21 nt, Pseudomonas aeruginosa PA01
cgcgccggacaggccacccgc

SEQ ID NO: 1443120 - RNA, 20 nt, Pseudomonas aeruginosa PA01
cgcgccggaaguggcagcgc

SEQ ID NO: 1443121 - RNA, 11 nt, Pseudomonas aeruginosa PA01
cgcgccggaug

SEQ ID NO: 1443122 - RNA, 16 nt, Pseudomonas aeruginosa PA01
cgcgccggaugggcga

SEQ ID NO: 1443123 - RNA, 18 nt, Pseudomonas aeruginosa PA01
cgcgccggaugggcgagc

SEQ ID NO: 1443124 - RNA, 22 nt, Pseudomonas aeruginosa PA01
cgcgccggaugggcgagcugcc

SEQ ID NO: 1443125 - RNA, 13 nt, Pseudomonas aeruginosa PA01
cgcgccgccgagg

SEQ ID NO: 1443126 - RNA, 13 nt, Pseudomonas aeruginosa PA01
cgcgccgccgaag

SEQ ID NO: 1443127 - RNA, 17 nt, Pseudomonas aeruginosa PA01
cgcgccgccgaagccga

SEQ ID NO: 1443128 - RNA, 17 nt, Pseudomonas aeruginosa PA01
cgcgccgagcuggcgcg

SEQ ID NO: 1443129 - RNA, 19 nt, Pseudomonas aeruginosa PA01
cgcgccgagcuggcgcgcg

SEQ ID NO: 1443130 - RNA, 16 nt, Pseudomonas aeruginosa PA01
cgcgccgaguuggccc

SEQ ID NO: 1443131 - RNA, 20 nt, Pseudomonas aeruginosa PA01
cgcgccgcccggcucgccgc

SEQ ID NO: 1443132 - RNA, 22 nt, Pseudomonas aeruginosa PA01
cgcgccgcccggcucgccgccg

SEQ ID NO: 1443133 - RNA, 13 nt, Pseudomonas aeruginosa PA01
cgcgccgccggau

SEQ ID NO: 1443134 - RNA, 14 nt, Pseudomonas aeruginosa PA01
cgcgccgccgggcg

SEQ ID NO: 1443135 - RNA, 17 nt, Pseudomonas aeruginosa PA01
cgcgccccacggcgcgg

SEQ ID NO: 1443136 - RNA, 19 nt, Pseudomonas aeruginosa PA01
cgcgccccacggcgcggcc

SEQ ID NO: 1443137 - RNA, 14 nt, Pseudomonas aeruginosa PA01
cgcgccccagcggc

SEQ ID NO: 1443138 - RNA, 15 nt, Pseudomonas aeruginosa PA01
cgcgcccccuggccg

SEQ ID NO: 1443139 - RNA, 11 nt, Pseudomonas aeruginosa PA01
cgcgcccggcc

SEQ ID NO: 1443140 - RNA, 12 nt, Pseudomonas aeruginosa PA01
cgcgcccaggca

SEQ ID NO: 1443141 - RNA, 17 nt, Pseudomonas aeruginosa PA01
cgcgcccaggcaggcga

SEQ ID NO: 1443142 - RNA, 17 nt, Pseudomonas aeruginosa PA01
cgcgcccaggcccagcg

SEQ ID NO: 1443143 - RNA, 19 nt, Pseudomonas aeruginosa PA01
cgcgcccaggcugccggcc

SEQ ID NO: 1443144 - RNA, 22 nt, Pseudomonas aeruginosa PA01
cgcgcccaggcugccggccagg

SEQ ID NO: 1443145 - RNA, 13 nt, Pseudomonas aeruginosa PA01
cgcgcccggcgca

SEQ ID NO: 1443146 - RNA, 13 nt, Pseudomonas aeruginosa PA01
cgcgcccggccag

SEQ ID NO: 1443147 - RNA, 14 nt, Pseudomonas aeruginosa PA01
cgcgcccggccagg

SEQ ID NO: 1443148 - RNA, 24 nt, Pseudomonas aeruginosa PA01
cgcgcccggccaggccgcccagga

SEQ ID NO: 1443149 - RNA, 14 nt, Pseudomonas aeruginosa PA01
cgcgcccggccucc

SEQ ID NO: 1443150 - RNA, 20 nt, Pseudomonas aeruginosa PA01
cgcgcccggccuucaccgcg

SEQ ID NO: 1443151 - RNA, 16 nt, Pseudomonas aeruginosa PA01
cgcgccgaccagccgc

SEQ ID NO: 1443152 - RNA, 19 nt, Pseudomonas aeruginosa PA01
cgcgccgaccagccgcagg

SEQ ID NO: 1443153 - RNA, 14 nt, Pseudomonas aeruginosa PA01
cgcgcccggcgcca

SEQ ID NO: 1443154 - RNA, 16 nt, Pseudomonas aeruginosa PA01
cgcgcccggcgccacc

SEQ ID NO: 1443155 - RNA, 16 nt, Pseudomonas aeruginosa PA01
cgcgcccggcuggcca

SEQ ID NO: 1443156 - RNA, 22 nt, Pseudomonas aeruginosa PA01
cgcgccgagcccccggcgccca

SEQ ID NO: 1443157 - RNA, 15 nt, Pseudomonas aeruginosa PA01
cgcgccgagccggcu

SEQ ID NO: 1443158 - RNA, 19 nt, Pseudomonas aeruginosa PA01
cgcgccgaguucgccgcga

SEQ ID NO: 1443159 - RNA, 21 nt, Pseudomonas aeruginosa PA01
cgcgccgaguucgccgcgagc

SEQ ID NO: 1443160 - RNA, 21 nt, Pseudomonas aeruginosa PA01
cgcgacugccgucggcgcccu

SEQ ID NO: 1443161 - RNA, 16 nt, Pseudomonas aeruginosa PA01
cgcgacugcugaucag

SEQ ID NO: 1443162 - RNA, 20 nt, Pseudomonas aeruginosa PA01
cgcgacuguucucuacgccg

SEQ ID NO: 1443163 - RNA, 23 nt, Pseudomonas aeruginosa PA01
cgcgacuguucucuacgccguag

SEQ ID NO: 1443164 - RNA, 14 nt, Pseudomonas aeruginosa PA01
cgcgacggcccacg

SEQ ID NO: 1443165 - RNA, 21 nt, Pseudomonas aeruginosa PA01
cgcgacucgaagcucuucgcc

SEQ ID NO: 1443166 - RNA, 16 nt, Pseudomonas aeruginosa PA01
cgcgacucgagcacca

SEQ ID NO: 1443167 - RNA, 18 nt, Pseudomonas aeruginosa PA01
cgcgacucgagcaccacc

SEQ ID NO: 1443168 - RNA, 20 nt, Pseudomonas aeruginosa PA01
cgcgacucgagcaccaccac

SEQ ID NO: 1443169 - RNA, 21 nt, Pseudomonas aeruginosa PA01
cgcgacucgguaaagcccagg

SEQ ID NO: 1443170 - RNA, 13 nt, Pseudomonas aeruginosa PA01
cgcgacucguagg

SEQ ID NO: 1443171 - RNA, 16 nt, Pseudomonas aeruginosa PA01
cgcgacugaccacgca

SEQ ID NO: 1443172 - RNA, 20 nt, Pseudomonas aeruginosa PA01
cgcgacugaccacgcagagc

SEQ ID NO: 1443173 - RNA, 16 nt, Pseudomonas aeruginosa PA01
cgcgacggaccgcgac

SEQ ID NO: 1443174 - RNA, 18 nt, Pseudomonas aeruginosa PA01
cgcgacggaccgcgacaa

SEQ ID NO: 1443175 - RNA, 23 nt, Pseudomonas aeruginosa PA01
cgcgacggaccgcgacaacccug

SEQ ID NO: 1443176 - RNA, 14 nt, Pseudomonas aeruginosa PA01
cgccugcggcguag

SEQ ID NO: 1443177 - RNA, 22 nt, Pseudomonas aeruginosa PA01
cgccugcggcguuauccgcccu

SEQ ID NO: 1443178 - RNA, 17 nt, Pseudomonas aeruginosa PA01
cgccugcgucagcgagg

SEQ ID NO: 1443179 - RNA, 21 nt, Pseudomonas aeruginosa PA01
cgccugcgucagcgaggcggg

SEQ ID NO: 1443180 - RNA, 15 nt, Pseudomonas aeruginosa PA01
cgccugcggaccaca

SEQ ID NO: 1443181 - RNA, 17 nt, Pseudomonas aeruginosa PA01
cgccugcucuucggcgg

SEQ ID NO: 1443182 - RNA, 18 nt, Pseudomonas aeruginosa PA01
cgccugcucuucggcggc

SEQ ID NO: 1443183 - RNA, 20 nt, Pseudomonas aeruginosa PA01
cgccugcucuucggcggcca

SEQ ID NO: 1443184 - RNA, 22 nt, Pseudomonas aeruginosa PA01
cgccugcucuucggcggccagc

SEQ ID NO: 1443185 - RNA, 23 nt, Pseudomonas aeruginosa PA01
cgccugcucuucggcggccagcg

SEQ ID NO: 1443186 - RNA, 17 nt, Pseudomonas aeruginosa PA01
cgccugcucgccgcuga

SEQ ID NO: 1443187 - RNA, 18 nt, Pseudomonas aeruginosa PA01
cgccugcucgcggcuggc

SEQ ID NO: 1443188 - RNA, 15 nt, Pseudomonas aeruginosa PA01
cgccugcucggccug

SEQ ID NO: 1443189 - RNA, 16 nt, Pseudomonas aeruginosa PA01
cgccugcucggccugc

SEQ ID NO: 1443190 - RNA, 22 nt, Pseudomonas aeruginosa PA01
cgccugcucggccugcugcgcc

SEQ ID NO: 1443191 - RNA, 14 nt, Pseudomonas aeruginosa PA01
cgcgagcaccgcgc

SEQ ID NO: 1443192 - RNA, 20 nt, Pseudomonas aeruginosa PA01
cgcgagcaccgcgcagacca

SEQ ID NO: 1443193 - RNA, 23 nt, Pseudomonas aeruginosa PA01
cgcgagcaccgcgcagaccauca

SEQ ID NO: 1443194 - RNA, 16 nt, Pseudomonas aeruginosa PA01
cgcgagauggcgucga

SEQ ID NO: 1443195 - RNA, 21 nt, Pseudomonas aeruginosa PA01
cgcgagcaccaugcagcggca

SEQ ID NO: 1443196 - RNA, 20 nt, Pseudomonas aeruginosa PA01
cgcgagcagggcgaugccga

SEQ ID NO: 1443197 - RNA, 15 nt, Pseudomonas aeruginosa PA01
cgcgaguucgccggc

SEQ ID NO: 1443198 - RNA, 17 nt, Pseudomonas aeruginosa PA01
cgcgaguucgccggcca

SEQ ID NO: 1443199 - RNA, 19 nt, Pseudomonas aeruginosa PA01
cgcgaguucgccggccagg

SEQ ID NO: 1443200 - RNA, 20 nt, Pseudomonas aeruginosa PA01
cgcgaguucgccggccaggu

SEQ ID NO: 1443201 - RNA, 18 nt, Pseudomonas aeruginosa PA01
cgcgagcagccgacgauc

SEQ ID NO: 1443202 - RNA, 12 nt, Pseudomonas aeruginosa PA01
cgcgagcaccgc

SEQ ID NO: 1443203 - RNA, 13 nt, Pseudomonas aeruginosa PA01
cgcgagcaccgcg

SEQ ID NO: 1443204 - RNA, 22 nt, Pseudomonas aeruginosa PA01
cgcgauaaaaagccccgcuucg

SEQ ID NO: 1443205 - RNA, 19 nt, Pseudomonas aeruginosa PA01
cgcgagagguucaccgacc

SEQ ID NO: 1443206 - RNA, 16 nt, Pseudomonas aeruginosa PA01
cgcgagaccccggcgg

SEQ ID NO: 1443207 - RNA, 18 nt, Pseudomonas aeruginosa PA01
cgcgagaccccggcggcg

SEQ ID NO: 1443208 - RNA, 19 nt, Pseudomonas aeruginosa PA01
cgcgagaccccggcggcgc

SEQ ID NO: 1443209 - RNA, 20 nt, Pseudomonas aeruginosa PA01
cgcgagaccccggcggcgcg

SEQ ID NO: 1443210 - RNA, 15 nt, Pseudomonas aeruginosa PA01
cgcgacugucgagca

SEQ ID NO: 1443211 - RNA, 23 nt, Pseudomonas aeruginosa PA01
cgcgagaagccagccaggucgga

SEQ ID NO: 1443212 - RNA, 16 nt, Pseudomonas aeruginosa PA01
cgcgagaagccgccca

SEQ ID NO: 1443213 - RNA, 16 nt, Pseudomonas aeruginosa PA01
cgcgacuuggacagcg

SEQ ID NO: 1443214 - RNA, 15 nt, Pseudomonas aeruginosa PA01
cgcgauagacgccgg

SEQ ID NO: 1443215 - RNA, 18 nt, Pseudomonas aeruginosa PA01
cgcgauagacgccggcga

SEQ ID NO: 1443216 - RNA, 20 nt, Pseudomonas aeruginosa PA01
cgcgauacccuggccggccu

SEQ ID NO: 1443217 - RNA, 22 nt, Pseudomonas aeruginosa PA01
cgcgauacccuggccggccucg

SEQ ID NO: 1443218 - RNA, 22 nt, Pseudomonas aeruginosa PA01
cgcgauccgcgcggcaaccugu

SEQ ID NO: 1443219 - RNA, 14 nt, Pseudomonas aeruginosa PA01
cgcgauaucacgcc

SEQ ID NO: 1443220 - RNA, 15 nt, Pseudomonas aeruginosa PA01
cgcgauaucacgccc

SEQ ID NO: 1443221 - RNA, 18 nt, Pseudomonas aeruginosa PA01
cgcgauauccgccaggcg

SEQ ID NO: 1443222 - RNA, 14 nt, Pseudomonas aeruginosa PA01
cgcgauaucgcagg

SEQ ID NO: 1443223 - RNA, 16 nt, Pseudomonas aeruginosa PA01
cgcgauaucgcaggcc

SEQ ID NO: 1443224 - RNA, 22 nt, Pseudomonas aeruginosa PA01
cgcgauaucgcaggccaggccc

SEQ ID NO: 1443225 - RNA, 14 nt, Pseudomonas aeruginosa PA01
cgcgcacggaggcg

SEQ ID NO: 1443226 - RNA, 20 nt, Pseudomonas aeruginosa PA01
cgcgcacggaggcgcucagg

SEQ ID NO: 1443227 - RNA, 22 nt, Pseudomonas aeruginosa PA01
cgcgcacggaucgcgcugggcg

SEQ ID NO: 1443228 - RNA, 14 nt, Pseudomonas aeruginosa PA01
cgcgcacggcgaag

SEQ ID NO: 1443229 - RNA, 18 nt, Pseudomonas aeruginosa PA01
cgcgcacgucaccguccu

SEQ ID NO: 1443230 - RNA, 21 nt, Pseudomonas aeruginosa PA01
cgcgcaccagcacuuccggcg

SEQ ID NO: 1443231 - RNA, 12 nt, Pseudomonas aeruginosa PA01
cgcgcaccagcg

SEQ ID NO: 1443232 - RNA, 14 nt, Pseudomonas aeruginosa PA01
cgcgcaccagcggg

SEQ ID NO: 1443233 - RNA, 23 nt, Pseudomonas aeruginosa PA01
cgcgcaccaggccucccagccgu

SEQ ID NO: 1443234 - RNA, 12 nt, Pseudomonas aeruginosa PA01
cgcgcaccaggc

SEQ ID NO: 1443235 - RNA, 21 nt, Pseudomonas aeruginosa PA01
cgcgcaagcucgucacccgcg

SEQ ID NO: 1443236 - RNA, 23 nt, Pseudomonas aeruginosa PA01
cgcgcaagcucgucacccgcgcc

SEQ ID NO: 1443237 - RNA, 16 nt, Pseudomonas aeruginosa PA01
cgcgcaaggcagcguc

SEQ ID NO: 1443238 - RNA, 18 nt, Pseudomonas aeruginosa PA01
cgcgcaaggcagcguccg

SEQ ID NO: 1443239 - RNA, 12 nt, Pseudomonas aeruginosa PA01
cgcgcaaggccg

SEQ ID NO: 1443240 - RNA, 19 nt, Pseudomonas aeruginosa PA01
cgcgcacaugccgagcgaa

SEQ ID NO: 1443241 - RNA, 20 nt, Pseudomonas aeruginosa PA01
cgcgcaccaccgagagcggc

SEQ ID NO: 1443242 - RNA, 15 nt, Pseudomonas aeruginosa PA01
cgcgcaccaccuggc

SEQ ID NO: 1443243 - RNA, 17 nt, Pseudomonas aeruginosa PA01
cgcgaucgaucggcugg

SEQ ID NO: 1443244 - RNA, 23 nt, Pseudomonas aeruginosa PA01
cgcgaucgaggccuacccgcgcu

SEQ ID NO: 1443245 - RNA, 22 nt, Pseudomonas aeruginosa PA01
cgcgauccuccgccagccccag

SEQ ID NO: 1443246 - RNA, 14 nt, Pseudomonas aeruginosa PA01
cgcgauccuggcgg

SEQ ID NO: 1443247 - RNA, 16 nt, Pseudomonas aeruginosa PA01
cgcgauccuggcggca

SEQ ID NO: 1443248 - RNA, 19 nt, Pseudomonas aeruginosa PA01
cgcgauccuucggaggucg

SEQ ID NO: 1443249 - RNA, 22 nt, Pseudomonas aeruginosa PA01
cgcgauccuucggaggucgagc

SEQ ID NO: 1443250 - RNA, 18 nt, Pseudomonas aeruginosa PA01
cgcgaugcguuccagggc

SEQ ID NO: 1443251 - RNA, 23 nt, Pseudomonas aeruginosa PA01
cgcgaugcguuccagggcgaagu

SEQ ID NO: 1443252 - RNA, 14 nt, Pseudomonas aeruginosa PA01
cgcgauggccggcg

SEQ ID NO: 1443253 - RNA, 16 nt, Pseudomonas aeruginosa PA01
cgcgauggccggcgga

SEQ ID NO: 1443254 - RNA, 18 nt, Pseudomonas aeruginosa PA01
cgcgauggccggcggaga

SEQ ID NO: 1443255 - RNA, 18 nt, Pseudomonas aeruginosa PA01
cgcgauggaguaggcguc

SEQ ID NO: 1443256 - RNA, 19 nt, Pseudomonas aeruginosa PA01
cgcgcaacgguuccaugcg

SEQ ID NO: 1443257 - RNA, 19 nt, Pseudomonas aeruginosa PA01
cgcgcaacgcuuccagcac

SEQ ID NO: 1443258 - RNA, 18 nt, Pseudomonas aeruginosa PA01
cgcgauggcucgcggcgc

SEQ ID NO: 1443259 - RNA, 21 nt, Pseudomonas aeruginosa PA01
cgcgauggcucgcggcgcucg

SEQ ID NO: 1443260 - RNA, 18 nt, Pseudomonas aeruginosa PA01
cggccugccccgccggcg

SEQ ID NO: 1443261 - RNA, 16 nt, Pseudomonas aeruginosa PA01
cggccugcagcgacuc

SEQ ID NO: 1443262 - RNA, 15 nt, Pseudomonas aeruginosa PA01
cggccuggcugccga

SEQ ID NO: 1443263 - RNA, 18 nt, Pseudomonas aeruginosa PA01
cggccuggcugccgagca

SEQ ID NO: 1443264 - RNA, 13 nt, Pseudomonas aeruginosa PA01
cggccuggcuggc

SEQ ID NO: 1443265 - RNA, 16 nt, Pseudomonas aeruginosa PA01
cggccuggcuggccuu

SEQ ID NO: 1443266 - RNA, 22 nt, Pseudomonas aeruginosa PA01
cggccuggcgguugaugccgac

SEQ ID NO: 1443267 - RNA, 22 nt, Pseudomonas aeruginosa PA01
cggccuggggcucggcuuccau

SEQ ID NO: 1443268 - RNA, 19 nt, Pseudomonas aeruginosa PA01
cggccuggguacgcaccgg

SEQ ID NO: 1443269 - RNA, 20 nt, Pseudomonas aeruginosa PA01
cggccuggguacgcaccggc

SEQ ID NO: 1443270 - RNA, 14 nt, Pseudomonas aeruginosa PA01
cggccuggucgucg

SEQ ID NO: 1443271 - RNA, 16 nt, Pseudomonas aeruginosa PA01
cggccuggugacccgg

SEQ ID NO: 1443272 - RNA, 17 nt, Pseudomonas aeruginosa PA01
cggccuggugacccgga

SEQ ID NO: 1443273 - RNA, 20 nt, Pseudomonas aeruginosa PA01
cggccuggugacccggacag

SEQ ID NO: 1443274 - RNA, 18 nt, Pseudomonas aeruginosa PA01
cggccuggugcaccuggc

SEQ ID NO: 1443275 - RNA, 17 nt, Pseudomonas aeruginosa PA01
cggccuggugccgggcu

SEQ ID NO: 1443276 - RNA, 15 nt, Pseudomonas aeruginosa PA01
cggccugguaggccu

SEQ ID NO: 1443277 - RNA, 14 nt, Pseudomonas aeruginosa PA01
cggccugguagucg

SEQ ID NO: 1443278 - RNA, 16 nt, Pseudomonas aeruginosa PA01
cggccugguagucgcc

SEQ ID NO: 1443279 - RNA, 22 nt, Pseudomonas aeruginosa PA01
cggccugguagucgccggucag

SEQ ID NO: 1443280 - RNA, 20 nt, Pseudomonas aeruginosa PA01
cggccugguccggcacuucc

SEQ ID NO: 1443281 - RNA, 16 nt, Pseudomonas aeruginosa PA01
cggccuguucggccuu

SEQ ID NO: 1443282 - RNA, 15 nt, Pseudomonas aeruginosa PA01
cggccugucacgccg

SEQ ID NO: 1443283 - RNA, 20 nt, Pseudomonas aeruginosa PA01
cggccugggccgaaggccag

SEQ ID NO: 1443284 - RNA, 22 nt, Pseudomonas aeruginosa PA01
cggccugggccgaaggccaggc

SEQ ID NO: 1443285 - RNA, 17 nt, Pseudomonas aeruginosa PA01
cggccuguucgcccaag

SEQ ID NO: 1443286 - RNA, 22 nt, Pseudomonas aeruginosa PA01
cggccuguucgcccaaggccag

SEQ ID NO: 1443287 - RNA, 15 nt, Pseudomonas aeruginosa PA01
cggccuucgacgaug

SEQ ID NO: 1443288 - RNA, 18 nt, Pseudomonas aeruginosa PA01
cggccuucagcgguggcg

SEQ ID NO: 1443289 - RNA, 22 nt, Pseudomonas aeruginosa PA01
cggccuucagcgguggcguugu

SEQ ID NO: 1443290 - RNA, 18 nt, Pseudomonas aeruginosa PA01
cggccuucaccgcgccgc

SEQ ID NO: 1443291 - RNA, 20 nt, Pseudomonas aeruginosa PA01
cggccuucucgucgccgccc

SEQ ID NO: 1443292 - RNA, 16 nt, Pseudomonas aeruginosa PA01
cggccuucuugcugcc

SEQ ID NO: 1443293 - RNA, 17 nt, Pseudomonas aeruginosa PA01
cggccuucuugcugccg

SEQ ID NO: 1443294 - RNA, 21 nt, Pseudomonas aeruginosa PA01
cggccuucuugcugccggcgu

SEQ ID NO: 1443295 - RNA, 22 nt, Pseudomonas aeruginosa PA01
cggccucgacaucgucucgcga

SEQ ID NO: 1443296 - RNA, 15 nt, Pseudomonas aeruginosa PA01
cggccuccgguggcg

SEQ ID NO: 1443297 - RNA, 13 nt, Pseudomonas aeruginosa PA01
cggccucgagcau

SEQ ID NO: 1443298 - RNA, 19 nt, Pseudomonas aeruginosa PA01
cggccucgagcaucuccgg

SEQ ID NO: 1443299 - RNA, 21 nt, Pseudomonas aeruginosa PA01
cggccucgagcaucuccggca

SEQ ID NO: 1443300 - RNA, 22 nt, Pseudomonas aeruginosa PA01
cggccucgaggucggccuggcu

SEQ ID NO: 1443301 - RNA, 23 nt, Pseudomonas aeruginosa PA01
cggccucgacgcagagcgccaug

SEQ ID NO: 1443302 - RNA, 20 nt, Pseudomonas aeruginosa PA01
cggccucgcaauugaucauc

SEQ ID NO: 1443303 - RNA, 14 nt, Pseudomonas aeruginosa PA01
cggccucgauggcg

SEQ ID NO: 1443304 - RNA, 16 nt, Pseudomonas aeruginosa PA01
cggccucgauggcggc

SEQ ID NO: 1443305 - RNA, 13 nt, Pseudomonas aeruginosa PA01
cggccucgccgau

SEQ ID NO: 1443306 - RNA, 16 nt, Pseudomonas aeruginosa PA01
cggccucgccggucgc

SEQ ID NO: 1443307 - RNA, 18 nt, Pseudomonas aeruginosa PA01
cggccucgccugcggcgc

SEQ ID NO: 1443308 - RNA, 19 nt, Pseudomonas aeruginosa PA01
cggccucgccugcggcgcc

SEQ ID NO: 1443309 - RNA, 14 nt, Pseudomonas aeruginosa PA01
cggccucgcgcaac

SEQ ID NO: 1443310 - RNA, 20 nt, Pseudomonas aeruginosa PA01
cggccucgcgcaacugcggg

SEQ ID NO: 1443311 - RNA, 15 nt, Pseudomonas aeruginosa PA01
cggccucgcggcgcu

SEQ ID NO: 1443312 - RNA, 17 nt, Pseudomonas aeruginosa PA01
cggccucgcggcgcucg

SEQ ID NO: 1443313 - RNA, 19 nt, Pseudomonas aeruginosa PA01
cggccucgcugccgccgca

SEQ ID NO: 1443314 - RNA, 15 nt, Pseudomonas aeruginosa PA01
cggccucggcgucgc

SEQ ID NO: 1443315 - RNA, 12 nt, Pseudomonas aeruginosa PA01
cggccucggccu

SEQ ID NO: 1443316 - RNA, 11 nt, Pseudomonas aeruginosa PA01
cggccucggcg

SEQ ID NO: 1443317 - RNA, 13 nt, Pseudomonas aeruginosa PA01
cggccucggcggc

SEQ ID NO: 1443318 - RNA, 14 nt, Pseudomonas aeruginosa PA01
cggccugcaccagc

SEQ ID NO: 1443319 - RNA, 21 nt, Pseudomonas aeruginosa PA01
cggccugcaccagccaguccg

SEQ ID NO: 1443320 - RNA, 20 nt, Pseudomonas aeruginosa PA01
cggccugagcugccgcuucg

SEQ ID NO: 1443321 - RNA, 19 nt, Pseudomonas aeruginosa PA01
cggccugcaacacccaggc

SEQ ID NO: 1443322 - RNA, 20 nt, Pseudomonas aeruginosa PA01
cggccugcaacacccaggcc

SEQ ID NO: 1443323 - RNA, 21 nt, Pseudomonas aeruginosa PA01
cggccugcaacacccaggccu

SEQ ID NO: 1443324 - RNA, 20 nt, Pseudomonas aeruginosa PA01
cggccucgucgagcaucugc

SEQ ID NO: 1443325 - RNA, 22 nt, Pseudomonas aeruginosa PA01
cggccucgucgagcaucugccg

SEQ ID NO: 1443326 - RNA, 22 nt, Pseudomonas aeruginosa PA01
cggccucggucagguauucgcc

SEQ ID NO: 1443327 - RNA, 14 nt, Pseudomonas aeruginosa PA01
cggccucggcggcg

SEQ ID NO: 1443328 - RNA, 16 nt, Pseudomonas aeruginosa PA01
cggccucggcggcgcg

SEQ ID NO: 1443329 - RNA, 19 nt, Pseudomonas aeruginosa PA01
cggccucguaggcggcgcg

SEQ ID NO: 1443330 - RNA, 19 nt, Pseudomonas aeruginosa PA01
cggccucuccgagacgcug

SEQ ID NO: 1443331 - RNA, 20 nt, Pseudomonas aeruginosa PA01
cggccucuccgagacgcugc

SEQ ID NO: 1443332 - RNA, 15 nt, Pseudomonas aeruginosa PA01
cggccgucacggccu

SEQ ID NO: 1443333 - RNA, 18 nt, Pseudomonas aeruginosa PA01
cggccgucacggccuccg

SEQ ID NO: 1443334 - RNA, 17 nt, Pseudomonas aeruginosa PA01
cggccgucccagguugg

SEQ ID NO: 1443335 - RNA, 13 nt, Pseudomonas aeruginosa PA01
cggccgucccagu

SEQ ID NO: 1443336 - RNA, 16 nt, Pseudomonas aeruginosa PA01
cggccgucccagucgg

SEQ ID NO: 1443337 - RNA, 19 nt, Pseudomonas aeruginosa PA01
cggccgucccagucggcgu

SEQ ID NO: 1443338 - RNA, 22 nt, Pseudomonas aeruginosa PA01
cggccgucccagucggcguccg

SEQ ID NO: 1443339 - RNA, 15 nt, Pseudomonas aeruginosa PA01
cggccgucggccugg

SEQ ID NO: 1443340 - RNA, 17 nt, Pseudomonas aeruginosa PA01
cggccgucggccuggcg

SEQ ID NO: 1443341 - RNA, 21 nt, Pseudomonas aeruginosa PA01
cggccgucgcgcaccacccau

SEQ ID NO: 1443342 - RNA, 15 nt, Pseudomonas aeruginosa PA01
cggccgucgcgcacc

SEQ ID NO: 1443343 - RNA, 22 nt, Pseudomonas aeruginosa PA01
cggccggugccuucggcggcgc

SEQ ID NO: 1443344 - RNA, 15 nt, Pseudomonas aeruginosa PA01
cggccgggucgaggu

SEQ ID NO: 1443345 - RNA, 20 nt, Pseudomonas aeruginosa PA01
cggccggggcgcgcccgcca

SEQ ID NO: 1443346 - RNA, 13 nt, Pseudomonas aeruginosa PA01
cggccggggcgga

SEQ ID NO: 1443347 - RNA, 14 nt, Pseudomonas aeruginosa PA01
cggccggggcggau

SEQ ID NO: 1443348 - RNA, 17 nt, Pseudomonas aeruginosa PA01
cggccggggccggcacc

SEQ ID NO: 1443349 - RNA, 17 nt, Pseudomonas aeruginosa PA01
cggccggggucaggccg

SEQ ID NO: 1443350 - RNA, 18 nt, Pseudomonas aeruginosa PA01
cggccggggucaggccga

SEQ ID NO: 1443351 - RNA, 19 nt, Pseudomonas aeruginosa PA01
cggccggggucaggccgag

SEQ ID NO: 1443352 - RNA, 22 nt, Pseudomonas aeruginosa PA01
cggccggggucaggccgaggcg

SEQ ID NO: 1443353 - RNA, 17 nt, Pseudomonas aeruginosa PA01
cggccuccccggcccgc

SEQ ID NO: 1443354 - RNA, 19 nt, Pseudomonas aeruginosa PA01
cggccuccccggcccgcgc

SEQ ID NO: 1443355 - RNA, 13 nt, Pseudomonas aeruginosa PA01
cggccuccagcgc

SEQ ID NO: 1443356 - RNA, 20 nt, Pseudomonas aeruginosa PA01
cggccuccagcgccucgccg

SEQ ID NO: 1443357 - RNA, 23 nt, Pseudomonas aeruginosa PA01
cggccuccagcgccucgccgagc

SEQ ID NO: 1443358 - RNA, 18 nt, Pseudomonas aeruginosa PA01
cggccuccagcgccuggc

SEQ ID NO: 1443359 - RNA, 19 nt, Pseudomonas aeruginosa PA01
cggccuccagcgccuggcg

SEQ ID NO: 1443360 - RNA, 17 nt, Pseudomonas aeruginosa PA01
cggccuccaggcuggcc

SEQ ID NO: 1443361 - RNA, 19 nt, Pseudomonas aeruginosa PA01
cggccuccaggcuggccuu

SEQ ID NO: 1443362 - RNA, 23 nt, Pseudomonas aeruginosa PA01
cggccucacggguguuucggccg

SEQ ID NO: 1443363 - RNA, 16 nt, Pseudomonas aeruginosa PA01
cggccucaggccuggc

SEQ ID NO: 1443364 - RNA, 17 nt, Pseudomonas aeruginosa PA01
cggccuccagcacucgc

SEQ ID NO: 1443365 - RNA, 17 nt, Pseudomonas aeruginosa PA01
cggccucaacgaccgcc

SEQ ID NO: 1443366 - RNA, 21 nt, Pseudomonas aeruginosa PA01
cggccguucuccgggucgggc

SEQ ID NO: 1443367 - RNA, 13 nt, Pseudomonas aeruginosa PA01
cggccguucgccc

SEQ ID NO: 1443368 - RNA, 18 nt, Pseudomonas aeruginosa PA01
cggccguuucguuuccgu

SEQ ID NO: 1443369 - RNA, 15 nt, Pseudomonas aeruginosa PA01
cggccgugcaugccg

SEQ ID NO: 1443370 - RNA, 16 nt, Pseudomonas aeruginosa PA01
cggccgugcaugccga

SEQ ID NO: 1443371 - RNA, 19 nt, Pseudomonas aeruginosa PA01
cggccgugcaugccgacga

SEQ ID NO: 1443372 - RNA, 21 nt, Pseudomonas aeruginosa PA01
cggccgugcaugccgacgagc

SEQ ID NO: 1443373 - RNA, 22 nt, Pseudomonas aeruginosa PA01
cggccgugcaugccgacgagca

SEQ ID NO: 1443374 - RNA, 15 nt, Pseudomonas aeruginosa PA01
cggccggauuggccg

SEQ ID NO: 1443375 - RNA, 17 nt, Pseudomonas aeruginosa PA01
cggccggauuggccgag

SEQ ID NO: 1443376 - RNA, 21 nt, Pseudomonas aeruginosa PA01
cggccggcggccugagccggc

SEQ ID NO: 1443377 - RNA, 21 nt, Pseudomonas aeruginosa PA01
cggccggcggugagggcgacg

SEQ ID NO: 1443378 - RNA, 14 nt, Pseudomonas aeruginosa PA01
cggccggcgcggcg

SEQ ID NO: 1443379 - RNA, 15 nt, Pseudomonas aeruginosa PA01
cggccggcgcggcgc

SEQ ID NO: 1443380 - RNA, 20 nt, Pseudomonas aeruginosa PA01
cggccggcgcggcgcguucc

SEQ ID NO: 1443381 - RNA, 17 nt, Pseudomonas aeruginosa PA01
cggccggcucagcgcuu

SEQ ID NO: 1443382 - RNA, 19 nt, Pseudomonas aeruginosa PA01
cggccggcucagcgcuucg

SEQ ID NO: 1443383 - RNA, 20 nt, Pseudomonas aeruginosa PA01
cggccggcuucuacgccuug

SEQ ID NO: 1443384 - RNA, 23 nt, Pseudomonas aeruginosa PA01
cggccgggauaugggugaugacc

SEQ ID NO: 1443385 - RNA, 17 nt, Pseudomonas aeruginosa PA01
cggccgccgagcaacug

SEQ ID NO: 1443386 - RNA, 13 nt, Pseudomonas aeruginosa PA01
cggccgccgccga

SEQ ID NO: 1443387 - RNA, 14 nt, Pseudomonas aeruginosa PA01
cggccgccgccgac

SEQ ID NO: 1443388 - RNA, 15 nt, Pseudomonas aeruginosa PA01
cggccgccgccgaca

SEQ ID NO: 1443389 - RNA, 12 nt, Pseudomonas aeruginosa PA01
cggccgccggcg

SEQ ID NO: 1443390 - RNA, 15 nt, Pseudomonas aeruginosa PA01
cggccgccggcgccc

SEQ ID NO: 1443391 - RNA, 18 nt, Pseudomonas aeruginosa PA01
cggccgccggcgcccugc

SEQ ID NO: 1443392 - RNA, 13 nt, Pseudomonas aeruginosa PA01
cggccgccugccu

SEQ ID NO: 1443393 - RNA, 23 nt, Pseudomonas aeruginosa PA01
cggccgcugucgucuucggccag

SEQ ID NO: 1443394 - RNA, 21 nt, Pseudomonas aeruginosa PA01
cggccgcuggcgaucucggcg

SEQ ID NO: 1443395 - RNA, 22 nt, Pseudomonas aeruginosa PA01
cggccgcuggcgaucucggcgc

SEQ ID NO: 1443396 - RNA, 17 nt, Pseudomonas aeruginosa PA01
cggccgcgucgcccagg

SEQ ID NO: 1443397 - RNA, 13 nt, Pseudomonas aeruginosa PA01
cggccgcguccga

SEQ ID NO: 1443398 - RNA, 21 nt, Pseudomonas aeruginosa PA01
cggccgcguccgagagcaggg

SEQ ID NO: 1443399 - RNA, 14 nt, Pseudomonas aeruginosa PA01
cggccgcggcuggc

SEQ ID NO: 1443400 - RNA, 16 nt, Pseudomonas aeruginosa PA01
cggccgccucggucca

SEQ ID NO: 1443401 - RNA, 18 nt, Pseudomonas aeruginosa PA01
cggccgccuggcgugccg

SEQ ID NO: 1443402 - RNA, 21 nt, Pseudomonas aeruginosa PA01
cggccgccuggcgugccgcca

SEQ ID NO: 1443403 - RNA, 14 nt, Pseudomonas aeruginosa PA01
cggccccaccgcac

SEQ ID NO: 1443404 - RNA, 14 nt, Pseudomonas aeruginosa PA01
cggccccaccuggc

SEQ ID NO: 1443405 - RNA, 19 nt, Pseudomonas aeruginosa PA01
cggccccaggcugcccagg

SEQ ID NO: 1443406 - RNA, 22 nt, Pseudomonas aeruginosa PA01
cggccccaccuggcgacaggcg

SEQ ID NO: 1443407 - RNA, 14 nt, Pseudomonas aeruginosa PA01
cggcccggagccaa

SEQ ID NO: 1443408 - RNA, 20 nt, Pseudomonas aeruginosa PA01
cggcccggagcgcgaggcga

SEQ ID NO: 1443409 - RNA, 13 nt, Pseudomonas aeruginosa PA01
cggcccggccagg

SEQ ID NO: 1443410 - RNA, 15 nt, Pseudomonas aeruginosa PA01
cggcccggccaggcg

SEQ ID NO: 1443411 - RNA, 19 nt, Pseudomonas aeruginosa PA01
cggcccggccaggcgauag

SEQ ID NO: 1443412 - RNA, 14 nt, Pseudomonas aeruginosa PA01
cggcccggccaggu

SEQ ID NO: 1443413 - RNA, 13 nt, Pseudomonas aeruginosa PA01
cggcccggcaggc

SEQ ID NO: 1443414 - RNA, 15 nt, Pseudomonas aeruginosa PA01
cggcccggcaggcgc

SEQ ID NO: 1443415 - RNA, 16 nt, Pseudomonas aeruginosa PA01
cggcccggcaggcgca

SEQ ID NO: 1443416 - RNA, 14 nt, Pseudomonas aeruginosa PA01
cggcccggcgcugc

SEQ ID NO: 1443417 - RNA, 19 nt, Pseudomonas aeruginosa PA01
cggcccggcgcugcccggg

SEQ ID NO: 1443418 - RNA, 12 nt, Pseudomonas aeruginosa PA01
cggcccuccggc

SEQ ID NO: 1443419 - RNA, 18 nt, Pseudomonas aeruginosa PA01
cggcccggcgugagcagg

SEQ ID NO: 1443420 - RNA, 13 nt, Pseudomonas aeruginosa PA01
cggcccugcgccg

SEQ ID NO: 1443421 - RNA, 22 nt, Pseudomonas aeruginosa PA01
cggcccugcgccgcagcggcca

SEQ ID NO: 1443422 - RNA, 22 nt, Pseudomonas aeruginosa PA01
cggcccgggccuggugcacgcc

SEQ ID NO: 1443423 - RNA, 15 nt, Pseudomonas aeruginosa PA01
cggcccugcucgccg

SEQ ID NO: 1443424 - RNA, 17 nt, Pseudomonas aeruginosa PA01
cggcccugcucgccggc

SEQ ID NO: 1443425 - RNA, 18 nt, Pseudomonas aeruginosa PA01
cggcccugcucgccggcg

SEQ ID NO: 1443426 - RNA, 16 nt, Pseudomonas aeruginosa PA01
cggcccuucgacaugg

SEQ ID NO: 1443427 - RNA, 14 nt, Pseudomonas aeruginosa PA01
cggcccuggcggcg

SEQ ID NO: 1443428 - RNA, 18 nt, Pseudomonas aeruginosa PA01
cggccgacagagcggccg

SEQ ID NO: 1443429 - RNA, 19 nt, Pseudomonas aeruginosa PA01
cggccgacagagcggccgg

SEQ ID NO: 1443430 - RNA, 15 nt, Pseudomonas aeruginosa PA01
cggcccuucgacgac

SEQ ID NO: 1443431 - RNA, 14 nt, Pseudomonas aeruginosa PA01
cggccgacaggcug

SEQ ID NO: 1443432 - RNA, 13 nt, Pseudomonas aeruginosa PA01
cggccgaccaggc

SEQ ID NO: 1443433 - RNA, 18 nt, Pseudomonas aeruginosa PA01
cggccgaccaggccguag

SEQ ID NO: 1443434 - RNA, 19 nt, Pseudomonas aeruginosa PA01
cggccgagauccugcagca

SEQ ID NO: 1443435 - RNA, 15 nt, Pseudomonas aeruginosa PA01
cggccgagcaccacg

SEQ ID NO: 1443436 - RNA, 16 nt, Pseudomonas aeruginosa PA01
cggccgagcaccacgc

SEQ ID NO: 1443437 - RNA, 18 nt, Pseudomonas aeruginosa PA01
cggccgagcaggcgcgcc

SEQ ID NO: 1443438 - RNA, 19 nt, Pseudomonas aeruginosa PA01
cggccgagcaggcgcgcca

SEQ ID NO: 1443439 - RNA, 23 nt, Pseudomonas aeruginosa PA01
cggccgagcaggcgcgccaggcc

SEQ ID NO: 1443440 - RNA, 22 nt, Pseudomonas aeruginosa PA01
cggccgacgguaguaccucgaa

SEQ ID NO: 1443441 - RNA, 21 nt, Pseudomonas aeruginosa PA01
cggccgaggaacuccuccucg

SEQ ID NO: 1443442 - RNA, 20 nt, Pseudomonas aeruginosa PA01
cggccgaggaaggcgcuggc

SEQ ID NO: 1443443 - RNA, 15 nt, Pseudomonas aeruginosa PA01
cggccgaggcuuccu

SEQ ID NO: 1443444 - RNA, 14 nt, Pseudomonas aeruginosa PA01
cggccgagggcagc

SEQ ID NO: 1443445 - RNA, 14 nt, Pseudomonas aeruginosa PA01
cggccgaguucgcg

SEQ ID NO: 1443446 - RNA, 23 nt, Pseudomonas aeruginosa PA01
cggccgaguucgcgcaggcgcug

SEQ ID NO: 1443447 - RNA, 15 nt, Pseudomonas aeruginosa PA01
cggccgaucaucggc

SEQ ID NO: 1443448 - RNA, 16 nt, Pseudomonas aeruginosa PA01
cggccgaucaucggcu

SEQ ID NO: 1443449 - RNA, 19 nt, Pseudomonas aeruginosa PA01
cggccgaucaucggcuggu

SEQ ID NO: 1443450 - RNA, 21 nt, Pseudomonas aeruginosa PA01
cggccgaucaccuucaccggc

SEQ ID NO: 1443451 - RNA, 15 nt, Pseudomonas aeruginosa PA01
cggcauucgccgggc

SEQ ID NO: 1443452 - RNA, 16 nt, Pseudomonas aeruginosa PA01
cggcauucgcgcuggu

SEQ ID NO: 1443453 - RNA, 14 nt, Pseudomonas aeruginosa PA01
cggcauuccugguc

SEQ ID NO: 1443454 - RNA, 15 nt, Pseudomonas aeruginosa PA01
cggcauuccuggucc

SEQ ID NO: 1443455 - RNA, 21 nt, Pseudomonas aeruginosa PA01
cggcauuccugguccagccag

SEQ ID NO: 1443456 - RNA, 22 nt, Pseudomonas aeruginosa PA01
cggcauuccugguccagccagc

SEQ ID NO: 1443457 - RNA, 14 nt, Pseudomonas aeruginosa PA01
cggcauucgacccg

SEQ ID NO: 1443458 - RNA, 17 nt, Pseudomonas aeruginosa PA01
cggcauucgacccgccg

SEQ ID NO: 1443459 - RNA, 18 nt, Pseudomonas aeruginosa PA01
cggcauucgacccgccga

SEQ ID NO: 1443460 - RNA, 21 nt, Pseudomonas aeruginosa PA01
cggcauucgacccgccgacca

SEQ ID NO: 1443461 - RNA, 20 nt, Pseudomonas aeruginosa PA01
cggcauguugugcuugacga

SEQ ID NO: 1443462 - RNA, 16 nt, Pseudomonas aeruginosa PA01
cggcauugagggcgag

SEQ ID NO: 1443463 - RNA, 23 nt, Pseudomonas aeruginosa PA01
cggcauggcuguagggacaggcu

SEQ ID NO: 1443464 - RNA, 17 nt, Pseudomonas aeruginosa PA01
cggcaugggcauccugc

SEQ ID NO: 1443465 - RNA, 18 nt, Pseudomonas aeruginosa PA01
cggcaugggcauccugcc

SEQ ID NO: 1443466 - RNA, 16 nt, Pseudomonas aeruginosa PA01
cggcauggucagccca

SEQ ID NO: 1443467 - RNA, 23 nt, Pseudomonas aeruginosa PA01
cggcaugguccguucggcgccca

SEQ ID NO: 1443468 - RNA, 14 nt, Pseudomonas aeruginosa PA01
cggcauggccgacc

SEQ ID NO: 1443469 - RNA, 20 nt, Pseudomonas aeruginosa PA01
cggcauggccgaccgccagg

SEQ ID NO: 1443470 - RNA, 24 nt, Pseudomonas aeruginosa PA01
cggcauggccgaccgccaggccga

SEQ ID NO: 1443471 - RNA, 19 nt, Pseudomonas aeruginosa PA01
cggccaccgacgcgcgcgc

SEQ ID NO: 1443472 - RNA, 21 nt, Pseudomonas aeruginosa PA01
cggcaggaaauccgccgcgca

SEQ ID NO: 1443473 - RNA, 13 nt, Pseudomonas aeruginosa PA01
cggcaggaccucg

SEQ ID NO: 1443474 - RNA, 20 nt, Pseudomonas aeruginosa PA01
cggcaggaccucgggcgaga

SEQ ID NO: 1443475 - RNA, 20 nt, Pseudomonas aeruginosa PA01
cggcaggaacgcccgcggca

SEQ ID NO: 1443476 - RNA, 14 nt, Pseudomonas aeruginosa PA01
cggcaggaucaggc

SEQ ID NO: 1443477 - RNA, 15 nt, Pseudomonas aeruginosa PA01
cggcaggaucaggcu

SEQ ID NO: 1443478 - RNA, 19 nt, Pseudomonas aeruginosa PA01
cggcaggaucaggcucgag

SEQ ID NO: 1443479 - RNA, 20 nt, Pseudomonas aeruginosa PA01
cggcaggaucaggcucgagc

SEQ ID NO: 1443480 - RNA, 21 nt, Pseudomonas aeruginosa PA01
cggcaggaucaggcucgagcc

SEQ ID NO: 1443481 - RNA, 15 nt, Pseudomonas aeruginosa PA01
cggcaggaucggcgc

SEQ ID NO: 1443482 - RNA, 16 nt, Pseudomonas aeruginosa PA01
cggcaggaucggcgcg

SEQ ID NO: 1443483 - RNA, 21 nt, Pseudomonas aeruginosa PA01
cggcaggaucggcgcggucgg

SEQ ID NO: 1443484 - RNA, 23 nt, Pseudomonas aeruginosa PA01
cggcagcuuggcgacguccugcg

SEQ ID NO: 1443485 - RNA, 12 nt, Pseudomonas aeruginosa PA01
cggcaggccgau

SEQ ID NO: 1443486 - RNA, 13 nt, Pseudomonas aeruginosa PA01
cggcaggccgaug

SEQ ID NO: 1443487 - RNA, 16 nt, Pseudomonas aeruginosa PA01
cggcaggccgauggcc

SEQ ID NO: 1443488 - RNA, 14 nt, Pseudomonas aeruginosa PA01
cggcaggccgaugu

SEQ ID NO: 1443489 - RNA, 15 nt, Pseudomonas aeruginosa PA01
cggcaggccacggcc

SEQ ID NO: 1443490 - RNA, 17 nt, Pseudomonas aeruginosa PA01
cggcaggccacggccgc

SEQ ID NO: 1443491 - RNA, 23 nt, Pseudomonas aeruginosa PA01
cggcaggccacggccgcugcgca

SEQ ID NO: 1443492 - RNA, 15 nt, Pseudomonas aeruginosa PA01
cggcaggccagcagg

SEQ ID NO: 1443493 - RNA, 23 nt, Pseudomonas aeruginosa PA01
cggcaggccagcuuccaggcgcg

SEQ ID NO: 1443494 - RNA, 15 nt, Pseudomonas aeruginosa PA01
cggcaggcacgcugc

SEQ ID NO: 1443495 - RNA, 19 nt, Pseudomonas aeruginosa PA01
cggcaggcacgcugccagc

SEQ ID NO: 1443496 - RNA, 17 nt, Pseudomonas aeruginosa PA01
cggcagcucccuugccg

SEQ ID NO: 1443497 - RNA, 14 nt, Pseudomonas aeruginosa PA01
cggcagcuccggcg

SEQ ID NO: 1443498 - RNA, 22 nt, Pseudomonas aeruginosa PA01
cggcagcucgcuaugcagcagg

SEQ ID NO: 1443499 - RNA, 14 nt, Pseudomonas aeruginosa PA01
cggcagcucggcga

SEQ ID NO: 1443500 - RNA, 16 nt, Pseudomonas aeruginosa PA01
cggcagcucggcgaca

SEQ ID NO: 1443501 - RNA, 18 nt, Pseudomonas aeruginosa PA01
cggcagcucauaggucag

SEQ ID NO: 1443502 - RNA, 23 nt, Pseudomonas aeruginosa PA01
cggcagcucauaggucagguaca

SEQ ID NO: 1443503 - RNA, 20 nt, Pseudomonas aeruginosa PA01
cggcagcugcggcggcacca

SEQ ID NO: 1443504 - RNA, 22 nt, Pseudomonas aeruginosa PA01
cggcagcugcggcggcaccacg

SEQ ID NO: 1443505 - RNA, 20 nt, Pseudomonas aeruginosa PA01
cggcacgaccacaucggcca

SEQ ID NO: 1443506 - RNA, 13 nt, Pseudomonas aeruginosa PA01
cggcaggucgagg

SEQ ID NO: 1443507 - RNA, 15 nt, Pseudomonas aeruginosa PA01
cggcaggucggacag

SEQ ID NO: 1443508 - RNA, 19 nt, Pseudomonas aeruginosa PA01
cggcauaggcccggcgugc

SEQ ID NO: 1443509 - RNA, 13 nt, Pseudomonas aeruginosa PA01
cggcauaggcgcc

SEQ ID NO: 1443510 - RNA, 18 nt, Pseudomonas aeruginosa PA01
cggcauagaugccggccu

SEQ ID NO: 1443511 - RNA, 20 nt, Pseudomonas aeruginosa PA01
cggcauagaugccggccucg

SEQ ID NO: 1443512 - RNA, 22 nt, Pseudomonas aeruginosa PA01
cggcauagccgaacuccgccag

SEQ ID NO: 1443513 - RNA, 16 nt, Pseudomonas aeruginosa PA01
cggcagggcgauccgc

SEQ ID NO: 1443514 - RNA, 20 nt, Pseudomonas aeruginosa PA01
cggcagggcgauccgcccgc

SEQ ID NO: 1443515 - RNA, 18 nt, Pseudomonas aeruginosa PA01
cggcagggcgcccgcccg

SEQ ID NO: 1443516 - RNA, 14 nt, Pseudomonas aeruginosa PA01
cggcagggcgccga

SEQ ID NO: 1443517 - RNA, 18 nt, Pseudomonas aeruginosa PA01
cggcaggccgccgauccc

SEQ ID NO: 1443518 - RNA, 16 nt, Pseudomonas aeruginosa PA01
cggcagggcggcgaug

SEQ ID NO: 1443519 - RNA, 16 nt, Pseudomonas aeruginosa PA01
cggcagguagaccucg

SEQ ID NO: 1443520 - RNA, 18 nt, Pseudomonas aeruginosa PA01
cggcaggguacgggucgg

SEQ ID NO: 1443521 - RNA, 15 nt, Pseudomonas aeruginosa PA01
cggcagggucacgcc

SEQ ID NO: 1443522 - RNA, 13 nt, Pseudomonas aeruginosa PA01
cggcauccuggcg

SEQ ID NO: 1443523 - RNA, 14 nt, Pseudomonas aeruginosa PA01
cggcauccuggcgg

SEQ ID NO: 1443524 - RNA, 14 nt, Pseudomonas aeruginosa PA01
cggcaucccgcccg

SEQ ID NO: 1443525 - RNA, 15 nt, Pseudomonas aeruginosa PA01
cggcaucccgcccgg

SEQ ID NO: 1443526 - RNA, 15 nt, Pseudomonas aeruginosa PA01
cggcauccgccgcug

SEQ ID NO: 1443527 - RNA, 12 nt, Pseudomonas aeruginosa PA01
cggcauccucgc

SEQ ID NO: 1443528 - RNA, 22 nt, Pseudomonas aeruginosa PA01
cggcaucgaccagcagcggcuc

SEQ ID NO: 1443529 - RNA, 21 nt, Pseudomonas aeruginosa PA01
cggcaucgaccagggccgggu

SEQ ID NO: 1443530 - RNA, 21 nt, Pseudomonas aeruginosa PA01
cggcauccaguuccugcacca

SEQ ID NO: 1443531 - RNA, 23 nt, Pseudomonas aeruginosa PA01
cggcauccaguuccugcaccacg

SEQ ID NO: 1443532 - RNA, 13 nt, Pseudomonas aeruginosa PA01
cggcauccagcau

SEQ ID NO: 1443533 - RNA, 15 nt, Pseudomonas aeruginosa PA01
cggcauccagcaucc

SEQ ID NO: 1443534 - RNA, 14 nt, Pseudomonas aeruginosa PA01
cggcaucaccggcg

SEQ ID NO: 1443535 - RNA, 24 nt, Pseudomonas aeruginosa PA01
cggcaucaccggcgggauguacgc

SEQ ID NO: 1443536 - RNA, 11 nt, Pseudomonas aeruginosa PA01
cggcccacgcu

SEQ ID NO: 1443537 - RNA, 15 nt, Pseudomonas aeruginosa PA01
cggcccacggcgaga

SEQ ID NO: 1443538 - RNA, 12 nt, Pseudomonas aeruginosa PA01
cggcccagcagc

SEQ ID NO: 1443539 - RNA, 15 nt, Pseudomonas aeruginosa PA01
cggcccagcagcgcu

SEQ ID NO: 1443540 - RNA, 17 nt, Pseudomonas aeruginosa PA01
cggcccagcagcgcuca

SEQ ID NO: 1443541 - RNA, 19 nt, Pseudomonas aeruginosa PA01
cggcccagccgcggcgcca

SEQ ID NO: 1443542 - RNA, 20 nt, Pseudomonas aeruginosa PA01
cggcccagccgcggcgccac

SEQ ID NO: 1443543 - RNA, 17 nt, Pseudomonas aeruginosa PA01
cggcccaugcggaucgc

SEQ ID NO: 1443544 - RNA, 18 nt, Pseudomonas aeruginosa PA01
cggcccaugcggaucgcc

SEQ ID NO: 1443545 - RNA, 14 nt, Pseudomonas aeruginosa PA01
cggcccauggcgac

SEQ ID NO: 1443546 - RNA, 16 nt, Pseudomonas aeruginosa PA01
cggcccauggcgacgc

SEQ ID NO: 1443547 - RNA, 18 nt, Pseudomonas aeruginosa PA01
cggcccauccgccgcagg

SEQ ID NO: 1443548 - RNA, 22 nt, Pseudomonas aeruginosa PA01
cggcccaugaaaaagcccggcc

SEQ ID NO: 1443549 - RNA, 13 nt, Pseudomonas aeruginosa PA01
cggccaugccggc

SEQ ID NO: 1443550 - RNA, 17 nt, Pseudomonas aeruginosa PA01
cggccaugccggccagg

SEQ ID NO: 1443551 - RNA, 15 nt, Pseudomonas aeruginosa PA01
cggccaugcaggcca

SEQ ID NO: 1443552 - RNA, 20 nt, Pseudomonas aeruginosa PA01
cggccaugcaggccagggcg

SEQ ID NO: 1443553 - RNA, 16 nt, Pseudomonas aeruginosa PA01
cggccaugccgccgac

SEQ ID NO: 1443554 - RNA, 19 nt, Pseudomonas aeruginosa PA01
cggccaugccgccgacgcc

SEQ ID NO: 1443555 - RNA, 20 nt, Pseudomonas aeruginosa PA01
cggccaugccgccgacgccg

SEQ ID NO: 1443556 - RNA, 15 nt, Pseudomonas aeruginosa PA01
cggccauggccgagc

SEQ ID NO: 1443557 - RNA, 14 nt, Pseudomonas aeruginosa PA01
cggccauggccgag

SEQ ID NO: 1443558 - RNA, 13 nt, Pseudomonas aeruginosa PA01
cggccauggccga

SEQ ID NO: 1443559 - RNA, 17 nt, Pseudomonas aeruginosa PA01
cggccaucuggcugccg

SEQ ID NO: 1443560 - RNA, 16 nt, Pseudomonas aeruginosa PA01
cggccaugagccgggg

SEQ ID NO: 1443561 - RNA, 17 nt, Pseudomonas aeruginosa PA01
cggccaugagccggggu

SEQ ID NO: 1443562 - RNA, 15 nt, Pseudomonas aeruginosa PA01
cggccaucagcacca

SEQ ID NO: 1443563 - RNA, 16 nt, Pseudomonas aeruginosa PA01
cggccaucagcaccag

SEQ ID NO: 1443564 - RNA, 17 nt, Pseudomonas aeruginosa PA01
cggccaucagcaccagg

SEQ ID NO: 1443565 - RNA, 14 nt, Pseudomonas aeruginosa PA01
cggccaggccgccc

SEQ ID NO: 1443566 - RNA, 12 nt, Pseudomonas aeruginosa PA01
cggccaggcgau

SEQ ID NO: 1443567 - RNA, 14 nt, Pseudomonas aeruginosa PA01
cggccaggcgccag

SEQ ID NO: 1443568 - RNA, 23 nt, Pseudomonas aeruginosa PA01
cggccaggcgccagggccggguc

SEQ ID NO: 1443569 - RNA, 18 nt, Pseudomonas aeruginosa PA01
cggccaggcgccagguag

SEQ ID NO: 1443570 - RNA, 12 nt, Pseudomonas aeruginosa PA01
cggccaggcgcg

SEQ ID NO: 1443571 - RNA, 22 nt, Pseudomonas aeruginosa PA01
cggccagggccgcucgagggcg

SEQ ID NO: 1443572 - RNA, 15 nt, Pseudomonas aeruginosa PA01
cggccagggcgcggu

SEQ ID NO: 1443573 - RNA, 15 nt, Pseudomonas aeruginosa PA01
cggccagggcgaaca

SEQ ID NO: 1443574 - RNA, 20 nt, Pseudomonas aeruginosa PA01
cggccagggcgaacagcgcc

SEQ ID NO: 1443575 - RNA, 21 nt, Pseudomonas aeruginosa PA01
cggccagggcgaacagcgccg

SEQ ID NO: 1443576 - RNA, 22 nt, Pseudomonas aeruginosa PA01
cggccagggcgaacagcgccgc

SEQ ID NO: 1443577 - RNA, 14 nt, Pseudomonas aeruginosa PA01
cggccaggcgcggc

SEQ ID NO: 1443578 - RNA, 15 nt, Pseudomonas aeruginosa PA01
cggccaggcgcgggu

SEQ ID NO: 1443579 - RNA, 23 nt, Pseudomonas aeruginosa PA01
cggccagggcaugggucagcgcc

SEQ ID NO: 1443580 - RNA, 18 nt, Pseudomonas aeruginosa PA01
cggccaggcgguccagcc

SEQ ID NO: 1443581 - RNA, 22 nt, Pseudomonas aeruginosa PA01
cggccaggcgcugguccagcac

SEQ ID NO: 1443582 - RNA, 16 nt, Pseudomonas aeruginosa PA01
cggccaggcggccgac

SEQ ID NO: 1443583 - RNA, 20 nt, Pseudomonas aeruginosa PA01
cggccagguaccggccaggc

SEQ ID NO: 1443584 - RNA, 16 nt, Pseudomonas aeruginosa PA01
cggccagguacuuggc

SEQ ID NO: 1443585 - RNA, 20 nt, Pseudomonas aeruginosa PA01
cggccagguaggcgacgaag

SEQ ID NO: 1443586 - RNA, 14 nt, Pseudomonas aeruginosa PA01
cggccagggucgcc

SEQ ID NO: 1443587 - RNA, 21 nt, Pseudomonas aeruginosa PA01
cggccaggggcugaacagcgc

SEQ ID NO: 1443588 - RNA, 15 nt, Pseudomonas aeruginosa PA01
cggccaggggagcgc

SEQ ID NO: 1443589 - RNA, 17 nt, Pseudomonas aeruginosa PA01
cggccaggggagcgccg

SEQ ID NO: 1443590 - RNA, 20 nt, Pseudomonas aeruginosa PA01
cggccaggggagcgccggcg

SEQ ID NO: 1443591 - RNA, 23 nt, Pseudomonas aeruginosa PA01
cggccaggggagcgccggcgcgg

SEQ ID NO: 1443592 - RNA, 16 nt, Pseudomonas aeruginosa PA01
cggccauaccuccagc

SEQ ID NO: 1443593 - RNA, 22 nt, Pseudomonas aeruginosa PA01
cggccauaccuccagccagcag

SEQ ID NO: 1443594 - RNA, 17 nt, Pseudomonas aeruginosa PA01
cggccaguucgucgagc

SEQ ID NO: 1443595 - RNA, 16 nt, Pseudomonas aeruginosa PA01
cggccauaauggccgc

SEQ ID NO: 1443596 - RNA, 20 nt, Pseudomonas aeruginosa PA01
cggccaguuggugcacgcgc

SEQ ID NO: 1443597 - RNA, 13 nt, Pseudomonas aeruginosa PA01
cggccaguuccuu

SEQ ID NO: 1443598 - RNA, 20 nt, Pseudomonas aeruginosa PA01
cggccaguuccuucacggca

SEQ ID NO: 1443599 - RNA, 22 nt, Pseudomonas aeruginosa PA01
cggccaguuccuucacggcauc

SEQ ID NO: 1443600 - RNA, 23 nt, Pseudomonas aeruginosa PA01
cggccaguuccuucacggcaucc

SEQ ID NO: 1443601 - RNA, 15 nt, Pseudomonas aeruginosa PA01
cggccagcagcacgc

SEQ ID NO: 1443602 - RNA, 16 nt, Pseudomonas aeruginosa PA01
cggccagcagcacgcc

SEQ ID NO: 1443603 - RNA, 20 nt, Pseudomonas aeruginosa PA01
cggccagcagcacggcgacg

SEQ ID NO: 1443604 - RNA, 15 nt, Pseudomonas aeruginosa PA01
cggccagcagcgccu

SEQ ID NO: 1443605 - RNA, 12 nt, Pseudomonas aeruginosa PA01
cggccagccccc

SEQ ID NO: 1443606 - RNA, 17 nt, Pseudomonas aeruginosa PA01
cggccagccagggcagc

SEQ ID NO: 1443607 - RNA, 20 nt, Pseudomonas aeruginosa PA01
cggccagccagggcagcagg

SEQ ID NO: 1443608 - RNA, 23 nt, Pseudomonas aeruginosa PA01
cggccagccgcuagcgguagccg

SEQ ID NO: 1443609 - RNA, 14 nt, Pseudomonas aeruginosa PA01
cggccagccgcgcc

SEQ ID NO: 1443610 - RNA, 16 nt, Pseudomonas aeruginosa PA01
cggccagccgcgccag

SEQ ID NO: 1443611 - RNA, 15 nt, Pseudomonas aeruginosa PA01
cggccagcccggccu

SEQ ID NO: 1443612 - RNA, 18 nt, Pseudomonas aeruginosa PA01
cggccagcggaugcuggc

SEQ ID NO: 1443613 - RNA, 21 nt, Pseudomonas aeruginosa PA01
cggccagcggaugcuggcgga

SEQ ID NO: 1443614 - RNA, 17 nt, Pseudomonas aeruginosa PA01
cggccaggcccacgccg

SEQ ID NO: 1443615 - RNA, 19 nt, Pseudomonas aeruginosa PA01
cggccagcguccuucggcg

SEQ ID NO: 1443616 - RNA, 16 nt, Pseudomonas aeruginosa PA01
cggccaggccacggcg

SEQ ID NO: 1443617 - RNA, 18 nt, Pseudomonas aeruginosa PA01
cggccaggccacggcgga

SEQ ID NO: 1443618 - RNA, 14 nt, Pseudomonas aeruginosa PA01
cggccaccuucgcc

SEQ ID NO: 1443619 - RNA, 21 nt, Pseudomonas aeruginosa PA01
cggccaccuucgcccgcugcg

SEQ ID NO: 1443620 - RNA, 16 nt, Pseudomonas aeruginosa PA01
cggccacgcgaccagc

SEQ ID NO: 1443621 - RNA, 17 nt, Pseudomonas aeruginosa PA01
cggccacgcgaccagcg

SEQ ID NO: 1443622 - RNA, 18 nt, Pseudomonas aeruginosa PA01
cggccacgcgaccagcgc

SEQ ID NO: 1443623 - RNA, 20 nt, Pseudomonas aeruginosa PA01
cggccacgcgaccagcgcca

SEQ ID NO: 1443624 - RNA, 13 nt, Pseudomonas aeruginosa PA01
cggccacggcgga

SEQ ID NO: 1443625 - RNA, 14 nt, Pseudomonas aeruginosa PA01
cggccacuaucgcc

SEQ ID NO: 1443626 - RNA, 19 nt, Pseudomonas aeruginosa PA01
cggccacuccagccccgcg

SEQ ID NO: 1443627 - RNA, 19 nt, Pseudomonas aeruginosa PA01
cggccacucgcagccgcgc

SEQ ID NO: 1443628 - RNA, 20 nt, Pseudomonas aeruginosa PA01
cggccacucgcagccgcgcu

SEQ ID NO: 1443629 - RNA, 17 nt, Pseudomonas aeruginosa PA01
cggccacuucguccggc

SEQ ID NO: 1443630 - RNA, 18 nt, Pseudomonas aeruginosa PA01
cggccacuucguccggcc

SEQ ID NO: 1443631 - RNA, 19 nt, Pseudomonas aeruginosa PA01
cggccagagcuucugcugg

SEQ ID NO: 1443632 - RNA, 20 nt, Pseudomonas aeruginosa PA01
cggccagagcuucugcugga

SEQ ID NO: 1443633 - RNA, 21 nt, Pseudomonas aeruginosa PA01
cggauagucggaacgaccggu

SEQ ID NO: 1443634 - RNA, 17 nt, Pseudomonas aeruginosa PA01
cggauauagcuggucaa

SEQ ID NO: 1443635 - RNA, 23 nt, Pseudomonas aeruginosa PA01
cggauauccccguauccuccgcg

SEQ ID NO: 1443636 - RNA, 15 nt, Pseudomonas aeruginosa PA01
cggauaucgcgccgc

SEQ ID NO: 1443637 - RNA, 15 nt, Pseudomonas aeruginosa PA01
cggauaucgcguggu

SEQ ID NO: 1443638 - RNA, 16 nt, Pseudomonas aeruginosa PA01
cggauaugcgccgcca

SEQ ID NO: 1443639 - RNA, 13 nt, Pseudomonas aeruginosa PA01
cggaucaacgccg

SEQ ID NO: 1443640 - RNA, 15 nt, Pseudomonas aeruginosa PA01
cggaucaacgccggu

SEQ ID NO: 1443641 - RNA, 16 nt, Pseudomonas aeruginosa PA01
cggaucaacgccgguc

SEQ ID NO: 1443642 - RNA, 15 nt, Pseudomonas aeruginosa PA01
cggaucaacgggccc

SEQ ID NO: 1443643 - RNA, 20 nt, Pseudomonas aeruginosa PA01
cggaucacaggcucuucucg

SEQ ID NO: 1443644 - RNA, 12 nt, Pseudomonas aeruginosa PA01
cggaucaccacg

SEQ ID NO: 1443645 - RNA, 22 nt, Pseudomonas aeruginosa PA01
cggaucaccacguaaucgccau

SEQ ID NO: 1443646 - RNA, 12 nt, Pseudomonas aeruginosa PA01
cggaucaccggc

SEQ ID NO: 1443647 - RNA, 13 nt, Pseudomonas aeruginosa PA01
cggaucaccuggc

SEQ ID NO: 1443648 - RNA, 21 nt, Pseudomonas aeruginosa PA01
cggaucaggcgggcuccgccg

SEQ ID NO: 1443649 - RNA, 14 nt, Pseudomonas aeruginosa PA01
cggaucaggcuggg

SEQ ID NO: 1443650 - RNA, 14 nt, Pseudomonas aeruginosa PA01
cggauaccacccgc

SEQ ID NO: 1443651 - RNA, 14 nt, Pseudomonas aeruginosa PA01
cggauagcaccgau

SEQ ID NO: 1443652 - RNA, 17 nt, Pseudomonas aeruginosa PA01
cggauacggcaggguag

SEQ ID NO: 1443653 - RNA, 17 nt, Pseudomonas aeruginosa PA01
cggauagccaaccagau

SEQ ID NO: 1443654 - RNA, 16 nt, Pseudomonas aeruginosa PA01
cggauagccgcaagcg

SEQ ID NO: 1443655 - RNA, 21 nt, Pseudomonas aeruginosa PA01
cggauagccgugcagcagcga

SEQ ID NO: 1443656 - RNA, 13 nt, Pseudomonas aeruginosa PA01
cggauaacgccga

SEQ ID NO: 1443657 - RNA, 16 nt, Pseudomonas aeruginosa PA01
cggauaacgccggugg

SEQ ID NO: 1443658 - RNA, 20 nt, Pseudomonas aeruginosa PA01
cggauaacgccuauggcguu

SEQ ID NO: 1443659 - RNA, 18 nt, Pseudomonas aeruginosa PA01
cggauaacggcagccgcg

SEQ ID NO: 1443660 - RNA, 19 nt, Pseudomonas aeruginosa PA01
cggauaagcaagcgcaacg

SEQ ID NO: 1443661 - RNA, 16 nt, Pseudomonas aeruginosa PA01
cggauaaaauccacaa

SEQ ID NO: 1443662 - RNA, 17 nt, Pseudomonas aeruginosa PA01
cggagugcucgaucagg

SEQ ID NO: 1443663 - RNA, 20 nt, Pseudomonas aeruginosa PA01
cggagucggugugaccuuca

SEQ ID NO: 1443664 - RNA, 13 nt, Pseudomonas aeruginosa PA01
cggagucaggcuc

SEQ ID NO: 1443665 - RNA, 12 nt, Pseudomonas aeruginosa PA01
cggagucgccgg

SEQ ID NO: 1443666 - RNA, 18 nt, Pseudomonas aeruginosa PA01
cggagucguagcgcaugc

SEQ ID NO: 1443667 - RNA, 19 nt, Pseudomonas aeruginosa PA01
cggagucguagcgcaugcc

SEQ ID NO: 1443668 - RNA, 15 nt, Pseudomonas aeruginosa PA01
cggagucguagcgcg

SEQ ID NO: 1443669 - RNA, 19 nt, Pseudomonas aeruginosa PA01
cggagucguagcgcgcggc

SEQ ID NO: 1443670 - RNA, 21 nt, Pseudomonas aeruginosa PA01
cggagucguagcgcgcggcga

SEQ ID NO: 1443671 - RNA, 13 nt, Pseudomonas aeruginosa PA01
cggagucucggga

SEQ ID NO: 1443672 - RNA, 17 nt, Pseudomonas aeruginosa PA01
cggagggucaggccgag

SEQ ID NO: 1443673 - RNA, 18 nt, Pseudomonas aeruginosa PA01
cggagggucaggccgagg

SEQ ID NO: 1443674 - RNA, 20 nt, Pseudomonas aeruginosa PA01
cggagggucaggccgagggc

SEQ ID NO: 1443675 - RNA, 14 nt, Pseudomonas aeruginosa PA01
cggaggcggcgagc

SEQ ID NO: 1443676 - RNA, 16 nt, Pseudomonas aeruginosa PA01
cggaguagccggcggc

SEQ ID NO: 1443677 - RNA, 18 nt, Pseudomonas aeruginosa PA01
cggaguagccggcggcga

SEQ ID NO: 1443678 - RNA, 14 nt, Pseudomonas aeruginosa PA01
cggaggggcggccg

SEQ ID NO: 1443679 - RNA, 20 nt, Pseudomonas aeruginosa PA01
cggaggggcggccgccgagc

SEQ ID NO: 1443680 - RNA, 16 nt, Pseudomonas aeruginosa PA01
cggagccgucggcucc

SEQ ID NO: 1443681 - RNA, 13 nt, Pseudomonas aeruginosa PA01
cggagccgucggc

SEQ ID NO: 1443682 - RNA, 16 nt, Pseudomonas aeruginosa PA01
cggaggcgaggucgcc

SEQ ID NO: 1443683 - RNA, 21 nt, Pseudomonas aeruginosa PA01
cggaggcagcgaugccuccgg

SEQ ID NO: 1443684 - RNA, 23 nt, Pseudomonas aeruginosa PA01
cggagcugcaugagugucgccau

SEQ ID NO: 1443685 - RNA, 23 nt, Pseudomonas aeruginosa PA01
cggagcuuugcagggcgauccag

SEQ ID NO: 1443686 - RNA, 15 nt, Pseudomonas aeruginosa PA01
cggaggaaacccaug

SEQ ID NO: 1443687 - RNA, 23 nt, Pseudomonas aeruginosa PA01
cggaggaaacccaugcccgcccc

SEQ ID NO: 1443688 - RNA, 18 nt, Pseudomonas aeruginosa PA01
cggagcgucggaagcguc

SEQ ID NO: 1443689 - RNA, 14 nt, Pseudomonas aeruginosa PA01
cggagcguccacca

SEQ ID NO: 1443690 - RNA, 16 nt, Pseudomonas aeruginosa PA01
cggagcguccaccagc

SEQ ID NO: 1443691 - RNA, 19 nt, Pseudomonas aeruginosa PA01
cggagcguccaccagcgcc

SEQ ID NO: 1443692 - RNA, 20 nt, Pseudomonas aeruginosa PA01
cggagcguccaccagcgccc

SEQ ID NO: 1443693 - RNA, 18 nt, Pseudomonas aeruginosa PA01
cggacuugaugaccgucc

SEQ ID NO: 1443694 - RNA, 20 nt, Pseudomonas aeruginosa PA01
cggagaaacuuucuucgcca

SEQ ID NO: 1443695 - RNA, 15 nt, Pseudomonas aeruginosa PA01
cggagaacagcagcg

SEQ ID NO: 1443696 - RNA, 16 nt, Pseudomonas aeruginosa PA01
cggagaacagcagcgg

SEQ ID NO: 1443697 - RNA, 18 nt, Pseudomonas aeruginosa PA01
cggagaacagcagcggca

SEQ ID NO: 1443698 - RNA, 21 nt, Pseudomonas aeruginosa PA01
cggagaacagcagcggcacca

SEQ ID NO: 1443699 - RNA, 15 nt, Pseudomonas aeruginosa PA01
cggagaacagcgaga

SEQ ID NO: 1443700 - RNA, 18 nt, Pseudomonas aeruginosa PA01
cggagaacgccgccacgc

SEQ ID NO: 1443701 - RNA, 13 nt, Pseudomonas aeruginosa PA01
cggagaccgugcc

SEQ ID NO: 1443702 - RNA, 17 nt, Pseudomonas aeruginosa PA01
cggagaagggcgcgccc

SEQ ID NO: 1443703 - RNA, 19 nt, Pseudomonas aeruginosa PA01
cggagaagggcgcgccccg

SEQ ID NO: 1443704 - RNA, 20 nt, Pseudomonas aeruginosa PA01
cggagaagggcgcgccccgu

SEQ ID NO: 1443705 - RNA, 14 nt, Pseudomonas aeruginosa PA01
cggagaauucgcgu

SEQ ID NO: 1443706 - RNA, 21 nt, Pseudomonas aeruginosa PA01
cggagacaggaaucgacccag

SEQ ID NO: 1443707 - RNA, 21 nt, Pseudomonas aeruginosa PA01
cggagaccacggugaucaggc

SEQ ID NO: 1443708 - RNA, 16 nt, Pseudomonas aeruginosa PA01
cggagacuucagcgca

SEQ ID NO: 1443709 - RNA, 16 nt, Pseudomonas aeruginosa PA01
cggagagcagcacggc

SEQ ID NO: 1443710 - RNA, 14 nt, Pseudomonas aeruginosa PA01
cggagagcagccaa

SEQ ID NO: 1443711 - RNA, 21 nt, Pseudomonas aeruginosa PA01
cggagagcagccaagccacca

SEQ ID NO: 1443712 - RNA, 21 nt, Pseudomonas aeruginosa PA01
cggagagcgaauacaccgagc

SEQ ID NO: 1443713 - RNA, 22 nt, Pseudomonas aeruginosa PA01
cggagagcgaauacaccgagcg

SEQ ID NO: 1443714 - RNA, 22 nt, Pseudomonas aeruginosa PA01
cggagaggaucagcgaacccgg

SEQ ID NO: 1443715 - RNA, 13 nt, Pseudomonas aeruginosa PA01
cggagauagccuc

SEQ ID NO: 1443716 - RNA, 22 nt, Pseudomonas aeruginosa PA01
cggagaucggcugcaacgccgg

SEQ ID NO: 1443717 - RNA, 18 nt, Pseudomonas aeruginosa PA01
cggagagacccgccagcg

SEQ ID NO: 1443718 - RNA, 18 nt, Pseudomonas aeruginosa PA01
cggagagauagucgccgu

SEQ ID NO: 1443719 - RNA, 13 nt, Pseudomonas aeruginosa PA01
cggagcaccgcgc

SEQ ID NO: 1443720 - RNA, 22 nt, Pseudomonas aeruginosa PA01
cggagcaccgcgccuuccagcc

SEQ ID NO: 1443721 - RNA, 13 nt, Pseudomonas aeruginosa PA01
cggagcaggccau

SEQ ID NO: 1443722 - RNA, 21 nt, Pseudomonas aeruginosa PA01
cggagcaggccaugggugucg

SEQ ID NO: 1443723 - RNA, 19 nt, Pseudomonas aeruginosa PA01
cggagccaacgcccgggcc

SEQ ID NO: 1443724 - RNA, 16 nt, Pseudomonas aeruginosa PA01
cggacuggauucggcc

SEQ ID NO: 1443725 - RNA, 18 nt, Pseudomonas aeruginosa PA01
cggacuggauucggccug

SEQ ID NO: 1443726 - RNA, 15 nt, Pseudomonas aeruginosa PA01
cggacugcucgccgc

SEQ ID NO: 1443727 - RNA, 16 nt, Pseudomonas aeruginosa PA01
cggacugcucgccgcc

SEQ ID NO: 1443728 - RNA, 18 nt, Pseudomonas aeruginosa PA01
cggacugcucgccgccgg

SEQ ID NO: 1443729 - RNA, 20 nt, Pseudomonas aeruginosa PA01
cggacugcucgccgccggcg

SEQ ID NO: 1443730 - RNA, 22 nt, Pseudomonas aeruginosa PA01
cggacugguaggacagggccag

SEQ ID NO: 1443731 - RNA, 17 nt, Pseudomonas aeruginosa PA01
cggacugcccagcgccg

SEQ ID NO: 1443732 - RNA, 20 nt, Pseudomonas aeruginosa PA01
cggacugcccagcgccgcca

SEQ ID NO: 1443733 - RNA, 21 nt, Pseudomonas aeruginosa PA01
cggacugcccagcgccgccag

SEQ ID NO: 1443734 - RNA, 22 nt, Pseudomonas aeruginosa PA01
cggacugcccagcgccgccagc

SEQ ID NO: 1443735 - RNA, 18 nt, Pseudomonas aeruginosa PA01
cggacuaccuucgaucac

SEQ ID NO: 1443736 - RNA, 21 nt, Pseudomonas aeruginosa PA01
cggacuaccuucgaucacccg

SEQ ID NO: 1443737 - RNA, 17 nt, Pseudomonas aeruginosa PA01
cggacguuuccagcggc

SEQ ID NO: 1443738 - RNA, 17 nt, Pseudomonas aeruginosa PA01
cggacguuccaccuggc

SEQ ID NO: 1443739 - RNA, 20 nt, Pseudomonas aeruginosa PA01
cggacguuccaccuggcgca

SEQ ID NO: 1443740 - RNA, 22 nt, Pseudomonas aeruginosa PA01
cggacguuccaccuggcgcagg

SEQ ID NO: 1443741 - RNA, 17 nt, Pseudomonas aeruginosa PA01
cggacuccggaggcgca

SEQ ID NO: 1443742 - RNA, 17 nt, Pseudomonas aeruginosa PA01
cggacugaaaccccacc

SEQ ID NO: 1443743 - RNA, 12 nt, Pseudomonas aeruginosa PA01
cggacggcucgc

SEQ ID NO: 1443744 - RNA, 18 nt, Pseudomonas aeruginosa PA01
cggacggcucgcgcagcg

SEQ ID NO: 1443745 - RNA, 21 nt, Pseudomonas aeruginosa PA01
cggacggcucgcgcagcggcg

SEQ ID NO: 1443746 - RNA, 22 nt, Pseudomonas aeruginosa PA01
cggacggcucgcgcagcggcgc

SEQ ID NO: 1443747 - RNA, 13 nt, Pseudomonas aeruginosa PA01
cggacggcggcgu

SEQ ID NO: 1443748 - RNA, 20 nt, Pseudomonas aeruginosa PA01
cggacgcuuguccuucggcc

SEQ ID NO: 1443749 - RNA, 22 nt, Pseudomonas aeruginosa PA01
cggacgcuuguccuucggccag

SEQ ID NO: 1443750 - RNA, 23 nt, Pseudomonas aeruginosa PA01
cggacgcuuguccuucggccagu

SEQ ID NO: 1443751 - RNA, 13 nt, Pseudomonas aeruginosa PA01
cggacggcacggg

SEQ ID NO: 1443752 - RNA, 22 nt, Pseudomonas aeruginosa PA01
cggacgcugcaugcggaacacc

SEQ ID NO: 1443753 - RNA, 23 nt, Pseudomonas aeruginosa PA01
cggacgggugcgcgccaccuggu

SEQ ID NO: 1443754 - RNA, 14 nt, Pseudomonas aeruginosa PA01
cggacgccgaagcg

SEQ ID NO: 1443755 - RNA, 12 nt, Pseudomonas aeruginosa PA01
cggacgcgcagg

SEQ ID NO: 1443756 - RNA, 20 nt, Pseudomonas aeruginosa PA01
cggacgcggcuggcgcagga

SEQ ID NO: 1443757 - RNA, 14 nt, Pseudomonas aeruginosa PA01
cggacgcaccagca

SEQ ID NO: 1443758 - RNA, 17 nt, Pseudomonas aeruginosa PA01
cggacgcaccagcaggc

SEQ ID NO: 1443759 - RNA, 15 nt, Pseudomonas aeruginosa PA01
cggacgauggucgcc

SEQ ID NO: 1443760 - RNA, 17 nt, Pseudomonas aeruginosa PA01
cggacgauggucgccgc

SEQ ID NO: 1443761 - RNA, 21 nt, Pseudomonas aeruginosa PA01
cggacgauggucgccgcgacc

SEQ ID NO: 1443762 - RNA, 15 nt, Pseudomonas aeruginosa PA01
cggaccucucucgcu

SEQ ID NO: 1443763 - RNA, 19 nt, Pseudomonas aeruginosa PA01
cggaccucucucgcugcgc

SEQ ID NO: 1443764 - RNA, 20 nt, Pseudomonas aeruginosa PA01
cggaccucucucgcugcgcg

SEQ ID NO: 1443765 - RNA, 21 nt, Pseudomonas aeruginosa PA01
cggaccucugcguucugcugc

SEQ ID NO: 1443766 - RNA, 13 nt, Pseudomonas aeruginosa PA01
cggaccgucgggc

SEQ ID NO: 1443767 - RNA, 16 nt, Pseudomonas aeruginosa PA01
cggaccguggugacgg

SEQ ID NO: 1443768 - RNA, 15 nt, Pseudomonas aeruginosa PA01
cggaccuccagccgg

SEQ ID NO: 1443769 - RNA, 16 nt, Pseudomonas aeruginosa PA01
cggaccuccagccggc

SEQ ID NO: 1443770 - RNA, 14 nt, Pseudomonas aeruginosa PA01
cggaccuccgccag

SEQ ID NO: 1443771 - RNA, 21 nt, Pseudomonas aeruginosa PA01
cggaccugagaucagcgcccg

SEQ ID NO: 1443772 - RNA, 22 nt, Pseudomonas aeruginosa PA01
cggaccugucccgauuccgcgc

SEQ ID NO: 1443773 - RNA, 18 nt, Pseudomonas aeruginosa PA01
cggaccuugucgccggug

SEQ ID NO: 1443774 - RNA, 21 nt, Pseudomonas aeruginosa PA01
cggacgacgaagugaccgcgc

SEQ ID NO: 1443775 - RNA, 18 nt, Pseudomonas aeruginosa PA01
cggacagguuggcgccgg

SEQ ID NO: 1443776 - RNA, 19 nt, Pseudomonas aeruginosa PA01
cgcugaggaagagcagcgc

SEQ ID NO: 1443777 - RNA, 17 nt, Pseudomonas aeruginosa PA01
cggacaggccacccgcc

SEQ ID NO: 1443778 - RNA, 20 nt, Pseudomonas aeruginosa PA01
cggacaggccacccgccucg

SEQ ID NO: 1443779 - RNA, 19 nt, Pseudomonas aeruginosa PA01
cgcugagcgccucgaucgc

SEQ ID NO: 1443780 - RNA, 12 nt, Pseudomonas aeruginosa PA01
cggacauggcgc

SEQ ID NO: 1443781 - RNA, 23 nt, Pseudomonas aeruginosa PA01
cggacauguugcagggucgccgg

SEQ ID NO: 1443782 - RNA, 18 nt, Pseudomonas aeruginosa PA01
cgcugagcggcugguggc

SEQ ID NO: 1443783 - RNA, 16 nt, Pseudomonas aeruginosa PA01
cggaccagaucggcgc

SEQ ID NO: 1443784 - RNA, 19 nt, Pseudomonas aeruginosa PA01
cggaccagaucggcgcgca

SEQ ID NO: 1443785 - RNA, 20 nt, Pseudomonas aeruginosa PA01
cggaccagaucggcgcgcag

SEQ ID NO: 1443786 - RNA, 21 nt, Pseudomonas aeruginosa PA01
cggaccagaucggcgcgcagg

SEQ ID NO: 1443787 - RNA, 19 nt, Pseudomonas aeruginosa PA01
cgcugagcaggaacucgau

SEQ ID NO: 1443788 - RNA, 22 nt, Pseudomonas aeruginosa PA01
cgcugagcaguugcgggcgcag

SEQ ID NO: 1443789 - RNA, 17 nt, Pseudomonas aeruginosa PA01
cgcugacuuccaucagc

SEQ ID NO: 1443790 - RNA, 23 nt, Pseudomonas aeruginosa PA01
cgcugagaccgauccagcagucg

SEQ ID NO: 1443791 - RNA, 20 nt, Pseudomonas aeruginosa PA01
cgcugacggcaaggaccugc

SEQ ID NO: 1443792 - RNA, 19 nt, Pseudomonas aeruginosa PA01
cgcugacgaggacgccgcc

SEQ ID NO: 1443793 - RNA, 21 nt, Pseudomonas aeruginosa PA01
cgcugacgaggacgccgccgg

SEQ ID NO: 1443794 - RNA, 13 nt, Pseudomonas aeruginosa PA01
cgcugacgccggc

SEQ ID NO: 1443795 - RNA, 14 nt, Pseudomonas aeruginosa PA01
cgcugacgccggca

SEQ ID NO: 1443796 - RNA, 20 nt, Pseudomonas aeruginosa PA01
cgcugaccggccgcagcagg

SEQ ID NO: 1443797 - RNA, 17 nt, Pseudomonas aeruginosa PA01
cgcugaccgcgaauggc

SEQ ID NO: 1443798 - RNA, 18 nt, Pseudomonas aeruginosa PA01
cgcugaccgcgaauggca

SEQ ID NO: 1443799 - RNA, 16 nt, Pseudomonas aeruginosa PA01
cgcugaccgcucccag

SEQ ID NO: 1443800 - RNA, 20 nt, Pseudomonas aeruginosa PA01
cgcugaccucgagcuggacg

SEQ ID NO: 1443801 - RNA, 17 nt, Pseudomonas aeruginosa PA01
cgcugaccucgauggcg

SEQ ID NO: 1443802 - RNA, 18 nt, Pseudomonas aeruginosa PA01
cgcugaccucggugagga

SEQ ID NO: 1443803 - RNA, 19 nt, Pseudomonas aeruginosa PA01
cgcugaccgggcggaucgc

SEQ ID NO: 1443804 - RNA, 20 nt, Pseudomonas aeruginosa PA01
cggaccgcagaaccagacgc

SEQ ID NO: 1443805 - RNA, 21 nt, Pseudomonas aeruginosa PA01
cggaccggcucucuucggccg

SEQ ID NO: 1443806 - RNA, 17 nt, Pseudomonas aeruginosa PA01
cggaccgcgacaacccu

SEQ ID NO: 1443807 - RNA, 23 nt, Pseudomonas aeruginosa PA01
cggaccgaucucguucggguagu

SEQ ID NO: 1443808 - RNA, 12 nt, Pseudomonas aeruginosa PA01
cggacccugccg

SEQ ID NO: 1443809 - RNA, 22 nt, Pseudomonas aeruginosa PA01
cggaccgaaggcaacagcccgc

SEQ ID NO: 1443810 - RNA, 16 nt, Pseudomonas aeruginosa PA01
cggacccgcucggccu

SEQ ID NO: 1443811 - RNA, 17 nt, Pseudomonas aeruginosa PA01
cggacccgcucggccuu

SEQ ID NO: 1443812 - RNA, 17 nt, Pseudomonas aeruginosa PA01
cggaccagggcgccggg

SEQ ID NO: 1443813 - RNA, 13 nt, Pseudomonas aeruginosa PA01
cggaccagccggu

SEQ ID NO: 1443814 - RNA, 16 nt, Pseudomonas aeruginosa PA01
cggaccagccguccgc

SEQ ID NO: 1443815 - RNA, 16 nt, Pseudomonas aeruginosa PA01
cggaccagcuccgaag

SEQ ID NO: 1443816 - RNA, 21 nt, Pseudomonas aeruginosa PA01
cggacccaguugggccaggag

SEQ ID NO: 1443817 - RNA, 14 nt, Pseudomonas aeruginosa PA01
cggacccgcgccgg

SEQ ID NO: 1443818 - RNA, 15 nt, Pseudomonas aeruginosa PA01
cggacccgcgccggc

SEQ ID NO: 1443819 - RNA, 16 nt, Pseudomonas aeruginosa PA01
cggacccgcgccggca

SEQ ID NO: 1443820 - RNA, 18 nt, Pseudomonas aeruginosa PA01
cggaccccauguaccucu

SEQ ID NO: 1443821 - RNA, 21 nt, Pseudomonas aeruginosa PA01
cggaccccauguaccucuggc

SEQ ID NO: 1443822 - RNA, 14 nt, Pseudomonas aeruginosa PA01
cggcaaccgggcgg

SEQ ID NO: 1443823 - RNA, 14 nt, Pseudomonas aeruginosa PA01
cggcaacgcgccca

SEQ ID NO: 1443824 - RNA, 17 nt, Pseudomonas aeruginosa PA01
cggcaacgacgaggccu

SEQ ID NO: 1443825 - RNA, 14 nt, Pseudomonas aeruginosa PA01
cggcaacgacggca

SEQ ID NO: 1443826 - RNA, 15 nt, Pseudomonas aeruginosa PA01
cggcaacgauaccgc

SEQ ID NO: 1443827 - RNA, 17 nt, Pseudomonas aeruginosa PA01
cggcaacgauaccgccg

SEQ ID NO: 1443828 - RNA, 18 nt, Pseudomonas aeruginosa PA01
cggcaacgauaccgccgc

SEQ ID NO: 1443829 - RNA, 19 nt, Pseudomonas aeruginosa PA01
cggcaacgauaccgccgcc

SEQ ID NO: 1443830 - RNA, 20 nt, Pseudomonas aeruginosa PA01
cggcaacgauaccgccgccg

SEQ ID NO: 1443831 - RNA, 21 nt, Pseudomonas aeruginosa PA01
cggcaacgauaccgccgccgg

SEQ ID NO: 1443832 - RNA, 13 nt, Pseudomonas aeruginosa PA01
cggcaagcaccuu

SEQ ID NO: 1443833 - RNA, 16 nt, Pseudomonas aeruginosa PA01
cggcaacgucaggcug

SEQ ID NO: 1443834 - RNA, 14 nt, Pseudomonas aeruginosa PA01
cggcaacgucgcgg

SEQ ID NO: 1443835 - RNA, 18 nt, Pseudomonas aeruginosa PA01
cggcaaggcgaucccggc

SEQ ID NO: 1443836 - RNA, 13 nt, Pseudomonas aeruginosa PA01
cggcaaggcgcug

SEQ ID NO: 1443837 - RNA, 14 nt, Pseudomonas aeruginosa PA01
cggcaaggcgcuga

SEQ ID NO: 1443838 - RNA, 15 nt, Pseudomonas aeruginosa PA01
cggcaaggcacacgc

SEQ ID NO: 1443839 - RNA, 18 nt, Pseudomonas aeruginosa PA01
cggcaaggcacacgcccg

SEQ ID NO: 1443840 - RNA, 19 nt, Pseudomonas aeruginosa PA01
cggcaaggcacacgcccgg

SEQ ID NO: 1443841 - RNA, 19 nt, Pseudomonas aeruginosa PA01
cggcaagcugaagcgccgc

SEQ ID NO: 1443842 - RNA, 20 nt, Pseudomonas aeruginosa PA01
cggcaagcugaagcgccgcg

SEQ ID NO: 1443843 - RNA, 22 nt, Pseudomonas aeruginosa PA01
cggcaagggcacgugcagcggc

SEQ ID NO: 1443844 - RNA, 23 nt, Pseudomonas aeruginosa PA01
cggcaagggcacgugcagcggca

SEQ ID NO: 1443845 - RNA, 18 nt, Pseudomonas aeruginosa PA01
cggcaagggccugcucag

SEQ ID NO: 1443846 - RNA, 14 nt, Pseudomonas aeruginosa PA01
cggcaagcgccggc

SEQ ID NO: 1443847 - RNA, 16 nt, Pseudomonas aeruginosa PA01
cggcaagcgugccccg

SEQ ID NO: 1443848 - RNA, 12 nt, Pseudomonas aeruginosa PA01
cggcaagcaggc

SEQ ID NO: 1443849 - RNA, 19 nt, Pseudomonas aeruginosa PA01
cggcaagcaggccgcggua

SEQ ID NO: 1443850 - RNA, 23 nt, Pseudomonas aeruginosa PA01
cggcaagcaggccgcgguaacgg

SEQ ID NO: 1443851 - RNA, 22 nt, Pseudomonas aeruginosa PA01
cggcaaugcggcgauggcgucc

SEQ ID NO: 1443852 - RNA, 18 nt, Pseudomonas aeruginosa PA01
cggcaaguucgcauaggc

SEQ ID NO: 1443853 - RNA, 19 nt, Pseudomonas aeruginosa PA01
cggcaauguccgagcaggu

SEQ ID NO: 1443854 - RNA, 16 nt, Pseudomonas aeruginosa PA01
cggcacaggcggcugu

SEQ ID NO: 1443855 - RNA, 19 nt, Pseudomonas aeruginosa PA01
cggcacagcguggccagcg

SEQ ID NO: 1443856 - RNA, 20 nt, Pseudomonas aeruginosa PA01
cggcacagcguggccagcgc

SEQ ID NO: 1443857 - RNA, 22 nt, Pseudomonas aeruginosa PA01
cggcacagcguggccagcgccc

SEQ ID NO: 1443858 - RNA, 18 nt, Pseudomonas aeruginosa PA01
cggcaauucuucaagguc

SEQ ID NO: 1443859 - RNA, 16 nt, Pseudomonas aeruginosa PA01
cggcaccagcgcgucg

SEQ ID NO: 1443860 - RNA, 19 nt, Pseudomonas aeruginosa PA01
cggcaccagcgcgucgaag

SEQ ID NO: 1443861 - RNA, 15 nt, Pseudomonas aeruginosa PA01
cggcaccaccagcgc

SEQ ID NO: 1443862 - RNA, 12 nt, Pseudomonas aeruginosa PA01
cggcaccaccac

SEQ ID NO: 1443863 - RNA, 15 nt, Pseudomonas aeruginosa PA01
cggcaccaccaccga

SEQ ID NO: 1443864 - RNA, 16 nt, Pseudomonas aeruginosa PA01
cggcaccaccaccgac

SEQ ID NO: 1443865 - RNA, 17 nt, Pseudomonas aeruginosa PA01
cggcaccaccaccgaca

SEQ ID NO: 1443866 - RNA, 21 nt, Pseudomonas aeruginosa PA01
cggcaccaccaccgacaggcc

SEQ ID NO: 1443867 - RNA, 15 nt, Pseudomonas aeruginosa PA01
cggcaccaccaccgg

SEQ ID NO: 1443868 - RNA, 14 nt, Pseudomonas aeruginosa PA01
cggcaccgucgagc

SEQ ID NO: 1443869 - RNA, 14 nt, Pseudomonas aeruginosa PA01
cggcaccgcuuucg

SEQ ID NO: 1443870 - RNA, 15 nt, Pseudomonas aeruginosa PA01
cggcaccgcuuucgu

SEQ ID NO: 1443871 - RNA, 13 nt, Pseudomonas aeruginosa PA01
cggcaccgcucug

SEQ ID NO: 1443872 - RNA, 21 nt, Pseudomonas aeruginosa PA01
cggcaccgcucugcagugcgu

SEQ ID NO: 1443873 - RNA, 13 nt, Pseudomonas aeruginosa PA01
aacaggucgaggg

SEQ ID NO: 1443874 - RNA, 18 nt, Pseudomonas aeruginosa PA01
cggcaccagccagguguu

SEQ ID NO: 1443875 - RNA, 17 nt, Pseudomonas aeruginosa PA01
cggcaccaucaccgaca

SEQ ID NO: 1443876 - RNA, 18 nt, Pseudomonas aeruginosa PA01
cggcaaaggcccggcgcg

SEQ ID NO: 1443877 - RNA, 15 nt, Pseudomonas aeruginosa PA01
cggcaaacgccgcca

SEQ ID NO: 1443878 - RNA, 16 nt, Pseudomonas aeruginosa PA01
cggauugccgcggguc

SEQ ID NO: 1443879 - RNA, 13 nt, Pseudomonas aeruginosa PA01
cggauuggccgag

SEQ ID NO: 1443880 - RNA, 14 nt, Pseudomonas aeruginosa PA01
cggauuggccgggc

SEQ ID NO: 1443881 - RNA, 19 nt, Pseudomonas aeruginosa PA01
cggauuggccgggccgaug

SEQ ID NO: 1443882 - RNA, 12 nt, Pseudomonas aeruginosa PA01
cggauugccgcg

SEQ ID NO: 1443883 - RNA, 23 nt, Pseudomonas aeruginosa PA01
cggauugacgauggccagcccgg

SEQ ID NO: 1443884 - RNA, 14 nt, Pseudomonas aeruginosa PA01
cggauucgccgagg

SEQ ID NO: 1443885 - RNA, 20 nt, Pseudomonas aeruginosa PA01
cggauucgccgaggaacuuc

SEQ ID NO: 1443886 - RNA, 18 nt, Pseudomonas aeruginosa PA01
cggauucgcgcagcaggc

SEQ ID NO: 1443887 - RNA, 14 nt, Pseudomonas aeruginosa PA01
cggauuccagcgcg

SEQ ID NO: 1443888 - RNA, 15 nt, Pseudomonas aeruginosa PA01
cggauucaggcgcgc

SEQ ID NO: 1443889 - RNA, 16 nt, Pseudomonas aeruginosa PA01
cggauucaggcgcgcu

SEQ ID NO: 1443890 - RNA, 18 nt, Pseudomonas aeruginosa PA01
cggauguucgaaggccag

SEQ ID NO: 1443891 - RNA, 18 nt, Pseudomonas aeruginosa PA01
cggaugucgggcucgacg

SEQ ID NO: 1443892 - RNA, 22 nt, Pseudomonas aeruginosa PA01
cggauguaguccagcgccgcgc

SEQ ID NO: 1443893 - RNA, 22 nt, Pseudomonas aeruginosa PA01
cggaugggcgacgacgaacgcc

SEQ ID NO: 1443894 - RNA, 14 nt, Pseudomonas aeruginosa PA01
cggaugggcgagcu

SEQ ID NO: 1443895 - RNA, 16 nt, Pseudomonas aeruginosa PA01
cggauggcgaucgagc

SEQ ID NO: 1443896 - RNA, 15 nt, Pseudomonas aeruginosa PA01
cggauggcgcggggc

SEQ ID NO: 1443897 - RNA, 15 nt, Pseudomonas aeruginosa PA01
cggauggccgccguu

SEQ ID NO: 1443898 - RNA, 23 nt, Pseudomonas aeruginosa PA01
cggaugcuccagguucggcgcca

SEQ ID NO: 1443899 - RNA, 20 nt, Pseudomonas aeruginosa PA01
cggaugcguugcucgcacca

SEQ ID NO: 1443900 - RNA, 13 nt, Pseudomonas aeruginosa PA01
cggaugccggcgc

SEQ ID NO: 1443901 - RNA, 13 nt, Pseudomonas aeruginosa PA01
cggaucggcgugu

SEQ ID NO: 1443902 - RNA, 18 nt, Pseudomonas aeruginosa PA01
cggaucgagcagcggcgc

SEQ ID NO: 1443903 - RNA, 22 nt, Pseudomonas aeruginosa PA01
cggaucgaggaauuccggcagc

SEQ ID NO: 1443904 - RNA, 13 nt, Pseudomonas aeruginosa PA01
cggaucgccaacc

SEQ ID NO: 1443905 - RNA, 13 nt, Pseudomonas aeruginosa PA01
cggaucgcgcugg

SEQ ID NO: 1443906 - RNA, 23 nt, Pseudomonas aeruginosa PA01
cggaucgcgcaaugccgcgucga

SEQ ID NO: 1443907 - RNA, 19 nt, Pseudomonas aeruginosa PA01
cggaucgcgccgucgcugg

SEQ ID NO: 1443908 - RNA, 23 nt, Pseudomonas aeruginosa PA01
cggaucgcgccgucgcuggcgau

SEQ ID NO: 1443909 - RNA, 19 nt, Pseudomonas aeruginosa PA01
cggaucgcccuggcgccag

SEQ ID NO: 1443910 - RNA, 14 nt, Pseudomonas aeruginosa PA01
cggaucgacgccuu

SEQ ID NO: 1443911 - RNA, 21 nt, Pseudomonas aeruginosa PA01
cggaucgaucagcagcaccgc

SEQ ID NO: 1443912 - RNA, 22 nt, Pseudomonas aeruginosa PA01
cggauccggguggagaggcgug

SEQ ID NO: 1443913 - RNA, 18 nt, Pseudomonas aeruginosa PA01
cggaucaugguauggaga

SEQ ID NO: 1443914 - RNA, 12 nt, Pseudomonas aeruginosa PA01
cggaucgucgcg

SEQ ID NO: 1443915 - RNA, 13 nt, Pseudomonas aeruginosa PA01
cggaucgucgcgg

SEQ ID NO: 1443916 - RNA, 23 nt, Pseudomonas aeruginosa PA01
cggaucgguaggcucugcuccag

SEQ ID NO: 1443917 - RNA, 14 nt, Pseudomonas aeruginosa PA01
cggaucguccgggc

SEQ ID NO: 1443918 - RNA, 14 nt, Pseudomonas aeruginosa PA01
cggaucggcugacc

SEQ ID NO: 1443919 - RNA, 20 nt, Pseudomonas aeruginosa PA01
cggaucugcuccugcaggcc

SEQ ID NO: 1443920 - RNA, 16 nt, Pseudomonas aeruginosa PA01
cggaucugcucgacgu

SEQ ID NO: 1443921 - RNA, 21 nt, Pseudomonas aeruginosa PA01
cggaucuggcccuuuuccucg

SEQ ID NO: 1443922 - RNA, 15 nt, Pseudomonas aeruginosa PA01
cggaucucgucgccg

SEQ ID NO: 1443923 - RNA, 16 nt, Pseudomonas aeruginosa PA01
cggaucucgucgccga

SEQ ID NO: 1443924 - RNA, 18 nt, Pseudomonas aeruginosa PA01
cggaucucgucgccgacc

SEQ ID NO: 1443925 - RNA, 23 nt, Pseudomonas aeruginosa PA01
cggaugaaagcaaaaaaagccca

SEQ ID NO: 1443926 - RNA, 19 nt, Pseudomonas aeruginosa PA01
cggaugacgggcgaagacg

SEQ ID NO: 1443927 - RNA, 22 nt, Pseudomonas aeruginosa PA01
cggaugacguucccguccgggc

SEQ ID NO: 1443928 - RNA, 19 nt, Pseudomonas aeruginosa PA01
cggaugacgcaaacgccau

SEQ ID NO: 1443929 - RNA, 19 nt, Pseudomonas aeruginosa PA01
cggaugcagauccagcggc

SEQ ID NO: 1443930 - RNA, 13 nt, Pseudomonas aeruginosa PA01
cggaugcagcgcu

SEQ ID NO: 1443931 - RNA, 17 nt, Pseudomonas aeruginosa PA01
cggaugcagucccgcca

SEQ ID NO: 1443932 - RNA, 20 nt, Pseudomonas aeruginosa PA01
cggaugcaguugagucgcgc

SEQ ID NO: 1443933 - RNA, 22 nt, Pseudomonas aeruginosa PA01
cggaugcaguugagucgcgcgc

SEQ ID NO: 1443934 - RNA, 14 nt, Pseudomonas aeruginosa PA01
cggaugccgggcga

SEQ ID NO: 1443935 - RNA, 15 nt, Pseudomonas aeruginosa PA01
cggaugcccuggucg

SEQ ID NO: 1443936 - RNA, 18 nt, Pseudomonas aeruginosa PA01
cggaugcccuggucggcg

SEQ ID NO: 1443937 - RNA, 19 nt, Pseudomonas aeruginosa PA01
cggaugcccuggucggcgg

SEQ ID NO: 1443938 - RNA, 15 nt, Pseudomonas aeruginosa PA01
cggaugccgcgagcc

SEQ ID NO: 1443939 - RNA, 14 nt, Pseudomonas aeruginosa PA01
cggcgaucgccggc

SEQ ID NO: 1443940 - RNA, 13 nt, Pseudomonas aeruginosa PA01
cggcgaucgccag

SEQ ID NO: 1443941 - RNA, 14 nt, Pseudomonas aeruginosa PA01
cggcgaucgccagg

SEQ ID NO: 1443942 - RNA, 15 nt, Pseudomonas aeruginosa PA01
cggcgaucgccaggc

SEQ ID NO: 1443943 - RNA, 15 nt, Pseudomonas aeruginosa PA01
cggcgaucgccaggu

SEQ ID NO: 1443944 - RNA, 15 nt, Pseudomonas aeruginosa PA01
cggccuuuucggcgg

SEQ ID NO: 1443945 - RNA, 20 nt, Pseudomonas aeruginosa PA01
cggccuuuucggcggccagg

SEQ ID NO: 1443946 - RNA, 15 nt, Pseudomonas aeruginosa PA01
cggccuuuugcauuu

SEQ ID NO: 1443947 - RNA, 13 nt, Pseudomonas aeruginosa PA01
cggccuugcuggc

SEQ ID NO: 1443948 - RNA, 20 nt, Pseudomonas aeruginosa PA01
cggccuugcuuugcgccucg

SEQ ID NO: 1443949 - RNA, 22 nt, Pseudomonas aeruginosa PA01
cggccuugcuuugcgccucgcg

SEQ ID NO: 1443950 - RNA, 19 nt, Pseudomonas aeruginosa PA01
cggccuuggucaucagcac

SEQ ID NO: 1443951 - RNA, 20 nt, Pseudomonas aeruginosa PA01
cggccuuggucucgaucagc

SEQ ID NO: 1443952 - RNA, 19 nt, Pseudomonas aeruginosa PA01
cggccuuggucucgcgggc

SEQ ID NO: 1443953 - RNA, 23 nt, Pseudomonas aeruginosa PA01
cggccuuggucucgcgggcgacg

SEQ ID NO: 1443954 - RNA, 21 nt, Pseudomonas aeruginosa PA01
cggccuuguagaguuugccga

SEQ ID NO: 1443955 - RNA, 16 nt, Pseudomonas aeruginosa PA01
cggccuuguccgcgcg

SEQ ID NO: 1443956 - RNA, 16 nt, Pseudomonas aeruginosa PA01
cggccuuguccggcac

SEQ ID NO: 1443957 - RNA, 13 nt, Pseudomonas aeruginosa PA01
cggcgaucucgcc

SEQ ID NO: 1443958 - RNA, 14 nt, Pseudomonas aeruginosa PA01
cggcgaucucgccc

SEQ ID NO: 1443959 - RNA, 21 nt, Pseudomonas aeruginosa PA01
cggcgaucucgcccagggcgu

SEQ ID NO: 1443960 - RNA, 15 nt, Pseudomonas aeruginosa PA01
cggcgaucgccuggu

SEQ ID NO: 1443961 - RNA, 21 nt, Pseudomonas aeruginosa PA01
cggcgaucggguagagcgcgg

SEQ ID NO: 1443962 - RNA, 22 nt, Pseudomonas aeruginosa PA01
cggcgaucggguagagcgcggc

SEQ ID NO: 1443963 - RNA, 19 nt, Pseudomonas aeruginosa PA01
cggcgaugaagcugaugcc

SEQ ID NO: 1443964 - RNA, 16 nt, Pseudomonas aeruginosa PA01
cggcgaugaccagcuc

SEQ ID NO: 1443965 - RNA, 18 nt, Pseudomonas aeruginosa PA01
cggcgaugaccagcucgg

SEQ ID NO: 1443966 - RNA, 20 nt, Pseudomonas aeruginosa PA01
cggcgaugaccagcucggcg

SEQ ID NO: 1443967 - RNA, 21 nt, Pseudomonas aeruginosa PA01
cggcgaugaccagcucggcgg

SEQ ID NO: 1443968 - RNA, 20 nt, Pseudomonas aeruginosa PA01
cggcgaucuucagguaggcg

SEQ ID NO: 1443969 - RNA, 18 nt, Pseudomonas aeruginosa PA01
cggcgaucuucuccgccg

SEQ ID NO: 1443970 - RNA, 21 nt, Pseudomonas aeruginosa PA01
cggcgaucuucuccgccgcgu

SEQ ID NO: 1443971 - RNA, 23 nt, Pseudomonas aeruginosa PA01
cggcgaugauggucaacaccagc

SEQ ID NO: 1443972 - RNA, 15 nt, Pseudomonas aeruginosa PA01
cggcgaugcccaggc

SEQ ID NO: 1443973 - RNA, 20 nt, Pseudomonas aeruginosa PA01
cggcgaugcccaggccgccg

SEQ ID NO: 1443974 - RNA, 22 nt, Pseudomonas aeruginosa PA01
cggcgaugcccaggccgccgau

SEQ ID NO: 1443975 - RNA, 14 nt, Pseudomonas aeruginosa PA01
cggcgaugaucggc

SEQ ID NO: 1443976 - RNA, 14 nt, Pseudomonas aeruginosa PA01
cggcgauggcgucc

SEQ ID NO: 1443977 - RNA, 18 nt, Pseudomonas aeruginosa PA01
cggcgauggcguccaccg

SEQ ID NO: 1443978 - RNA, 19 nt, Pseudomonas aeruginosa PA01
cggcgauggcguccaccgc

SEQ ID NO: 1443979 - RNA, 21 nt, Pseudomonas aeruginosa PA01
cggcgauggccgccagcaggc

SEQ ID NO: 1443980 - RNA, 16 nt, Pseudomonas aeruginosa PA01
cggcgauggccgccug

SEQ ID NO: 1443981 - RNA, 17 nt, Pseudomonas aeruginosa PA01
cggcgauggccgccugc

SEQ ID NO: 1443982 - RNA, 16 nt, Pseudomonas aeruginosa PA01
cggcgaugccgcccag

SEQ ID NO: 1443983 - RNA, 20 nt, Pseudomonas aeruginosa PA01
cggcgaugccgcccagcacc

SEQ ID NO: 1443984 - RNA, 22 nt, Pseudomonas aeruginosa PA01
cggcgaugccgcccagcaccga

SEQ ID NO: 1443985 - RNA, 16 nt, Pseudomonas aeruginosa PA01
cggcgaugccgccggg

SEQ ID NO: 1443986 - RNA, 14 nt, Pseudomonas aeruginosa PA01
cggcgaugccgcgc

SEQ ID NO: 1443987 - RNA, 17 nt, Pseudomonas aeruginosa PA01
cggcgaugccgcgccag

SEQ ID NO: 1443988 - RNA, 12 nt, Pseudomonas aeruginosa PA01
cggcgaugccgg

SEQ ID NO: 1443989 - RNA, 13 nt, Pseudomonas aeruginosa PA01
cggcgaugucggc

SEQ ID NO: 1443990 - RNA, 14 nt, Pseudomonas aeruginosa PA01
cggcgaugucggcc

SEQ ID NO: 1443991 - RNA, 15 nt, Pseudomonas aeruginosa PA01
cggcgaugucggccu

SEQ ID NO: 1443992 - RNA, 14 nt, Pseudomonas aeruginosa PA01
cggcgaugugcggc

SEQ ID NO: 1443993 - RNA, 18 nt, Pseudomonas aeruginosa PA01
cggcgaugggucgcgugg

SEQ ID NO: 1443994 - RNA, 16 nt, Pseudomonas aeruginosa PA01
cggcgauggcgcgcgg

SEQ ID NO: 1443995 - RNA, 17 nt, Pseudomonas aeruginosa PA01
cggcgauggcgcgcggg

SEQ ID NO: 1443996 - RNA, 17 nt, Pseudomonas aeruginosa PA01
cggcgauggucaggacg

SEQ ID NO: 1443997 - RNA, 14 nt, Pseudomonas aeruginosa PA01
cggcgcaccgacgc

SEQ ID NO: 1443998 - RNA, 22 nt, Pseudomonas aeruginosa PA01
cggcgcaccgacgccgccugcg

SEQ ID NO: 1443999 - RNA, 23 nt, Pseudomonas aeruginosa PA01
cggcgcacauuacccccuugccc

SEQ ID NO: 1444000 - RNA, 16 nt, Pseudomonas aeruginosa PA01
cggcgccccaggcgcc

SEQ ID NO: 1444001 - RNA, 23 nt, Pseudomonas aeruginosa PA01
cggcgccccggcccagccgcggc

SEQ ID NO: 1444002 - RNA, 14 nt, Pseudomonas aeruginosa PA01
cggcgcccgccaag

SEQ ID NO: 1444003 - RNA, 15 nt, Pseudomonas aeruginosa PA01
cggcgcccgccaagg

SEQ ID NO: 1444004 - RNA, 16 nt, Pseudomonas aeruginosa PA01
cggcgccccugcggcg

SEQ ID NO: 1444005 - RNA, 17 nt, Pseudomonas aeruginosa PA01
cggcgccccugcggcgc

SEQ ID NO: 1444006 - RNA, 22 nt, Pseudomonas aeruginosa PA01
cggcgccccugcggcgccgguu

SEQ ID NO: 1444007 - RNA, 17 nt, Pseudomonas aeruginosa PA01
cggcgcccgccugcagg

SEQ ID NO: 1444008 - RNA, 13 nt, Pseudomonas aeruginosa PA01
cggcgcccggcgc

SEQ ID NO: 1444009 - RNA, 20 nt, Pseudomonas aeruginosa PA01
cggcgcccggcgcaugccgc

SEQ ID NO: 1444010 - RNA, 14 nt, Pseudomonas aeruginosa PA01
cggcgccgccgaac

SEQ ID NO: 1444011 - RNA, 15 nt, Pseudomonas aeruginosa PA01
cggcgccgccgaaca

SEQ ID NO: 1444012 - RNA, 15 nt, Pseudomonas aeruginosa PA01
cggcgccgccgggga

SEQ ID NO: 1444013 - RNA, 14 nt, Pseudomonas aeruginosa PA01
cggcgccgccuggc

SEQ ID NO: 1444014 - RNA, 16 nt, Pseudomonas aeruginosa PA01
cggcgccgccuggccg

SEQ ID NO: 1444015 - RNA, 18 nt, Pseudomonas aeruginosa PA01
cggcgccgccuggccggu

SEQ ID NO: 1444016 - RNA, 13 nt, Pseudomonas aeruginosa PA01
cggcgccgcugcc

SEQ ID NO: 1444017 - RNA, 15 nt, Pseudomonas aeruginosa PA01
cggcgccgcugccca

SEQ ID NO: 1444018 - RNA, 15 nt, Pseudomonas aeruginosa PA01
cggcgccgcgcaccu

SEQ ID NO: 1444019 - RNA, 19 nt, Pseudomonas aeruginosa PA01
cggcgcccaaugcaucggc

SEQ ID NO: 1444020 - RNA, 20 nt, Pseudomonas aeruginosa PA01
cggcgcccacaaccugccga

SEQ ID NO: 1444021 - RNA, 24 nt, Pseudomonas aeruginosa PA01
cggcgcccacaaccugccgaucgc

SEQ ID NO: 1444022 - RNA, 20 nt, Pseudomonas aeruginosa PA01
cggcgccauaggccagcacc

SEQ ID NO: 1444023 - RNA, 14 nt, Pseudomonas aeruginosa PA01
cggcgccaguucgc

SEQ ID NO: 1444024 - RNA, 19 nt, Pseudomonas aeruginosa PA01
cggcgccaguucgccggug

SEQ ID NO: 1444025 - RNA, 23 nt, Pseudomonas aeruginosa PA01
cggcgccauaccggcaaggcggc

SEQ ID NO: 1444026 - RNA, 20 nt, Pseudomonas aeruginosa PA01
cggcgccaucgaucagcagc

SEQ ID NO: 1444027 - RNA, 19 nt, Pseudomonas aeruginosa PA01
cggcgccauagggcacccg

SEQ ID NO: 1444028 - RNA, 15 nt, Pseudomonas aeruginosa PA01
cggcgcccagcacca

SEQ ID NO: 1444029 - RNA, 19 nt, Pseudomonas aeruginosa PA01
cggcgcccagcaccacagc

SEQ ID NO: 1444030 - RNA, 21 nt, Pseudomonas aeruginosa PA01
cggcgcccagcaccacagcac

SEQ ID NO: 1444031 - RNA, 15 nt, Pseudomonas aeruginosa PA01
cggcgcccagguagg

SEQ ID NO: 1444032 - RNA, 18 nt, Pseudomonas aeruginosa PA01
cggcgcaggcugucggcc

SEQ ID NO: 1444033 - RNA, 21 nt, Pseudomonas aeruginosa PA01
cggcgcaggcugucggccagc

SEQ ID NO: 1444034 - RNA, 21 nt, Pseudomonas aeruginosa PA01
cggcgcaggcggaucgcccgg

SEQ ID NO: 1444035 - RNA, 11 nt, Pseudomonas aeruginosa PA01
cggcgcaggca

SEQ ID NO: 1444036 - RNA, 13 nt, Pseudomonas aeruginosa PA01
cggcgcaggcgau

SEQ ID NO: 1444037 - RNA, 21 nt, Pseudomonas aeruginosa PA01
cggcgccaggcguuccagcuc

SEQ ID NO: 1444038 - RNA, 19 nt, Pseudomonas aeruginosa PA01
cggcgccaggcugaccgcg

SEQ ID NO: 1444039 - RNA, 22 nt, Pseudomonas aeruginosa PA01
cggcgccaggcugaccgcgugg

SEQ ID NO: 1444040 - RNA, 17 nt, Pseudomonas aeruginosa PA01
cggcgccaggccggcga

SEQ ID NO: 1444041 - RNA, 14 nt, Pseudomonas aeruginosa PA01
cggcgccaggccgg

SEQ ID NO: 1444042 - RNA, 22 nt, Pseudomonas aeruginosa PA01
cggcgccaggccggagccgcgu

SEQ ID NO: 1444043 - RNA, 21 nt, Pseudomonas aeruginosa PA01
cggcgcagcuucuccaccgga

SEQ ID NO: 1444044 - RNA, 16 nt, Pseudomonas aeruginosa PA01
cggcgcagccucgcgc

SEQ ID NO: 1444045 - RNA, 20 nt, Pseudomonas aeruginosa PA01
cggcggcaccacgugcagca

SEQ ID NO: 1444046 - RNA, 14 nt, Pseudomonas aeruginosa PA01
cggcggaaggcggc

SEQ ID NO: 1444047 - RNA, 16 nt, Pseudomonas aeruginosa PA01
cggcggaaggcggcgu

SEQ ID NO: 1444048 - RNA, 22 nt, Pseudomonas aeruginosa PA01
cggcggaaggcggcgucgucgc

SEQ ID NO: 1444049 - RNA, 22 nt, Pseudomonas aeruginosa PA01
cggcggaagucgaagcagccgu

SEQ ID NO: 1444050 - RNA, 21 nt, Pseudomonas aeruginosa PA01
cggcggaacuugucgccgcug

SEQ ID NO: 1444051 - RNA, 21 nt, Pseudomonas aeruginosa PA01
cggcggaagaauaccgccagc

SEQ ID NO: 1444052 - RNA, 23 nt, Pseudomonas aeruginosa PA01
cggcggacagcccgcgcucggcc

SEQ ID NO: 1444053 - RNA, 17 nt, Pseudomonas aeruginosa PA01
cggcggacagcggaaac

SEQ ID NO: 1444054 - RNA, 17 nt, Pseudomonas aeruginosa PA01
cggcggacaggcagccg

SEQ ID NO: 1444055 - RNA, 19 nt, Pseudomonas aeruginosa PA01
cggcggacaggcagccggc

SEQ ID NO: 1444056 - RNA, 18 nt, Pseudomonas aeruginosa PA01
cggcggaauuccugcucg

SEQ ID NO: 1444057 - RNA, 19 nt, Pseudomonas aeruginosa PA01
cggcggacaaccaccaugc

SEQ ID NO: 1444058 - RNA, 21 nt, Pseudomonas aeruginosa PA01
cggcggcacccucuuccgcgc

SEQ ID NO: 1444059 - RNA, 14 nt, Pseudomonas aeruginosa PA01
cggcggcacgacca

SEQ ID NO: 1444060 - RNA, 14 nt, Pseudomonas aeruginosa PA01
cggcggcagcugcg

SEQ ID NO: 1444061 - RNA, 17 nt, Pseudomonas aeruginosa PA01
cggcggcagcugcggcg

SEQ ID NO: 1444062 - RNA, 12 nt, Pseudomonas aeruginosa PA01
cggcggcaggcc

SEQ ID NO: 1444063 - RNA, 23 nt, Pseudomonas aeruginosa PA01
cggcggcaggccagcuuccaggc

SEQ ID NO: 1444064 - RNA, 15 nt, Pseudomonas aeruginosa PA01
cggcggcaggccgau

SEQ ID NO: 1444065 - RNA, 17 nt, Pseudomonas aeruginosa PA01
cggcggcaggcgcauca

SEQ ID NO: 1444066 - RNA, 12 nt, Pseudomonas aeruginosa PA01
cggcggcaggcu

SEQ ID NO: 1444067 - RNA, 20 nt, Pseudomonas aeruginosa PA01
cggcggcaggcugcgccgcu

SEQ ID NO: 1444068 - RNA, 19 nt, Pseudomonas aeruginosa PA01
cggcgcguuccgggucgcu

SEQ ID NO: 1444069 - RNA, 17 nt, Pseudomonas aeruginosa PA01
cggcgcgucuccaugcg

SEQ ID NO: 1444070 - RNA, 21 nt, Pseudomonas aeruginosa PA01
cggcgcgucggugccgcccgg

SEQ ID NO: 1444071 - RNA, 13 nt, Pseudomonas aeruginosa PA01
cggcgcgucgcuc

SEQ ID NO: 1444072 - RNA, 19 nt, Pseudomonas aeruginosa PA01
cggcgcgucgcucauccgc

SEQ ID NO: 1444073 - RNA, 19 nt, Pseudomonas aeruginosa PA01
cggcgcgucgcugcgcaac

SEQ ID NO: 1444074 - RNA, 20 nt, Pseudomonas aeruginosa PA01
cggcgcguccaccuggcggc

SEQ ID NO: 1444075 - RNA, 18 nt, Pseudomonas aeruginosa PA01
cggcgcgucccugggcgc

SEQ ID NO: 1444076 - RNA, 19 nt, Pseudomonas aeruginosa PA01
cggcgcgucccugggcgca

SEQ ID NO: 1444077 - RNA, 15 nt, Pseudomonas aeruginosa PA01
cggcgcugccgaaca

SEQ ID NO: 1444078 - RNA, 19 nt, Pseudomonas aeruginosa PA01
cggcgcugccgaacagcag

SEQ ID NO: 1444079 - RNA, 13 nt, Pseudomonas aeruginosa PA01
cggcgcugcgagc

SEQ ID NO: 1444080 - RNA, 14 nt, Pseudomonas aeruginosa PA01
cggcgcugccggcc

SEQ ID NO: 1444081 - RNA, 19 nt, Pseudomonas aeruginosa PA01
cggcgcugccggccagggu

SEQ ID NO: 1444082 - RNA, 23 nt, Pseudomonas aeruginosa PA01
cggcgcugccggccagggucgcc

SEQ ID NO: 1444083 - RNA, 22 nt, Pseudomonas aeruginosa PA01
cggcgcugcgccguuucgacga

SEQ ID NO: 1444084 - RNA, 21 nt, Pseudomonas aeruginosa PA01
cggcgcuggucucuuccagca

SEQ ID NO: 1444085 - RNA, 22 nt, Pseudomonas aeruginosa PA01
cggcgcuggucucuuccagcau

SEQ ID NO: 1444086 - RNA, 22 nt, Pseudomonas aeruginosa PA01
cggcgcuugcgggcgcgccuga

SEQ ID NO: 1444087 - RNA, 24 nt, Pseudomonas aeruginosa PA01
cggcgcugugggugaggcguucga

SEQ ID NO: 1444088 - RNA, 17 nt, Pseudomonas aeruginosa PA01
cggcgcuguuugcggcg

SEQ ID NO: 1444089 - RNA, 21 nt, Pseudomonas aeruginosa PA01
cggcgcuucgcgcaggacgag

SEQ ID NO: 1444090 - RNA, 16 nt, Pseudomonas aeruginosa PA01
cggcgcuucugcgagc

SEQ ID NO: 1444091 - RNA, 14 nt, Pseudomonas aeruginosa PA01
cggcgcuuuccacu

SEQ ID NO: 1444092 - RNA, 22 nt, Pseudomonas aeruginosa PA01
cggcgcuuuuuucuugccgcca

SEQ ID NO: 1444093 - RNA, 17 nt, Pseudomonas aeruginosa PA01
cggcggaacauggucga

SEQ ID NO: 1444094 - RNA, 19 nt, Pseudomonas aeruginosa PA01
cggcggaacauggucgaga

SEQ ID NO: 1444095 - RNA, 21 nt, Pseudomonas aeruginosa PA01
cggcgcugucgccguuggccu

SEQ ID NO: 1444096 - RNA, 14 nt, Pseudomonas aeruginosa PA01
cggcgcuuggcgaa

SEQ ID NO: 1444097 - RNA, 11 nt, Pseudomonas aeruginosa PA01
cggcgcgccgg

SEQ ID NO: 1444098 - RNA, 12 nt, Pseudomonas aeruginosa PA01
cggcgcgccgga

SEQ ID NO: 1444099 - RNA, 23 nt, Pseudomonas aeruginosa PA01
cggcgcgcgacacauggucggcc

SEQ ID NO: 1444100 - RNA, 19 nt, Pseudomonas aeruginosa PA01
cggcgcgccuucagcgccu

SEQ ID NO: 1444101 - RNA, 23 nt, Pseudomonas aeruginosa PA01
cggcgcgccuucagcgccuccag

SEQ ID NO: 1444102 - RNA, 11 nt, Pseudomonas aeruginosa PA01
cggcgcgccuu

SEQ ID NO: 1444103 - RNA, 15 nt, Pseudomonas aeruginosa PA01
cggcgcggcccgucc

SEQ ID NO: 1444104 - RNA, 24 nt, Pseudomonas aeruginosa PA01
cggcgcggcccguccgcgccacgg

SEQ ID NO: 1444105 - RNA, 14 nt, Pseudomonas aeruginosa PA01
cggcgcggccggcg

SEQ ID NO: 1444106 - RNA, 15 nt, Pseudomonas aeruginosa PA01
cggcgcggccggcgc

SEQ ID NO: 1444107 - RNA, 19 nt, Pseudomonas aeruginosa PA01
cggcgcggccggcgccgcg

SEQ ID NO: 1444108 - RNA, 21 nt, Pseudomonas aeruginosa PA01
cggcgcggccggcgccgcggu

SEQ ID NO: 1444109 - RNA, 13 nt, Pseudomonas aeruginosa PA01
cggcgcggcgcgu

SEQ ID NO: 1444110 - RNA, 17 nt, Pseudomonas aeruginosa PA01
cggcgcggguucgugcc

SEQ ID NO: 1444111 - RNA, 18 nt, Pseudomonas aeruginosa PA01
cggcgcgggucugcucgc

SEQ ID NO: 1444112 - RNA, 20 nt, Pseudomonas aeruginosa PA01
cggcgcgggucugcucgcgc

SEQ ID NO: 1444113 - RNA, 16 nt, Pseudomonas aeruginosa PA01
cggcgcggccugcagc

SEQ ID NO: 1444114 - RNA, 14 nt, Pseudomonas aeruginosa PA01
cggcgcggcgcaau

SEQ ID NO: 1444115 - RNA, 14 nt, Pseudomonas aeruginosa PA01
cggcgcggcgcagc

SEQ ID NO: 1444116 - RNA, 16 nt, Pseudomonas aeruginosa PA01
cggcgcggcgcagcca

SEQ ID NO: 1444117 - RNA, 18 nt, Pseudomonas aeruginosa PA01
cggcgcggcgcagccaga

SEQ ID NO: 1444118 - RNA, 21 nt, Pseudomonas aeruginosa PA01
cggcgcggugccgugggucgc

SEQ ID NO: 1444119 - RNA, 20 nt, Pseudomonas aeruginosa PA01
cggcgcgguuucgcagcgcu

SEQ ID NO: 1444120 - RNA, 15 nt, Pseudomonas aeruginosa PA01
cggcgccgguugcgu

SEQ ID NO: 1444121 - RNA, 18 nt, Pseudomonas aeruginosa PA01
cggcgccgguugcugcug

SEQ ID NO: 1444122 - RNA, 19 nt, Pseudomonas aeruginosa PA01
cggcgccgguugcugcugc

SEQ ID NO: 1444123 - RNA, 14 nt, Pseudomonas aeruginosa PA01
cggcgccggcagga

SEQ ID NO: 1444124 - RNA, 14 nt, Pseudomonas aeruginosa PA01
cggcgccgucgauc

SEQ ID NO: 1444125 - RNA, 15 nt, Pseudomonas aeruginosa PA01
cggcgccgucgauca

SEQ ID NO: 1444126 - RNA, 20 nt, Pseudomonas aeruginosa PA01
cggcgcgacggcccacggcg

SEQ ID NO: 1444127 - RNA, 24 nt, Pseudomonas aeruginosa PA01
cggcgcgacgcuacguuccagggc

SEQ ID NO: 1444128 - RNA, 15 nt, Pseudomonas aeruginosa PA01
cggcgcgacgcucca

SEQ ID NO: 1444129 - RNA, 20 nt, Pseudomonas aeruginosa PA01
cggcgcgauauccgccaggg

SEQ ID NO: 1444130 - RNA, 12 nt, Pseudomonas aeruginosa PA01
cggcgcgauccu

SEQ ID NO: 1444131 - RNA, 16 nt, Pseudomonas aeruginosa PA01
cggcgcgauccuccgc

SEQ ID NO: 1444132 - RNA, 20 nt, Pseudomonas aeruginosa PA01
cggcgcgauccuggcggcac

SEQ ID NO: 1444133 - RNA, 17 nt, Pseudomonas aeruginosa PA01
cggcgcgcacggaggcg

SEQ ID NO: 1444134 - RNA, 14 nt, Pseudomonas aeruginosa PA01
cggcgcgcccggcg

SEQ ID NO: 1444135 - RNA, 15 nt, Pseudomonas aeruginosa PA01
cggcgcgcccggcgc

SEQ ID NO: 1444136 - RNA, 16 nt, Pseudomonas aeruginosa PA01
cggcgcgcccggcgca

SEQ ID NO: 1444137 - RNA, 13 nt, Pseudomonas aeruginosa PA01
cggcgcgauggag

SEQ ID NO: 1444138 - RNA, 21 nt, Pseudomonas aeruginosa PA01
cggcguccgggugccccaggc

SEQ ID NO: 1444139 - RNA, 13 nt, Pseudomonas aeruginosa PA01
cggcguccuccuc

SEQ ID NO: 1444140 - RNA, 22 nt, Pseudomonas aeruginosa PA01
cggcgucgaggugcggcugccg

SEQ ID NO: 1444141 - RNA, 14 nt, Pseudomonas aeruginosa PA01
cggcguccgccggg

SEQ ID NO: 1444142 - RNA, 15 nt, Pseudomonas aeruginosa PA01
cggcguccgccgggu

SEQ ID NO: 1444143 - RNA, 18 nt, Pseudomonas aeruginosa PA01
cggcguccgccucgcuga

SEQ ID NO: 1444144 - RNA, 20 nt, Pseudomonas aeruginosa PA01
cggcguccgcggccugcucg

SEQ ID NO: 1444145 - RNA, 16 nt, Pseudomonas aeruginosa PA01
cggcgucccggcgccg

SEQ ID NO: 1444146 - RNA, 20 nt, Pseudomonas aeruginosa PA01
cggcgucccggcgccgcccu

SEQ ID NO: 1444147 - RNA, 14 nt, Pseudomonas aeruginosa PA01
cggcguccccuucc

SEQ ID NO: 1444148 - RNA, 22 nt, Pseudomonas aeruginosa PA01
cggcguccccuuccuccucgcc

SEQ ID NO: 1444149 - RNA, 23 nt, Pseudomonas aeruginosa PA01
cggcguccccuuccuccucgccg

SEQ ID NO: 1444150 - RNA, 17 nt, Pseudomonas aeruginosa PA01
cggcgugaagccgccgc

SEQ ID NO: 1444151 - RNA, 20 nt, Pseudomonas aeruginosa PA01
cggcgugaagccgccgccca

SEQ ID NO: 1444152 - RNA, 21 nt, Pseudomonas aeruginosa PA01
cggcgugaagccgccgcccag

SEQ ID NO: 1444153 - RNA, 22 nt, Pseudomonas aeruginosa PA01
cggcgugaagccgccgcccagc

SEQ ID NO: 1444154 - RNA, 22 nt, Pseudomonas aeruginosa PA01
cggcgugagggucgcgccgacg

SEQ ID NO: 1444155 - RNA, 22 nt, Pseudomonas aeruginosa PA01
cggcgucgggcgaaacggcagg

SEQ ID NO: 1444156 - RNA, 19 nt, Pseudomonas aeruginosa PA01
cggcgucguccugcgcggc

SEQ ID NO: 1444157 - RNA, 22 nt, Pseudomonas aeruginosa PA01
cggcgucguccugcgcggcgac

SEQ ID NO: 1444158 - RNA, 14 nt, Pseudomonas aeruginosa PA01
cggcgucgucgauc

SEQ ID NO: 1444159 - RNA, 17 nt, Pseudomonas aeruginosa PA01
cggcgucgucgaucgga

SEQ ID NO: 1444160 - RNA, 14 nt, Pseudomonas aeruginosa PA01
cggcguaggcgcgc

SEQ ID NO: 1444161 - RNA, 18 nt, Pseudomonas aeruginosa PA01
cggcguaugcgccuccag

SEQ ID NO: 1444162 - RNA, 20 nt, Pseudomonas aeruginosa PA01
cggcguauccaagagagcgc

SEQ ID NO: 1444163 - RNA, 22 nt, Pseudomonas aeruginosa PA01
cggcguagugcuggguggaggc

SEQ ID NO: 1444164 - RNA, 14 nt, Pseudomonas aeruginosa PA01
cggcguaggagucg

SEQ ID NO: 1444165 - RNA, 14 nt, Pseudomonas aeruginosa PA01
cggcguaggccagu

SEQ ID NO: 1444166 - RNA, 17 nt, Pseudomonas aeruginosa PA01
cggcguaggccucggag

SEQ ID NO: 1444167 - RNA, 15 nt, Pseudomonas aeruginosa PA01
cggcguagccggcca

SEQ ID NO: 1444168 - RNA, 17 nt, Pseudomonas aeruginosa PA01
cggcguagccggcgauc

SEQ ID NO: 1444169 - RNA, 15 nt, Pseudomonas aeruginosa PA01
cggcguagcgcaggg

SEQ ID NO: 1444170 - RNA, 20 nt, Pseudomonas aeruginosa PA01
cggcguagcgcagggucgcg

SEQ ID NO: 1444171 - RNA, 13 nt, Pseudomonas aeruginosa PA01
cggcguccaggag

SEQ ID NO: 1444172 - RNA, 14 nt, Pseudomonas aeruginosa PA01
cggcguauucgccg

SEQ ID NO: 1444173 - RNA, 16 nt, Pseudomonas aeruginosa PA01
cggcguauucgccgaa

SEQ ID NO: 1444174 - RNA, 14 nt, Pseudomonas aeruginosa PA01
cggcguccauggcg

SEQ ID NO: 1444175 - RNA, 13 nt, Pseudomonas aeruginosa PA01
cggcgguucgccg

SEQ ID NO: 1444176 - RNA, 16 nt, Pseudomonas aeruginosa PA01
cggcgguucgccgagc

SEQ ID NO: 1444177 - RNA, 14 nt, Pseudomonas aeruginosa PA01
cggcgguguagucg

SEQ ID NO: 1444178 - RNA, 16 nt, Pseudomonas aeruginosa PA01
cggcgguuuccaguuc

SEQ ID NO: 1444179 - RNA, 17 nt, Pseudomonas aeruginosa PA01
cggcgguuucgccgagg

SEQ ID NO: 1444180 - RNA, 18 nt, Pseudomonas aeruginosa PA01
cggcgguuucgccgaggc

SEQ ID NO: 1444181 - RNA, 19 nt, Pseudomonas aeruginosa PA01
cggcguaaucgaaggucag

SEQ ID NO: 1444182 - RNA, 16 nt, Pseudomonas aeruginosa PA01
cggcggucucgaacgc

SEQ ID NO: 1444183 - RNA, 19 nt, Pseudomonas aeruginosa PA01
cggcggucucgaacgccag

SEQ ID NO: 1444184 - RNA, 15 nt, Pseudomonas aeruginosa PA01
cggcgguccgccgcg

SEQ ID NO: 1444185 - RNA, 19 nt, Pseudomonas aeruginosa PA01
cggcgguccgccgcgggac

SEQ ID NO: 1444186 - RNA, 18 nt, Pseudomonas aeruginosa PA01
cggcggucuugaucacgu

SEQ ID NO: 1444187 - RNA, 22 nt, Pseudomonas aeruginosa PA01
cggcggucuugaucacguccag

SEQ ID NO: 1444188 - RNA, 14 nt, Pseudomonas aeruginosa PA01
cggcggucgcgauc

SEQ ID NO: 1444189 - RNA, 17 nt, Pseudomonas aeruginosa PA01
cggcggucgcgaucugc

SEQ ID NO: 1444190 - RNA, 16 nt, Pseudomonas aeruginosa PA01
cggcgguggggaagcg

SEQ ID NO: 1444191 - RNA, 18 nt, Pseudomonas aeruginosa PA01
cggcgguggggccgccga

SEQ ID NO: 1444192 - RNA, 22 nt, Pseudomonas aeruginosa PA01
cggcgguggggccgccgaugcc

SEQ ID NO: 1444193 - RNA, 15 nt, Pseudomonas aeruginosa PA01
cggcgguggacgucg

SEQ ID NO: 1444194 - RNA, 12 nt, Pseudomonas aeruginosa PA01
cggcggugcaga

SEQ ID NO: 1444195 - RNA, 16 nt, Pseudomonas aeruginosa PA01
cggcggugcagaacgc

SEQ ID NO: 1444196 - RNA, 22 nt, Pseudomonas aeruginosa PA01
cggcggugccauggaucaccag

SEQ ID NO: 1444197 - RNA, 17 nt, Pseudomonas aeruginosa PA01
cggcgggucacgccgag

SEQ ID NO: 1444198 - RNA, 19 nt, Pseudomonas aeruginosa PA01
cggcggguucagcccgccg

SEQ ID NO: 1444199 - RNA, 21 nt, Pseudomonas aeruginosa PA01
cggcggguucagcccgccgug

SEQ ID NO: 1444200 - RNA, 22 nt, Pseudomonas aeruginosa PA01
cggcggguucagcccgccgugc

SEQ ID NO: 1444201 - RNA, 19 nt, Pseudomonas aeruginosa PA01
cggcggguugaccccgagg

SEQ ID NO: 1444202 - RNA, 20 nt, Pseudomonas aeruginosa PA01
cggcggguugaccccgaggu

SEQ ID NO: 1444203 - RNA, 15 nt, Pseudomonas aeruginosa PA01
cggcggggucgggca

SEQ ID NO: 1444204 - RNA, 22 nt, Pseudomonas aeruginosa PA01
cggcggguaguguuugcgcagg

SEQ ID NO: 1444205 - RNA, 21 nt, Pseudomonas aeruginosa PA01
cggcggguauccgccgggccg

SEQ ID NO: 1444206 - RNA, 18 nt, Pseudomonas aeruginosa PA01
cggcggggugaucaccca

SEQ ID NO: 1444207 - RNA, 20 nt, Pseudomonas aeruginosa PA01
cggcggggcuuuuuuucgcc

SEQ ID NO: 1444208 - RNA, 18 nt, Pseudomonas aeruginosa PA01
cggcgguagcuccaggcc

SEQ ID NO: 1444209 - RNA, 21 nt, Pseudomonas aeruginosa PA01
cggcgguagcuccaggccgaa

SEQ ID NO: 1444210 - RNA, 16 nt, Pseudomonas aeruginosa PA01
cggcgguagccgaggc

SEQ ID NO: 1444211 - RNA, 19 nt, Pseudomonas aeruginosa PA01
cggcgguagccgaggcggc

SEQ ID NO: 1444212 - RNA, 19 nt, Pseudomonas aeruginosa PA01
cggcgguacauggccuucu

SEQ ID NO: 1444213 - RNA, 15 nt, Pseudomonas aeruginosa PA01
cggcggucaucgcgc

SEQ ID NO: 1444214 - RNA, 21 nt, Pseudomonas aeruginosa PA01
cggcggucaucgcgccgccga

SEQ ID NO: 1444215 - RNA, 23 nt, Pseudomonas aeruginosa PA01
cggcggucccagaccagcagcgg

SEQ ID NO: 1444216 - RNA, 16 nt, Pseudomonas aeruginosa PA01
cggcggucccaucagc

SEQ ID NO: 1444217 - RNA, 12 nt, Pseudomonas aeruginosa PA01
cggcggucaggc

SEQ ID NO: 1444218 - RNA, 20 nt, Pseudomonas aeruginosa PA01
cggcggucaggcucagcucg

SEQ ID NO: 1444219 - RNA, 16 nt, Pseudomonas aeruginosa PA01
cggcgggagagggcgg

SEQ ID NO: 1444220 - RNA, 20 nt, Pseudomonas aeruginosa PA01
cggcgggagagggcggcgac

SEQ ID NO: 1444221 - RNA, 15 nt, Pseudomonas aeruginosa PA01
cggcgggaggucaca

SEQ ID NO: 1444222 - RNA, 21 nt, Pseudomonas aeruginosa PA01
cggcgggacaggaacgcccuu

SEQ ID NO: 1444223 - RNA, 14 nt, Pseudomonas aeruginosa PA01
cggcgggcaccgcc

SEQ ID NO: 1444224 - RNA, 17 nt, Pseudomonas aeruginosa PA01
cggcgggcaccgccagc

SEQ ID NO: 1444225 - RNA, 19 nt, Pseudomonas aeruginosa PA01
cggcgggcaccgccagccc

SEQ ID NO: 1444226 - RNA, 23 nt, Pseudomonas aeruginosa PA01
cggcgggaucgaguaagugccga

SEQ ID NO: 1444227 - RNA, 17 nt, Pseudomonas aeruginosa PA01
cggcgggccgcucagga

SEQ ID NO: 1444228 - RNA, 14 nt, Pseudomonas aeruginosa PA01
cggcgggccggcgu

SEQ ID NO: 1444229 - RNA, 13 nt, Pseudomonas aeruginosa PA01
cggcgggccggcg

SEQ ID NO: 1444230 - RNA, 13 nt, Pseudomonas aeruginosa PA01
cggcgggcgcgag

SEQ ID NO: 1444231 - RNA, 16 nt, Pseudomonas aeruginosa PA01
cggcgggcgcccgcca

SEQ ID NO: 1444232 - RNA, 14 nt, Pseudomonas aeruginosa PA01
cggcgggcgguuuc

SEQ ID NO: 1444233 - RNA, 15 nt, Pseudomonas aeruginosa PA01
cggcggggcgcaccg

SEQ ID NO: 1444234 - RNA, 16 nt, Pseudomonas aeruginosa PA01
cggcggggcgcaccgc

SEQ ID NO: 1444235 - RNA, 17 nt, Pseudomonas aeruginosa PA01
cggcggggcgcaccgcc

SEQ ID NO: 1444236 - RNA, 15 nt, Pseudomonas aeruginosa PA01
cggcggggcgcagca

SEQ ID NO: 1444237 - RNA, 17 nt, Pseudomonas aeruginosa PA01
cggcggggcgcagcagg

SEQ ID NO: 1444238 - RNA, 17 nt, Pseudomonas aeruginosa PA01
cggcgggcugccgcgga

SEQ ID NO: 1444239 - RNA, 20 nt, Pseudomonas aeruginosa PA01
cggcggggaagccuucgccc

SEQ ID NO: 1444240 - RNA, 23 nt, Pseudomonas aeruginosa PA01
cggcggggaagccuucgcccggc

SEQ ID NO: 1444241 - RNA, 14 nt, Pseudomonas aeruginosa PA01
cggcggggaaggcg

SEQ ID NO: 1444242 - RNA, 18 nt, Pseudomonas aeruginosa PA01
cggcggggaaggcgucgg

SEQ ID NO: 1444243 - RNA, 21 nt, Pseudomonas aeruginosa PA01
cggcgggcucgcaaucagcgc

SEQ ID NO: 1444244 - RNA, 22 nt, Pseudomonas aeruginosa PA01
cggcgggcucgcaaucagcgcg

SEQ ID NO: 1444245 - RNA, 21 nt, Pseudomonas aeruginosa PA01
cggcggcguauucgccgaaga

SEQ ID NO: 1444246 - RNA, 15 nt, Pseudomonas aeruginosa PA01
cggcggcggccagca

SEQ ID NO: 1444247 - RNA, 16 nt, Pseudomonas aeruginosa PA01
cggcggcggccagcag

SEQ ID NO: 1444248 - RNA, 17 nt, Pseudomonas aeruginosa PA01
cggcggcggccagcagc

SEQ ID NO: 1444249 - RNA, 12 nt, Pseudomonas aeruginosa PA01
cggcggcggccu

SEQ ID NO: 1444250 - RNA, 21 nt, Pseudomonas aeruginosa PA01
cggcggcggggaaggcgucgg

SEQ ID NO: 1444251 - RNA, 23 nt, Pseudomonas aeruginosa PA01
cggcggcuaccagcgcuucggcg

SEQ ID NO: 1444252 - RNA, 21 nt, Pseudomonas aeruginosa PA01
cggcggcucuuuccgggucau

SEQ ID NO: 1444253 - RNA, 22 nt, Pseudomonas aeruginosa PA01
cggcggcguuggccgaggaggc

SEQ ID NO: 1444254 - RNA, 16 nt, Pseudomonas aeruginosa PA01
cggcggcgugcaggcc

SEQ ID NO: 1444255 - RNA, 18 nt, Pseudomonas aeruginosa PA01
cggcggcgugcaggccga

SEQ ID NO: 1444256 - RNA, 15 nt, Pseudomonas aeruginosa PA01
cggcggcgugcaggg

SEQ ID NO: 1444257 - RNA, 19 nt, Pseudomonas aeruginosa PA01
cggcggcugcugcgccugg

SEQ ID NO: 1444258 - RNA, 22 nt, Pseudomonas aeruginosa PA01
cggcggcugcugcgccuggccg

SEQ ID NO: 1444259 - RNA, 17 nt, Pseudomonas aeruginosa PA01
cggcggcuucagccaga

SEQ ID NO: 1444260 - RNA, 21 nt, Pseudomonas aeruginosa PA01
cggcggcuuccuccaucgccu

SEQ ID NO: 1444261 - RNA, 15 nt, Pseudomonas aeruginosa PA01
cggcgggaacgccgg

SEQ ID NO: 1444262 - RNA, 16 nt, Pseudomonas aeruginosa PA01
cggcgggaacgccggg

SEQ ID NO: 1444263 - RNA, 17 nt, Pseudomonas aeruginosa PA01
cggcgggaacgccgggc

SEQ ID NO: 1444264 - RNA, 17 nt, Pseudomonas aeruginosa PA01
cggcggcgccggcaggu

SEQ ID NO: 1444265 - RNA, 21 nt, Pseudomonas aeruginosa PA01
cggcggcgcgaaccagcagca

SEQ ID NO: 1444266 - RNA, 15 nt, Pseudomonas aeruginosa PA01
cggcggcgcgcagcg

SEQ ID NO: 1444267 - RNA, 16 nt, Pseudomonas aeruginosa PA01
cggcggcgcgcagcga

SEQ ID NO: 1444268 - RNA, 22 nt, Pseudomonas aeruginosa PA01
cggcggcgcgcagcgaacgggc

SEQ ID NO: 1444269 - RNA, 16 nt, Pseudomonas aeruginosa PA01
cggcggcggaccuccg

SEQ ID NO: 1444270 - RNA, 13 nt, Pseudomonas aeruginosa PA01
cggcggcggacgc

SEQ ID NO: 1444271 - RNA, 20 nt, Pseudomonas aeruginosa PA01
cggcggcggacgcaggccga

SEQ ID NO: 1444272 - RNA, 20 nt, Pseudomonas aeruginosa PA01
cggcggcggauaacgccugu

SEQ ID NO: 1444273 - RNA, 15 nt, Pseudomonas aeruginosa PA01
cggcggcgcugagga

SEQ ID NO: 1444274 - RNA, 16 nt, Pseudomonas aeruginosa PA01
cggcggcgcugaggau

SEQ ID NO: 1444275 - RNA, 22 nt, Pseudomonas aeruginosa PA01
cggcggcgcguccaccuggcgg

SEQ ID NO: 1444276 - RNA, 17 nt, Pseudomonas aeruginosa PA01
cggcggcgcuauccgcc

SEQ ID NO: 1444277 - RNA, 21 nt, Pseudomonas aeruginosa PA01
cggcggcgcgcugcgggucau

SEQ ID NO: 1444278 - RNA, 12 nt, Pseudomonas aeruginosa PA01
cggcggcgcggg

SEQ ID NO: 1444279 - RNA, 10 nt, Pseudomonas aeruginosa PA01
cggcggccuu

SEQ ID NO: 1444280 - RNA, 17 nt, Pseudomonas aeruginosa PA01
cggcggccugccccgcc

SEQ ID NO: 1444281 - RNA, 23 nt, Pseudomonas aeruginosa PA01
cggcggccuuuucggcggccagg

SEQ ID NO: 1444282 - RNA, 20 nt, Pseudomonas aeruginosa PA01
cggcggcgaauacguggggg

SEQ ID NO: 1444283 - RNA, 21 nt, Pseudomonas aeruginosa PA01
cggcggcgaauacguggggga

SEQ ID NO: 1444284 - RNA, 14 nt, Pseudomonas aeruginosa PA01
cggcggcgacccag

SEQ ID NO: 1444285 - RNA, 15 nt, Pseudomonas aeruginosa PA01
cggcggcgacccaga

SEQ ID NO: 1444286 - RNA, 21 nt, Pseudomonas aeruginosa PA01
cggcggcgacccagaccugcc

SEQ ID NO: 1444287 - RNA, 22 nt, Pseudomonas aeruginosa PA01
cggcggcgacccagaccugccg

SEQ ID NO: 1444288 - RNA, 17 nt, Pseudomonas aeruginosa PA01
cggcggcgaccccgauc

SEQ ID NO: 1444289 - RNA, 12 nt, Pseudomonas aeruginosa PA01
cggcggcgaucu

SEQ ID NO: 1444290 - RNA, 22 nt, Pseudomonas aeruginosa PA01
cggcggcgaucuucuccgccgc

SEQ ID NO: 1444291 - RNA, 18 nt, Pseudomonas aeruginosa PA01
cggcggcgaugaucggca

SEQ ID NO: 1444292 - RNA, 23 nt, Pseudomonas aeruginosa PA01
cggcggcgaugaucggcagccgu

SEQ ID NO: 1444293 - RNA, 14 nt, Pseudomonas aeruginosa PA01
cggcggcgagcgcc

SEQ ID NO: 1444294 - RNA, 20 nt, Pseudomonas aeruginosa PA01
cggcggcgagcgccgcggcg

SEQ ID NO: 1444295 - RNA, 14 nt, Pseudomonas aeruginosa PA01
cggcggcgacgcug

SEQ ID NO: 1444296 - RNA, 22 nt, Pseudomonas aeruginosa PA01
cggcggcgacgcuggcggugcg

SEQ ID NO: 1444297 - RNA, 21 nt, Pseudomonas aeruginosa PA01
cggcggccgccuugaccugcu

SEQ ID NO: 1444298 - RNA, 12 nt, Pseudomonas aeruginosa PA01
cggcggccgccu

SEQ ID NO: 1444299 - RNA, 17 nt, Pseudomonas aeruginosa PA01
cggcggccgccucggcg

SEQ ID NO: 1444300 - RNA, 14 nt, Pseudomonas aeruginosa PA01
cggcggccucgagg

SEQ ID NO: 1444301 - RNA, 20 nt, Pseudomonas aeruginosa PA01
cggcggccucgaggucggcc

SEQ ID NO: 1444302 - RNA, 14 nt, Pseudomonas aeruginosa PA01
cggcggccucgcgg

SEQ ID NO: 1444303 - RNA, 23 nt, Pseudomonas aeruginosa PA01
cggcggccucggccucgucgagc

SEQ ID NO: 1444304 - RNA, 15 nt, Pseudomonas aeruginosa PA01
cggcggccugcucgc

SEQ ID NO: 1444305 - RNA, 18 nt, Pseudomonas aeruginosa PA01
cggcggccugcucgcgca

SEQ ID NO: 1444306 - RNA, 12 nt, Pseudomonas aeruginosa PA01
cggcggccgucg

SEQ ID NO: 1444307 - RNA, 15 nt, Pseudomonas aeruginosa PA01
cggcggccgucgcug

SEQ ID NO: 1444308 - RNA, 15 nt, Pseudomonas aeruginosa PA01
cggcggccagcagca

SEQ ID NO: 1444309 - RNA, 16 nt, Pseudomonas aeruginosa PA01
cggcggccagcagcac

SEQ ID NO: 1444310 - RNA, 23 nt, Pseudomonas aeruginosa PA01
cggcggccagcggaugcuggcgg

SEQ ID NO: 1444311 - RNA, 12 nt, Pseudomonas aeruginosa PA01
cggcggccgagg

SEQ ID NO: 1444312 - RNA, 17 nt, Pseudomonas aeruginosa PA01
cggcggccgccaucgcc

SEQ ID NO: 1444313 - RNA, 12 nt, Pseudomonas aeruginosa PA01
cggcggccgcca

SEQ ID NO: 1444314 - RNA, 18 nt, Pseudomonas aeruginosa PA01
cggcggccgcaugccggg

SEQ ID NO: 1444315 - RNA, 14 nt, Pseudomonas aeruginosa PA01
cgggcugccagcau

SEQ ID NO: 1444316 - RNA, 22 nt, Pseudomonas aeruginosa PA01
cgggcugccgcggaagugcgcc

SEQ ID NO: 1444317 - RNA, 18 nt, Pseudomonas aeruginosa PA01
cgggcugcgcucggcgcu

SEQ ID NO: 1444318 - RNA, 14 nt, Pseudomonas aeruginosa PA01
cgggcuggccacca

SEQ ID NO: 1444319 - RNA, 19 nt, Pseudomonas aeruginosa PA01
cgggcuggccaccagcacc

SEQ ID NO: 1444320 - RNA, 16 nt, Pseudomonas aeruginosa PA01
cgggcuggccaccgcc

SEQ ID NO: 1444321 - RNA, 22 nt, Pseudomonas aeruginosa PA01
cgggcuggccaccgggaucagc

SEQ ID NO: 1444322 - RNA, 17 nt, Pseudomonas aeruginosa PA01
cgggcugcgugccagca

SEQ ID NO: 1444323 - RNA, 21 nt, Pseudomonas aeruginosa PA01
cgggcuucagcgccgggucga

SEQ ID NO: 1444324 - RNA, 16 nt, Pseudomonas aeruginosa PA01
cgggcuuccuggccgg

SEQ ID NO: 1444325 - RNA, 17 nt, Pseudomonas aeruginosa PA01
cgggcuuccuggccggg

SEQ ID NO: 1444326 - RNA, 14 nt, Pseudomonas aeruginosa PA01
cgggcuucggcagc

SEQ ID NO: 1444327 - RNA, 20 nt, Pseudomonas aeruginosa PA01
cgggcuuuuucauggcuggc

SEQ ID NO: 1444328 - RNA, 23 nt, Pseudomonas aeruginosa PA01
cgggcuuuuucauggcuggcccu

SEQ ID NO: 1444329 - RNA, 20 nt, Pseudomonas aeruginosa PA01
cgggcuuuuucauuuccgca

SEQ ID NO: 1444330 - RNA, 23 nt, Pseudomonas aeruginosa PA01
cgggcuuuuucauuuccuccgag

SEQ ID NO: 1444331 - RNA, 16 nt, Pseudomonas aeruginosa PA01
cggggaacacgcgcug

SEQ ID NO: 1444332 - RNA, 13 nt, Pseudomonas aeruginosa PA01
cggggaacagcau

SEQ ID NO: 1444333 - RNA, 14 nt, Pseudomonas aeruginosa PA01
cggggaacagcgcc

SEQ ID NO: 1444334 - RNA, 21 nt, Pseudomonas aeruginosa PA01
cggggaacagcgccagcggca

SEQ ID NO: 1444335 - RNA, 15 nt, Pseudomonas aeruginosa PA01
cggggaaccacaccu

SEQ ID NO: 1444336 - RNA, 19 nt, Pseudomonas aeruginosa PA01
cgggcuucgguguaucggc

SEQ ID NO: 1444337 - RNA, 20 nt, Pseudomonas aeruginosa PA01
cgggcuucgguguaucggcg

SEQ ID NO: 1444338 - RNA, 22 nt, Pseudomonas aeruginosa PA01
cgggcuucgguguaucggcgga

SEQ ID NO: 1444339 - RNA, 15 nt, Pseudomonas aeruginosa PA01
cgggcucaggcucuu

SEQ ID NO: 1444340 - RNA, 22 nt, Pseudomonas aeruginosa PA01
cgggcucacauuaauugcgagc

SEQ ID NO: 1444341 - RNA, 20 nt, Pseudomonas aeruginosa PA01
cgggcucgcaaucagcgcga

SEQ ID NO: 1444342 - RNA, 17 nt, Pseudomonas aeruginosa PA01
cgggcucgacgaggaac

SEQ ID NO: 1444343 - RNA, 21 nt, Pseudomonas aeruginosa PA01
cgggcgugaguaucaucgcga

SEQ ID NO: 1444344 - RNA, 16 nt, Pseudomonas aeruginosa PA01
cgggcgucuccugccg

SEQ ID NO: 1444345 - RNA, 20 nt, Pseudomonas aeruginosa PA01
cgggcgucuccugccgccga

SEQ ID NO: 1444346 - RNA, 14 nt, Pseudomonas aeruginosa PA01
cgggcguccggcga

SEQ ID NO: 1444347 - RNA, 22 nt, Pseudomonas aeruginosa PA01
cgggcguccguaaugcaacccg

SEQ ID NO: 1444348 - RNA, 14 nt, Pseudomonas aeruginosa PA01
cgggcggccgacgu

SEQ ID NO: 1444349 - RNA, 11 nt, Pseudomonas aeruginosa PA01
cgggcggccuc

SEQ ID NO: 1444350 - RNA, 13 nt, Pseudomonas aeruginosa PA01
cgggcccauggcg

SEQ ID NO: 1444351 - RNA, 19 nt, Pseudomonas aeruginosa PA01
cgggcccauggcgguagug

SEQ ID NO: 1444352 - RNA, 16 nt, Pseudomonas aeruginosa PA01
cgggcccugccagagg

SEQ ID NO: 1444353 - RNA, 21 nt, Pseudomonas aeruginosa PA01
cgggcccugcuucgaacgugc

SEQ ID NO: 1444354 - RNA, 19 nt, Pseudomonas aeruginosa PA01
cgggcccugggccccggcc

SEQ ID NO: 1444355 - RNA, 20 nt, Pseudomonas aeruginosa PA01
cgggcccugggccccggccg

SEQ ID NO: 1444356 - RNA, 17 nt, Pseudomonas aeruginosa PA01
cgggccgacggcccucc

SEQ ID NO: 1444357 - RNA, 23 nt, Pseudomonas aeruginosa PA01
cgggccgacggcccuccggcgcg

SEQ ID NO: 1444358 - RNA, 14 nt, Pseudomonas aeruginosa PA01
cgggccgaccugcc

SEQ ID NO: 1444359 - RNA, 15 nt, Pseudomonas aeruginosa PA01
cgggccgaccugccc

SEQ ID NO: 1444360 - RNA, 22 nt, Pseudomonas aeruginosa PA01
cgggccgaccugcccgcuguug

SEQ ID NO: 1444361 - RNA, 17 nt, Pseudomonas aeruginosa PA01
cgggccgagggcugaga

SEQ ID NO: 1444362 - RNA, 15 nt, Pseudomonas aeruginosa PA01
cgggccgagggugau

SEQ ID NO: 1444363 - RNA, 19 nt, Pseudomonas aeruginosa PA01
cgggccgaggucgcgggcc

SEQ ID NO: 1444364 - RNA, 22 nt, Pseudomonas aeruginosa PA01
cgggccgaggucgcgggccagg

SEQ ID NO: 1444365 - RNA, 20 nt, Pseudomonas aeruginosa PA01
cgggccuucgccagcggcca

SEQ ID NO: 1444366 - RNA, 15 nt, Pseudomonas aeruginosa PA01
cgggccuucaggcug

SEQ ID NO: 1444367 - RNA, 15 nt, Pseudomonas aeruginosa PA01
cgggccugggcaucg

SEQ ID NO: 1444368 - RNA, 17 nt, Pseudomonas aeruginosa PA01
cgggccuggugagcgga

SEQ ID NO: 1444369 - RNA, 18 nt, Pseudomonas aeruginosa PA01
cgggcgaaacggcaggcc

SEQ ID NO: 1444370 - RNA, 19 nt, Pseudomonas aeruginosa PA01
cgggcgaaacggcaggcca

SEQ ID NO: 1444371 - RNA, 21 nt, Pseudomonas aeruginosa PA01
cgggcgaaacggcaggccagc

SEQ ID NO: 1444372 - RNA, 14 nt, Pseudomonas aeruginosa PA01
cgggcgagcgcaga

SEQ ID NO: 1444373 - RNA, 23 nt, Pseudomonas aeruginosa PA01
cgggcgagcgcagacgggugcug

SEQ ID NO: 1444374 - RNA, 20 nt, Pseudomonas aeruginosa PA01
cgggcgaggcuaacgccgag

SEQ ID NO: 1444375 - RNA, 13 nt, Pseudomonas aeruginosa PA01
cgggcgagggcgg

SEQ ID NO: 1444376 - RNA, 18 nt, Pseudomonas aeruginosa PA01
cgggcgagcagggaggag

SEQ ID NO: 1444377 - RNA, 15 nt, Pseudomonas aeruginosa PA01
cgggcgaggucgcca

SEQ ID NO: 1444378 - RNA, 14 nt, Pseudomonas aeruginosa PA01
cgggcgagucgauc

SEQ ID NO: 1444379 - RNA, 21 nt, Pseudomonas aeruginosa PA01
cgggcgcgaggcgcccgccgg

SEQ ID NO: 1444380 - RNA, 23 nt, Pseudomonas aeruginosa PA01
cgggcgcgaggcgcccgccggcc

SEQ ID NO: 1444381 - RNA, 18 nt, Pseudomonas aeruginosa PA01
cgggcgaucuccucgauc

SEQ ID NO: 1444382 - RNA, 20 nt, Pseudomonas aeruginosa PA01
cgggcgccuuuuucauggcc

SEQ ID NO: 1444383 - RNA, 16 nt, Pseudomonas aeruginosa PA01
cgggcgcgcgccaccg

SEQ ID NO: 1444384 - RNA, 20 nt, Pseudomonas aeruginosa PA01
cgggcgcgcgccaccgccug

SEQ ID NO: 1444385 - RNA, 16 nt, Pseudomonas aeruginosa PA01
cgggcgcgcuggucgu

SEQ ID NO: 1444386 - RNA, 20 nt, Pseudomonas aeruginosa PA01
cgggcgcugcaugggcucgc

SEQ ID NO: 1444387 - RNA, 22 nt, Pseudomonas aeruginosa PA01
cgggcgcugcaugggcucgcgc

SEQ ID NO: 1444388 - RNA, 16 nt, Pseudomonas aeruginosa PA01
cgggcgcggcuggugc

SEQ ID NO: 1444389 - RNA, 16 nt, Pseudomonas aeruginosa PA01
cgggcgcucuggccgc

SEQ ID NO: 1444390 - RNA, 18 nt, Pseudomonas aeruginosa PA01
cgggcgcucuggccgcgc

SEQ ID NO: 1444391 - RNA, 19 nt, Pseudomonas aeruginosa PA01
cgggcgcucuggccgcgcu

SEQ ID NO: 1444392 - RNA, 19 nt, Pseudomonas aeruginosa PA01
cggggaucacucgccgccg

SEQ ID NO: 1444393 - RNA, 19 nt, Pseudomonas aeruginosa PA01
cggggagggugccguggaa

SEQ ID NO: 1444394 - RNA, 22 nt, Pseudomonas aeruginosa PA01
cggggagauguccaucagccgc

SEQ ID NO: 1444395 - RNA, 14 nt, Pseudomonas aeruginosa PA01
cggggacgcugucc

SEQ ID NO: 1444396 - RNA, 19 nt, Pseudomonas aeruginosa PA01
cggggacgcugucccggcc

SEQ ID NO: 1444397 - RNA, 20 nt, Pseudomonas aeruginosa PA01
cggggaaaccuucgguggcg

SEQ ID NO: 1444398 - RNA, 18 nt, Pseudomonas aeruginosa PA01
cggggaagccuucgcccg

SEQ ID NO: 1444399 - RNA, 19 nt, Pseudomonas aeruginosa PA01
cggggaagcugccuuccag

SEQ ID NO: 1444400 - RNA, 23 nt, Pseudomonas aeruginosa PA01
cggggaagcugccuuccagcagg

SEQ ID NO: 1444401 - RNA, 19 nt, Pseudomonas aeruginosa PA01
cggggaagggacgucgcca

SEQ ID NO: 1444402 - RNA, 17 nt, Pseudomonas aeruginosa PA01
cggggauguccgccgcc

SEQ ID NO: 1444403 - RNA, 19 nt, Pseudomonas aeruginosa PA01
cggggaugaccguccgguc

SEQ ID NO: 1444404 - RNA, 18 nt, Pseudomonas aeruginosa PA01
cggggcauucguccagcc

SEQ ID NO: 1444405 - RNA, 20 nt, Pseudomonas aeruginosa PA01
cggggcauucguccagccgc

SEQ ID NO: 1444406 - RNA, 21 nt, Pseudomonas aeruginosa PA01
cggggcauucguccagccgcc

SEQ ID NO: 1444407 - RNA, 16 nt, Pseudomonas aeruginosa PA01
cggggcaggcaugcgg

SEQ ID NO: 1444408 - RNA, 13 nt, Pseudomonas aeruginosa PA01
cggggcaggcgca

SEQ ID NO: 1444409 - RNA, 14 nt, Pseudomonas aeruginosa PA01
cggggcaggcgcag

SEQ ID NO: 1444410 - RNA, 17 nt, Pseudomonas aeruginosa PA01
cggggcaggcgcaggcg

SEQ ID NO: 1444411 - RNA, 19 nt, Pseudomonas aeruginosa PA01
cggggcaggcgcaggcgaa

SEQ ID NO: 1444412 - RNA, 23 nt, Pseudomonas aeruginosa PA01
cggggcaggcgcaggcgaacugc

SEQ ID NO: 1444413 - RNA, 17 nt, Pseudomonas aeruginosa PA01
cggggccguccgccagg

SEQ ID NO: 1444414 - RNA, 14 nt, Pseudomonas aeruginosa PA01
cggggcccggcucc

SEQ ID NO: 1444415 - RNA, 15 nt, Pseudomonas aeruginosa PA01
cggggcccuccaggc

SEQ ID NO: 1444416 - RNA, 20 nt, Pseudomonas aeruginosa PA01
cggggccgaggucgaccagc

SEQ ID NO: 1444417 - RNA, 21 nt, Pseudomonas aeruginosa PA01
cggggccgaggucgaccagcc

SEQ ID NO: 1444418 - RNA, 14 nt, Pseudomonas aeruginosa PA01
cggggccaggucgg

SEQ ID NO: 1444419 - RNA, 15 nt, Pseudomonas aeruginosa PA01
cggggccaucagugc

SEQ ID NO: 1444420 - RNA, 13 nt, Pseudomonas aeruginosa PA01
cggggccccggca

SEQ ID NO: 1444421 - RNA, 16 nt, Pseudomonas aeruginosa PA01
cggggccccggcaagg

SEQ ID NO: 1444422 - RNA, 17 nt, Pseudomonas aeruginosa PA01
cggggcccggcaggcag

SEQ ID NO: 1444423 - RNA, 18 nt, Pseudomonas aeruginosa PA01
cggggcccggcaggcagu

SEQ ID NO: 1444424 - RNA, 22 nt, Pseudomonas aeruginosa PA01
cggggcggccaaccucucccca

SEQ ID NO: 1444425 - RNA, 15 nt, Pseudomonas aeruginosa PA01
cggggcgcucgcccu

SEQ ID NO: 1444426 - RNA, 22 nt, Pseudomonas aeruginosa PA01
cggggcgccgcgcggcgccccg

SEQ ID NO: 1444427 - RNA, 22 nt, Pseudomonas aeruginosa PA01
cggggcgccuccagcgggccuu

SEQ ID NO: 1444428 - RNA, 12 nt, Pseudomonas aeruginosa PA01
cggggcgcgcug

SEQ ID NO: 1444429 - RNA, 16 nt, Pseudomonas aeruginosa PA01
cggggcgcgcugcgaa

SEQ ID NO: 1444430 - RNA, 17 nt, Pseudomonas aeruginosa PA01
cggggccguucaggaag

SEQ ID NO: 1444431 - RNA, 17 nt, Pseudomonas aeruginosa PA01
cggggccugcugcgggc

SEQ ID NO: 1444432 - RNA, 19 nt, Pseudomonas aeruginosa PA01
cggggccuucaggcgcucc

SEQ ID NO: 1444433 - RNA, 12 nt, Pseudomonas aeruginosa PA01
cggggcgcaagg

SEQ ID NO: 1444434 - RNA, 21 nt, Pseudomonas aeruginosa PA01
cggggcgcaaggccagcggca

SEQ ID NO: 1444435 - RNA, 15 nt, Pseudomonas aeruginosa PA01
cggggcgcaccgccu

SEQ ID NO: 1444436 - RNA, 18 nt, Pseudomonas aeruginosa PA01
cggggcgcaccgccucga

SEQ ID NO: 1444437 - RNA, 20 nt, Pseudomonas aeruginosa PA01
cggggcgcaccgccucgacc

SEQ ID NO: 1444438 - RNA, 16 nt, Pseudomonas aeruginosa PA01
cggggcgcagcaggau

SEQ ID NO: 1444439 - RNA, 14 nt, Pseudomonas aeruginosa PA01
cggggcgaggucgg

SEQ ID NO: 1444440 - RNA, 18 nt, Pseudomonas aeruginosa PA01
cggggcgaggucggccug

SEQ ID NO: 1444441 - RNA, 14 nt, Pseudomonas aeruginosa PA01
cggggcucugccgg

SEQ ID NO: 1444442 - RNA, 21 nt, Pseudomonas aeruginosa PA01
cggggcguuuuucauggcggc

SEQ ID NO: 1444443 - RNA, 22 nt, Pseudomonas aeruginosa PA01
cggggcguuuuucauggcggca

SEQ ID NO: 1444444 - RNA, 14 nt, Pseudomonas aeruginosa PA01
cggggcgugcaggc

SEQ ID NO: 1444445 - RNA, 18 nt, Pseudomonas aeruginosa PA01
cggggcguauagcccggg

SEQ ID NO: 1444446 - RNA, 17 nt, Pseudomonas aeruginosa PA01
cggggcugcggccucgu

SEQ ID NO: 1444447 - RNA, 15 nt, Pseudomonas aeruginosa PA01
cgggggcucggucga

SEQ ID NO: 1444448 - RNA, 17 nt, Pseudomonas aeruginosa PA01
cgggggcucggucgagc

SEQ ID NO: 1444449 - RNA, 21 nt, Pseudomonas aeruginosa PA01
cgggggaagaacccagacagc

SEQ ID NO: 1444450 - RNA, 14 nt, Pseudomonas aeruginosa PA01
cgggggucgcggcg

SEQ ID NO: 1444451 - RNA, 14 nt, Pseudomonas aeruginosa PA01
cggggucgggcagc

SEQ ID NO: 1444452 - RNA, 15 nt, Pseudomonas aeruginosa PA01
cggggucggccugcg

SEQ ID NO: 1444453 - RNA, 19 nt, Pseudomonas aeruginosa PA01
cggggucuuuaccguggaa

SEQ ID NO: 1444454 - RNA, 16 nt, Pseudomonas aeruginosa PA01
cggggucuggccggcg

SEQ ID NO: 1444455 - RNA, 17 nt, Pseudomonas aeruginosa PA01
cggggucuggccggcga

SEQ ID NO: 1444456 - RNA, 19 nt, Pseudomonas aeruginosa PA01
cggggucuggccggcgauc

SEQ ID NO: 1444457 - RNA, 20 nt, Pseudomonas aeruginosa PA01
cggggucuggccggcgauca

SEQ ID NO: 1444458 - RNA, 22 nt, Pseudomonas aeruginosa PA01
cggggucuggccggcgaucaga

SEQ ID NO: 1444459 - RNA, 21 nt, Pseudomonas aeruginosa PA01
cgggguuuuuuuugccuggaa

SEQ ID NO: 1444460 - RNA, 15 nt, Pseudomonas aeruginosa PA01
cggguaauccaucgc

SEQ ID NO: 1444461 - RNA, 20 nt, Pseudomonas aeruginosa PA01
cggguaacgguagcggcagg

SEQ ID NO: 1444462 - RNA, 21 nt, Pseudomonas aeruginosa PA01
cgggguugaguugcaggccgg

SEQ ID NO: 1444463 - RNA, 15 nt, Pseudomonas aeruginosa PA01
cgggguucgacccgc

SEQ ID NO: 1444464 - RNA, 19 nt, Pseudomonas aeruginosa PA01
cgggguucgacccgcacuu

SEQ ID NO: 1444465 - RNA, 21 nt, Pseudomonas aeruginosa PA01
cgggguucgacgcgccacgca

SEQ ID NO: 1444466 - RNA, 23 nt, Pseudomonas aeruginosa PA01
cgggguucgacgcgccacgcagg

SEQ ID NO: 1444467 - RNA, 20 nt, Pseudomonas aeruginosa PA01
cgggguucuugucgaccagc

SEQ ID NO: 1444468 - RNA, 22 nt, Pseudomonas aeruginosa PA01
cgggguucuugucgaccagcgg

SEQ ID NO: 1444469 - RNA, 19 nt, Pseudomonas aeruginosa PA01
cgggaaggauuccacccgc

SEQ ID NO: 1444470 - RNA, 21 nt, Pseudomonas aeruginosa PA01
cgggaaggauuccacccgcuc

SEQ ID NO: 1444471 - RNA, 15 nt, Pseudomonas aeruginosa PA01
cgggaaggccugacg

SEQ ID NO: 1444472 - RNA, 15 nt, Pseudomonas aeruginosa PA01
cgggaagggaucgac

SEQ ID NO: 1444473 - RNA, 14 nt, Pseudomonas aeruginosa PA01
cgggaaggucggca

SEQ ID NO: 1444474 - RNA, 23 nt, Pseudomonas aeruginosa PA01
cgggaaguaggccuggccgccca

SEQ ID NO: 1444475 - RNA, 19 nt, Pseudomonas aeruginosa PA01
cgggaagucguucccggcc

SEQ ID NO: 1444476 - RNA, 17 nt, Pseudomonas aeruginosa PA01
cgggaacuuggcgcgca

SEQ ID NO: 1444477 - RNA, 19 nt, Pseudomonas aeruginosa PA01
cgggaacuuggcgcgcagg

SEQ ID NO: 1444478 - RNA, 22 nt, Pseudomonas aeruginosa PA01
cgggaacuuggcgcgcagggca

SEQ ID NO: 1444479 - RNA, 19 nt, Pseudomonas aeruginosa PA01
cgggaagcaccgacucgcc

SEQ ID NO: 1444480 - RNA, 23 nt, Pseudomonas aeruginosa PA01
cgggaagcaggucucgacgcgca

SEQ ID NO: 1444481 - RNA, 15 nt, Pseudomonas aeruginosa PA01
cgggaagccgcucgg

SEQ ID NO: 1444482 - RNA, 21 nt, Pseudomonas aeruginosa PA01
cgggaagccgcucggcguagc

SEQ ID NO: 1444483 - RNA, 15 nt, Pseudomonas aeruginosa PA01
cgggaaaggccgcca

SEQ ID NO: 1444484 - RNA, 16 nt, Pseudomonas aeruginosa PA01
cgggaaaggccgccac

SEQ ID NO: 1444485 - RNA, 17 nt, Pseudomonas aeruginosa PA01
cgggaaaggccgccacg

SEQ ID NO: 1444486 - RNA, 16 nt, Pseudomonas aeruginosa PA01
cgggaacagcccgucg

SEQ ID NO: 1444487 - RNA, 20 nt, Pseudomonas aeruginosa PA01
cggcuuuuucauucggcuug

SEQ ID NO: 1444488 - RNA, 21 nt, Pseudomonas aeruginosa PA01
cggcuuuuucauuucuucggg

SEQ ID NO: 1444489 - RNA, 22 nt, Pseudomonas aeruginosa PA01
cggcuuuuuucgcccgugccga

SEQ ID NO: 1444490 - RNA, 19 nt, Pseudomonas aeruginosa PA01
cgggaaacagggcgacgcc

SEQ ID NO: 1444491 - RNA, 22 nt, Pseudomonas aeruginosa PA01
cgggaaacagggcgacgccgau

SEQ ID NO: 1444492 - RNA, 16 nt, Pseudomonas aeruginosa PA01
cgggaaaccaccagga

SEQ ID NO: 1444493 - RNA, 21 nt, Pseudomonas aeruginosa PA01
cgggaaaccaccaggaaggcg

SEQ ID NO: 1444494 - RNA, 23 nt, Pseudomonas aeruginosa PA01
cggcuuguugcgcuccacccagg

SEQ ID NO: 1444495 - RNA, 21 nt, Pseudomonas aeruginosa PA01
cggcuugucggguagggcgaa

SEQ ID NO: 1444496 - RNA, 21 nt, Pseudomonas aeruginosa PA01
cggcuuguucagcucggcgua

SEQ ID NO: 1444497 - RNA, 23 nt, Pseudomonas aeruginosa PA01
cggcuuguucagcucggcguagc

SEQ ID NO: 1444498 - RNA, 17 nt, Pseudomonas aeruginosa PA01
cggcuuguccuggcgca

SEQ ID NO: 1444499 - RNA, 22 nt, Pseudomonas aeruginosa PA01
cggcuuguccuggcgcaugucg

SEQ ID NO: 1444500 - RNA, 14 nt, Pseudomonas aeruginosa PA01
cggcuugcguucgc

SEQ ID NO: 1444501 - RNA, 17 nt, Pseudomonas aeruginosa PA01
cggcuuggcgggcucgc

SEQ ID NO: 1444502 - RNA, 13 nt, Pseudomonas aeruginosa PA01
cggcuuggcucag

SEQ ID NO: 1444503 - RNA, 14 nt, Pseudomonas aeruginosa PA01
cggcuuggcucagu

SEQ ID NO: 1444504 - RNA, 20 nt, Pseudomonas aeruginosa PA01
cggcuuggcucaguugcuga

SEQ ID NO: 1444505 - RNA, 23 nt, Pseudomonas aeruginosa PA01
cggcuuggcucaguugcugauca

SEQ ID NO: 1444506 - RNA, 18 nt, Pseudomonas aeruginosa PA01
cggcuucagagcuggacg

SEQ ID NO: 1444507 - RNA, 16 nt, Pseudomonas aeruginosa PA01
cggcuucagcgccagg

SEQ ID NO: 1444508 - RNA, 17 nt, Pseudomonas aeruginosa PA01
cggcuucagcgccaggc

SEQ ID NO: 1444509 - RNA, 22 nt, Pseudomonas aeruginosa PA01
cggcuguugucgaacagguagu

SEQ ID NO: 1444510 - RNA, 19 nt, Pseudomonas aeruginosa PA01
cggcuguuucaggccggcg

SEQ ID NO: 1444511 - RNA, 19 nt, Pseudomonas aeruginosa PA01
cggcuugccggcagcgacc

SEQ ID NO: 1444512 - RNA, 21 nt, Pseudomonas aeruginosa PA01
cggcuugccggcagcgaccac

SEQ ID NO: 1444513 - RNA, 20 nt, Pseudomonas aeruginosa PA01
cggcuugccggcgcgcgguu

SEQ ID NO: 1444514 - RNA, 16 nt, Pseudomonas aeruginosa PA01
cggcuugccggcggcg

SEQ ID NO: 1444515 - RNA, 17 nt, Pseudomonas aeruginosa PA01
cggcuugccggcggcgc

SEQ ID NO: 1444516 - RNA, 18 nt, Pseudomonas aeruginosa PA01
cggcuuccaccagacgca

SEQ ID NO: 1444517 - RNA, 11 nt, Pseudomonas aeruginosa PA01
cggcuugccgg

SEQ ID NO: 1444518 - RNA, 13 nt, Pseudomonas aeruginosa PA01
cggcuugccggca

SEQ ID NO: 1444519 - RNA, 16 nt, Pseudomonas aeruginosa PA01
cggcugugcucgagga

SEQ ID NO: 1444520 - RNA, 13 nt, Pseudomonas aeruginosa PA01
cggcugugcaggg

SEQ ID NO: 1444521 - RNA, 16 nt, Pseudomonas aeruginosa PA01
cggcuguugccggaau

SEQ ID NO: 1444522 - RNA, 19 nt, Pseudomonas aeruginosa PA01
cggcugcuccggaucgcgc

SEQ ID NO: 1444523 - RNA, 16 nt, Pseudomonas aeruginosa PA01
cggcugcauguccgcc

SEQ ID NO: 1444524 - RNA, 19 nt, Pseudomonas aeruginosa PA01
cggcugcacguuguucacc

SEQ ID NO: 1444525 - RNA, 20 nt, Pseudomonas aeruginosa PA01
cggcugcacguuguucaccg

SEQ ID NO: 1444526 - RNA, 18 nt, Pseudomonas aeruginosa PA01
cggcugcacagguugacg

SEQ ID NO: 1444527 - RNA, 14 nt, Pseudomonas aeruginosa PA01
cggcugcaacgccg

SEQ ID NO: 1444528 - RNA, 15 nt, Pseudomonas aeruginosa PA01
cggcugcaacgccgc

SEQ ID NO: 1444529 - RNA, 16 nt, Pseudomonas aeruginosa PA01
cggcugcaacgccggc

SEQ ID NO: 1444530 - RNA, 18 nt, Pseudomonas aeruginosa PA01
cggcugcaacgccggccc

SEQ ID NO: 1444531 - RNA, 18 nt, Pseudomonas aeruginosa PA01
cggcugcaacuuccacuc

SEQ ID NO: 1444532 - RNA, 22 nt, Pseudomonas aeruginosa PA01
cggcugcugcugcggcuucgcg

SEQ ID NO: 1444533 - RNA, 14 nt, Pseudomonas aeruginosa PA01
cggcuggccgucga

SEQ ID NO: 1444534 - RNA, 19 nt, Pseudomonas aeruginosa PA01
cggcugcugcgccuggccg

SEQ ID NO: 1444535 - RNA, 23 nt, Pseudomonas aeruginosa PA01
cggcugcugcgccuggccgcgca

SEQ ID NO: 1444536 - RNA, 14 nt, Pseudomonas aeruginosa PA01
cggcuggcgcagga

SEQ ID NO: 1444537 - RNA, 19 nt, Pseudomonas aeruginosa PA01
cggcuggcgcaggaccgcc

SEQ ID NO: 1444538 - RNA, 19 nt, Pseudomonas aeruginosa PA01
cggcuggcgcuugccgcgc

SEQ ID NO: 1444539 - RNA, 13 nt, Pseudomonas aeruginosa PA01
cggcuggcggcuc

SEQ ID NO: 1444540 - RNA, 15 nt, Pseudomonas aeruginosa PA01
cggcuggcggcucgg

SEQ ID NO: 1444541 - RNA, 22 nt, Pseudomonas aeruginosa PA01
cggcuggcgggcgaccggaugc

SEQ ID NO: 1444542 - RNA, 13 nt, Pseudomonas aeruginosa PA01
cggcuggcgccgg

SEQ ID NO: 1444543 - RNA, 16 nt, Pseudomonas aeruginosa PA01
cggcuggcgccggugc

SEQ ID NO: 1444544 - RNA, 20 nt, Pseudomonas aeruginosa PA01
cggcuggcgccggugcauga

SEQ ID NO: 1444545 - RNA, 20 nt, Pseudomonas aeruginosa PA01
cggcuggcgcgaucggggca

SEQ ID NO: 1444546 - RNA, 14 nt, Pseudomonas aeruginosa PA01
cggcuggcgcgcgc

SEQ ID NO: 1444547 - RNA, 18 nt, Pseudomonas aeruginosa PA01
cggcugucgacgcagccg

SEQ ID NO: 1444548 - RNA, 14 nt, Pseudomonas aeruginosa PA01
cggcuggcugaagc

SEQ ID NO: 1444549 - RNA, 15 nt, Pseudomonas aeruginosa PA01
cggcuggcugaagcc

SEQ ID NO: 1444550 - RNA, 17 nt, Pseudomonas aeruginosa PA01
cggcguggucgaugccc

SEQ ID NO: 1444551 - RNA, 20 nt, Pseudomonas aeruginosa PA01
cggcguggucgaugcccacc

SEQ ID NO: 1444552 - RNA, 15 nt, Pseudomonas aeruginosa PA01
cggcgugggcggucg

SEQ ID NO: 1444553 - RNA, 17 nt, Pseudomonas aeruginosa PA01
cggcgugggcggucggc

SEQ ID NO: 1444554 - RNA, 19 nt, Pseudomonas aeruginosa PA01
cggcgugggcggucggcga

SEQ ID NO: 1444555 - RNA, 14 nt, Pseudomonas aeruginosa PA01
cggcguggcucgau

SEQ ID NO: 1444556 - RNA, 19 nt, Pseudomonas aeruginosa PA01
cggcguggcucgaucagcc

SEQ ID NO: 1444557 - RNA, 20 nt, Pseudomonas aeruginosa PA01
cggcguggcucgaucagccg

SEQ ID NO: 1444558 - RNA, 21 nt, Pseudomonas aeruginosa PA01
cggcguggcucgaucagccgg

SEQ ID NO: 1444559 - RNA, 16 nt, Pseudomonas aeruginosa PA01
cggcguggccggcgac

SEQ ID NO: 1444560 - RNA, 17 nt, Pseudomonas aeruginosa PA01
cggcguggccggcgacc

SEQ ID NO: 1444561 - RNA, 18 nt, Pseudomonas aeruginosa PA01
cggcguggccggcgacca

SEQ ID NO: 1444562 - RNA, 17 nt, Pseudomonas aeruginosa PA01
cggcgugcauggccggg

SEQ ID NO: 1444563 - RNA, 18 nt, Pseudomonas aeruginosa PA01
cggcgugcaggccgauca

SEQ ID NO: 1444564 - RNA, 21 nt, Pseudomonas aeruginosa PA01
cggcgugcagguagcagccgu

SEQ ID NO: 1444565 - RNA, 14 nt, Pseudomonas aeruginosa PA01
cggcugaccggcau

SEQ ID NO: 1444566 - RNA, 21 nt, Pseudomonas aeruginosa PA01
cggcugaccggcaucgaccag

SEQ ID NO: 1444567 - RNA, 15 nt, Pseudomonas aeruginosa PA01
cggcugaaggccgaa

SEQ ID NO: 1444568 - RNA, 13 nt, Pseudomonas aeruginosa PA01
cggcugagcgcca

SEQ ID NO: 1444569 - RNA, 16 nt, Pseudomonas aeruginosa PA01
cggcugagcgccaggc

SEQ ID NO: 1444570 - RNA, 15 nt, Pseudomonas aeruginosa PA01
cggcugacgcuggcg

SEQ ID NO: 1444571 - RNA, 17 nt, Pseudomonas aeruginosa PA01
cggcugacgcuggcgaa

SEQ ID NO: 1444572 - RNA, 20 nt, Pseudomonas aeruginosa PA01
cggcugacgcuggcgaaggc

SEQ ID NO: 1444573 - RNA, 15 nt, Pseudomonas aeruginosa PA01
cggcugaggcuggcg

SEQ ID NO: 1444574 - RNA, 16 nt, Pseudomonas aeruginosa PA01
cggcugaggcuggcga

SEQ ID NO: 1444575 - RNA, 18 nt, Pseudomonas aeruginosa PA01
cggcugaucggccgccag

SEQ ID NO: 1444576 - RNA, 22 nt, Pseudomonas aeruginosa PA01
cgggaaugcucagcacggcgac

SEQ ID NO: 1444577 - RNA, 15 nt, Pseudomonas aeruginosa PA01
cgggaaucuggccga

SEQ ID NO: 1444578 - RNA, 17 nt, Pseudomonas aeruginosa PA01
cgggaaucuggccgaug

SEQ ID NO: 1444579 - RNA, 20 nt, Pseudomonas aeruginosa PA01
cgggaaucuggccgaugccg

SEQ ID NO: 1444580 - RNA, 15 nt, Pseudomonas aeruginosa PA01
cgggaaucgccagca

SEQ ID NO: 1444581 - RNA, 12 nt, Pseudomonas aeruginosa PA01
cgggaauggcgg

SEQ ID NO: 1444582 - RNA, 16 nt, Pseudomonas aeruginosa PA01
cgggaaguccgggcgc

SEQ ID NO: 1444583 - RNA, 14 nt, Pseudomonas aeruginosa PA01
cgggacgccaggcg

SEQ ID NO: 1444584 - RNA, 16 nt, Pseudomonas aeruginosa PA01
cgggacgccaggcguc

SEQ ID NO: 1444585 - RNA, 17 nt, Pseudomonas aeruginosa PA01
cgggacgccaggcgucc

SEQ ID NO: 1444586 - RNA, 16 nt, Pseudomonas aeruginosa PA01
cgggacgccuggcguc

SEQ ID NO: 1444587 - RNA, 16 nt, Pseudomonas aeruginosa PA01
cgggacgcaugcgcgg

SEQ ID NO: 1444588 - RNA, 19 nt, Pseudomonas aeruginosa PA01
cgggacgcaugcgcggcgu

SEQ ID NO: 1444589 - RNA, 13 nt, Pseudomonas aeruginosa PA01
cgggacgaugccg

SEQ ID NO: 1444590 - RNA, 15 nt, Pseudomonas aeruginosa PA01
cgggacuggggcaug

SEQ ID NO: 1444591 - RNA, 18 nt, Pseudomonas aeruginosa PA01
cgggacuggggcaugggc

SEQ ID NO: 1444592 - RNA, 15 nt, Pseudomonas aeruginosa PA01
cgggacuuguacucg

SEQ ID NO: 1444593 - RNA, 20 nt, Pseudomonas aeruginosa PA01
cgggacuuuccgaagccccg

SEQ ID NO: 1444594 - RNA, 16 nt, Pseudomonas aeruginosa PA01
aacauggcgucggcga

SEQ ID NO: 1444595 - RNA, 17 nt, Pseudomonas aeruginosa PA01
aacaugguguugggcag

SEQ ID NO: 1444596 - RNA, 13 nt, Pseudomonas aeruginosa PA01
cgggauaccggcc

SEQ ID NO: 1444597 - RNA, 21 nt, Pseudomonas aeruginosa PA01
cgggauaccggccaucagcac

SEQ ID NO: 1444598 - RNA, 18 nt, Pseudomonas aeruginosa PA01
cgggaucaggucgccagc

SEQ ID NO: 1444599 - RNA, 21 nt, Pseudomonas aeruginosa PA01
cgggaucaggucgccagcgcc

SEQ ID NO: 1444600 - RNA, 16 nt, Pseudomonas aeruginosa PA01
cgggaucagcggcggg

SEQ ID NO: 1444601 - RNA, 15 nt, Pseudomonas aeruginosa PA01
cgggauggucgaggg

SEQ ID NO: 1444602 - RNA, 19 nt, Pseudomonas aeruginosa PA01
cgggauggucgagggcgcg

SEQ ID NO: 1444603 - RNA, 14 nt, Pseudomonas aeruginosa PA01
cgggaugugcacca

SEQ ID NO: 1444604 - RNA, 17 nt, Pseudomonas aeruginosa PA01
cgggaugugcaccagca

SEQ ID NO: 1444605 - RNA, 17 nt, Pseudomonas aeruginosa PA01
cgggaugcucaccgcgc

SEQ ID NO: 1444606 - RNA, 19 nt, Pseudomonas aeruginosa PA01
cgggaugcucaccgcgcuu

SEQ ID NO: 1444607 - RNA, 19 nt, Pseudomonas aeruginosa PA01
cgggaugccgugccgugga

SEQ ID NO: 1444608 - RNA, 17 nt, Pseudomonas aeruginosa PA01
cgggcagaguggcgcgg

SEQ ID NO: 1444609 - RNA, 21 nt, Pseudomonas aeruginosa PA01
cgggcagaguggcgcggcuga

SEQ ID NO: 1444610 - RNA, 17 nt, Pseudomonas aeruginosa PA01
cgggcagauguccaggc

SEQ ID NO: 1444611 - RNA, 19 nt, Pseudomonas aeruginosa PA01
cgggcagauguccaggcag

SEQ ID NO: 1444612 - RNA, 20 nt, Pseudomonas aeruginosa PA01
cgggcagauguccaggcagg

SEQ ID NO: 1444613 - RNA, 21 nt, Pseudomonas aeruginosa PA01
cgggcagauguccaggcaggc

SEQ ID NO: 1444614 - RNA, 18 nt, Pseudomonas aeruginosa PA01
cgggcagacuucgccgug

SEQ ID NO: 1444615 - RNA, 14 nt, Pseudomonas aeruginosa PA01
cgggcagcagccgg

SEQ ID NO: 1444616 - RNA, 20 nt, Pseudomonas aeruginosa PA01
cgggcagccccuugagcgcg

SEQ ID NO: 1444617 - RNA, 16 nt, Pseudomonas aeruginosa PA01
cgggcagccguuggcg

SEQ ID NO: 1444618 - RNA, 14 nt, Pseudomonas aeruginosa PA01
cgggcagccuggcu

SEQ ID NO: 1444619 - RNA, 23 nt, Pseudomonas aeruginosa PA01
cgggcacuucucgaacagcuccu

SEQ ID NO: 1444620 - RNA, 17 nt, Pseudomonas aeruginosa PA01
cgggcacuugucgacgu

SEQ ID NO: 1444621 - RNA, 18 nt, Pseudomonas aeruginosa PA01
cgggcagacaccaccagg

SEQ ID NO: 1444622 - RNA, 19 nt, Pseudomonas aeruginosa PA01
cgggcagacaccaccaggu

SEQ ID NO: 1444623 - RNA, 18 nt, Pseudomonas aeruginosa PA01
cgggcaacugccgauggu

SEQ ID NO: 1444624 - RNA, 16 nt, Pseudomonas aeruginosa PA01
cgggcaacugaucagc

SEQ ID NO: 1444625 - RNA, 14 nt, Pseudomonas aeruginosa PA01
cgggccagcuggcg

SEQ ID NO: 1444626 - RNA, 15 nt, Pseudomonas aeruginosa PA01
cgggccagcuccagc

SEQ ID NO: 1444627 - RNA, 16 nt, Pseudomonas aeruginosa PA01
cgggccagcuccgccu

SEQ ID NO: 1444628 - RNA, 17 nt, Pseudomonas aeruginosa PA01
cgggccagcuccgccug

SEQ ID NO: 1444629 - RNA, 19 nt, Pseudomonas aeruginosa PA01
cgggccagcuccgccugac

SEQ ID NO: 1444630 - RNA, 13 nt, Pseudomonas aeruginosa PA01
cgggccaggcccu

SEQ ID NO: 1444631 - RNA, 14 nt, Pseudomonas aeruginosa PA01
cgggccaggcccuu

SEQ ID NO: 1444632 - RNA, 14 nt, Pseudomonas aeruginosa PA01
cgggccaucagguc

SEQ ID NO: 1444633 - RNA, 17 nt, Pseudomonas aeruginosa PA01
cgggcccaggcuggcgg

SEQ ID NO: 1444634 - RNA, 18 nt, Pseudomonas aeruginosa PA01
cgggcccaggcuggcggc

SEQ ID NO: 1444635 - RNA, 19 nt, Pseudomonas aeruginosa PA01
cgggcccaggcuggcggcc

SEQ ID NO: 1444636 - RNA, 15 nt, Pseudomonas aeruginosa PA01
cgggccaugcgcucg

SEQ ID NO: 1444637 - RNA, 15 nt, Pseudomonas aeruginosa PA01
cgggccauugcaggu

SEQ ID NO: 1444638 - RNA, 13 nt, Pseudomonas aeruginosa PA01
cgggcccaagccg

SEQ ID NO: 1444639 - RNA, 23 nt, Pseudomonas aeruginosa PA01
cgggcccaagccgagcggcaagg

SEQ ID NO: 1444640 - RNA, 21 nt, Pseudomonas aeruginosa PA01
cgggccagcaggguggccagg

SEQ ID NO: 1444641 - RNA, 21 nt, Pseudomonas aeruginosa PA01
cgggccaugagcagggcggau

SEQ ID NO: 1444642 - RNA, 23 nt, Pseudomonas aeruginosa PA01
cgggcagcucguugcacagcgcc

SEQ ID NO: 1444643 - RNA, 16 nt, Pseudomonas aeruginosa PA01
cgggcaguccuggcgg

SEQ ID NO: 1444644 - RNA, 16 nt, Pseudomonas aeruginosa PA01
cgggcaguuccaggcc

SEQ ID NO: 1444645 - RNA, 23 nt, Pseudomonas aeruginosa PA01
cgggcaucaugccgagcaucagc

SEQ ID NO: 1444646 - RNA, 12 nt, Pseudomonas aeruginosa PA01
cgggcauccagc

SEQ ID NO: 1444647 - RNA, 14 nt, Pseudomonas aeruginosa PA01
cgggcauccagcgg

SEQ ID NO: 1444648 - RNA, 18 nt, Pseudomonas aeruginosa PA01
cgggcauauggaucggcc

SEQ ID NO: 1444649 - RNA, 20 nt, Pseudomonas aeruginosa PA01
cgggcaucgucgaagggcca

SEQ ID NO: 1444650 - RNA, 15 nt, Pseudomonas aeruginosa PA01
cgacggcgugcaggu

SEQ ID NO: 1444651 - RNA, 16 nt, Pseudomonas aeruginosa PA01
cgacggcgugccgugg

SEQ ID NO: 1444652 - RNA, 13 nt, Pseudomonas aeruginosa PA01
cgacggcggugcg

SEQ ID NO: 1444653 - RNA, 13 nt, Pseudomonas aeruginosa PA01
cgacggcggcggc

SEQ ID NO: 1444654 - RNA, 15 nt, Pseudomonas aeruginosa PA01
cgacggcggcggcgg

SEQ ID NO: 1444655 - RNA, 19 nt, Pseudomonas aeruginosa PA01
cgacggcggccgccaucgc

SEQ ID NO: 1444656 - RNA, 15 nt, Pseudomonas aeruginosa PA01
cgacggcggccgcca

SEQ ID NO: 1444657 - RNA, 14 nt, Pseudomonas aeruginosa PA01
cgacggcgcgcugc

SEQ ID NO: 1444658 - RNA, 14 nt, Pseudomonas aeruginosa PA01
cgacggcuuccagg

SEQ ID NO: 1444659 - RNA, 19 nt, Pseudomonas aeruginosa PA01
cgacggcuugaucacgccg

SEQ ID NO: 1444660 - RNA, 20 nt, Pseudomonas aeruginosa PA01
cgacggcucuggaugcggcg

SEQ ID NO: 1444661 - RNA, 19 nt, Pseudomonas aeruginosa PA01
cgacgggagcgcgaggcgc

SEQ ID NO: 1444662 - RNA, 22 nt, Pseudomonas aeruginosa PA01
cgacgggagcgcgaggcgcagg

SEQ ID NO: 1444663 - RNA, 16 nt, Pseudomonas aeruginosa PA01
cgacgggcgcuuccgg

SEQ ID NO: 1444664 - RNA, 12 nt, Pseudomonas aeruginosa PA01
cgacgggucgcc

SEQ ID NO: 1444665 - RNA, 19 nt, Pseudomonas aeruginosa PA01
cgacgggucgccauggucg

SEQ ID NO: 1444666 - RNA, 19 nt, Pseudomonas aeruginosa PA01
cgacgguaccagggaagcg

SEQ ID NO: 1444667 - RNA, 16 nt, Pseudomonas aeruginosa PA01
cgacggguuugugccg

SEQ ID NO: 1444668 - RNA, 16 nt, Pseudomonas aeruginosa PA01
cgacggucagcaggcc

SEQ ID NO: 1444669 - RNA, 21 nt, Pseudomonas aeruginosa PA01
cgacggucaggccgagcagcg

SEQ ID NO: 1444670 - RNA, 22 nt, Pseudomonas aeruginosa PA01
cgacggucaggccgagcagcgc

SEQ ID NO: 1444671 - RNA, 23 nt, Pseudomonas aeruginosa PA01
cgacggugaaguagaucgcccgc

SEQ ID NO: 1444672 - RNA, 17 nt, Pseudomonas aeruginosa PA01
cgacggucggcaggugg

SEQ ID NO: 1444673 - RNA, 17 nt, Pseudomonas aeruginosa PA01
cgacgguugauagcgcg

SEQ ID NO: 1444674 - RNA, 20 nt, Pseudomonas aeruginosa PA01
cgacggugauagagcacgcc

SEQ ID NO: 1444675 - RNA, 19 nt, Pseudomonas aeruginosa PA01
cgacggaaauaggcgucgu

SEQ ID NO: 1444676 - RNA, 17 nt, Pseudomonas aeruginosa PA01
cgacggaacaagccgcc

SEQ ID NO: 1444677 - RNA, 13 nt, Pseudomonas aeruginosa PA01
cgacggaacagga

SEQ ID NO: 1444678 - RNA, 20 nt, Pseudomonas aeruginosa PA01
cgacggaaggugcgguugaa

SEQ ID NO: 1444679 - RNA, 20 nt, Pseudomonas aeruginosa PA01
cgacgcugucguggacgccg

SEQ ID NO: 1444680 - RNA, 18 nt, Pseudomonas aeruginosa PA01
cgacgcugcccagcccgc

SEQ ID NO: 1444681 - RNA, 14 nt, Pseudomonas aeruginosa PA01
cgacgcugaugccg

SEQ ID NO: 1444682 - RNA, 17 nt, Pseudomonas aeruginosa PA01
cgacgccauggcgcuuc

SEQ ID NO: 1444683 - RNA, 18 nt, Pseudomonas aeruginosa PA01
cgacgccauggcgcuuca

SEQ ID NO: 1444684 - RNA, 21 nt, Pseudomonas aeruginosa PA01
cgacgcugaugaugccgcggc

SEQ ID NO: 1444685 - RNA, 17 nt, Pseudomonas aeruginosa PA01
cgacgcuguugccggca

SEQ ID NO: 1444686 - RNA, 19 nt, Pseudomonas aeruginosa PA01
cgacgcuguugccggcaaa

SEQ ID NO: 1444687 - RNA, 16 nt, Pseudomonas aeruginosa PA01
cgacgcuggccugccg

SEQ ID NO: 1444688 - RNA, 17 nt, Pseudomonas aeruginosa PA01
cgacgcuggccugccga

SEQ ID NO: 1444689 - RNA, 23 nt, Pseudomonas aeruginosa PA01
cgacgaugugagaguccuugucc

SEQ ID NO: 1444690 - RNA, 19 nt, Pseudomonas aeruginosa PA01
cgacgauguucgaggcgcc

SEQ ID NO: 1444691 - RNA, 24 nt, Pseudomonas aeruginosa PA01
cgacgauguucgaggcgccgacca

SEQ ID NO: 1444692 - RNA, 22 nt, Pseudomonas aeruginosa PA01
cgacgauguucuccacgucguc

SEQ ID NO: 1444693 - RNA, 21 nt, Pseudomonas aeruginosa PA01
cgacgauguuguugcccacca

SEQ ID NO: 1444694 - RNA, 23 nt, Pseudomonas aeruginosa PA01
cgacgauguuguugcccaccagc

SEQ ID NO: 1444695 - RNA, 22 nt, Pseudomonas aeruginosa PA01
cgacgccacccgcaucgaggcc

SEQ ID NO: 1444696 - RNA, 15 nt, Pseudomonas aeruginosa PA01
cgacgccagcucggc

SEQ ID NO: 1444697 - RNA, 14 nt, Pseudomonas aeruginosa PA01
cgacgccagcggcg

SEQ ID NO: 1444698 - RNA, 13 nt, Pseudomonas aeruginosa PA01
cgacgccagcggc

SEQ ID NO: 1444699 - RNA, 18 nt, Pseudomonas aeruginosa PA01
cgacggcccacggcgaga

SEQ ID NO: 1444700 - RNA, 15 nt, Pseudomonas aeruginosa PA01
cgacggcgaucucag

SEQ ID NO: 1444701 - RNA, 20 nt, Pseudomonas aeruginosa PA01
cgacggccuuggucucgcgg

SEQ ID NO: 1444702 - RNA, 22 nt, Pseudomonas aeruginosa PA01
cgacggccuuggucucgcgggc

SEQ ID NO: 1444703 - RNA, 23 nt, Pseudomonas aeruginosa PA01
cgacggcaacugagcgcaacucg

SEQ ID NO: 1444704 - RNA, 15 nt, Pseudomonas aeruginosa PA01
cgacggcaccagcgc

SEQ ID NO: 1444705 - RNA, 18 nt, Pseudomonas aeruginosa PA01
cgacggcaccagcgcguc

SEQ ID NO: 1444706 - RNA, 14 nt, Pseudomonas aeruginosa PA01
cgacggcccuccgg

SEQ ID NO: 1444707 - RNA, 15 nt, Pseudomonas aeruginosa PA01
cgacggcccuccggc

SEQ ID NO: 1444708 - RNA, 15 nt, Pseudomonas aeruginosa PA01
cgacggcagguggcg

SEQ ID NO: 1444709 - RNA, 22 nt, Pseudomonas aeruginosa PA01
cgacguugagaaggcgccugag

SEQ ID NO: 1444710 - RNA, 16 nt, Pseudomonas aeruginosa PA01
cgacguccuccaggac

SEQ ID NO: 1444711 - RNA, 15 nt, Pseudomonas aeruginosa PA01
cgacguaggcggcga

SEQ ID NO: 1444712 - RNA, 17 nt, Pseudomonas aeruginosa PA01
cgacguaggcggcgagg

SEQ ID NO: 1444713 - RNA, 20 nt, Pseudomonas aeruginosa PA01
cgacguagggcaucgccgac

SEQ ID NO: 1444714 - RNA, 22 nt, Pseudomonas aeruginosa PA01
cgacgucacggauaggcggcgg

SEQ ID NO: 1444715 - RNA, 16 nt, Pseudomonas aeruginosa PA01
cgacgucccuuccccg

SEQ ID NO: 1444716 - RNA, 20 nt, Pseudomonas aeruginosa PA01
cgacguccacugcguccugg

SEQ ID NO: 1444717 - RNA, 14 nt, Pseudomonas aeruginosa PA01
cgacguccaucagc

SEQ ID NO: 1444718 - RNA, 20 nt, Pseudomonas aeruginosa PA01
cgacguccaucagcgucugc

SEQ ID NO: 1444719 - RNA, 21 nt, Pseudomonas aeruginosa PA01
cgacgucauaggccuuggcga

SEQ ID NO: 1444720 - RNA, 23 nt, Pseudomonas aeruginosa PA01
cgacgucauaggccuuggcgauc

SEQ ID NO: 1444721 - RNA, 13 nt, Pseudomonas aeruginosa PA01
cgacucgcugggc

SEQ ID NO: 1444722 - RNA, 21 nt, Pseudomonas aeruginosa PA01
cgacucgcugggcgccggcag

SEQ ID NO: 1444723 - RNA, 19 nt, Pseudomonas aeruginosa PA01
cgacucgcgaucgaucggc

SEQ ID NO: 1444724 - RNA, 19 nt, Pseudomonas aeruginosa PA01
cgacucgaugaacgcccug

SEQ ID NO: 1444725 - RNA, 15 nt, Pseudomonas aeruginosa PA01
cgacucgagcaccac

SEQ ID NO: 1444726 - RNA, 13 nt, Pseudomonas aeruginosa PA01
cgacuaccugggg

SEQ ID NO: 1444727 - RNA, 19 nt, Pseudomonas aeruginosa PA01
cgacucgaagcucuucgcc

SEQ ID NO: 1444728 - RNA, 14 nt, Pseudomonas aeruginosa PA01
cgacguugcgcagg

SEQ ID NO: 1444729 - RNA, 22 nt, Pseudomonas aeruginosa PA01
cgacguugcgcaggggcgcggc

SEQ ID NO: 1444730 - RNA, 19 nt, Pseudomonas aeruginosa PA01
cgacugacgaaggcuggag

SEQ ID NO: 1444731 - RNA, 19 nt, Pseudomonas aeruginosa PA01
cgacugagcuaauccggcg

SEQ ID NO: 1444732 - RNA, 23 nt, Pseudomonas aeruginosa PA01
cgacugaccacgcagagcggcag

SEQ ID NO: 1444733 - RNA, 14 nt, Pseudomonas aeruginosa PA01
cgacugcacgcaga

SEQ ID NO: 1444734 - RNA, 22 nt, Pseudomonas aeruginosa PA01
cgacugcacgcagacgucgagg

SEQ ID NO: 1444735 - RNA, 18 nt, Pseudomonas aeruginosa PA01
cgacucggcugcaacgcc

SEQ ID NO: 1444736 - RNA, 21 nt, Pseudomonas aeruginosa PA01
cgacucggcugcaacgccgcg

SEQ ID NO: 1444737 - RNA, 19 nt, Pseudomonas aeruginosa PA01
cgacucgguaaagcccagg

SEQ ID NO: 1444738 - RNA, 13 nt, Pseudomonas aeruginosa PA01
cgacucgucgccc

SEQ ID NO: 1444739 - RNA, 17 nt, Pseudomonas aeruginosa PA01
cgacucguugcacgcag

SEQ ID NO: 1444740 - RNA, 19 nt, Pseudomonas aeruginosa PA01
cgacucuccgcgccgcggc

SEQ ID NO: 1444741 - RNA, 14 nt, Pseudomonas aeruginosa PA01
cgagcaccaggcgg

SEQ ID NO: 1444742 - RNA, 14 nt, Pseudomonas aeruginosa PA01
cgagcaccccgagc

SEQ ID NO: 1444743 - RNA, 18 nt, Pseudomonas aeruginosa PA01
cgagcaccagcaggucgg

SEQ ID NO: 1444744 - RNA, 23 nt, Pseudomonas aeruginosa PA01
cgagcaauugccagaggcugcgc

SEQ ID NO: 1444745 - RNA, 22 nt, Pseudomonas aeruginosa PA01
cgagcaauccggcgcugccgaa

SEQ ID NO: 1444746 - RNA, 23 nt, Pseudomonas aeruginosa PA01
cgagcaaugaaaaaggcgaucga

SEQ ID NO: 1444747 - RNA, 16 nt, Pseudomonas aeruginosa PA01
cgagaucaccuugucg

SEQ ID NO: 1444748 - RNA, 14 nt, Pseudomonas aeruginosa PA01
cgagagcgccgacc

SEQ ID NO: 1444749 - RNA, 20 nt, Pseudomonas aeruginosa PA01
cgacuggggcaucucggcca

SEQ ID NO: 1444750 - RNA, 15 nt, Pseudomonas aeruginosa PA01
cgacugucgagcagg

SEQ ID NO: 1444751 - RNA, 16 nt, Pseudomonas aeruginosa PA01
cgacugucgagcaggg

SEQ ID NO: 1444752 - RNA, 18 nt, Pseudomonas aeruginosa PA01
cgacugucgagcaggguc

SEQ ID NO: 1444753 - RNA, 23 nt, Pseudomonas aeruginosa PA01
cgacugcgcuggccgagcugccg

SEQ ID NO: 1444754 - RNA, 20 nt, Pseudomonas aeruginosa PA01
cgacugcgguuuuccugccc

SEQ ID NO: 1444755 - RNA, 15 nt, Pseudomonas aeruginosa PA01
cgacugcgagccgac

SEQ ID NO: 1444756 - RNA, 16 nt, Pseudomonas aeruginosa PA01
cgacuggaugaacagc

SEQ ID NO: 1444757 - RNA, 16 nt, Pseudomonas aeruginosa PA01
cgacuggaugcagccg

SEQ ID NO: 1444758 - RNA, 13 nt, Pseudomonas aeruginosa PA01
cgacuggcagcga

SEQ ID NO: 1444759 - RNA, 19 nt, Pseudomonas aeruginosa PA01
cgacugcaacuggccgaga

SEQ ID NO: 1444760 - RNA, 19 nt, Pseudomonas aeruginosa PA01
cgacugcaugaugccgugc

SEQ ID NO: 1444761 - RNA, 15 nt, Pseudomonas aeruginosa PA01
cgacugccgucggcg

SEQ ID NO: 1444762 - RNA, 17 nt, Pseudomonas aeruginosa PA01
cgacugccgucggcgcc

SEQ ID NO: 1444763 - RNA, 22 nt, Pseudomonas aeruginosa PA01
cgagacguugacgaucgccccg

SEQ ID NO: 1444764 - RNA, 16 nt, Pseudomonas aeruginosa PA01
cgagacuaccgaucgg

SEQ ID NO: 1444765 - RNA, 21 nt, Pseudomonas aeruginosa PA01
cgagaagguucucggccacca

SEQ ID NO: 1444766 - RNA, 16 nt, Pseudomonas aeruginosa PA01
cgagagaauccgccgu

SEQ ID NO: 1444767 - RNA, 17 nt, Pseudomonas aeruginosa PA01
cgagagaauccgccguu

SEQ ID NO: 1444768 - RNA, 16 nt, Pseudomonas aeruginosa PA01
cgagaacuugccggcg

SEQ ID NO: 1444769 - RNA, 19 nt, Pseudomonas aeruginosa PA01
cgagaacuugccggcgcca

SEQ ID NO: 1444770 - RNA, 16 nt, Pseudomonas aeruginosa PA01
cgagaaggcugccggg

SEQ ID NO: 1444771 - RNA, 17 nt, Pseudomonas aeruginosa PA01
cgagaagccggggcagg

SEQ ID NO: 1444772 - RNA, 13 nt, Pseudomonas aeruginosa PA01
cgacgacugcggc

SEQ ID NO: 1444773 - RNA, 21 nt, Pseudomonas aeruginosa PA01
cgacgagacguugacgaucgc

SEQ ID NO: 1444774 - RNA, 19 nt, Pseudomonas aeruginosa PA01
cgacgacaccugcaacgcc

SEQ ID NO: 1444775 - RNA, 13 nt, Pseudomonas aeruginosa PA01
cgacgacgggagc

SEQ ID NO: 1444776 - RNA, 13 nt, Pseudomonas aeruginosa PA01
cgacgaucagccc

SEQ ID NO: 1444777 - RNA, 17 nt, Pseudomonas aeruginosa PA01
cgacgaucagcccgccg

SEQ ID NO: 1444778 - RNA, 20 nt, Pseudomonas aeruginosa PA01
cgacgaucagcccgccggcg

SEQ ID NO: 1444779 - RNA, 24 nt, Pseudomonas aeruginosa PA01
cgacgaucagcccgccggcgaugc

SEQ ID NO: 1444780 - RNA, 17 nt, Pseudomonas aeruginosa PA01
cgacgauauccacgccg

SEQ ID NO: 1444781 - RNA, 16 nt, Pseudomonas aeruginosa PA01
cgacgauccggccgau

SEQ ID NO: 1444782 - RNA, 19 nt, Pseudomonas aeruginosa PA01
cgacgaugcgccccagcgc

SEQ ID NO: 1444783 - RNA, 20 nt, Pseudomonas aeruginosa PA01
cgacgaugcgccccagcgcc

SEQ ID NO: 1444784 - RNA, 16 nt, Pseudomonas aeruginosa PA01
cgacgaaggucggcgg

SEQ ID NO: 1444785 - RNA, 17 nt, Pseudomonas aeruginosa PA01
cgacgaaggucggcggc

SEQ ID NO: 1444786 - RNA, 18 nt, Pseudomonas aeruginosa PA01
cgacgaaggucggcggca

SEQ ID NO: 1444787 - RNA, 16 nt, Pseudomonas aeruginosa PA01
cgacgaagugaccgcg

SEQ ID NO: 1444788 - RNA, 17 nt, Pseudomonas aeruginosa PA01
cgacgaagugaccgcgc

SEQ ID NO: 1444789 - RNA, 19 nt, Pseudomonas aeruginosa PA01
cgacgaagugaccgcgcgc

SEQ ID NO: 1444790 - RNA, 21 nt, Pseudomonas aeruginosa PA01
cgacgaagugaccgcgcgcca

SEQ ID NO: 1444791 - RNA, 22 nt, Pseudomonas aeruginosa PA01
cgacgaaguugcaggccagcgc

SEQ ID NO: 1444792 - RNA, 23 nt, Pseudomonas aeruginosa PA01
cgacgaaguugcaggccagcgcc

SEQ ID NO: 1444793 - RNA, 17 nt, Pseudomonas aeruginosa PA01
cgacgaaauagucgcgg

SEQ ID NO: 1444794 - RNA, 17 nt, Pseudomonas aeruginosa PA01
cgaccuuguccacgucg

SEQ ID NO: 1444795 - RNA, 16 nt, Pseudomonas aeruginosa PA01
cgaccuuguccaggcg

SEQ ID NO: 1444796 - RNA, 18 nt, Pseudomonas aeruginosa PA01
cgaccuuguccaggcgcu

SEQ ID NO: 1444797 - RNA, 19 nt, Pseudomonas aeruginosa PA01
cgaccuuguccaggcgcug

SEQ ID NO: 1444798 - RNA, 21 nt, Pseudomonas aeruginosa PA01
cgaccuuguccugcggccggg

SEQ ID NO: 1444799 - RNA, 20 nt, Pseudomonas aeruginosa PA01
cgaccuugucgauggucuug

SEQ ID NO: 1444800 - RNA, 16 nt, Pseudomonas aeruginosa PA01
cgaccuuugaggguca

SEQ ID NO: 1444801 - RNA, 23 nt, Pseudomonas aeruginosa PA01
cgaccuuugagggucagaccagc

SEQ ID NO: 1444802 - RNA, 14 nt, Pseudomonas aeruginosa PA01
cgaccuugcccacc

SEQ ID NO: 1444803 - RNA, 17 nt, Pseudomonas aeruginosa PA01
cgaccuugcccaccggg

SEQ ID NO: 1444804 - RNA, 18 nt, Pseudomonas aeruginosa PA01
cgaccuugcgucuucgcc

SEQ ID NO: 1444805 - RNA, 23 nt, Pseudomonas aeruginosa PA01
cgacgaaaagcgguuucgccacc

SEQ ID NO: 1444806 - RNA, 21 nt, Pseudomonas aeruginosa PA01
cgacgaaacggcucugcuucu

SEQ ID NO: 1444807 - RNA, 17 nt, Pseudomonas aeruginosa PA01
cgacgaaagacgcugcg

SEQ ID NO: 1444808 - RNA, 18 nt, Pseudomonas aeruginosa PA01
cgacgaaaggccgcgccg

SEQ ID NO: 1444809 - RNA, 21 nt, Pseudomonas aeruginosa PA01
cgacgaaaggccgcgccggau

SEQ ID NO: 1444810 - RNA, 21 nt, Pseudomonas aeruginosa PA01
cgacgaaauaaugcggcgcga

SEQ ID NO: 1444811 - RNA, 22 nt, Pseudomonas aeruginosa PA01
cgacgaaauaaugcggcgcgau

SEQ ID NO: 1444812 - RNA, 17 nt, Pseudomonas aeruginosa PA01
cgaccuggccacgcccg

SEQ ID NO: 1444813 - RNA, 18 nt, Pseudomonas aeruginosa PA01
cgaccuggccacgcccgg

SEQ ID NO: 1444814 - RNA, 14 nt, Pseudomonas aeruginosa PA01
cgaccuggcgccga

SEQ ID NO: 1444815 - RNA, 16 nt, Pseudomonas aeruginosa PA01
cgaccuggcgccgaaa

SEQ ID NO: 1444816 - RNA, 23 nt, Pseudomonas aeruginosa PA01
cgaccugcucgucgaugcugccg

SEQ ID NO: 1444817 - RNA, 17 nt, Pseudomonas aeruginosa PA01
cgaccuggggcggccuc

SEQ ID NO: 1444818 - RNA, 22 nt, Pseudomonas aeruginosa PA01
cgaccuggggcggccucaggcc

SEQ ID NO: 1444819 - RNA, 20 nt, Pseudomonas aeruginosa PA01
cgaccugguagccgaagucg

SEQ ID NO: 1444820 - RNA, 19 nt, Pseudomonas aeruginosa PA01
cgaccuguaccgcucccca

SEQ ID NO: 1444821 - RNA, 15 nt, Pseudomonas aeruginosa PA01
cgaccuucaccacca

SEQ ID NO: 1444822 - RNA, 17 nt, Pseudomonas aeruginosa PA01
cgaccuugacgaagccg

SEQ ID NO: 1444823 - RNA, 20 nt, Pseudomonas aeruginosa PA01
cgaccuugacgaagccggcg

SEQ ID NO: 1444824 - RNA, 15 nt, Pseudomonas aeruginosa PA01
cgaccuugcccucgg

SEQ ID NO: 1444825 - RNA, 17 nt, Pseudomonas aeruginosa PA01
cgaccuugcccucggcg

SEQ ID NO: 1444826 - RNA, 17 nt, Pseudomonas aeruginosa PA01
cgaccuugccgacgccg

SEQ ID NO: 1444827 - RNA, 19 nt, Pseudomonas aeruginosa PA01
cgaccuugccgacgccgcg

SEQ ID NO: 1444828 - RNA, 23 nt, Pseudomonas aeruginosa PA01
cgaccuugccgacgccgcggccg

SEQ ID NO: 1444829 - RNA, 20 nt, Pseudomonas aeruginosa PA01
cgaccuugcgcaccagggcc

SEQ ID NO: 1444830 - RNA, 18 nt, Pseudomonas aeruginosa PA01
cgacccgggucuggggaa

SEQ ID NO: 1444831 - RNA, 18 nt, Pseudomonas aeruginosa PA01
cgacccgguacagccaac

SEQ ID NO: 1444832 - RNA, 16 nt, Pseudomonas aeruginosa PA01
cgacccgggucaggcc

SEQ ID NO: 1444833 - RNA, 18 nt, Pseudomonas aeruginosa PA01
cgacccgggucaggccga

SEQ ID NO: 1444834 - RNA, 14 nt, Pseudomonas aeruginosa PA01
cgacccgcccgccg

SEQ ID NO: 1444835 - RNA, 16 nt, Pseudomonas aeruginosa PA01
cgacccgcccgccguc

SEQ ID NO: 1444836 - RNA, 22 nt, Pseudomonas aeruginosa PA01
cgacccgccgaccagcacggcg

SEQ ID NO: 1444837 - RNA, 13 nt, Pseudomonas aeruginosa PA01
cgaccgccugcca

SEQ ID NO: 1444838 - RNA, 15 nt, Pseudomonas aeruginosa PA01
cgaccgccugcucgc

SEQ ID NO: 1444839 - RNA, 21 nt, Pseudomonas aeruginosa PA01
cgaccgccugcucgcggcugg

SEQ ID NO: 1444840 - RNA, 16 nt, Pseudomonas aeruginosa PA01
cgacccgugcgccgcg

SEQ ID NO: 1444841 - RNA, 12 nt, Pseudomonas aeruginosa PA01
cgaccgcgccgg

SEQ ID NO: 1444842 - RNA, 14 nt, Pseudomonas aeruginosa PA01
cgaccgcgccggcg

SEQ ID NO: 1444843 - RNA, 15 nt, Pseudomonas aeruginosa PA01
cgaccgcgccggcga

SEQ ID NO: 1444844 - RNA, 20 nt, Pseudomonas aeruginosa PA01
cgaccgcgaguucgccggcc

SEQ ID NO: 1444845 - RNA, 23 nt, Pseudomonas aeruginosa PA01
cgaccggaaucacgucgaucugc

SEQ ID NO: 1444846 - RNA, 14 nt, Pseudomonas aeruginosa PA01
cgaccgcuggacca

SEQ ID NO: 1444847 - RNA, 18 nt, Pseudomonas aeruginosa PA01
cgaccggaugcuccaggu

SEQ ID NO: 1444848 - RNA, 16 nt, Pseudomonas aeruginosa PA01
cgaccucggcggucag

SEQ ID NO: 1444849 - RNA, 12 nt, Pseudomonas aeruginosa PA01
cgaccucggccg

SEQ ID NO: 1444850 - RNA, 13 nt, Pseudomonas aeruginosa PA01
cgaccucggccgc

SEQ ID NO: 1444851 - RNA, 13 nt, Pseudomonas aeruginosa PA01
cgaccucgcgggc

SEQ ID NO: 1444852 - RNA, 20 nt, Pseudomonas aeruginosa PA01
cgaccucgauggcgauaugg

SEQ ID NO: 1444853 - RNA, 15 nt, Pseudomonas aeruginosa PA01
cgaccugcggggcgg

SEQ ID NO: 1444854 - RNA, 14 nt, Pseudomonas aeruginosa PA01
cgaccugcucgcgc

SEQ ID NO: 1444855 - RNA, 17 nt, Pseudomonas aeruginosa PA01
cgaccugcucgcgcacc

SEQ ID NO: 1444856 - RNA, 21 nt, Pseudomonas aeruginosa PA01
cgaccugcucgcgcaccgcgg

SEQ ID NO: 1444857 - RNA, 17 nt, Pseudomonas aeruginosa PA01
cgaccugcucgaaccgg

SEQ ID NO: 1444858 - RNA, 22 nt, Pseudomonas aeruginosa PA01
cgaccugcggguuggucggcac

SEQ ID NO: 1444859 - RNA, 20 nt, Pseudomonas aeruginosa PA01
cgaccgguuccagcggccgc

SEQ ID NO: 1444860 - RNA, 22 nt, Pseudomonas aeruginosa PA01
cgaccgguuccgcgucgccuuc

SEQ ID NO: 1444861 - RNA, 15 nt, Pseudomonas aeruginosa PA01
cgaccuccggcgcca

SEQ ID NO: 1444862 - RNA, 19 nt, Pseudomonas aeruginosa PA01
cgaccuccgccgcuuccgc

SEQ ID NO: 1444863 - RNA, 13 nt, Pseudomonas aeruginosa PA01
cgaccgucggccg

SEQ ID NO: 1444864 - RNA, 14 nt, Pseudomonas aeruginosa PA01
cgaccgucggccgg

SEQ ID NO: 1444865 - RNA, 22 nt, Pseudomonas aeruginosa PA01
cgaauuggacagcaggcugccg

SEQ ID NO: 1444866 - RNA, 18 nt, Pseudomonas aeruginosa PA01
cgaaugcccggcagcgcc

SEQ ID NO: 1444867 - RNA, 18 nt, Pseudomonas aeruginosa PA01
cgaaugcccgugcgcugc

SEQ ID NO: 1444868 - RNA, 13 nt, Pseudomonas aeruginosa PA01
cgacaucgacgcc

SEQ ID NO: 1444869 - RNA, 23 nt, Pseudomonas aeruginosa PA01
cgacauccugucgaggccucguc

SEQ ID NO: 1444870 - RNA, 13 nt, Pseudomonas aeruginosa PA01
cgacauacuccgc

SEQ ID NO: 1444871 - RNA, 14 nt, Pseudomonas aeruginosa PA01
cgacauacuccgcc

SEQ ID NO: 1444872 - RNA, 19 nt, Pseudomonas aeruginosa PA01
cgacauacuccgccgcuuc

SEQ ID NO: 1444873 - RNA, 14 nt, Pseudomonas aeruginosa PA01
cgacauagccggcg

SEQ ID NO: 1444874 - RNA, 17 nt, Pseudomonas aeruginosa PA01
cgacauagcgcagcacc

SEQ ID NO: 1444875 - RNA, 15 nt, Pseudomonas aeruginosa PA01
cgacauagcggcugc

SEQ ID NO: 1444876 - RNA, 14 nt, Pseudomonas aeruginosa PA01
cgacaucgucucgc

SEQ ID NO: 1444877 - RNA, 12 nt, Pseudomonas aeruginosa PA01
cgacaucucguc

SEQ ID NO: 1444878 - RNA, 23 nt, Pseudomonas aeruginosa PA01
cgacaugggccgcgcagaucgcg

SEQ ID NO: 1444879 - RNA, 14 nt, Pseudomonas aeruginosa PA01
cgacauggaucacc

SEQ ID NO: 1444880 - RNA, 23 nt, Pseudomonas aeruginosa PA01
cgacaugcaccaggccgccaugc

SEQ ID NO: 1444881 - RNA, 22 nt, Pseudomonas aeruginosa PA01
cgacauugcugccgaggccgag

SEQ ID NO: 1444882 - RNA, 17 nt, Pseudomonas aeruginosa PA01
cgacaugccccgccgac

SEQ ID NO: 1444883 - RNA, 14 nt, Pseudomonas aeruginosa PA01
cgaccaucggcggc

SEQ ID NO: 1444884 - RNA, 15 nt, Pseudomonas aeruginosa PA01
cgaccaucggcggcg

SEQ ID NO: 1444885 - RNA, 22 nt, Pseudomonas aeruginosa PA01
cgaccaucggcggcggcccgca

SEQ ID NO: 1444886 - RNA, 20 nt, Pseudomonas aeruginosa PA01
cgaccagcucgaagccgccg

SEQ ID NO: 1444887 - RNA, 19 nt, Pseudomonas aeruginosa PA01
cgaccagcgucgcgcgugc

SEQ ID NO: 1444888 - RNA, 20 nt, Pseudomonas aeruginosa PA01
cgaccagcgucgcgcgugcc

SEQ ID NO: 1444889 - RNA, 16 nt, Pseudomonas aeruginosa PA01
cgaccauccagccugc

SEQ ID NO: 1444890 - RNA, 19 nt, Pseudomonas aeruginosa PA01
cgaccauccagccugcgcu

SEQ ID NO: 1444891 - RNA, 12 nt, Pseudomonas aeruginosa PA01
cgaccagcgcgc

SEQ ID NO: 1444892 - RNA, 12 nt, Pseudomonas aeruginosa PA01
cgaccagcgccg

SEQ ID NO: 1444893 - RNA, 16 nt, Pseudomonas aeruginosa PA01
cgaccagcgccgacuu

SEQ ID NO: 1444894 - RNA, 14 nt, Pseudomonas aeruginosa PA01
cgaccagcgccgcg

SEQ ID NO: 1444895 - RNA, 18 nt, Pseudomonas aeruginosa PA01
cgaccaugguguuggcgg

SEQ ID NO: 1444896 - RNA, 19 nt, Pseudomonas aeruginosa PA01
cgaccaugguguuggcggc

SEQ ID NO: 1444897 - RNA, 20 nt, Pseudomonas aeruginosa PA01
cgaccauucccacgacccgc

SEQ ID NO: 1444898 - RNA, 18 nt, Pseudomonas aeruginosa PA01
cgacccagaccugccgcc

SEQ ID NO: 1444899 - RNA, 13 nt, Pseudomonas aeruginosa PA01
cgacccagagcgc

SEQ ID NO: 1444900 - RNA, 20 nt, Pseudomonas aeruginosa PA01
cgacccagagcgcgcccugc

SEQ ID NO: 1444901 - RNA, 14 nt, Pseudomonas aeruginosa PA01
cgacccgcagcggc

SEQ ID NO: 1444902 - RNA, 15 nt, Pseudomonas aeruginosa PA01
cgacccgcaggccgg

SEQ ID NO: 1444903 - RNA, 22 nt, Pseudomonas aeruginosa PA01
cgaccauuucccgcgagcagcc

SEQ ID NO: 1444904 - RNA, 16 nt, Pseudomonas aeruginosa PA01
cgaccaccucggcguc

SEQ ID NO: 1444905 - RNA, 14 nt, Pseudomonas aeruginosa PA01
cgaccacgacccgg

SEQ ID NO: 1444906 - RNA, 12 nt, Pseudomonas aeruginosa PA01
cgaccacgccug

SEQ ID NO: 1444907 - RNA, 15 nt, Pseudomonas aeruginosa PA01
cgaccacgccugcca

SEQ ID NO: 1444908 - RNA, 20 nt, Pseudomonas aeruginosa PA01
cgaccacucgcgagauggcg

SEQ ID NO: 1444909 - RNA, 17 nt, Pseudomonas aeruginosa PA01
cgaccagacgcagcagc

SEQ ID NO: 1444910 - RNA, 12 nt, Pseudomonas aeruginosa PA01
cgaccaccgcgu

SEQ ID NO: 1444911 - RNA, 13 nt, Pseudomonas aeruginosa PA01
cgaccaccgcgug

SEQ ID NO: 1444912 - RNA, 16 nt, Pseudomonas aeruginosa PA01
cgaccaccgcguggug

SEQ ID NO: 1444913 - RNA, 14 nt, Pseudomonas aeruginosa PA01
cgaccaccucggcg

SEQ ID NO: 1444914 - RNA, 19 nt, Pseudomonas aeruginosa PA01
cgaccacccggcgguccgc

SEQ ID NO: 1444915 - RNA, 13 nt, Pseudomonas aeruginosa PA01
cgaccacccggcg

SEQ ID NO: 1444916 - RNA, 13 nt, Pseudomonas aeruginosa PA01
cgaccaccaucac

SEQ ID NO: 1444917 - RNA, 16 nt, Pseudomonas aeruginosa PA01
cgaccacaugggcgac

SEQ ID NO: 1444918 - RNA, 23 nt, Pseudomonas aeruginosa PA01
cgaccacaggcggcggaagaagc

SEQ ID NO: 1444919 - RNA, 17 nt, Pseudomonas aeruginosa PA01
ccugucgcagcgggcau

SEQ ID NO: 1444920 - RNA, 14 nt, Pseudomonas aeruginosa PA01
ccugucgcuccggc

SEQ ID NO: 1444921 - RNA, 14 nt, Pseudomonas aeruginosa PA01
ccugucggcacgac

SEQ ID NO: 1444922 - RNA, 15 nt, Pseudomonas aeruginosa PA01
ccugucggcucgcgc

SEQ ID NO: 1444923 - RNA, 19 nt, Pseudomonas aeruginosa PA01
ccugucggcucgcgccggc

SEQ ID NO: 1444924 - RNA, 21 nt, Pseudomonas aeruginosa PA01
ccugucggcucgcgccggcgc

SEQ ID NO: 1444925 - RNA, 17 nt, Pseudomonas aeruginosa PA01
ccugucgauuucccccg

SEQ ID NO: 1444926 - RNA, 17 nt, Pseudomonas aeruginosa PA01
ccuguccguccgaaccg

SEQ ID NO: 1444927 - RNA, 13 nt, Pseudomonas aeruginosa PA01
ccuguccgcugcg

SEQ ID NO: 1444928 - RNA, 20 nt, Pseudomonas aeruginosa PA01
ccugucccaucacggccccg

SEQ ID NO: 1444929 - RNA, 19 nt, Pseudomonas aeruginosa PA01
ccugucuacucgacgcugc

SEQ ID NO: 1444930 - RNA, 19 nt, Pseudomonas aeruginosa PA01
ccugugcgguaacgaagcg

SEQ ID NO: 1444931 - RNA, 16 nt, Pseudomonas aeruginosa PA01
ccugugcugcgcgccg

SEQ ID NO: 1444932 - RNA, 21 nt, Pseudomonas aeruginosa PA01
ccugugcugcgcgccgcaacg

SEQ ID NO: 1444933 - RNA, 20 nt, Pseudomonas aeruginosa PA01
ccuguggcguuauucgcccu

SEQ ID NO: 1444934 - RNA, 18 nt, Pseudomonas aeruginosa PA01
ccucgucgcgccaggcga

SEQ ID NO: 1444935 - RNA, 18 nt, Pseudomonas aeruginosa PA01
ccucgucgccaugcggca

SEQ ID NO: 1444936 - RNA, 19 nt, Pseudomonas aeruginosa PA01
ccucgucgagcgcagcgac

SEQ ID NO: 1444937 - RNA, 19 nt, Pseudomonas aeruginosa PA01
ccucgucgauacgcaucug

SEQ ID NO: 1444938 - RNA, 13 nt, Pseudomonas aeruginosa PA01
ccucgucgauccg

SEQ ID NO: 1444939 - RNA, 16 nt, Pseudomonas aeruginosa PA01
ccucgucgagcagcgc

SEQ ID NO: 1444940 - RNA, 21 nt, Pseudomonas aeruginosa PA01
ccucgucgagcagcgcgcggc

SEQ ID NO: 1444941 - RNA, 22 nt, Pseudomonas aeruginosa PA01
ccucgucgagcagcgcgcggcu

SEQ ID NO: 1444942 - RNA, 12 nt, Pseudomonas aeruginosa PA01
ccuguccagcuc

SEQ ID NO: 1444943 - RNA, 13 nt, Pseudomonas aeruginosa PA01
ccuguccagcucc

SEQ ID NO: 1444944 - RNA, 21 nt, Pseudomonas aeruginosa PA01
ccuguccagucaccaggucgc

SEQ ID NO: 1444945 - RNA, 23 nt, Pseudomonas aeruginosa PA01
ccuguccccucacggcgcgagaa

SEQ ID NO: 1444946 - RNA, 14 nt, Pseudomonas aeruginosa PA01
ccuguucgcgcgcc

SEQ ID NO: 1444947 - RNA, 14 nt, Pseudomonas aeruginosa PA01
ccuguuccgcgauc

SEQ ID NO: 1444948 - RNA, 22 nt, Pseudomonas aeruginosa PA01
ccuguggaauguccugccgcag

SEQ ID NO: 1444949 - RNA, 22 nt, Pseudomonas aeruginosa PA01
ccuguggauaaaaaggcccgga

SEQ ID NO: 1444950 - RNA, 14 nt, Pseudomonas aeruginosa PA01
ccuguggucaggcg

SEQ ID NO: 1444951 - RNA, 16 nt, Pseudomonas aeruginosa PA01
ccuguggucaggcgcc

SEQ ID NO: 1444952 - RNA, 13 nt, Pseudomonas aeruginosa PA01
ccuguucggccuu

SEQ ID NO: 1444953 - RNA, 13 nt, Pseudomonas aeruginosa PA01
ccuguucggcgcu

SEQ ID NO: 1444954 - RNA, 15 nt, Pseudomonas aeruginosa PA01
ccuguucggcgcuga

SEQ ID NO: 1444955 - RNA, 17 nt, Pseudomonas aeruginosa PA01
ccuguucggcgggaucg

SEQ ID NO: 1444956 - RNA, 19 nt, Pseudomonas aeruginosa PA01
ccuguucggcgggaucgac

SEQ ID NO: 1444957 - RNA, 22 nt, Pseudomonas aeruginosa PA01
ccuguucggcgggaucgacgcc

SEQ ID NO: 1444958 - RNA, 15 nt, Pseudomonas aeruginosa PA01
ccuguugaaaaccgg

SEQ ID NO: 1444959 - RNA, 20 nt, Pseudomonas aeruginosa PA01
ccuguucgucuggcgccugg

SEQ ID NO: 1444960 - RNA, 17 nt, Pseudomonas aeruginosa PA01
ccuguugcagagcggcc

SEQ ID NO: 1444961 - RNA, 20 nt, Pseudomonas aeruginosa PA01
ccuguugcagagcggccagg

SEQ ID NO: 1444962 - RNA, 22 nt, Pseudomonas aeruginosa PA01
ccuguugcagagcggccagguc

SEQ ID NO: 1444963 - RNA, 15 nt, Pseudomonas aeruginosa PA01
ccuucaacggcgacc

SEQ ID NO: 1444964 - RNA, 16 nt, Pseudomonas aeruginosa PA01
ccuucaacggcgaccg

SEQ ID NO: 1444965 - RNA, 14 nt, Pseudomonas aeruginosa PA01
ccuucacggcaucc

SEQ ID NO: 1444966 - RNA, 21 nt, Pseudomonas aeruginosa PA01
ccuucacguaguugacccgcc

SEQ ID NO: 1444967 - RNA, 16 nt, Pseudomonas aeruginosa PA01
ccuucaccgcgccgcg

SEQ ID NO: 1444968 - RNA, 15 nt, Pseudomonas aeruginosa PA01
ccuucaccggacggc

SEQ ID NO: 1444969 - RNA, 17 nt, Pseudomonas aeruginosa PA01
ccuucaccggacggcug

SEQ ID NO: 1444970 - RNA, 14 nt, Pseudomonas aeruginosa PA01
ccuucaccaccagc

SEQ ID NO: 1444971 - RNA, 13 nt, Pseudomonas aeruginosa PA01
ccuucggcgccgg

SEQ ID NO: 1444972 - RNA, 17 nt, Pseudomonas aeruginosa PA01
ccuucgggagagcccgg

SEQ ID NO: 1444973 - RNA, 19 nt, Pseudomonas aeruginosa PA01
ccuucggaucggucagcga

SEQ ID NO: 1444974 - RNA, 18 nt, Pseudomonas aeruginosa PA01
ccuucggcaggaccucgg

SEQ ID NO: 1444975 - RNA, 21 nt, Pseudomonas aeruginosa PA01
ccuucggcgcucuucagcacg

SEQ ID NO: 1444976 - RNA, 23 nt, Pseudomonas aeruginosa PA01
ccuucggcgcucuucagcacgcc

SEQ ID NO: 1444977 - RNA, 15 nt, Pseudomonas aeruginosa PA01
ccuucggcggccggg

SEQ ID NO: 1444978 - RNA, 17 nt, Pseudomonas aeruginosa PA01
ccuucguccaugcucgc

SEQ ID NO: 1444979 - RNA, 19 nt, Pseudomonas aeruginosa PA01
ccuucgguggcgaccagga

SEQ ID NO: 1444980 - RNA, 15 nt, Pseudomonas aeruginosa PA01
ccuucucgucgccgc

SEQ ID NO: 1444981 - RNA, 12 nt, Pseudomonas aeruginosa PA01
ccuucugcaccg

SEQ ID NO: 1444982 - RNA, 18 nt, Pseudomonas aeruginosa PA01
ccuucugcaccgugcgcg

SEQ ID NO: 1444983 - RNA, 20 nt, Pseudomonas aeruginosa PA01
ccuucuuccaguuggccggg

SEQ ID NO: 1444984 - RNA, 18 nt, Pseudomonas aeruginosa PA01
ccuucuccgccagccagc

SEQ ID NO: 1444985 - RNA, 19 nt, Pseudomonas aeruginosa PA01
ccuucuccggggcccggca

SEQ ID NO: 1444986 - RNA, 21 nt, Pseudomonas aeruginosa PA01
ccuucuccggggcccggcagg

SEQ ID NO: 1444987 - RNA, 23 nt, Pseudomonas aeruginosa PA01
ccuucguuggccuugaugccggc

SEQ ID NO: 1444988 - RNA, 19 nt, Pseudomonas aeruginosa PA01
ccuugaccugcugggccag

SEQ ID NO: 1444989 - RNA, 21 nt, Pseudomonas aeruginosa PA01
ccuugacccgguacagcgccu

SEQ ID NO: 1444990 - RNA, 17 nt, Pseudomonas aeruginosa PA01
ccuugagggccucggcg

SEQ ID NO: 1444991 - RNA, 17 nt, Pseudomonas aeruginosa PA01
ccuugagccuugccccg

SEQ ID NO: 1444992 - RNA, 17 nt, Pseudomonas aeruginosa PA01
ccuugagcgccagcagg

SEQ ID NO: 1444993 - RNA, 18 nt, Pseudomonas aeruginosa PA01
ccuugagcaugauggugc

SEQ ID NO: 1444994 - RNA, 14 nt, Pseudomonas aeruginosa PA01
ccuugagcacgguc

SEQ ID NO: 1444995 - RNA, 18 nt, Pseudomonas aeruginosa PA01
ccuugagcacgucgccuu

SEQ ID NO: 1444996 - RNA, 23 nt, Pseudomonas aeruginosa PA01
ccuugagcacgucgccuucgcug

SEQ ID NO: 1444997 - RNA, 13 nt, Pseudomonas aeruginosa PA01
ccuugagcaggcg

SEQ ID NO: 1444998 - RNA, 19 nt, Pseudomonas aeruginosa PA01
ccuugagcaggcggccguc

SEQ ID NO: 1444999 - RNA, 19 nt, Pseudomonas aeruginosa PA01
ccuugaauugcugccacuc

SEQ ID NO: 1445000 - RNA, 20 nt, Pseudomonas aeruginosa PA01
ccuugaacaggcuggcgucg

SEQ ID NO: 1445001 - RNA, 15 nt, Pseudomonas aeruginosa PA01
ccuugaccagcggcc

SEQ ID NO: 1445002 - RNA, 17 nt, Pseudomonas aeruginosa PA01
ccuugaccaccgccagg

SEQ ID NO: 1445003 - RNA, 19 nt, Pseudomonas aeruginosa PA01
ccuugaccaccgccaggcu

SEQ ID NO: 1445004 - RNA, 20 nt, Pseudomonas aeruginosa PA01
ccuugaccaccgccaggcug

SEQ ID NO: 1445005 - RNA, 13 nt, Pseudomonas aeruginosa PA01
ccuucaccgcgcc

SEQ ID NO: 1445006 - RNA, 14 nt, Pseudomonas aeruginosa PA01
ccuucagacgcacc

SEQ ID NO: 1445007 - RNA, 13 nt, Pseudomonas aeruginosa PA01
ccuucagccccag

SEQ ID NO: 1445008 - RNA, 16 nt, Pseudomonas aeruginosa PA01
ccuucagccccagcac

SEQ ID NO: 1445009 - RNA, 15 nt, Pseudomonas aeruginosa PA01
ccuucagcgcaccgc

SEQ ID NO: 1445010 - RNA, 16 nt, Pseudomonas aeruginosa PA01
ccuucagcgccagcag

SEQ ID NO: 1445011 - RNA, 19 nt, Pseudomonas aeruginosa PA01
ccuucagcgccgccaggcc

SEQ ID NO: 1445012 - RNA, 16 nt, Pseudomonas aeruginosa PA01
ccuucaggagggaacg

SEQ ID NO: 1445013 - RNA, 13 nt, Pseudomonas aeruginosa PA01
ccuucaggcgcuc

SEQ ID NO: 1445014 - RNA, 14 nt, Pseudomonas aeruginosa PA01
ccuuccagcagguc

SEQ ID NO: 1445015 - RNA, 15 nt, Pseudomonas aeruginosa PA01
ccuuccagccgcccu

SEQ ID NO: 1445016 - RNA, 15 nt, Pseudomonas aeruginosa PA01
ccuuccagccgcgcg

SEQ ID NO: 1445017 - RNA, 21 nt, Pseudomonas aeruginosa PA01
ccuucccagacguccagcgcc

SEQ ID NO: 1445018 - RNA, 20 nt, Pseudomonas aeruginosa PA01
ccuucccagccgaggcagcc

SEQ ID NO: 1445019 - RNA, 22 nt, Pseudomonas aeruginosa PA01
ccuuccaggcuguagccggcga

SEQ ID NO: 1445020 - RNA, 19 nt, Pseudomonas aeruginosa PA01
ccuucaucaccaggucgcu

SEQ ID NO: 1445021 - RNA, 17 nt, Pseudomonas aeruginosa PA01
ccuucagcaccugcgcc

SEQ ID NO: 1445022 - RNA, 12 nt, Pseudomonas aeruginosa PA01
ccuucgcgggcc

SEQ ID NO: 1445023 - RNA, 15 nt, Pseudomonas aeruginosa PA01
ccuucgcgggccagg

SEQ ID NO: 1445024 - RNA, 17 nt, Pseudomonas aeruginosa PA01
ccuucgcggcggcgcgu

SEQ ID NO: 1445025 - RNA, 12 nt, Pseudomonas aeruginosa PA01
ccuucgaucacc

SEQ ID NO: 1445026 - RNA, 16 nt, Pseudomonas aeruginosa PA01
ccuucgcaaagcgagc

SEQ ID NO: 1445027 - RNA, 15 nt, Pseudomonas aeruginosa PA01
ccuucgccagcaggc

SEQ ID NO: 1445028 - RNA, 18 nt, Pseudomonas aeruginosa PA01
ccuucgccgucagacgcg

SEQ ID NO: 1445029 - RNA, 13 nt, Pseudomonas aeruginosa PA01
ccuucgcccgcug

SEQ ID NO: 1445030 - RNA, 20 nt, Pseudomonas aeruginosa PA01
ccuucgcccgcugcgcugcc

SEQ ID NO: 1445031 - RNA, 12 nt, Pseudomonas aeruginosa PA01
ccuucgcccggc

SEQ ID NO: 1445032 - RNA, 16 nt, Pseudomonas aeruginosa PA01
ccuuccugccagcgcg

SEQ ID NO: 1445033 - RNA, 22 nt, Pseudomonas aeruginosa PA01
ccuuccucggccgccaggcgcg

SEQ ID NO: 1445034 - RNA, 13 nt, Pseudomonas aeruginosa PA01
ccuuccucggcga

SEQ ID NO: 1445035 - RNA, 13 nt, Pseudomonas aeruginosa PA01
ccuuccgcgccca

SEQ ID NO: 1445036 - RNA, 15 nt, Pseudomonas aeruginosa PA01
ccuuccgccagcagg

SEQ ID NO: 1445037 - RNA, 19 nt, Pseudomonas aeruginosa PA01
ccuuccgccagcaggcgcg

SEQ ID NO: 1445038 - RNA, 21 nt, Pseudomonas aeruginosa PA01
ccuuccgccagcaggcgcggg

SEQ ID NO: 1445039 - RNA, 21 nt, Pseudomonas aeruginosa PA01
ccuuccgucgucaccucggcg

SEQ ID NO: 1445040 - RNA, 17 nt, Pseudomonas aeruginosa PA01
ccuuccuugauccacuc

SEQ ID NO: 1445041 - RNA, 20 nt, Pseudomonas aeruginosa PA01
ccuuccuugauccacucgcc

SEQ ID NO: 1445042 - RNA, 23 nt, Pseudomonas aeruginosa PA01
ccuucgaacccgcccucguggcg

SEQ ID NO: 1445043 - RNA, 19 nt, Pseudomonas aeruginosa PA01
ccuucgacggagagcagca

SEQ ID NO: 1445044 - RNA, 20 nt, Pseudomonas aeruginosa PA01
ccuucgagccuggccaggcg

SEQ ID NO: 1445045 - RNA, 17 nt, Pseudomonas aeruginosa PA01
ccuucgagcgcgguuuu

SEQ ID NO: 1445046 - RNA, 16 nt, Pseudomonas aeruginosa PA01
ccuucgagcaacacau

SEQ ID NO: 1445047 - RNA, 18 nt, Pseudomonas aeruginosa PA01
ccuucgagcaacacaugc

SEQ ID NO: 1445048 - RNA, 21 nt, Pseudomonas aeruginosa PA01
ccuucgagcaacacaugcagg

SEQ ID NO: 1445049 - RNA, 14 nt, Pseudomonas aeruginosa PA01
cgaaacgcuugcgu

SEQ ID NO: 1445050 - RNA, 13 nt, Pseudomonas aeruginosa PA01
cgaaacgccgacg

SEQ ID NO: 1445051 - RNA, 21 nt, Pseudomonas aeruginosa PA01
cgaaaccggccagcgcggcgg

SEQ ID NO: 1445052 - RNA, 17 nt, Pseudomonas aeruginosa PA01
cgaaagccucgacgaca

SEQ ID NO: 1445053 - RNA, 15 nt, Pseudomonas aeruginosa PA01
cgaaagccugccggg

SEQ ID NO: 1445054 - RNA, 17 nt, Pseudomonas aeruginosa PA01
cgaaagccugccgggca

SEQ ID NO: 1445055 - RNA, 22 nt, Pseudomonas aeruginosa PA01
cgaaagccgccgccgcgccggc

SEQ ID NO: 1445056 - RNA, 14 nt, Pseudomonas aeruginosa PA01
cgaaagccgaagcg

SEQ ID NO: 1445057 - RNA, 17 nt, Pseudomonas aeruginosa PA01
cgaaagccgaagcgcga

SEQ ID NO: 1445058 - RNA, 14 nt, Pseudomonas aeruginosa PA01
cgaaagcgccccgg

SEQ ID NO: 1445059 - RNA, 13 nt, Pseudomonas aeruginosa PA01
cgaaagcggugcc

SEQ ID NO: 1445060 - RNA, 17 nt, Pseudomonas aeruginosa PA01
cgaaagcggugccgcgu

SEQ ID NO: 1445061 - RNA, 15 nt, Pseudomonas aeruginosa PA01
cgaaagcgucagcgc

SEQ ID NO: 1445062 - RNA, 19 nt, Pseudomonas aeruginosa PA01
cgaaagcgucagcgcgcca

SEQ ID NO: 1445063 - RNA, 22 nt, Pseudomonas aeruginosa PA01
cgaaagcgucagcgcgccagca

SEQ ID NO: 1445064 - RNA, 15 nt, Pseudomonas aeruginosa PA01
cgaaagcuucgucgc

SEQ ID NO: 1445065 - RNA, 21 nt, Pseudomonas aeruginosa PA01
cgaaagcuucgucgcgcaggc

SEQ ID NO: 1445066 - RNA, 16 nt, Pseudomonas aeruginosa PA01
cgaaaggccgcgccgg

SEQ ID NO: 1445067 - RNA, 22 nt, Pseudomonas aeruginosa PA01
cgaaagcacugcggcggucccu

SEQ ID NO: 1445068 - RNA, 15 nt, Pseudomonas aeruginosa PA01
cgaaaaucgaagggu

SEQ ID NO: 1445069 - RNA, 12 nt, Pseudomonas aeruginosa PA01
cgaaaaccgcag

SEQ ID NO: 1445070 - RNA, 14 nt, Pseudomonas aeruginosa PA01
cgaaaacggcgacc

SEQ ID NO: 1445071 - RNA, 21 nt, Pseudomonas aeruginosa PA01
cgaaaagaagccccgcagccg

SEQ ID NO: 1445072 - RNA, 21 nt, Pseudomonas aeruginosa PA01
cgaaaagcgguuucgccaccu

SEQ ID NO: 1445073 - RNA, 17 nt, Pseudomonas aeruginosa PA01
cgaaaaaaggcgccuuc

SEQ ID NO: 1445074 - RNA, 15 nt, Pseudomonas aeruginosa PA01
cgaaaaagccggcgc

SEQ ID NO: 1445075 - RNA, 14 nt, Pseudomonas aeruginosa PA01
cgaaaaaggcgcgc

SEQ ID NO: 1445076 - RNA, 17 nt, Pseudomonas aeruginosa PA01
cgaaaaagaacgccccg

SEQ ID NO: 1445077 - RNA, 20 nt, Pseudomonas aeruginosa PA01
ccuuuugacuugacccgacu

SEQ ID NO: 1445078 - RNA, 20 nt, Pseudomonas aeruginosa PA01
ccuuuuccucgaucaggccu

SEQ ID NO: 1445079 - RNA, 18 nt, Pseudomonas aeruginosa PA01
ccuuuucaauuccgccgc

SEQ ID NO: 1445080 - RNA, 19 nt, Pseudomonas aeruginosa PA01
ccuuuucaauuccgccgcg

SEQ ID NO: 1445081 - RNA, 20 nt, Pseudomonas aeruginosa PA01
ccuugugcgccagcucggcc

SEQ ID NO: 1445082 - RNA, 18 nt, Pseudomonas aeruginosa PA01
ccuuguuuuccuggcccu

SEQ ID NO: 1445083 - RNA, 19 nt, Pseudomonas aeruginosa PA01
ccuuguuuuccuggcccug

SEQ ID NO: 1445084 - RNA, 23 nt, Pseudomonas aeruginosa PA01
ccuugugcacgaacaggugcugg

SEQ ID NO: 1445085 - RNA, 20 nt, Pseudomonas aeruginosa PA01
ccuuguucaggguggcgacc

SEQ ID NO: 1445086 - RNA, 24 nt, Pseudomonas aeruginosa PA01
ccuuguucaggguggcgaccgccg

SEQ ID NO: 1445087 - RNA, 16 nt, Pseudomonas aeruginosa PA01
ccuuggucaggccgac

SEQ ID NO: 1445088 - RNA, 16 nt, Pseudomonas aeruginosa PA01
ccuuggucagggugcc

SEQ ID NO: 1445089 - RNA, 20 nt, Pseudomonas aeruginosa PA01
ccuuggucaggucgacgccg

SEQ ID NO: 1445090 - RNA, 20 nt, Pseudomonas aeruginosa PA01
ccuuggugaugaagucggcg

SEQ ID NO: 1445091 - RNA, 22 nt, Pseudomonas aeruginosa PA01
ccuuggugaugaagucggcgua

SEQ ID NO: 1445092 - RNA, 17 nt, Pseudomonas aeruginosa PA01
ccuuguccaggcgcugc

SEQ ID NO: 1445093 - RNA, 17 nt, Pseudomonas aeruginosa PA01
ccuuguccuggccggcg

SEQ ID NO: 1445094 - RNA, 12 nt, Pseudomonas aeruginosa PA01
ccuugucgccgg

SEQ ID NO: 1445095 - RNA, 15 nt, Pseudomonas aeruginosa PA01
ccuugucgcgcacca

SEQ ID NO: 1445096 - RNA, 19 nt, Pseudomonas aeruginosa PA01
ccuuggugucgaugccgcc

SEQ ID NO: 1445097 - RNA, 19 nt, Pseudomonas aeruginosa PA01
ccuugcugaagcccaggcg

SEQ ID NO: 1445098 - RNA, 14 nt, Pseudomonas aeruginosa PA01
ccuuggagccgccc

SEQ ID NO: 1445099 - RNA, 18 nt, Pseudomonas aeruginosa PA01
ccuuggagccgcccucgg

SEQ ID NO: 1445100 - RNA, 17 nt, Pseudomonas aeruginosa PA01
ccuugcuguucgccuuc

SEQ ID NO: 1445101 - RNA, 20 nt, Pseudomonas aeruginosa PA01
ccuugcgccaugcgcccgcu

SEQ ID NO: 1445102 - RNA, 12 nt, Pseudomonas aeruginosa PA01
ccuugcucgcgg

SEQ ID NO: 1445103 - RNA, 18 nt, Pseudomonas aeruginosa PA01
ccuugcucucgcgcacgc

SEQ ID NO: 1445104 - RNA, 20 nt, Pseudomonas aeruginosa PA01
ccuugcggccguucuccggg

SEQ ID NO: 1445105 - RNA, 19 nt, Pseudomonas aeruginosa PA01
ccuugcgucuucgccgaug

SEQ ID NO: 1445106 - RNA, 18 nt, Pseudomonas aeruginosa PA01
ccuuggcuugcagguagc

SEQ ID NO: 1445107 - RNA, 13 nt, Pseudomonas aeruginosa PA01
ccuuggcuggcca

SEQ ID NO: 1445108 - RNA, 20 nt, Pseudomonas aeruginosa PA01
ccuuggcuuccuggcgccgg

SEQ ID NO: 1445109 - RNA, 17 nt, Pseudomonas aeruginosa PA01
ccuugggccaggcaucc

SEQ ID NO: 1445110 - RNA, 20 nt, Pseudomonas aeruginosa PA01
ccuuggccacgacccugcug

SEQ ID NO: 1445111 - RNA, 13 nt, Pseudomonas aeruginosa PA01
ccuuggccacgcu

SEQ ID NO: 1445112 - RNA, 13 nt, Pseudomonas aeruginosa PA01
ccuuggccacggc

SEQ ID NO: 1445113 - RNA, 17 nt, Pseudomonas aeruginosa PA01
ccuuggccagcgcggcg

SEQ ID NO: 1445114 - RNA, 20 nt, Pseudomonas aeruginosa PA01
ccuuggccagcgcggcgcgg

SEQ ID NO: 1445115 - RNA, 15 nt, Pseudomonas aeruginosa PA01
ccuuggccaugggca

SEQ ID NO: 1445116 - RNA, 14 nt, Pseudomonas aeruginosa PA01
ccuuggcgcaggua

SEQ ID NO: 1445117 - RNA, 23 nt, Pseudomonas aeruginosa PA01
ccuugcccggauuuugggcagcg

SEQ ID NO: 1445118 - RNA, 14 nt, Pseudomonas aeruginosa PA01
ccuugcccggcgcg

SEQ ID NO: 1445119 - RNA, 15 nt, Pseudomonas aeruginosa PA01
ccuugcccggcgcgu

SEQ ID NO: 1445120 - RNA, 16 nt, Pseudomonas aeruginosa PA01
ccuugcccucggcgcc

SEQ ID NO: 1445121 - RNA, 17 nt, Pseudomonas aeruginosa PA01
ccuugcccucggcgccc

SEQ ID NO: 1445122 - RNA, 21 nt, Pseudomonas aeruginosa PA01
ccuugcccucggcgcccgccu

SEQ ID NO: 1445123 - RNA, 16 nt, Pseudomonas aeruginosa PA01
ccuugcccuggccggc

SEQ ID NO: 1445124 - RNA, 15 nt, Pseudomonas aeruginosa PA01
ccuugcccugggcgu

SEQ ID NO: 1445125 - RNA, 20 nt, Pseudomonas aeruginosa PA01
ccuugcccugggcgucgacg

SEQ ID NO: 1445126 - RNA, 14 nt, Pseudomonas aeruginosa PA01
ccuugccgacgccg

SEQ ID NO: 1445127 - RNA, 20 nt, Pseudomonas aeruginosa PA01
ccuugccgaggaagucggcg

SEQ ID NO: 1445128 - RNA, 22 nt, Pseudomonas aeruginosa PA01
ccuugccgaggaagucggcggc

SEQ ID NO: 1445129 - RNA, 17 nt, Pseudomonas aeruginosa PA01
ccuugcagcgccaugcu

SEQ ID NO: 1445130 - RNA, 19 nt, Pseudomonas aeruginosa PA01
ccuugcagggccgccagcc

SEQ ID NO: 1445131 - RNA, 22 nt, Pseudomonas aeruginosa PA01
ccuugcagggccgccagccgcc

SEQ ID NO: 1445132 - RNA, 19 nt, Pseudomonas aeruginosa PA01
ccuugaguagcuggcgcag

SEQ ID NO: 1445133 - RNA, 16 nt, Pseudomonas aeruginosa PA01
ccuugaguucgccacu

SEQ ID NO: 1445134 - RNA, 17 nt, Pseudomonas aeruginosa PA01
ccuugagguaacgcgga

SEQ ID NO: 1445135 - RNA, 13 nt, Pseudomonas aeruginosa PA01
ccuugagcggcgc

SEQ ID NO: 1445136 - RNA, 17 nt, Pseudomonas aeruginosa PA01
ccuugaucuuguccggg

SEQ ID NO: 1445137 - RNA, 23 nt, Pseudomonas aeruginosa PA01
ccuugaugaucaggucggccgcc

SEQ ID NO: 1445138 - RNA, 19 nt, Pseudomonas aeruginosa PA01
ccuugaucaccuugccauc

SEQ ID NO: 1445139 - RNA, 15 nt, Pseudomonas aeruginosa PA01
ccuugaucagcgcgc

SEQ ID NO: 1445140 - RNA, 17 nt, Pseudomonas aeruginosa PA01
ccuugauggugugcagc

SEQ ID NO: 1445141 - RNA, 14 nt, Pseudomonas aeruginosa PA01
ccuugcacauccag

SEQ ID NO: 1445142 - RNA, 16 nt, Pseudomonas aeruginosa PA01
ccuugcagccagccgu

SEQ ID NO: 1445143 - RNA, 15 nt, Pseudomonas aeruginosa PA01
ccuugcgcggcaggc

SEQ ID NO: 1445144 - RNA, 20 nt, Pseudomonas aeruginosa PA01
ccuugcgcggcaggccgucc

SEQ ID NO: 1445145 - RNA, 21 nt, Pseudomonas aeruginosa PA01
ccuugcgcggcaggccguccu

SEQ ID NO: 1445146 - RNA, 15 nt, Pseudomonas aeruginosa PA01
ccuugcgcgugcugg

SEQ ID NO: 1445147 - RNA, 13 nt, Pseudomonas aeruginosa PA01
ccuugcggccccc

SEQ ID NO: 1445148 - RNA, 19 nt, Pseudomonas aeruginosa PA01
ccuugcgcucuggcgcaua

SEQ ID NO: 1445149 - RNA, 14 nt, Pseudomonas aeruginosa PA01
ccuugcgccaggcc

SEQ ID NO: 1445150 - RNA, 15 nt, Pseudomonas aeruginosa PA01
ccuugcgccaggccu

SEQ ID NO: 1445151 - RNA, 22 nt, Pseudomonas aeruginosa PA01
ccuugcgcagguacucgccggc

SEQ ID NO: 1445152 - RNA, 23 nt, Pseudomonas aeruginosa PA01
ccuugcgcagguacucgccggcg

SEQ ID NO: 1445153 - RNA, 13 nt, Pseudomonas aeruginosa PA01
ccuugcgcccggc

SEQ ID NO: 1445154 - RNA, 14 nt, Pseudomonas aeruginosa PA01
ccuugcgcaccgcc

SEQ ID NO: 1445155 - RNA, 12 nt, Pseudomonas aeruginosa PA01
ccuugcgccgcg

SEQ ID NO: 1445156 - RNA, 16 nt, Pseudomonas aeruginosa PA01
ccuugcgccgcgguuc

SEQ ID NO: 1445157 - RNA, 14 nt, Pseudomonas aeruginosa PA01
ccuugcgaucgagg

SEQ ID NO: 1445158 - RNA, 12 nt, Pseudomonas aeruginosa PA01
ccuugccggugc

SEQ ID NO: 1445159 - RNA, 13 nt, Pseudomonas aeruginosa PA01
ccuugccguccag

SEQ ID NO: 1445160 - RNA, 17 nt, Pseudomonas aeruginosa PA01
ccuugccguccagccgg

SEQ ID NO: 1445161 - RNA, 21 nt, Pseudomonas aeruginosa PA01
ccuugccugucuacucgacgc

SEQ ID NO: 1445162 - RNA, 17 nt, Pseudomonas aeruginosa PA01
ccuugcgaaaagcccgc

SEQ ID NO: 1445163 - RNA, 17 nt, Pseudomonas aeruginosa PA01
ccuugccgccggucuuc

SEQ ID NO: 1445164 - RNA, 15 nt, Pseudomonas aeruginosa PA01
ccuugccgcgcccgg

SEQ ID NO: 1445165 - RNA, 18 nt, Pseudomonas aeruginosa PA01
ccuugccgcgcccggccu

SEQ ID NO: 1445166 - RNA, 14 nt, Pseudomonas aeruginosa PA01
cgaaucuucggcgc

SEQ ID NO: 1445167 - RNA, 12 nt, Pseudomonas aeruginosa PA01
cgaaucggcgca

SEQ ID NO: 1445168 - RNA, 13 nt, Pseudomonas aeruginosa PA01
cgaauagccggcg

SEQ ID NO: 1445169 - RNA, 21 nt, Pseudomonas aeruginosa PA01
cgaauagcgccgcgggcgcua

SEQ ID NO: 1445170 - RNA, 20 nt, Pseudomonas aeruginosa PA01
cgaauauccucgucgauccg

SEQ ID NO: 1445171 - RNA, 16 nt, Pseudomonas aeruginosa PA01
cgaauacugcacgccc

SEQ ID NO: 1445172 - RNA, 17 nt, Pseudomonas aeruginosa PA01
cgaauaucgcggcgcga

SEQ ID NO: 1445173 - RNA, 20 nt, Pseudomonas aeruginosa PA01
cgaauaaccauugcgcggga

SEQ ID NO: 1445174 - RNA, 13 nt, Pseudomonas aeruginosa PA01
cgaauaaccgcau

SEQ ID NO: 1445175 - RNA, 19 nt, Pseudomonas aeruginosa PA01
cgaauaaccgcaucgcggu

SEQ ID NO: 1445176 - RNA, 18 nt, Pseudomonas aeruginosa PA01
cgaaguuggcggccgacg

SEQ ID NO: 1445177 - RNA, 17 nt, Pseudomonas aeruginosa PA01
cgaaguugcaggccagc

SEQ ID NO: 1445178 - RNA, 21 nt, Pseudomonas aeruginosa PA01
cgaaguugcaggccagcgcca

SEQ ID NO: 1445179 - RNA, 14 nt, Pseudomonas aeruginosa PA01
cgaaguugccgccg

SEQ ID NO: 1445180 - RNA, 15 nt, Pseudomonas aeruginosa PA01
cgaaguugccgccgc

SEQ ID NO: 1445181 - RNA, 17 nt, Pseudomonas aeruginosa PA01
cgaaguugccgccgcug

SEQ ID NO: 1445182 - RNA, 18 nt, Pseudomonas aeruginosa PA01
cgaaguugccgccgcugg

SEQ ID NO: 1445183 - RNA, 13 nt, Pseudomonas aeruginosa PA01
cgaauaacgccgc

SEQ ID NO: 1445184 - RNA, 20 nt, Pseudomonas aeruginosa PA01
cgaauaacgccgcaggcguu

SEQ ID NO: 1445185 - RNA, 21 nt, Pseudomonas aeruginosa PA01
cgaauaacgccgcaggcguua

SEQ ID NO: 1445186 - RNA, 14 nt, Pseudomonas aeruginosa PA01
cgaauaccggagcg

SEQ ID NO: 1445187 - RNA, 18 nt, Pseudomonas aeruginosa PA01
cgaauaccggagcgaacg

SEQ ID NO: 1445188 - RNA, 20 nt, Pseudomonas aeruginosa PA01
cgaauaccagggcucggacg

SEQ ID NO: 1445189 - RNA, 18 nt, Pseudomonas aeruginosa PA01
cgaauaccagugccgcgg

SEQ ID NO: 1445190 - RNA, 19 nt, Pseudomonas aeruginosa PA01
cgaauaccagugccgcggu

SEQ ID NO: 1445191 - RNA, 17 nt, Pseudomonas aeruginosa PA01
cgaaguagccggaaaac

SEQ ID NO: 1445192 - RNA, 20 nt, Pseudomonas aeruginosa PA01
cgaagugauggaagagcgcc

SEQ ID NO: 1445193 - RNA, 18 nt, Pseudomonas aeruginosa PA01
cgaaguagaagcgcgcgg

SEQ ID NO: 1445194 - RNA, 15 nt, Pseudomonas aeruginosa PA01
cgaaguucuccagca

SEQ ID NO: 1445195 - RNA, 16 nt, Pseudomonas aeruginosa PA01
cgaaguucccgccgcu

SEQ ID NO: 1445196 - RNA, 17 nt, Pseudomonas aeruginosa PA01
cgaaguucccgccgcuc

SEQ ID NO: 1445197 - RNA, 15 nt, Pseudomonas aeruginosa PA01
cgaagcugucggccc

SEQ ID NO: 1445198 - RNA, 18 nt, Pseudomonas aeruginosa PA01
cgaagcugucggcccgcg

SEQ ID NO: 1445199 - RNA, 12 nt, Pseudomonas aeruginosa PA01
cgaagcugucgu

SEQ ID NO: 1445200 - RNA, 16 nt, Pseudomonas aeruginosa PA01
cgaaggugaagcugcc

SEQ ID NO: 1445201 - RNA, 17 nt, Pseudomonas aeruginosa PA01
cgaaggugcaggccgcg

SEQ ID NO: 1445202 - RNA, 14 nt, Pseudomonas aeruginosa PA01
cgaagcuggccagu

SEQ ID NO: 1445203 - RNA, 19 nt, Pseudomonas aeruginosa PA01
cgaagcugucgagcacggc

SEQ ID NO: 1445204 - RNA, 15 nt, Pseudomonas aeruginosa PA01
cgaagcucggcgcga

SEQ ID NO: 1445205 - RNA, 14 nt, Pseudomonas aeruginosa PA01
cgaagcucucgccg

SEQ ID NO: 1445206 - RNA, 15 nt, Pseudomonas aeruginosa PA01
cgaagcucucgccgc

SEQ ID NO: 1445207 - RNA, 17 nt, Pseudomonas aeruginosa PA01
cgaagguggcgaccugg

SEQ ID NO: 1445208 - RNA, 18 nt, Pseudomonas aeruginosa PA01
cgaagguggcgaccuggu

SEQ ID NO: 1445209 - RNA, 23 nt, Pseudomonas aeruginosa PA01
cgaaguacucguguuccggcagg

SEQ ID NO: 1445210 - RNA, 22 nt, Pseudomonas aeruginosa PA01
cgaagcggggcuuuuuccaacg

SEQ ID NO: 1445211 - RNA, 15 nt, Pseudomonas aeruginosa PA01
cgaagcgcaccaggg

SEQ ID NO: 1445212 - RNA, 23 nt, Pseudomonas aeruginosa PA01
cgaagcuccucgauaaacggcgc

SEQ ID NO: 1445213 - RNA, 17 nt, Pseudomonas aeruginosa PA01
cgaagcgugggcggccg

SEQ ID NO: 1445214 - RNA, 15 nt, Pseudomonas aeruginosa PA01
cgaagccggcggcgc

SEQ ID NO: 1445215 - RNA, 18 nt, Pseudomonas aeruginosa PA01
cgaagcgacggcgcaagg

SEQ ID NO: 1445216 - RNA, 15 nt, Pseudomonas aeruginosa PA01
cgaagccgacgccga

SEQ ID NO: 1445217 - RNA, 20 nt, Pseudomonas aeruginosa PA01
cgaagcccgugucgccuucc

SEQ ID NO: 1445218 - RNA, 15 nt, Pseudomonas aeruginosa PA01
cgaagccgagcugcc

SEQ ID NO: 1445219 - RNA, 17 nt, Pseudomonas aeruginosa PA01
cgaagccgagcugccgg

SEQ ID NO: 1445220 - RNA, 18 nt, Pseudomonas aeruginosa PA01
cgaagccgagcugccggg

SEQ ID NO: 1445221 - RNA, 12 nt, Pseudomonas aeruginosa PA01
cgaagccgccgc

SEQ ID NO: 1445222 - RNA, 14 nt, Pseudomonas aeruginosa PA01
cgaagccgccgccg

SEQ ID NO: 1445223 - RNA, 17 nt, Pseudomonas aeruginosa PA01
cgaagccgcgcagcacu

SEQ ID NO: 1445224 - RNA, 12 nt, Pseudomonas aeruginosa PA01
cgaagccgcgcc

SEQ ID NO: 1445225 - RNA, 18 nt, Pseudomonas aeruginosa PA01
cgaagccgcgcccggccu

SEQ ID NO: 1445226 - RNA, 15 nt, Pseudomonas aeruginosa PA01
cgaagcccagcgagc

SEQ ID NO: 1445227 - RNA, 15 nt, Pseudomonas aeruginosa PA01
cgaagcccagcgccg

SEQ ID NO: 1445228 - RNA, 15 nt, Pseudomonas aeruginosa PA01
cgaagcccagcgccu

SEQ ID NO: 1445229 - RNA, 19 nt, Pseudomonas aeruginosa PA01
cgaagcccaggcugacccg

SEQ ID NO: 1445230 - RNA, 23 nt, Pseudomonas aeruginosa PA01
cgaagcccaggcugacccggucg

SEQ ID NO: 1445231 - RNA, 14 nt, Pseudomonas aeruginosa PA01
cgaagccagcacgg

SEQ ID NO: 1445232 - RNA, 19 nt, Pseudomonas aeruginosa PA01
cgaagccaggaagcggcgg

SEQ ID NO: 1445233 - RNA, 18 nt, Pseudomonas aeruginosa PA01
cgaagacccccugcggcc

SEQ ID NO: 1445234 - RNA, 21 nt, Pseudomonas aeruginosa PA01
cgaagaaugccuucaccggcg

SEQ ID NO: 1445235 - RNA, 20 nt, Pseudomonas aeruginosa PA01
cgaagaccaccauggucuuu

SEQ ID NO: 1445236 - RNA, 16 nt, Pseudomonas aeruginosa PA01
cgaagaccagcggagc

SEQ ID NO: 1445237 - RNA, 14 nt, Pseudomonas aeruginosa PA01
cgaagaacuccauc

SEQ ID NO: 1445238 - RNA, 22 nt, Pseudomonas aeruginosa PA01
cgaagaacuccaucucgcggcg

SEQ ID NO: 1445239 - RNA, 20 nt, Pseudomonas aeruginosa PA01
cgaagaacucggcgcugccg

SEQ ID NO: 1445240 - RNA, 21 nt, Pseudomonas aeruginosa PA01
cgaagaacucggcgcugccgg

SEQ ID NO: 1445241 - RNA, 15 nt, Pseudomonas aeruginosa PA01
cgaagaacgccagcc

SEQ ID NO: 1445242 - RNA, 14 nt, Pseudomonas aeruginosa PA01
cgaagaacggcgcg

SEQ ID NO: 1445243 - RNA, 17 nt, Pseudomonas aeruginosa PA01
cgaagaacggcgcgguc

SEQ ID NO: 1445244 - RNA, 15 nt, Pseudomonas aeruginosa PA01
cgaagaagccggccc

SEQ ID NO: 1445245 - RNA, 17 nt, Pseudomonas aeruginosa PA01
cgaagaagccggccccu

SEQ ID NO: 1445246 - RNA, 23 nt, Pseudomonas aeruginosa PA01
cgaagaagcuucgcuggguuuuc

SEQ ID NO: 1445247 - RNA, 16 nt, Pseudomonas aeruginosa PA01
cgaagaaggcucaccg

SEQ ID NO: 1445248 - RNA, 23 nt, Pseudomonas aeruginosa PA01
cgaacgggaaguaggccuggccg

SEQ ID NO: 1445249 - RNA, 22 nt, Pseudomonas aeruginosa PA01
cgaacucguagacgaauaccgg

SEQ ID NO: 1445250 - RNA, 14 nt, Pseudomonas aeruginosa PA01
cgaacucggcgccg

SEQ ID NO: 1445251 - RNA, 12 nt, Pseudomonas aeruginosa PA01
cgaacucuggcg

SEQ ID NO: 1445252 - RNA, 20 nt, Pseudomonas aeruginosa PA01
cgaacugcacccgccgaccg

SEQ ID NO: 1445253 - RNA, 21 nt, Pseudomonas aeruginosa PA01
cgaacugcacccgccgaccgg

SEQ ID NO: 1445254 - RNA, 14 nt, Pseudomonas aeruginosa PA01
cgaacugcacgccc

SEQ ID NO: 1445255 - RNA, 16 nt, Pseudomonas aeruginosa PA01
cgaacgcucccagccg

SEQ ID NO: 1445256 - RNA, 20 nt, Pseudomonas aeruginosa PA01
cgaacgcucccagccgacgu

SEQ ID NO: 1445257 - RNA, 15 nt, Pseudomonas aeruginosa PA01
cgaacgcgugaagcu

SEQ ID NO: 1445258 - RNA, 14 nt, Pseudomonas aeruginosa PA01
cgaacggcagcguc

SEQ ID NO: 1445259 - RNA, 23 nt, Pseudomonas aeruginosa PA01
cgaacggcgugagggucgcgccg

SEQ ID NO: 1445260 - RNA, 19 nt, Pseudomonas aeruginosa PA01
cgaacggcucaauccggcu

SEQ ID NO: 1445261 - RNA, 21 nt, Pseudomonas aeruginosa PA01
cgaacggcucaauccggcugg

SEQ ID NO: 1445262 - RNA, 21 nt, Pseudomonas aeruginosa PA01
cgaacgcuugagccccggcag

SEQ ID NO: 1445263 - RNA, 13 nt, Pseudomonas aeruginosa PA01
cgaacggaucgcg

SEQ ID NO: 1445264 - RNA, 22 nt, Pseudomonas aeruginosa PA01
cgaacggaucgcgucgcaggcg

SEQ ID NO: 1445265 - RNA, 23 nt, Pseudomonas aeruginosa PA01
cgaacgcgcugacggcaaggacc

SEQ ID NO: 1445266 - RNA, 22 nt, Pseudomonas aeruginosa PA01
cgaacuccggugucaggccgag

SEQ ID NO: 1445267 - RNA, 22 nt, Pseudomonas aeruginosa PA01
cgaacgguagguagcguugcgc

SEQ ID NO: 1445268 - RNA, 23 nt, Pseudomonas aeruginosa PA01
cgaacgggcacuucucgaacagc

SEQ ID NO: 1445269 - RNA, 15 nt, Pseudomonas aeruginosa PA01
cgaaccaguccagca

SEQ ID NO: 1445270 - RNA, 14 nt, Pseudomonas aeruginosa PA01
cgaaccgccggccu

SEQ ID NO: 1445271 - RNA, 13 nt, Pseudomonas aeruginosa PA01
cgaaccgcagaag

SEQ ID NO: 1445272 - RNA, 15 nt, Pseudomonas aeruginosa PA01
cgaacccgcccucgu

SEQ ID NO: 1445273 - RNA, 16 nt, Pseudomonas aeruginosa PA01
cgaacccccgaccuuc

SEQ ID NO: 1445274 - RNA, 15 nt, Pseudomonas aeruginosa PA01
cgaaccccuggcgcu

SEQ ID NO: 1445275 - RNA, 15 nt, Pseudomonas aeruginosa PA01
cgaacccaggccgcg

SEQ ID NO: 1445276 - RNA, 18 nt, Pseudomonas aeruginosa PA01
cgaaccaggcaauggccg

SEQ ID NO: 1445277 - RNA, 17 nt, Pseudomonas aeruginosa PA01
cgaaccagcucagcucc

SEQ ID NO: 1445278 - RNA, 20 nt, Pseudomonas aeruginosa PA01
cgaaccagcucagcuccagg

SEQ ID NO: 1445279 - RNA, 18 nt, Pseudomonas aeruginosa PA01
cgaaccagugcaccgccg

SEQ ID NO: 1445280 - RNA, 19 nt, Pseudomonas aeruginosa PA01
cgaaccagugcaccgccgg

SEQ ID NO: 1445281 - RNA, 21 nt, Pseudomonas aeruginosa PA01
cgaaccagugcaccgccgggu

SEQ ID NO: 1445282 - RNA, 15 nt, Pseudomonas aeruginosa PA01
cgaaccaggcggccg

SEQ ID NO: 1445283 - RNA, 14 nt, Pseudomonas aeruginosa PA01
cgaaccagccgcgu

SEQ ID NO: 1445284 - RNA, 18 nt, Pseudomonas aeruginosa PA01
cgaaccacugcgccaugc

SEQ ID NO: 1445285 - RNA, 20 nt, Pseudomonas aeruginosa PA01
cgaaccacugcgccaugccg

SEQ ID NO: 1445286 - RNA, 15 nt, Pseudomonas aeruginosa PA01
cgaacaugagcgauc

SEQ ID NO: 1445287 - RNA, 15 nt, Pseudomonas aeruginosa PA01
cgaacaucagcagca

SEQ ID NO: 1445288 - RNA, 17 nt, Pseudomonas aeruginosa PA01
cgaacaucagcagcagg

SEQ ID NO: 1445289 - RNA, 20 nt, Pseudomonas aeruginosa PA01
cgaacaucagcagcgccagc

SEQ ID NO: 1445290 - RNA, 18 nt, Pseudomonas aeruginosa PA01
cgaacaucgccagcgcca

SEQ ID NO: 1445291 - RNA, 17 nt, Pseudomonas aeruginosa PA01
cgaacaucucgaagcag

SEQ ID NO: 1445292 - RNA, 20 nt, Pseudomonas aeruginosa PA01
cgaacaugaagccgcgcgcc

SEQ ID NO: 1445293 - RNA, 14 nt, Pseudomonas aeruginosa PA01
cgaaccguggcggc

SEQ ID NO: 1445294 - RNA, 16 nt, Pseudomonas aeruginosa PA01
cgaaccguggcggccg

SEQ ID NO: 1445295 - RNA, 18 nt, Pseudomonas aeruginosa PA01
cgaaccguggcggccgcc

SEQ ID NO: 1445296 - RNA, 19 nt, Pseudomonas aeruginosa PA01
cgaaccguggcggccgccg

SEQ ID NO: 1445297 - RNA, 20 nt, Pseudomonas aeruginosa PA01
cgaaccguggcggccgccgc

SEQ ID NO: 1445298 - RNA, 20 nt, Pseudomonas aeruginosa PA01
cgaaccgugguucucggucg

SEQ ID NO: 1445299 - RNA, 20 nt, Pseudomonas aeruginosa PA01
cgaaccggaaaagaagccgc

SEQ ID NO: 1445300 - RNA, 22 nt, Pseudomonas aeruginosa PA01
cgaaccggaaaagaagccgcgc

SEQ ID NO: 1445301 - RNA, 23 nt, Pseudomonas aeruginosa PA01
cgaaccggaaaagaagccgcgca

SEQ ID NO: 1445302 - RNA, 22 nt, Pseudomonas aeruginosa PA01
cgaacgcacuucguccgccacc

SEQ ID NO: 1445303 - RNA, 18 nt, Pseudomonas aeruginosa PA01
cgaacgccaggcaggcgg

SEQ ID NO: 1445304 - RNA, 20 nt, Pseudomonas aeruginosa PA01
cgaacgccgcccgucgcgcc

SEQ ID NO: 1445305 - RNA, 13 nt, Pseudomonas aeruginosa PA01
cgaacgccgcagc

SEQ ID NO: 1445306 - RNA, 13 nt, Pseudomonas aeruginosa PA01
cgaacgacagcac

SEQ ID NO: 1445307 - RNA, 22 nt, Pseudomonas aeruginosa PA01
cgaacgaggcucggucgcgcgg

SEQ ID NO: 1445308 - RNA, 18 nt, Pseudomonas aeruginosa PA01
cgaacgaugguggucggc

SEQ ID NO: 1445309 - RNA, 14 nt, Pseudomonas aeruginosa PA01
cgaacgaggcgagg

SEQ ID NO: 1445310 - RNA, 17 nt, Pseudomonas aeruginosa PA01
cgaacacuugaccgucg

SEQ ID NO: 1445311 - RNA, 13 nt, Pseudomonas aeruginosa PA01
cgaacagcagcaa

SEQ ID NO: 1445312 - RNA, 17 nt, Pseudomonas aeruginosa PA01
cgaacagcagcaagccg

SEQ ID NO: 1445313 - RNA, 17 nt, Pseudomonas aeruginosa PA01
cgaacagccgccccacc

SEQ ID NO: 1445314 - RNA, 12 nt, Pseudomonas aeruginosa PA01
cgaacagcgaga

SEQ ID NO: 1445315 - RNA, 16 nt, Pseudomonas aeruginosa PA01
cgaacagcgagucguc

SEQ ID NO: 1445316 - RNA, 17 nt, Pseudomonas aeruginosa PA01
cgaacaccugcaucacc

SEQ ID NO: 1445317 - RNA, 17 nt, Pseudomonas aeruginosa PA01
cgaacaccgggccgccg

SEQ ID NO: 1445318 - RNA, 20 nt, Pseudomonas aeruginosa PA01
cgaacaccgggccgccggcg

SEQ ID NO: 1445319 - RNA, 14 nt, Pseudomonas aeruginosa PA01
cgaacaccggcgcc

SEQ ID NO: 1445320 - RNA, 15 nt, Pseudomonas aeruginosa PA01
cgaacaccggcgccg

SEQ ID NO: 1445321 - RNA, 16 nt, Pseudomonas aeruginosa PA01
cgaacagcuugccgcu

SEQ ID NO: 1445322 - RNA, 13 nt, Pseudomonas aeruginosa PA01
cgaacagcuugcc

SEQ ID NO: 1445323 - RNA, 16 nt, Pseudomonas aeruginosa PA01
cgaacaggcagcgggc

SEQ ID NO: 1445324 - RNA, 19 nt, Pseudomonas aeruginosa PA01
cgaacaggcagcgggccag

SEQ ID NO: 1445325 - RNA, 12 nt, Pseudomonas aeruginosa PA01
cgaacaggcguc

SEQ ID NO: 1445326 - RNA, 14 nt, Pseudomonas aeruginosa PA01
cgaacagcgccgcg

SEQ ID NO: 1445327 - RNA, 13 nt, Pseudomonas aeruginosa PA01
cgaacagccagcg

SEQ ID NO: 1445328 - RNA, 17 nt, Pseudomonas aeruginosa PA01
cgaacagcgcgccaucg

SEQ ID NO: 1445329 - RNA, 19 nt, Pseudomonas aeruginosa PA01
cgaacagcuccuccagccg

SEQ ID NO: 1445330 - RNA, 20 nt, Pseudomonas aeruginosa PA01
cgaacagcuccuccagccgc

SEQ ID NO: 1445331 - RNA, 21 nt, Pseudomonas aeruginosa PA01
cgaacagcuccuccagccgcg

SEQ ID NO: 1445332 - RNA, 21 nt, Pseudomonas aeruginosa PA01
cgaacagggccaucagggcga

SEQ ID NO: 1445333 - RNA, 17 nt, Pseudomonas aeruginosa PA01
cgaacagggcgaaggcc

SEQ ID NO: 1445334 - RNA, 16 nt, Pseudomonas aeruginosa PA01
cgaacagggcgagcag

SEQ ID NO: 1445335 - RNA, 17 nt, Pseudomonas aeruginosa PA01
cgaacagggcgagcagg

SEQ ID NO: 1445336 - RNA, 19 nt, Pseudomonas aeruginosa PA01
cgaacagggcgagcagggc

SEQ ID NO: 1445337 - RNA, 22 nt, Pseudomonas aeruginosa PA01
cgaacagggucuucaggccgag

SEQ ID NO: 1445338 - RNA, 17 nt, Pseudomonas aeruginosa PA01
cgaacagguagccccgg

SEQ ID NO: 1445339 - RNA, 13 nt, Pseudomonas aeruginosa PA01
cgaacaguucggc

SEQ ID NO: 1445340 - RNA, 18 nt, Pseudomonas aeruginosa PA01
cgaacaguuguuccgggu

SEQ ID NO: 1445341 - RNA, 17 nt, Pseudomonas aeruginosa PA01
cgaaauaaugcggcgcg

SEQ ID NO: 1445342 - RNA, 13 nt, Pseudomonas aeruginosa PA01
cgaaaucggcagg

SEQ ID NO: 1445343 - RNA, 19 nt, Pseudomonas aeruginosa PA01
cgaacaccaggcgccaggg

SEQ ID NO: 1445344 - RNA, 16 nt, Pseudomonas aeruginosa PA01
cgaacaaucggucgcc

SEQ ID NO: 1445345 - RNA, 17 nt, Pseudomonas aeruginosa PA01
cgaacaaucggucgccc

SEQ ID NO: 1445346 - RNA, 18 nt, Pseudomonas aeruginosa PA01
cgaacaaucggucgcccu

SEQ ID NO: 1445347 - RNA, 16 nt, Pseudomonas aeruginosa PA01
cgaacaacccgccagc

SEQ ID NO: 1445348 - RNA, 14 nt, Pseudomonas aeruginosa PA01
cgaacaacgccgcc

SEQ ID NO: 1445349 - RNA, 15 nt, Pseudomonas aeruginosa PA01
cgaacaacgccgccg

SEQ ID NO: 1445350 - RNA, 16 nt, Pseudomonas aeruginosa PA01
cgaacaacgccgccgg

SEQ ID NO: 1445351 - RNA, 21 nt, Pseudomonas aeruginosa PA01
cgaaauggcgguggccguggg

SEQ ID NO: 1445352 - RNA, 16 nt, Pseudomonas aeruginosa PA01
cgaaaugcugcaggcc

SEQ ID NO: 1445353 - RNA, 15 nt, Pseudomonas aeruginosa PA01
cgaugccgggcaacg

SEQ ID NO: 1445354 - RNA, 20 nt, Pseudomonas aeruginosa PA01
cgaugcccucgcggcggcag

SEQ ID NO: 1445355 - RNA, 21 nt, Pseudomonas aeruginosa PA01
cgaugccggaaagccuggccg

SEQ ID NO: 1445356 - RNA, 18 nt, Pseudomonas aeruginosa PA01
cgaugccggccggcagcg

SEQ ID NO: 1445357 - RNA, 21 nt, Pseudomonas aeruginosa PA01
cgaugccggccggcagcgagc

SEQ ID NO: 1445358 - RNA, 12 nt, Pseudomonas aeruginosa PA01
cgaugcgcaacg

SEQ ID NO: 1445359 - RNA, 20 nt, Pseudomonas aeruginosa PA01
cgaugcgcaacgggcggcgg

SEQ ID NO: 1445360 - RNA, 21 nt, Pseudomonas aeruginosa PA01
cgaugcgcaacgggcggcggg

SEQ ID NO: 1445361 - RNA, 18 nt, Pseudomonas aeruginosa PA01
cgaugccguuguagcuga

SEQ ID NO: 1445362 - RNA, 19 nt, Pseudomonas aeruginosa PA01
cgaugccuugcggccccca

SEQ ID NO: 1445363 - RNA, 16 nt, Pseudomonas aeruginosa PA01
cgaugccuucggcggc

SEQ ID NO: 1445364 - RNA, 17 nt, Pseudomonas aeruginosa PA01
cgaugcgguuccuggcu

SEQ ID NO: 1445365 - RNA, 18 nt, Pseudomonas aeruginosa PA01
cgaugcguuccagggcga

SEQ ID NO: 1445366 - RNA, 19 nt, Pseudomonas aeruginosa PA01
cgaugcguuccagggcgaa

SEQ ID NO: 1445367 - RNA, 16 nt, Pseudomonas aeruginosa PA01
cgaugcguccgcgcag

SEQ ID NO: 1445368 - RNA, 19 nt, Pseudomonas aeruginosa PA01
cgaugcguccgcgcaggcg

SEQ ID NO: 1445369 - RNA, 20 nt, Pseudomonas aeruginosa PA01
cgaugcguccgcgcaggcgg

SEQ ID NO: 1445370 - RNA, 22 nt, Pseudomonas aeruginosa PA01
cgaugcgguagucgcugcuggc

SEQ ID NO: 1445371 - RNA, 23 nt, Pseudomonas aeruginosa PA01
cgaugcgguagucgcugcuggcg

SEQ ID NO: 1445372 - RNA, 17 nt, Pseudomonas aeruginosa PA01
cgaugcggcccgccggc

SEQ ID NO: 1445373 - RNA, 22 nt, Pseudomonas aeruginosa PA01
cgaugauggucaacaccagcgc

SEQ ID NO: 1445374 - RNA, 23 nt, Pseudomonas aeruginosa PA01
cgaugauggucaacaccagcgcc

SEQ ID NO: 1445375 - RNA, 14 nt, Pseudomonas aeruginosa PA01
cgaugaugccgccg

SEQ ID NO: 1445376 - RNA, 16 nt, Pseudomonas aeruginosa PA01
cgaugaugccgccguu

SEQ ID NO: 1445377 - RNA, 18 nt, Pseudomonas aeruginosa PA01
cgaugaugccgccguuga

SEQ ID NO: 1445378 - RNA, 19 nt, Pseudomonas aeruginosa PA01
cgaugacguugcugcccug

SEQ ID NO: 1445379 - RNA, 22 nt, Pseudomonas aeruginosa PA01
cgaugacguugcugcccuggcg

SEQ ID NO: 1445380 - RNA, 18 nt, Pseudomonas aeruginosa PA01
cgaugagcaugccgcaga

SEQ ID NO: 1445381 - RNA, 13 nt, Pseudomonas aeruginosa PA01
cgaugcccaccug

SEQ ID NO: 1445382 - RNA, 15 nt, Pseudomonas aeruginosa PA01
cgaugcccaggccgc

SEQ ID NO: 1445383 - RNA, 16 nt, Pseudomonas aeruginosa PA01
cgaugcccaggccgcc

SEQ ID NO: 1445384 - RNA, 17 nt, Pseudomonas aeruginosa PA01
cgaugcccaggccgccg

SEQ ID NO: 1445385 - RNA, 18 nt, Pseudomonas aeruginosa PA01
cgaugcccaggccgccga

SEQ ID NO: 1445386 - RNA, 22 nt, Pseudomonas aeruginosa PA01
cgaugcccaggccgccgaucca

SEQ ID NO: 1445387 - RNA, 18 nt, Pseudomonas aeruginosa PA01
cgaugauggugcggugga

SEQ ID NO: 1445388 - RNA, 12 nt, Pseudomonas aeruginosa PA01
cgaugccaucga

SEQ ID NO: 1445389 - RNA, 18 nt, Pseudomonas aeruginosa PA01
cgaugccaucgaggccag

SEQ ID NO: 1445390 - RNA, 16 nt, Pseudomonas aeruginosa PA01
cgaugccgccgggcau

SEQ ID NO: 1445391 - RNA, 17 nt, Pseudomonas aeruginosa PA01
cgaugccgcgccaggcg

SEQ ID NO: 1445392 - RNA, 18 nt, Pseudomonas aeruginosa PA01
cgaugccgcgccaggcgc

SEQ ID NO: 1445393 - RNA, 14 nt, Pseudomonas aeruginosa PA01
cgaugccgcgccgg

SEQ ID NO: 1445394 - RNA, 12 nt, Pseudomonas aeruginosa PA01
cgaugccgcgcg

SEQ ID NO: 1445395 - RNA, 14 nt, Pseudomonas aeruginosa PA01
cgaugccgcgcgcc

SEQ ID NO: 1445396 - RNA, 15 nt, Pseudomonas aeruginosa PA01
cgaugccgcgcgccu

SEQ ID NO: 1445397 - RNA, 16 nt, Pseudomonas aeruginosa PA01
cgaugccgcgcgccug

SEQ ID NO: 1445398 - RNA, 17 nt, Pseudomonas aeruginosa PA01
cgaugccgcgcgccugg

SEQ ID NO: 1445399 - RNA, 18 nt, Pseudomonas aeruginosa PA01
cgaugccccauccgacgc

SEQ ID NO: 1445400 - RNA, 19 nt, Pseudomonas aeruginosa PA01
cgaugccccauccgacgcc

SEQ ID NO: 1445401 - RNA, 19 nt, Pseudomonas aeruginosa PA01
cgaugcccgccagcaggcg

SEQ ID NO: 1445402 - RNA, 21 nt, Pseudomonas aeruginosa PA01
cgaugcccgccagcaggcgcc

SEQ ID NO: 1445403 - RNA, 22 nt, Pseudomonas aeruginosa PA01
cgaugaccaggguggcggcggc

SEQ ID NO: 1445404 - RNA, 15 nt, Pseudomonas aeruginosa PA01
cgaugaccgccccgg

SEQ ID NO: 1445405 - RNA, 19 nt, Pseudomonas aeruginosa PA01
cgaugaccgccccggcagc

SEQ ID NO: 1445406 - RNA, 23 nt, Pseudomonas aeruginosa PA01
cgaugaccgccccggcagccacc

SEQ ID NO: 1445407 - RNA, 21 nt, Pseudomonas aeruginosa PA01
cgaugacauggaaagcaucgu

SEQ ID NO: 1445408 - RNA, 14 nt, Pseudomonas aeruginosa PA01
cgaugaaugcgcag

SEQ ID NO: 1445409 - RNA, 17 nt, Pseudomonas aeruginosa PA01
cgaucugcgccgcaagc

SEQ ID NO: 1445410 - RNA, 12 nt, Pseudomonas aeruginosa PA01
cgaugaagcuga

SEQ ID NO: 1445411 - RNA, 16 nt, Pseudomonas aeruginosa PA01
cgaugaagcugaugcc

SEQ ID NO: 1445412 - RNA, 13 nt, Pseudomonas aeruginosa PA01
cgaucucuucccg

SEQ ID NO: 1445413 - RNA, 17 nt, Pseudomonas aeruginosa PA01
cgaucucuucccggcuc

SEQ ID NO: 1445414 - RNA, 22 nt, Pseudomonas aeruginosa PA01
cgaucucuucccggcucggcac

SEQ ID NO: 1445415 - RNA, 16 nt, Pseudomonas aeruginosa PA01
cgaucucuacuaccgc

SEQ ID NO: 1445416 - RNA, 19 nt, Pseudomonas aeruginosa PA01
cgaucucuacuaccgccag

SEQ ID NO: 1445417 - RNA, 20 nt, Pseudomonas aeruginosa PA01
cgaucucuacuaccgccagc

SEQ ID NO: 1445418 - RNA, 22 nt, Pseudomonas aeruginosa PA01
cgaucucguagcggucgugcag

SEQ ID NO: 1445419 - RNA, 16 nt, Pseudomonas aeruginosa PA01
cgaucucgucggcggg

SEQ ID NO: 1445420 - RNA, 23 nt, Pseudomonas aeruginosa PA01
cgaucucgucggcggggcgcacc

SEQ ID NO: 1445421 - RNA, 23 nt, Pseudomonas aeruginosa PA01
cgaucucgugcuuggugucggcc

SEQ ID NO: 1445422 - RNA, 18 nt, Pseudomonas aeruginosa PA01
cgaucucguucggguagu

SEQ ID NO: 1445423 - RNA, 20 nt, Pseudomonas aeruginosa PA01
cgaucucgcguuccagcacc

SEQ ID NO: 1445424 - RNA, 15 nt, Pseudomonas aeruginosa PA01
cgaucucggcgcggg

SEQ ID NO: 1445425 - RNA, 17 nt, Pseudomonas aeruginosa PA01
cgaucucgcccagggcg

SEQ ID NO: 1445426 - RNA, 17 nt, Pseudomonas aeruginosa PA01
cgaucuccgccaggcgg

SEQ ID NO: 1445427 - RNA, 21 nt, Pseudomonas aeruginosa PA01
cgaucuccgccaggcggccga

SEQ ID NO: 1445428 - RNA, 23 nt, Pseudomonas aeruginosa PA01
cgaucuccgccaggcggccgaag

SEQ ID NO: 1445429 - RNA, 15 nt, Pseudomonas aeruginosa PA01
cgaucucccgcgauu

SEQ ID NO: 1445430 - RNA, 22 nt, Pseudomonas aeruginosa PA01
cgaucucccgcgauucgccggg

SEQ ID NO: 1445431 - RNA, 15 nt, Pseudomonas aeruginosa PA01
cgaucuccuccgccc

SEQ ID NO: 1445432 - RNA, 15 nt, Pseudomonas aeruginosa PA01
cgaucuccuccucgg

SEQ ID NO: 1445433 - RNA, 17 nt, Pseudomonas aeruginosa PA01
cgaucuccuccucggcg

SEQ ID NO: 1445434 - RNA, 17 nt, Pseudomonas aeruginosa PA01
cgaucuccucgauccgc

SEQ ID NO: 1445435 - RNA, 13 nt, Pseudomonas aeruginosa PA01
cgaucucaucgcc

SEQ ID NO: 1445436 - RNA, 17 nt, Pseudomonas aeruginosa PA01
cgaucuccucgcgcagc

SEQ ID NO: 1445437 - RNA, 13 nt, Pseudomonas aeruginosa PA01
cgaucuccugccg

SEQ ID NO: 1445438 - RNA, 17 nt, Pseudomonas aeruginosa PA01
cgaucuccugccgcggc

SEQ ID NO: 1445439 - RNA, 15 nt, Pseudomonas aeruginosa PA01
cgaucuccugcuggg

SEQ ID NO: 1445440 - RNA, 23 nt, Pseudomonas aeruginosa PA01
cgaucuccugcugggcgucgaac

SEQ ID NO: 1445441 - RNA, 14 nt, Pseudomonas aeruginosa PA01
cgaucucgaagacc

SEQ ID NO: 1445442 - RNA, 17 nt, Pseudomonas aeruginosa PA01
cgaucggguagagcgcg

SEQ ID NO: 1445443 - RNA, 19 nt, Pseudomonas aeruginosa PA01
cgaucgucgagaugcugcg

SEQ ID NO: 1445444 - RNA, 20 nt, Pseudomonas aeruginosa PA01
cgaucguugccagccggccu

SEQ ID NO: 1445445 - RNA, 14 nt, Pseudomonas aeruginosa PA01
cgaucguuggcgaa

SEQ ID NO: 1445446 - RNA, 18 nt, Pseudomonas aeruginosa PA01
cgaucuaccugcgugcgc

SEQ ID NO: 1445447 - RNA, 23 nt, Pseudomonas aeruginosa PA01
cgaucggcugcccaagggccugg

SEQ ID NO: 1445448 - RNA, 15 nt, Pseudomonas aeruginosa PA01
cgaucggcuggucgu

SEQ ID NO: 1445449 - RNA, 21 nt, Pseudomonas aeruginosa PA01
cgaucggcguccgcggccugc

SEQ ID NO: 1445450 - RNA, 13 nt, Pseudomonas aeruginosa PA01
cgaucggggcaga

SEQ ID NO: 1445451 - RNA, 21 nt, Pseudomonas aeruginosa PA01
cgaucggcagggcgccgacca

SEQ ID NO: 1445452 - RNA, 22 nt, Pseudomonas aeruginosa PA01
cgaucggcagggcgccgaccag

SEQ ID NO: 1445453 - RNA, 16 nt, Pseudomonas aeruginosa PA01
cgaucggcccgggcgc

SEQ ID NO: 1445454 - RNA, 22 nt, Pseudomonas aeruginosa PA01
cgaucggaugcacgugcagcuc

SEQ ID NO: 1445455 - RNA, 18 nt, Pseudomonas aeruginosa PA01
cgaucggaagaucgcccg

SEQ ID NO: 1445456 - RNA, 17 nt, Pseudomonas aeruginosa PA01
cgaucgcggccagccgc

SEQ ID NO: 1445457 - RNA, 22 nt, Pseudomonas aeruginosa PA01
cgaucgcggccagccgcuagcg

SEQ ID NO: 1445458 - RNA, 20 nt, Pseudomonas aeruginosa PA01
cgaucgcggcgacgaucacc

SEQ ID NO: 1445459 - RNA, 18 nt, Pseudomonas aeruginosa PA01
cgaucgccgcggcgaagc

SEQ ID NO: 1445460 - RNA, 23 nt, Pseudomonas aeruginosa PA01
cgaucgccgcggcgaagcguugc

SEQ ID NO: 1445461 - RNA, 13 nt, Pseudomonas aeruginosa PA01
cgaucgccgccau

SEQ ID NO: 1445462 - RNA, 16 nt, Pseudomonas aeruginosa PA01
cgaucgccgccauuga

SEQ ID NO: 1445463 - RNA, 18 nt, Pseudomonas aeruginosa PA01
cgaucgccucgggcgagc

SEQ ID NO: 1445464 - RNA, 17 nt, Pseudomonas aeruginosa PA01
cgaucgccucgucgagc

SEQ ID NO: 1445465 - RNA, 13 nt, Pseudomonas aeruginosa PA01
cgaucgccucguu

SEQ ID NO: 1445466 - RNA, 20 nt, Pseudomonas aeruginosa PA01
cgaucgccucguucagcagc

SEQ ID NO: 1445467 - RNA, 19 nt, Pseudomonas aeruginosa PA01
cgaucgaccugccgguagu

SEQ ID NO: 1445468 - RNA, 20 nt, Pseudomonas aeruginosa PA01
cgaucgaggaugaucggcuc

SEQ ID NO: 1445469 - RNA, 21 nt, Pseudomonas aeruginosa PA01
cgaucgaggaugaucggcucc

SEQ ID NO: 1445470 - RNA, 15 nt, Pseudomonas aeruginosa PA01
cgaucgagcggcccg

SEQ ID NO: 1445471 - RNA, 16 nt, Pseudomonas aeruginosa PA01
cgaucgagcggcccgc

SEQ ID NO: 1445472 - RNA, 17 nt, Pseudomonas aeruginosa PA01
cgaucgagcggcccgcg

SEQ ID NO: 1445473 - RNA, 15 nt, Pseudomonas aeruginosa PA01
cgaucgagcugucca

SEQ ID NO: 1445474 - RNA, 18 nt, Pseudomonas aeruginosa PA01
cgaucgauagccuggcug

SEQ ID NO: 1445475 - RNA, 19 nt, Pseudomonas aeruginosa PA01
cgaucgauagccuggcugg

SEQ ID NO: 1445476 - RNA, 17 nt, Pseudomonas aeruginosa PA01
cgauccaggaaccggcc

SEQ ID NO: 1445477 - RNA, 18 nt, Pseudomonas aeruginosa PA01
cgauccaggaaccggcca

SEQ ID NO: 1445478 - RNA, 13 nt, Pseudomonas aeruginosa PA01
cgauccagccggg

SEQ ID NO: 1445479 - RNA, 16 nt, Pseudomonas aeruginosa PA01
cgauccaccgccaggg

SEQ ID NO: 1445480 - RNA, 16 nt, Pseudomonas aeruginosa PA01
cgauccaugcgcacca

SEQ ID NO: 1445481 - RNA, 22 nt, Pseudomonas aeruginosa PA01
cgauccaugcgcaccaggucgc

SEQ ID NO: 1445482 - RNA, 17 nt, Pseudomonas aeruginosa PA01
cgaucccaggucggcgg

SEQ ID NO: 1445483 - RNA, 18 nt, Pseudomonas aeruginosa PA01
cgaucccaggucggcggg

SEQ ID NO: 1445484 - RNA, 22 nt, Pseudomonas aeruginosa PA01
cgaucaugggggccagcagggc

SEQ ID NO: 1445485 - RNA, 20 nt, Pseudomonas aeruginosa PA01
cgaucauggugaagcccacc

SEQ ID NO: 1445486 - RNA, 21 nt, Pseudomonas aeruginosa PA01
cgaucaugccuucgaucucau

SEQ ID NO: 1445487 - RNA, 13 nt, Pseudomonas aeruginosa PA01
cgaucaucggcug

SEQ ID NO: 1445488 - RNA, 16 nt, Pseudomonas aeruginosa PA01
cgaucaucgccagcgg

SEQ ID NO: 1445489 - RNA, 21 nt, Pseudomonas aeruginosa PA01
cgaucaguggucgcagcucca

SEQ ID NO: 1445490 - RNA, 23 nt, Pseudomonas aeruginosa PA01
cgaucccggauucgccgaggaac

SEQ ID NO: 1445491 - RNA, 14 nt, Pseudomonas aeruginosa PA01
cgauccgaccuggg

SEQ ID NO: 1445492 - RNA, 13 nt, Pseudomonas aeruginosa PA01
cgauccgcacccg

SEQ ID NO: 1445493 - RNA, 15 nt, Pseudomonas aeruginosa PA01
cgaucccguagaccg

SEQ ID NO: 1445494 - RNA, 14 nt, Pseudomonas aeruginosa PA01
cgauccgcgccugc

SEQ ID NO: 1445495 - RNA, 21 nt, Pseudomonas aeruginosa PA01
cgauccgcgcuuccgcaucgg

SEQ ID NO: 1445496 - RNA, 22 nt, Pseudomonas aeruginosa PA01
cgauccuucggaggucgagcag

SEQ ID NO: 1445497 - RNA, 20 nt, Pseudomonas aeruginosa PA01
cgauccugaccguccuggcc

SEQ ID NO: 1445498 - RNA, 20 nt, Pseudomonas aeruginosa PA01
cgauccuggcggcacuccag

SEQ ID NO: 1445499 - RNA, 12 nt, Pseudomonas aeruginosa PA01
cgauagaccgcu

SEQ ID NO: 1445500 - RNA, 17 nt, Pseudomonas aeruginosa PA01
cgauagccgaccaggcc

SEQ ID NO: 1445501 - RNA, 18 nt, Pseudomonas aeruginosa PA01
cgauaggcgccggcgcgc

SEQ ID NO: 1445502 - RNA, 16 nt, Pseudomonas aeruginosa PA01
cgauagcguccaggug

SEQ ID NO: 1445503 - RNA, 15 nt, Pseudomonas aeruginosa PA01
cgauagcucagucgg

SEQ ID NO: 1445504 - RNA, 20 nt, Pseudomonas aeruginosa PA01
cgauagcucagucgguagag

SEQ ID NO: 1445505 - RNA, 15 nt, Pseudomonas aeruginosa PA01
cgauagcggcgcgag

SEQ ID NO: 1445506 - RNA, 19 nt, Pseudomonas aeruginosa PA01
cgauagcggcgcgaggccg

SEQ ID NO: 1445507 - RNA, 24 nt, Pseudomonas aeruginosa PA01
cgauagcggcgcgaggccguacca

SEQ ID NO: 1445508 - RNA, 14 nt, Pseudomonas aeruginosa PA01
cgaucaccaccagc

SEQ ID NO: 1445509 - RNA, 16 nt, Pseudomonas aeruginosa PA01
cgaucaccaccagcgc

SEQ ID NO: 1445510 - RNA, 19 nt, Pseudomonas aeruginosa PA01
cgaucaccaccagcgccgc

SEQ ID NO: 1445511 - RNA, 12 nt, Pseudomonas aeruginosa PA01
cgaucaccagcg

SEQ ID NO: 1445512 - RNA, 14 nt, Pseudomonas aeruginosa PA01
cgaucaccagcgcc

SEQ ID NO: 1445513 - RNA, 23 nt, Pseudomonas aeruginosa PA01
cgaucaccaggaucgccgggcuu

SEQ ID NO: 1445514 - RNA, 17 nt, Pseudomonas aeruginosa PA01
cgaucacccgcgaggcc

SEQ ID NO: 1445515 - RNA, 22 nt, Pseudomonas aeruginosa PA01
cgaucaacgcggccagcagcac

SEQ ID NO: 1445516 - RNA, 15 nt, Pseudomonas aeruginosa PA01
cgaucaacgugguga

SEQ ID NO: 1445517 - RNA, 15 nt, Pseudomonas aeruginosa PA01
cgauagacgccggcg

SEQ ID NO: 1445518 - RNA, 16 nt, Pseudomonas aeruginosa PA01
cgauagacgccggcga

SEQ ID NO: 1445519 - RNA, 21 nt, Pseudomonas aeruginosa PA01
cgauacaccugcaacucggcg

SEQ ID NO: 1445520 - RNA, 13 nt, Pseudomonas aeruginosa PA01
cgagugccggcgc

SEQ ID NO: 1445521 - RNA, 20 nt, Pseudomonas aeruginosa PA01
cgagugcgcccagcagcagg

SEQ ID NO: 1445522 - RNA, 23 nt, Pseudomonas aeruginosa PA01
cgauaacaccaggagcgccagca

SEQ ID NO: 1445523 - RNA, 22 nt, Pseudomonas aeruginosa PA01
cgagucggcgacgaugccgccg

SEQ ID NO: 1445524 - RNA, 19 nt, Pseudomonas aeruginosa PA01
cgagugcagcgagucgccg

SEQ ID NO: 1445525 - RNA, 20 nt, Pseudomonas aeruginosa PA01
cgagugcagcgagucgccgu

SEQ ID NO: 1445526 - RNA, 21 nt, Pseudomonas aeruginosa PA01
cgagugcagcgagucgccgug

SEQ ID NO: 1445527 - RNA, 19 nt, Pseudomonas aeruginosa PA01
cgaucagguaggccggcgu

SEQ ID NO: 1445528 - RNA, 17 nt, Pseudomonas aeruginosa PA01
cgaucagguccuggccg

SEQ ID NO: 1445529 - RNA, 20 nt, Pseudomonas aeruginosa PA01
cgaucagguccuggccgaag

SEQ ID NO: 1445530 - RNA, 14 nt, Pseudomonas aeruginosa PA01
cgaucaggucgccg

SEQ ID NO: 1445531 - RNA, 16 nt, Pseudomonas aeruginosa PA01
cgaucaggucgccgcc

SEQ ID NO: 1445532 - RNA, 17 nt, Pseudomonas aeruginosa PA01
cgaucaggucgcgcgcc

SEQ ID NO: 1445533 - RNA, 18 nt, Pseudomonas aeruginosa PA01
cgaucaggucgcgcgccu

SEQ ID NO: 1445534 - RNA, 20 nt, Pseudomonas aeruginosa PA01
cgaucaggucgcgcgccuuc

SEQ ID NO: 1445535 - RNA, 20 nt, Pseudomonas aeruginosa PA01
cgaucagugcaucggccgcc

SEQ ID NO: 1445536 - RNA, 15 nt, Pseudomonas aeruginosa PA01
cgaucaggccgaugc

SEQ ID NO: 1445537 - RNA, 16 nt, Pseudomonas aeruginosa PA01
cgaucaggccgaugcg

SEQ ID NO: 1445538 - RNA, 17 nt, Pseudomonas aeruginosa PA01
cgaucaggccgaugcgc

SEQ ID NO: 1445539 - RNA, 21 nt, Pseudomonas aeruginosa PA01
cgaucaggcccuuuuccaccg

SEQ ID NO: 1445540 - RNA, 12 nt, Pseudomonas aeruginosa PA01
cgaucaggccga

SEQ ID NO: 1445541 - RNA, 20 nt, Pseudomonas aeruginosa PA01
cgaucaggcgggcgucgucg

SEQ ID NO: 1445542 - RNA, 18 nt, Pseudomonas aeruginosa PA01
cgaucaggcugugcaucu

SEQ ID NO: 1445543 - RNA, 17 nt, Pseudomonas aeruginosa PA01
cgaucaggcguaggccg

SEQ ID NO: 1445544 - RNA, 15 nt, Pseudomonas aeruginosa PA01
cgaucagcuuggccu

SEQ ID NO: 1445545 - RNA, 22 nt, Pseudomonas aeruginosa PA01
cgaucaggcugaagcggccgcc

SEQ ID NO: 1445546 - RNA, 17 nt, Pseudomonas aeruginosa PA01
cgaucagggccucgcca

SEQ ID NO: 1445547 - RNA, 17 nt, Pseudomonas aeruginosa PA01
cgaucagcuuguggucg

SEQ ID NO: 1445548 - RNA, 16 nt, Pseudomonas aeruginosa PA01
cgaucaggaacgcgcc

SEQ ID NO: 1445549 - RNA, 13 nt, Pseudomonas aeruginosa PA01
cgaucagcucgcg

SEQ ID NO: 1445550 - RNA, 14 nt, Pseudomonas aeruginosa PA01
cgaucagcucgcgg

SEQ ID NO: 1445551 - RNA, 15 nt, Pseudomonas aeruginosa PA01
cgaucagcucgcggu

SEQ ID NO: 1445552 - RNA, 16 nt, Pseudomonas aeruginosa PA01
cgaucagcucgcggua

SEQ ID NO: 1445553 - RNA, 15 nt, Pseudomonas aeruginosa PA01
cgaucagcggcccga

SEQ ID NO: 1445554 - RNA, 14 nt, Pseudomonas aeruginosa PA01
cgaucagcgcgcgg

SEQ ID NO: 1445555 - RNA, 17 nt, Pseudomonas aeruginosa PA01
cgaucagcgccggguga

SEQ ID NO: 1445556 - RNA, 18 nt, Pseudomonas aeruginosa PA01
cgaucagcgccucggcgc

SEQ ID NO: 1445557 - RNA, 15 nt, Pseudomonas aeruginosa PA01
cgaucagcccgucgg

SEQ ID NO: 1445558 - RNA, 22 nt, Pseudomonas aeruginosa PA01
cgaucagcccgucggccucgcc

SEQ ID NO: 1445559 - RNA, 21 nt, Pseudomonas aeruginosa PA01
cgaucagccauuggccgacgc

SEQ ID NO: 1445560 - RNA, 22 nt, Pseudomonas aeruginosa PA01
cgaucagccauuggccgacgcc

SEQ ID NO: 1445561 - RNA, 16 nt, Pseudomonas aeruginosa PA01
cgaucagcccgccggc

SEQ ID NO: 1445562 - RNA, 18 nt, Pseudomonas aeruginosa PA01
cgaucagcccgccggcga

SEQ ID NO: 1445563 - RNA, 14 nt, Pseudomonas aeruginosa PA01
cgaucaccuggccg

SEQ ID NO: 1445564 - RNA, 14 nt, Pseudomonas aeruginosa PA01
cgaucaccgcgucc

SEQ ID NO: 1445565 - RNA, 21 nt, Pseudomonas aeruginosa PA01
cgaucaccgcguccauccccg

SEQ ID NO: 1445566 - RNA, 23 nt, Pseudomonas aeruginosa PA01
cgaucaccgcguccauccccgcc

SEQ ID NO: 1445567 - RNA, 20 nt, Pseudomonas aeruginosa PA01
cgaucaccagggugcgcucg

SEQ ID NO: 1445568 - RNA, 21 nt, Pseudomonas aeruginosa PA01
cgaucaccagcaauugccggc

SEQ ID NO: 1445569 - RNA, 20 nt, Pseudomonas aeruginosa PA01
cgaucacccccagcgagccg

SEQ ID NO: 1445570 - RNA, 15 nt, Pseudomonas aeruginosa PA01
cgaucagcagcaccg

SEQ ID NO: 1445571 - RNA, 16 nt, Pseudomonas aeruginosa PA01
cgaucagcagcagcgc

SEQ ID NO: 1445572 - RNA, 16 nt, Pseudomonas aeruginosa PA01
cgaucagcaccgccac

SEQ ID NO: 1445573 - RNA, 17 nt, Pseudomonas aeruginosa PA01
cgaucagcaccgccacc

SEQ ID NO: 1445574 - RNA, 15 nt, Pseudomonas aeruginosa PA01
cgaucagcagcgcca

SEQ ID NO: 1445575 - RNA, 16 nt, Pseudomonas aeruginosa PA01
cgaucagccagggcaa

SEQ ID NO: 1445576 - RNA, 21 nt, Pseudomonas aeruginosa PA01
cgaucagccagggcaacgcca

SEQ ID NO: 1445577 - RNA, 22 nt, Pseudomonas aeruginosa PA01
cgaucacgucguacucggcggg

SEQ ID NO: 1445578 - RNA, 14 nt, Pseudomonas aeruginosa PA01
cgaucacgucguac

SEQ ID NO: 1445579 - RNA, 16 nt, Pseudomonas aeruginosa PA01
cgaucacggcgccccg

SEQ ID NO: 1445580 - RNA, 17 nt, Pseudomonas aeruginosa PA01
cgaucagaacgaugccg

SEQ ID NO: 1445581 - RNA, 16 nt, Pseudomonas aeruginosa PA01
cgaggugaucgagggc

SEQ ID NO: 1445582 - RNA, 19 nt, Pseudomonas aeruginosa PA01
cgaguaccgcugcggccgg

SEQ ID NO: 1445583 - RNA, 14 nt, Pseudomonas aeruginosa PA01
cgagucccguccgc

SEQ ID NO: 1445584 - RNA, 17 nt, Pseudomonas aeruginosa PA01
cgagucccguccgcugc

SEQ ID NO: 1445585 - RNA, 21 nt, Pseudomonas aeruginosa PA01
cgagucccguccgcugcgcca

SEQ ID NO: 1445586 - RNA, 15 nt, Pseudomonas aeruginosa PA01
cgagucaccccgacc

SEQ ID NO: 1445587 - RNA, 23 nt, Pseudomonas aeruginosa PA01
cgaguagguccaggcgucggcgc

SEQ ID NO: 1445588 - RNA, 19 nt, Pseudomonas aeruginosa PA01
cgaguagucgcggggcgga

SEQ ID NO: 1445589 - RNA, 15 nt, Pseudomonas aeruginosa PA01
cgaggucuuggccag

SEQ ID NO: 1445590 - RNA, 17 nt, Pseudomonas aeruginosa PA01
cgaggucuuggccagcc

SEQ ID NO: 1445591 - RNA, 19 nt, Pseudomonas aeruginosa PA01
cgaggucuuggccagccgc

SEQ ID NO: 1445592 - RNA, 20 nt, Pseudomonas aeruginosa PA01
cgaggucuuggccagccgcg

SEQ ID NO: 1445593 - RNA, 22 nt, Pseudomonas aeruginosa PA01
cgaggucuuggccagccgcgcg

SEQ ID NO: 1445594 - RNA, 16 nt, Pseudomonas aeruginosa PA01
cgaggggcggagcagc

SEQ ID NO: 1445595 - RNA, 15 nt, Pseudomonas aeruginosa PA01
cgagggugaucagcc

SEQ ID NO: 1445596 - RNA, 15 nt, Pseudomonas aeruginosa PA01
cgagggucgccuuga

SEQ ID NO: 1445597 - RNA, 22 nt, Pseudomonas aeruginosa PA01
cgagggucgccuugaccagcgg

SEQ ID NO: 1445598 - RNA, 18 nt, Pseudomonas aeruginosa PA01
cgagggugaacuggccgu

SEQ ID NO: 1445599 - RNA, 22 nt, Pseudomonas aeruginosa PA01
cgaggggcgggauugucgccgc

SEQ ID NO: 1445600 - RNA, 19 nt, Pseudomonas aeruginosa PA01
cgagggggccucggccagc

SEQ ID NO: 1445601 - RNA, 15 nt, Pseudomonas aeruginosa PA01
cgaggggccgccgua

SEQ ID NO: 1445602 - RNA, 20 nt, Pseudomonas aeruginosa PA01
cgaggggaacauugccacca

SEQ ID NO: 1445603 - RNA, 15 nt, Pseudomonas aeruginosa PA01
cgaggggaaccgggu

SEQ ID NO: 1445604 - RNA, 17 nt, Pseudomonas aeruginosa PA01
cgagggcgucccgcugc

SEQ ID NO: 1445605 - RNA, 19 nt, Pseudomonas aeruginosa PA01
cgagggcgucccgcugcgu

SEQ ID NO: 1445606 - RNA, 18 nt, Pseudomonas aeruginosa PA01
cgagggcugggcagcgcc

SEQ ID NO: 1445607 - RNA, 18 nt, Pseudomonas aeruginosa PA01
cgagggcuguaaucgccg

SEQ ID NO: 1445608 - RNA, 19 nt, Pseudomonas aeruginosa PA01
cgagggcuguaaucgccgc

SEQ ID NO: 1445609 - RNA, 16 nt, Pseudomonas aeruginosa PA01
cgagggcucgggcgcg

SEQ ID NO: 1445610 - RNA, 21 nt, Pseudomonas aeruginosa PA01
cgagggcugagacgcugccgu

SEQ ID NO: 1445611 - RNA, 15 nt, Pseudomonas aeruginosa PA01
cgaggcgaucgccgc

SEQ ID NO: 1445612 - RNA, 18 nt, Pseudomonas aeruginosa PA01
cgaggcgaucgccgcggc

SEQ ID NO: 1445613 - RNA, 20 nt, Pseudomonas aeruginosa PA01
cgaggcgaucgccgcggcga

SEQ ID NO: 1445614 - RNA, 22 nt, Pseudomonas aeruginosa PA01
cgaggcgacccgggucaggccg

SEQ ID NO: 1445615 - RNA, 18 nt, Pseudomonas aeruginosa PA01
cgaggcgaccuuggccag

SEQ ID NO: 1445616 - RNA, 19 nt, Pseudomonas aeruginosa PA01
cgaggcgaccuuggccagc

SEQ ID NO: 1445617 - RNA, 20 nt, Pseudomonas aeruginosa PA01
cgaggcgaccuuggccagcc

SEQ ID NO: 1445618 - RNA, 19 nt, Pseudomonas aeruginosa PA01
cgaggccguaccagucgcc

SEQ ID NO: 1445619 - RNA, 22 nt, Pseudomonas aeruginosa PA01
cgaggccucgucguucagccca

SEQ ID NO: 1445620 - RNA, 13 nt, Pseudomonas aeruginosa PA01
cgaggcgcaggca

SEQ ID NO: 1445621 - RNA, 18 nt, Pseudomonas aeruginosa PA01
cgaggcgcccgccggccg

SEQ ID NO: 1445622 - RNA, 14 nt, Pseudomonas aeruginosa PA01
cgaggcgccgacca

SEQ ID NO: 1445623 - RNA, 17 nt, Pseudomonas aeruginosa PA01
cgaggcgccgaccacga

SEQ ID NO: 1445624 - RNA, 21 nt, Pseudomonas aeruginosa PA01
cgaggcgccgaccacgaccgc

SEQ ID NO: 1445625 - RNA, 22 nt, Pseudomonas aeruginosa PA01
cgaggcgccgaccacgaccgcg

SEQ ID NO: 1445626 - RNA, 21 nt, Pseudomonas aeruginosa PA01
cgaggcgcuccaccgcccccg

SEQ ID NO: 1445627 - RNA, 18 nt, Pseudomonas aeruginosa PA01
cgaggcgcucgacgauca

SEQ ID NO: 1445628 - RNA, 19 nt, Pseudomonas aeruginosa PA01
cgaggcgcucgacgaucag

SEQ ID NO: 1445629 - RNA, 19 nt, Pseudomonas aeruginosa PA01
cgaggcgcgccgacagcac

SEQ ID NO: 1445630 - RNA, 20 nt, Pseudomonas aeruginosa PA01
cgaggcgcgccgacagcacg

SEQ ID NO: 1445631 - RNA, 13 nt, Pseudomonas aeruginosa PA01
cgaggcgcgccug

SEQ ID NO: 1445632 - RNA, 14 nt, Pseudomonas aeruginosa PA01
cgaggcgcgccugg

SEQ ID NO: 1445633 - RNA, 22 nt, Pseudomonas aeruginosa PA01
cgaggcgcuucugcucggccug

SEQ ID NO: 1445634 - RNA, 23 nt, Pseudomonas aeruginosa PA01
cgaggcggaagaaaagaaggcgg

SEQ ID NO: 1445635 - RNA, 19 nt, Pseudomonas aeruginosa PA01
cgaggcggauuugccgccg

SEQ ID NO: 1445636 - RNA, 21 nt, Pseudomonas aeruginosa PA01
cgaggcggauuugccgccgag

SEQ ID NO: 1445637 - RNA, 13 nt, Pseudomonas aeruginosa PA01
cgaggcggccgua

SEQ ID NO: 1445638 - RNA, 14 nt, Pseudomonas aeruginosa PA01
cgaggcggcgcagc

SEQ ID NO: 1445639 - RNA, 16 nt, Pseudomonas aeruginosa PA01
cgaggcggugcagcgg

SEQ ID NO: 1445640 - RNA, 17 nt, Pseudomonas aeruginosa PA01
cgaggcggucaugcgcc

SEQ ID NO: 1445641 - RNA, 19 nt, Pseudomonas aeruginosa PA01
cgaggcggucaugcgcccu

SEQ ID NO: 1445642 - RNA, 15 nt, Pseudomonas aeruginosa PA01
cgaggcgggcgcgga

SEQ ID NO: 1445643 - RNA, 22 nt, Pseudomonas aeruginosa PA01
cgagggcaugaccgauggcgcc

SEQ ID NO: 1445644 - RNA, 23 nt, Pseudomonas aeruginosa PA01
cgagggcauguuggcgccuucgg

SEQ ID NO: 1445645 - RNA, 15 nt, Pseudomonas aeruginosa PA01
cgagggccgcgccga

SEQ ID NO: 1445646 - RNA, 17 nt, Pseudomonas aeruginosa PA01
cgagggccgcgccgacc

SEQ ID NO: 1445647 - RNA, 18 nt, Pseudomonas aeruginosa PA01
cgagggccgcgccgaccc

SEQ ID NO: 1445648 - RNA, 12 nt, Pseudomonas aeruginosa PA01
cgagggcgaaca

SEQ ID NO: 1445649 - RNA, 14 nt, Pseudomonas aeruginosa PA01
cgagggcgaacagc

SEQ ID NO: 1445650 - RNA, 20 nt, Pseudomonas aeruginosa PA01
cgagggcgaagaucucgcca

SEQ ID NO: 1445651 - RNA, 17 nt, Pseudomonas aeruginosa PA01
cgagggcgaccgccagg

SEQ ID NO: 1445652 - RNA, 20 nt, Pseudomonas aeruginosa PA01
cgagggcgaccgccaggcgg

SEQ ID NO: 1445653 - RNA, 20 nt, Pseudomonas aeruginosa PA01
cgagggcgaguucggcgagc

SEQ ID NO: 1445654 - RNA, 23 nt, Pseudomonas aeruginosa PA01
cgagggcgaguucggcgagcagg

SEQ ID NO: 1445655 - RNA, 22 nt, Pseudomonas aeruginosa PA01
cgagggcgcgcacuuccucggc

SEQ ID NO: 1445656 - RNA, 15 nt, Pseudomonas aeruginosa PA01
cgagggcgccaggug

SEQ ID NO: 1445657 - RNA, 17 nt, Pseudomonas aeruginosa PA01
cgagggcgccaggugca

SEQ ID NO: 1445658 - RNA, 16 nt, Pseudomonas aeruginosa PA01
cgagggcgcguugccc

SEQ ID NO: 1445659 - RNA, 20 nt, Pseudomonas aeruginosa PA01
cgagggcgcguugcccagcc

SEQ ID NO: 1445660 - RNA, 17 nt, Pseudomonas aeruginosa PA01
cgagggcggcgaccugg

SEQ ID NO: 1445661 - RNA, 12 nt, Pseudomonas aeruginosa PA01
cgagggcggcgc

SEQ ID NO: 1445662 - RNA, 18 nt, Pseudomonas aeruginosa PA01
cgaggaucacgcagcagg

SEQ ID NO: 1445663 - RNA, 19 nt, Pseudomonas aeruginosa PA01
cgaggaucacgcagcaggc

SEQ ID NO: 1445664 - RNA, 20 nt, Pseudomonas aeruginosa PA01
cgaggaucagccacgggcgc

SEQ ID NO: 1445665 - RNA, 14 nt, Pseudomonas aeruginosa PA01
cgaggaucgcgcug

SEQ ID NO: 1445666 - RNA, 15 nt, Pseudomonas aeruginosa PA01
cgaggaucgcgcugg

SEQ ID NO: 1445667 - RNA, 19 nt, Pseudomonas aeruginosa PA01
cgaggaucgcgcuggccag

SEQ ID NO: 1445668 - RNA, 20 nt, Pseudomonas aeruginosa PA01
cgaggccaggaucgucggcc

SEQ ID NO: 1445669 - RNA, 14 nt, Pseudomonas aeruginosa PA01
cgaggccaggccga

SEQ ID NO: 1445670 - RNA, 19 nt, Pseudomonas aeruginosa PA01
cgaggccaggccgagcgcc

SEQ ID NO: 1445671 - RNA, 16 nt, Pseudomonas aeruginosa PA01
cgaggccagcaggccg

SEQ ID NO: 1445672 - RNA, 18 nt, Pseudomonas aeruginosa PA01
cgaggccauccccgaggc

SEQ ID NO: 1445673 - RNA, 21 nt, Pseudomonas aeruginosa PA01
cgaggccauccccgaggcgac

SEQ ID NO: 1445674 - RNA, 12 nt, Pseudomonas aeruginosa PA01
cgaggcccucgg

SEQ ID NO: 1445675 - RNA, 16 nt, Pseudomonas aeruginosa PA01
cgaggcccucggcggc

SEQ ID NO: 1445676 - RNA, 20 nt, Pseudomonas aeruginosa PA01
cgaggcccucggcggcgagc

SEQ ID NO: 1445677 - RNA, 13 nt, Pseudomonas aeruginosa PA01
cgaggcccgccca

SEQ ID NO: 1445678 - RNA, 22 nt, Pseudomonas aeruginosa PA01
cgaggcccgcccaguugcgggc

SEQ ID NO: 1445679 - RNA, 16 nt, Pseudomonas aeruginosa PA01
cgaggcccgcgccgcc

SEQ ID NO: 1445680 - RNA, 14 nt, Pseudomonas aeruginosa PA01
cgaggccgagccgg

SEQ ID NO: 1445681 - RNA, 15 nt, Pseudomonas aeruginosa PA01
cgaggccgagccggc

SEQ ID NO: 1445682 - RNA, 18 nt, Pseudomonas aeruginosa PA01
cgaggaucuugcgcccgg

SEQ ID NO: 1445683 - RNA, 13 nt, Pseudomonas aeruginosa PA01
cgaggccgccgcg

SEQ ID NO: 1445684 - RNA, 17 nt, Pseudomonas aeruginosa PA01
cgaggccggcgaucagc

SEQ ID NO: 1445685 - RNA, 14 nt, Pseudomonas aeruginosa PA01
cgaggccggcaugc

SEQ ID NO: 1445686 - RNA, 18 nt, Pseudomonas aeruginosa PA01
cgaggaggaucucgcgcc

SEQ ID NO: 1445687 - RNA, 23 nt, Pseudomonas aeruginosa PA01
cgaggaggaucucgcgccccggg

SEQ ID NO: 1445688 - RNA, 18 nt, Pseudomonas aeruginosa PA01
cgaggaggaugccgauca

SEQ ID NO: 1445689 - RNA, 14 nt, Pseudomonas aeruginosa PA01
cgaggaggccagca

SEQ ID NO: 1445690 - RNA, 21 nt, Pseudomonas aeruginosa PA01
cgaggagguuggucugcucgg

SEQ ID NO: 1445691 - RNA, 22 nt, Pseudomonas aeruginosa PA01
cgaggagguuggucugcucggc

SEQ ID NO: 1445692 - RNA, 17 nt, Pseudomonas aeruginosa PA01
cgaggauagcguccagc

SEQ ID NO: 1445693 - RNA, 19 nt, Pseudomonas aeruginosa PA01
cgaggauagcguccagcuc

SEQ ID NO: 1445694 - RNA, 17 nt, Pseudomonas aeruginosa PA01
cgaggaacagcgagagg

SEQ ID NO: 1445695 - RNA, 20 nt, Pseudomonas aeruginosa PA01
cgaggaacaggucgacgcca

SEQ ID NO: 1445696 - RNA, 14 nt, Pseudomonas aeruginosa PA01
cgaggagaucggcg

SEQ ID NO: 1445697 - RNA, 20 nt, Pseudomonas aeruginosa PA01
cgaggagccguagggcgcau

SEQ ID NO: 1445698 - RNA, 20 nt, Pseudomonas aeruginosa PA01
cgagcuuguuggccagcagc

SEQ ID NO: 1445699 - RNA, 21 nt, Pseudomonas aeruginosa PA01
cgagcuuguuggccagcagcc

SEQ ID NO: 1445700 - RNA, 18 nt, Pseudomonas aeruginosa PA01
cgagcuugaggucggccu

SEQ ID NO: 1445701 - RNA, 16 nt, Pseudomonas aeruginosa PA01
cgagcuuggccacucc

SEQ ID NO: 1445702 - RNA, 14 nt, Pseudomonas aeruginosa PA01
cgagcuuggcccug

SEQ ID NO: 1445703 - RNA, 14 nt, Pseudomonas aeruginosa PA01
cgagcguccgccgc

SEQ ID NO: 1445704 - RNA, 15 nt, Pseudomonas aeruginosa PA01
cgagcguccgccgcc

SEQ ID NO: 1445705 - RNA, 17 nt, Pseudomonas aeruginosa PA01
cgagcguccgccgccgu

SEQ ID NO: 1445706 - RNA, 20 nt, Pseudomonas aeruginosa PA01
cgagcguccgccgccguggc

SEQ ID NO: 1445707 - RNA, 17 nt, Pseudomonas aeruginosa PA01
cgagcgguuauucgccc

SEQ ID NO: 1445708 - RNA, 18 nt, Pseudomonas aeruginosa PA01
cgagcgguuauucgcccu

SEQ ID NO: 1445709 - RNA, 15 nt, Pseudomonas aeruginosa PA01
cgagcggucggccau

SEQ ID NO: 1445710 - RNA, 12 nt, Pseudomonas aeruginosa PA01
cgagcaccgcgg

SEQ ID NO: 1445711 - RNA, 14 nt, Pseudomonas aeruginosa PA01
cgagcgggucagca

SEQ ID NO: 1445712 - RNA, 21 nt, Pseudomonas aeruginosa PA01
cgagcgggucagcagcaccgc

SEQ ID NO: 1445713 - RNA, 22 nt, Pseudomonas aeruginosa PA01
cgagcgggucagcagcaccgcg

SEQ ID NO: 1445714 - RNA, 15 nt, Pseudomonas aeruginosa PA01
cgagcaccgcgcaga

SEQ ID NO: 1445715 - RNA, 23 nt, Pseudomonas aeruginosa PA01
cgagcaccgcgcagaccaucagc

SEQ ID NO: 1445716 - RNA, 18 nt, Pseudomonas aeruginosa PA01
cgagcgggcggucgucgc

SEQ ID NO: 1445717 - RNA, 19 nt, Pseudomonas aeruginosa PA01
cgagcgggcggucgucgcc

SEQ ID NO: 1445718 - RNA, 22 nt, Pseudomonas aeruginosa PA01
cgagcugaucgcgcagaucgcc

SEQ ID NO: 1445719 - RNA, 23 nt, Pseudomonas aeruginosa PA01
cgagcugguggauguucgccgcc

SEQ ID NO: 1445720 - RNA, 19 nt, Pseudomonas aeruginosa PA01
cgagcuguccaucucgccg

SEQ ID NO: 1445721 - RNA, 22 nt, Pseudomonas aeruginosa PA01
cgagcuguccaucucgccgcgc

SEQ ID NO: 1445722 - RNA, 21 nt, Pseudomonas aeruginosa PA01
cgagcugaccaccagggcgau

SEQ ID NO: 1445723 - RNA, 12 nt, Pseudomonas aeruginosa PA01
cgagcgucgagu

SEQ ID NO: 1445724 - RNA, 14 nt, Pseudomonas aeruginosa PA01
cgagcucggccagg

SEQ ID NO: 1445725 - RNA, 17 nt, Pseudomonas aeruginosa PA01
cgagcucggccaggcac

SEQ ID NO: 1445726 - RNA, 19 nt, Pseudomonas aeruginosa PA01
cgcagcagggcgucggcgu

SEQ ID NO: 1445727 - RNA, 21 nt, Pseudomonas aeruginosa PA01
cgcagcagggcgucggcgugc

SEQ ID NO: 1445728 - RNA, 14 nt, Pseudomonas aeruginosa PA01
cgcagcagguagug

SEQ ID NO: 1445729 - RNA, 19 nt, Pseudomonas aeruginosa PA01
cgcagcagguagugcggcg

SEQ ID NO: 1445730 - RNA, 23 nt, Pseudomonas aeruginosa PA01
cgcagcagguagugcggcgggcg

SEQ ID NO: 1445731 - RNA, 12 nt, Pseudomonas aeruginosa PA01
cgcagcagcaug

SEQ ID NO: 1445732 - RNA, 13 nt, Pseudomonas aeruginosa PA01
cgcagcagcgcca

SEQ ID NO: 1445733 - RNA, 14 nt, Pseudomonas aeruginosa PA01
cgcagcagcgccag

SEQ ID NO: 1445734 - RNA, 13 nt, Pseudomonas aeruginosa PA01
cgcagcagcucgu

SEQ ID NO: 1445735 - RNA, 18 nt, Pseudomonas aeruginosa PA01
cgcagcagcucguccaug

SEQ ID NO: 1445736 - RNA, 17 nt, Pseudomonas aeruginosa PA01
cgcagcagcuucggcgc

SEQ ID NO: 1445737 - RNA, 18 nt, Pseudomonas aeruginosa PA01
cgcagcagcuucggcgcg

SEQ ID NO: 1445738 - RNA, 21 nt, Pseudomonas aeruginosa PA01
cgcagcagcuucggcgcgacg

SEQ ID NO: 1445739 - RNA, 14 nt, Pseudomonas aeruginosa PA01
cgcagcagcggcga

SEQ ID NO: 1445740 - RNA, 15 nt, Pseudomonas aeruginosa PA01
cgcagcagcggcgac

SEQ ID NO: 1445741 - RNA, 21 nt, Pseudomonas aeruginosa PA01
cgcagcagcggcgacaccgcc

SEQ ID NO: 1445742 - RNA, 23 nt, Pseudomonas aeruginosa PA01
cgcagcagcgucgcgucggccug

SEQ ID NO: 1445743 - RNA, 21 nt, Pseudomonas aeruginosa PA01
cgcagcaggcguucggcgaug

SEQ ID NO: 1445744 - RNA, 18 nt, Pseudomonas aeruginosa PA01
cgcagcaggccgcuggcg

SEQ ID NO: 1445745 - RNA, 21 nt, Pseudomonas aeruginosa PA01
cgcagcaggccgcuggcgacg

SEQ ID NO: 1445746 - RNA, 13 nt, Pseudomonas aeruginosa PA01
cgcagcaggcgac

SEQ ID NO: 1445747 - RNA, 14 nt, Pseudomonas aeruginosa PA01
cgcagcaggcgacg

SEQ ID NO: 1445748 - RNA, 22 nt, Pseudomonas aeruginosa PA01
cgcagcaggcgacggucaggcc

SEQ ID NO: 1445749 - RNA, 22 nt, Pseudomonas aeruginosa PA01
cgcagcacggcggcuacccgcg

SEQ ID NO: 1445750 - RNA, 14 nt, Pseudomonas aeruginosa PA01
cgcagcacggcggc

SEQ ID NO: 1445751 - RNA, 19 nt, Pseudomonas aeruginosa PA01
cgcagcaacuggucgccgc

SEQ ID NO: 1445752 - RNA, 20 nt, Pseudomonas aeruginosa PA01
cgcagcaacuggucgccgca

SEQ ID NO: 1445753 - RNA, 23 nt, Pseudomonas aeruginosa PA01
cgcagcaacuggucgccgcaggu

SEQ ID NO: 1445754 - RNA, 20 nt, Pseudomonas aeruginosa PA01
cgcagcaagucgaacaggcc

SEQ ID NO: 1445755 - RNA, 15 nt, Pseudomonas aeruginosa PA01
cgcagcacccggucg

SEQ ID NO: 1445756 - RNA, 14 nt, Pseudomonas aeruginosa PA01
cgcagaugaucgcc

SEQ ID NO: 1445757 - RNA, 14 nt, Pseudomonas aeruginosa PA01
cgcagaugcuccag

SEQ ID NO: 1445758 - RNA, 20 nt, Pseudomonas aeruginosa PA01
cgcagaugcuccagggagcg

SEQ ID NO: 1445759 - RNA, 13 nt, Pseudomonas aeruginosa PA01
cgcagaucaucgc

SEQ ID NO: 1445760 - RNA, 18 nt, Pseudomonas aeruginosa PA01
cgcagauagggcaucagc

SEQ ID NO: 1445761 - RNA, 16 nt, Pseudomonas aeruginosa PA01
cgcagauagaggcguu

SEQ ID NO: 1445762 - RNA, 18 nt, Pseudomonas aeruginosa PA01
cgcagaucgcggcgcagg

SEQ ID NO: 1445763 - RNA, 16 nt, Pseudomonas aeruginosa PA01
cgcagaucgccgcgua

SEQ ID NO: 1445764 - RNA, 23 nt, Pseudomonas aeruginosa PA01
cgcagacguggcauucgucgccg

SEQ ID NO: 1445765 - RNA, 24 nt, Pseudomonas aeruginosa PA01
cgcagacguggcauucgucgccgc

SEQ ID NO: 1445766 - RNA, 15 nt, Pseudomonas aeruginosa PA01
cgcagacuccggcgc

SEQ ID NO: 1445767 - RNA, 18 nt, Pseudomonas aeruginosa PA01
cgcagacuccggcgcagc

SEQ ID NO: 1445768 - RNA, 21 nt, Pseudomonas aeruginosa PA01
cgcagacuccggcgcagccca

SEQ ID NO: 1445769 - RNA, 16 nt, Pseudomonas aeruginosa PA01
cgcagagacgcagcgc

SEQ ID NO: 1445770 - RNA, 18 nt, Pseudomonas aeruginosa PA01
cgcagagacgcagcgcua

SEQ ID NO: 1445771 - RNA, 16 nt, Pseudomonas aeruginosa PA01
cgcagagaucggcggc

SEQ ID NO: 1445772 - RNA, 17 nt, Pseudomonas aeruginosa PA01
cgcagagaucggcggcg

SEQ ID NO: 1445773 - RNA, 13 nt, Pseudomonas aeruginosa PA01
cgcagagggcgau

SEQ ID NO: 1445774 - RNA, 13 nt, Pseudomonas aeruginosa PA01
cgcagaggcgcuc

SEQ ID NO: 1445775 - RNA, 16 nt, Pseudomonas aeruginosa PA01
cgcagagcaucacccg

SEQ ID NO: 1445776 - RNA, 15 nt, Pseudomonas aeruginosa PA01
cgcagagccagccgc

SEQ ID NO: 1445777 - RNA, 17 nt, Pseudomonas aeruginosa PA01
cgcagagccagccgcag

SEQ ID NO: 1445778 - RNA, 18 nt, Pseudomonas aeruginosa PA01
cgcagagccagccgcagc

SEQ ID NO: 1445779 - RNA, 14 nt, Pseudomonas aeruginosa PA01
cgcagagcgccagc

SEQ ID NO: 1445780 - RNA, 16 nt, Pseudomonas aeruginosa PA01
cgcagagcggcaggcc

SEQ ID NO: 1445781 - RNA, 18 nt, Pseudomonas aeruginosa PA01
cgcagagcggcaggccgc

SEQ ID NO: 1445782 - RNA, 13 nt, Pseudomonas aeruginosa PA01
cgcagagcgguga

SEQ ID NO: 1445783 - RNA, 15 nt, Pseudomonas aeruginosa PA01
cgcacugagggucag

SEQ ID NO: 1445784 - RNA, 14 nt, Pseudomonas aeruginosa PA01
cgcacugccaggag

SEQ ID NO: 1445785 - RNA, 17 nt, Pseudomonas aeruginosa PA01
cgcacugccaggagcac

SEQ ID NO: 1445786 - RNA, 20 nt, Pseudomonas aeruginosa PA01
cgcacugccaggagcacgcc

SEQ ID NO: 1445787 - RNA, 21 nt, Pseudomonas aeruginosa PA01
cgcacugccaggagcacgccg

SEQ ID NO: 1445788 - RNA, 14 nt, Pseudomonas aeruginosa PA01
cgcagacggggccu

SEQ ID NO: 1445789 - RNA, 18 nt, Pseudomonas aeruginosa PA01
cgcagacgggugcugaag

SEQ ID NO: 1445790 - RNA, 16 nt, Pseudomonas aeruginosa PA01
cgcagacgauugaccu

SEQ ID NO: 1445791 - RNA, 22 nt, Pseudomonas aeruginosa PA01
cgcagacgauugaccucccgcg

SEQ ID NO: 1445792 - RNA, 23 nt, Pseudomonas aeruginosa PA01
cgcagacgauugaccucccgcgc

SEQ ID NO: 1445793 - RNA, 19 nt, Pseudomonas aeruginosa PA01
cgcacggucguccugcgga

SEQ ID NO: 1445794 - RNA, 16 nt, Pseudomonas aeruginosa PA01
cgcacucauagcucag

SEQ ID NO: 1445795 - RNA, 18 nt, Pseudomonas aeruginosa PA01
cgcacuccgggcagacca

SEQ ID NO: 1445796 - RNA, 20 nt, Pseudomonas aeruginosa PA01
cgcacuccgggcagaccagc

SEQ ID NO: 1445797 - RNA, 22 nt, Pseudomonas aeruginosa PA01
cgcacuccgggcagaccagcag

SEQ ID NO: 1445798 - RNA, 15 nt, Pseudomonas aeruginosa PA01
cgcaccuugcccugc

SEQ ID NO: 1445799 - RNA, 17 nt, Pseudomonas aeruginosa PA01
cgcaccuugcccugcau

SEQ ID NO: 1445800 - RNA, 19 nt, Pseudomonas aeruginosa PA01
cgcaccuugcccugcauca

SEQ ID NO: 1445801 - RNA, 21 nt, Pseudomonas aeruginosa PA01
cgcacggccgucacggccucc

SEQ ID NO: 1445802 - RNA, 21 nt, Pseudomonas aeruginosa PA01
cgcaccugguggacacccugc

SEQ ID NO: 1445803 - RNA, 22 nt, Pseudomonas aeruginosa PA01
cgcaccuguuccagcaacgccu

SEQ ID NO: 1445804 - RNA, 13 nt, Pseudomonas aeruginosa PA01
cgcaccuguuuca

SEQ ID NO: 1445805 - RNA, 19 nt, Pseudomonas aeruginosa PA01
cgcacggcgaagaacagcg

SEQ ID NO: 1445806 - RNA, 18 nt, Pseudomonas aeruginosa PA01
cgcaccuggcgguaggcg

SEQ ID NO: 1445807 - RNA, 17 nt, Pseudomonas aeruginosa PA01
cgcaccugggcguuggc

SEQ ID NO: 1445808 - RNA, 21 nt, Pseudomonas aeruginosa PA01
cgcaccugggcguuggccagc

SEQ ID NO: 1445809 - RNA, 22 nt, Pseudomonas aeruginosa PA01
cgcaccugggcguuggccagcg

SEQ ID NO: 1445810 - RNA, 13 nt, Pseudomonas aeruginosa PA01
cgcaccucgucga

SEQ ID NO: 1445811 - RNA, 15 nt, Pseudomonas aeruginosa PA01
cgcaccucgucgagc

SEQ ID NO: 1445812 - RNA, 18 nt, Pseudomonas aeruginosa PA01
cgcaccucgucgagcagc

SEQ ID NO: 1445813 - RNA, 12 nt, Pseudomonas aeruginosa PA01
cgcaccggcuuc

SEQ ID NO: 1445814 - RNA, 16 nt, Pseudomonas aeruginosa PA01
cgcaccgggaggcgcc

SEQ ID NO: 1445815 - RNA, 18 nt, Pseudomonas aeruginosa PA01
cgcaccgggaggcgccgc

SEQ ID NO: 1445816 - RNA, 22 nt, Pseudomonas aeruginosa PA01
cgcaccgggaggcgccgcgcca

SEQ ID NO: 1445817 - RNA, 24 nt, Pseudomonas aeruginosa PA01
cgcaccgggaggcgccgcgccagg

SEQ ID NO: 1445818 - RNA, 14 nt, Pseudomonas aeruginosa PA01
cgcaccuccuuggg

SEQ ID NO: 1445819 - RNA, 22 nt, Pseudomonas aeruginosa PA01
cgcaccuccuugggaucggcga

SEQ ID NO: 1445820 - RNA, 14 nt, Pseudomonas aeruginosa PA01
cgcaccucgaccgc

SEQ ID NO: 1445821 - RNA, 15 nt, Pseudomonas aeruginosa PA01
cgcaccucgaccgcg

SEQ ID NO: 1445822 - RNA, 18 nt, Pseudomonas aeruginosa PA01
cgcaccucgaccgcgccg

SEQ ID NO: 1445823 - RNA, 21 nt, Pseudomonas aeruginosa PA01
cgcaccucgaccgcgccggcg

SEQ ID NO: 1445824 - RNA, 22 nt, Pseudomonas aeruginosa PA01
cgcaccucgaccgcgccggcga

SEQ ID NO: 1445825 - RNA, 15 nt, Pseudomonas aeruginosa PA01
cgcaccucggccagg

SEQ ID NO: 1445826 - RNA, 13 nt, Pseudomonas aeruginosa PA01
cgcaccucgcccu

SEQ ID NO: 1445827 - RNA, 13 nt, Pseudomonas aeruginosa PA01
cgcaccagcaggc

SEQ ID NO: 1445828 - RNA, 13 nt, Pseudomonas aeruginosa PA01
cgcaccagccagc

SEQ ID NO: 1445829 - RNA, 12 nt, Pseudomonas aeruginosa PA01
cgcaccagccgg

SEQ ID NO: 1445830 - RNA, 15 nt, Pseudomonas aeruginosa PA01
cgcaccagccggcgc

SEQ ID NO: 1445831 - RNA, 21 nt, Pseudomonas aeruginosa PA01
cgcaccagccuuccggcacca

SEQ ID NO: 1445832 - RNA, 21 nt, Pseudomonas aeruginosa PA01
cgcaccagggccaggagcauc

SEQ ID NO: 1445833 - RNA, 14 nt, Pseudomonas aeruginosa PA01
cgcaccaggccucc

SEQ ID NO: 1445834 - RNA, 20 nt, Pseudomonas aeruginosa PA01
cgcaccggcgauggccggca

SEQ ID NO: 1445835 - RNA, 14 nt, Pseudomonas aeruginosa PA01
cgcaccggcgcgcc

SEQ ID NO: 1445836 - RNA, 15 nt, Pseudomonas aeruginosa PA01
cgcaccggcgcgccg

SEQ ID NO: 1445837 - RNA, 16 nt, Pseudomonas aeruginosa PA01
cgcaccggcgcgccgg

SEQ ID NO: 1445838 - RNA, 22 nt, Pseudomonas aeruginosa PA01
cgcaccagggucgggccgcgcu

SEQ ID NO: 1445839 - RNA, 21 nt, Pseudomonas aeruginosa PA01
cgcaccggcauguagcgcgcc

SEQ ID NO: 1445840 - RNA, 22 nt, Pseudomonas aeruginosa PA01
cgcaccggcauguagcgcgccg

SEQ ID NO: 1445841 - RNA, 20 nt, Pseudomonas aeruginosa PA01
cgcaaagcgagcgcccgccg

SEQ ID NO: 1445842 - RNA, 23 nt, Pseudomonas aeruginosa PA01
cgcaaagcgagcgcccgccguca

SEQ ID NO: 1445843 - RNA, 15 nt, Pseudomonas aeruginosa PA01
cgcaaaggucggcga

SEQ ID NO: 1445844 - RNA, 17 nt, Pseudomonas aeruginosa PA01
cgcaaaggucggcgaag

SEQ ID NO: 1445845 - RNA, 19 nt, Pseudomonas aeruginosa PA01
cgcaaagcucgcgcaagcg

SEQ ID NO: 1445846 - RNA, 19 nt, Pseudomonas aeruginosa PA01
cgcaacgcuuccagcaccu

SEQ ID NO: 1445847 - RNA, 15 nt, Pseudomonas aeruginosa PA01
cgcaacgcgcgcagg

SEQ ID NO: 1445848 - RNA, 17 nt, Pseudomonas aeruginosa PA01
cgcaacgcgcgcaggac

SEQ ID NO: 1445849 - RNA, 21 nt, Pseudomonas aeruginosa PA01
cgcaacgcgguuauccgccgc

SEQ ID NO: 1445850 - RNA, 23 nt, Pseudomonas aeruginosa PA01
cgcaacgcgguuauccgccgcug

SEQ ID NO: 1445851 - RNA, 12 nt, Pseudomonas aeruginosa PA01
cgcaacugccgg

SEQ ID NO: 1445852 - RNA, 15 nt, Pseudomonas aeruginosa PA01
cgcaacugcgccagc

SEQ ID NO: 1445853 - RNA, 16 nt, Pseudomonas aeruginosa PA01
cgcaacugcgccagcc

SEQ ID NO: 1445854 - RNA, 17 nt, Pseudomonas aeruginosa PA01
cgcaacugcgccagccg

SEQ ID NO: 1445855 - RNA, 19 nt, Pseudomonas aeruginosa PA01
cgcaacaccuugcgcaccg

SEQ ID NO: 1445856 - RNA, 21 nt, Pseudomonas aeruginosa PA01
cgcaacgggacgccaggcguc

SEQ ID NO: 1445857 - RNA, 14 nt, Pseudomonas aeruginosa PA01
cgcaacgggcggcg

SEQ ID NO: 1445858 - RNA, 18 nt, Pseudomonas aeruginosa PA01
cgcaagcgcucggccugc

SEQ ID NO: 1445859 - RNA, 19 nt, Pseudomonas aeruginosa PA01
cgcaagcgcucggccugcg

SEQ ID NO: 1445860 - RNA, 23 nt, Pseudomonas aeruginosa PA01
cgcaagcggcggcuucagccaga

SEQ ID NO: 1445861 - RNA, 21 nt, Pseudomonas aeruginosa PA01
cgcaagccauuccaacuggcg

SEQ ID NO: 1445862 - RNA, 15 nt, Pseudomonas aeruginosa PA01
cgcaagcgcccggcg

SEQ ID NO: 1445863 - RNA, 14 nt, Pseudomonas aeruginosa PA01
cgauggccagcgcg

SEQ ID NO: 1445864 - RNA, 13 nt, Pseudomonas aeruginosa PA01
cgauggccagggg

SEQ ID NO: 1445865 - RNA, 22 nt, Pseudomonas aeruginosa PA01
cgauggcccagaugaucaggcc

SEQ ID NO: 1445866 - RNA, 12 nt, Pseudomonas aeruginosa PA01
cgauggccccgg

SEQ ID NO: 1445867 - RNA, 15 nt, Pseudomonas aeruginosa PA01
cgauggccccggcga

SEQ ID NO: 1445868 - RNA, 16 nt, Pseudomonas aeruginosa PA01
cgauggccccggcgau

SEQ ID NO: 1445869 - RNA, 17 nt, Pseudomonas aeruginosa PA01
cgauggccccggcgauc

SEQ ID NO: 1445870 - RNA, 20 nt, Pseudomonas aeruginosa PA01
cgaugcugccguagcgcuuc

SEQ ID NO: 1445871 - RNA, 22 nt, Pseudomonas aeruginosa PA01
cgaugcugaucacccgcccgcc

SEQ ID NO: 1445872 - RNA, 18 nt, Pseudomonas aeruginosa PA01
cgaugcugaucuucuguc

SEQ ID NO: 1445873 - RNA, 15 nt, Pseudomonas aeruginosa PA01
cgaugcucagcgccg

SEQ ID NO: 1445874 - RNA, 21 nt, Pseudomonas aeruginosa PA01
cgaugcguuugucgaccugcc

SEQ ID NO: 1445875 - RNA, 13 nt, Pseudomonas aeruginosa PA01
cgaugcucgcgcc

SEQ ID NO: 1445876 - RNA, 22 nt, Pseudomonas aeruginosa PA01
cgaugcucgcgccagccccagg

SEQ ID NO: 1445877 - RNA, 20 nt, Pseudomonas aeruginosa PA01
cgaugcucgguugccaggcc

SEQ ID NO: 1445878 - RNA, 18 nt, Pseudomonas aeruginosa PA01
cgaugcucauccugcccg

SEQ ID NO: 1445879 - RNA, 13 nt, Pseudomonas aeruginosa PA01
cgauuucgcugcg

SEQ ID NO: 1445880 - RNA, 14 nt, Pseudomonas aeruginosa PA01
cgauuucgcugcgc

SEQ ID NO: 1445881 - RNA, 20 nt, Pseudomonas aeruginosa PA01
cgauggcccguuccaccgcc

SEQ ID NO: 1445882 - RNA, 11 nt, Pseudomonas aeruginosa PA01
cgauggccgcc

SEQ ID NO: 1445883 - RNA, 16 nt, Pseudomonas aeruginosa PA01
cgcaauggcgcagccg

SEQ ID NO: 1445884 - RNA, 20 nt, Pseudomonas aeruginosa PA01
cgcaaugaaagagccccucu

SEQ ID NO: 1445885 - RNA, 21 nt, Pseudomonas aeruginosa PA01
cgcaauagugcagcuccaccg

SEQ ID NO: 1445886 - RNA, 22 nt, Pseudomonas aeruginosa PA01
cgcaaucagggcugggcgcccu

SEQ ID NO: 1445887 - RNA, 18 nt, Pseudomonas aeruginosa PA01
cgcaauccgccgcucccg

SEQ ID NO: 1445888 - RNA, 22 nt, Pseudomonas aeruginosa PA01
cgcaauccucggugcgcacgca

SEQ ID NO: 1445889 - RNA, 20 nt, Pseudomonas aeruginosa PA01
cgcaagcgguuauucgcccc

SEQ ID NO: 1445890 - RNA, 16 nt, Pseudomonas aeruginosa PA01
cgcaagcuccccgccg

SEQ ID NO: 1445891 - RNA, 19 nt, Pseudomonas aeruginosa PA01
cgcaagcuccccgccgcca

SEQ ID NO: 1445892 - RNA, 18 nt, Pseudomonas aeruginosa PA01
cgcaaggaacuggaagcc

SEQ ID NO: 1445893 - RNA, 17 nt, Pseudomonas aeruginosa PA01
cgcaaggcagcguccga

SEQ ID NO: 1445894 - RNA, 16 nt, Pseudomonas aeruginosa PA01
cgcaaggccagcggca

SEQ ID NO: 1445895 - RNA, 21 nt, Pseudomonas aeruginosa PA01
cgcaaggccagggcggcgccg

SEQ ID NO: 1445896 - RNA, 22 nt, Pseudomonas aeruginosa PA01
cgcaaggccagggcggcgccga

SEQ ID NO: 1445897 - RNA, 14 nt, Pseudomonas aeruginosa PA01
cgcaagggcgccgc

SEQ ID NO: 1445898 - RNA, 16 nt, Pseudomonas aeruginosa PA01
cgcaagggcgccgccg

SEQ ID NO: 1445899 - RNA, 19 nt, Pseudomonas aeruginosa PA01
cgcaagggcgccgccgacg

SEQ ID NO: 1445900 - RNA, 17 nt, Pseudomonas aeruginosa PA01
cgcaaguuacgcgcagc

SEQ ID NO: 1445901 - RNA, 15 nt, Pseudomonas aeruginosa PA01
cgcaaguggcggcug

SEQ ID NO: 1445902 - RNA, 16 nt, Pseudomonas aeruginosa PA01
cgcaaguggcggcuga

SEQ ID NO: 1445903 - RNA, 19 nt, Pseudomonas aeruginosa PA01
cgcaagucggccugcacca

SEQ ID NO: 1445904 - RNA, 22 nt, Pseudomonas aeruginosa PA01
cgcaagucggccugcaccagcc

SEQ ID NO: 1445905 - RNA, 15 nt, Pseudomonas aeruginosa PA01
cgcaauacaccgcug

SEQ ID NO: 1445906 - RNA, 20 nt, Pseudomonas aeruginosa PA01
cgcaauacaccgcugcgccg

SEQ ID NO: 1445907 - RNA, 23 nt, Pseudomonas aeruginosa PA01
cgcaauacaccgcugcgccgccg

SEQ ID NO: 1445908 - RNA, 21 nt, Pseudomonas aeruginosa PA01
cgcacaguugcgcgccggcgg

SEQ ID NO: 1445909 - RNA, 19 nt, Pseudomonas aeruginosa PA01
cgcacagguagaggucgaa

SEQ ID NO: 1445910 - RNA, 16 nt, Pseudomonas aeruginosa PA01
cgcacaggcuggccag

SEQ ID NO: 1445911 - RNA, 13 nt, Pseudomonas aeruginosa PA01
cgcacaucacccg

SEQ ID NO: 1445912 - RNA, 15 nt, Pseudomonas aeruginosa PA01
cgcacaucacccggu

SEQ ID NO: 1445913 - RNA, 17 nt, Pseudomonas aeruginosa PA01
cgcacaaaaaagcccgc

SEQ ID NO: 1445914 - RNA, 21 nt, Pseudomonas aeruginosa PA01
cgcacaccgucgaaccagccg

SEQ ID NO: 1445915 - RNA, 19 nt, Pseudomonas aeruginosa PA01
cgccaaccacuccgccacc

SEQ ID NO: 1445916 - RNA, 17 nt, Pseudomonas aeruginosa PA01
cgccaaccaggaaggcg

SEQ ID NO: 1445917 - RNA, 14 nt, Pseudomonas aeruginosa PA01
cgccacacauccag

SEQ ID NO: 1445918 - RNA, 17 nt, Pseudomonas aeruginosa PA01
cgccacacauccagugu

SEQ ID NO: 1445919 - RNA, 16 nt, Pseudomonas aeruginosa PA01
cgccaacgcgccgucg

SEQ ID NO: 1445920 - RNA, 19 nt, Pseudomonas aeruginosa PA01
cgccaacgcgccgucgcga

SEQ ID NO: 1445921 - RNA, 14 nt, Pseudomonas aeruginosa PA01
cgccaacgccaccg

SEQ ID NO: 1445922 - RNA, 11 nt, Pseudomonas aeruginosa PA01
cgcaugucgcg

SEQ ID NO: 1445923 - RNA, 12 nt, Pseudomonas aeruginosa PA01
cgcaugucgcga

SEQ ID NO: 1445924 - RNA, 16 nt, Pseudomonas aeruginosa PA01
cgcauggcucguucgu

SEQ ID NO: 1445925 - RNA, 20 nt, Pseudomonas aeruginosa PA01
cgcauggcguucugcgacau

SEQ ID NO: 1445926 - RNA, 20 nt, Pseudomonas aeruginosa PA01
cgccaccccgcuccgcucag

SEQ ID NO: 1445927 - RNA, 14 nt, Pseudomonas aeruginosa PA01
cgccacccgcaucg

SEQ ID NO: 1445928 - RNA, 22 nt, Pseudomonas aeruginosa PA01
cgccaccaaccacaaccagcca

SEQ ID NO: 1445929 - RNA, 17 nt, Pseudomonas aeruginosa PA01
cgccaccccgccgcgca

SEQ ID NO: 1445930 - RNA, 16 nt, Pseudomonas aeruginosa PA01
cgccaccccgccgcug

SEQ ID NO: 1445931 - RNA, 16 nt, Pseudomonas aeruginosa PA01
cgccaccccgccggcg

SEQ ID NO: 1445932 - RNA, 17 nt, Pseudomonas aeruginosa PA01
cgccaccccgccggcgu

SEQ ID NO: 1445933 - RNA, 18 nt, Pseudomonas aeruginosa PA01
cgccaccccgccggcguu

SEQ ID NO: 1445934 - RNA, 19 nt, Pseudomonas aeruginosa PA01
cgccaccgauagcggcgcg

SEQ ID NO: 1445935 - RNA, 18 nt, Pseudomonas aeruginosa PA01
cgccaccgacccucggcg

SEQ ID NO: 1445936 - RNA, 17 nt, Pseudomonas aeruginosa PA01
cgccacccgcuccggcu

SEQ ID NO: 1445937 - RNA, 17 nt, Pseudomonas aeruginosa PA01
cgccacccucggcuucg

SEQ ID NO: 1445938 - RNA, 21 nt, Pseudomonas aeruginosa PA01
cgccacccucggcuucguccu

SEQ ID NO: 1445939 - RNA, 14 nt, Pseudomonas aeruginosa PA01
cgccacccguuccu

SEQ ID NO: 1445940 - RNA, 18 nt, Pseudomonas aeruginosa PA01
cgccacccguuccuugcg

SEQ ID NO: 1445941 - RNA, 20 nt, Pseudomonas aeruginosa PA01
cgccacccguuccuugcgcg

SEQ ID NO: 1445942 - RNA, 21 nt, Pseudomonas aeruginosa PA01
cgccacaggcguuauccgccg

SEQ ID NO: 1445943 - RNA, 23 nt, Pseudomonas aeruginosa PA01
cgccacaggcguuauccgccgau

SEQ ID NO: 1445944 - RNA, 14 nt, Pseudomonas aeruginosa PA01
cgccacagaucgcc

SEQ ID NO: 1445945 - RNA, 18 nt, Pseudomonas aeruginosa PA01
cgccacagaucgccagcu

SEQ ID NO: 1445946 - RNA, 21 nt, Pseudomonas aeruginosa PA01
cgccacagaucgccagcucgc

SEQ ID NO: 1445947 - RNA, 22 nt, Pseudomonas aeruginosa PA01
cgccacacggcuaucaggugag

SEQ ID NO: 1445948 - RNA, 23 nt, Pseudomonas aeruginosa PA01
cgcaucccaguagccggucaggc

SEQ ID NO: 1445949 - RNA, 15 nt, Pseudomonas aeruginosa PA01
cgcauccucguucca

SEQ ID NO: 1445950 - RNA, 12 nt, Pseudomonas aeruginosa PA01
cgcaucgaaggc

SEQ ID NO: 1445951 - RNA, 17 nt, Pseudomonas aeruginosa PA01
cgcaucgaaggcgccgg

SEQ ID NO: 1445952 - RNA, 20 nt, Pseudomonas aeruginosa PA01
cgcaucgaaggcgccggcau

SEQ ID NO: 1445953 - RNA, 20 nt, Pseudomonas aeruginosa PA01
cgcaucgaccuugcccucgg

SEQ ID NO: 1445954 - RNA, 22 nt, Pseudomonas aeruginosa PA01
cgcaucgaccuugcccucggcg

SEQ ID NO: 1445955 - RNA, 13 nt, Pseudomonas aeruginosa PA01
cgcaucgaggccg

SEQ ID NO: 1445956 - RNA, 14 nt, Pseudomonas aeruginosa PA01
cgcaucgaggccgc

SEQ ID NO: 1445957 - RNA, 19 nt, Pseudomonas aeruginosa PA01
cgcaucgaggccgcccagc

SEQ ID NO: 1445958 - RNA, 16 nt, Pseudomonas aeruginosa PA01
cgcaucgaggccggca

SEQ ID NO: 1445959 - RNA, 19 nt, Pseudomonas aeruginosa PA01
cgcaucgccugggccggcg

SEQ ID NO: 1445960 - RNA, 13 nt, Pseudomonas aeruginosa PA01
cgcaucgccaccg

SEQ ID NO: 1445961 - RNA, 17 nt, Pseudomonas aeruginosa PA01
cgcaucgcgcacaugcc

SEQ ID NO: 1445962 - RNA, 19 nt, Pseudomonas aeruginosa PA01
cgcaucgcgcacaugccga

SEQ ID NO: 1445963 - RNA, 20 nt, Pseudomonas aeruginosa PA01
cgcaucgcgcacaugccgag

SEQ ID NO: 1445964 - RNA, 18 nt, Pseudomonas aeruginosa PA01
cgcaucgcgggcgugcuc

SEQ ID NO: 1445965 - RNA, 21 nt, Pseudomonas aeruginosa PA01
cgcaucgcgggcgugcuccag

SEQ ID NO: 1445966 - RNA, 22 nt, Pseudomonas aeruginosa PA01
cgcaucgcgguuauccgccggc

SEQ ID NO: 1445967 - RNA, 22 nt, Pseudomonas aeruginosa PA01
cgcaucgcggacaccgcggugu

SEQ ID NO: 1445968 - RNA, 14 nt, Pseudomonas aeruginosa PA01
cgcaucggccgaca

SEQ ID NO: 1445969 - RNA, 21 nt, Pseudomonas aeruginosa PA01
cgcaucggccgacagagcggc

SEQ ID NO: 1445970 - RNA, 21 nt, Pseudomonas aeruginosa PA01
cgcaugccaucuuccugugcg

SEQ ID NO: 1445971 - RNA, 15 nt, Pseudomonas aeruginosa PA01
cgcaugcccagggcc

SEQ ID NO: 1445972 - RNA, 18 nt, Pseudomonas aeruginosa PA01
cgcaugccguuggccgag

SEQ ID NO: 1445973 - RNA, 14 nt, Pseudomonas aeruginosa PA01
cgcaugcgccggcu

SEQ ID NO: 1445974 - RNA, 13 nt, Pseudomonas aeruginosa PA01
cgcaugcgcggcg

SEQ ID NO: 1445975 - RNA, 15 nt, Pseudomonas aeruginosa PA01
cgcauggacaggucg

SEQ ID NO: 1445976 - RNA, 18 nt, Pseudomonas aeruginosa PA01
cgcauggacaggucgacg

SEQ ID NO: 1445977 - RNA, 20 nt, Pseudomonas aeruginosa PA01
cgcauggagacggcccgccc

SEQ ID NO: 1445978 - RNA, 19 nt, Pseudomonas aeruginosa PA01
cgcauggcgaccugguggc

SEQ ID NO: 1445979 - RNA, 20 nt, Pseudomonas aeruginosa PA01
cgcaucguuggcgccguccu

SEQ ID NO: 1445980 - RNA, 12 nt, Pseudomonas aeruginosa PA01
cgcaucgucgaa

SEQ ID NO: 1445981 - RNA, 20 nt, Pseudomonas aeruginosa PA01
cgcaucgucgaugcguccgc

SEQ ID NO: 1445982 - RNA, 12 nt, Pseudomonas aeruginosa PA01
cgcaucggcgga

SEQ ID NO: 1445983 - RNA, 18 nt, Pseudomonas aeruginosa PA01
cgcaugaucgccucggcg

SEQ ID NO: 1445984 - RNA, 23 nt, Pseudomonas aeruginosa PA01
cgcaugaccuucagcaccugcgc

SEQ ID NO: 1445985 - RNA, 14 nt, Pseudomonas aeruginosa PA01
cgcaggcagcgcgc

SEQ ID NO: 1445986 - RNA, 17 nt, Pseudomonas aeruginosa PA01
cgcaggcagcgcgcguc

SEQ ID NO: 1445987 - RNA, 20 nt, Pseudomonas aeruginosa PA01
cgcaggcaguggcgccagcc

SEQ ID NO: 1445988 - RNA, 14 nt, Pseudomonas aeruginosa PA01
cgcaggccagcgcc

SEQ ID NO: 1445989 - RNA, 16 nt, Pseudomonas aeruginosa PA01
cgcaggccagcgccag

SEQ ID NO: 1445990 - RNA, 14 nt, Pseudomonas aeruginosa PA01
cgcaggccaggccc

SEQ ID NO: 1445991 - RNA, 13 nt, Pseudomonas aeruginosa PA01
cgcaggccgccgg

SEQ ID NO: 1445992 - RNA, 14 nt, Pseudomonas aeruginosa PA01
cgcaggccgccggc

SEQ ID NO: 1445993 - RNA, 13 nt, Pseudomonas aeruginosa PA01
cgcagggcagcgc

SEQ ID NO: 1445994 - RNA, 14 nt, Pseudomonas aeruginosa PA01
cgcagggcagcgcg

SEQ ID NO: 1445995 - RNA, 16 nt, Pseudomonas aeruginosa PA01
cgcagggcagcgcgau

SEQ ID NO: 1445996 - RNA, 20 nt, Pseudomonas aeruginosa PA01
cgcagggccagggcggcggc

SEQ ID NO: 1445997 - RNA, 13 nt, Pseudomonas aeruginosa PA01
cgcagggcaucga

SEQ ID NO: 1445998 - RNA, 14 nt, Pseudomonas aeruginosa PA01
cgcagggcaucgac

SEQ ID NO: 1445999 - RNA, 16 nt, Pseudomonas aeruginosa PA01
cgcagggcaucgauga

SEQ ID NO: 1446000 - RNA, 22 nt, Pseudomonas aeruginosa PA01
cgcagggcaucgaugaccuucg

SEQ ID NO: 1446001 - RNA, 22 nt, Pseudomonas aeruginosa PA01
cgcaggcuuucguaggcaggcg

SEQ ID NO: 1446002 - RNA, 23 nt, Pseudomonas aeruginosa PA01
cgcaggcuuucguaggcaggcgc

SEQ ID NO: 1446003 - RNA, 15 nt, Pseudomonas aeruginosa PA01
cgcaggcugguaugc

SEQ ID NO: 1446004 - RNA, 20 nt, Pseudomonas aeruginosa PA01
cgcaggcugguaugcagcaa

SEQ ID NO: 1446005 - RNA, 16 nt, Pseudomonas aeruginosa PA01
cgcaggccgaccucgg

SEQ ID NO: 1446006 - RNA, 17 nt, Pseudomonas aeruginosa PA01
cgcaggccgaccucggc

SEQ ID NO: 1446007 - RNA, 18 nt, Pseudomonas aeruginosa PA01
cgcaggccgaccucggcg

SEQ ID NO: 1446008 - RNA, 18 nt, Pseudomonas aeruginosa PA01
cgcaggucuugucgcggg

SEQ ID NO: 1446009 - RNA, 20 nt, Pseudomonas aeruginosa PA01
cgcagguugagggccgcgcu

SEQ ID NO: 1446010 - RNA, 22 nt, Pseudomonas aeruginosa PA01
cgcagguugagggccgcgcugc

SEQ ID NO: 1446011 - RNA, 15 nt, Pseudomonas aeruginosa PA01
cgcagguucaucgcc

SEQ ID NO: 1446012 - RNA, 17 nt, Pseudomonas aeruginosa PA01
cgcagguucaucgccgc

SEQ ID NO: 1446013 - RNA, 19 nt, Pseudomonas aeruginosa PA01
cgcagguucaucgccgcca

SEQ ID NO: 1446014 - RNA, 14 nt, Pseudomonas aeruginosa PA01
cgcaggugcaccgc

SEQ ID NO: 1446015 - RNA, 19 nt, Pseudomonas aeruginosa PA01
cgcaggugcuuggcaccgc

SEQ ID NO: 1446016 - RNA, 13 nt, Pseudomonas aeruginosa PA01
cgcagggcggcga

SEQ ID NO: 1446017 - RNA, 13 nt, Pseudomonas aeruginosa PA01
cgcagggcggcgc

SEQ ID NO: 1446018 - RNA, 14 nt, Pseudomonas aeruginosa PA01
cgcagggcggcgcc

SEQ ID NO: 1446019 - RNA, 18 nt, Pseudomonas aeruginosa PA01
cgcaggcugucggccagc

SEQ ID NO: 1446020 - RNA, 22 nt, Pseudomonas aeruginosa PA01
cgcaggcugucggccagccccu

SEQ ID NO: 1446021 - RNA, 14 nt, Pseudomonas aeruginosa PA01
cgcaggucggccuc

SEQ ID NO: 1446022 - RNA, 17 nt, Pseudomonas aeruginosa PA01
cgcaggucggccucggc

SEQ ID NO: 1446023 - RNA, 18 nt, Pseudomonas aeruginosa PA01
cgcaggucggccucggcg

SEQ ID NO: 1446024 - RNA, 19 nt, Pseudomonas aeruginosa PA01
cgcaggucggccucggcga

SEQ ID NO: 1446025 - RNA, 15 nt, Pseudomonas aeruginosa PA01
cgcaggucggcgucu

SEQ ID NO: 1446026 - RNA, 23 nt, Pseudomonas aeruginosa PA01
cgcagggcguucuucacccgcag

SEQ ID NO: 1446027 - RNA, 22 nt, Pseudomonas aeruginosa PA01
cgcagggcuauguauucggcgg

SEQ ID NO: 1446028 - RNA, 15 nt, Pseudomonas aeruginosa PA01
cgcaggucgcugucg

SEQ ID NO: 1446029 - RNA, 22 nt, Pseudomonas aeruginosa PA01
cgcagggcgguacgccgcgcug

SEQ ID NO: 1446030 - RNA, 13 nt, Pseudomonas aeruginosa PA01
cgcagggcgucga

SEQ ID NO: 1446031 - RNA, 21 nt, Pseudomonas aeruginosa PA01
cgcagcccgguccguccagcg

SEQ ID NO: 1446032 - RNA, 18 nt, Pseudomonas aeruginosa PA01
cgcagcccuugcaaccgc

SEQ ID NO: 1446033 - RNA, 21 nt, Pseudomonas aeruginosa PA01
cgcagcccuugcaaccgccgc

SEQ ID NO: 1446034 - RNA, 20 nt, Pseudomonas aeruginosa PA01
cgcagccauucgccgcgacg

SEQ ID NO: 1446035 - RNA, 14 nt, Pseudomonas aeruginosa PA01
cgcagccccgccgg

SEQ ID NO: 1446036 - RNA, 20 nt, Pseudomonas aeruginosa PA01
cgcagccccgccggaagacg

SEQ ID NO: 1446037 - RNA, 15 nt, Pseudomonas aeruginosa PA01
cgcagccgggccgca

SEQ ID NO: 1446038 - RNA, 14 nt, Pseudomonas aeruginosa PA01
cgcagccggcgaac

SEQ ID NO: 1446039 - RNA, 12 nt, Pseudomonas aeruginosa PA01
cgcagccggcgg

SEQ ID NO: 1446040 - RNA, 13 nt, Pseudomonas aeruginosa PA01
cgcagccggcggc

SEQ ID NO: 1446041 - RNA, 13 nt, Pseudomonas aeruginosa PA01
cgcagccucgcgc

SEQ ID NO: 1446042 - RNA, 14 nt, Pseudomonas aeruginosa PA01
cgcagccguggcgc

SEQ ID NO: 1446043 - RNA, 20 nt, Pseudomonas aeruginosa PA01
cgcagccguuggccagcagg

SEQ ID NO: 1446044 - RNA, 21 nt, Pseudomonas aeruginosa PA01
cgcagccguuggccagcaggc

SEQ ID NO: 1446045 - RNA, 21 nt, Pseudomonas aeruginosa PA01
cgcagccgguggucuucagca

SEQ ID NO: 1446046 - RNA, 14 nt, Pseudomonas aeruginosa PA01
cgcaggaaggcgaa

SEQ ID NO: 1446047 - RNA, 13 nt, Pseudomonas aeruginosa PA01
cgcagccuuggca

SEQ ID NO: 1446048 - RNA, 15 nt, Pseudomonas aeruginosa PA01
cgcaggagucgacga

SEQ ID NO: 1446049 - RNA, 16 nt, Pseudomonas aeruginosa PA01
cgcaggagucgacgaa

SEQ ID NO: 1446050 - RNA, 22 nt, Pseudomonas aeruginosa PA01
cgcaggacggauaacggcagcc

SEQ ID NO: 1446051 - RNA, 13 nt, Pseudomonas aeruginosa PA01
cgcagcgaacggg

SEQ ID NO: 1446052 - RNA, 23 nt, Pseudomonas aeruginosa PA01
cgcaggaccagacgcggauuggc

SEQ ID NO: 1446053 - RNA, 12 nt, Pseudomonas aeruginosa PA01
cgcaggaccgcc

SEQ ID NO: 1446054 - RNA, 18 nt, Pseudomonas aeruginosa PA01
cgcaggacgaggaaggcg

SEQ ID NO: 1446055 - RNA, 18 nt, Pseudomonas aeruginosa PA01
cgcaggaugccgccugcg

SEQ ID NO: 1446056 - RNA, 13 nt, Pseudomonas aeruginosa PA01
cgcaggcagaacg

SEQ ID NO: 1446057 - RNA, 22 nt, Pseudomonas aeruginosa PA01
cgcaggcagcacaugccacgca

SEQ ID NO: 1446058 - RNA, 22 nt, Pseudomonas aeruginosa PA01
cgcaucaggucggucuggcggc

SEQ ID NO: 1446059 - RNA, 14 nt, Pseudomonas aeruginosa PA01
cgcauccaccagcg

SEQ ID NO: 1446060 - RNA, 20 nt, Pseudomonas aeruginosa PA01
cgcauaaccgcuugcgguua

SEQ ID NO: 1446061 - RNA, 15 nt, Pseudomonas aeruginosa PA01
cgcauaacgccaacg

SEQ ID NO: 1446062 - RNA, 18 nt, Pseudomonas aeruginosa PA01
cgcauaacgccaacggcg

SEQ ID NO: 1446063 - RNA, 16 nt, Pseudomonas aeruginosa PA01
cgcauagccaccgccg

SEQ ID NO: 1446064 - RNA, 19 nt, Pseudomonas aeruginosa PA01
cgcauagccaccgccgaca

SEQ ID NO: 1446065 - RNA, 13 nt, Pseudomonas aeruginosa PA01
cgcauagccggcg

SEQ ID NO: 1446066 - RNA, 15 nt, Pseudomonas aeruginosa PA01
cgcauagccggcgcg

SEQ ID NO: 1446067 - RNA, 18 nt, Pseudomonas aeruginosa PA01
cgcauagccggcgcgccc

SEQ ID NO: 1446068 - RNA, 21 nt, Pseudomonas aeruginosa PA01
cgcauagccggcgcgcccggc

SEQ ID NO: 1446069 - RNA, 23 nt, Pseudomonas aeruginosa PA01
cgcauaggucaugcccaggccga

SEQ ID NO: 1446070 - RNA, 13 nt, Pseudomonas aeruginosa PA01
cgcauagucgcga

SEQ ID NO: 1446071 - RNA, 14 nt, Pseudomonas aeruginosa PA01
cgcauagucgcgau

SEQ ID NO: 1446072 - RNA, 18 nt, Pseudomonas aeruginosa PA01
cgcauaggcggccagccu

SEQ ID NO: 1446073 - RNA, 14 nt, Pseudomonas aeruginosa PA01
cgcauagcugaucu

SEQ ID NO: 1446074 - RNA, 19 nt, Pseudomonas aeruginosa PA01
cgcauagcugaucucggcg

SEQ ID NO: 1446075 - RNA, 19 nt, Pseudomonas aeruginosa PA01
cgcauagcgcgcuguagcc

SEQ ID NO: 1446076 - RNA, 14 nt, Pseudomonas aeruginosa PA01
cgcagucuucucgg

SEQ ID NO: 1446077 - RNA, 14 nt, Pseudomonas aeruginosa PA01
cgcaguucgucgcc

SEQ ID NO: 1446078 - RNA, 16 nt, Pseudomonas aeruginosa PA01
cgcaguucgccccgcc

SEQ ID NO: 1446079 - RNA, 13 nt, Pseudomonas aeruginosa PA01
cgcaguucgccgc

SEQ ID NO: 1446080 - RNA, 23 nt, Pseudomonas aeruginosa PA01
cgcaguuguuccucgcggcucac

SEQ ID NO: 1446081 - RNA, 16 nt, Pseudomonas aeruginosa PA01
cgcaguuccucgccgc

SEQ ID NO: 1446082 - RNA, 18 nt, Pseudomonas aeruginosa PA01
cgcaguuccucgccgcug

SEQ ID NO: 1446083 - RNA, 19 nt, Pseudomonas aeruginosa PA01
cgcaguuccucgccgcugc

SEQ ID NO: 1446084 - RNA, 15 nt, Pseudomonas aeruginosa PA01
cgcaguucgccgccg

SEQ ID NO: 1446085 - RNA, 16 nt, Pseudomonas aeruginosa PA01
cgcaguucgccgccga

SEQ ID NO: 1446086 - RNA, 17 nt, Pseudomonas aeruginosa PA01
cgcaguucgccgccgag

SEQ ID NO: 1446087 - RNA, 18 nt, Pseudomonas aeruginosa PA01
cgcaguucgccgccgagc

SEQ ID NO: 1446088 - RNA, 16 nt, Pseudomonas aeruginosa PA01
cgcaguagcuggaucu

SEQ ID NO: 1446089 - RNA, 22 nt, Pseudomonas aeruginosa PA01
cgcaguagcuggaucugguuga

SEQ ID NO: 1446090 - RNA, 15 nt, Pseudomonas aeruginosa PA01
cgcaguagucgaccg

SEQ ID NO: 1446091 - RNA, 16 nt, Pseudomonas aeruginosa PA01
cgcaguagucgaccgg

SEQ ID NO: 1446092 - RNA, 15 nt, Pseudomonas aeruginosa PA01
cgcaguacccggccg

SEQ ID NO: 1446093 - RNA, 16 nt, Pseudomonas aeruginosa PA01
cgcaguacccggccgc

SEQ ID NO: 1446094 - RNA, 19 nt, Pseudomonas aeruginosa PA01
cgcaguacgaucagccagg

SEQ ID NO: 1446095 - RNA, 16 nt, Pseudomonas aeruginosa PA01
cgcaguagaugccgcg

SEQ ID NO: 1446096 - RNA, 21 nt, Pseudomonas aeruginosa PA01
cgcaguagaugccgcgucggc

SEQ ID NO: 1446097 - RNA, 15 nt, Pseudomonas aeruginosa PA01
cgcagguuggccccg

SEQ ID NO: 1446098 - RNA, 17 nt, Pseudomonas aeruginosa PA01
cgcagguuggccccgcc

SEQ ID NO: 1446099 - RNA, 21 nt, Pseudomonas aeruginosa PA01
cgcagguuggccccgccgagg

SEQ ID NO: 1446100 - RNA, 22 nt, Pseudomonas aeruginosa PA01
cgcagguuggccccgccgagga

SEQ ID NO: 1446101 - RNA, 15 nt, Pseudomonas aeruginosa PA01
cgcaguacagcucgg

SEQ ID NO: 1446102 - RNA, 18 nt, Pseudomonas aeruginosa PA01
cgcaguacagcucggcgc

SEQ ID NO: 1446103 - RNA, 19 nt, Pseudomonas aeruginosa PA01
cgcaguacagcugcaccgc

SEQ ID NO: 1446104 - RNA, 21 nt, Pseudomonas aeruginosa PA01
cgcaguacagcugcaccgcgc

SEQ ID NO: 1446105 - RNA, 20 nt, Pseudomonas aeruginosa PA01
cgcaguccgguagcgcgccu

SEQ ID NO: 1446106 - RNA, 14 nt, Pseudomonas aeruginosa PA01
cgcagucguagcgc

SEQ ID NO: 1446107 - RNA, 15 nt, Pseudomonas aeruginosa PA01
cgcaguccagggcga

SEQ ID NO: 1446108 - RNA, 13 nt, Pseudomonas aeruginosa PA01
cgcagucccgcgc

SEQ ID NO: 1446109 - RNA, 14 nt, Pseudomonas aeruginosa PA01
ccguuucgccgccg

SEQ ID NO: 1446110 - RNA, 16 nt, Pseudomonas aeruginosa PA01
ccguuguucaggcgcg

SEQ ID NO: 1446111 - RNA, 14 nt, Pseudomonas aeruginosa PA01
ccguuguggcggcg

SEQ ID NO: 1446112 - RNA, 22 nt, Pseudomonas aeruginosa PA01
ccguugugcagguacggcgccg

SEQ ID NO: 1446113 - RNA, 21 nt, Pseudomonas aeruginosa PA01
ccguuuuuccuuguggcgguu

SEQ ID NO: 1446114 - RNA, 16 nt, Pseudomonas aeruginosa PA01
ccguuugccgucggcg

SEQ ID NO: 1446115 - RNA, 15 nt, Pseudomonas aeruginosa PA01
ccguuggucaacggc

SEQ ID NO: 1446116 - RNA, 16 nt, Pseudomonas aeruginosa PA01
ccguuggucaacggcg

SEQ ID NO: 1446117 - RNA, 19 nt, Pseudomonas aeruginosa PA01
ccguuguagaucggcagca

SEQ ID NO: 1446118 - RNA, 20 nt, Pseudomonas aeruginosa PA01
ccguuggcgcgggcgaaggc

SEQ ID NO: 1446119 - RNA, 19 nt, Pseudomonas aeruginosa PA01
ccguuggcgucaacgguga

SEQ ID NO: 1446120 - RNA, 16 nt, Pseudomonas aeruginosa PA01
ccguuggcgucgcgca

SEQ ID NO: 1446121 - RNA, 11 nt, Pseudomonas aeruginosa PA01
ccguuggccuu

SEQ ID NO: 1446122 - RNA, 23 nt, Pseudomonas aeruginosa PA01
ccguuggcgaacuucaggccggc

SEQ ID NO: 1446123 - RNA, 16 nt, Pseudomonas aeruginosa PA01
ccguuggccagcaggc

SEQ ID NO: 1446124 - RNA, 18 nt, Pseudomonas aeruginosa PA01
ccguugccuucgccgucg

SEQ ID NO: 1446125 - RNA, 20 nt, Pseudomonas aeruginosa PA01
ccguugcgccucgccgcccg

SEQ ID NO: 1446126 - RNA, 13 nt, Pseudomonas aeruginosa PA01
ccguugcggcagc

SEQ ID NO: 1446127 - RNA, 21 nt, Pseudomonas aeruginosa PA01
ccuaccagaccgcagccggcg

SEQ ID NO: 1446128 - RNA, 21 nt, Pseudomonas aeruginosa PA01
ccuacgcaacccgcccggcuc

SEQ ID NO: 1446129 - RNA, 19 nt, Pseudomonas aeruginosa PA01
ccuacugggcguggcggcc

SEQ ID NO: 1446130 - RNA, 15 nt, Pseudomonas aeruginosa PA01
ccuaccggcgccgcc

SEQ ID NO: 1446131 - RNA, 16 nt, Pseudomonas aeruginosa PA01
ccuaccggcgccgccc

SEQ ID NO: 1446132 - RNA, 19 nt, Pseudomonas aeruginosa PA01
ccuacaaugauggcccuuc

SEQ ID NO: 1446133 - RNA, 16 nt, Pseudomonas aeruginosa PA01
ccuaccgcccacccug

SEQ ID NO: 1446134 - RNA, 15 nt, Pseudomonas aeruginosa PA01
ccuacggaccggugc

SEQ ID NO: 1446135 - RNA, 22 nt, Pseudomonas aeruginosa PA01
ccuacggaccggugccccgcug

SEQ ID NO: 1446136 - RNA, 19 nt, Pseudomonas aeruginosa PA01
ccuacgcggcaccgcuuuc

SEQ ID NO: 1446137 - RNA, 14 nt, Pseudomonas aeruginosa PA01
ccguucaggcgcgg

SEQ ID NO: 1446138 - RNA, 22 nt, Pseudomonas aeruginosa PA01
ccguucagggacaugucgaggg

SEQ ID NO: 1446139 - RNA, 20 nt, Pseudomonas aeruginosa PA01
ccguucagggucagguugcc

SEQ ID NO: 1446140 - RNA, 13 nt, Pseudomonas aeruginosa PA01
ccguucaggccgg

SEQ ID NO: 1446141 - RNA, 15 nt, Pseudomonas aeruginosa PA01
ccguucaggccggcg

SEQ ID NO: 1446142 - RNA, 17 nt, Pseudomonas aeruginosa PA01
ccguucaggccggcgcc

SEQ ID NO: 1446143 - RNA, 15 nt, Pseudomonas aeruginosa PA01
ccguucacgccuggc

SEQ ID NO: 1446144 - RNA, 20 nt, Pseudomonas aeruginosa PA01
ccguucacgccuggcggcug

SEQ ID NO: 1446145 - RNA, 18 nt, Pseudomonas aeruginosa PA01
ccguuccaccgccuggac

SEQ ID NO: 1446146 - RNA, 23 nt, Pseudomonas aeruginosa PA01
ccguuccagcggcacuucccgcc

SEQ ID NO: 1446147 - RNA, 15 nt, Pseudomonas aeruginosa PA01
ccguuccaggcgggg

SEQ ID NO: 1446148 - RNA, 16 nt, Pseudomonas aeruginosa PA01
ccguuccgacccggcc

SEQ ID NO: 1446149 - RNA, 23 nt, Pseudomonas aeruginosa PA01
ccguuccgacccggccgaccagg

SEQ ID NO: 1446150 - RNA, 20 nt, Pseudomonas aeruginosa PA01
ccguguucggccagccggcg

SEQ ID NO: 1446151 - RNA, 22 nt, Pseudomonas aeruginosa PA01
ccguguucggccagccggcgcc

SEQ ID NO: 1446152 - RNA, 23 nt, Pseudomonas aeruginosa PA01
ccguguucggccagccggcgccg

SEQ ID NO: 1446153 - RNA, 20 nt, Pseudomonas aeruginosa PA01
ccgugcccgccggcgcgccc

SEQ ID NO: 1446154 - RNA, 19 nt, Pseudomonas aeruginosa PA01
ccguguaaugacuccgguc

SEQ ID NO: 1446155 - RNA, 15 nt, Pseudomonas aeruginosa PA01
ccgugucgagggcga

SEQ ID NO: 1446156 - RNA, 19 nt, Pseudomonas aeruginosa PA01
ccgugucgagggcgaacag

SEQ ID NO: 1446157 - RNA, 12 nt, Pseudomonas aeruginosa PA01
ccgugucggcgg

SEQ ID NO: 1446158 - RNA, 13 nt, Pseudomonas aeruginosa PA01
ccgugucggcggc

SEQ ID NO: 1446159 - RNA, 16 nt, Pseudomonas aeruginosa PA01
ccguucgcccgcggcg

SEQ ID NO: 1446160 - RNA, 19 nt, Pseudomonas aeruginosa PA01
ccguuccuugcgcggcagg

SEQ ID NO: 1446161 - RNA, 17 nt, Pseudomonas aeruginosa PA01
ccguucccagcagcgcc

SEQ ID NO: 1446162 - RNA, 14 nt, Pseudomonas aeruginosa PA01
ccguuccuccucgc

SEQ ID NO: 1446163 - RNA, 18 nt, Pseudomonas aeruginosa PA01
ccguuccuccucgccgcc

SEQ ID NO: 1446164 - RNA, 19 nt, Pseudomonas aeruginosa PA01
ccguuccuccucgccgccg

SEQ ID NO: 1446165 - RNA, 11 nt, Pseudomonas aeruginosa PA01
ccguucgccgg

SEQ ID NO: 1446166 - RNA, 16 nt, Pseudomonas aeruginosa PA01
ccguugaacucggcgc

SEQ ID NO: 1446167 - RNA, 17 nt, Pseudomonas aeruginosa PA01
ccguugaacucggcgcc

SEQ ID NO: 1446168 - RNA, 16 nt, Pseudomonas aeruginosa PA01
ccguugaccagcgcgu

SEQ ID NO: 1446169 - RNA, 14 nt, Pseudomonas aeruginosa PA01
ccguugagcaccuc

SEQ ID NO: 1446170 - RNA, 20 nt, Pseudomonas aeruginosa PA01
ccguugaaacgcucggcguc

SEQ ID NO: 1446171 - RNA, 21 nt, Pseudomonas aeruginosa PA01
ccguugaaacgcucggcgucg

SEQ ID NO: 1446172 - RNA, 14 nt, Pseudomonas aeruginosa PA01
ccguucuccagguc

SEQ ID NO: 1446173 - RNA, 18 nt, Pseudomonas aeruginosa PA01
ccguucgucaccggcgcc

SEQ ID NO: 1446174 - RNA, 23 nt, Pseudomonas aeruginosa PA01
ccguucuugaucaccgcggugcg

SEQ ID NO: 1446175 - RNA, 18 nt, Pseudomonas aeruginosa PA01
ccguugccgguacucgcc

SEQ ID NO: 1446176 - RNA, 19 nt, Pseudomonas aeruginosa PA01
ccguugcccucgcgcugga

SEQ ID NO: 1446177 - RNA, 18 nt, Pseudomonas aeruginosa PA01
ccguugccgaccgagcag

SEQ ID NO: 1446178 - RNA, 22 nt, Pseudomonas aeruginosa PA01
ccguugccgaccgagcagcgga

SEQ ID NO: 1446179 - RNA, 24 nt, Pseudomonas aeruginosa PA01
ccguugccgaccgagcagcggacg

SEQ ID NO: 1446180 - RNA, 13 nt, Pseudomonas aeruginosa PA01
ccguugaugacga

SEQ ID NO: 1446181 - RNA, 14 nt, Pseudomonas aeruginosa PA01
ccguugaugucgac

SEQ ID NO: 1446182 - RNA, 22 nt, Pseudomonas aeruginosa PA01
ccucauggaaaccccggccugg

SEQ ID NO: 1446183 - RNA, 21 nt, Pseudomonas aeruginosa PA01
ccuccgccagccccaggccgc

SEQ ID NO: 1446184 - RNA, 12 nt, Pseudomonas aeruginosa PA01
ccuccgccagga

SEQ ID NO: 1446185 - RNA, 15 nt, Pseudomonas aeruginosa PA01
ccuccgccaggucga

SEQ ID NO: 1446186 - RNA, 15 nt, Pseudomonas aeruginosa PA01
ccuccggacgccgaa

SEQ ID NO: 1446187 - RNA, 18 nt, Pseudomonas aeruginosa PA01
ccuccggacgccgaacgc

SEQ ID NO: 1446188 - RNA, 14 nt, Pseudomonas aeruginosa PA01
ccuccgcgcccagg

SEQ ID NO: 1446189 - RNA, 14 nt, Pseudomonas aeruginosa PA01
ccuccgccugcacg

SEQ ID NO: 1446190 - RNA, 12 nt, Pseudomonas aeruginosa PA01
ccuccggcagcg

SEQ ID NO: 1446191 - RNA, 14 nt, Pseudomonas aeruginosa PA01
ccuccggcagcguc

SEQ ID NO: 1446192 - RNA, 18 nt, Pseudomonas aeruginosa PA01
ccuccggcacgcugccgc

SEQ ID NO: 1446193 - RNA, 21 nt, Pseudomonas aeruginosa PA01
ccuccggcacgcugccgccga

SEQ ID NO: 1446194 - RNA, 21 nt, Pseudomonas aeruginosa PA01
ccuccgccgcuuccgccaggc

SEQ ID NO: 1446195 - RNA, 20 nt, Pseudomonas aeruginosa PA01
ccuccggaugcagauccagc

SEQ ID NO: 1446196 - RNA, 14 nt, Pseudomonas aeruginosa PA01
ccuccggcgccagg

SEQ ID NO: 1446197 - RNA, 15 nt, Pseudomonas aeruginosa PA01
ccuccgggcguaacg

SEQ ID NO: 1446198 - RNA, 13 nt, Pseudomonas aeruginosa PA01
ccuccuccaguuc

SEQ ID NO: 1446199 - RNA, 12 nt, Pseudomonas aeruginosa PA01
ccuccucgccgc

SEQ ID NO: 1446200 - RNA, 17 nt, Pseudomonas aeruginosa PA01
ccuccucgccgccgacc

SEQ ID NO: 1446201 - RNA, 18 nt, Pseudomonas aeruginosa PA01
ccuccucgccgcuccgcg

SEQ ID NO: 1446202 - RNA, 16 nt, Pseudomonas aeruginosa PA01
ccucgaagcccagcgc

SEQ ID NO: 1446203 - RNA, 18 nt, Pseudomonas aeruginosa PA01
ccucgaagcccagcgccu

SEQ ID NO: 1446204 - RNA, 22 nt, Pseudomonas aeruginosa PA01
ccucgaagcggaucucgucgcc

SEQ ID NO: 1446205 - RNA, 17 nt, Pseudomonas aeruginosa PA01
ccucgaagcuggccagu

SEQ ID NO: 1446206 - RNA, 18 nt, Pseudomonas aeruginosa PA01
ccuauggcguuauucgcc

SEQ ID NO: 1446207 - RNA, 18 nt, Pseudomonas aeruginosa PA01
ccuauccgugacgucggc

SEQ ID NO: 1446208 - RNA, 11 nt, Pseudomonas aeruginosa PA01
ccuauaaugcg

SEQ ID NO: 1446209 - RNA, 15 nt, Pseudomonas aeruginosa PA01
ccuaggcgacccggc

SEQ ID NO: 1446210 - RNA, 14 nt, Pseudomonas aeruginosa PA01
ccuaggggacgcca

SEQ ID NO: 1446211 - RNA, 20 nt, Pseudomonas aeruginosa PA01
ccucauagugcugcggcagg

SEQ ID NO: 1446212 - RNA, 15 nt, Pseudomonas aeruginosa PA01
ccucaugcugcgcgg

SEQ ID NO: 1446213 - RNA, 21 nt, Pseudomonas aeruginosa PA01
ccucagugagccccggcgucg

SEQ ID NO: 1446214 - RNA, 16 nt, Pseudomonas aeruginosa PA01
ccucagugcgggcagu

SEQ ID NO: 1446215 - RNA, 16 nt, Pseudomonas aeruginosa PA01
ccucaaggcaucgcga

SEQ ID NO: 1446216 - RNA, 18 nt, Pseudomonas aeruginosa PA01
ccucaacgaccgcccagg

SEQ ID NO: 1446217 - RNA, 16 nt, Pseudomonas aeruginosa PA01
ccucaggccuggcgca

SEQ ID NO: 1446218 - RNA, 17 nt, Pseudomonas aeruginosa PA01
ccucaggauagccggcg

SEQ ID NO: 1446219 - RNA, 18 nt, Pseudomonas aeruginosa PA01
ccucaggauagccggcgc

SEQ ID NO: 1446220 - RNA, 20 nt, Pseudomonas aeruginosa PA01
ccucaggauagccggcgcgu

SEQ ID NO: 1446221 - RNA, 15 nt, Pseudomonas aeruginosa PA01
ccucaggggugcagc

SEQ ID NO: 1446222 - RNA, 22 nt, Pseudomonas aeruginosa PA01
ccucaggggugcagcccuggcg

SEQ ID NO: 1446223 - RNA, 19 nt, Pseudomonas aeruginosa PA01
ccucagguagucggcgaug

SEQ ID NO: 1446224 - RNA, 11 nt, Pseudomonas aeruginosa PA01
ccucaggcgcc

SEQ ID NO: 1446225 - RNA, 17 nt, Pseudomonas aeruginosa PA01
ccucaggcgcugcgcgg

SEQ ID NO: 1446226 - RNA, 19 nt, Pseudomonas aeruginosa PA01
ccucaggcgcugcgcggcc

SEQ ID NO: 1446227 - RNA, 13 nt, Pseudomonas aeruginosa PA01
ccucgccgcggca

SEQ ID NO: 1446228 - RNA, 12 nt, Pseudomonas aeruginosa PA01
ccucgccgcucc

SEQ ID NO: 1446229 - RNA, 13 nt, Pseudomonas aeruginosa PA01
ccucgccgcugcu

SEQ ID NO: 1446230 - RNA, 15 nt, Pseudomonas aeruginosa PA01
ccucgccgcugcugg

SEQ ID NO: 1446231 - RNA, 14 nt, Pseudomonas aeruginosa PA01
ccucgccgcuggcg

SEQ ID NO: 1446232 - RNA, 18 nt, Pseudomonas aeruginosa PA01
ccucgccgcuggcgcuga

SEQ ID NO: 1446233 - RNA, 18 nt, Pseudomonas aeruginosa PA01
ccucgcggcucaccgaga

SEQ ID NO: 1446234 - RNA, 16 nt, Pseudomonas aeruginosa PA01
ccucgcgggaacggcg

SEQ ID NO: 1446235 - RNA, 20 nt, Pseudomonas aeruginosa PA01
ccucgcggcgcucgaggggc

SEQ ID NO: 1446236 - RNA, 13 nt, Pseudomonas aeruginosa PA01
ccucgcggcggca

SEQ ID NO: 1446237 - RNA, 15 nt, Pseudomonas aeruginosa PA01
ccucgccgaccgcca

SEQ ID NO: 1446238 - RNA, 14 nt, Pseudomonas aeruginosa PA01
ccucgccaaccagg

SEQ ID NO: 1446239 - RNA, 16 nt, Pseudomonas aeruginosa PA01
ccucgccaagcuggcg

SEQ ID NO: 1446240 - RNA, 17 nt, Pseudomonas aeruginosa PA01
ccucgccaagcuggcga

SEQ ID NO: 1446241 - RNA, 16 nt, Pseudomonas aeruginosa PA01
ccucgcccucgaagcc

SEQ ID NO: 1446242 - RNA, 20 nt, Pseudomonas aeruginosa PA01
ccucgcccucgaagcccugc

SEQ ID NO: 1446243 - RNA, 13 nt, Pseudomonas aeruginosa PA01
ccucgccccgccg

SEQ ID NO: 1446244 - RNA, 15 nt, Pseudomonas aeruginosa PA01
ccucgccccgccggg

SEQ ID NO: 1446245 - RNA, 18 nt, Pseudomonas aeruginosa PA01
ccucgccccgccgggagc

SEQ ID NO: 1446246 - RNA, 23 nt, Pseudomonas aeruginosa PA01
ccucgaucucguccucggcguag

SEQ ID NO: 1446247 - RNA, 21 nt, Pseudomonas aeruginosa PA01
ccucgaugaacagugcgcccg

SEQ ID NO: 1446248 - RNA, 13 nt, Pseudomonas aeruginosa PA01
ccucgccaggcug

SEQ ID NO: 1446249 - RNA, 17 nt, Pseudomonas aeruginosa PA01
ccucgcccaggugcgcc

SEQ ID NO: 1446250 - RNA, 21 nt, Pseudomonas aeruginosa PA01
ccucgcccaggugcgccgagc

SEQ ID NO: 1446251 - RNA, 15 nt, Pseudomonas aeruginosa PA01
ccucgcccaucgcca

SEQ ID NO: 1446252 - RNA, 20 nt, Pseudomonas aeruginosa PA01
ccucgaccuggccacgcccg

SEQ ID NO: 1446253 - RNA, 16 nt, Pseudomonas aeruginosa PA01
ccucgaggucggccug

SEQ ID NO: 1446254 - RNA, 20 nt, Pseudomonas aeruginosa PA01
ccucgaggucggccuggcug

SEQ ID NO: 1446255 - RNA, 22 nt, Pseudomonas aeruginosa PA01
ccucgaucagugcaucggccgc

SEQ ID NO: 1446256 - RNA, 14 nt, Pseudomonas aeruginosa PA01
ccucgaucaggccu

SEQ ID NO: 1446257 - RNA, 16 nt, Pseudomonas aeruginosa PA01
ccucgaucaucugcgg

SEQ ID NO: 1446258 - RNA, 13 nt, Pseudomonas aeruginosa PA01
ccucgauccgcug

SEQ ID NO: 1446259 - RNA, 15 nt, Pseudomonas aeruginosa PA01
ccucgaccgcgccgg

SEQ ID NO: 1446260 - RNA, 19 nt, Pseudomonas aeruginosa PA01
ccucgacccuggcgccgac

SEQ ID NO: 1446261 - RNA, 21 nt, Pseudomonas aeruginosa PA01
ccucgacccuggcgccgaccu

SEQ ID NO: 1446262 - RNA, 20 nt, Pseudomonas aeruginosa PA01
ccuccucgcucugcgccgcg

SEQ ID NO: 1446263 - RNA, 22 nt, Pseudomonas aeruginosa PA01
ccucgaggaucuugcgcccggc

SEQ ID NO: 1446264 - RNA, 23 nt, Pseudomonas aeruginosa PA01
ccucgaggaucuugcgcccggcg

SEQ ID NO: 1446265 - RNA, 21 nt, Pseudomonas aeruginosa PA01
ccucggcgccauaggccagca

SEQ ID NO: 1446266 - RNA, 13 nt, Pseudomonas aeruginosa PA01
ccucggcgcccgc

SEQ ID NO: 1446267 - RNA, 15 nt, Pseudomonas aeruginosa PA01
ccucggcgcccgccu

SEQ ID NO: 1446268 - RNA, 12 nt, Pseudomonas aeruginosa PA01
ccucggcgcggg

SEQ ID NO: 1446269 - RNA, 20 nt, Pseudomonas aeruginosa PA01
ccucgggcgagaaucgccga

SEQ ID NO: 1446270 - RNA, 20 nt, Pseudomonas aeruginosa PA01
ccucggggaaggucaccgaa

SEQ ID NO: 1446271 - RNA, 12 nt, Pseudomonas aeruginosa PA01
ccucggggccga

SEQ ID NO: 1446272 - RNA, 22 nt, Pseudomonas aeruginosa PA01
ccucggggccgaggucgaccag

SEQ ID NO: 1446273 - RNA, 17 nt, Pseudomonas aeruginosa PA01
ccucgggcaccagcacg

SEQ ID NO: 1446274 - RNA, 21 nt, Pseudomonas aeruginosa PA01
ccucgggcaccagcacggugc

SEQ ID NO: 1446275 - RNA, 18 nt, Pseudomonas aeruginosa PA01
ccucgggaugcaguucgu

SEQ ID NO: 1446276 - RNA, 17 nt, Pseudomonas aeruginosa PA01
ccucgucgacgcccugg

SEQ ID NO: 1446277 - RNA, 19 nt, Pseudomonas aeruginosa PA01
ccucggugauaccgccggc

SEQ ID NO: 1446278 - RNA, 18 nt, Pseudomonas aeruginosa PA01
ccucgguagaccccggug

SEQ ID NO: 1446279 - RNA, 16 nt, Pseudomonas aeruginosa PA01
ccucgguagccggcca

SEQ ID NO: 1446280 - RNA, 13 nt, Pseudomonas aeruginosa PA01
ccucgggcagcuc

SEQ ID NO: 1446281 - RNA, 18 nt, Pseudomonas aeruginosa PA01
ccucggguuuggcgcccg

SEQ ID NO: 1446282 - RNA, 22 nt, Pseudomonas aeruginosa PA01
ccucggucagguauucgccggc

SEQ ID NO: 1446283 - RNA, 19 nt, Pseudomonas aeruginosa PA01
ccucggcgaucgccaggug

SEQ ID NO: 1446284 - RNA, 18 nt, Pseudomonas aeruginosa PA01
ccucggcgaucacccggc

SEQ ID NO: 1446285 - RNA, 19 nt, Pseudomonas aeruginosa PA01
ccucggcgaucacccggcg

SEQ ID NO: 1446286 - RNA, 16 nt, Pseudomonas aeruginosa PA01
ccucggccucgucgag

SEQ ID NO: 1446287 - RNA, 20 nt, Pseudomonas aeruginosa PA01
ccucggcgaacuccgccagc

SEQ ID NO: 1446288 - RNA, 17 nt, Pseudomonas aeruginosa PA01
ccucggcgaagucgccg

SEQ ID NO: 1446289 - RNA, 15 nt, Pseudomonas aeruginosa PA01
ccucggcgaccaaca

SEQ ID NO: 1446290 - RNA, 18 nt, Pseudomonas aeruginosa PA01
ccucggccugggcgcagg

SEQ ID NO: 1446291 - RNA, 19 nt, Pseudomonas aeruginosa PA01
ccucggccugggcgcaggc

SEQ ID NO: 1446292 - RNA, 18 nt, Pseudomonas aeruginosa PA01
ccucgcugaugugccgca

SEQ ID NO: 1446293 - RNA, 19 nt, Pseudomonas aeruginosa PA01
ccucgcuacggaaggucgc

SEQ ID NO: 1446294 - RNA, 18 nt, Pseudomonas aeruginosa PA01
ccucgcuagucuuccugc

SEQ ID NO: 1446295 - RNA, 14 nt, Pseudomonas aeruginosa PA01
ccucggagaacagc

SEQ ID NO: 1446296 - RNA, 15 nt, Pseudomonas aeruginosa PA01
ccucggagaacagca

SEQ ID NO: 1446297 - RNA, 14 nt, Pseudomonas aeruginosa PA01
ccucggaaucggcg

SEQ ID NO: 1446298 - RNA, 14 nt, Pseudomonas aeruginosa PA01
ccucgcuggcgaag

SEQ ID NO: 1446299 - RNA, 14 nt, Pseudomonas aeruginosa PA01
ccucgcugccgccg

SEQ ID NO: 1446300 - RNA, 18 nt, Pseudomonas aeruginosa PA01
ccucgcugccgccgcaga

SEQ ID NO: 1446301 - RNA, 13 nt, Pseudomonas aeruginosa PA01
ccguaccagcgcg

SEQ ID NO: 1446302 - RNA, 17 nt, Pseudomonas aeruginosa PA01
ccguaccagucgcccgc

SEQ ID NO: 1446303 - RNA, 13 nt, Pseudomonas aeruginosa PA01
ccguaccccgacg

SEQ ID NO: 1446304 - RNA, 16 nt, Pseudomonas aeruginosa PA01
ccguacaggucggcgc

SEQ ID NO: 1446305 - RNA, 17 nt, Pseudomonas aeruginosa PA01
ccguacaggucggcgcc

SEQ ID NO: 1446306 - RNA, 18 nt, Pseudomonas aeruginosa PA01
ccguacaggucggcgccg

SEQ ID NO: 1446307 - RNA, 19 nt, Pseudomonas aeruginosa PA01
ccguacaggucggcgccgg

SEQ ID NO: 1446308 - RNA, 22 nt, Pseudomonas aeruginosa PA01
ccguacaggucggcgccggugc

SEQ ID NO: 1446309 - RNA, 19 nt, Pseudomonas aeruginosa PA01
ccguacagcccccgccggc

SEQ ID NO: 1446310 - RNA, 20 nt, Pseudomonas aeruginosa PA01
ccguacagcccccgccggcc

SEQ ID NO: 1446311 - RNA, 21 nt, Pseudomonas aeruginosa PA01
ccguacagcccccgccggccg

SEQ ID NO: 1446312 - RNA, 22 nt, Pseudomonas aeruginosa PA01
ccguacagcccccgccggccgg

SEQ ID NO: 1446313 - RNA, 17 nt, Pseudomonas aeruginosa PA01
ccguacgcaccgcguag

SEQ ID NO: 1446314 - RNA, 18 nt, Pseudomonas aeruginosa PA01
ccguagaccggcuccagg

SEQ ID NO: 1446315 - RNA, 22 nt, Pseudomonas aeruginosa PA01
ccguagaccggcuccagggcga

SEQ ID NO: 1446316 - RNA, 14 nt, Pseudomonas aeruginosa PA01
ccguagaacgccag

SEQ ID NO: 1446317 - RNA, 14 nt, Pseudomonas aeruginosa PA01
ccguagaccaccag

SEQ ID NO: 1446318 - RNA, 15 nt, Pseudomonas aeruginosa PA01
ccguagaccaccagc

SEQ ID NO: 1446319 - RNA, 17 nt, Pseudomonas aeruginosa PA01
ccguagaccaccagcag

SEQ ID NO: 1446320 - RNA, 19 nt, Pseudomonas aeruginosa PA01
ccguagaccaccagcagca

SEQ ID NO: 1446321 - RNA, 13 nt, Pseudomonas aeruginosa PA01
ccguacuggcgcc

SEQ ID NO: 1446322 - RNA, 18 nt, Pseudomonas aeruginosa PA01
ccguacuggcgccaggcc

SEQ ID NO: 1446323 - RNA, 22 nt, Pseudomonas aeruginosa PA01
ccguacuggcgccaggccgcgu

SEQ ID NO: 1446324 - RNA, 20 nt, Pseudomonas aeruginosa PA01
ccguacucauggccgcagcg

SEQ ID NO: 1446325 - RNA, 12 nt, Pseudomonas aeruginosa PA01
ccguccagcgcg

SEQ ID NO: 1446326 - RNA, 13 nt, Pseudomonas aeruginosa PA01
ccguccagccggc

SEQ ID NO: 1446327 - RNA, 14 nt, Pseudomonas aeruginosa PA01
ccguccagccggcg

SEQ ID NO: 1446328 - RNA, 22 nt, Pseudomonas aeruginosa PA01
ccguccagcgagaacuugccgg

SEQ ID NO: 1446329 - RNA, 16 nt, Pseudomonas aeruginosa PA01
ccgucaggcaccucgu

SEQ ID NO: 1446330 - RNA, 20 nt, Pseudomonas aeruginosa PA01
ccgucagggcguaagcuggg

SEQ ID NO: 1446331 - RNA, 20 nt, Pseudomonas aeruginosa PA01
ccgucaggccuugcgcggcg

SEQ ID NO: 1446332 - RNA, 13 nt, Pseudomonas aeruginosa PA01
ccguccagcgcgc

SEQ ID NO: 1446333 - RNA, 14 nt, Pseudomonas aeruginosa PA01
ccguccagcgcgcc

SEQ ID NO: 1446334 - RNA, 16 nt, Pseudomonas aeruginosa PA01
ccguccagcgcgcccg

SEQ ID NO: 1446335 - RNA, 22 nt, Pseudomonas aeruginosa PA01
ccguccagcgcgcccggcgcca

SEQ ID NO: 1446336 - RNA, 23 nt, Pseudomonas aeruginosa PA01
ccguccagcgcgcccggcgccac

SEQ ID NO: 1446337 - RNA, 13 nt, Pseudomonas aeruginosa PA01
ccguccaggcgcg

SEQ ID NO: 1446338 - RNA, 17 nt, Pseudomonas aeruginosa PA01
ccgucccacaggccggc

SEQ ID NO: 1446339 - RNA, 16 nt, Pseudomonas aeruginosa PA01
ccgucccagucggcgu

SEQ ID NO: 1446340 - RNA, 15 nt, Pseudomonas aeruginosa PA01
ccguccuccagcaag

SEQ ID NO: 1446341 - RNA, 23 nt, Pseudomonas aeruginosa PA01
ccguccgucggcaguggugaucc

SEQ ID NO: 1446342 - RNA, 22 nt, Pseudomonas aeruginosa PA01
ccguccgucccacaggccggcu

SEQ ID NO: 1446343 - RNA, 19 nt, Pseudomonas aeruginosa PA01
ccguccuacgcgaccgguc

SEQ ID NO: 1446344 - RNA, 12 nt, Pseudomonas aeruginosa PA01
ccgucccgcgcg

SEQ ID NO: 1446345 - RNA, 15 nt, Pseudomonas aeruginosa PA01
ccguccgggcacgca

SEQ ID NO: 1446346 - RNA, 22 nt, Pseudomonas aeruginosa PA01
ccguccgggugggucauggcgu

SEQ ID NO: 1446347 - RNA, 22 nt, Pseudomonas aeruginosa PA01
ccgucgacacugauauccgcuc

SEQ ID NO: 1446348 - RNA, 22 nt, Pseudomonas aeruginosa PA01
ccgucgaccaucaccagcgccg

SEQ ID NO: 1446349 - RNA, 23 nt, Pseudomonas aeruginosa PA01
ccgucgaccaucaccagcgccgu

SEQ ID NO: 1446350 - RNA, 12 nt, Pseudomonas aeruginosa PA01
ccgucgaagggc

SEQ ID NO: 1446351 - RNA, 17 nt, Pseudomonas aeruginosa PA01
ccgucgaaguggacgaa

SEQ ID NO: 1446352 - RNA, 18 nt, Pseudomonas aeruginosa PA01
ccgucgacgcccugggcg

SEQ ID NO: 1446353 - RNA, 14 nt, Pseudomonas aeruginosa PA01
ccgucgacccgccu

SEQ ID NO: 1446354 - RNA, 21 nt, Pseudomonas aeruginosa PA01
ccgucgaauuggacagcaggc

SEQ ID NO: 1446355 - RNA, 16 nt, Pseudomonas aeruginosa PA01
ccgucgaacagcagcu

SEQ ID NO: 1446356 - RNA, 21 nt, Pseudomonas aeruginosa PA01
ccgucgaacagcagcucgccg

SEQ ID NO: 1446357 - RNA, 22 nt, Pseudomonas aeruginosa PA01
ccgucgaacagcagcucgccgc

SEQ ID NO: 1446358 - RNA, 16 nt, Pseudomonas aeruginosa PA01
ccguccugcggccgca

SEQ ID NO: 1446359 - RNA, 15 nt, Pseudomonas aeruginosa PA01
ccguccuucggccgc

SEQ ID NO: 1446360 - RNA, 16 nt, Pseudomonas aeruginosa PA01
ccgucguagcgcagcg

SEQ ID NO: 1446361 - RNA, 21 nt, Pseudomonas aeruginosa PA01
ccgucguagcgcagcggcagg

SEQ ID NO: 1446362 - RNA, 16 nt, Pseudomonas aeruginosa PA01
ccgucgggcaguuccg

SEQ ID NO: 1446363 - RNA, 17 nt, Pseudomonas aeruginosa PA01
ccgucgucaccucggcg

SEQ ID NO: 1446364 - RNA, 19 nt, Pseudomonas aeruginosa PA01
ccgucgucaccucggcgcc

SEQ ID NO: 1446365 - RNA, 18 nt, Pseudomonas aeruginosa PA01
ccgucgucacggaacuga

SEQ ID NO: 1446366 - RNA, 23 nt, Pseudomonas aeruginosa PA01
ccgucgucguccaccgaguggcg

SEQ ID NO: 1446367 - RNA, 15 nt, Pseudomonas aeruginosa PA01
ccgugcaucaccggc

SEQ ID NO: 1446368 - RNA, 22 nt, Pseudomonas aeruginosa PA01
ccgugcaucaccggcagcagcg

SEQ ID NO: 1446369 - RNA, 17 nt, Pseudomonas aeruginosa PA01
ccgugcaugccgacgag

SEQ ID NO: 1446370 - RNA, 14 nt, Pseudomonas aeruginosa PA01
ccgugacgaggggc

SEQ ID NO: 1446371 - RNA, 12 nt, Pseudomonas aeruginosa PA01
ccgucggauggc

SEQ ID NO: 1446372 - RNA, 19 nt, Pseudomonas aeruginosa PA01
ccgucggauggccguccag

SEQ ID NO: 1446373 - RNA, 20 nt, Pseudomonas aeruginosa PA01
ccgucggauggccguccagg

SEQ ID NO: 1446374 - RNA, 19 nt, Pseudomonas aeruginosa PA01
ccgucggcaagcaggccgc

SEQ ID NO: 1446375 - RNA, 15 nt, Pseudomonas aeruginosa PA01
ccgucgcuucgcccg

SEQ ID NO: 1446376 - RNA, 16 nt, Pseudomonas aeruginosa PA01
ccgucggccuggcggu

SEQ ID NO: 1446377 - RNA, 12 nt, Pseudomonas aeruginosa PA01
ccgucggccugc

SEQ ID NO: 1446378 - RNA, 12 nt, Pseudomonas aeruginosa PA01
ccgucggccggg

SEQ ID NO: 1446379 - RNA, 22 nt, Pseudomonas aeruginosa PA01
ccgucggccggggucaggccga

SEQ ID NO: 1446380 - RNA, 13 nt, Pseudomonas aeruginosa PA01
ccgucggcgcggg

SEQ ID NO: 1446381 - RNA, 11 nt, Pseudomonas aeruginosa PA01
ccgucggcggu

SEQ ID NO: 1446382 - RNA, 20 nt, Pseudomonas aeruginosa PA01
ccgucggcggucagcuugcc

SEQ ID NO: 1446383 - RNA, 14 nt, Pseudomonas aeruginosa PA01
ccgucgagggcaaa

SEQ ID NO: 1446384 - RNA, 23 nt, Pseudomonas aeruginosa PA01
ccgucgagggcaaaggcgcgcag

SEQ ID NO: 1446385 - RNA, 24 nt, Pseudomonas aeruginosa PA01
ccgucgagggcaaaggcgcgcagg

SEQ ID NO: 1446386 - RNA, 16 nt, Pseudomonas aeruginosa PA01
ccgucgaggucggcga

SEQ ID NO: 1446387 - RNA, 15 nt, Pseudomonas aeruginosa PA01
ccgucgagccagccc

SEQ ID NO: 1446388 - RNA, 22 nt, Pseudomonas aeruginosa PA01
ccgucgagccagcccagcggcg

SEQ ID NO: 1446389 - RNA, 11 nt, Pseudomonas aeruginosa PA01
ccgucgagcac

SEQ ID NO: 1446390 - RNA, 14 nt, Pseudomonas aeruginosa PA01
ccgucgagcaccag

SEQ ID NO: 1446391 - RNA, 16 nt, Pseudomonas aeruginosa PA01
ccgucgagcaccagca

SEQ ID NO: 1446392 - RNA, 18 nt, Pseudomonas aeruginosa PA01
ccgucgagcaccagcagg

SEQ ID NO: 1446393 - RNA, 21 nt, Pseudomonas aeruginosa PA01
ccgucgcggucaucgccggcg

SEQ ID NO: 1446394 - RNA, 22 nt, Pseudomonas aeruginosa PA01
ccgucgaucagguaggccggcg

SEQ ID NO: 1446395 - RNA, 23 nt, Pseudomonas aeruginosa PA01
ccgucgaucagguaggccggcgu

SEQ ID NO: 1446396 - RNA, 17 nt, Pseudomonas aeruginosa PA01
ccgucggacucgacguc

SEQ ID NO: 1446397 - RNA, 21 nt, Pseudomonas aeruginosa PA01
ccgguccggugaaccugacca

SEQ ID NO: 1446398 - RNA, 23 nt, Pseudomonas aeruginosa PA01
ccgguccguccagcgcgcccggc

SEQ ID NO: 1446399 - RNA, 12 nt, Pseudomonas aeruginosa PA01
ccgguccucgac

SEQ ID NO: 1446400 - RNA, 22 nt, Pseudomonas aeruginosa PA01
ccggucgagguugcgcggcagg

SEQ ID NO: 1446401 - RNA, 21 nt, Pseudomonas aeruginosa PA01
ccggucgcgcucaggcgcagc

SEQ ID NO: 1446402 - RNA, 21 nt, Pseudomonas aeruginosa PA01
ccggucgcgcuggaccuggcc

SEQ ID NO: 1446403 - RNA, 18 nt, Pseudomonas aeruginosa PA01
ccggguacagcgccacgg

SEQ ID NO: 1446404 - RNA, 17 nt, Pseudomonas aeruginosa PA01
ccggguaccugcucgcg

SEQ ID NO: 1446405 - RNA, 18 nt, Pseudomonas aeruginosa PA01
ccggguaccugcucgcgg

SEQ ID NO: 1446406 - RNA, 17 nt, Pseudomonas aeruginosa PA01
ccggguacuggcgcugc

SEQ ID NO: 1446407 - RNA, 23 nt, Pseudomonas aeruginosa PA01
ccggguacuggcgcugcgcggcg

SEQ ID NO: 1446408 - RNA, 20 nt, Pseudomonas aeruginosa PA01
ccggguagcguuaucgccgg

SEQ ID NO: 1446409 - RNA, 16 nt, Pseudomonas aeruginosa PA01
ccggggcgggccgcgc

SEQ ID NO: 1446410 - RNA, 20 nt, Pseudomonas aeruginosa PA01
ccgggggaagaacccagaca

SEQ ID NO: 1446411 - RNA, 13 nt, Pseudomonas aeruginosa PA01
ccggggcguaggg

SEQ ID NO: 1446412 - RNA, 16 nt, Pseudomonas aeruginosa PA01
ccggggcgugcaggcc

SEQ ID NO: 1446413 - RNA, 20 nt, Pseudomonas aeruginosa PA01
ccggggcgugcaggccgccg

SEQ ID NO: 1446414 - RNA, 22 nt, Pseudomonas aeruginosa PA01
ccggggcgugcaggccgccgag

SEQ ID NO: 1446415 - RNA, 18 nt, Pseudomonas aeruginosa PA01
ccgggguugcccagcagg

SEQ ID NO: 1446416 - RNA, 15 nt, Pseudomonas aeruginosa PA01
ccgggguuggcgcug

SEQ ID NO: 1446417 - RNA, 20 nt, Pseudomonas aeruginosa PA01
ccggucggaacgaccacgcc

SEQ ID NO: 1446418 - RNA, 21 nt, Pseudomonas aeruginosa PA01
ccggucggaacgaccacgccu

SEQ ID NO: 1446419 - RNA, 11 nt, Pseudomonas aeruginosa PA01
ccggucggacu

SEQ ID NO: 1446420 - RNA, 18 nt, Pseudomonas aeruginosa PA01
ccggucggacuccgccca

SEQ ID NO: 1446421 - RNA, 19 nt, Pseudomonas aeruginosa PA01
ccggucggacuccgcccag

SEQ ID NO: 1446422 - RNA, 15 nt, Pseudomonas aeruginosa PA01
ccggucgcuguagac

SEQ ID NO: 1446423 - RNA, 14 nt, Pseudomonas aeruginosa PA01
ccggucgcugacca

SEQ ID NO: 1446424 - RNA, 14 nt, Pseudomonas aeruginosa PA01
ccggucggccuuga

SEQ ID NO: 1446425 - RNA, 15 nt, Pseudomonas aeruginosa PA01
ccggucuagccgggc

SEQ ID NO: 1446426 - RNA, 16 nt, Pseudomonas aeruginosa PA01
ccggucuagccgggcc

SEQ ID NO: 1446427 - RNA, 13 nt, Pseudomonas aeruginosa PA01
ccggucuagcgcc

SEQ ID NO: 1446428 - RNA, 20 nt, Pseudomonas aeruginosa PA01
ccggucuagcgccccggccg

SEQ ID NO: 1446429 - RNA, 14 nt, Pseudomonas aeruginosa PA01
ccggucucagccgg

SEQ ID NO: 1446430 - RNA, 15 nt, Pseudomonas aeruginosa PA01
ccggucucggcgaug

SEQ ID NO: 1446431 - RNA, 14 nt, Pseudomonas aeruginosa PA01
ccggucugcugcgc

SEQ ID NO: 1446432 - RNA, 16 nt, Pseudomonas aeruginosa PA01
ccggucugcugcgcgc

SEQ ID NO: 1446433 - RNA, 20 nt, Pseudomonas aeruginosa PA01
ccggucugcugcgcgcacca

SEQ ID NO: 1446434 - RNA, 13 nt, Pseudomonas aeruginosa PA01
ccggucuugccgg

SEQ ID NO: 1446435 - RNA, 22 nt, Pseudomonas aeruginosa PA01
ccggugaacagguagcuggaaa

SEQ ID NO: 1446436 - RNA, 19 nt, Pseudomonas aeruginosa PA01
ccggucugguagcgaaucu

SEQ ID NO: 1446437 - RNA, 16 nt, Pseudomonas aeruginosa PA01
ccggugcaccaggcga

SEQ ID NO: 1446438 - RNA, 17 nt, Pseudomonas aeruginosa PA01
ccggugcaccaggcgau

SEQ ID NO: 1446439 - RNA, 19 nt, Pseudomonas aeruginosa PA01
ccggugcaccaggcgaugc

SEQ ID NO: 1446440 - RNA, 19 nt, Pseudomonas aeruginosa PA01
ccggugaugucggcgcugu

SEQ ID NO: 1446441 - RNA, 20 nt, Pseudomonas aeruginosa PA01
ccggugacccacuccggcag

SEQ ID NO: 1446442 - RNA, 18 nt, Pseudomonas aeruginosa PA01
ccguaaaauggcgcgccu

SEQ ID NO: 1446443 - RNA, 22 nt, Pseudomonas aeruginosa PA01
ccgguuuuuuauugccagcgac

SEQ ID NO: 1446444 - RNA, 16 nt, Pseudomonas aeruginosa PA01
ccgguuugcugaccgg

SEQ ID NO: 1446445 - RNA, 15 nt, Pseudomonas aeruginosa PA01
ccgguuucgaccggc

SEQ ID NO: 1446446 - RNA, 20 nt, Pseudomonas aeruginosa PA01
ccgguuucccucgagcaccg

SEQ ID NO: 1446447 - RNA, 15 nt, Pseudomonas aeruginosa PA01
ccgguuuccgcagcg

SEQ ID NO: 1446448 - RNA, 16 nt, Pseudomonas aeruginosa PA01
ccgguuucgccaguuc

SEQ ID NO: 1446449 - RNA, 14 nt, Pseudomonas aeruginosa PA01
ccguaagaucgaug

SEQ ID NO: 1446450 - RNA, 23 nt, Pseudomonas aeruginosa PA01
ccguaagaucgaugaugaucgcc

SEQ ID NO: 1446451 - RNA, 15 nt, Pseudomonas aeruginosa PA01
ccgguugugcgcccg

SEQ ID NO: 1446452 - RNA, 16 nt, Pseudomonas aeruginosa PA01
ccgguugugcgcccgu

SEQ ID NO: 1446453 - RNA, 13 nt, Pseudomonas aeruginosa PA01
ccgguuccagcgg

SEQ ID NO: 1446454 - RNA, 15 nt, Pseudomonas aeruginosa PA01
ccgguuccagcggcc

SEQ ID NO: 1446455 - RNA, 18 nt, Pseudomonas aeruginosa PA01
ccgguuccagcggccgcg

SEQ ID NO: 1446456 - RNA, 15 nt, Pseudomonas aeruginosa PA01
ccgguucccgcagcg

SEQ ID NO: 1446457 - RNA, 17 nt, Pseudomonas aeruginosa PA01
ccgguuccgcgucgccu

SEQ ID NO: 1446458 - RNA, 20 nt, Pseudomonas aeruginosa PA01
ccgguuccgcgucgccuucg

SEQ ID NO: 1446459 - RNA, 18 nt, Pseudomonas aeruginosa PA01
ccgguucgacacgcucag

SEQ ID NO: 1446460 - RNA, 21 nt, Pseudomonas aeruginosa PA01
ccgguuaucgaggcgucggcg

SEQ ID NO: 1446461 - RNA, 18 nt, Pseudomonas aeruginosa PA01
ccggugcuggugcggccg

SEQ ID NO: 1446462 - RNA, 19 nt, Pseudomonas aeruginosa PA01
ccggugcuggugcggccga

SEQ ID NO: 1446463 - RNA, 19 nt, Pseudomonas aeruginosa PA01
ccggugccaggaccagccc

SEQ ID NO: 1446464 - RNA, 14 nt, Pseudomonas aeruginosa PA01
ccggugccagggcg

SEQ ID NO: 1446465 - RNA, 15 nt, Pseudomonas aeruginosa PA01
ccggugccagggcgg

SEQ ID NO: 1446466 - RNA, 22 nt, Pseudomonas aeruginosa PA01
ccggugccagggcggucggcca

SEQ ID NO: 1446467 - RNA, 19 nt, Pseudomonas aeruginosa PA01
ccggugccauacagcgccc

SEQ ID NO: 1446468 - RNA, 17 nt, Pseudomonas aeruginosa PA01
ccggugcaggaacaggu

SEQ ID NO: 1446469 - RNA, 14 nt, Pseudomonas aeruginosa PA01
ccggugcaggccga

SEQ ID NO: 1446470 - RNA, 14 nt, Pseudomonas aeruginosa PA01
ccggugcaccuggg

SEQ ID NO: 1446471 - RNA, 21 nt, Pseudomonas aeruginosa PA01
ccggugcagaagacgcccagc

SEQ ID NO: 1446472 - RNA, 20 nt, Pseudomonas aeruginosa PA01
ccggugcaugaaggcgcuga

SEQ ID NO: 1446473 - RNA, 14 nt, Pseudomonas aeruginosa PA01
ccggugcaugcgca

SEQ ID NO: 1446474 - RNA, 19 nt, Pseudomonas aeruginosa PA01
ccgguggggcgggcgaagc

SEQ ID NO: 1446475 - RNA, 17 nt, Pseudomonas aeruginosa PA01
ccggugggacugagccg

SEQ ID NO: 1446476 - RNA, 18 nt, Pseudomonas aeruginosa PA01
ccggugggacugagccgc

SEQ ID NO: 1446477 - RNA, 12 nt, Pseudomonas aeruginosa PA01
ccgguggcgguu

SEQ ID NO: 1446478 - RNA, 17 nt, Pseudomonas aeruginosa PA01
ccgguggcguacccgcc

SEQ ID NO: 1446479 - RNA, 22 nt, Pseudomonas aeruginosa PA01
ccgguggccuccugcaacgccu

SEQ ID NO: 1446480 - RNA, 24 nt, Pseudomonas aeruginosa PA01
ccggcgcggccgaacucuggcggc

SEQ ID NO: 1446481 - RNA, 15 nt, Pseudomonas aeruginosa PA01
ccggcgcggacggcc

SEQ ID NO: 1446482 - RNA, 18 nt, Pseudomonas aeruginosa PA01
ccggcgcggacggccugc

SEQ ID NO: 1446483 - RNA, 23 nt, Pseudomonas aeruginosa PA01
ccggcgcggacggccugcgcccu

SEQ ID NO: 1446484 - RNA, 12 nt, Pseudomonas aeruginosa PA01
ccggcgcgccgu

SEQ ID NO: 1446485 - RNA, 15 nt, Pseudomonas aeruginosa PA01
ccggcgcgcgguuuc

SEQ ID NO: 1446486 - RNA, 22 nt, Pseudomonas aeruginosa PA01
ccggcgcgcgguuucuucgccu

SEQ ID NO: 1446487 - RNA, 15 nt, Pseudomonas aeruginosa PA01
ccggcgcggcggccg

SEQ ID NO: 1446488 - RNA, 17 nt, Pseudomonas aeruginosa PA01
ccggcgcggcggccgcc

SEQ ID NO: 1446489 - RNA, 24 nt, Pseudomonas aeruginosa PA01
ccggcgcggcggccgccucggcgu

SEQ ID NO: 1446490 - RNA, 13 nt, Pseudomonas aeruginosa PA01
ccggcgcggcgca

SEQ ID NO: 1446491 - RNA, 15 nt, Pseudomonas aeruginosa PA01
ccggcgcggcgcagc

SEQ ID NO: 1446492 - RNA, 19 nt, Pseudomonas aeruginosa PA01
ccggcgcggcgcagccaga

SEQ ID NO: 1446493 - RNA, 13 nt, Pseudomonas aeruginosa PA01
ccggcgcggcgcg

SEQ ID NO: 1446494 - RNA, 20 nt, Pseudomonas aeruginosa PA01
ccggcgcggccugcagcgac

SEQ ID NO: 1446495 - RNA, 14 nt, Pseudomonas aeruginosa PA01
ccggcgcgauccug

SEQ ID NO: 1446496 - RNA, 17 nt, Pseudomonas aeruginosa PA01
ccggcgccuugcgccag

SEQ ID NO: 1446497 - RNA, 18 nt, Pseudomonas aeruginosa PA01
ccggcgccuugcgccagg

SEQ ID NO: 1446498 - RNA, 15 nt, Pseudomonas aeruginosa PA01
ccggcgcgaccgucg

SEQ ID NO: 1446499 - RNA, 18 nt, Pseudomonas aeruginosa PA01
ccggcgcgaccgucggcc

SEQ ID NO: 1446500 - RNA, 19 nt, Pseudomonas aeruginosa PA01
ccggcgcgaccgucggccg

SEQ ID NO: 1446501 - RNA, 20 nt, Pseudomonas aeruginosa PA01
ccggcgcgacgcuccaggug

SEQ ID NO: 1446502 - RNA, 13 nt, Pseudomonas aeruginosa PA01
ccggcgcgcacgg

SEQ ID NO: 1446503 - RNA, 19 nt, Pseudomonas aeruginosa PA01
ccggcgcgcacggaggcgc

SEQ ID NO: 1446504 - RNA, 16 nt, Pseudomonas aeruginosa PA01
ccggcgcgcacggucu

SEQ ID NO: 1446505 - RNA, 14 nt, Pseudomonas aeruginosa PA01
ccggcgcgccggac

SEQ ID NO: 1446506 - RNA, 15 nt, Pseudomonas aeruginosa PA01
ccggcgcgccggaca

SEQ ID NO: 1446507 - RNA, 17 nt, Pseudomonas aeruginosa PA01
ccggcgcgccggacagg

SEQ ID NO: 1446508 - RNA, 17 nt, Pseudomonas aeruginosa PA01
ccggcgcgcccggcgcc

SEQ ID NO: 1446509 - RNA, 18 nt, Pseudomonas aeruginosa PA01
ccggcgcgccccugcgcc

SEQ ID NO: 1446510 - RNA, 12 nt, Pseudomonas aeruginosa PA01
ccggcgcgcccg

SEQ ID NO: 1446511 - RNA, 20 nt, Pseudomonas aeruginosa PA01
ccggcggacaaccaccaugc

SEQ ID NO: 1446512 - RNA, 21 nt, Pseudomonas aeruginosa PA01
ccggcggauaaccgcaagcgg

SEQ ID NO: 1446513 - RNA, 20 nt, Pseudomonas aeruginosa PA01
ccggcggauaacgccugcgg

SEQ ID NO: 1446514 - RNA, 13 nt, Pseudomonas aeruginosa PA01
ccggcggaugacg

SEQ ID NO: 1446515 - RNA, 22 nt, Pseudomonas aeruginosa PA01
ccggcggauuacuccgccggcg

SEQ ID NO: 1446516 - RNA, 17 nt, Pseudomonas aeruginosa PA01
ccggcggaucagcccgc

SEQ ID NO: 1446517 - RNA, 23 nt, Pseudomonas aeruginosa PA01
ccggcggaucagcccgcugaccg

SEQ ID NO: 1446518 - RNA, 16 nt, Pseudomonas aeruginosa PA01
ccggcgcgggcggccu

SEQ ID NO: 1446519 - RNA, 20 nt, Pseudomonas aeruginosa PA01
ccggcgcgguuucgcagcgc

SEQ ID NO: 1446520 - RNA, 21 nt, Pseudomonas aeruginosa PA01
ccggcgcgguuucgcagcgcu

SEQ ID NO: 1446521 - RNA, 20 nt, Pseudomonas aeruginosa PA01
ccggcgcguagaggaugccg

SEQ ID NO: 1446522 - RNA, 23 nt, Pseudomonas aeruginosa PA01
ccggcgcguagaggaugccggcc

SEQ ID NO: 1446523 - RNA, 19 nt, Pseudomonas aeruginosa PA01
ccggcgcuccaacagcagg

SEQ ID NO: 1446524 - RNA, 21 nt, Pseudomonas aeruginosa PA01
ccggcgcuccaacagcaggua

SEQ ID NO: 1446525 - RNA, 18 nt, Pseudomonas aeruginosa PA01
ccggcgcgucgcugcgca

SEQ ID NO: 1446526 - RNA, 17 nt, Pseudomonas aeruginosa PA01
ccggcgcugagcgagac

SEQ ID NO: 1446527 - RNA, 18 nt, Pseudomonas aeruginosa PA01
ccggcgcucggccagguc

SEQ ID NO: 1446528 - RNA, 14 nt, Pseudomonas aeruginosa PA01
ccggcgcugcccgg

SEQ ID NO: 1446529 - RNA, 20 nt, Pseudomonas aeruginosa PA01
ccggcgcugucucgccagcc

SEQ ID NO: 1446530 - RNA, 13 nt, Pseudomonas aeruginosa PA01
ccggcgcuggccg

SEQ ID NO: 1446531 - RNA, 15 nt, Pseudomonas aeruginosa PA01
ccggcgcuggccgcg

SEQ ID NO: 1446532 - RNA, 20 nt, Pseudomonas aeruginosa PA01
ccggcggaacauggucgaga

SEQ ID NO: 1446533 - RNA, 18 nt, Pseudomonas aeruginosa PA01
ccggcgcuucgcgcagga

SEQ ID NO: 1446534 - RNA, 15 nt, Pseudomonas aeruginosa PA01
ccggcgcacgccggc

SEQ ID NO: 1446535 - RNA, 21 nt, Pseudomonas aeruginosa PA01
ccggcgcacgccggccucgcg

SEQ ID NO: 1446536 - RNA, 17 nt, Pseudomonas aeruginosa PA01
ccggcgcagucgucaag

SEQ ID NO: 1446537 - RNA, 16 nt, Pseudomonas aeruginosa PA01
ccggcgaagcuccucg

SEQ ID NO: 1446538 - RNA, 19 nt, Pseudomonas aeruginosa PA01
ccggcgcagaucgcggcgc

SEQ ID NO: 1446539 - RNA, 16 nt, Pseudomonas aeruginosa PA01
ccggcgccaccccgcc

SEQ ID NO: 1446540 - RNA, 22 nt, Pseudomonas aeruginosa PA01
ccggcgccaccccgccgcgcau

SEQ ID NO: 1446541 - RNA, 17 nt, Pseudomonas aeruginosa PA01
ccggcgcaugcgccggc

SEQ ID NO: 1446542 - RNA, 19 nt, Pseudomonas aeruginosa PA01
ccggcgcaucgucgaaacg

SEQ ID NO: 1446543 - RNA, 16 nt, Pseudomonas aeruginosa PA01
ccggcgcaucagcgcc

SEQ ID NO: 1446544 - RNA, 14 nt, Pseudomonas aeruginosa PA01
ccggcgccacccuc

SEQ ID NO: 1446545 - RNA, 12 nt, Pseudomonas aeruginosa PA01
ccggcgccaccg

SEQ ID NO: 1446546 - RNA, 21 nt, Pseudomonas aeruginosa PA01
ccggcgccaccgauucgccgg

SEQ ID NO: 1446547 - RNA, 22 nt, Pseudomonas aeruginosa PA01
ccggcgccaccgauucgccggc

SEQ ID NO: 1446548 - RNA, 14 nt, Pseudomonas aeruginosa PA01
ccggcgccagcagg

SEQ ID NO: 1446549 - RNA, 14 nt, Pseudomonas aeruginosa PA01
ccggcgaacgccgg

SEQ ID NO: 1446550 - RNA, 23 nt, Pseudomonas aeruginosa PA01
ccggcgaacgcuugagccccggc

SEQ ID NO: 1446551 - RNA, 16 nt, Pseudomonas aeruginosa PA01
ccggcgaacggcaugc

SEQ ID NO: 1446552 - RNA, 17 nt, Pseudomonas aeruginosa PA01
ccggcgaagggcaggcc

SEQ ID NO: 1446553 - RNA, 19 nt, Pseudomonas aeruginosa PA01
ccggcgaagggcaggccga

SEQ ID NO: 1446554 - RNA, 14 nt, Pseudomonas aeruginosa PA01
ccggccucggcggc

SEQ ID NO: 1446555 - RNA, 18 nt, Pseudomonas aeruginosa PA01
ccggccucggcggcgcga

SEQ ID NO: 1446556 - RNA, 13 nt, Pseudomonas aeruginosa PA01
ccggccucgccgg

SEQ ID NO: 1446557 - RNA, 18 nt, Pseudomonas aeruginosa PA01
ccggcgaaccgugguucu

SEQ ID NO: 1446558 - RNA, 16 nt, Pseudomonas aeruginosa PA01
ccggcgaacagccagc

SEQ ID NO: 1446559 - RNA, 18 nt, Pseudomonas aeruginosa PA01
ccggcgaacagccagcgg

SEQ ID NO: 1446560 - RNA, 16 nt, Pseudomonas aeruginosa PA01
ccggcgaaccaggcgg

SEQ ID NO: 1446561 - RNA, 20 nt, Pseudomonas aeruginosa PA01
ccggcgaaccaggcggccga

SEQ ID NO: 1446562 - RNA, 13 nt, Pseudomonas aeruginosa PA01
ccggcgaaccagu

SEQ ID NO: 1446563 - RNA, 21 nt, Pseudomonas aeruginosa PA01
ccggcgaaccagugcaccgcc

SEQ ID NO: 1446564 - RNA, 12 nt, Pseudomonas aeruginosa PA01
ccggcgaacagc

SEQ ID NO: 1446565 - RNA, 13 nt, Pseudomonas aeruginosa PA01
ccggcgccaggcc

SEQ ID NO: 1446566 - RNA, 21 nt, Pseudomonas aeruginosa PA01
ccggcgccaguucgccgguga

SEQ ID NO: 1446567 - RNA, 13 nt, Pseudomonas aeruginosa PA01
ccggcgcccagaa

SEQ ID NO: 1446568 - RNA, 14 nt, Pseudomonas aeruginosa PA01
ccggcgccccggcc

SEQ ID NO: 1446569 - RNA, 19 nt, Pseudomonas aeruginosa PA01
ccggcgccccggcccagcc

SEQ ID NO: 1446570 - RNA, 14 nt, Pseudomonas aeruginosa PA01
ccggcgccccugcg

SEQ ID NO: 1446571 - RNA, 21 nt, Pseudomonas aeruginosa PA01
ccggcgccccugcggcgccgg

SEQ ID NO: 1446572 - RNA, 15 nt, Pseudomonas aeruginosa PA01
ccggcgcccggcgca

SEQ ID NO: 1446573 - RNA, 19 nt, Pseudomonas aeruginosa PA01
ccggcgcccggcgcaugcc

SEQ ID NO: 1446574 - RNA, 12 nt, Pseudomonas aeruginosa PA01
ccggcgccgccc

SEQ ID NO: 1446575 - RNA, 19 nt, Pseudomonas aeruginosa PA01
ccggcgcccugggcgcgaa

SEQ ID NO: 1446576 - RNA, 12 nt, Pseudomonas aeruginosa PA01
ccggcgccgagg

SEQ ID NO: 1446577 - RNA, 23 nt, Pseudomonas aeruginosa PA01
ccggcgccgagguaguaggucug

SEQ ID NO: 1446578 - RNA, 16 nt, Pseudomonas aeruginosa PA01
ccggcgccgccgaaca

SEQ ID NO: 1446579 - RNA, 22 nt, Pseudomonas aeruginosa PA01
ccggcgccgccgaacaugccga

SEQ ID NO: 1446580 - RNA, 14 nt, Pseudomonas aeruginosa PA01
ccggcgccgcccuu

SEQ ID NO: 1446581 - RNA, 18 nt, Pseudomonas aeruginosa PA01
ccggcgccgccucgggca

SEQ ID NO: 1446582 - RNA, 14 nt, Pseudomonas aeruginosa PA01
ccggcgccgccugg

SEQ ID NO: 1446583 - RNA, 16 nt, Pseudomonas aeruginosa PA01
ccggcgccgccuggcc

SEQ ID NO: 1446584 - RNA, 17 nt, Pseudomonas aeruginosa PA01
ccggcgccgccuggccg

SEQ ID NO: 1446585 - RNA, 18 nt, Pseudomonas aeruginosa PA01
ccggcgccgccuggccgg

SEQ ID NO: 1446586 - RNA, 12 nt, Pseudomonas aeruginosa PA01
ccggcgccggca

SEQ ID NO: 1446587 - RNA, 14 nt, Pseudomonas aeruginosa PA01
ccggcgccggcagg

SEQ ID NO: 1446588 - RNA, 14 nt, Pseudomonas aeruginosa PA01
ccggcgccgucgac

SEQ ID NO: 1446589 - RNA, 13 nt, Pseudomonas aeruginosa PA01
ccggcgccgggau

SEQ ID NO: 1446590 - RNA, 13 nt, Pseudomonas aeruginosa PA01
ccggcccuugagc

SEQ ID NO: 1446591 - RNA, 20 nt, Pseudomonas aeruginosa PA01
ccggcccuugagcauggcgu

SEQ ID NO: 1446592 - RNA, 13 nt, Pseudomonas aeruginosa PA01
ccggccgaccagg

SEQ ID NO: 1446593 - RNA, 15 nt, Pseudomonas aeruginosa PA01
ccggcccucgcgagc

SEQ ID NO: 1446594 - RNA, 17 nt, Pseudomonas aeruginosa PA01
ccggcccucgcgagccc

SEQ ID NO: 1446595 - RNA, 17 nt, Pseudomonas aeruginosa PA01
ccggccauccagccagg

SEQ ID NO: 1446596 - RNA, 22 nt, Pseudomonas aeruginosa PA01
ccggccauccagccaggcgcuc

SEQ ID NO: 1446597 - RNA, 11 nt, Pseudomonas aeruginosa PA01
ccggccauccu

SEQ ID NO: 1446598 - RNA, 14 nt, Pseudomonas aeruginosa PA01
ccggccauccuggc

SEQ ID NO: 1446599 - RNA, 17 nt, Pseudomonas aeruginosa PA01
ccggccauccuggccgg

SEQ ID NO: 1446600 - RNA, 18 nt, Pseudomonas aeruginosa PA01
ccggccauccuggccggu

SEQ ID NO: 1446601 - RNA, 23 nt, Pseudomonas aeruginosa PA01
ccggccaguuggugcacgcgccg

SEQ ID NO: 1446602 - RNA, 16 nt, Pseudomonas aeruginosa PA01
ccggccaucagcacca

SEQ ID NO: 1446603 - RNA, 21 nt, Pseudomonas aeruginosa PA01
ccggccaucagcaccaggaag

SEQ ID NO: 1446604 - RNA, 18 nt, Pseudomonas aeruginosa PA01
ccggccagguaccggcca

SEQ ID NO: 1446605 - RNA, 23 nt, Pseudomonas aeruginosa PA01
ccggccagguagcggcguucgcc

SEQ ID NO: 1446606 - RNA, 17 nt, Pseudomonas aeruginosa PA01
ccggccagguaggcgac

SEQ ID NO: 1446607 - RNA, 18 nt, Pseudomonas aeruginosa PA01
ccggccagguaggcgacg

SEQ ID NO: 1446608 - RNA, 22 nt, Pseudomonas aeruginosa PA01
ccggccaggucguugcgccggc

SEQ ID NO: 1446609 - RNA, 21 nt, Pseudomonas aeruginosa PA01
ccggccgccuuccucggccgc

SEQ ID NO: 1446610 - RNA, 23 nt, Pseudomonas aeruginosa PA01
ccggccgaucaccuucaccggca

SEQ ID NO: 1446611 - RNA, 14 nt, Pseudomonas aeruginosa PA01
ccggccgcgcucga

SEQ ID NO: 1446612 - RNA, 19 nt, Pseudomonas aeruginosa PA01
ccggccgcgcucgacgguc

SEQ ID NO: 1446613 - RNA, 21 nt, Pseudomonas aeruginosa PA01
ccggccgcgucgcccaggccg

SEQ ID NO: 1446614 - RNA, 12 nt, Pseudomonas aeruginosa PA01
ccggccgcugcc

SEQ ID NO: 1446615 - RNA, 17 nt, Pseudomonas aeruginosa PA01
ccggccgcugccgggcu

SEQ ID NO: 1446616 - RNA, 12 nt, Pseudomonas aeruginosa PA01
ccggccgcugga

SEQ ID NO: 1446617 - RNA, 23 nt, Pseudomonas aeruginosa PA01
ccggccgcuggaugccgaccacg

SEQ ID NO: 1446618 - RNA, 13 nt, Pseudomonas aeruginosa PA01
ccggccggcagcg

SEQ ID NO: 1446619 - RNA, 16 nt, Pseudomonas aeruginosa PA01
ccggccggcggccuga

SEQ ID NO: 1446620 - RNA, 12 nt, Pseudomonas aeruginosa PA01
ccggccggcuca

SEQ ID NO: 1446621 - RNA, 23 nt, Pseudomonas aeruginosa PA01
ccggccgggcuagguuuccccgu

SEQ ID NO: 1446622 - RNA, 15 nt, Pseudomonas aeruginosa PA01
ccggccuccagcgcc

SEQ ID NO: 1446623 - RNA, 16 nt, Pseudomonas aeruginosa PA01
ccggccuccagcgccu

SEQ ID NO: 1446624 - RNA, 17 nt, Pseudomonas aeruginosa PA01
ccggccuccagcgccuc

SEQ ID NO: 1446625 - RNA, 16 nt, Pseudomonas aeruginosa PA01
ccggccuccaggcugg

SEQ ID NO: 1446626 - RNA, 20 nt, Pseudomonas aeruginosa PA01
ccggccucaacgaccgccca

SEQ ID NO: 1446627 - RNA, 21 nt, Pseudomonas aeruginosa PA01
ccggccuccccggcccgcgcc

SEQ ID NO: 1446628 - RNA, 22 nt, Pseudomonas aeruginosa PA01
ccggccuccccggcccgcgccg

SEQ ID NO: 1446629 - RNA, 12 nt, Pseudomonas aeruginosa PA01
ccggccucggcg

SEQ ID NO: 1446630 - RNA, 17 nt, Pseudomonas aeruginosa PA01
ccggccucgacgcagag

SEQ ID NO: 1446631 - RNA, 21 nt, Pseudomonas aeruginosa PA01
ccggccucgacgcagagcgcc

SEQ ID NO: 1446632 - RNA, 15 nt, Pseudomonas aeruginosa PA01
ccggccucgccgguc

SEQ ID NO: 1446633 - RNA, 15 nt, Pseudomonas aeruginosa PA01
ccggccucgcgcaac

SEQ ID NO: 1446634 - RNA, 13 nt, Pseudomonas aeruginosa PA01
ccggccagcagcg

SEQ ID NO: 1446635 - RNA, 15 nt, Pseudomonas aeruginosa PA01
ccggccagcagcgcc

SEQ ID NO: 1446636 - RNA, 20 nt, Pseudomonas aeruginosa PA01
ccggccagagcuucugcugg

SEQ ID NO: 1446637 - RNA, 18 nt, Pseudomonas aeruginosa PA01
ccggccagcgcggcggac

SEQ ID NO: 1446638 - RNA, 13 nt, Pseudomonas aeruginosa PA01
ccggccagcgcgg

SEQ ID NO: 1446639 - RNA, 18 nt, Pseudomonas aeruginosa PA01
ccggccagccgcgccagu

SEQ ID NO: 1446640 - RNA, 18 nt, Pseudomonas aeruginosa PA01
ccggccagccuucccggc

SEQ ID NO: 1446641 - RNA, 12 nt, Pseudomonas aeruginosa PA01
ccggccagcgca

SEQ ID NO: 1446642 - RNA, 14 nt, Pseudomonas aeruginosa PA01
ccggccagccaggc

SEQ ID NO: 1446643 - RNA, 12 nt, Pseudomonas aeruginosa PA01
ccggccagcccg

SEQ ID NO: 1446644 - RNA, 15 nt, Pseudomonas aeruginosa PA01
ccggccagcccggcc

SEQ ID NO: 1446645 - RNA, 16 nt, Pseudomonas aeruginosa PA01
ccggccagcccggccu

SEQ ID NO: 1446646 - RNA, 12 nt, Pseudomonas aeruginosa PA01
ccggccagccgc

SEQ ID NO: 1446647 - RNA, 23 nt, Pseudomonas aeruginosa PA01
ccggccacgcgaccagcgccagg

SEQ ID NO: 1446648 - RNA, 14 nt, Pseudomonas aeruginosa PA01
ccggccacucgcag

SEQ ID NO: 1446649 - RNA, 15 nt, Pseudomonas aeruginosa PA01
ccggccacucgcagc

SEQ ID NO: 1446650 - RNA, 18 nt, Pseudomonas aeruginosa PA01
ccggccacucgcagccgc

SEQ ID NO: 1446651 - RNA, 19 nt, Pseudomonas aeruginosa PA01
ccggccacucgcagccgcg

SEQ ID NO: 1446652 - RNA, 21 nt, Pseudomonas aeruginosa PA01
ccggccacucgcagccgcgcu

SEQ ID NO: 1446653 - RNA, 14 nt, Pseudomonas aeruginosa PA01
ccggccaauggccg

SEQ ID NO: 1446654 - RNA, 15 nt, Pseudomonas aeruginosa PA01
ccggccaauggccgg

SEQ ID NO: 1446655 - RNA, 18 nt, Pseudomonas aeruginosa PA01
ccggccaauggccgggcu

SEQ ID NO: 1446656 - RNA, 22 nt, Pseudomonas aeruginosa PA01
ccggccaccaggcuuacccgcg

SEQ ID NO: 1446657 - RNA, 15 nt, Pseudomonas aeruginosa PA01
ccggccaccagcagc

SEQ ID NO: 1446658 - RNA, 15 nt, Pseudomonas aeruginosa PA01
ccgcuugccagccgc

SEQ ID NO: 1446659 - RNA, 16 nt, Pseudomonas aeruginosa PA01
ccgcuugaagcggcca

SEQ ID NO: 1446660 - RNA, 16 nt, Pseudomonas aeruginosa PA01
ccgcuucuucccgccc

SEQ ID NO: 1446661 - RNA, 13 nt, Pseudomonas aeruginosa PA01
ccgcuucgucggu

SEQ ID NO: 1446662 - RNA, 13 nt, Pseudomonas aeruginosa PA01
ccgcuugcgccgc

SEQ ID NO: 1446663 - RNA, 21 nt, Pseudomonas aeruginosa PA01
ccgcuugcggucauccgccgg

SEQ ID NO: 1446664 - RNA, 22 nt, Pseudomonas aeruginosa PA01
ccgcuugcggucauccgccggc

SEQ ID NO: 1446665 - RNA, 15 nt, Pseudomonas aeruginosa PA01
ccgcuugcgguuauc

SEQ ID NO: 1446666 - RNA, 19 nt, Pseudomonas aeruginosa PA01
ccgcuugcgguuauccgcc

SEQ ID NO: 1446667 - RNA, 23 nt, Pseudomonas aeruginosa PA01
ccgcuugcgguuauccgccgugg

SEQ ID NO: 1446668 - RNA, 19 nt, Pseudomonas aeruginosa PA01
ccgcuuggagcgggcgccg

SEQ ID NO: 1446669 - RNA, 17 nt, Pseudomonas aeruginosa PA01
ccgcuuggccauggcgc

SEQ ID NO: 1446670 - RNA, 18 nt, Pseudomonas aeruginosa PA01
ccgcuuucguagggcgaa

SEQ ID NO: 1446671 - RNA, 18 nt, Pseudomonas aeruginosa PA01
ccgcuuuccccggcggca

SEQ ID NO: 1446672 - RNA, 15 nt, Pseudomonas aeruginosa PA01
ccgcuuucagcgccg

SEQ ID NO: 1446673 - RNA, 17 nt, Pseudomonas aeruginosa PA01
ccgcuuucagcgccgcu

SEQ ID NO: 1446674 - RNA, 18 nt, Pseudomonas aeruginosa PA01
ccgcuuucagcgccgcuc

SEQ ID NO: 1446675 - RNA, 22 nt, Pseudomonas aeruginosa PA01
ccgcuuucagcgccgcucggcg

SEQ ID NO: 1446676 - RNA, 21 nt, Pseudomonas aeruginosa PA01
ccgcuugccgucgaccugcgg

SEQ ID NO: 1446677 - RNA, 16 nt, Pseudomonas aeruginosa PA01
ccggaaaacagcgagc

SEQ ID NO: 1446678 - RNA, 14 nt, Pseudomonas aeruginosa PA01
ccggaaaagaagcc

SEQ ID NO: 1446679 - RNA, 17 nt, Pseudomonas aeruginosa PA01
ccggaaagccuggccgg

SEQ ID NO: 1446680 - RNA, 17 nt, Pseudomonas aeruginosa PA01
ccggcaucgugccgcgg

SEQ ID NO: 1446681 - RNA, 15 nt, Pseudomonas aeruginosa PA01
ccggcaucguggcca

SEQ ID NO: 1446682 - RNA, 14 nt, Pseudomonas aeruginosa PA01
ccggcaucugccgg

SEQ ID NO: 1446683 - RNA, 16 nt, Pseudomonas aeruginosa PA01
ccggcaugcucagccg

SEQ ID NO: 1446684 - RNA, 22 nt, Pseudomonas aeruginosa PA01
ccggcaugacggauccacucgu

SEQ ID NO: 1446685 - RNA, 14 nt, Pseudomonas aeruginosa PA01
ccggcauggaucaa

SEQ ID NO: 1446686 - RNA, 15 nt, Pseudomonas aeruginosa PA01
ccggcaugcuugcca

SEQ ID NO: 1446687 - RNA, 21 nt, Pseudomonas aeruginosa PA01
ccggcauuagucuuuggucua

SEQ ID NO: 1446688 - RNA, 19 nt, Pseudomonas aeruginosa PA01
ccggcauguagcgcgccga

SEQ ID NO: 1446689 - RNA, 13 nt, Pseudomonas aeruginosa PA01
ccggcauugccga

SEQ ID NO: 1446690 - RNA, 12 nt, Pseudomonas aeruginosa PA01
ccggcauucgcc

SEQ ID NO: 1446691 - RNA, 15 nt, Pseudomonas aeruginosa PA01
ccggcauucgccggg

SEQ ID NO: 1446692 - RNA, 16 nt, Pseudomonas aeruginosa PA01
ccggcauucgccgggc

SEQ ID NO: 1446693 - RNA, 13 nt, Pseudomonas aeruginosa PA01
ccggcuucagcaa

SEQ ID NO: 1446694 - RNA, 22 nt, Pseudomonas aeruginosa PA01
ccggcuuccaccagacgcagca

SEQ ID NO: 1446695 - RNA, 19 nt, Pseudomonas aeruginosa PA01
ccggcugugcagggcagcg

SEQ ID NO: 1446696 - RNA, 20 nt, Pseudomonas aeruginosa PA01
ccggcugucgacgcagccgg

SEQ ID NO: 1446697 - RNA, 24 nt, Pseudomonas aeruginosa PA01
ccggcugucgacgcagccgggccg

SEQ ID NO: 1446698 - RNA, 19 nt, Pseudomonas aeruginosa PA01
ccggcugguugccagcagc

SEQ ID NO: 1446699 - RNA, 22 nt, Pseudomonas aeruginosa PA01
ccggcugguugccagcagcgcu

SEQ ID NO: 1446700 - RNA, 13 nt, Pseudomonas aeruginosa PA01
ccgggaggcgccg

SEQ ID NO: 1446701 - RNA, 13 nt, Pseudomonas aeruginosa PA01
ccgggagcggccg

SEQ ID NO: 1446702 - RNA, 20 nt, Pseudomonas aeruginosa PA01
ccgggcaacgauucgacgca

SEQ ID NO: 1446703 - RNA, 18 nt, Pseudomonas aeruginosa PA01
ccgggcaacgccaggccg

SEQ ID NO: 1446704 - RNA, 18 nt, Pseudomonas aeruginosa PA01
ccgggcaacgcgcagagg

SEQ ID NO: 1446705 - RNA, 16 nt, Pseudomonas aeruginosa PA01
ccgggaugcccggccg

SEQ ID NO: 1446706 - RNA, 18 nt, Pseudomonas aeruginosa PA01
ccgggaugaacugcagcu

SEQ ID NO: 1446707 - RNA, 21 nt, Pseudomonas aeruginosa PA01
ccgggaugaacugcagcuugu

SEQ ID NO: 1446708 - RNA, 19 nt, Pseudomonas aeruginosa PA01
ccgggauuguugcggcggg

SEQ ID NO: 1446709 - RNA, 19 nt, Pseudomonas aeruginosa PA01
ccgggaucaccucgaaccc

SEQ ID NO: 1446710 - RNA, 21 nt, Pseudomonas aeruginosa PA01
ccgggaucaccucgaaccccu

SEQ ID NO: 1446711 - RNA, 19 nt, Pseudomonas aeruginosa PA01
ccgggaucagcggcggggc

SEQ ID NO: 1446712 - RNA, 19 nt, Pseudomonas aeruginosa PA01
ccgggaucuccucgacggc

SEQ ID NO: 1446713 - RNA, 22 nt, Pseudomonas aeruginosa PA01
ccgggaucgaugcgcgcccuga

SEQ ID NO: 1446714 - RNA, 16 nt, Pseudomonas aeruginosa PA01
ccgggcaucuugccca

SEQ ID NO: 1446715 - RNA, 14 nt, Pseudomonas aeruginosa PA01
ccgggcaucgccga

SEQ ID NO: 1446716 - RNA, 13 nt, Pseudomonas aeruginosa PA01
ccgggcagcagcc

SEQ ID NO: 1446717 - RNA, 18 nt, Pseudomonas aeruginosa PA01
ccgggcaacugaucagcc

SEQ ID NO: 1446718 - RNA, 20 nt, Pseudomonas aeruginosa PA01
ccgggcaacugaucagccgg

SEQ ID NO: 1446719 - RNA, 21 nt, Pseudomonas aeruginosa PA01
ccgggcaacugaucagccggg

SEQ ID NO: 1446720 - RNA, 17 nt, Pseudomonas aeruginosa PA01
ccgggcaagcucgacga

SEQ ID NO: 1446721 - RNA, 13 nt, Pseudomonas aeruginosa PA01
ccgggcagcggcg

SEQ ID NO: 1446722 - RNA, 16 nt, Pseudomonas aeruginosa PA01
ccgggcagcggcgcaa

SEQ ID NO: 1446723 - RNA, 22 nt, Pseudomonas aeruginosa PA01
ccgggcaggccgaggccggcga

SEQ ID NO: 1446724 - RNA, 15 nt, Pseudomonas aeruginosa PA01
ccgggccgcgcacaa

SEQ ID NO: 1446725 - RNA, 14 nt, Pseudomonas aeruginosa PA01
ccgggccgccggcg

SEQ ID NO: 1446726 - RNA, 14 nt, Pseudomonas aeruginosa PA01
ccgggccuccuggc

SEQ ID NO: 1446727 - RNA, 18 nt, Pseudomonas aeruginosa PA01
ccgggccuccuggcggcg

SEQ ID NO: 1446728 - RNA, 16 nt, Pseudomonas aeruginosa PA01
ccgggccgucgggcau

SEQ ID NO: 1446729 - RNA, 17 nt, Pseudomonas aeruginosa PA01
ccgggccggccagggcg

SEQ ID NO: 1446730 - RNA, 21 nt, Pseudomonas aeruginosa PA01
ccgggcguugguacagcucgc

SEQ ID NO: 1446731 - RNA, 18 nt, Pseudomonas aeruginosa PA01
ccgggcguggggcgaaua

SEQ ID NO: 1446732 - RNA, 13 nt, Pseudomonas aeruginosa PA01
ccgggcgugccag

SEQ ID NO: 1446733 - RNA, 19 nt, Pseudomonas aeruginosa PA01
ccgggcucacucccgucca

SEQ ID NO: 1446734 - RNA, 23 nt, Pseudomonas aeruginosa PA01
ccgggcucacucccguccagcgc

SEQ ID NO: 1446735 - RNA, 21 nt, Pseudomonas aeruginosa PA01
ccgggcucugguagccgcagu

SEQ ID NO: 1446736 - RNA, 23 nt, Pseudomonas aeruginosa PA01
ccgggcugccgaacaggcguccc

SEQ ID NO: 1446737 - RNA, 13 nt, Pseudomonas aeruginosa PA01
ccgggccuggugc

SEQ ID NO: 1446738 - RNA, 19 nt, Pseudomonas aeruginosa PA01
ccgggccuggugcacgccg

SEQ ID NO: 1446739 - RNA, 22 nt, Pseudomonas aeruginosa PA01
ccgggccuggugcacgccgaug

SEQ ID NO: 1446740 - RNA, 13 nt, Pseudomonas aeruginosa PA01
ccgggcgaccugc

SEQ ID NO: 1446741 - RNA, 23 nt, Pseudomonas aeruginosa PA01
ccgggcgaccugcucgcgcaccg

SEQ ID NO: 1446742 - RNA, 20 nt, Pseudomonas aeruginosa PA01
ccgggcgccaccgauagcgg

SEQ ID NO: 1446743 - RNA, 23 nt, Pseudomonas aeruginosa PA01
ccgggcgagucgaucaggucgcc

SEQ ID NO: 1446744 - RNA, 21 nt, Pseudomonas aeruginosa PA01
ccgggcuucgguguaucggcg

SEQ ID NO: 1446745 - RNA, 23 nt, Pseudomonas aeruginosa PA01
ccgggcuucgguguaucggcgga

SEQ ID NO: 1446746 - RNA, 23 nt, Pseudomonas aeruginosa PA01
ccggggaagauguucgccgccgc

SEQ ID NO: 1446747 - RNA, 17 nt, Pseudomonas aeruginosa PA01
ccgggcuuuuucauggc

SEQ ID NO: 1446748 - RNA, 23 nt, Pseudomonas aeruginosa PA01
ccgggcuuuuucauggcuggccc

SEQ ID NO: 1446749 - RNA, 18 nt, Pseudomonas aeruginosa PA01
ccgggcugguucagcggg

SEQ ID NO: 1446750 - RNA, 14 nt, Pseudomonas aeruginosa PA01
ccgggcuggccguc

SEQ ID NO: 1446751 - RNA, 21 nt, Pseudomonas aeruginosa PA01
ccgggcugcgcucggcgcucg

SEQ ID NO: 1446752 - RNA, 13 nt, Pseudomonas aeruginosa PA01
ccgggcuggccgu

SEQ ID NO: 1446753 - RNA, 12 nt, Pseudomonas aeruginosa PA01
ccgggcuggcca

SEQ ID NO: 1446754 - RNA, 13 nt, Pseudomonas aeruginosa PA01
ccgggcuggccac

SEQ ID NO: 1446755 - RNA, 17 nt, Pseudomonas aeruginosa PA01
ccgggcuggccaccagc

SEQ ID NO: 1446756 - RNA, 16 nt, Pseudomonas aeruginosa PA01
ccggggcgcgggcgaa

SEQ ID NO: 1446757 - RNA, 18 nt, Pseudomonas aeruginosa PA01
ccggggcgcgggcgaagc

SEQ ID NO: 1446758 - RNA, 20 nt, Pseudomonas aeruginosa PA01
ccggggcgcgggcgaagcgc

SEQ ID NO: 1446759 - RNA, 20 nt, Pseudomonas aeruginosa PA01
ccggggcggauucaggcgcg

SEQ ID NO: 1446760 - RNA, 22 nt, Pseudomonas aeruginosa PA01
ccggggcggauucaggcgcgcu

SEQ ID NO: 1446761 - RNA, 24 nt, Pseudomonas aeruginosa PA01
ccggggcggauucaggcgcgcucg

SEQ ID NO: 1446762 - RNA, 19 nt, Pseudomonas aeruginosa PA01
ccggggcgcuguuggccug

SEQ ID NO: 1446763 - RNA, 13 nt, Pseudomonas aeruginosa PA01
ccggggcgcgccc

SEQ ID NO: 1446764 - RNA, 19 nt, Pseudomonas aeruginosa PA01
ccggggcgcgcccgccagg

SEQ ID NO: 1446765 - RNA, 18 nt, Pseudomonas aeruginosa PA01
ccggggaucagcgagagc

SEQ ID NO: 1446766 - RNA, 19 nt, Pseudomonas aeruginosa PA01
ccggggaucagcgagagcu

SEQ ID NO: 1446767 - RNA, 14 nt, Pseudomonas aeruginosa PA01
ccggggaucagguc

SEQ ID NO: 1446768 - RNA, 21 nt, Pseudomonas aeruginosa PA01
ccggggaucaggucgccgcug

SEQ ID NO: 1446769 - RNA, 19 nt, Pseudomonas aeruginosa PA01
ccggggagggugccgugga

SEQ ID NO: 1446770 - RNA, 14 nt, Pseudomonas aeruginosa PA01
ccggggcagcaggg

SEQ ID NO: 1446771 - RNA, 16 nt, Pseudomonas aeruginosa PA01
ccggggcagcagggcg

SEQ ID NO: 1446772 - RNA, 13 nt, Pseudomonas aeruginosa PA01
ccggggcccggca

SEQ ID NO: 1446773 - RNA, 14 nt, Pseudomonas aeruginosa PA01
ccggggcccggcag

SEQ ID NO: 1446774 - RNA, 15 nt, Pseudomonas aeruginosa PA01
ccggggcccggcagg

SEQ ID NO: 1446775 - RNA, 21 nt, Pseudomonas aeruginosa PA01
ccggcggcgcugaggaucagc

SEQ ID NO: 1446776 - RNA, 15 nt, Pseudomonas aeruginosa PA01
ccggcggcggacgca

SEQ ID NO: 1446777 - RNA, 13 nt, Pseudomonas aeruginosa PA01
ccggcggcggcac

SEQ ID NO: 1446778 - RNA, 14 nt, Pseudomonas aeruginosa PA01
ccggcggcgccagg

SEQ ID NO: 1446779 - RNA, 20 nt, Pseudomonas aeruginosa PA01
ccggcggcgccaggccggcg

SEQ ID NO: 1446780 - RNA, 16 nt, Pseudomonas aeruginosa PA01
ccggcggcgcggcagu

SEQ ID NO: 1446781 - RNA, 18 nt, Pseudomonas aeruginosa PA01
ccggcggcgcggcagugc

SEQ ID NO: 1446782 - RNA, 20 nt, Pseudomonas aeruginosa PA01
ccggcggcgcguuccacguc

SEQ ID NO: 1446783 - RNA, 22 nt, Pseudomonas aeruginosa PA01
ccggcggcugcugcgccuggcc

SEQ ID NO: 1446784 - RNA, 23 nt, Pseudomonas aeruginosa PA01
ccggcggcugcugcgccuggccg

SEQ ID NO: 1446785 - RNA, 17 nt, Pseudomonas aeruginosa PA01
ccggcgggaaacgcgag

SEQ ID NO: 1446786 - RNA, 19 nt, Pseudomonas aeruginosa PA01
ccggcgggauguacgccag

SEQ ID NO: 1446787 - RNA, 15 nt, Pseudomonas aeruginosa PA01
ccggcggcgacccag

SEQ ID NO: 1446788 - RNA, 16 nt, Pseudomonas aeruginosa PA01
ccggcggcgacccaga

SEQ ID NO: 1446789 - RNA, 12 nt, Pseudomonas aeruginosa PA01
ccggcggcgaug

SEQ ID NO: 1446790 - RNA, 18 nt, Pseudomonas aeruginosa PA01
ccggcggcgaugaucggc

SEQ ID NO: 1446791 - RNA, 21 nt, Pseudomonas aeruginosa PA01
ccggcggcgaugaucggcagc

SEQ ID NO: 1446792 - RNA, 22 nt, Pseudomonas aeruginosa PA01
ccggcggcgaugaucggcagcc

SEQ ID NO: 1446793 - RNA, 13 nt, Pseudomonas aeruginosa PA01
ccggcggcgaaca

SEQ ID NO: 1446794 - RNA, 16 nt, Pseudomonas aeruginosa PA01
ccggcggccugagccg

SEQ ID NO: 1446795 - RNA, 18 nt, Pseudomonas aeruginosa PA01
ccggcggccugagccggc

SEQ ID NO: 1446796 - RNA, 12 nt, Pseudomonas aeruginosa PA01
ccggcggccugc

SEQ ID NO: 1446797 - RNA, 14 nt, Pseudomonas aeruginosa PA01
ccggcggccggcgc

SEQ ID NO: 1446798 - RNA, 17 nt, Pseudomonas aeruginosa PA01
ccggcggccggcgcagu

SEQ ID NO: 1446799 - RNA, 20 nt, Pseudomonas aeruginosa PA01
ccggcggugagggcgacggc

SEQ ID NO: 1446800 - RNA, 21 nt, Pseudomonas aeruginosa PA01
ccggcggugagggcgacggcg

SEQ ID NO: 1446801 - RNA, 22 nt, Pseudomonas aeruginosa PA01
ccggcgguggacgucggcgugg

SEQ ID NO: 1446802 - RNA, 20 nt, Pseudomonas aeruginosa PA01
ccggcgguuucgccgaggcc

SEQ ID NO: 1446803 - RNA, 23 nt, Pseudomonas aeruginosa PA01
ccggcgguuucgccgaggcccag

SEQ ID NO: 1446804 - RNA, 18 nt, Pseudomonas aeruginosa PA01
ccggcguaccguuggcga

SEQ ID NO: 1446805 - RNA, 22 nt, Pseudomonas aeruginosa PA01
ccggcguacgaaccccgggccg

SEQ ID NO: 1446806 - RNA, 22 nt, Pseudomonas aeruginosa PA01
ccggcggggaagccuucgcccg

SEQ ID NO: 1446807 - RNA, 23 nt, Pseudomonas aeruginosa PA01
ccggcggggaagccuucgcccgg

SEQ ID NO: 1446808 - RNA, 19 nt, Pseudomonas aeruginosa PA01
ccggcgggcgcgaggcgcc

SEQ ID NO: 1446809 - RNA, 21 nt, Pseudomonas aeruginosa PA01
ccggcgggcgcgaggcgcccg

SEQ ID NO: 1446810 - RNA, 20 nt, Pseudomonas aeruginosa PA01
ccggcgguccgccgcgggac

SEQ ID NO: 1446811 - RNA, 18 nt, Pseudomonas aeruginosa PA01
ccggcggguucagcccgc

SEQ ID NO: 1446812 - RNA, 21 nt, Pseudomonas aeruginosa PA01
ccggcggguucagcccgccgu

SEQ ID NO: 1446813 - RNA, 15 nt, Pseudomonas aeruginosa PA01
ccggcuccggcugcg

SEQ ID NO: 1446814 - RNA, 16 nt, Pseudomonas aeruginosa PA01
ccggcucgacgccgac

SEQ ID NO: 1446815 - RNA, 17 nt, Pseudomonas aeruginosa PA01
ccggcucgcccagcagg

SEQ ID NO: 1446816 - RNA, 21 nt, Pseudomonas aeruginosa PA01
ccggcucgcccaugcgcggcg

SEQ ID NO: 1446817 - RNA, 19 nt, Pseudomonas aeruginosa PA01
ccggcugacgcuggcgaag

SEQ ID NO: 1446818 - RNA, 13 nt, Pseudomonas aeruginosa PA01
ccggcugcacagg

SEQ ID NO: 1446819 - RNA, 14 nt, Pseudomonas aeruginosa PA01
ccggcugcaugccg

SEQ ID NO: 1446820 - RNA, 15 nt, Pseudomonas aeruginosa PA01
ccggcugcaugccgg

SEQ ID NO: 1446821 - RNA, 16 nt, Pseudomonas aeruginosa PA01
ccggcugcaugccggg

SEQ ID NO: 1446822 - RNA, 18 nt, Pseudomonas aeruginosa PA01
ccggcugcauguccgcca

SEQ ID NO: 1446823 - RNA, 20 nt, Pseudomonas aeruginosa PA01
ccggcugcauguccgccagu

SEQ ID NO: 1446824 - RNA, 13 nt, Pseudomonas aeruginosa PA01
ccggcugagcgcc

SEQ ID NO: 1446825 - RNA, 20 nt, Pseudomonas aeruginosa PA01
ccggcugagcgccaggcgca

SEQ ID NO: 1446826 - RNA, 13 nt, Pseudomonas aeruginosa PA01
ccggcguugccga

SEQ ID NO: 1446827 - RNA, 17 nt, Pseudomonas aeruginosa PA01
ccggcguugccgauggu

SEQ ID NO: 1446828 - RNA, 13 nt, Pseudomonas aeruginosa PA01
ccggcuccagccg

SEQ ID NO: 1446829 - RNA, 17 nt, Pseudomonas aeruginosa PA01
ccggcuccagccgggcu

SEQ ID NO: 1446830 - RNA, 14 nt, Pseudomonas aeruginosa PA01
ccggcuaaccgcga

SEQ ID NO: 1446831 - RNA, 20 nt, Pseudomonas aeruginosa PA01
ccggcuccccuggaaugccg

SEQ ID NO: 1446832 - RNA, 17 nt, Pseudomonas aeruginosa PA01
ccggcuccaacggcccu

SEQ ID NO: 1446833 - RNA, 16 nt, Pseudomonas aeruginosa PA01
ccggcguuucgccggg

SEQ ID NO: 1446834 - RNA, 18 nt, Pseudomonas aeruginosa PA01
ccggcguuucgccgggcc

SEQ ID NO: 1446835 - RNA, 20 nt, Pseudomonas aeruginosa PA01
ccggcguccccuuccuccuc

SEQ ID NO: 1446836 - RNA, 23 nt, Pseudomonas aeruginosa PA01
ccggcguccccuuccuccucgcc

SEQ ID NO: 1446837 - RNA, 18 nt, Pseudomonas aeruginosa PA01
ccggcguacuucggcgcg

SEQ ID NO: 1446838 - RNA, 18 nt, Pseudomonas aeruginosa PA01
ccggcguccacuccggca

SEQ ID NO: 1446839 - RNA, 20 nt, Pseudomonas aeruginosa PA01
ccggcguccacuccggcagc

SEQ ID NO: 1446840 - RNA, 15 nt, Pseudomonas aeruginosa PA01
ccggcguccaggagg

SEQ ID NO: 1446841 - RNA, 21 nt, Pseudomonas aeruginosa PA01
ccggcguccgggugccccagg

SEQ ID NO: 1446842 - RNA, 20 nt, Pseudomonas aeruginosa PA01
ccggcguccuccuccaguuc

SEQ ID NO: 1446843 - RNA, 16 nt, Pseudomonas aeruginosa PA01
ccggcguccucgcgac

SEQ ID NO: 1446844 - RNA, 21 nt, Pseudomonas aeruginosa PA01
ccggcguccucgcgacaccgg

SEQ ID NO: 1446845 - RNA, 13 nt, Pseudomonas aeruginosa PA01
ccggcguccucgg

SEQ ID NO: 1446846 - RNA, 18 nt, Pseudomonas aeruginosa PA01
ccggcguccucggagagc

SEQ ID NO: 1446847 - RNA, 14 nt, Pseudomonas aeruginosa PA01
ccggcgucggcgcg

SEQ ID NO: 1446848 - RNA, 14 nt, Pseudomonas aeruginosa PA01
ccggcgucguccug

SEQ ID NO: 1446849 - RNA, 22 nt, Pseudomonas aeruginosa PA01
ccggcgucguccugcgcggcga

SEQ ID NO: 1446850 - RNA, 23 nt, Pseudomonas aeruginosa PA01
ccggcgucguccugcgcggcgac

SEQ ID NO: 1446851 - RNA, 15 nt, Pseudomonas aeruginosa PA01
ccggcgucggcgcgg

SEQ ID NO: 1446852 - RNA, 16 nt, Pseudomonas aeruginosa PA01
ccggcgucggcgcggg

SEQ ID NO: 1446853 - RNA, 22 nt, Pseudomonas aeruginosa PA01
ccggcgucggcgcgggcgccga

SEQ ID NO: 1446854 - RNA, 18 nt, Pseudomonas aeruginosa PA01
ccggcguggacccacgca

SEQ ID NO: 1446855 - RNA, 19 nt, Pseudomonas aeruginosa PA01
ccggcgugggcggucggcg

SEQ ID NO: 1446856 - RNA, 20 nt, Pseudomonas aeruginosa PA01
ccggcgugggcggucggcga

SEQ ID NO: 1446857 - RNA, 13 nt, Pseudomonas aeruginosa PA01
ccggcgugguggc

SEQ ID NO: 1446858 - RNA, 16 nt, Pseudomonas aeruginosa PA01
ccggcguuauccgccg

SEQ ID NO: 1446859 - RNA, 18 nt, Pseudomonas aeruginosa PA01
ccggcguuauccgccgau

SEQ ID NO: 1446860 - RNA, 19 nt, Pseudomonas aeruginosa PA01
ccggcguuauccgccgaua

SEQ ID NO: 1446861 - RNA, 17 nt, Pseudomonas aeruginosa PA01
ccggcgugagcagggcc

SEQ ID NO: 1446862 - RNA, 22 nt, Pseudomonas aeruginosa PA01
ccggcgugagcagggccgagcg

SEQ ID NO: 1446863 - RNA, 14 nt, Pseudomonas aeruginosa PA01
ccggcgugaacgcg

SEQ ID NO: 1446864 - RNA, 17 nt, Pseudomonas aeruginosa PA01
ccggcgugaacgcggcg

SEQ ID NO: 1446865 - RNA, 20 nt, Pseudomonas aeruginosa PA01
ccggcgugaacgcggcgaga

SEQ ID NO: 1446866 - RNA, 14 nt, Pseudomonas aeruginosa PA01
ccgcuucagcgcgc

SEQ ID NO: 1446867 - RNA, 15 nt, Pseudomonas aeruginosa PA01
ccgcuucagcgcgcc

SEQ ID NO: 1446868 - RNA, 15 nt, Pseudomonas aeruginosa PA01
ccgcuucgccgcccu

SEQ ID NO: 1446869 - RNA, 12 nt, Pseudomonas aeruginosa PA01
ccgcuucggcug

SEQ ID NO: 1446870 - RNA, 13 nt, Pseudomonas aeruginosa PA01
ccgcuucggcggg

SEQ ID NO: 1446871 - RNA, 14 nt, Pseudomonas aeruginosa PA01
ccgcuucgcggauc

SEQ ID NO: 1446872 - RNA, 14 nt, Pseudomonas aeruginosa PA01
ccgcuuccgcccag

SEQ ID NO: 1446873 - RNA, 13 nt, Pseudomonas aeruginosa PA01
ccgcuuccgccgg

SEQ ID NO: 1446874 - RNA, 23 nt, Pseudomonas aeruginosa PA01
ccgcuguuucuccaguucggcga

SEQ ID NO: 1446875 - RNA, 21 nt, Pseudomonas aeruginosa PA01
ccgcuuccugggcuucguccg

SEQ ID NO: 1446876 - RNA, 11 nt, Pseudomonas aeruginosa PA01
ccgcuucgagc

SEQ ID NO: 1446877 - RNA, 16 nt, Pseudomonas aeruginosa PA01
ccgcuucgagcgggcu

SEQ ID NO: 1446878 - RNA, 15 nt, Pseudomonas aeruginosa PA01
ccgcugggcagcacg

SEQ ID NO: 1446879 - RNA, 18 nt, Pseudomonas aeruginosa PA01
ccgcugggcagcacgcug

SEQ ID NO: 1446880 - RNA, 23 nt, Pseudomonas aeruginosa PA01
ccgcugguaauggugaucaccuu

SEQ ID NO: 1446881 - RNA, 16 nt, Pseudomonas aeruginosa PA01
ccgcugguagcccagg

SEQ ID NO: 1446882 - RNA, 19 nt, Pseudomonas aeruginosa PA01
ccgcugguagcccaggccg

SEQ ID NO: 1446883 - RNA, 22 nt, Pseudomonas aeruginosa PA01
ccgcugguagcuaccgucggcc

SEQ ID NO: 1446884 - RNA, 17 nt, Pseudomonas aeruginosa PA01
ccgcugguccagcuggc

SEQ ID NO: 1446885 - RNA, 18 nt, Pseudomonas aeruginosa PA01
ccgcugguccagcuggcg

SEQ ID NO: 1446886 - RNA, 13 nt, Pseudomonas aeruginosa PA01
ccgcuggucggca

SEQ ID NO: 1446887 - RNA, 15 nt, Pseudomonas aeruginosa PA01
ccgcuggucggcauc

SEQ ID NO: 1446888 - RNA, 21 nt, Pseudomonas aeruginosa PA01
ccgcuggucggcauccggcag

SEQ ID NO: 1446889 - RNA, 23 nt, Pseudomonas aeruginosa PA01
ccgcuggucggcauccggcaggc

SEQ ID NO: 1446890 - RNA, 24 nt, Pseudomonas aeruginosa PA01
ccgcuggucggcauccggcaggcg

SEQ ID NO: 1446891 - RNA, 16 nt, Pseudomonas aeruginosa PA01
ccgcuguccgccgccg

SEQ ID NO: 1446892 - RNA, 21 nt, Pseudomonas aeruginosa PA01
ccgcuguccgccgccgcggcg

SEQ ID NO: 1446893 - RNA, 15 nt, Pseudomonas aeruginosa PA01
ccgcuguccgccggc

SEQ ID NO: 1446894 - RNA, 17 nt, Pseudomonas aeruginosa PA01
ccgcuguccgccggccu

SEQ ID NO: 1446895 - RNA, 13 nt, Pseudomonas aeruginosa PA01
ccgcugucgucca

SEQ ID NO: 1446896 - RNA, 19 nt, Pseudomonas aeruginosa PA01
ccgcugucguccagcgggu

SEQ ID NO: 1446897 - RNA, 20 nt, Pseudomonas aeruginosa PA01
ccgcugucguccagcgggua

SEQ ID NO: 1446898 - RNA, 21 nt, Pseudomonas aeruginosa PA01
ccgcuguggaaguacggcgcg

SEQ ID NO: 1446899 - RNA, 22 nt, Pseudomonas aeruginosa PA01
ccgcuguggaaguacggcgcgg

SEQ ID NO: 1446900 - RNA, 19 nt, Pseudomonas aeruginosa PA01
ccgcugucgucuucggcca

SEQ ID NO: 1446901 - RNA, 22 nt, Pseudomonas aeruginosa PA01
ccgcuggcggccuucggcgucg

SEQ ID NO: 1446902 - RNA, 15 nt, Pseudomonas aeruginosa PA01
ccgcuggcggcgacg

SEQ ID NO: 1446903 - RNA, 21 nt, Pseudomonas aeruginosa PA01
ccgcuggcggcgacgaagguc

SEQ ID NO: 1446904 - RNA, 14 nt, Pseudomonas aeruginosa PA01
ccgcuggccagguc

SEQ ID NO: 1446905 - RNA, 15 nt, Pseudomonas aeruginosa PA01
ccgcuggccuggcca

SEQ ID NO: 1446906 - RNA, 13 nt, Pseudomonas aeruginosa PA01
ccgcuggcgacgc

SEQ ID NO: 1446907 - RNA, 13 nt, Pseudomonas aeruginosa PA01
ccgcuggcgagga

SEQ ID NO: 1446908 - RNA, 14 nt, Pseudomonas aeruginosa PA01
ccgcuggcgaucuc

SEQ ID NO: 1446909 - RNA, 19 nt, Pseudomonas aeruginosa PA01
ccgcuggcgaucucggcgc

SEQ ID NO: 1446910 - RNA, 20 nt, Pseudomonas aeruginosa PA01
ccgcuggcgaucucggcgcg

SEQ ID NO: 1446911 - RNA, 16 nt, Pseudomonas aeruginosa PA01
ccgcugcgcaggccga

SEQ ID NO: 1446912 - RNA, 14 nt, Pseudomonas aeruginosa PA01
ccgcugcgcgaagc

SEQ ID NO: 1446913 - RNA, 14 nt, Pseudomonas aeruginosa PA01
ccgcugcgcgcagu

SEQ ID NO: 1446914 - RNA, 13 nt, Pseudomonas aeruginosa PA01
ccgcugcgccgcc

SEQ ID NO: 1446915 - RNA, 14 nt, Pseudomonas aeruginosa PA01
ccgcugcgccgccg

SEQ ID NO: 1446916 - RNA, 16 nt, Pseudomonas aeruginosa PA01
ccgcugcgccgccguc

SEQ ID NO: 1446917 - RNA, 17 nt, Pseudomonas aeruginosa PA01
ccgcugcgccgccgucu

SEQ ID NO: 1446918 - RNA, 19 nt, Pseudomonas aeruginosa PA01
ccgcugcggaagagguacg

SEQ ID NO: 1446919 - RNA, 13 nt, Pseudomonas aeruginosa PA01
ccgcugcgcgggu

SEQ ID NO: 1446920 - RNA, 20 nt, Pseudomonas aeruginosa PA01
ccgcugcgcgguuauccgcc

SEQ ID NO: 1446921 - RNA, 14 nt, Pseudomonas aeruginosa PA01
ccgcugcgcugcca

SEQ ID NO: 1446922 - RNA, 20 nt, Pseudomonas aeruginosa PA01
ccgcugcgcugccagcgccg

SEQ ID NO: 1446923 - RNA, 20 nt, Pseudomonas aeruginosa PA01
ccgcugcgcgggucuugccg

SEQ ID NO: 1446924 - RNA, 15 nt, Pseudomonas aeruginosa PA01
ccgcugccgccgucu

SEQ ID NO: 1446925 - RNA, 15 nt, Pseudomonas aeruginosa PA01
ccgcucugcuggcca

SEQ ID NO: 1446926 - RNA, 20 nt, Pseudomonas aeruginosa PA01
ccgcugccugucgcagcggg

SEQ ID NO: 1446927 - RNA, 21 nt, Pseudomonas aeruginosa PA01
ccgcugccugucgcagcgggc

SEQ ID NO: 1446928 - RNA, 17 nt, Pseudomonas aeruginosa PA01
ccgcugaaauagcgcgu

SEQ ID NO: 1446929 - RNA, 15 nt, Pseudomonas aeruginosa PA01
ccgcugccgcucugg

SEQ ID NO: 1446930 - RNA, 19 nt, Pseudomonas aeruginosa PA01
ccgcucuucugguaggcca

SEQ ID NO: 1446931 - RNA, 13 nt, Pseudomonas aeruginosa PA01
ccgcuccaggcug

SEQ ID NO: 1446932 - RNA, 16 nt, Pseudomonas aeruginosa PA01
ccgcucgucaggcgcu

SEQ ID NO: 1446933 - RNA, 17 nt, Pseudomonas aeruginosa PA01
ccgcucgucauggcgca

SEQ ID NO: 1446934 - RNA, 19 nt, Pseudomonas aeruginosa PA01
ccgcucgucauggcgcacg

SEQ ID NO: 1446935 - RNA, 22 nt, Pseudomonas aeruginosa PA01
ccgcucgucauggcgcacgccg

SEQ ID NO: 1446936 - RNA, 21 nt, Pseudomonas aeruginosa PA01
ccgcucguuggcggccagcau

SEQ ID NO: 1446937 - RNA, 13 nt, Pseudomonas aeruginosa PA01
ccgcucugccaga

SEQ ID NO: 1446938 - RNA, 16 nt, Pseudomonas aeruginosa PA01
ccgcuaucgccgccgc

SEQ ID NO: 1446939 - RNA, 17 nt, Pseudomonas aeruginosa PA01
ccgcuaucgcuggcgca

SEQ ID NO: 1446940 - RNA, 20 nt, Pseudomonas aeruginosa PA01
ccgcuaucgcuggcgcagcc

SEQ ID NO: 1446941 - RNA, 18 nt, Pseudomonas aeruginosa PA01
ccgcuacugcgcgggcau

SEQ ID NO: 1446942 - RNA, 23 nt, Pseudomonas aeruginosa PA01
ccgcguugcauguccucggcgcc

SEQ ID NO: 1446943 - RNA, 23 nt, Pseudomonas aeruginosa PA01
ccgcucaagacggcccgcagauc

SEQ ID NO: 1446944 - RNA, 18 nt, Pseudomonas aeruginosa PA01
ccgcuaugggcaccgcgc

SEQ ID NO: 1446945 - RNA, 21 nt, Pseudomonas aeruginosa PA01
ccgcuaugggcaccgcgccgg

SEQ ID NO: 1446946 - RNA, 22 nt, Pseudomonas aeruginosa PA01
ccgcuaugggcaccgcgccggc

SEQ ID NO: 1446947 - RNA, 20 nt, Pseudomonas aeruginosa PA01
ccgcguugcgguuauucgcc

SEQ ID NO: 1446948 - RNA, 18 nt, Pseudomonas aeruginosa PA01
ccgcucggcguagccggc

SEQ ID NO: 1446949 - RNA, 20 nt, Pseudomonas aeruginosa PA01
ccgcucggcguagccggcga

SEQ ID NO: 1446950 - RNA, 23 nt, Pseudomonas aeruginosa PA01
ccgcucggcggguauccgccggg

SEQ ID NO: 1446951 - RNA, 22 nt, Pseudomonas aeruginosa PA01
ccgcuccaggaucgccuccacc

SEQ ID NO: 1446952 - RNA, 11 nt, Pseudomonas aeruginosa PA01
ccgcuccaggc

SEQ ID NO: 1446953 - RNA, 13 nt, Pseudomonas aeruginosa PA01
ccgcuccagccgg

SEQ ID NO: 1446954 - RNA, 15 nt, Pseudomonas aeruginosa PA01
ccgcuccagccggca

SEQ ID NO: 1446955 - RNA, 17 nt, Pseudomonas aeruginosa PA01
ccgcuccagccggcaag

SEQ ID NO: 1446956 - RNA, 13 nt, Pseudomonas aeruginosa PA01
ccgcuccagcgcc

SEQ ID NO: 1446957 - RNA, 14 nt, Pseudomonas aeruginosa PA01
ccgcuccagcgccu

SEQ ID NO: 1446958 - RNA, 19 nt, Pseudomonas aeruginosa PA01
ccgcuccagcgccucgacc

SEQ ID NO: 1446959 - RNA, 21 nt, Pseudomonas aeruginosa PA01
ccgcucaugagauccgccagc

SEQ ID NO: 1446960 - RNA, 17 nt, Pseudomonas aeruginosa PA01
ccgcucagucgaccguc

SEQ ID NO: 1446961 - RNA, 15 nt, Pseudomonas aeruginosa PA01
ccgcucaccgccacc

SEQ ID NO: 1446962 - RNA, 16 nt, Pseudomonas aeruginosa PA01
ccgcucaggaugcgau

SEQ ID NO: 1446963 - RNA, 16 nt, Pseudomonas aeruginosa PA01
ccgcucaggcugugca

SEQ ID NO: 1446964 - RNA, 15 nt, Pseudomonas aeruginosa PA01
ccgcucaaccgaaca

SEQ ID NO: 1446965 - RNA, 14 nt, Pseudomonas aeruginosa PA01
ccgcucaccaggcc

SEQ ID NO: 1446966 - RNA, 20 nt, Pseudomonas aeruginosa PA01
ccgcgguacccggcagggcc

SEQ ID NO: 1446967 - RNA, 16 nt, Pseudomonas aeruginosa PA01
ccgcggguuccucacg

SEQ ID NO: 1446968 - RNA, 18 nt, Pseudomonas aeruginosa PA01
ccgcgguagcugcgcagg

SEQ ID NO: 1446969 - RNA, 20 nt, Pseudomonas aeruginosa PA01
ccgcgguagcugcgcagggc

SEQ ID NO: 1446970 - RNA, 22 nt, Pseudomonas aeruginosa PA01
ccgcgguagcugcgcagggcgc

SEQ ID NO: 1446971 - RNA, 18 nt, Pseudomonas aeruginosa PA01
ccgcgguauucuccagca

SEQ ID NO: 1446972 - RNA, 19 nt, Pseudomonas aeruginosa PA01
ccgcggucacucggccucg

SEQ ID NO: 1446973 - RNA, 13 nt, Pseudomonas aeruginosa PA01
ccgcgucgcgcgc

SEQ ID NO: 1446974 - RNA, 15 nt, Pseudomonas aeruginosa PA01
ccgcgucgcgcgcgg

SEQ ID NO: 1446975 - RNA, 22 nt, Pseudomonas aeruginosa PA01
ccgcgucgcgcgcggcauccag

SEQ ID NO: 1446976 - RNA, 13 nt, Pseudomonas aeruginosa PA01
ccgcgucgccgcc

SEQ ID NO: 1446977 - RNA, 16 nt, Pseudomonas aeruginosa PA01
ccgcgucgccgccagc

SEQ ID NO: 1446978 - RNA, 18 nt, Pseudomonas aeruginosa PA01
ccgcguguucgaccgggu

SEQ ID NO: 1446979 - RNA, 15 nt, Pseudomonas aeruginosa PA01
ccgcguguucgcggc

SEQ ID NO: 1446980 - RNA, 20 nt, Pseudomonas aeruginosa PA01
ccgcguguucgcggcucugg

SEQ ID NO: 1446981 - RNA, 12 nt, Pseudomonas aeruginosa PA01
ccgcgugggccg

SEQ ID NO: 1446982 - RNA, 15 nt, Pseudomonas aeruginosa PA01
ccgcgugggccggca

SEQ ID NO: 1446983 - RNA, 16 nt, Pseudomonas aeruginosa PA01
ccgcgugggccggcau

SEQ ID NO: 1446984 - RNA, 17 nt, Pseudomonas aeruginosa PA01
ccgcgugggccggcaug

SEQ ID NO: 1446985 - RNA, 20 nt, Pseudomonas aeruginosa PA01
ccgcgugggcuucgccgccg

SEQ ID NO: 1446986 - RNA, 14 nt, Pseudomonas aeruginosa PA01
ccgcguggcgugcu

SEQ ID NO: 1446987 - RNA, 18 nt, Pseudomonas aeruginosa PA01
ccgcguggcgugcucggc

SEQ ID NO: 1446988 - RNA, 19 nt, Pseudomonas aeruginosa PA01
ccgcguggcgugcucggcg

SEQ ID NO: 1446989 - RNA, 15 nt, Pseudomonas aeruginosa PA01
ccgcguucugcggac

SEQ ID NO: 1446990 - RNA, 14 nt, Pseudomonas aeruginosa PA01
ccgcguucgccgag

SEQ ID NO: 1446991 - RNA, 15 nt, Pseudomonas aeruginosa PA01
ccgcguucgccgagg

SEQ ID NO: 1446992 - RNA, 14 nt, Pseudomonas aeruginosa PA01
ccgcguucgcgggg

SEQ ID NO: 1446993 - RNA, 15 nt, Pseudomonas aeruginosa PA01
ccgcguucagucccg

SEQ ID NO: 1446994 - RNA, 21 nt, Pseudomonas aeruginosa PA01
ccgcguucagucccgcggcgc

SEQ ID NO: 1446995 - RNA, 15 nt, Pseudomonas aeruginosa PA01
ccgcgugcgcgccgc

SEQ ID NO: 1446996 - RNA, 18 nt, Pseudomonas aeruginosa PA01
ccgcgugcgcgccgccgg

SEQ ID NO: 1446997 - RNA, 20 nt, Pseudomonas aeruginosa PA01
ccgcgugcgcgccgccgggc

SEQ ID NO: 1446998 - RNA, 23 nt, Pseudomonas aeruginosa PA01
ccgcgucggcucgguuccagcuc

SEQ ID NO: 1446999 - RNA, 21 nt, Pseudomonas aeruginosa PA01
ccgcgucgggaaaggccgcca

SEQ ID NO: 1447000 - RNA, 15 nt, Pseudomonas aeruginosa PA01
ccgcggaccgggcgg

SEQ ID NO: 1447001 - RNA, 17 nt, Pseudomonas aeruginosa PA01
ccgcggaccgggcggcg

SEQ ID NO: 1447002 - RNA, 22 nt, Pseudomonas aeruginosa PA01
ccgcggaccgggcggcgcggcg

SEQ ID NO: 1447003 - RNA, 21 nt, Pseudomonas aeruginosa PA01
ccgcggacgauauugguguag

SEQ ID NO: 1447004 - RNA, 19 nt, Pseudomonas aeruginosa PA01
ccgcggacggcacggggcg

SEQ ID NO: 1447005 - RNA, 12 nt, Pseudomonas aeruginosa PA01
ccgcggacggcc

SEQ ID NO: 1447006 - RNA, 23 nt, Pseudomonas aeruginosa PA01
ccgcggauccacgccuggcccug

SEQ ID NO: 1447007 - RNA, 15 nt, Pseudomonas aeruginosa PA01
ccgcggaucgcgccg

SEQ ID NO: 1447008 - RNA, 21 nt, Pseudomonas aeruginosa PA01
ccgcggaucgcgccgucgcug

SEQ ID NO: 1447009 - RNA, 15 nt, Pseudomonas aeruginosa PA01
ccgcggaucguccgg

SEQ ID NO: 1447010 - RNA, 19 nt, Pseudomonas aeruginosa PA01
ccgcggaucguccgggcgg

SEQ ID NO: 1447011 - RNA, 16 nt, Pseudomonas aeruginosa PA01
ccgcggaugacgggcg

SEQ ID NO: 1447012 - RNA, 21 nt, Pseudomonas aeruginosa PA01
ccgcggagaaacgcuuggcga

SEQ ID NO: 1447013 - RNA, 15 nt, Pseudomonas aeruginosa PA01
ccgcggagucgccgg

SEQ ID NO: 1447014 - RNA, 16 nt, Pseudomonas aeruginosa PA01
ccgcggagucgccggu

SEQ ID NO: 1447015 - RNA, 21 nt, Pseudomonas aeruginosa PA01
ccgcggccagcccccucgccc

SEQ ID NO: 1447016 - RNA, 17 nt, Pseudomonas aeruginosa PA01
ccgcggcaccggcgacg

SEQ ID NO: 1447017 - RNA, 16 nt, Pseudomonas aeruginosa PA01
ccgcggcacuccggca

SEQ ID NO: 1447018 - RNA, 14 nt, Pseudomonas aeruginosa PA01
ccgcggcagcagcc

SEQ ID NO: 1447019 - RNA, 16 nt, Pseudomonas aeruginosa PA01
ccgcggcaucggccug

SEQ ID NO: 1447020 - RNA, 19 nt, Pseudomonas aeruginosa PA01
ccgcggaaucgcguagcgc

SEQ ID NO: 1447021 - RNA, 13 nt, Pseudomonas aeruginosa PA01
ccgcggaauggcg

SEQ ID NO: 1447022 - RNA, 16 nt, Pseudomonas aeruginosa PA01
ccgcggaauggcgcgc

SEQ ID NO: 1447023 - RNA, 15 nt, Pseudomonas aeruginosa PA01
ccgcgcuucuucgac

SEQ ID NO: 1447024 - RNA, 22 nt, Pseudomonas aeruginosa PA01
ccgcggaaaacgccgcgaagcc

SEQ ID NO: 1447025 - RNA, 18 nt, Pseudomonas aeruginosa PA01
ccgcgcggcgcccugccg

SEQ ID NO: 1447026 - RNA, 20 nt, Pseudomonas aeruginosa PA01
ccgcgcgccugcaacgccag

SEQ ID NO: 1447027 - RNA, 19 nt, Pseudomonas aeruginosa PA01
ccgcgcuuggccuugccgu

SEQ ID NO: 1447028 - RNA, 19 nt, Pseudomonas aeruginosa PA01
ccgcgcuuccgcaucggcc

SEQ ID NO: 1447029 - RNA, 20 nt, Pseudomonas aeruginosa PA01
ccgcgcgggccgaggucgcg

SEQ ID NO: 1447030 - RNA, 15 nt, Pseudomonas aeruginosa PA01
ccgcgcgggccggcg

SEQ ID NO: 1447031 - RNA, 17 nt, Pseudomonas aeruginosa PA01
ccgcgcgggccggcgau

SEQ ID NO: 1447032 - RNA, 15 nt, Pseudomonas aeruginosa PA01
ccgcgggcagcucga

SEQ ID NO: 1447033 - RNA, 15 nt, Pseudomonas aeruginosa PA01
ccgcgggcgaacggc

SEQ ID NO: 1447034 - RNA, 23 nt, Pseudomonas aeruginosa PA01
ccgcgggcgccuuuuucauggcc

SEQ ID NO: 1447035 - RNA, 18 nt, Pseudomonas aeruginosa PA01
ccgcgggucucgaucagc

SEQ ID NO: 1447036 - RNA, 22 nt, Pseudomonas aeruginosa PA01
ccgcgggucucgaucagcgccg

SEQ ID NO: 1447037 - RNA, 23 nt, Pseudomonas aeruginosa PA01
ccgcgggucucgaucagcgccgg

SEQ ID NO: 1447038 - RNA, 19 nt, Pseudomonas aeruginosa PA01
ccgcgggucugcucggcgc

SEQ ID NO: 1447039 - RNA, 21 nt, Pseudomonas aeruginosa PA01
ccgcggguggcaaccgacgag

SEQ ID NO: 1447040 - RNA, 14 nt, Pseudomonas aeruginosa PA01
ccgcgggacgccgc

SEQ ID NO: 1447041 - RNA, 15 nt, Pseudomonas aeruginosa PA01
ccgcgggacgcggcg

SEQ ID NO: 1447042 - RNA, 16 nt, Pseudomonas aeruginosa PA01
ccgcgggcagcagucg

SEQ ID NO: 1447043 - RNA, 21 nt, Pseudomonas aeruginosa PA01
ccgcgggcaaccgcggcggcc

SEQ ID NO: 1447044 - RNA, 14 nt, Pseudomonas aeruginosa PA01
ccgcggcggcgugc

SEQ ID NO: 1447045 - RNA, 19 nt, Pseudomonas aeruginosa PA01
ccgcggcggcgugcaggcc

SEQ ID NO: 1447046 - RNA, 14 nt, Pseudomonas aeruginosa PA01
ccgcggcggcgacg

SEQ ID NO: 1447047 - RNA, 15 nt, Pseudomonas aeruginosa PA01
ccgcggcggcgacgc

SEQ ID NO: 1447048 - RNA, 22 nt, Pseudomonas aeruginosa PA01
ccgcggcguuagccgccugcgg

SEQ ID NO: 1447049 - RNA, 23 nt, Pseudomonas aeruginosa PA01
ccgcggcguugucggccagcagc

SEQ ID NO: 1447050 - RNA, 14 nt, Pseudomonas aeruginosa PA01
ccgcggcuccagcc

SEQ ID NO: 1447051 - RNA, 17 nt, Pseudomonas aeruginosa PA01
ccgcggcugaugccgcg

SEQ ID NO: 1447052 - RNA, 22 nt, Pseudomonas aeruginosa PA01
ccgcggcuggcaggugccgcuc

SEQ ID NO: 1447053 - RNA, 14 nt, Pseudomonas aeruginosa PA01
ccgcggcuggccau

SEQ ID NO: 1447054 - RNA, 21 nt, Pseudomonas aeruginosa PA01
ccgcggcuggccauccgcccu

SEQ ID NO: 1447055 - RNA, 21 nt, Pseudomonas aeruginosa PA01
ccgcggcccugcgccgcagcg

SEQ ID NO: 1447056 - RNA, 15 nt, Pseudomonas aeruginosa PA01
ccgcggcccugcucg

SEQ ID NO: 1447057 - RNA, 16 nt, Pseudomonas aeruginosa PA01
ccgcggcccugcucgc

SEQ ID NO: 1447058 - RNA, 12 nt, Pseudomonas aeruginosa PA01
ccgcggccccgg

SEQ ID NO: 1447059 - RNA, 14 nt, Pseudomonas aeruginosa PA01
ccgcggccccggcg

SEQ ID NO: 1447060 - RNA, 23 nt, Pseudomonas aeruginosa PA01
ccgcggccgaaaucgaugucgcg

SEQ ID NO: 1447061 - RNA, 13 nt, Pseudomonas aeruginosa PA01
ccgcggccucgcu

SEQ ID NO: 1447062 - RNA, 18 nt, Pseudomonas aeruginosa PA01
ccgcggccucgcuggcga

SEQ ID NO: 1447063 - RNA, 13 nt, Pseudomonas aeruginosa PA01
ccgcggccggcuu

SEQ ID NO: 1447064 - RNA, 13 nt, Pseudomonas aeruginosa PA01
ccgcggccgggga

SEQ ID NO: 1447065 - RNA, 12 nt, Pseudomonas aeruginosa PA01
ccgcggccggcg

SEQ ID NO: 1447066 - RNA, 12 nt, Pseudomonas aeruginosa PA01
ccgcggccggca

SEQ ID NO: 1447067 - RNA, 13 nt, Pseudomonas aeruginosa PA01
ccgcggccggcag

SEQ ID NO: 1447068 - RNA, 16 nt, Pseudomonas aeruginosa PA01
ccgcggccggcaggcc

SEQ ID NO: 1447069 - RNA, 18 nt, Pseudomonas aeruginosa PA01
ccgcggccggcaggccga

SEQ ID NO: 1447070 - RNA, 12 nt, Pseudomonas aeruginosa PA01
ccgcggccuugg

SEQ ID NO: 1447071 - RNA, 12 nt, Pseudomonas aeruginosa PA01
ccgcggcgaagc

SEQ ID NO: 1447072 - RNA, 18 nt, Pseudomonas aeruginosa PA01
ccgcggcgaagcgcucga

SEQ ID NO: 1447073 - RNA, 19 nt, Pseudomonas aeruginosa PA01
ccgcggcgaagcgcucgac

SEQ ID NO: 1447074 - RNA, 18 nt, Pseudomonas aeruginosa PA01
ccgcggcgaccagcgcgg

SEQ ID NO: 1447075 - RNA, 12 nt, Pseudomonas aeruginosa PA01
ccgcggcgacgg

SEQ ID NO: 1447076 - RNA, 17 nt, Pseudomonas aeruginosa PA01
ccgcggcgagcagcggc

SEQ ID NO: 1447077 - RNA, 21 nt, Pseudomonas aeruginosa PA01
ccgcggcgagcaucucggcca

SEQ ID NO: 1447078 - RNA, 22 nt, Pseudomonas aeruginosa PA01
ccgcggcgcccucugccggucg

SEQ ID NO: 1447079 - RNA, 13 nt, Pseudomonas aeruginosa PA01
ccgcggcgcgccu

SEQ ID NO: 1447080 - RNA, 15 nt, Pseudomonas aeruginosa PA01
ccgcggcgcucggca

SEQ ID NO: 1447081 - RNA, 21 nt, Pseudomonas aeruginosa PA01
ccgcgcagcuugccuuccagg

SEQ ID NO: 1447082 - RNA, 18 nt, Pseudomonas aeruginosa PA01
ccgcgcaggcggucgccg

SEQ ID NO: 1447083 - RNA, 24 nt, Pseudomonas aeruginosa PA01
ccgcgaugguauggcggucggcca

SEQ ID NO: 1447084 - RNA, 15 nt, Pseudomonas aeruginosa PA01
ccgcgcauaggaggc

SEQ ID NO: 1447085 - RNA, 22 nt, Pseudomonas aeruginosa PA01
ccgcgcaucaccccgcaaccgc

SEQ ID NO: 1447086 - RNA, 17 nt, Pseudomonas aeruginosa PA01
ccgcgauggcucgcggc

SEQ ID NO: 1447087 - RNA, 16 nt, Pseudomonas aeruginosa PA01
ccgcgaugcguuccag

SEQ ID NO: 1447088 - RNA, 22 nt, Pseudomonas aeruginosa PA01
ccgcgaugcguuccagggcgaa

SEQ ID NO: 1447089 - RNA, 17 nt, Pseudomonas aeruginosa PA01
ccgcgccccagcggcag

SEQ ID NO: 1447090 - RNA, 14 nt, Pseudomonas aeruginosa PA01
ccgcgcccggccag

SEQ ID NO: 1447091 - RNA, 13 nt, Pseudomonas aeruginosa PA01
ccgcgcccggcug

SEQ ID NO: 1447092 - RNA, 14 nt, Pseudomonas aeruginosa PA01
ccgcgcccggcugg

SEQ ID NO: 1447093 - RNA, 18 nt, Pseudomonas aeruginosa PA01
ccgcgcccggcuggccau

SEQ ID NO: 1447094 - RNA, 17 nt, Pseudomonas aeruginosa PA01
ccgcgccaacuggcgca

SEQ ID NO: 1447095 - RNA, 15 nt, Pseudomonas aeruginosa PA01
ccgcgcccaggcgca

SEQ ID NO: 1447096 - RNA, 23 nt, Pseudomonas aeruginosa PA01
ccgcgcccaggcugccggccagg

SEQ ID NO: 1447097 - RNA, 22 nt, Pseudomonas aeruginosa PA01
ccgcgcauggagacggcccgcc

SEQ ID NO: 1447098 - RNA, 15 nt, Pseudomonas aeruginosa PA01
ccgcgcauggcggcg

SEQ ID NO: 1447099 - RNA, 16 nt, Pseudomonas aeruginosa PA01
ccgcgcauggcggcga

SEQ ID NO: 1447100 - RNA, 19 nt, Pseudomonas aeruginosa PA01
ccgcgcaugaaaaagccgc

SEQ ID NO: 1447101 - RNA, 16 nt, Pseudomonas aeruginosa PA01
ccgcgccgccgagggc

SEQ ID NO: 1447102 - RNA, 21 nt, Pseudomonas aeruginosa PA01
ccgcgccgccgagggcaccga

SEQ ID NO: 1447103 - RNA, 12 nt, Pseudomonas aeruginosa PA01
ccgcgccgccga

SEQ ID NO: 1447104 - RNA, 13 nt, Pseudomonas aeruginosa PA01
ccgcgccgccucg

SEQ ID NO: 1447105 - RNA, 14 nt, Pseudomonas aeruginosa PA01
ccgcgccgccucga

SEQ ID NO: 1447106 - RNA, 15 nt, Pseudomonas aeruginosa PA01
ccgcgccgccucgau

SEQ ID NO: 1447107 - RNA, 13 nt, Pseudomonas aeruginosa PA01
ccgcgccgccgga

SEQ ID NO: 1447108 - RNA, 12 nt, Pseudomonas aeruginosa PA01
ccgcgccgcgcu

SEQ ID NO: 1447109 - RNA, 20 nt, Pseudomonas aeruginosa PA01
ccgcgccggcgaucgccagg

SEQ ID NO: 1447110 - RNA, 22 nt, Pseudomonas aeruginosa PA01
ccgcgcgaucgaggccuacccg

SEQ ID NO: 1447111 - RNA, 16 nt, Pseudomonas aeruginosa PA01
ccgcgcgauggccggc

SEQ ID NO: 1447112 - RNA, 15 nt, Pseudomonas aeruginosa PA01
ccgcgccgguggcca

SEQ ID NO: 1447113 - RNA, 18 nt, Pseudomonas aeruginosa PA01
ccgcgccggggcagcagg

SEQ ID NO: 1447114 - RNA, 24 nt, Pseudomonas aeruginosa PA01
ccgcgccggggcagcagggcguag

SEQ ID NO: 1447115 - RNA, 16 nt, Pseudomonas aeruginosa PA01
ccgcgcgccagcaacg

SEQ ID NO: 1447116 - RNA, 20 nt, Pseudomonas aeruginosa PA01
ccgcgcgcauggucgcgcug

SEQ ID NO: 1447117 - RNA, 13 nt, Pseudomonas aeruginosa PA01
ccgcgcgccgagc

SEQ ID NO: 1447118 - RNA, 17 nt, Pseudomonas aeruginosa PA01
ccgcgaccugcucgucg

SEQ ID NO: 1447119 - RNA, 19 nt, Pseudomonas aeruginosa PA01
ccgcgaccgaagccgcgca

SEQ ID NO: 1447120 - RNA, 14 nt, Pseudomonas aeruginosa PA01
ccgcgacgcgcugg

SEQ ID NO: 1447121 - RNA, 21 nt, Pseudomonas aeruginosa PA01
ccgcgacgcgaccuccggcgc

SEQ ID NO: 1447122 - RNA, 19 nt, Pseudomonas aeruginosa PA01
ccgcgacgacugcggcagc

SEQ ID NO: 1447123 - RNA, 20 nt, Pseudomonas aeruginosa PA01
ccgcgacgacugcggcagcu

SEQ ID NO: 1447124 - RNA, 13 nt, Pseudomonas aeruginosa PA01
ccgcgacucgagc

SEQ ID NO: 1447125 - RNA, 18 nt, Pseudomonas aeruginosa PA01
ccgcgacucgagcaccac

SEQ ID NO: 1447126 - RNA, 14 nt, Pseudomonas aeruginosa PA01
ccgcgacucggcug

SEQ ID NO: 1447127 - RNA, 12 nt, Pseudomonas aeruginosa PA01
ccgcgacggcug

SEQ ID NO: 1447128 - RNA, 19 nt, Pseudomonas aeruginosa PA01
ccgcgacggaccgcgacaa

SEQ ID NO: 1447129 - RNA, 19 nt, Pseudomonas aeruginosa PA01
ccgcgacgcuccagcggca

SEQ ID NO: 1447130 - RNA, 20 nt, Pseudomonas aeruginosa PA01
ccgcgagaccccggcggcgc

SEQ ID NO: 1447131 - RNA, 24 nt, Pseudomonas aeruginosa PA01
ccgcgagcagccgacgauccggcc

SEQ ID NO: 1447132 - RNA, 14 nt, Pseudomonas aeruginosa PA01
ccgcgagccagccg

SEQ ID NO: 1447133 - RNA, 14 nt, Pseudomonas aeruginosa PA01
ccgcgagccgcgca

SEQ ID NO: 1447134 - RNA, 17 nt, Pseudomonas aeruginosa PA01
ccgcgagccgcgcagca

SEQ ID NO: 1447135 - RNA, 21 nt, Pseudomonas aeruginosa PA01
ccgcgagcgaaacggcgcuga

SEQ ID NO: 1447136 - RNA, 15 nt, Pseudomonas aeruginosa PA01
ccgccugcgccucgg

SEQ ID NO: 1447137 - RNA, 16 nt, Pseudomonas aeruginosa PA01
ccgccugcgccucggc

SEQ ID NO: 1447138 - RNA, 20 nt, Pseudomonas aeruginosa PA01
ccgccugcgccucggcccug

SEQ ID NO: 1447139 - RNA, 17 nt, Pseudomonas aeruginosa PA01
ccgcgacaggauggaca

SEQ ID NO: 1447140 - RNA, 16 nt, Pseudomonas aeruginosa PA01
ccgcgacaacccuguc

SEQ ID NO: 1447141 - RNA, 19 nt, Pseudomonas aeruginosa PA01
ccgcgacaacccugucccc

SEQ ID NO: 1447142 - RNA, 18 nt, Pseudomonas aeruginosa PA01
ccgcgaccacaggcggcg

SEQ ID NO: 1447143 - RNA, 15 nt, Pseudomonas aeruginosa PA01
ccgccugcagcacca

SEQ ID NO: 1447144 - RNA, 15 nt, Pseudomonas aeruginosa PA01
ccgccucgucgccau

SEQ ID NO: 1447145 - RNA, 20 nt, Pseudomonas aeruginosa PA01
ccgccucuaugaaccggggc

SEQ ID NO: 1447146 - RNA, 15 nt, Pseudomonas aeruginosa PA01
ccgccugcagggcgu

SEQ ID NO: 1447147 - RNA, 16 nt, Pseudomonas aeruginosa PA01
ccgccucgcgcaacug

SEQ ID NO: 1447148 - RNA, 21 nt, Pseudomonas aeruginosa PA01
ccgccucgcgcaacugcucga

SEQ ID NO: 1447149 - RNA, 12 nt, Pseudomonas aeruginosa PA01
ccgccucgcgcc

SEQ ID NO: 1447150 - RNA, 14 nt, Pseudomonas aeruginosa PA01
ccgccucgcgccgc

SEQ ID NO: 1447151 - RNA, 15 nt, Pseudomonas aeruginosa PA01
ccgccucgcgccgcg

SEQ ID NO: 1447152 - RNA, 17 nt, Pseudomonas aeruginosa PA01
ccgccucgcgccgcgcc

SEQ ID NO: 1447153 - RNA, 20 nt, Pseudomonas aeruginosa PA01
ccgccucgaaggccggcaaa

SEQ ID NO: 1447154 - RNA, 12 nt, Pseudomonas aeruginosa PA01
ccgccucgacca

SEQ ID NO: 1447155 - RNA, 16 nt, Pseudomonas aeruginosa PA01
ccgccucgaccagcgc

SEQ ID NO: 1447156 - RNA, 18 nt, Pseudomonas aeruginosa PA01
ccgccucgaccaucggcg

SEQ ID NO: 1447157 - RNA, 22 nt, Pseudomonas aeruginosa PA01
ccgccucgcugggcgggcgucc

SEQ ID NO: 1447158 - RNA, 21 nt, Pseudomonas aeruginosa PA01
ccgccucggagaacagcagcg

SEQ ID NO: 1447159 - RNA, 14 nt, Pseudomonas aeruginosa PA01
ccgccucggcggcu

SEQ ID NO: 1447160 - RNA, 16 nt, Pseudomonas aeruginosa PA01
ccgccucggcggcucu

SEQ ID NO: 1447161 - RNA, 16 nt, Pseudomonas aeruginosa PA01
ccgccggugcaccagg

SEQ ID NO: 1447162 - RNA, 18 nt, Pseudomonas aeruginosa PA01
ccgccgucgcggccaucg

SEQ ID NO: 1447163 - RNA, 21 nt, Pseudomonas aeruginosa PA01
ccgccgucgcggccaucggcg

SEQ ID NO: 1447164 - RNA, 15 nt, Pseudomonas aeruginosa PA01
ccgccggcgcccugg

SEQ ID NO: 1447165 - RNA, 21 nt, Pseudomonas aeruginosa PA01
ccgccggcgaacggcaugcgu

SEQ ID NO: 1447166 - RNA, 19 nt, Pseudomonas aeruginosa PA01
ccgccggcgaggaucgcgc

SEQ ID NO: 1447167 - RNA, 13 nt, Pseudomonas aeruginosa PA01
ccgccggcgaugc

SEQ ID NO: 1447168 - RNA, 15 nt, Pseudomonas aeruginosa PA01
ccgccggcgccgccg

SEQ ID NO: 1447169 - RNA, 13 nt, Pseudomonas aeruginosa PA01
ccgccggcgccgc

SEQ ID NO: 1447170 - RNA, 17 nt, Pseudomonas aeruginosa PA01
ccgccggggaucagcga

SEQ ID NO: 1447171 - RNA, 19 nt, Pseudomonas aeruginosa PA01
ccgccggggaucagcgaga

SEQ ID NO: 1447172 - RNA, 12 nt, Pseudomonas aeruginosa PA01
ccgccggggcgc

SEQ ID NO: 1447173 - RNA, 15 nt, Pseudomonas aeruginosa PA01
ccgccggggcgcagg

SEQ ID NO: 1447174 - RNA, 16 nt, Pseudomonas aeruginosa PA01
ccgccgggcuucggug

SEQ ID NO: 1447175 - RNA, 17 nt, Pseudomonas aeruginosa PA01
ccgccggggaagcugcc

SEQ ID NO: 1447176 - RNA, 22 nt, Pseudomonas aeruginosa PA01
ccgccggggcgugcaggccgcc

SEQ ID NO: 1447177 - RNA, 16 nt, Pseudomonas aeruginosa PA01
ccgccgucgggcuucg

SEQ ID NO: 1447178 - RNA, 20 nt, Pseudomonas aeruginosa PA01
ccgccgugaggcgcgcgccg

SEQ ID NO: 1447179 - RNA, 18 nt, Pseudomonas aeruginosa PA01
ccgccgugcgcuccgcca

SEQ ID NO: 1447180 - RNA, 19 nt, Pseudomonas aeruginosa PA01
ccgccgugcgcuccgccag

SEQ ID NO: 1447181 - RNA, 20 nt, Pseudomonas aeruginosa PA01
ccgccgugcgcuccgccagg

SEQ ID NO: 1447182 - RNA, 21 nt, Pseudomonas aeruginosa PA01
ccgccgugcgcuccgccaggc

SEQ ID NO: 1447183 - RNA, 22 nt, Pseudomonas aeruginosa PA01
ccgccgugcgcuccgccaggcc

SEQ ID NO: 1447184 - RNA, 21 nt, Pseudomonas aeruginosa PA01
ccgccguggcugugcuggcca

SEQ ID NO: 1447185 - RNA, 17 nt, Pseudomonas aeruginosa PA01
ccgccguggaacgcagg

SEQ ID NO: 1447186 - RNA, 15 nt, Pseudomonas aeruginosa PA01
ccgccguuacgccgg

SEQ ID NO: 1447187 - RNA, 17 nt, Pseudomonas aeruginosa PA01
ccgccguucucauugcg

SEQ ID NO: 1447188 - RNA, 19 nt, Pseudomonas aeruginosa PA01
ccgccgugaucucgaacuc

SEQ ID NO: 1447189 - RNA, 21 nt, Pseudomonas aeruginosa PA01
ccgccguuccuccucgccgcc

SEQ ID NO: 1447190 - RNA, 15 nt, Pseudomonas aeruginosa PA01
ccgccguucgcccgc

SEQ ID NO: 1447191 - RNA, 14 nt, Pseudomonas aeruginosa PA01
ccgccgcugugcag

SEQ ID NO: 1447192 - RNA, 20 nt, Pseudomonas aeruginosa PA01
ccgccgcuuccgccaggcgc

SEQ ID NO: 1447193 - RNA, 15 nt, Pseudomonas aeruginosa PA01
ccgccgcuuccgccg

SEQ ID NO: 1447194 - RNA, 17 nt, Pseudomonas aeruginosa PA01
ccgccgcuuccgccggc

SEQ ID NO: 1447195 - RNA, 19 nt, Pseudomonas aeruginosa PA01
ccgccgcuuccgccggcgc

SEQ ID NO: 1447196 - RNA, 20 nt, Pseudomonas aeruginosa PA01
ccgccgcuuccgccggcgcc

SEQ ID NO: 1447197 - RNA, 19 nt, Pseudomonas aeruginosa PA01
ccgccgcugaucaguaccg

SEQ ID NO: 1447198 - RNA, 14 nt, Pseudomonas aeruginosa PA01
ccgccgcugcgucg

SEQ ID NO: 1447199 - RNA, 22 nt, Pseudomonas aeruginosa PA01
ccgccgcugcgucgucgcggcg

SEQ ID NO: 1447200 - RNA, 22 nt, Pseudomonas aeruginosa PA01
ccgccgcuggcauaaccggaag

SEQ ID NO: 1447201 - RNA, 12 nt, Pseudomonas aeruginosa PA01
ccgccgcuggcc

SEQ ID NO: 1447202 - RNA, 13 nt, Pseudomonas aeruginosa PA01
ccgccgcuggcga

SEQ ID NO: 1447203 - RNA, 14 nt, Pseudomonas aeruginosa PA01
ccgccgcuggcgag

SEQ ID NO: 1447204 - RNA, 14 nt, Pseudomonas aeruginosa PA01
ccgccggacccugc

SEQ ID NO: 1447205 - RNA, 16 nt, Pseudomonas aeruginosa PA01
ccgccggacccugccg

SEQ ID NO: 1447206 - RNA, 17 nt, Pseudomonas aeruginosa PA01
ccgccggacccugccgu

SEQ ID NO: 1447207 - RNA, 18 nt, Pseudomonas aeruginosa PA01
ccgccggaagcuuccagc

SEQ ID NO: 1447208 - RNA, 20 nt, Pseudomonas aeruginosa PA01
ccgccggaaugacgagccgc

SEQ ID NO: 1447209 - RNA, 22 nt, Pseudomonas aeruginosa PA01
ccgccggaaugacgagccgcag

SEQ ID NO: 1447210 - RNA, 14 nt, Pseudomonas aeruginosa PA01
ccgccggaccgucg

SEQ ID NO: 1447211 - RNA, 17 nt, Pseudomonas aeruginosa PA01
ccgccggaccgucgcga

SEQ ID NO: 1447212 - RNA, 22 nt, Pseudomonas aeruginosa PA01
ccgccggaaccugcaugucacc

SEQ ID NO: 1447213 - RNA, 18 nt, Pseudomonas aeruginosa PA01
ccgccggaaccuguccga

SEQ ID NO: 1447214 - RNA, 13 nt, Pseudomonas aeruginosa PA01
ccgccggagggaa

SEQ ID NO: 1447215 - RNA, 15 nt, Pseudomonas aeruginosa PA01
ccgccggccugcacg

SEQ ID NO: 1447216 - RNA, 17 nt, Pseudomonas aeruginosa PA01
ccgccggcgaccgcgcg

SEQ ID NO: 1447217 - RNA, 12 nt, Pseudomonas aeruginosa PA01
ccgccggcgacg

SEQ ID NO: 1447218 - RNA, 15 nt, Pseudomonas aeruginosa PA01
ccgccggcgacgagg

SEQ ID NO: 1447219 - RNA, 16 nt, Pseudomonas aeruginosa PA01
ccgccggcgacgaggu

SEQ ID NO: 1447220 - RNA, 15 nt, Pseudomonas aeruginosa PA01
ccgccggcgaacagc

SEQ ID NO: 1447221 - RNA, 19 nt, Pseudomonas aeruginosa PA01
ccgccggcgaacagccagc

SEQ ID NO: 1447222 - RNA, 20 nt, Pseudomonas aeruginosa PA01
ccgccggcgaacagccagcg

SEQ ID NO: 1447223 - RNA, 13 nt, Pseudomonas aeruginosa PA01
ccgccggcgaacg

SEQ ID NO: 1447224 - RNA, 17 nt, Pseudomonas aeruginosa PA01
ccgccggccaccagcag

SEQ ID NO: 1447225 - RNA, 18 nt, Pseudomonas aeruginosa PA01
ccgccggccagccgcgcc

SEQ ID NO: 1447226 - RNA, 19 nt, Pseudomonas aeruginosa PA01
ccgccggccagccgcgcca

SEQ ID NO: 1447227 - RNA, 21 nt, Pseudomonas aeruginosa PA01
ccgccggccagccgcgccagu

SEQ ID NO: 1447228 - RNA, 17 nt, Pseudomonas aeruginosa PA01
ccgccgcgggcaaccgc

SEQ ID NO: 1447229 - RNA, 13 nt, Pseudomonas aeruginosa PA01
ccgccgcgggcga

SEQ ID NO: 1447230 - RNA, 16 nt, Pseudomonas aeruginosa PA01
ccgccgcgggcgaacg

SEQ ID NO: 1447231 - RNA, 21 nt, Pseudomonas aeruginosa PA01
ccgccgcgggcgaacggcagc

SEQ ID NO: 1447232 - RNA, 20 nt, Pseudomonas aeruginosa PA01
ccgccgcgggacgccgcagg

SEQ ID NO: 1447233 - RNA, 16 nt, Pseudomonas aeruginosa PA01
ccgccgcgucgucggc

SEQ ID NO: 1447234 - RNA, 17 nt, Pseudomonas aeruginosa PA01
ccgccgcuacugcgcgg

SEQ ID NO: 1447235 - RNA, 13 nt, Pseudomonas aeruginosa PA01
ccgccgcuccggc

SEQ ID NO: 1447236 - RNA, 17 nt, Pseudomonas aeruginosa PA01
ccgccgcucacccuguc

SEQ ID NO: 1447237 - RNA, 21 nt, Pseudomonas aeruginosa PA01
ccgccgcucacccugucccau

SEQ ID NO: 1447238 - RNA, 14 nt, Pseudomonas aeruginosa PA01
ccgccgcgugccgc

SEQ ID NO: 1447239 - RNA, 19 nt, Pseudomonas aeruginosa PA01
ccgccgcgugccgccggac

SEQ ID NO: 1447240 - RNA, 20 nt, Pseudomonas aeruginosa PA01
ccgccgcgugggcuucgccg

SEQ ID NO: 1447241 - RNA, 21 nt, Pseudomonas aeruginosa PA01
ccgccgcgugggcuucgccgc

SEQ ID NO: 1447242 - RNA, 15 nt, Pseudomonas aeruginosa PA01
ccgccgcgugcgcgc

SEQ ID NO: 1447243 - RNA, 17 nt, Pseudomonas aeruginosa PA01
ccgccgcgugcgcgccc

SEQ ID NO: 1447244 - RNA, 21 nt, Pseudomonas aeruginosa PA01
ccgccgcgugcgcgcccucgg

SEQ ID NO: 1447245 - RNA, 18 nt, Pseudomonas aeruginosa PA01
ccgcccggcucgccgccg

SEQ ID NO: 1447246 - RNA, 20 nt, Pseudomonas aeruginosa PA01
ccgccgcggcaaugcggcga

SEQ ID NO: 1447247 - RNA, 22 nt, Pseudomonas aeruginosa PA01
ccgccgcggcaaugcggcgaug

SEQ ID NO: 1447248 - RNA, 12 nt, Pseudomonas aeruginosa PA01
ccgccgcggcca

SEQ ID NO: 1447249 - RNA, 13 nt, Pseudomonas aeruginosa PA01
ccgccgcggccag

SEQ ID NO: 1447250 - RNA, 14 nt, Pseudomonas aeruginosa PA01
ccgccgcggccagc

SEQ ID NO: 1447251 - RNA, 22 nt, Pseudomonas aeruginosa PA01
ccgccgcggccagcccccucgc

SEQ ID NO: 1447252 - RNA, 16 nt, Pseudomonas aeruginosa PA01
ccgccgcggcaccggc

SEQ ID NO: 1447253 - RNA, 20 nt, Pseudomonas aeruginosa PA01
ccgccgcggcaccggcgacg

SEQ ID NO: 1447254 - RNA, 17 nt, Pseudomonas aeruginosa PA01
ccgcccggaaccaccgg

SEQ ID NO: 1447255 - RNA, 18 nt, Pseudomonas aeruginosa PA01
ccgcccggcgccaccgcg

SEQ ID NO: 1447256 - RNA, 12 nt, Pseudomonas aeruginosa PA01
ccgcccggccgc

SEQ ID NO: 1447257 - RNA, 12 nt, Pseudomonas aeruginosa PA01
ccgcccggcagc

SEQ ID NO: 1447258 - RNA, 15 nt, Pseudomonas aeruginosa PA01
ccgcccggcagcggc

SEQ ID NO: 1447259 - RNA, 21 nt, Pseudomonas aeruginosa PA01
ccgcccggcagcggcuggccg

SEQ ID NO: 1447260 - RNA, 19 nt, Pseudomonas aeruginosa PA01
ccgcaugaacgccucgcca

SEQ ID NO: 1447261 - RNA, 22 nt, Pseudomonas aeruginosa PA01
ccgcaugaacgccucgccaacc

SEQ ID NO: 1447262 - RNA, 15 nt, Pseudomonas aeruginosa PA01
ccgcaugccagggcc

SEQ ID NO: 1447263 - RNA, 16 nt, Pseudomonas aeruginosa PA01
ccgcaugccagggccu

SEQ ID NO: 1447264 - RNA, 20 nt, Pseudomonas aeruginosa PA01
ccgcagcgcuuuucaggaug

SEQ ID NO: 1447265 - RNA, 14 nt, Pseudomonas aeruginosa PA01
ccgcagcggcaugc

SEQ ID NO: 1447266 - RNA, 18 nt, Pseudomonas aeruginosa PA01
ccgcagcggcaugcccug

SEQ ID NO: 1447267 - RNA, 14 nt, Pseudomonas aeruginosa PA01
ccgcagcggccagg

SEQ ID NO: 1447268 - RNA, 15 nt, Pseudomonas aeruginosa PA01
ccgcagccccgccgg

SEQ ID NO: 1447269 - RNA, 21 nt, Pseudomonas aeruginosa PA01
ccgcagcgccccucccagcca

SEQ ID NO: 1447270 - RNA, 14 nt, Pseudomonas aeruginosa PA01
ccgccaagggcgcc

SEQ ID NO: 1447271 - RNA, 19 nt, Pseudomonas aeruginosa PA01
ccgccaagggcgccgccga

SEQ ID NO: 1447272 - RNA, 20 nt, Pseudomonas aeruginosa PA01
ccgccaagggcgccgccgag

SEQ ID NO: 1447273 - RNA, 21 nt, Pseudomonas aeruginosa PA01
ccgccaagggcgccgccgagg

SEQ ID NO: 1447274 - RNA, 22 nt, Pseudomonas aeruginosa PA01
ccgccaagggcgccgccgagga

SEQ ID NO: 1447275 - RNA, 16 nt, Pseudomonas aeruginosa PA01
ccgccaaggaugggaa

SEQ ID NO: 1447276 - RNA, 14 nt, Pseudomonas aeruginosa PA01
ccgccaaggcccug

SEQ ID NO: 1447277 - RNA, 20 nt, Pseudomonas aeruginosa PA01
ccgccaaggcccugcugcag

SEQ ID NO: 1447278 - RNA, 17 nt, Pseudomonas aeruginosa PA01
ccgccaaggccucggca

SEQ ID NO: 1447279 - RNA, 17 nt, Pseudomonas aeruginosa PA01
ccgccaacuggcugucg

SEQ ID NO: 1447280 - RNA, 16 nt, Pseudomonas aeruginosa PA01
ccgccaccugccccgg

SEQ ID NO: 1447281 - RNA, 18 nt, Pseudomonas aeruginosa PA01
ccgccacagaucgccagc

SEQ ID NO: 1447282 - RNA, 21 nt, Pseudomonas aeruginosa PA01
ccgccaccaaccacaaccagc

SEQ ID NO: 1447283 - RNA, 23 nt, Pseudomonas aeruginosa PA01
ccgccacggcgguuucgucgaag

SEQ ID NO: 1447284 - RNA, 19 nt, Pseudomonas aeruginosa PA01
ccgccacuuccagcacgcc

SEQ ID NO: 1447285 - RNA, 17 nt, Pseudomonas aeruginosa PA01
ccgccagcaggucggcc

SEQ ID NO: 1447286 - RNA, 19 nt, Pseudomonas aeruginosa PA01
ccgccagcaggucggccug

SEQ ID NO: 1447287 - RNA, 21 nt, Pseudomonas aeruginosa PA01
ccgccagcaguggcuccgcgc

SEQ ID NO: 1447288 - RNA, 14 nt, Pseudomonas aeruginosa PA01
ccgccagcaggccg

SEQ ID NO: 1447289 - RNA, 15 nt, Pseudomonas aeruginosa PA01
ccgccagcaggcgcc

SEQ ID NO: 1447290 - RNA, 16 nt, Pseudomonas aeruginosa PA01
ccgccagcaggcgccg

SEQ ID NO: 1447291 - RNA, 20 nt, Pseudomonas aeruginosa PA01
ccgccagcaggcgccggcgg

SEQ ID NO: 1447292 - RNA, 17 nt, Pseudomonas aeruginosa PA01
ccgccagcaggcgcggg

SEQ ID NO: 1447293 - RNA, 20 nt, Pseudomonas aeruginosa PA01
ccgccagcaggcgcgggcug

SEQ ID NO: 1447294 - RNA, 17 nt, Pseudomonas aeruginosa PA01
ccgccagcauggcgaag

SEQ ID NO: 1447295 - RNA, 23 nt, Pseudomonas aeruginosa PA01
ccgccagcauggcgaagcucggc

SEQ ID NO: 1447296 - RNA, 14 nt, Pseudomonas aeruginosa PA01
ccgccagcaggcgu

SEQ ID NO: 1447297 - RNA, 20 nt, Pseudomonas aeruginosa PA01
ccgccagcaguugcaacagc

SEQ ID NO: 1447298 - RNA, 15 nt, Pseudomonas aeruginosa PA01
ccgccagcagacggc

SEQ ID NO: 1447299 - RNA, 13 nt, Pseudomonas aeruginosa PA01
ccgccagcaggcc

SEQ ID NO: 1447300 - RNA, 23 nt, Pseudomonas aeruginosa PA01
ccgcccacgccuugcagcaccgc

SEQ ID NO: 1447301 - RNA, 16 nt, Pseudomonas aeruginosa PA01
ccgcccacccugcgcg

SEQ ID NO: 1447302 - RNA, 12 nt, Pseudomonas aeruginosa PA01
ccgcccaccgcg

SEQ ID NO: 1447303 - RNA, 22 nt, Pseudomonas aeruginosa PA01
ccgcccaggacaacgacagccc

SEQ ID NO: 1447304 - RNA, 19 nt, Pseudomonas aeruginosa PA01
ccgcccagggggccgggcc

SEQ ID NO: 1447305 - RNA, 12 nt, Pseudomonas aeruginosa PA01
ccgcccagccga

SEQ ID NO: 1447306 - RNA, 16 nt, Pseudomonas aeruginosa PA01
ccgcccagcagcacca

SEQ ID NO: 1447307 - RNA, 13 nt, Pseudomonas aeruginosa PA01
ccgcccaguucgc

SEQ ID NO: 1447308 - RNA, 18 nt, Pseudomonas aeruginosa PA01
ccgcccaguucgccggcc

SEQ ID NO: 1447309 - RNA, 20 nt, Pseudomonas aeruginosa PA01
ccgcccaguucgccggccag

SEQ ID NO: 1447310 - RNA, 18 nt, Pseudomonas aeruginosa PA01
ccgcccaguucgcgcgga

SEQ ID NO: 1447311 - RNA, 18 nt, Pseudomonas aeruginosa PA01
ccgcccaguucuucgccg

SEQ ID NO: 1447312 - RNA, 19 nt, Pseudomonas aeruginosa PA01
ccgcccaguucuucgccgc

SEQ ID NO: 1447313 - RNA, 14 nt, Pseudomonas aeruginosa PA01
ccgcccaucaacga

SEQ ID NO: 1447314 - RNA, 19 nt, Pseudomonas aeruginosa PA01
ccgcccaucaacgagccga

SEQ ID NO: 1447315 - RNA, 17 nt, Pseudomonas aeruginosa PA01
ccgcccauugcccggcc

SEQ ID NO: 1447316 - RNA, 19 nt, Pseudomonas aeruginosa PA01
ccgcccauugcccggccag

SEQ ID NO: 1447317 - RNA, 13 nt, Pseudomonas aeruginosa PA01
ccgccccgcaagg

SEQ ID NO: 1447318 - RNA, 22 nt, Pseudomonas aeruginosa PA01
ccgccccgcaccagccagcccg

SEQ ID NO: 1447319 - RNA, 16 nt, Pseudomonas aeruginosa PA01
ccgccccggcagccac

SEQ ID NO: 1447320 - RNA, 17 nt, Pseudomonas aeruginosa PA01
ccgccccugcuccucgc

SEQ ID NO: 1447321 - RNA, 14 nt, Pseudomonas aeruginosa PA01
ccgcccccagcgcg

SEQ ID NO: 1447322 - RNA, 14 nt, Pseudomonas aeruginosa PA01
ccgccccgaggggc

SEQ ID NO: 1447323 - RNA, 15 nt, Pseudomonas aeruginosa PA01
ccgcccccggcccgg

SEQ ID NO: 1447324 - RNA, 15 nt, Pseudomonas aeruginosa PA01
ccgccaggccucggc

SEQ ID NO: 1447325 - RNA, 18 nt, Pseudomonas aeruginosa PA01
ccgccaggccucggcgcg

SEQ ID NO: 1447326 - RNA, 14 nt, Pseudomonas aeruginosa PA01
ccgccaggccuucc

SEQ ID NO: 1447327 - RNA, 12 nt, Pseudomonas aeruginosa PA01
ccgccaggccgc

SEQ ID NO: 1447328 - RNA, 12 nt, Pseudomonas aeruginosa PA01
ccgccaggacgg

SEQ ID NO: 1447329 - RNA, 16 nt, Pseudomonas aeruginosa PA01
ccgccaggacggcagg

SEQ ID NO: 1447330 - RNA, 20 nt, Pseudomonas aeruginosa PA01
ccgccagcucgcuguccagc

SEQ ID NO: 1447331 - RNA, 18 nt, Pseudomonas aeruginosa PA01
ccgccagcuaccggcagg

SEQ ID NO: 1447332 - RNA, 12 nt, Pseudomonas aeruginosa PA01
ccgccaggcaga

SEQ ID NO: 1447333 - RNA, 18 nt, Pseudomonas aeruginosa PA01
ccgccaggcagaccaggc

SEQ ID NO: 1447334 - RNA, 21 nt, Pseudomonas aeruginosa PA01
ccgccaggcagaccaggccga

SEQ ID NO: 1447335 - RNA, 23 nt, Pseudomonas aeruginosa PA01
ccgccaggcagaccaggccgagc

SEQ ID NO: 1447336 - RNA, 20 nt, Pseudomonas aeruginosa PA01
ccgccaggcaggccgggcug

SEQ ID NO: 1447337 - RNA, 17 nt, Pseudomonas aeruginosa PA01
ccgccagcgggacgaug

SEQ ID NO: 1447338 - RNA, 18 nt, Pseudomonas aeruginosa PA01
ccgccagccgccaggacg

SEQ ID NO: 1447339 - RNA, 13 nt, Pseudomonas aeruginosa PA01
ccgccagcggcau

SEQ ID NO: 1447340 - RNA, 12 nt, Pseudomonas aeruginosa PA01
ccgccagcgucg

SEQ ID NO: 1447341 - RNA, 18 nt, Pseudomonas aeruginosa PA01
ccgccagcgucgccgccg

SEQ ID NO: 1447342 - RNA, 20 nt, Pseudomonas aeruginosa PA01
ccgccagcgucgccgccgcg

SEQ ID NO: 1447343 - RNA, 13 nt, Pseudomonas aeruginosa PA01
ccgccagcccgcc

SEQ ID NO: 1447344 - RNA, 12 nt, Pseudomonas aeruginosa PA01
ccgccagccaga

SEQ ID NO: 1447345 - RNA, 15 nt, Pseudomonas aeruginosa PA01
ccgccagccagccgc

SEQ ID NO: 1447346 - RNA, 16 nt, Pseudomonas aeruginosa PA01
ccgccagccagccgcg

SEQ ID NO: 1447347 - RNA, 19 nt, Pseudomonas aeruginosa PA01
ccgccagccagccgcgcgc

SEQ ID NO: 1447348 - RNA, 13 nt, Pseudomonas aeruginosa PA01
ccgccaggcccug

SEQ ID NO: 1447349 - RNA, 19 nt, Pseudomonas aeruginosa PA01
ccgccaggcccugggcggc

SEQ ID NO: 1447350 - RNA, 20 nt, Pseudomonas aeruginosa PA01
ccgccaggcccugggcggcg

SEQ ID NO: 1447351 - RNA, 16 nt, Pseudomonas aeruginosa PA01
ccgccaucgccucgcc

SEQ ID NO: 1447352 - RNA, 17 nt, Pseudomonas aeruginosa PA01
ccgccaucgccucgccg

SEQ ID NO: 1447353 - RNA, 19 nt, Pseudomonas aeruginosa PA01
ccgccaucgccucgccggc

SEQ ID NO: 1447354 - RNA, 18 nt, Pseudomonas aeruginosa PA01
ccgccaggcgcagccagc

SEQ ID NO: 1447355 - RNA, 14 nt, Pseudomonas aeruginosa PA01
ccgccaggcgccga

SEQ ID NO: 1447356 - RNA, 20 nt, Pseudomonas aeruginosa PA01
ccgccaugcucggccagcuc

SEQ ID NO: 1447357 - RNA, 16 nt, Pseudomonas aeruginosa PA01
ccgccaugcuguugca

SEQ ID NO: 1447358 - RNA, 22 nt, Pseudomonas aeruginosa PA01
ccgcaacgaaaaagggcggcca

SEQ ID NO: 1447359 - RNA, 23 nt, Pseudomonas aeruginosa PA01
ccgcaacgaaaaagggcggccac

SEQ ID NO: 1447360 - RNA, 12 nt, Pseudomonas aeruginosa PA01
ccgcaaccgcug

SEQ ID NO: 1447361 - RNA, 17 nt, Pseudomonas aeruginosa PA01
ccgauuucgaugacgcc

SEQ ID NO: 1447362 - RNA, 12 nt, Pseudomonas aeruginosa PA01
ccgauuccugcg

SEQ ID NO: 1447363 - RNA, 12 nt, Pseudomonas aeruginosa PA01
ccgauucgccgg

SEQ ID NO: 1447364 - RNA, 18 nt, Pseudomonas aeruginosa PA01
ccgauucuuggcucggca

SEQ ID NO: 1447365 - RNA, 14 nt, Pseudomonas aeruginosa PA01
ccgcaauccgaccg

SEQ ID NO: 1447366 - RNA, 12 nt, Pseudomonas aeruginosa PA01
ccgcaaugacgg

SEQ ID NO: 1447367 - RNA, 20 nt, Pseudomonas aeruginosa PA01
ccgcaaggccagggcggcgc

SEQ ID NO: 1447368 - RNA, 22 nt, Pseudomonas aeruginosa PA01
ccgcaaggccagggcggcgccg

SEQ ID NO: 1447369 - RNA, 23 nt, Pseudomonas aeruginosa PA01
ccgcaaggccagggcggcgccga

SEQ ID NO: 1447370 - RNA, 23 nt, Pseudomonas aeruginosa PA01
ccgcaagcuuuuccgaauacugc

SEQ ID NO: 1447371 - RNA, 19 nt, Pseudomonas aeruginosa PA01
ccgcaaggugcgggccguc

SEQ ID NO: 1447372 - RNA, 14 nt, Pseudomonas aeruginosa PA01
ccgcaaguggcggc

SEQ ID NO: 1447373 - RNA, 19 nt, Pseudomonas aeruginosa PA01
ccgcaagcgguuauucgcc

SEQ ID NO: 1447374 - RNA, 15 nt, Pseudomonas aeruginosa PA01
ccgcaccacccgcug

SEQ ID NO: 1447375 - RNA, 14 nt, Pseudomonas aeruginosa PA01
ccgcaccagccagc

SEQ ID NO: 1447376 - RNA, 16 nt, Pseudomonas aeruginosa PA01
ccgcaccagccagccc

SEQ ID NO: 1447377 - RNA, 13 nt, Pseudomonas aeruginosa PA01
ccgcaccagccgg

SEQ ID NO: 1447378 - RNA, 20 nt, Pseudomonas aeruginosa PA01
ccgcaccacguagccggcgu

SEQ ID NO: 1447379 - RNA, 19 nt, Pseudomonas aeruginosa PA01
ccgcacaccgcgcgcgccu

SEQ ID NO: 1447380 - RNA, 13 nt, Pseudomonas aeruginosa PA01
ccgcacaccgcgc

SEQ ID NO: 1447381 - RNA, 18 nt, Pseudomonas aeruginosa PA01
ccgcacaguugcgcgccg

SEQ ID NO: 1447382 - RNA, 13 nt, Pseudomonas aeruginosa PA01
ccgcacaggcugg

SEQ ID NO: 1447383 - RNA, 14 nt, Pseudomonas aeruginosa PA01
ccgcagcagcggca

SEQ ID NO: 1447384 - RNA, 17 nt, Pseudomonas aeruginosa PA01
ccgcagcagcggcgaca

SEQ ID NO: 1447385 - RNA, 19 nt, Pseudomonas aeruginosa PA01
ccgcagcagguucgaaugc

SEQ ID NO: 1447386 - RNA, 23 nt, Pseudomonas aeruginosa PA01
ccgcagcagguucgaaugcugcc

SEQ ID NO: 1447387 - RNA, 12 nt, Pseudomonas aeruginosa PA01
ccgcagccacag

SEQ ID NO: 1447388 - RNA, 18 nt, Pseudomonas aeruginosa PA01
ccgcagccacaggcgcca

SEQ ID NO: 1447389 - RNA, 20 nt, Pseudomonas aeruginosa PA01
ccgcagccacaggcgccagu

SEQ ID NO: 1447390 - RNA, 20 nt, Pseudomonas aeruginosa PA01
ccgcagaugcuccagggagc

SEQ ID NO: 1447391 - RNA, 21 nt, Pseudomonas aeruginosa PA01
ccgcagaugcuccagggagcg

SEQ ID NO: 1447392 - RNA, 23 nt, Pseudomonas aeruginosa PA01
ccgcagcacagccccagccucgg

SEQ ID NO: 1447393 - RNA, 23 nt, Pseudomonas aeruginosa PA01
ccgcagauagggcaucagccccu

SEQ ID NO: 1447394 - RNA, 16 nt, Pseudomonas aeruginosa PA01
ccgcagacuccggcgc

SEQ ID NO: 1447395 - RNA, 20 nt, Pseudomonas aeruginosa PA01
ccgcagagcaucacccgcga

SEQ ID NO: 1447396 - RNA, 16 nt, Pseudomonas aeruginosa PA01
ccgcagagccagccgc

SEQ ID NO: 1447397 - RNA, 23 nt, Pseudomonas aeruginosa PA01
ccgcagagccagccgcagcccgg

SEQ ID NO: 1447398 - RNA, 22 nt, Pseudomonas aeruginosa PA01
ccgcacguugaggucgaagacc

SEQ ID NO: 1447399 - RNA, 17 nt, Pseudomonas aeruginosa PA01
ccgcagacaucgccgag

SEQ ID NO: 1447400 - RNA, 20 nt, Pseudomonas aeruginosa PA01
ccgcagacaucgccgagggc

SEQ ID NO: 1447401 - RNA, 23 nt, Pseudomonas aeruginosa PA01
ccgcagacaucgccgagggcgaa

SEQ ID NO: 1447402 - RNA, 22 nt, Pseudomonas aeruginosa PA01
ccgcagaccagcgaaccgccgg

SEQ ID NO: 1447403 - RNA, 23 nt, Pseudomonas aeruginosa PA01
ccgcagaccagcgaaccgccggc

SEQ ID NO: 1447404 - RNA, 21 nt, Pseudomonas aeruginosa PA01
ccgcagaaccagacgcucggc

SEQ ID NO: 1447405 - RNA, 23 nt, Pseudomonas aeruginosa PA01
ccgcagaaccagacgcucggcca

SEQ ID NO: 1447406 - RNA, 21 nt, Pseudomonas aeruginosa PA01
ccgcacugguggcgaacagca

SEQ ID NO: 1447407 - RNA, 13 nt, Pseudomonas aeruginosa PA01
ccgcaccgccagc

SEQ ID NO: 1447408 - RNA, 16 nt, Pseudomonas aeruginosa PA01
ccgcaccgccagcguc

SEQ ID NO: 1447409 - RNA, 21 nt, Pseudomonas aeruginosa PA01
ccgcaccgccagcgucgccgc

SEQ ID NO: 1447410 - RNA, 23 nt, Pseudomonas aeruginosa PA01
ccgcacccgggcaacugaucagc

SEQ ID NO: 1447411 - RNA, 17 nt, Pseudomonas aeruginosa PA01
ccgcaccgguucgacac

SEQ ID NO: 1447412 - RNA, 14 nt, Pseudomonas aeruginosa PA01
ccgcaccggcgcgc

SEQ ID NO: 1447413 - RNA, 16 nt, Pseudomonas aeruginosa PA01
ccgcaccggcgcgccg

SEQ ID NO: 1447414 - RNA, 19 nt, Pseudomonas aeruginosa PA01
ccgcaccggcgcgccggac

SEQ ID NO: 1447415 - RNA, 14 nt, Pseudomonas aeruginosa PA01
ccgcaccguagcgg

SEQ ID NO: 1447416 - RNA, 23 nt, Pseudomonas aeruginosa PA01
ccgcaccugguggacacccugcu

SEQ ID NO: 1447417 - RNA, 12 nt, Pseudomonas aeruginosa PA01
ccgcaccugccg

SEQ ID NO: 1447418 - RNA, 13 nt, Pseudomonas aeruginosa PA01
ccgcaccuggacc

SEQ ID NO: 1447419 - RNA, 19 nt, Pseudomonas aeruginosa PA01
ccgcaccuggaccgggauc

SEQ ID NO: 1447420 - RNA, 17 nt, Pseudomonas aeruginosa PA01
ccgcacgaggcgggcug

SEQ ID NO: 1447421 - RNA, 23 nt, Pseudomonas aeruginosa PA01
ccgaacacaggacgagacgccga

SEQ ID NO: 1447422 - RNA, 22 nt, Pseudomonas aeruginosa PA01
ccgagcaugcgcggcaggauca

SEQ ID NO: 1447423 - RNA, 23 nt, Pseudomonas aeruginosa PA01
ccgagcauguaggcgcaccaggc

SEQ ID NO: 1447424 - RNA, 19 nt, Pseudomonas aeruginosa PA01
ccgaaaugcugcaggccga

SEQ ID NO: 1447425 - RNA, 19 nt, Pseudomonas aeruginosa PA01
ccgaaauugaccagguacg

SEQ ID NO: 1447426 - RNA, 15 nt, Pseudomonas aeruginosa PA01
ccgaaacgccgacgg

SEQ ID NO: 1447427 - RNA, 12 nt, Pseudomonas aeruginosa PA01
ccgagccaggua

SEQ ID NO: 1447428 - RNA, 14 nt, Pseudomonas aeruginosa PA01
ccgagccagguacg

SEQ ID NO: 1447429 - RNA, 19 nt, Pseudomonas aeruginosa PA01
ccgagccagguacggaugc

SEQ ID NO: 1447430 - RNA, 16 nt, Pseudomonas aeruginosa PA01
ccgagcccagcggcag

SEQ ID NO: 1447431 - RNA, 22 nt, Pseudomonas aeruginosa PA01
ccgagccccgguuacucgccgg

SEQ ID NO: 1447432 - RNA, 23 nt, Pseudomonas aeruginosa PA01
ccgagccccgguuacucgccggc

SEQ ID NO: 1447433 - RNA, 15 nt, Pseudomonas aeruginosa PA01
ccgagcccaccggga

SEQ ID NO: 1447434 - RNA, 14 nt, Pseudomonas aeruginosa PA01
ccgagcccggccgg

SEQ ID NO: 1447435 - RNA, 14 nt, Pseudomonas aeruginosa PA01
ccgagccgacaucc

SEQ ID NO: 1447436 - RNA, 15 nt, Pseudomonas aeruginosa PA01
ccgagccgacauccu

SEQ ID NO: 1447437 - RNA, 11 nt, Pseudomonas aeruginosa PA01
ccgagccggcu

SEQ ID NO: 1447438 - RNA, 13 nt, Pseudomonas aeruginosa PA01
ccgagccggcugc

SEQ ID NO: 1447439 - RNA, 23 nt, Pseudomonas aeruginosa PA01
ccgagcuuugcgcagccacccgc

SEQ ID NO: 1447440 - RNA, 19 nt, Pseudomonas aeruginosa PA01
ccgaggaacauccgcggcc

SEQ ID NO: 1447441 - RNA, 22 nt, Pseudomonas aeruginosa PA01
ccgagcuggcgcgcgucgaugc

SEQ ID NO: 1447442 - RNA, 22 nt, Pseudomonas aeruginosa PA01
ccgagcuugaccuugccgccgg

SEQ ID NO: 1447443 - RNA, 14 nt, Pseudomonas aeruginosa PA01
ccgagcuggcgcgc

SEQ ID NO: 1447444 - RNA, 15 nt, Pseudomonas aeruginosa PA01
ccgagcugccgcacc

SEQ ID NO: 1447445 - RNA, 17 nt, Pseudomonas aeruginosa PA01
ccgagcugccgcaccgc

SEQ ID NO: 1447446 - RNA, 18 nt, Pseudomonas aeruginosa PA01
ccgagcugccgcaccgcc

SEQ ID NO: 1447447 - RNA, 22 nt, Pseudomonas aeruginosa PA01
ccgagcugccgcaccgccucga

SEQ ID NO: 1447448 - RNA, 21 nt, Pseudomonas aeruginosa PA01
ccgagcgugcgcaugcccgcg

SEQ ID NO: 1447449 - RNA, 21 nt, Pseudomonas aeruginosa PA01
ccgagcguggugcuaucgaug

SEQ ID NO: 1447450 - RNA, 23 nt, Pseudomonas aeruginosa PA01
ccgagcguugggccucgcugcgc

SEQ ID NO: 1447451 - RNA, 15 nt, Pseudomonas aeruginosa PA01
ccgagcugaccacca

SEQ ID NO: 1447452 - RNA, 22 nt, Pseudomonas aeruginosa PA01
ccgagcugaccaccagggcgau

SEQ ID NO: 1447453 - RNA, 13 nt, Pseudomonas aeruginosa PA01
ccgagcggcgcga

SEQ ID NO: 1447454 - RNA, 13 nt, Pseudomonas aeruginosa PA01
ccgagcggcaagg

SEQ ID NO: 1447455 - RNA, 15 nt, Pseudomonas aeruginosa PA01
ccgagcgcagcgcca

SEQ ID NO: 1447456 - RNA, 21 nt, Pseudomonas aeruginosa PA01
ccgagcgcaguucgucgccca

SEQ ID NO: 1447457 - RNA, 22 nt, Pseudomonas aeruginosa PA01
ccgagcgcaguucgucgcccau

SEQ ID NO: 1447458 - RNA, 14 nt, Pseudomonas aeruginosa PA01
ccgagcgccgccag

SEQ ID NO: 1447459 - RNA, 15 nt, Pseudomonas aeruginosa PA01
ccgagcgccgccagg

SEQ ID NO: 1447460 - RNA, 22 nt, Pseudomonas aeruginosa PA01
ccgagcgccgccaggcaggccg

SEQ ID NO: 1447461 - RNA, 14 nt, Pseudomonas aeruginosa PA01
ccgagcgcgccgcc

SEQ ID NO: 1447462 - RNA, 16 nt, Pseudomonas aeruginosa PA01
ccgagcgcgccgccga

SEQ ID NO: 1447463 - RNA, 19 nt, Pseudomonas aeruginosa PA01
ccgagcgaaaucggcaggc

SEQ ID NO: 1447464 - RNA, 23 nt, Pseudomonas aeruginosa PA01
ccgagcgcgagugcagcgagucg

SEQ ID NO: 1447465 - RNA, 18 nt, Pseudomonas aeruginosa PA01
ccgagcgcgaucagccgc

SEQ ID NO: 1447466 - RNA, 16 nt, Pseudomonas aeruginosa PA01
ccgaggcgaucgccgc

SEQ ID NO: 1447467 - RNA, 17 nt, Pseudomonas aeruginosa PA01
ccgaggcgaucgccgcg

SEQ ID NO: 1447468 - RNA, 21 nt, Pseudomonas aeruginosa PA01
ccgaggcgaucgccgcggcga

SEQ ID NO: 1447469 - RNA, 21 nt, Pseudomonas aeruginosa PA01
ccgaggcgcgccacgcaaucc

SEQ ID NO: 1447470 - RNA, 14 nt, Pseudomonas aeruginosa PA01
ccgaggcgcgccga

SEQ ID NO: 1447471 - RNA, 19 nt, Pseudomonas aeruginosa PA01
ccgaggcgcgccgacagca

SEQ ID NO: 1447472 - RNA, 21 nt, Pseudomonas aeruginosa PA01
ccgaggcgcgccgacagcacg

SEQ ID NO: 1447473 - RNA, 13 nt, Pseudomonas aeruginosa PA01
ccgaggcgcuucu

SEQ ID NO: 1447474 - RNA, 21 nt, Pseudomonas aeruginosa PA01
ccgaggcgcuucugcucggcc

SEQ ID NO: 1447475 - RNA, 23 nt, Pseudomonas aeruginosa PA01
ccgaggcgcuucugcucggccug

SEQ ID NO: 1447476 - RNA, 15 nt, Pseudomonas aeruginosa PA01
ccgaggcggaagacg

SEQ ID NO: 1447477 - RNA, 20 nt, Pseudomonas aeruginosa PA01
ccgaggcggauuugccgccg

SEQ ID NO: 1447478 - RNA, 21 nt, Pseudomonas aeruginosa PA01
ccgaggcggauuugccgccga

SEQ ID NO: 1447479 - RNA, 22 nt, Pseudomonas aeruginosa PA01
ccgaggcggauuugccgccgag

SEQ ID NO: 1447480 - RNA, 12 nt, Pseudomonas aeruginosa PA01
ccgaggcggccg

SEQ ID NO: 1447481 - RNA, 13 nt, Pseudomonas aeruginosa PA01
ccgaggcggccga

SEQ ID NO: 1447482 - RNA, 23 nt, Pseudomonas aeruginosa PA01
ccgaggcggccguagccgucgaa

SEQ ID NO: 1447483 - RNA, 15 nt, Pseudomonas aeruginosa PA01
ccgaggccggcgaag

SEQ ID NO: 1447484 - RNA, 12 nt, Pseudomonas aeruginosa PA01
ccgaggccgccg

SEQ ID NO: 1447485 - RNA, 16 nt, Pseudomonas aeruginosa PA01
ccgaggccagcaggcc

SEQ ID NO: 1447486 - RNA, 14 nt, Pseudomonas aeruginosa PA01
ccgaggcccagcga

SEQ ID NO: 1447487 - RNA, 13 nt, Pseudomonas aeruginosa PA01
ccgaggccgaggu

SEQ ID NO: 1447488 - RNA, 23 nt, Pseudomonas aeruginosa PA01
ccgaggcagccgucggugaucga

SEQ ID NO: 1447489 - RNA, 18 nt, Pseudomonas aeruginosa PA01
ccgaggaugcucgccugg

SEQ ID NO: 1447490 - RNA, 17 nt, Pseudomonas aeruginosa PA01
ccgaggauagcguccag

SEQ ID NO: 1447491 - RNA, 17 nt, Pseudomonas aeruginosa PA01
ccgaggaucggcacgaa

SEQ ID NO: 1447492 - RNA, 19 nt, Pseudomonas aeruginosa PA01
ccgaggaagucggcggccg

SEQ ID NO: 1447493 - RNA, 20 nt, Pseudomonas aeruginosa PA01
ccgaggaacuccuccucgcu

SEQ ID NO: 1447494 - RNA, 23 nt, Pseudomonas aeruginosa PA01
ccgaggagacgcggcaugaagcu

SEQ ID NO: 1447495 - RNA, 22 nt, Pseudomonas aeruginosa PA01
ccgaggaggaucucgcgccccg

SEQ ID NO: 1447496 - RNA, 20 nt, Pseudomonas aeruginosa PA01
ccgaggaacuucaugaugcg

SEQ ID NO: 1447497 - RNA, 22 nt, Pseudomonas aeruginosa PA01
ccgaggaacuucaugaugcgcc

SEQ ID NO: 1447498 - RNA, 22 nt, Pseudomonas aeruginosa PA01
ccgaggaagccgaccggcgccg

SEQ ID NO: 1447499 - RNA, 23 nt, Pseudomonas aeruginosa PA01
ccgaggaagccgaccggcgccgg

SEQ ID NO: 1447500 - RNA, 16 nt, Pseudomonas aeruginosa PA01
ccgaggaacgccgaca

SEQ ID NO: 1447501 - RNA, 20 nt, Pseudomonas aeruginosa PA01
ccgaggaacgccgacaggcc

SEQ ID NO: 1447502 - RNA, 20 nt, Pseudomonas aeruginosa PA01
ccgagggucgccuugaccag

SEQ ID NO: 1447503 - RNA, 20 nt, Pseudomonas aeruginosa PA01
ccgagggcuguaaucgccgc

SEQ ID NO: 1447504 - RNA, 22 nt, Pseudomonas aeruginosa PA01
ccgagggcuguaaucgccgcuu

SEQ ID NO: 1447505 - RNA, 15 nt, Pseudomonas aeruginosa PA01
ccgaggguggcgcug

SEQ ID NO: 1447506 - RNA, 16 nt, Pseudomonas aeruginosa PA01
ccgaggguggcgcugg

SEQ ID NO: 1447507 - RNA, 19 nt, Pseudomonas aeruginosa PA01
ccgaggguggcgcuggcca

SEQ ID NO: 1447508 - RNA, 15 nt, Pseudomonas aeruginosa PA01
ccgaggguguagagg

SEQ ID NO: 1447509 - RNA, 23 nt, Pseudomonas aeruginosa PA01
ccgaggguguagaggaucuccga

SEQ ID NO: 1447510 - RNA, 15 nt, Pseudomonas aeruginosa PA01
ccgaggucgccgcca

SEQ ID NO: 1447511 - RNA, 17 nt, Pseudomonas aeruginosa PA01
ccgaggucgccgccagc

SEQ ID NO: 1447512 - RNA, 19 nt, Pseudomonas aeruginosa PA01
ccgaggucgcgggccaggc

SEQ ID NO: 1447513 - RNA, 20 nt, Pseudomonas aeruginosa PA01
ccgaggucgcgggccaggcc

SEQ ID NO: 1447514 - RNA, 14 nt, Pseudomonas aeruginosa PA01
ccgaggucggcgaa

SEQ ID NO: 1447515 - RNA, 19 nt, Pseudomonas aeruginosa PA01
ccgaggucggcgaacaggg

SEQ ID NO: 1447516 - RNA, 14 nt, Pseudomonas aeruginosa PA01
ccgaggucggcggc

SEQ ID NO: 1447517 - RNA, 14 nt, Pseudomonas aeruginosa PA01
ccgagggcgcgcag

SEQ ID NO: 1447518 - RNA, 19 nt, Pseudomonas aeruginosa PA01
ccgagggcugccgcccggu

SEQ ID NO: 1447519 - RNA, 17 nt, Pseudomonas aeruginosa PA01
ccgagggcgcggcgcca

SEQ ID NO: 1447520 - RNA, 15 nt, Pseudomonas aeruginosa PA01
ccgagggccgcgccg

SEQ ID NO: 1447521 - RNA, 18 nt, Pseudomonas aeruginosa PA01
ccgagggccgcgccgacc

SEQ ID NO: 1447522 - RNA, 19 nt, Pseudomonas aeruginosa PA01
ccgagggccgcgccgaccc

SEQ ID NO: 1447523 - RNA, 20 nt, Pseudomonas aeruginosa PA01
ccgagggccgcgccgaccca

SEQ ID NO: 1447524 - RNA, 18 nt, Pseudomonas aeruginosa PA01
ccgaggcuuuccagcagg

SEQ ID NO: 1447525 - RNA, 23 nt, Pseudomonas aeruginosa PA01
ccgaggcuuuccagcaggcgcuc

SEQ ID NO: 1447526 - RNA, 19 nt, Pseudomonas aeruginosa PA01
ccgaggcguuauccgccga

SEQ ID NO: 1447527 - RNA, 20 nt, Pseudomonas aeruginosa PA01
ccgaggcguuauccgccgau

SEQ ID NO: 1447528 - RNA, 21 nt, Pseudomonas aeruginosa PA01
ccgaggcguuauccgccgaua

SEQ ID NO: 1447529 - RNA, 22 nt, Pseudomonas aeruginosa PA01
ccgagucggcaacgauaccgcc

SEQ ID NO: 1447530 - RNA, 18 nt, Pseudomonas aeruginosa PA01
ccgagugcgcccagcagc

SEQ ID NO: 1447531 - RNA, 21 nt, Pseudomonas aeruginosa PA01
ccgagugcgcccagcagcagg

SEQ ID NO: 1447532 - RNA, 22 nt, Pseudomonas aeruginosa PA01
ccgagguucuugcccagcaacg

SEQ ID NO: 1447533 - RNA, 18 nt, Pseudomonas aeruginosa PA01
ccgagguugacgaacggc

SEQ ID NO: 1447534 - RNA, 13 nt, Pseudomonas aeruginosa PA01
ccgaguccgcgcg

SEQ ID NO: 1447535 - RNA, 15 nt, Pseudomonas aeruginosa PA01
ccgaguccgcgcgcg

SEQ ID NO: 1447536 - RNA, 16 nt, Pseudomonas aeruginosa PA01
ccgaggugcggcuugc

SEQ ID NO: 1447537 - RNA, 17 nt, Pseudomonas aeruginosa PA01
ccgaggucuuggccagc

SEQ ID NO: 1447538 - RNA, 21 nt, Pseudomonas aeruginosa PA01
ccgaggucuuggccagccgcg

SEQ ID NO: 1447539 - RNA, 23 nt, Pseudomonas aeruginosa PA01
ccgaggucuuggccagccgcgcg

SEQ ID NO: 1447540 - RNA, 22 nt, Pseudomonas aeruginosa PA01
ccgaggucaguucggugccgcc

SEQ ID NO: 1447541 - RNA, 16 nt, Pseudomonas aeruginosa PA01
ccgauacagcgcgcga

SEQ ID NO: 1447542 - RNA, 22 nt, Pseudomonas aeruginosa PA01
ccgauacagcgcgcgauaccga

SEQ ID NO: 1447543 - RNA, 18 nt, Pseudomonas aeruginosa PA01
ccgaggucgucgcugagc

SEQ ID NO: 1447544 - RNA, 16 nt, Pseudomonas aeruginosa PA01
ccgaguggccgcugag

SEQ ID NO: 1447545 - RNA, 14 nt, Pseudomonas aeruginosa PA01
ccgaguggcgcagc

SEQ ID NO: 1447546 - RNA, 18 nt, Pseudomonas aeruginosa PA01
ccgaguggcgcagcgccc

SEQ ID NO: 1447547 - RNA, 19 nt, Pseudomonas aeruginosa PA01
ccgaguggcgcagcgcccg

SEQ ID NO: 1447548 - RNA, 13 nt, Pseudomonas aeruginosa PA01
ccgaguucaccac

SEQ ID NO: 1447549 - RNA, 18 nt, Pseudomonas aeruginosa PA01
ccgaguuucccggcgcgg

SEQ ID NO: 1447550 - RNA, 21 nt, Pseudomonas aeruginosa PA01
ccgaguuucccggcgcggccg

SEQ ID NO: 1447551 - RNA, 20 nt, Pseudomonas aeruginosa PA01
ccgauacccugggagccgcc

SEQ ID NO: 1447552 - RNA, 21 nt, Pseudomonas aeruginosa PA01
ccgauacccugggagccgccg

SEQ ID NO: 1447553 - RNA, 15 nt, Pseudomonas aeruginosa PA01
ccgauaggcgccggc

SEQ ID NO: 1447554 - RNA, 16 nt, Pseudomonas aeruginosa PA01
ccgauauaggcgacga

SEQ ID NO: 1447555 - RNA, 19 nt, Pseudomonas aeruginosa PA01
ccgaucagcccgucggccu

SEQ ID NO: 1447556 - RNA, 13 nt, Pseudomonas aeruginosa PA01
ccgaucagcggcg

SEQ ID NO: 1447557 - RNA, 13 nt, Pseudomonas aeruginosa PA01
ccgaucagcgccu

SEQ ID NO: 1447558 - RNA, 19 nt, Pseudomonas aeruginosa PA01
ccgaucagcggcgguccca

SEQ ID NO: 1447559 - RNA, 14 nt, Pseudomonas aeruginosa PA01
ccgaucaucggcug

SEQ ID NO: 1447560 - RNA, 15 nt, Pseudomonas aeruginosa PA01
ccgaucaucggcugg

SEQ ID NO: 1447561 - RNA, 17 nt, Pseudomonas aeruginosa PA01
ccgaucaggucgcgcgc

SEQ ID NO: 1447562 - RNA, 14 nt, Pseudomonas aeruginosa PA01
ccgaucaccaccag

SEQ ID NO: 1447563 - RNA, 19 nt, Pseudomonas aeruginosa PA01
ccgaucagcaccgccacca

SEQ ID NO: 1447564 - RNA, 15 nt, Pseudomonas aeruginosa PA01
ccgauccuccugggg

SEQ ID NO: 1447565 - RNA, 14 nt, Pseudomonas aeruginosa PA01
ccgaucccgaucgg

SEQ ID NO: 1447566 - RNA, 15 nt, Pseudomonas aeruginosa PA01
ccgaucccggcggcg

SEQ ID NO: 1447567 - RNA, 12 nt, Pseudomonas aeruginosa PA01
ccgaucaggcug

SEQ ID NO: 1447568 - RNA, 16 nt, Pseudomonas aeruginosa PA01
ccgaucaugcucggcg

SEQ ID NO: 1447569 - RNA, 24 nt, Pseudomonas aeruginosa PA01
ccgauccagcagucgcggcccugg

SEQ ID NO: 1447570 - RNA, 13 nt, Pseudomonas aeruginosa PA01
ccgaucggcaagc

SEQ ID NO: 1447571 - RNA, 15 nt, Pseudomonas aeruginosa PA01
ccgaucgcccgcgcc

SEQ ID NO: 1447572 - RNA, 16 nt, Pseudomonas aeruginosa PA01
ccgaucgcccgcgccu

SEQ ID NO: 1447573 - RNA, 16 nt, Pseudomonas aeruginosa PA01
ccgaucgccucggcca

SEQ ID NO: 1447574 - RNA, 20 nt, Pseudomonas aeruginosa PA01
ccgaucgccucggccaucga

SEQ ID NO: 1447575 - RNA, 20 nt, Pseudomonas aeruginosa PA01
ccgaucgccucgucgagcgc

SEQ ID NO: 1447576 - RNA, 21 nt, Pseudomonas aeruginosa PA01
ccgaucgccucguucagcagc

SEQ ID NO: 1447577 - RNA, 14 nt, Pseudomonas aeruginosa PA01
ccgaucgccgcgcg

SEQ ID NO: 1447578 - RNA, 17 nt, Pseudomonas aeruginosa PA01
ccgaucgccgcgcgguc

SEQ ID NO: 1447579 - RNA, 18 nt, Pseudomonas aeruginosa PA01
ccgaucgccgcgcggucg

SEQ ID NO: 1447580 - RNA, 17 nt, Pseudomonas aeruginosa PA01
ccgaugguuucgugcca

SEQ ID NO: 1447581 - RNA, 16 nt, Pseudomonas aeruginosa PA01
ccgauguacggcacca

SEQ ID NO: 1447582 - RNA, 14 nt, Pseudomonas aeruginosa PA01
ccgaugucgccggc

SEQ ID NO: 1447583 - RNA, 13 nt, Pseudomonas aeruginosa PA01
ccgauggcgccgc

SEQ ID NO: 1447584 - RNA, 14 nt, Pseudomonas aeruginosa PA01
ccgauggcgccgcc

SEQ ID NO: 1447585 - RNA, 19 nt, Pseudomonas aeruginosa PA01
ccgaugucguagccgcgcg

SEQ ID NO: 1447586 - RNA, 14 nt, Pseudomonas aeruginosa PA01
ccgaugcgccgacg

SEQ ID NO: 1447587 - RNA, 16 nt, Pseudomonas aeruginosa PA01
ccgaugcgccgacgcc

SEQ ID NO: 1447588 - RNA, 15 nt, Pseudomonas aeruginosa PA01
ccgaugcucgcgcca

SEQ ID NO: 1447589 - RNA, 19 nt, Pseudomonas aeruginosa PA01
ccgaugcucgcgccagccc

SEQ ID NO: 1447590 - RNA, 17 nt, Pseudomonas aeruginosa PA01
ccgaugcuaucgcgugg

SEQ ID NO: 1447591 - RNA, 19 nt, Pseudomonas aeruginosa PA01
ccgaugcgcgacucgaagc

SEQ ID NO: 1447592 - RNA, 21 nt, Pseudomonas aeruginosa PA01
ccgaugcgcgacucgaagcuc

SEQ ID NO: 1447593 - RNA, 18 nt, Pseudomonas aeruginosa PA01
ccgaugcgcuacggcauc

SEQ ID NO: 1447594 - RNA, 18 nt, Pseudomonas aeruginosa PA01
ccgaugcuguucagcagg

SEQ ID NO: 1447595 - RNA, 21 nt, Pseudomonas aeruginosa PA01
ccgaugcuguucagcaggagc

SEQ ID NO: 1447596 - RNA, 22 nt, Pseudomonas aeruginosa PA01
ccgauggagauguagucgacgc

SEQ ID NO: 1447597 - RNA, 20 nt, Pseudomonas aeruginosa PA01
ccgauggcgcgcuuuccggc

SEQ ID NO: 1447598 - RNA, 20 nt, Pseudomonas aeruginosa PA01
ccgauggauucgaaccacug

SEQ ID NO: 1447599 - RNA, 19 nt, Pseudomonas aeruginosa PA01
ccgaucucgugggccagca

SEQ ID NO: 1447600 - RNA, 19 nt, Pseudomonas aeruginosa PA01
ccgaucuucagcagcaggc

SEQ ID NO: 1447601 - RNA, 20 nt, Pseudomonas aeruginosa PA01
ccgaucuucagcagcaggcg

SEQ ID NO: 1447602 - RNA, 21 nt, Pseudomonas aeruginosa PA01
ccgaucucgcccaguaccgcc

SEQ ID NO: 1447603 - RNA, 15 nt, Pseudomonas aeruginosa PA01
ccgaugaacgccgcg

SEQ ID NO: 1447604 - RNA, 22 nt, Pseudomonas aeruginosa PA01
ccgaugaaauagccggcgaugc

SEQ ID NO: 1447605 - RNA, 15 nt, Pseudomonas aeruginosa PA01
ccgaugaagcaggcg

SEQ ID NO: 1447606 - RNA, 14 nt, Pseudomonas aeruginosa PA01
ccgaugcccaggcc

SEQ ID NO: 1447607 - RNA, 16 nt, Pseudomonas aeruginosa PA01
ccgaugccgggcaacg

SEQ ID NO: 1447608 - RNA, 13 nt, Pseudomonas aeruginosa PA01
ccgaugccgcgcc

SEQ ID NO: 1447609 - RNA, 14 nt, Pseudomonas aeruginosa PA01
ccgaugccgcgccg

SEQ ID NO: 1447610 - RNA, 19 nt, Pseudomonas aeruginosa PA01
ccgaugccggaaagccugg

SEQ ID NO: 1447611 - RNA, 21 nt, Pseudomonas aeruginosa PA01
ccgaugccggaaagccuggcc

SEQ ID NO: 1447612 - RNA, 22 nt, Pseudomonas aeruginosa PA01
ccgaugccggaaagccuggccg

SEQ ID NO: 1447613 - RNA, 15 nt, Pseudomonas aeruginosa PA01
ccgaugccggccggc

SEQ ID NO: 1447614 - RNA, 16 nt, Pseudomonas aeruginosa PA01
ccgaugccggccggca

SEQ ID NO: 1447615 - RNA, 18 nt, Pseudomonas aeruginosa PA01
ccgaugccggccggcagc

SEQ ID NO: 1447616 - RNA, 23 nt, Pseudomonas aeruginosa PA01
ccgaugccggccggcagcgagcg

SEQ ID NO: 1447617 - RNA, 18 nt, Pseudomonas aeruginosa PA01
ccgaugccgaccuugccg

SEQ ID NO: 1447618 - RNA, 19 nt, Pseudomonas aeruginosa PA01
ccgaugaucuccgcgccgg

SEQ ID NO: 1447619 - RNA, 16 nt, Pseudomonas aeruginosa PA01
ccgaugaucgagcgca

SEQ ID NO: 1447620 - RNA, 15 nt, Pseudomonas aeruginosa PA01
ccgaucuucgccgac

SEQ ID NO: 1447621 - RNA, 21 nt, Pseudomonas aeruginosa PA01
cacuguuccucagccccucgc

SEQ ID NO: 1447622 - RNA, 19 nt, Pseudomonas aeruginosa PA01
cacuguuuuccauggcgag

SEQ ID NO: 1447623 - RNA, 20 nt, Pseudomonas aeruginosa PA01
cacuguuuuccauggcgagu

SEQ ID NO: 1447624 - RNA, 15 nt, Pseudomonas aeruginosa PA01
cacuguccagggcga

SEQ ID NO: 1447625 - RNA, 22 nt, Pseudomonas aeruginosa PA01
cacugguggacggucucgccgc

SEQ ID NO: 1447626 - RNA, 15 nt, Pseudomonas aeruginosa PA01
cagaaacggcugccg

SEQ ID NO: 1447627 - RNA, 20 nt, Pseudomonas aeruginosa PA01
cagaaagccucaggcgcugc

SEQ ID NO: 1447628 - RNA, 15 nt, Pseudomonas aeruginosa PA01
cagaagaucagcgcg

SEQ ID NO: 1447629 - RNA, 19 nt, Pseudomonas aeruginosa PA01
cagaagaucagcgcgguga

SEQ ID NO: 1447630 - RNA, 13 nt, Pseudomonas aeruginosa PA01
cagaccacccggc

SEQ ID NO: 1447631 - RNA, 17 nt, Pseudomonas aeruginosa PA01
cagaccacccggcugca

SEQ ID NO: 1447632 - RNA, 23 nt, Pseudomonas aeruginosa PA01
cagaaggcuucuuccuggccggg

SEQ ID NO: 1447633 - RNA, 19 nt, Pseudomonas aeruginosa PA01
cagaagccccagagcccgc

SEQ ID NO: 1447634 - RNA, 16 nt, Pseudomonas aeruginosa PA01
cagaaguugcuggcga

SEQ ID NO: 1447635 - RNA, 22 nt, Pseudomonas aeruginosa PA01
cagaagucccagcgagugcuga

SEQ ID NO: 1447636 - RNA, 14 nt, Pseudomonas aeruginosa PA01
cagaccaucagcug

SEQ ID NO: 1447637 - RNA, 19 nt, Pseudomonas aeruginosa PA01
cagaccaucagcuggaucu

SEQ ID NO: 1447638 - RNA, 14 nt, Pseudomonas aeruginosa PA01
cagaccaggccgag

SEQ ID NO: 1447639 - RNA, 16 nt, Pseudomonas aeruginosa PA01
cagaccaggccgagca

SEQ ID NO: 1447640 - RNA, 16 nt, Pseudomonas aeruginosa PA01
cagaccagcccuggcg

SEQ ID NO: 1447641 - RNA, 14 nt, Pseudomonas aeruginosa PA01
cagaccagcgaacc

SEQ ID NO: 1447642 - RNA, 22 nt, Pseudomonas aeruginosa PA01
cagaccagcgcaagcggcggcu

SEQ ID NO: 1447643 - RNA, 20 nt, Pseudomonas aeruginosa PA01
cagaccacgaagcgaccgau

SEQ ID NO: 1447644 - RNA, 14 nt, Pseudomonas aeruginosa PA01
cagaccagcagcgg

SEQ ID NO: 1447645 - RNA, 15 nt, Pseudomonas aeruginosa PA01
cagaccagcagcggc

SEQ ID NO: 1447646 - RNA, 16 nt, Pseudomonas aeruginosa PA01
cagaccagcagcggca

SEQ ID NO: 1447647 - RNA, 14 nt, Pseudomonas aeruginosa PA01
cagaccgacccuca

SEQ ID NO: 1447648 - RNA, 20 nt, Pseudomonas aeruginosa PA01
cagacccaggugcgcaggcg

SEQ ID NO: 1447649 - RNA, 15 nt, Pseudomonas aeruginosa PA01
cagaccccggcgauc

SEQ ID NO: 1447650 - RNA, 14 nt, Pseudomonas aeruginosa PA01
cagacgaucagcgg

SEQ ID NO: 1447651 - RNA, 12 nt, Pseudomonas aeruginosa PA01
cagacgcccuga

SEQ ID NO: 1447652 - RNA, 13 nt, Pseudomonas aeruginosa PA01
cagacgccgcucu

SEQ ID NO: 1447653 - RNA, 21 nt, Pseudomonas aeruginosa PA01
cagacgcggguaauccaucgc

SEQ ID NO: 1447654 - RNA, 14 nt, Pseudomonas aeruginosa PA01
cagacgcucggcca

SEQ ID NO: 1447655 - RNA, 16 nt, Pseudomonas aeruginosa PA01
cagacgcucggccagc

SEQ ID NO: 1447656 - RNA, 12 nt, Pseudomonas aeruginosa PA01
cagaccugccgc

SEQ ID NO: 1447657 - RNA, 16 nt, Pseudomonas aeruginosa PA01
cagaccugccgcccgg

SEQ ID NO: 1447658 - RNA, 17 nt, Pseudomonas aeruginosa PA01
cagaccugccgcccggc

SEQ ID NO: 1447659 - RNA, 21 nt, Pseudomonas aeruginosa PA01
cagaccugccgcccggccagg

SEQ ID NO: 1447660 - RNA, 16 nt, Pseudomonas aeruginosa PA01
cagaccuuccagccgc

SEQ ID NO: 1447661 - RNA, 17 nt, Pseudomonas aeruginosa PA01
cagaccuuccagccgcg

SEQ ID NO: 1447662 - RNA, 19 nt, Pseudomonas aeruginosa PA01
cagaccuuccagccgcgcg

SEQ ID NO: 1447663 - RNA, 13 nt, Pseudomonas aeruginosa PA01
cagaccuggccgc

SEQ ID NO: 1447664 - RNA, 20 nt, Pseudomonas aeruginosa PA01
cagaccuggugggcggcggc

SEQ ID NO: 1447665 - RNA, 16 nt, Pseudomonas aeruginosa PA01
cagaccucgagcaggc

SEQ ID NO: 1447666 - RNA, 17 nt, Pseudomonas aeruginosa PA01
cagaccucgagcaggcc

SEQ ID NO: 1447667 - RNA, 19 nt, Pseudomonas aeruginosa PA01
cagaccucgagcaggccga

SEQ ID NO: 1447668 - RNA, 22 nt, Pseudomonas aeruginosa PA01
cagaccguggauuucagcaggc

SEQ ID NO: 1447669 - RNA, 14 nt, Pseudomonas aeruginosa PA01
cagaccggcagcgc

SEQ ID NO: 1447670 - RNA, 16 nt, Pseudomonas aeruginosa PA01
cagaccgcagccggcg

SEQ ID NO: 1447671 - RNA, 20 nt, Pseudomonas aeruginosa PA01
cagacggggccucgcugccu

SEQ ID NO: 1447672 - RNA, 15 nt, Pseudomonas aeruginosa PA01
cagagacauccggcc

SEQ ID NO: 1447673 - RNA, 20 nt, Pseudomonas aeruginosa PA01
cagacugagguucaugccgc

SEQ ID NO: 1447674 - RNA, 12 nt, Pseudomonas aeruginosa PA01
cagagcgccacg

SEQ ID NO: 1447675 - RNA, 22 nt, Pseudomonas aeruginosa PA01
cagagaucgcccagcggcuggc

SEQ ID NO: 1447676 - RNA, 19 nt, Pseudomonas aeruginosa PA01
cagagcagcaccagcacca

SEQ ID NO: 1447677 - RNA, 21 nt, Pseudomonas aeruginosa PA01
cagagcaggcggaucgccgcc

SEQ ID NO: 1447678 - RNA, 22 nt, Pseudomonas aeruginosa PA01
cagagcaggcggaucgccgccu

SEQ ID NO: 1447679 - RNA, 14 nt, Pseudomonas aeruginosa PA01
cagagccagccgca

SEQ ID NO: 1447680 - RNA, 17 nt, Pseudomonas aeruginosa PA01
cagagccagccgcagcc

SEQ ID NO: 1447681 - RNA, 14 nt, Pseudomonas aeruginosa PA01
cagagccagccgcg

SEQ ID NO: 1447682 - RNA, 20 nt, Pseudomonas aeruginosa PA01
cagagccaugggccggccga

SEQ ID NO: 1447683 - RNA, 16 nt, Pseudomonas aeruginosa PA01
cacgucgccgaccagg

SEQ ID NO: 1447684 - RNA, 18 nt, Pseudomonas aeruginosa PA01
cacgucgccgaccaggcg

SEQ ID NO: 1447685 - RNA, 15 nt, Pseudomonas aeruginosa PA01
cacgucgcgaccggu

SEQ ID NO: 1447686 - RNA, 13 nt, Pseudomonas aeruginosa PA01
cacgucgcgcacc

SEQ ID NO: 1447687 - RNA, 17 nt, Pseudomonas aeruginosa PA01
cacgucgcgcaccuggc

SEQ ID NO: 1447688 - RNA, 14 nt, Pseudomonas aeruginosa PA01
cacgucggcgucca

SEQ ID NO: 1447689 - RNA, 18 nt, Pseudomonas aeruginosa PA01
cacgucguugggccccac

SEQ ID NO: 1447690 - RNA, 18 nt, Pseudomonas aeruginosa PA01
cacgucugugccgaggcc

SEQ ID NO: 1447691 - RNA, 19 nt, Pseudomonas aeruginosa PA01
cacgucugugccgaggccg

SEQ ID NO: 1447692 - RNA, 21 nt, Pseudomonas aeruginosa PA01
cacgucugugccgaggccgcc

SEQ ID NO: 1447693 - RNA, 22 nt, Pseudomonas aeruginosa PA01
cacgucugugccgaggccgccg

SEQ ID NO: 1447694 - RNA, 14 nt, Pseudomonas aeruginosa PA01
cacgugccccaggc

SEQ ID NO: 1447695 - RNA, 19 nt, Pseudomonas aeruginosa PA01
cacgugaccguccagcgcg

SEQ ID NO: 1447696 - RNA, 22 nt, Pseudomonas aeruginosa PA01
cacgugaccguccagcgcgccg

SEQ ID NO: 1447697 - RNA, 23 nt, Pseudomonas aeruginosa PA01
cacgugaccguccagcgcgccgc

SEQ ID NO: 1447698 - RNA, 20 nt, Pseudomonas aeruginosa PA01
cacgugcagcggcagcgucu

SEQ ID NO: 1447699 - RNA, 23 nt, Pseudomonas aeruginosa PA01
cacgugcagcucggcacgcagca

SEQ ID NO: 1447700 - RNA, 16 nt, Pseudomonas aeruginosa PA01
cacguagaugccggug

SEQ ID NO: 1447701 - RNA, 14 nt, Pseudomonas aeruginosa PA01
cacguagcccccgc

SEQ ID NO: 1447702 - RNA, 13 nt, Pseudomonas aeruginosa PA01
cacguagccgccc

SEQ ID NO: 1447703 - RNA, 17 nt, Pseudomonas aeruginosa PA01
cacguagccggcguccg

SEQ ID NO: 1447704 - RNA, 23 nt, Pseudomonas aeruginosa PA01
cacguagccggcguccgccgggu

SEQ ID NO: 1447705 - RNA, 13 nt, Pseudomonas aeruginosa PA01
cacguagcgcagg

SEQ ID NO: 1447706 - RNA, 19 nt, Pseudomonas aeruginosa PA01
cacguaggagccggccagg

SEQ ID NO: 1447707 - RNA, 17 nt, Pseudomonas aeruginosa PA01
cacguaguaggcgcggg

SEQ ID NO: 1447708 - RNA, 15 nt, Pseudomonas aeruginosa PA01
cacguccagcggcau

SEQ ID NO: 1447709 - RNA, 22 nt, Pseudomonas aeruginosa PA01
cacguccagaugaaacugcccg

SEQ ID NO: 1447710 - RNA, 23 nt, Pseudomonas aeruginosa PA01
cacguccauguagcguugcaggc

SEQ ID NO: 1447711 - RNA, 17 nt, Pseudomonas aeruginosa PA01
cacgucgaucaccuugc

SEQ ID NO: 1447712 - RNA, 21 nt, Pseudomonas aeruginosa PA01
cacgucgagcacgccguccga

SEQ ID NO: 1447713 - RNA, 16 nt, Pseudomonas aeruginosa PA01
cacucgcccuugacca

SEQ ID NO: 1447714 - RNA, 13 nt, Pseudomonas aeruginosa PA01
cacucgccgccgu

SEQ ID NO: 1447715 - RNA, 14 nt, Pseudomonas aeruginosa PA01
cacucgccagcgcg

SEQ ID NO: 1447716 - RNA, 15 nt, Pseudomonas aeruginosa PA01
cacucgccagcgcgc

SEQ ID NO: 1447717 - RNA, 22 nt, Pseudomonas aeruginosa PA01
cacucgcagccgcgcucggcca

SEQ ID NO: 1447718 - RNA, 18 nt, Pseudomonas aeruginosa PA01
cacucgcgagcuggcgcc

SEQ ID NO: 1447719 - RNA, 19 nt, Pseudomonas aeruginosa PA01
cacucgcgagcuggcgccg

SEQ ID NO: 1447720 - RNA, 22 nt, Pseudomonas aeruginosa PA01
cacucggccagcaaugcccgcg

SEQ ID NO: 1447721 - RNA, 15 nt, Pseudomonas aeruginosa PA01
cacucggccaggcgc

SEQ ID NO: 1447722 - RNA, 16 nt, Pseudomonas aeruginosa PA01
cacucggccaggcgcc

SEQ ID NO: 1447723 - RNA, 16 nt, Pseudomonas aeruginosa PA01
cacucggcgugccggg

SEQ ID NO: 1447724 - RNA, 23 nt, Pseudomonas aeruginosa PA01
cacucggcgugccgggccggcca

SEQ ID NO: 1447725 - RNA, 16 nt, Pseudomonas aeruginosa PA01
cacuacgcccauggcg

SEQ ID NO: 1447726 - RNA, 21 nt, Pseudomonas aeruginosa PA01
cacguugaccugcgaggcguc

SEQ ID NO: 1447727 - RNA, 15 nt, Pseudomonas aeruginosa PA01
cacguucggcgcggg

SEQ ID NO: 1447728 - RNA, 22 nt, Pseudomonas aeruginosa PA01
cacguugaacacaucgaccagg

SEQ ID NO: 1447729 - RNA, 23 nt, Pseudomonas aeruginosa PA01
cacguugaacacaucgaccaggu

SEQ ID NO: 1447730 - RNA, 19 nt, Pseudomonas aeruginosa PA01
cacucugagggacacggcg

SEQ ID NO: 1447731 - RNA, 16 nt, Pseudomonas aeruginosa PA01
cacugacgcgcagcgc

SEQ ID NO: 1447732 - RNA, 19 nt, Pseudomonas aeruginosa PA01
cacugacgcgcagcgccgc

SEQ ID NO: 1447733 - RNA, 17 nt, Pseudomonas aeruginosa PA01
cacugcgagcaccaugc

SEQ ID NO: 1447734 - RNA, 21 nt, Pseudomonas aeruginosa PA01
cacugcgagcaccaugccgau

SEQ ID NO: 1447735 - RNA, 17 nt, Pseudomonas aeruginosa PA01
cacuggcccacggcgcc

SEQ ID NO: 1447736 - RNA, 15 nt, Pseudomonas aeruginosa PA01
cacuggcggaccgcc

SEQ ID NO: 1447737 - RNA, 17 nt, Pseudomonas aeruginosa PA01
cacggcacacgucggca

SEQ ID NO: 1447738 - RNA, 14 nt, Pseudomonas aeruginosa PA01
cacggcaucgaucc

SEQ ID NO: 1447739 - RNA, 18 nt, Pseudomonas aeruginosa PA01
cacggaugcagucccgcc

SEQ ID NO: 1447740 - RNA, 22 nt, Pseudomonas aeruginosa PA01
cacggaugcagucccgccaggc

SEQ ID NO: 1447741 - RNA, 16 nt, Pseudomonas aeruginosa PA01
cacggauagcaccgau

SEQ ID NO: 1447742 - RNA, 19 nt, Pseudomonas aeruginosa PA01
cacggaggccuucgccgac

SEQ ID NO: 1447743 - RNA, 23 nt, Pseudomonas aeruginosa PA01
cacggaggccuucgccgaccagg

SEQ ID NO: 1447744 - RNA, 16 nt, Pseudomonas aeruginosa PA01
cacggaggcgcucagg

SEQ ID NO: 1447745 - RNA, 16 nt, Pseudomonas aeruginosa PA01
cacggccccgagaaaa

SEQ ID NO: 1447746 - RNA, 21 nt, Pseudomonas aeruginosa PA01
cacggccgaacagacgcaggc

SEQ ID NO: 1447747 - RNA, 22 nt, Pseudomonas aeruginosa PA01
cacggccgaacagacgcaggca

SEQ ID NO: 1447748 - RNA, 13 nt, Pseudomonas aeruginosa PA01
cacggccaggcca

SEQ ID NO: 1447749 - RNA, 14 nt, Pseudomonas aeruginosa PA01
cacggccaggccac

SEQ ID NO: 1447750 - RNA, 15 nt, Pseudomonas aeruginosa PA01
cacggccaggccacg

SEQ ID NO: 1447751 - RNA, 18 nt, Pseudomonas aeruginosa PA01
cacggccaggccacggcc

SEQ ID NO: 1447752 - RNA, 20 nt, Pseudomonas aeruginosa PA01
cacggccaggccacggccgg

SEQ ID NO: 1447753 - RNA, 13 nt, Pseudomonas aeruginosa PA01
cacggccaggccc

SEQ ID NO: 1447754 - RNA, 18 nt, Pseudomonas aeruginosa PA01
cacggccaggcccacgcc

SEQ ID NO: 1447755 - RNA, 13 nt, Pseudomonas aeruginosa PA01
cacggccagcagg

SEQ ID NO: 1447756 - RNA, 15 nt, Pseudomonas aeruginosa PA01
cacgcuucugcuggc

SEQ ID NO: 1447757 - RNA, 17 nt, Pseudomonas aeruginosa PA01
cacgcuucugcuggccg

SEQ ID NO: 1447758 - RNA, 22 nt, Pseudomonas aeruginosa PA01
cacgcuucugcuggccgcgcag

SEQ ID NO: 1447759 - RNA, 24 nt, Pseudomonas aeruginosa PA01
cacgcuucugcuggccgcgcagga

SEQ ID NO: 1447760 - RNA, 17 nt, Pseudomonas aeruginosa PA01
cacgcuggugccgacgc

SEQ ID NO: 1447761 - RNA, 15 nt, Pseudomonas aeruginosa PA01
cacggacccgcucgg

SEQ ID NO: 1447762 - RNA, 17 nt, Pseudomonas aeruginosa PA01
cacggacccgcucggcc

SEQ ID NO: 1447763 - RNA, 15 nt, Pseudomonas aeruginosa PA01
cacggacgcgcaggg

SEQ ID NO: 1447764 - RNA, 14 nt, Pseudomonas aeruginosa PA01
cacggagaagcguc

SEQ ID NO: 1447765 - RNA, 13 nt, Pseudomonas aeruginosa PA01
cacggaagcgcug

SEQ ID NO: 1447766 - RNA, 19 nt, Pseudomonas aeruginosa PA01
cacggaaggccacgccgcc

SEQ ID NO: 1447767 - RNA, 15 nt, Pseudomonas aeruginosa PA01
cacgcugugcggcag

SEQ ID NO: 1447768 - RNA, 18 nt, Pseudomonas aeruginosa PA01
cacggaaacgccgagaac

SEQ ID NO: 1447769 - RNA, 13 nt, Pseudomonas aeruginosa PA01
cacgcugggcagg

SEQ ID NO: 1447770 - RNA, 13 nt, Pseudomonas aeruginosa PA01
cacgcuggcgaga

SEQ ID NO: 1447771 - RNA, 14 nt, Pseudomonas aeruginosa PA01
cacgcugcugccgg

SEQ ID NO: 1447772 - RNA, 22 nt, Pseudomonas aeruginosa PA01
cacgcucuguuucgggucgccc

SEQ ID NO: 1447773 - RNA, 17 nt, Pseudomonas aeruginosa PA01
cacgcugccagcaggcc

SEQ ID NO: 1447774 - RNA, 19 nt, Pseudomonas aeruginosa PA01
cacgcugccagcaggccga

SEQ ID NO: 1447775 - RNA, 17 nt, Pseudomonas aeruginosa PA01
cacgcugaagaucgcca

SEQ ID NO: 1447776 - RNA, 16 nt, Pseudomonas aeruginosa PA01
cacgcugacgccggca

SEQ ID NO: 1447777 - RNA, 18 nt, Pseudomonas aeruginosa PA01
cacgcucaccggucgaga

SEQ ID NO: 1447778 - RNA, 16 nt, Pseudomonas aeruginosa PA01
cacgcuccagaucgcc

SEQ ID NO: 1447779 - RNA, 17 nt, Pseudomonas aeruginosa PA01
cacgcucagugcgccgg

SEQ ID NO: 1447780 - RNA, 16 nt, Pseudomonas aeruginosa PA01
cacgcguugcgagggc

SEQ ID NO: 1447781 - RNA, 20 nt, Pseudomonas aeruginosa PA01
cacgcucucgaacagcagca

SEQ ID NO: 1447782 - RNA, 20 nt, Pseudomonas aeruginosa PA01
cacgcucuggccguucucca

SEQ ID NO: 1447783 - RNA, 14 nt, Pseudomonas aeruginosa PA01
cacgcguucggcga

SEQ ID NO: 1447784 - RNA, 16 nt, Pseudomonas aeruginosa PA01
cacgcgguuccacucc

SEQ ID NO: 1447785 - RNA, 20 nt, Pseudomonas aeruginosa PA01
cacgcguccgaccauuuccc

SEQ ID NO: 1447786 - RNA, 18 nt, Pseudomonas aeruginosa PA01
caccguuccgacccggcc

SEQ ID NO: 1447787 - RNA, 21 nt, Pseudomonas aeruginosa PA01
caccguuccgacccggccgac

SEQ ID NO: 1447788 - RNA, 14 nt, Pseudomonas aeruginosa PA01
caccguucccagca

SEQ ID NO: 1447789 - RNA, 22 nt, Pseudomonas aeruginosa PA01
caccguucuugaucaccgcggu

SEQ ID NO: 1447790 - RNA, 20 nt, Pseudomonas aeruginosa PA01
caccucaugcugcgcgggac

SEQ ID NO: 1447791 - RNA, 13 nt, Pseudomonas aeruginosa PA01
caccuacuaccgc

SEQ ID NO: 1447792 - RNA, 15 nt, Pseudomonas aeruginosa PA01
caccuacuaccgcug

SEQ ID NO: 1447793 - RNA, 14 nt, Pseudomonas aeruginosa PA01
caccuacccgagca

SEQ ID NO: 1447794 - RNA, 11 nt, Pseudomonas aeruginosa PA01
cacgcgccggg

SEQ ID NO: 1447795 - RNA, 12 nt, Pseudomonas aeruginosa PA01
cacgcgccgggu

SEQ ID NO: 1447796 - RNA, 22 nt, Pseudomonas aeruginosa PA01
cacgcggaccuugucgccggug

SEQ ID NO: 1447797 - RNA, 14 nt, Pseudomonas aeruginosa PA01
cacgcggagggcgg

SEQ ID NO: 1447798 - RNA, 15 nt, Pseudomonas aeruginosa PA01
cacgcggagggcggc

SEQ ID NO: 1447799 - RNA, 20 nt, Pseudomonas aeruginosa PA01
cacgcggauaucgcuggcgc

SEQ ID NO: 1447800 - RNA, 22 nt, Pseudomonas aeruginosa PA01
cacgcggauaucgcuggcgccc

SEQ ID NO: 1447801 - RNA, 17 nt, Pseudomonas aeruginosa PA01
cacgcggaucuggcccu

SEQ ID NO: 1447802 - RNA, 18 nt, Pseudomonas aeruginosa PA01
cacggcgcagggcaucga

SEQ ID NO: 1447803 - RNA, 14 nt, Pseudomonas aeruginosa PA01
cacggcgacccgca

SEQ ID NO: 1447804 - RNA, 14 nt, Pseudomonas aeruginosa PA01
cacggcgacggugc

SEQ ID NO: 1447805 - RNA, 18 nt, Pseudomonas aeruginosa PA01
cacggcgagagcgccgac

SEQ ID NO: 1447806 - RNA, 22 nt, Pseudomonas aeruginosa PA01
cacggcgagagcgccgaccagc

SEQ ID NO: 1447807 - RNA, 19 nt, Pseudomonas aeruginosa PA01
cacggcgaacaccgggccg

SEQ ID NO: 1447808 - RNA, 20 nt, Pseudomonas aeruginosa PA01
cacggcgaacaccgggccgc

SEQ ID NO: 1447809 - RNA, 22 nt, Pseudomonas aeruginosa PA01
cacggcgaacaccgggccgccg

SEQ ID NO: 1447810 - RNA, 19 nt, Pseudomonas aeruginosa PA01
cacggcgauacccaggccg

SEQ ID NO: 1447811 - RNA, 15 nt, Pseudomonas aeruginosa PA01
cacggcgaucgccgg

SEQ ID NO: 1447812 - RNA, 14 nt, Pseudomonas aeruginosa PA01
cacggcgcagccgc

SEQ ID NO: 1447813 - RNA, 20 nt, Pseudomonas aeruginosa PA01
cacggcgcagccgcaaggcc

SEQ ID NO: 1447814 - RNA, 20 nt, Pseudomonas aeruginosa PA01
cacggccgcugcgcaggccg

SEQ ID NO: 1447815 - RNA, 14 nt, Pseudomonas aeruginosa PA01
cacggccggcgagg

SEQ ID NO: 1447816 - RNA, 15 nt, Pseudomonas aeruginosa PA01
cacggccucgcgugc

SEQ ID NO: 1447817 - RNA, 14 nt, Pseudomonas aeruginosa PA01
cacggccuucggca

SEQ ID NO: 1447818 - RNA, 15 nt, Pseudomonas aeruginosa PA01
cacggccuucggcag

SEQ ID NO: 1447819 - RNA, 23 nt, Pseudomonas aeruginosa PA01
cacggcgaaaccggccagcgcgg

SEQ ID NO: 1447820 - RNA, 19 nt, Pseudomonas aeruginosa PA01
cacggcgaauucgucgccg

SEQ ID NO: 1447821 - RNA, 21 nt, Pseudomonas aeruginosa PA01
cacggcgaauucgucgccgcc

SEQ ID NO: 1447822 - RNA, 22 nt, Pseudomonas aeruginosa PA01
cacggcgaauucgucgccgccg

SEQ ID NO: 1447823 - RNA, 23 nt, Pseudomonas aeruginosa PA01
cacggcgaauucgucgccgccga

SEQ ID NO: 1447824 - RNA, 13 nt, Pseudomonas aeruginosa PA01
cacggcgugccgc

SEQ ID NO: 1447825 - RNA, 18 nt, Pseudomonas aeruginosa PA01
cacggcgugccgcaggcc

SEQ ID NO: 1447826 - RNA, 19 nt, Pseudomonas aeruginosa PA01
cacggcgugccgcaggccg

SEQ ID NO: 1447827 - RNA, 20 nt, Pseudomonas aeruginosa PA01
cacggcgugccgcaggccgc

SEQ ID NO: 1447828 - RNA, 22 nt, Pseudomonas aeruginosa PA01
cacggcgggacaggaacgcccu

SEQ ID NO: 1447829 - RNA, 13 nt, Pseudomonas aeruginosa PA01
cacggcucggcga

SEQ ID NO: 1447830 - RNA, 22 nt, Pseudomonas aeruginosa PA01
cacggcucggcgaggaacagca

SEQ ID NO: 1447831 - RNA, 15 nt, Pseudomonas aeruginosa PA01
cacggcgcuggucuc

SEQ ID NO: 1447832 - RNA, 14 nt, Pseudomonas aeruginosa PA01
cacggcggccucga

SEQ ID NO: 1447833 - RNA, 16 nt, Pseudomonas aeruginosa PA01
cacggcggccucgagg

SEQ ID NO: 1447834 - RNA, 19 nt, Pseudomonas aeruginosa PA01
cacggcgcgcuccggcgcg

SEQ ID NO: 1447835 - RNA, 12 nt, Pseudomonas aeruginosa PA01
cacggcgcggcc

SEQ ID NO: 1447836 - RNA, 18 nt, Pseudomonas aeruginosa PA01
cacggcgcggccgugccu

SEQ ID NO: 1447837 - RNA, 13 nt, Pseudomonas aeruginosa PA01
cacguacggcgcc

SEQ ID NO: 1447838 - RNA, 15 nt, Pseudomonas aeruginosa PA01
cacguacuccagcaa

SEQ ID NO: 1447839 - RNA, 17 nt, Pseudomonas aeruginosa PA01
cacgguguuguggcugg

SEQ ID NO: 1447840 - RNA, 20 nt, Pseudomonas aeruginosa PA01
cacgguguuguggcuggccu

SEQ ID NO: 1447841 - RNA, 16 nt, Pseudomonas aeruginosa PA01
cacgguguugccgugg

SEQ ID NO: 1447842 - RNA, 17 nt, Pseudomonas aeruginosa PA01
cacggugaaccaggcgc

SEQ ID NO: 1447843 - RNA, 18 nt, Pseudomonas aeruginosa PA01
cacggugaaccaggcgcc

SEQ ID NO: 1447844 - RNA, 22 nt, Pseudomonas aeruginosa PA01
cacggugacggugcagccaccc

SEQ ID NO: 1447845 - RNA, 13 nt, Pseudomonas aeruginosa PA01
cacggugaggacc

SEQ ID NO: 1447846 - RNA, 14 nt, Pseudomonas aeruginosa PA01
cacggucugcucgg

SEQ ID NO: 1447847 - RNA, 15 nt, Pseudomonas aeruginosa PA01
cacggugacacccug

SEQ ID NO: 1447848 - RNA, 18 nt, Pseudomonas aeruginosa PA01
cacggugacacccugccg

SEQ ID NO: 1447849 - RNA, 20 nt, Pseudomonas aeruginosa PA01
cacggggccccucgccguga

SEQ ID NO: 1447850 - RNA, 16 nt, Pseudomonas aeruginosa PA01
cacgggucgucgcccu

SEQ ID NO: 1447851 - RNA, 14 nt, Pseudomonas aeruginosa PA01
cacgggcgacccag

SEQ ID NO: 1447852 - RNA, 18 nt, Pseudomonas aeruginosa PA01
cacgggcgacccaggccg

SEQ ID NO: 1447853 - RNA, 20 nt, Pseudomonas aeruginosa PA01
cacgggcgccagcgguucag

SEQ ID NO: 1447854 - RNA, 18 nt, Pseudomonas aeruginosa PA01
cacggcuucagcgccagg

SEQ ID NO: 1447855 - RNA, 14 nt, Pseudomonas aeruginosa PA01
cacgguccgcgaac

SEQ ID NO: 1447856 - RNA, 19 nt, Pseudomonas aeruginosa PA01
cacggucgagacccgcaac

SEQ ID NO: 1447857 - RNA, 20 nt, Pseudomonas aeruginosa PA01
cacggucgagacccgcaaca

SEQ ID NO: 1447858 - RNA, 16 nt, Pseudomonas aeruginosa PA01
cacggucagcucggca

SEQ ID NO: 1447859 - RNA, 17 nt, Pseudomonas aeruginosa PA01
cacgggucgcagccgag

SEQ ID NO: 1447860 - RNA, 19 nt, Pseudomonas aeruginosa PA01
cacgguagagacggcggcg

SEQ ID NO: 1447861 - RNA, 20 nt, Pseudomonas aeruginosa PA01
cacgguagagacggcggcga

SEQ ID NO: 1447862 - RNA, 13 nt, Pseudomonas aeruginosa PA01
cacgguagccgcc

SEQ ID NO: 1447863 - RNA, 19 nt, Pseudomonas aeruginosa PA01
cagcaucagaggcaacacc

SEQ ID NO: 1447864 - RNA, 22 nt, Pseudomonas aeruginosa PA01
cagcaucaccuugcggaacccg

SEQ ID NO: 1447865 - RNA, 16 nt, Pseudomonas aeruginosa PA01
cagcaguaccuggcgg

SEQ ID NO: 1447866 - RNA, 17 nt, Pseudomonas aeruginosa PA01
cagcaguccgccauacc

SEQ ID NO: 1447867 - RNA, 20 nt, Pseudomonas aeruginosa PA01
cagcagucgcacagccaggg

SEQ ID NO: 1447868 - RNA, 14 nt, Pseudomonas aeruginosa PA01
cagcaggucgcgca

SEQ ID NO: 1447869 - RNA, 14 nt, Pseudomonas aeruginosa PA01
cagcaggucgaggg

SEQ ID NO: 1447870 - RNA, 15 nt, Pseudomonas aeruginosa PA01
cagcaggucgagcag

SEQ ID NO: 1447871 - RNA, 16 nt, Pseudomonas aeruginosa PA01
cagcaggucgagcagu

SEQ ID NO: 1447872 - RNA, 18 nt, Pseudomonas aeruginosa PA01
cagcagguagugcggcgg

SEQ ID NO: 1447873 - RNA, 19 nt, Pseudomonas aeruginosa PA01
cagcaggcugcugcugcgg

SEQ ID NO: 1447874 - RNA, 22 nt, Pseudomonas aeruginosa PA01
cagcagggugcggauggcgauc

SEQ ID NO: 1447875 - RNA, 23 nt, Pseudomonas aeruginosa PA01
cagcagggugcggauggcgaucg

SEQ ID NO: 1447876 - RNA, 24 nt, Pseudomonas aeruginosa PA01
cagcagggugcggauggcgaucga

SEQ ID NO: 1447877 - RNA, 21 nt, Pseudomonas aeruginosa PA01
cagcagguagccugcggccag

SEQ ID NO: 1447878 - RNA, 23 nt, Pseudomonas aeruginosa PA01
cagcagguagccugcggccagcg

SEQ ID NO: 1447879 - RNA, 14 nt, Pseudomonas aeruginosa PA01
cagcagguuccucc

SEQ ID NO: 1447880 - RNA, 22 nt, Pseudomonas aeruginosa PA01
cagcagguuccuccugggccga

SEQ ID NO: 1447881 - RNA, 14 nt, Pseudomonas aeruginosa PA01
cagcagguugaccc

SEQ ID NO: 1447882 - RNA, 23 nt, Pseudomonas aeruginosa PA01
cagcaggucuuccaccgcgucga

SEQ ID NO: 1447883 - RNA, 22 nt, Pseudomonas aeruginosa PA01
cagcagguggcaagccucgcgu

SEQ ID NO: 1447884 - RNA, 14 nt, Pseudomonas aeruginosa PA01
cagcagguggcgca

SEQ ID NO: 1447885 - RNA, 23 nt, Pseudomonas aeruginosa PA01
cagcagguggucgaugggcgagc

SEQ ID NO: 1447886 - RNA, 15 nt, Pseudomonas aeruginosa PA01
cagcaggucgucggc

SEQ ID NO: 1447887 - RNA, 19 nt, Pseudomonas aeruginosa PA01
cagcaggucgucggcgaaa

SEQ ID NO: 1447888 - RNA, 16 nt, Pseudomonas aeruginosa PA01
cagcaggucggccugc

SEQ ID NO: 1447889 - RNA, 23 nt, Pseudomonas aeruginosa PA01
cagcaggucggccugcugcucga

SEQ ID NO: 1447890 - RNA, 16 nt, Pseudomonas aeruginosa PA01
cagcaggucgcgcagu

SEQ ID NO: 1447891 - RNA, 20 nt, Pseudomonas aeruginosa PA01
cagcaggucgcgcaguucgu

SEQ ID NO: 1447892 - RNA, 20 nt, Pseudomonas aeruginosa PA01
cagcaggucggcagcgucga

SEQ ID NO: 1447893 - RNA, 13 nt, Pseudomonas aeruginosa PA01
cagcaggucggcc

SEQ ID NO: 1447894 - RNA, 13 nt, Pseudomonas aeruginosa PA01
cagcaggccggcc

SEQ ID NO: 1447895 - RNA, 17 nt, Pseudomonas aeruginosa PA01
cagcaggccggccagcc

SEQ ID NO: 1447896 - RNA, 13 nt, Pseudomonas aeruginosa PA01
cagcagcgccgcg

SEQ ID NO: 1447897 - RNA, 14 nt, Pseudomonas aeruginosa PA01
cagcagcgccgcga

SEQ ID NO: 1447898 - RNA, 16 nt, Pseudomonas aeruginosa PA01
cagcagcgccgcgaac

SEQ ID NO: 1447899 - RNA, 17 nt, Pseudomonas aeruginosa PA01
cagcagcgccgaacagg

SEQ ID NO: 1447900 - RNA, 12 nt, Pseudomonas aeruginosa PA01
cagcagcgccgc

SEQ ID NO: 1447901 - RNA, 22 nt, Pseudomonas aeruginosa PA01
cagcaggcgacggucaggccga

SEQ ID NO: 1447902 - RNA, 18 nt, Pseudomonas aeruginosa PA01
cagcaggccgugggccgg

SEQ ID NO: 1447903 - RNA, 18 nt, Pseudomonas aeruginosa PA01
cagcaggcgccggcggau

SEQ ID NO: 1447904 - RNA, 14 nt, Pseudomonas aeruginosa PA01
cagcaggcgcagca

SEQ ID NO: 1447905 - RNA, 20 nt, Pseudomonas aeruginosa PA01
cagcaggcgcagcagcgacu

SEQ ID NO: 1447906 - RNA, 16 nt, Pseudomonas aeruginosa PA01
cagcaggcgcaggucg

SEQ ID NO: 1447907 - RNA, 17 nt, Pseudomonas aeruginosa PA01
cagcaggcguucggcga

SEQ ID NO: 1447908 - RNA, 22 nt, Pseudomonas aeruginosa PA01
cagcaggcuggcggcaucggcg

SEQ ID NO: 1447909 - RNA, 19 nt, Pseudomonas aeruginosa PA01
cagcaggcuguacagcagg

SEQ ID NO: 1447910 - RNA, 14 nt, Pseudomonas aeruginosa PA01
cagcaggcgcucgg

SEQ ID NO: 1447911 - RNA, 16 nt, Pseudomonas aeruginosa PA01
cagcaggcgcucggcg

SEQ ID NO: 1447912 - RNA, 17 nt, Pseudomonas aeruginosa PA01
cagcaggcgcucggcga

SEQ ID NO: 1447913 - RNA, 19 nt, Pseudomonas aeruginosa PA01
cagcaggcgcucggcgacg

SEQ ID NO: 1447914 - RNA, 14 nt, Pseudomonas aeruginosa PA01
cagcagcgaacgcc

SEQ ID NO: 1447915 - RNA, 16 nt, Pseudomonas aeruginosa PA01
cagcagcgaacgccgc

SEQ ID NO: 1447916 - RNA, 23 nt, Pseudomonas aeruginosa PA01
cagcagcgaacgccgcagcucgg

SEQ ID NO: 1447917 - RNA, 23 nt, Pseudomonas aeruginosa PA01
cagcagccggaccagccguccgc

SEQ ID NO: 1447918 - RNA, 14 nt, Pseudomonas aeruginosa PA01
cagcagcgccagca

SEQ ID NO: 1447919 - RNA, 19 nt, Pseudomonas aeruginosa PA01
cagcagcgccagcaggucg

SEQ ID NO: 1447920 - RNA, 13 nt, Pseudomonas aeruginosa PA01
cagcagcgccagg

SEQ ID NO: 1447921 - RNA, 14 nt, Pseudomonas aeruginosa PA01
cagcagcgccaggg

SEQ ID NO: 1447922 - RNA, 15 nt, Pseudomonas aeruginosa PA01
cagcagcgagcaggc

SEQ ID NO: 1447923 - RNA, 16 nt, Pseudomonas aeruginosa PA01
cagcagcgagcaggcg

SEQ ID NO: 1447924 - RNA, 15 nt, Pseudomonas aeruginosa PA01
cagcagcgaccugac

SEQ ID NO: 1447925 - RNA, 17 nt, Pseudomonas aeruginosa PA01
cagcaucaggcgcuccg

SEQ ID NO: 1447926 - RNA, 13 nt, Pseudomonas aeruginosa PA01
cagcaucagcagg

SEQ ID NO: 1447927 - RNA, 20 nt, Pseudomonas aeruginosa PA01
cagcaucagcaggaagcuga

SEQ ID NO: 1447928 - RNA, 14 nt, Pseudomonas aeruginosa PA01
cagcaucagccgcg

SEQ ID NO: 1447929 - RNA, 21 nt, Pseudomonas aeruginosa PA01
cagcaucugcugguccuggcg

SEQ ID NO: 1447930 - RNA, 16 nt, Pseudomonas aeruginosa PA01
cagccacagaggucgc

SEQ ID NO: 1447931 - RNA, 17 nt, Pseudomonas aeruginosa PA01
cagccacagaggucgcu

SEQ ID NO: 1447932 - RNA, 16 nt, Pseudomonas aeruginosa PA01
cagccaagccaccagc

SEQ ID NO: 1447933 - RNA, 20 nt, Pseudomonas aeruginosa PA01
cagccacucccggcccuuga

SEQ ID NO: 1447934 - RNA, 15 nt, Pseudomonas aeruginosa PA01
cagccacucggccag

SEQ ID NO: 1447935 - RNA, 16 nt, Pseudomonas aeruginosa PA01
cagccacucggccagg

SEQ ID NO: 1447936 - RNA, 18 nt, Pseudomonas aeruginosa PA01
cagccacucggccaggcg

SEQ ID NO: 1447937 - RNA, 19 nt, Pseudomonas aeruginosa PA01
cagccacucggccaggcgc

SEQ ID NO: 1447938 - RNA, 17 nt, Pseudomonas aeruginosa PA01
cagccacugccgccuca

SEQ ID NO: 1447939 - RNA, 20 nt, Pseudomonas aeruginosa PA01
cagccacugcuuggcgaacu

SEQ ID NO: 1447940 - RNA, 14 nt, Pseudomonas aeruginosa PA01
cagccacuggcgga

SEQ ID NO: 1447941 - RNA, 16 nt, Pseudomonas aeruginosa PA01
cagccacuggcggacc

SEQ ID NO: 1447942 - RNA, 16 nt, Pseudomonas aeruginosa PA01
cagccagcagcccggc

SEQ ID NO: 1447943 - RNA, 17 nt, Pseudomonas aeruginosa PA01
cagccagcagcccggcc

SEQ ID NO: 1447944 - RNA, 20 nt, Pseudomonas aeruginosa PA01
cagccagcagcccggccugg

SEQ ID NO: 1447945 - RNA, 16 nt, Pseudomonas aeruginosa PA01
cagccagacguccggc

SEQ ID NO: 1447946 - RNA, 17 nt, Pseudomonas aeruginosa PA01
cagccagacguccggca

SEQ ID NO: 1447947 - RNA, 17 nt, Pseudomonas aeruginosa PA01
cagccagagccagucga

SEQ ID NO: 1447948 - RNA, 19 nt, Pseudomonas aeruginosa PA01
cagccagagccagucgaga

SEQ ID NO: 1447949 - RNA, 14 nt, Pseudomonas aeruginosa PA01
cagccagagcccgu

SEQ ID NO: 1447950 - RNA, 16 nt, Pseudomonas aeruginosa PA01
cagccagagcccgucg

SEQ ID NO: 1447951 - RNA, 22 nt, Pseudomonas aeruginosa PA01
cagccagagcguaucgaugcgc

SEQ ID NO: 1447952 - RNA, 14 nt, Pseudomonas aeruginosa PA01
cagccagagcucca

SEQ ID NO: 1447953 - RNA, 15 nt, Pseudomonas aeruginosa PA01
cagccagaccggcag

SEQ ID NO: 1447954 - RNA, 16 nt, Pseudomonas aeruginosa PA01
cagccagaccggcagc

SEQ ID NO: 1447955 - RNA, 18 nt, Pseudomonas aeruginosa PA01
cagccagaccggcagcgc

SEQ ID NO: 1447956 - RNA, 14 nt, Pseudomonas aeruginosa PA01
cagccagccgagca

SEQ ID NO: 1447957 - RNA, 16 nt, Pseudomonas aeruginosa PA01
cagccagccgagcaac

SEQ ID NO: 1447958 - RNA, 22 nt, Pseudomonas aeruginosa PA01
cagccagcccgcaauccgaccg

SEQ ID NO: 1447959 - RNA, 13 nt, Pseudomonas aeruginosa PA01
cagccagcccggc

SEQ ID NO: 1447960 - RNA, 14 nt, Pseudomonas aeruginosa PA01
cagccagcccggcg

SEQ ID NO: 1447961 - RNA, 17 nt, Pseudomonas aeruginosa PA01
cagccagcccggcggug

SEQ ID NO: 1447962 - RNA, 22 nt, Pseudomonas aeruginosa PA01
cagccagcccggcggugaugcc

SEQ ID NO: 1447963 - RNA, 16 nt, Pseudomonas aeruginosa PA01
cagccagccgccgaag

SEQ ID NO: 1447964 - RNA, 23 nt, Pseudomonas aeruginosa PA01
cagccagccgccgaagggccgca

SEQ ID NO: 1447965 - RNA, 13 nt, Pseudomonas aeruginosa PA01
cagccagccgccu

SEQ ID NO: 1447966 - RNA, 14 nt, Pseudomonas aeruginosa PA01
cagccagccgucgu

SEQ ID NO: 1447967 - RNA, 22 nt, Pseudomonas aeruginosa PA01
cagccagccgucgucguccacc

SEQ ID NO: 1447968 - RNA, 23 nt, Pseudomonas aeruginosa PA01
cagccagccgucgucguccaccg

SEQ ID NO: 1447969 - RNA, 22 nt, Pseudomonas aeruginosa PA01
cagccagcgcggcucgggcggc

SEQ ID NO: 1447970 - RNA, 14 nt, Pseudomonas aeruginosa PA01
cagccagcggcgcu

SEQ ID NO: 1447971 - RNA, 21 nt, Pseudomonas aeruginosa PA01
cagccagcgguugagcagggc

SEQ ID NO: 1447972 - RNA, 16 nt, Pseudomonas aeruginosa PA01
cagccaggcgauggug

SEQ ID NO: 1447973 - RNA, 20 nt, Pseudomonas aeruginosa PA01
cagccaggcgauggugcgcu

SEQ ID NO: 1447974 - RNA, 13 nt, Pseudomonas aeruginosa PA01
cagccaggcccgg

SEQ ID NO: 1447975 - RNA, 13 nt, Pseudomonas aeruginosa PA01
cagccaggcuggc

SEQ ID NO: 1447976 - RNA, 21 nt, Pseudomonas aeruginosa PA01
cagccaggcggccaccaccgu

SEQ ID NO: 1447977 - RNA, 21 nt, Pseudomonas aeruginosa PA01
cagccaggaagagcccgccac

SEQ ID NO: 1447978 - RNA, 20 nt, Pseudomonas aeruginosa PA01
cagccaggcgaagcggcugg

SEQ ID NO: 1447979 - RNA, 16 nt, Pseudomonas aeruginosa PA01
cagccaggcgaaggcg

SEQ ID NO: 1447980 - RNA, 18 nt, Pseudomonas aeruginosa PA01
cagccaggcgaaggcgau

SEQ ID NO: 1447981 - RNA, 19 nt, Pseudomonas aeruginosa PA01
cagccaggcgaaggcgauc

SEQ ID NO: 1447982 - RNA, 16 nt, Pseudomonas aeruginosa PA01
cagcaacccgcuccgu

SEQ ID NO: 1447983 - RNA, 21 nt, Pseudomonas aeruginosa PA01
cagcaacccgcccuugcucgc

SEQ ID NO: 1447984 - RNA, 15 nt, Pseudomonas aeruginosa PA01
cagcaacgccgcccc

SEQ ID NO: 1447985 - RNA, 14 nt, Pseudomonas aeruginosa PA01
cagcaacgccucga

SEQ ID NO: 1447986 - RNA, 21 nt, Pseudomonas aeruginosa PA01
cagcaacggcgcaucgucgau

SEQ ID NO: 1447987 - RNA, 13 nt, Pseudomonas aeruginosa PA01
cagcaacggcucc

SEQ ID NO: 1447988 - RNA, 17 nt, Pseudomonas aeruginosa PA01
cagcaacggcuccuuga

SEQ ID NO: 1447989 - RNA, 17 nt, Pseudomonas aeruginosa PA01
cagcaccaugcgcggca

SEQ ID NO: 1447990 - RNA, 21 nt, Pseudomonas aeruginosa PA01
cagcaccgggauggucgaggg

SEQ ID NO: 1447991 - RNA, 16 nt, Pseudomonas aeruginosa PA01
cagcaccucccccagc

SEQ ID NO: 1447992 - RNA, 20 nt, Pseudomonas aeruginosa PA01
cagcaccucccccagcgggc

SEQ ID NO: 1447993 - RNA, 23 nt, Pseudomonas aeruginosa PA01
cagcaccguggcgccauccucca

SEQ ID NO: 1447994 - RNA, 18 nt, Pseudomonas aeruginosa PA01
cagcaccguggucagcac

SEQ ID NO: 1447995 - RNA, 20 nt, Pseudomonas aeruginosa PA01
cagcaccguggucagcacca

SEQ ID NO: 1447996 - RNA, 16 nt, Pseudomonas aeruginosa PA01
cagcaccagcggaccg

SEQ ID NO: 1447997 - RNA, 17 nt, Pseudomonas aeruginosa PA01
cagcaccaggccaucga

SEQ ID NO: 1447998 - RNA, 17 nt, Pseudomonas aeruginosa PA01
cagcaccaggcuggcca

SEQ ID NO: 1447999 - RNA, 22 nt, Pseudomonas aeruginosa PA01
cagcaccaucggguugaucgac

SEQ ID NO: 1448000 - RNA, 12 nt, Pseudomonas aeruginosa PA01
cagcaccaucag

SEQ ID NO: 1448001 - RNA, 14 nt, Pseudomonas aeruginosa PA01
cagcaccaucagcc

SEQ ID NO: 1448002 - RNA, 17 nt, Pseudomonas aeruginosa PA01
cagcaccaucagccagc

SEQ ID NO: 1448003 - RNA, 19 nt, Pseudomonas aeruginosa PA01
cagcaccaucagccagccc

SEQ ID NO: 1448004 - RNA, 23 nt, Pseudomonas aeruginosa PA01
cagcacauagagggucagccggc

SEQ ID NO: 1448005 - RNA, 16 nt, Pseudomonas aeruginosa PA01
cagcaccacccggccg

SEQ ID NO: 1448006 - RNA, 18 nt, Pseudomonas aeruginosa PA01
cagcaccacccggccgcg

SEQ ID NO: 1448007 - RNA, 16 nt, Pseudomonas aeruginosa PA01
cagcaccacccggcgc

SEQ ID NO: 1448008 - RNA, 13 nt, Pseudomonas aeruginosa PA01
cagcaccacggcg

SEQ ID NO: 1448009 - RNA, 16 nt, Pseudomonas aeruginosa PA01
cagcaccacggcgaug

SEQ ID NO: 1448010 - RNA, 14 nt, Pseudomonas aeruginosa PA01
cagcaccagcagga

SEQ ID NO: 1448011 - RNA, 19 nt, Pseudomonas aeruginosa PA01
cagcacguugccauccagc

SEQ ID NO: 1448012 - RNA, 23 nt, Pseudomonas aeruginosa PA01
cagcacguugccauccagcgccu

SEQ ID NO: 1448013 - RNA, 13 nt, Pseudomonas aeruginosa PA01
cagcagcaacucc

SEQ ID NO: 1448014 - RNA, 16 nt, Pseudomonas aeruginosa PA01
cagcagcaacagcgcc

SEQ ID NO: 1448015 - RNA, 17 nt, Pseudomonas aeruginosa PA01
cagcagcaacagcgccg

SEQ ID NO: 1448016 - RNA, 19 nt, Pseudomonas aeruginosa PA01
cagcagcaacagcgccgcg

SEQ ID NO: 1448017 - RNA, 21 nt, Pseudomonas aeruginosa PA01
cagcagcaacagcgccgcgcg

SEQ ID NO: 1448018 - RNA, 23 nt, Pseudomonas aeruginosa PA01
cagcagccccgaggccagcaggc

SEQ ID NO: 1448019 - RNA, 16 nt, Pseudomonas aeruginosa PA01
cagcagcccggccugg

SEQ ID NO: 1448020 - RNA, 14 nt, Pseudomonas aeruginosa PA01
cagcagccaggccu

SEQ ID NO: 1448021 - RNA, 13 nt, Pseudomonas aeruginosa PA01
cagcagccaggcg

SEQ ID NO: 1448022 - RNA, 14 nt, Pseudomonas aeruginosa PA01
cagcagccaggcga

SEQ ID NO: 1448023 - RNA, 12 nt, Pseudomonas aeruginosa PA01
cagcagcaggcc

SEQ ID NO: 1448024 - RNA, 20 nt, Pseudomonas aeruginosa PA01
cagcagccaaggaugcgcca

SEQ ID NO: 1448025 - RNA, 22 nt, Pseudomonas aeruginosa PA01
cagcagccaaggaugcgccagc

SEQ ID NO: 1448026 - RNA, 21 nt, Pseudomonas aeruginosa PA01
cagcagcaugggauggcgcgg

SEQ ID NO: 1448027 - RNA, 19 nt, Pseudomonas aeruginosa PA01
cagcagcaccaucagccag

SEQ ID NO: 1448028 - RNA, 22 nt, Pseudomonas aeruginosa PA01
cagcagcaccaucagccagccc

SEQ ID NO: 1448029 - RNA, 13 nt, Pseudomonas aeruginosa PA01
cagcagcaggccg

SEQ ID NO: 1448030 - RNA, 14 nt, Pseudomonas aeruginosa PA01
cagcagcaggccgg

SEQ ID NO: 1448031 - RNA, 15 nt, Pseudomonas aeruginosa PA01
cagcagcaggccggc

SEQ ID NO: 1448032 - RNA, 16 nt, Pseudomonas aeruginosa PA01
cagcagcaggccggcg

SEQ ID NO: 1448033 - RNA, 12 nt, Pseudomonas aeruginosa PA01
cagcacggcggc

SEQ ID NO: 1448034 - RNA, 22 nt, Pseudomonas aeruginosa PA01
cagcacggcgacgaaggccugg

SEQ ID NO: 1448035 - RNA, 15 nt, Pseudomonas aeruginosa PA01
cagcacggcgaauuc

SEQ ID NO: 1448036 - RNA, 17 nt, Pseudomonas aeruginosa PA01
cagcacguagccgcccu

SEQ ID NO: 1448037 - RNA, 20 nt, Pseudomonas aeruginosa PA01
cagcacggugcuggcgucgc

SEQ ID NO: 1448038 - RNA, 22 nt, Pseudomonas aeruginosa PA01
cagcacgucguccagcgccgag

SEQ ID NO: 1448039 - RNA, 23 nt, Pseudomonas aeruginosa PA01
cagcacgucguccagcgccgaga

SEQ ID NO: 1448040 - RNA, 23 nt, Pseudomonas aeruginosa PA01
cagcacgucgauauccagcggca

SEQ ID NO: 1448041 - RNA, 15 nt, Pseudomonas aeruginosa PA01
cagcacgauggcgag

SEQ ID NO: 1448042 - RNA, 22 nt, Pseudomonas aeruginosa PA01
cagcacgauggcgaggaugauc

SEQ ID NO: 1448043 - RNA, 14 nt, Pseudomonas aeruginosa PA01
cagcaccucgacgc

SEQ ID NO: 1448044 - RNA, 13 nt, Pseudomonas aeruginosa PA01
cagcaccucgccg

SEQ ID NO: 1448045 - RNA, 13 nt, Pseudomonas aeruginosa PA01
cagcacgccgagc

SEQ ID NO: 1448046 - RNA, 20 nt, Pseudomonas aeruginosa PA01
cagcacgccgagcaacggca

SEQ ID NO: 1448047 - RNA, 21 nt, Pseudomonas aeruginosa PA01
cagcacgcccaguugcgccgc

SEQ ID NO: 1448048 - RNA, 14 nt, Pseudomonas aeruginosa PA01
cagcccgccgugcg

SEQ ID NO: 1448049 - RNA, 15 nt, Pseudomonas aeruginosa PA01
cagcccgccgugcgc

SEQ ID NO: 1448050 - RNA, 20 nt, Pseudomonas aeruginosa PA01
cagcccgccgugcgcuccgc

SEQ ID NO: 1448051 - RNA, 13 nt, Pseudomonas aeruginosa PA01
cagcccgcgccgc

SEQ ID NO: 1448052 - RNA, 21 nt, Pseudomonas aeruginosa PA01
cagccccgaucgccucggcca

SEQ ID NO: 1448053 - RNA, 13 nt, Pseudomonas aeruginosa PA01
cagcccccgccgg

SEQ ID NO: 1448054 - RNA, 12 nt, Pseudomonas aeruginosa PA01
cagccccggccc

SEQ ID NO: 1448055 - RNA, 14 nt, Pseudomonas aeruginosa PA01
cagccccggcccgg

SEQ ID NO: 1448056 - RNA, 18 nt, Pseudomonas aeruginosa PA01
cagcccccucgcccucga

SEQ ID NO: 1448057 - RNA, 14 nt, Pseudomonas aeruginosa PA01
cagccccgccggaa

SEQ ID NO: 1448058 - RNA, 15 nt, Pseudomonas aeruginosa PA01
cagccccgccggaag

SEQ ID NO: 1448059 - RNA, 17 nt, Pseudomonas aeruginosa PA01
cagcccauacaccaggc

SEQ ID NO: 1448060 - RNA, 18 nt, Pseudomonas aeruginosa PA01
cagcccauacaccaggcc

SEQ ID NO: 1448061 - RNA, 20 nt, Pseudomonas aeruginosa PA01
cagcccauacaccaggccgg

SEQ ID NO: 1448062 - RNA, 14 nt, Pseudomonas aeruginosa PA01
cagccccaccgcca

SEQ ID NO: 1448063 - RNA, 14 nt, Pseudomonas aeruginosa PA01
cagccccagcacgc

SEQ ID NO: 1448064 - RNA, 16 nt, Pseudomonas aeruginosa PA01
cagccccagcacgccg

SEQ ID NO: 1448065 - RNA, 18 nt, Pseudomonas aeruginosa PA01
cagccccagcacgccgag

SEQ ID NO: 1448066 - RNA, 17 nt, Pseudomonas aeruginosa PA01
cagcccccccagcacgg

SEQ ID NO: 1448067 - RNA, 13 nt, Pseudomonas aeruginosa PA01
cagccccaguccc

SEQ ID NO: 1448068 - RNA, 12 nt, Pseudomonas aeruginosa PA01
cagccccaggcc

SEQ ID NO: 1448069 - RNA, 14 nt, Pseudomonas aeruginosa PA01
cagccccaggccgc

SEQ ID NO: 1448070 - RNA, 16 nt, Pseudomonas aeruginosa PA01
cagccccaggcgcggc

SEQ ID NO: 1448071 - RNA, 17 nt, Pseudomonas aeruginosa PA01
cagccccaggcgcggcg

SEQ ID NO: 1448072 - RNA, 17 nt, Pseudomonas aeruginosa PA01
cagcccaguucgcgcag

SEQ ID NO: 1448073 - RNA, 22 nt, Pseudomonas aeruginosa PA01
cagcccagggcgaucgucgaga

SEQ ID NO: 1448074 - RNA, 13 nt, Pseudomonas aeruginosa PA01
cagcccagccgcu

SEQ ID NO: 1448075 - RNA, 16 nt, Pseudomonas aeruginosa PA01
cagcccagccgcucgc

SEQ ID NO: 1448076 - RNA, 15 nt, Pseudomonas aeruginosa PA01
cagcccagcggcgcg

SEQ ID NO: 1448077 - RNA, 17 nt, Pseudomonas aeruginosa PA01
cagcccagcggcgcggc

SEQ ID NO: 1448078 - RNA, 15 nt, Pseudomonas aeruginosa PA01
cagcccagcgcuucc

SEQ ID NO: 1448079 - RNA, 16 nt, Pseudomonas aeruginosa PA01
cagcccacgcgccugg

SEQ ID NO: 1448080 - RNA, 18 nt, Pseudomonas aeruginosa PA01
cagcccacgcgccuggcc

SEQ ID NO: 1448081 - RNA, 22 nt, Pseudomonas aeruginosa PA01
cagcccacccccagcccggcca

SEQ ID NO: 1448082 - RNA, 19 nt, Pseudomonas aeruginosa PA01
cagcccacccccggcccgg

SEQ ID NO: 1448083 - RNA, 22 nt, Pseudomonas aeruginosa PA01
cagcccacccccggcccggcca

SEQ ID NO: 1448084 - RNA, 13 nt, Pseudomonas aeruginosa PA01
cagccauggcugg

SEQ ID NO: 1448085 - RNA, 17 nt, Pseudomonas aeruginosa PA01
cagccauggcuggugcg

SEQ ID NO: 1448086 - RNA, 14 nt, Pseudomonas aeruginosa PA01
cagccauucgccgc

SEQ ID NO: 1448087 - RNA, 17 nt, Pseudomonas aeruginosa PA01
cagccauuggccgacgc

SEQ ID NO: 1448088 - RNA, 15 nt, Pseudomonas aeruginosa PA01
cagccaggggcacgc

SEQ ID NO: 1448089 - RNA, 20 nt, Pseudomonas aeruginosa PA01
cagccaggggcacgcuggcg

SEQ ID NO: 1448090 - RNA, 23 nt, Pseudomonas aeruginosa PA01
cagccaggguacuucgugccaca

SEQ ID NO: 1448091 - RNA, 21 nt, Pseudomonas aeruginosa PA01
cagccagguguucggccccgg

SEQ ID NO: 1448092 - RNA, 18 nt, Pseudomonas aeruginosa PA01
cagccaguaguccuccgc

SEQ ID NO: 1448093 - RNA, 19 nt, Pseudomonas aeruginosa PA01
cagccaguaguccuccgcg

SEQ ID NO: 1448094 - RNA, 20 nt, Pseudomonas aeruginosa PA01
cagccaguaguccuccgcgc

SEQ ID NO: 1448095 - RNA, 23 nt, Pseudomonas aeruginosa PA01
cagccaguaguccuccgcgccca

SEQ ID NO: 1448096 - RNA, 21 nt, Pseudomonas aeruginosa PA01
cagccagucgagacgccagcc

SEQ ID NO: 1448097 - RNA, 24 nt, Pseudomonas aeruginosa PA01
cagccagucgagacgccagccgcc

SEQ ID NO: 1448098 - RNA, 16 nt, Pseudomonas aeruginosa PA01
cagccagucggcgguc

SEQ ID NO: 1448099 - RNA, 16 nt, Pseudomonas aeruginosa PA01
cagccaguggcuggcg

SEQ ID NO: 1448100 - RNA, 13 nt, Pseudomonas aeruginosa PA01
cagccaguccggc

SEQ ID NO: 1448101 - RNA, 16 nt, Pseudomonas aeruginosa PA01
cagccaguccggcagc

SEQ ID NO: 1448102 - RNA, 21 nt, Pseudomonas aeruginosa PA01
cagccaguccggcagcacggc

SEQ ID NO: 1448103 - RNA, 22 nt, Pseudomonas aeruginosa PA01
cagccaguccggcagcacggcg

SEQ ID NO: 1448104 - RNA, 14 nt, Pseudomonas aeruginosa PA01
cagccauagcgccg

SEQ ID NO: 1448105 - RNA, 15 nt, Pseudomonas aeruginosa PA01
cagccauagcgccgg

SEQ ID NO: 1448106 - RNA, 16 nt, Pseudomonas aeruginosa PA01
cagccauagcgccggc

SEQ ID NO: 1448107 - RNA, 17 nt, Pseudomonas aeruginosa PA01
cagccauagcgccggca

SEQ ID NO: 1448108 - RNA, 19 nt, Pseudomonas aeruginosa PA01
cagccaucgcauagccggc

SEQ ID NO: 1448109 - RNA, 20 nt, Pseudomonas aeruginosa PA01
cagccaucgcauagccggcg

SEQ ID NO: 1448110 - RNA, 23 nt, Pseudomonas aeruginosa PA01
cagccaucgcauagccggcgcgc

SEQ ID NO: 1448111 - RNA, 15 nt, Pseudomonas aeruginosa PA01
cagccgcgccagugc

SEQ ID NO: 1448112 - RNA, 13 nt, Pseudomonas aeruginosa PA01
cagccgcgccggg

SEQ ID NO: 1448113 - RNA, 15 nt, Pseudomonas aeruginosa PA01
cagccgcgcgccgca

SEQ ID NO: 1448114 - RNA, 19 nt, Pseudomonas aeruginosa PA01
cagccgcgcgccgcaucgc

SEQ ID NO: 1448115 - RNA, 21 nt, Pseudomonas aeruginosa PA01
cagccgcgcgccgcaucgcug

SEQ ID NO: 1448116 - RNA, 19 nt, Pseudomonas aeruginosa PA01
cagccgcgaguccuucggc

SEQ ID NO: 1448117 - RNA, 22 nt, Pseudomonas aeruginosa PA01
cagccgcgaguccuucggcgca

SEQ ID NO: 1448118 - RNA, 18 nt, Pseudomonas aeruginosa PA01
cagccgccgcugcaccga

SEQ ID NO: 1448119 - RNA, 17 nt, Pseudomonas aeruginosa PA01
cagccgcgugcgcgccg

SEQ ID NO: 1448120 - RNA, 20 nt, Pseudomonas aeruginosa PA01
cagccgcgugcgcgccgccg

SEQ ID NO: 1448121 - RNA, 21 nt, Pseudomonas aeruginosa PA01
cagccgcgugcgcgccgccgg

SEQ ID NO: 1448122 - RNA, 14 nt, Pseudomonas aeruginosa PA01
cagccgcuccagga

SEQ ID NO: 1448123 - RNA, 14 nt, Pseudomonas aeruginosa PA01
cagccgcgguccau

SEQ ID NO: 1448124 - RNA, 13 nt, Pseudomonas aeruginosa PA01
cagccggcaucca

SEQ ID NO: 1448125 - RNA, 15 nt, Pseudomonas aeruginosa PA01
cagccggcauccagc

SEQ ID NO: 1448126 - RNA, 16 nt, Pseudomonas aeruginosa PA01
cagccggcauccagca

SEQ ID NO: 1448127 - RNA, 16 nt, Pseudomonas aeruginosa PA01
cagccgcgcucggcca

SEQ ID NO: 1448128 - RNA, 13 nt, Pseudomonas aeruginosa PA01
cagccgcggcgcc

SEQ ID NO: 1448129 - RNA, 17 nt, Pseudomonas aeruginosa PA01
cagccgcggcgccacgc

SEQ ID NO: 1448130 - RNA, 12 nt, Pseudomonas aeruginosa PA01
cagccgcggccg

SEQ ID NO: 1448131 - RNA, 14 nt, Pseudomonas aeruginosa PA01
cagccgcggccggg

SEQ ID NO: 1448132 - RNA, 12 nt, Pseudomonas aeruginosa PA01
cagccgcggcgc

SEQ ID NO: 1448133 - RNA, 13 nt, Pseudomonas aeruginosa PA01
cagccgcggauca

SEQ ID NO: 1448134 - RNA, 19 nt, Pseudomonas aeruginosa PA01
cagccgcggaucaccuggc

SEQ ID NO: 1448135 - RNA, 23 nt, Pseudomonas aeruginosa PA01
cagccgcggaucaccuggccgug

SEQ ID NO: 1448136 - RNA, 13 nt, Pseudomonas aeruginosa PA01
cagccgcgcgcgu

SEQ ID NO: 1448137 - RNA, 16 nt, Pseudomonas aeruginosa PA01
cagccgcgcgcgucga

SEQ ID NO: 1448138 - RNA, 16 nt, Pseudomonas aeruginosa PA01
cagccgccgcggcacc

SEQ ID NO: 1448139 - RNA, 19 nt, Pseudomonas aeruginosa PA01
cagccgccgaagggccgca

SEQ ID NO: 1448140 - RNA, 22 nt, Pseudomonas aeruginosa PA01
cagccgagguucuugcccagca

SEQ ID NO: 1448141 - RNA, 16 nt, Pseudomonas aeruginosa PA01
cagccgaggucgccgc

SEQ ID NO: 1448142 - RNA, 18 nt, Pseudomonas aeruginosa PA01
cagccgaggucgccgcca

SEQ ID NO: 1448143 - RNA, 19 nt, Pseudomonas aeruginosa PA01
cagccgaggucgccgccag

SEQ ID NO: 1448144 - RNA, 22 nt, Pseudomonas aeruginosa PA01
cagccgaggucgccgccagcua

SEQ ID NO: 1448145 - RNA, 15 nt, Pseudomonas aeruginosa PA01
cagccgaggcagccg

SEQ ID NO: 1448146 - RNA, 17 nt, Pseudomonas aeruginosa PA01
cagccgacuggcgguac

SEQ ID NO: 1448147 - RNA, 22 nt, Pseudomonas aeruginosa PA01
cagccgacuggcgguacgcugc

SEQ ID NO: 1448148 - RNA, 21 nt, Pseudomonas aeruginosa PA01
cagccgagcaacucggcggcg

SEQ ID NO: 1448149 - RNA, 19 nt, Pseudomonas aeruginosa PA01
cagccgagcccccauaccg

SEQ ID NO: 1448150 - RNA, 20 nt, Pseudomonas aeruginosa PA01
cagcccggccauccuggccg

SEQ ID NO: 1448151 - RNA, 15 nt, Pseudomonas aeruginosa PA01
cagccgaccguccgc

SEQ ID NO: 1448152 - RNA, 19 nt, Pseudomonas aeruginosa PA01
cagccgaccguccgccugc

SEQ ID NO: 1448153 - RNA, 22 nt, Pseudomonas aeruginosa PA01
cagccgacgauccggccgaucu

SEQ ID NO: 1448154 - RNA, 20 nt, Pseudomonas aeruginosa PA01
cagcccggccucgccggucg

SEQ ID NO: 1448155 - RNA, 22 nt, Pseudomonas aeruginosa PA01
cagcccggccucgccggucgcg

SEQ ID NO: 1448156 - RNA, 20 nt, Pseudomonas aeruginosa PA01
cagcccgcugaccgggcgga

SEQ ID NO: 1448157 - RNA, 16 nt, Pseudomonas aeruginosa PA01
cagcccgccuuccagc

SEQ ID NO: 1448158 - RNA, 14 nt, Pseudomonas aeruginosa PA01
cagcccgcgccgcg

SEQ ID NO: 1448159 - RNA, 20 nt, Pseudomonas aeruginosa PA01
cagcccgcgcucggccgccu

SEQ ID NO: 1448160 - RNA, 21 nt, Pseudomonas aeruginosa PA01
cagcgccgcauuggccaggcc

SEQ ID NO: 1448161 - RNA, 23 nt, Pseudomonas aeruginosa PA01
cagcgccgccaaccacuccgcca

SEQ ID NO: 1448162 - RNA, 18 nt, Pseudomonas aeruginosa PA01
cagcgcccagacacgccu

SEQ ID NO: 1448163 - RNA, 20 nt, Pseudomonas aeruginosa PA01
cagcgcccagacacgccuca

SEQ ID NO: 1448164 - RNA, 17 nt, Pseudomonas aeruginosa PA01
cagcgccgccaggcccu

SEQ ID NO: 1448165 - RNA, 16 nt, Pseudomonas aeruginosa PA01
cagcgccgccaggcgc

SEQ ID NO: 1448166 - RNA, 20 nt, Pseudomonas aeruginosa PA01
cagcgccgccaggcgcgucu

SEQ ID NO: 1448167 - RNA, 14 nt, Pseudomonas aeruginosa PA01
cagcgccgccaggc

SEQ ID NO: 1448168 - RNA, 20 nt, Pseudomonas aeruginosa PA01
cagcgccgccaggcagacca

SEQ ID NO: 1448169 - RNA, 15 nt, Pseudomonas aeruginosa PA01
cagcgccgccaggcc

SEQ ID NO: 1448170 - RNA, 13 nt, Pseudomonas aeruginosa PA01
cagcgccgccagc

SEQ ID NO: 1448171 - RNA, 16 nt, Pseudomonas aeruginosa PA01
cagcgccgccagcagg

SEQ ID NO: 1448172 - RNA, 17 nt, Pseudomonas aeruginosa PA01
cagcgccgccagcagga

SEQ ID NO: 1448173 - RNA, 20 nt, Pseudomonas aeruginosa PA01
cagcgccgccagcaggucgg

SEQ ID NO: 1448174 - RNA, 16 nt, Pseudomonas aeruginosa PA01
cagcgccgcgaacaca

SEQ ID NO: 1448175 - RNA, 13 nt, Pseudomonas aeruginosa PA01
cagcgccgccggg

SEQ ID NO: 1448176 - RNA, 12 nt, Pseudomonas aeruginosa PA01
cagcgccgccuc

SEQ ID NO: 1448177 - RNA, 14 nt, Pseudomonas aeruginosa PA01
cagcgccgccucgc

SEQ ID NO: 1448178 - RNA, 20 nt, Pseudomonas aeruginosa PA01
cagcgccgccucgcugggcg

SEQ ID NO: 1448179 - RNA, 15 nt, Pseudomonas aeruginosa PA01
cagcgccacgcugau

SEQ ID NO: 1448180 - RNA, 16 nt, Pseudomonas aeruginosa PA01
cagcgccacggccagc

SEQ ID NO: 1448181 - RNA, 17 nt, Pseudomonas aeruginosa PA01
cagcgccacggccagca

SEQ ID NO: 1448182 - RNA, 19 nt, Pseudomonas aeruginosa PA01
cagcgccacggccagcagg

SEQ ID NO: 1448183 - RNA, 14 nt, Pseudomonas aeruginosa PA01
cagcgccacggcga

SEQ ID NO: 1448184 - RNA, 16 nt, Pseudomonas aeruginosa PA01
cagcgccacggcgauc

SEQ ID NO: 1448185 - RNA, 14 nt, Pseudomonas aeruginosa PA01
cagcgccaggcgcg

SEQ ID NO: 1448186 - RNA, 15 nt, Pseudomonas aeruginosa PA01
cagcgccaggcgcgg

SEQ ID NO: 1448187 - RNA, 16 nt, Pseudomonas aeruginosa PA01
cagcgccaggcgcggu

SEQ ID NO: 1448188 - RNA, 17 nt, Pseudomonas aeruginosa PA01
cagcgccagggcccaca

SEQ ID NO: 1448189 - RNA, 16 nt, Pseudomonas aeruginosa PA01
cagcgccacgccgcug

SEQ ID NO: 1448190 - RNA, 22 nt, Pseudomonas aeruginosa PA01
cagcgccauggggaucaccgga

SEQ ID NO: 1448191 - RNA, 18 nt, Pseudomonas aeruginosa PA01
cagcgccaucaggcccuu

SEQ ID NO: 1448192 - RNA, 20 nt, Pseudomonas aeruginosa PA01
cagcgccagguuggccuggc

SEQ ID NO: 1448193 - RNA, 22 nt, Pseudomonas aeruginosa PA01
cagcgccagguuggccuggccc

SEQ ID NO: 1448194 - RNA, 23 nt, Pseudomonas aeruginosa PA01
cagcgccaguuggacgcggccug

SEQ ID NO: 1448195 - RNA, 23 nt, Pseudomonas aeruginosa PA01
cagcgauucccgaggguggcgcu

SEQ ID NO: 1448196 - RNA, 23 nt, Pseudomonas aeruginosa PA01
cagcgcaaccgguuucccucgag

SEQ ID NO: 1448197 - RNA, 23 nt, Pseudomonas aeruginosa PA01
cagcgcaacgaaaagccgccccg

SEQ ID NO: 1448198 - RNA, 15 nt, Pseudomonas aeruginosa PA01
cagcgaucgccgcca

SEQ ID NO: 1448199 - RNA, 23 nt, Pseudomonas aeruginosa PA01
cagcgaucgccgccauugacgaa

SEQ ID NO: 1448200 - RNA, 18 nt, Pseudomonas aeruginosa PA01
cagcgagcuucgccgcgc

SEQ ID NO: 1448201 - RNA, 19 nt, Pseudomonas aeruginosa PA01
cagcgagcuucgccgcgca

SEQ ID NO: 1448202 - RNA, 13 nt, Pseudomonas aeruginosa PA01
cagcgccaccagg

SEQ ID NO: 1448203 - RNA, 14 nt, Pseudomonas aeruginosa PA01
cagcgccaccagga

SEQ ID NO: 1448204 - RNA, 19 nt, Pseudomonas aeruginosa PA01
cagcgccaccaggaaaucg

SEQ ID NO: 1448205 - RNA, 17 nt, Pseudomonas aeruginosa PA01
cagcgccaccagcaggg

SEQ ID NO: 1448206 - RNA, 22 nt, Pseudomonas aeruginosa PA01
cagcgccaccagcagggccagg

SEQ ID NO: 1448207 - RNA, 16 nt, Pseudomonas aeruginosa PA01
cagcgccaccagcaug

SEQ ID NO: 1448208 - RNA, 14 nt, Pseudomonas aeruginosa PA01
cagcgccaccagca

SEQ ID NO: 1448209 - RNA, 21 nt, Pseudomonas aeruginosa PA01
cagcgcaugcggaaggcuucc

SEQ ID NO: 1448210 - RNA, 19 nt, Pseudomonas aeruginosa PA01
cagcgcauaggccugggcg

SEQ ID NO: 1448211 - RNA, 13 nt, Pseudomonas aeruginosa PA01
cagccugcgcugu

SEQ ID NO: 1448212 - RNA, 14 nt, Pseudomonas aeruginosa PA01
cagccucgcgcucg

SEQ ID NO: 1448213 - RNA, 17 nt, Pseudomonas aeruginosa PA01
cagccucgcgcucggcg

SEQ ID NO: 1448214 - RNA, 11 nt, Pseudomonas aeruginosa PA01
cagccucggca

SEQ ID NO: 1448215 - RNA, 18 nt, Pseudomonas aeruginosa PA01
cagccucggcagggcgcc

SEQ ID NO: 1448216 - RNA, 12 nt, Pseudomonas aeruginosa PA01
cagccucggcga

SEQ ID NO: 1448217 - RNA, 14 nt, Pseudomonas aeruginosa PA01
cagccucggcgaag

SEQ ID NO: 1448218 - RNA, 20 nt, Pseudomonas aeruginosa PA01
cagccugacguugccgcgcg

SEQ ID NO: 1448219 - RNA, 22 nt, Pseudomonas aeruginosa PA01
cagccuggcgucgcacugcugc

SEQ ID NO: 1448220 - RNA, 14 nt, Pseudomonas aeruginosa PA01
cagccuucccggcg

SEQ ID NO: 1448221 - RNA, 20 nt, Pseudomonas aeruginosa PA01
cagccuucccggcgcuucgc

SEQ ID NO: 1448222 - RNA, 22 nt, Pseudomonas aeruginosa PA01
cagccugggggucuacgugauc

SEQ ID NO: 1448223 - RNA, 16 nt, Pseudomonas aeruginosa PA01
cagccuggccagcguc

SEQ ID NO: 1448224 - RNA, 15 nt, Pseudomonas aeruginosa PA01
cagccugcuggccug

SEQ ID NO: 1448225 - RNA, 15 nt, Pseudomonas aeruginosa PA01
cagccggccauccag

SEQ ID NO: 1448226 - RNA, 18 nt, Pseudomonas aeruginosa PA01
cagccggccauccagcca

SEQ ID NO: 1448227 - RNA, 19 nt, Pseudomonas aeruginosa PA01
cagccggccaugcuggcgc

SEQ ID NO: 1448228 - RNA, 20 nt, Pseudomonas aeruginosa PA01
cagccggcccauccgccgca

SEQ ID NO: 1448229 - RNA, 19 nt, Pseudomonas aeruginosa PA01
cagccggccgaucuucagc

SEQ ID NO: 1448230 - RNA, 21 nt, Pseudomonas aeruginosa PA01
cagccggcgaagggcaggccg

SEQ ID NO: 1448231 - RNA, 22 nt, Pseudomonas aeruginosa PA01
cagccggcgaagggcaggccga

SEQ ID NO: 1448232 - RNA, 23 nt, Pseudomonas aeruginosa PA01
cagccucacccugcugggcggga

SEQ ID NO: 1448233 - RNA, 14 nt, Pseudomonas aeruginosa PA01
cagccucagcgaca

SEQ ID NO: 1448234 - RNA, 23 nt, Pseudomonas aeruginosa PA01
cagccuacugggcguggcggccg

SEQ ID NO: 1448235 - RNA, 18 nt, Pseudomonas aeruginosa PA01
cagccguuggccagcagg

SEQ ID NO: 1448236 - RNA, 20 nt, Pseudomonas aeruginosa PA01
cagccguuggccagcaggcg

SEQ ID NO: 1448237 - RNA, 19 nt, Pseudomonas aeruginosa PA01
cagcgagcgggcgagggcg

SEQ ID NO: 1448238 - RNA, 20 nt, Pseudomonas aeruginosa PA01
cagcgagcgggcgagggcgg

SEQ ID NO: 1448239 - RNA, 22 nt, Pseudomonas aeruginosa PA01
cagcgagcgggcgagggcggcg

SEQ ID NO: 1448240 - RNA, 19 nt, Pseudomonas aeruginosa PA01
cagcgagccgaucaccagc

SEQ ID NO: 1448241 - RNA, 21 nt, Pseudomonas aeruginosa PA01
cagcgagccgaucaccagcaa

SEQ ID NO: 1448242 - RNA, 12 nt, Pseudomonas aeruginosa PA01
cagcgagcaggc

SEQ ID NO: 1448243 - RNA, 20 nt, Pseudomonas aeruginosa PA01
cagcgagagcuguccggcgc

SEQ ID NO: 1448244 - RNA, 16 nt, Pseudomonas aeruginosa PA01
cagcgagaggggcgcu

SEQ ID NO: 1448245 - RNA, 14 nt, Pseudomonas aeruginosa PA01
cagcgagacgggcg

SEQ ID NO: 1448246 - RNA, 15 nt, Pseudomonas aeruginosa PA01
cagcgagaacagcuc

SEQ ID NO: 1448247 - RNA, 18 nt, Pseudomonas aeruginosa PA01
cagcgagaacuugccggc

SEQ ID NO: 1448248 - RNA, 19 nt, Pseudomonas aeruginosa PA01
cagcgagaacuugccggcg

SEQ ID NO: 1448249 - RNA, 18 nt, Pseudomonas aeruginosa PA01
cagcgaccgucgaaccag

SEQ ID NO: 1448250 - RNA, 14 nt, Pseudomonas aeruginosa PA01
cagcgaacccaggc

SEQ ID NO: 1448251 - RNA, 20 nt, Pseudomonas aeruginosa PA01
cagcgaaauggucaccauga

SEQ ID NO: 1448252 - RNA, 17 nt, Pseudomonas aeruginosa PA01
cagcgaccaccaccagg

SEQ ID NO: 1448253 - RNA, 23 nt, Pseudomonas aeruginosa PA01
cagcgaaacucgugcuccaccuc

SEQ ID NO: 1448254 - RNA, 22 nt, Pseudomonas aeruginosa PA01
cagccuugcuggacuucccggc

SEQ ID NO: 1448255 - RNA, 22 nt, Pseudomonas aeruginosa PA01
cagccuuggcaugaccgagcau

SEQ ID NO: 1448256 - RNA, 17 nt, Pseudomonas aeruginosa PA01
caggaauccuccgccag

SEQ ID NO: 1448257 - RNA, 17 nt, Pseudomonas aeruginosa PA01
caggacacuuccaguuc

SEQ ID NO: 1448258 - RNA, 16 nt, Pseudomonas aeruginosa PA01
caggacaacgacagcc

SEQ ID NO: 1448259 - RNA, 20 nt, Pseudomonas aeruginosa PA01
caggacaacgacagccccgg

SEQ ID NO: 1448260 - RNA, 23 nt, Pseudomonas aeruginosa PA01
caggacaacgacagccccggccc

SEQ ID NO: 1448261 - RNA, 17 nt, Pseudomonas aeruginosa PA01
caggacagcgugcggcc

SEQ ID NO: 1448262 - RNA, 14 nt, Pseudomonas aeruginosa PA01
caggaaguggcgga

SEQ ID NO: 1448263 - RNA, 22 nt, Pseudomonas aeruginosa PA01
caggaaguucacguaggagccg

SEQ ID NO: 1448264 - RNA, 21 nt, Pseudomonas aeruginosa PA01
caggacucgccaucggccugg

SEQ ID NO: 1448265 - RNA, 21 nt, Pseudomonas aeruginosa PA01
caggaccaguucgccgccgcg

SEQ ID NO: 1448266 - RNA, 22 nt, Pseudomonas aeruginosa PA01
caggaccaguucgccgccgcgc

SEQ ID NO: 1448267 - RNA, 23 nt, Pseudomonas aeruginosa PA01
caggaccagacgcggauuggccg

SEQ ID NO: 1448268 - RNA, 13 nt, Pseudomonas aeruginosa PA01
caggaccagcgcc

SEQ ID NO: 1448269 - RNA, 15 nt, Pseudomonas aeruginosa PA01
caggaccagcgccug

SEQ ID NO: 1448270 - RNA, 17 nt, Pseudomonas aeruginosa PA01
caggaucuccucggcca

SEQ ID NO: 1448271 - RNA, 17 nt, Pseudomonas aeruginosa PA01
caggaugaccaggcuga

SEQ ID NO: 1448272 - RNA, 15 nt, Pseudomonas aeruginosa PA01
caggagcgccgcgca

SEQ ID NO: 1448273 - RNA, 20 nt, Pseudomonas aeruginosa PA01
caggagcgccgcgcagcgcg

SEQ ID NO: 1448274 - RNA, 23 nt, Pseudomonas aeruginosa PA01
caggagcgccgcgcagcgcggcg

SEQ ID NO: 1448275 - RNA, 15 nt, Pseudomonas aeruginosa PA01
caggaucgccgggcu

SEQ ID NO: 1448276 - RNA, 14 nt, Pseudomonas aeruginosa PA01
caggaucgucggcc

SEQ ID NO: 1448277 - RNA, 15 nt, Pseudomonas aeruginosa PA01
caggaucgucggccc

SEQ ID NO: 1448278 - RNA, 17 nt, Pseudomonas aeruginosa PA01
caggaucgucggcccgc

SEQ ID NO: 1448279 - RNA, 18 nt, Pseudomonas aeruginosa PA01
caggaucgucggcccgca

SEQ ID NO: 1448280 - RNA, 19 nt, Pseudomonas aeruginosa PA01
caggaucgucggcccgcau

SEQ ID NO: 1448281 - RNA, 18 nt, Pseudomonas aeruginosa PA01
caggaucggcgcccagca

SEQ ID NO: 1448282 - RNA, 13 nt, Pseudomonas aeruginosa PA01
caggagcgccagc

SEQ ID NO: 1448283 - RNA, 14 nt, Pseudomonas aeruginosa PA01
caggagcgccagca

SEQ ID NO: 1448284 - RNA, 16 nt, Pseudomonas aeruginosa PA01
caggagcgccagcacc

SEQ ID NO: 1448285 - RNA, 20 nt, Pseudomonas aeruginosa PA01
caggagcgccaucagcgacc

SEQ ID NO: 1448286 - RNA, 16 nt, Pseudomonas aeruginosa PA01
caggagcacgccgugc

SEQ ID NO: 1448287 - RNA, 17 nt, Pseudomonas aeruginosa PA01
caggagcagcuugcgcg

SEQ ID NO: 1448288 - RNA, 18 nt, Pseudomonas aeruginosa PA01
caggagcagcuugcgcga

SEQ ID NO: 1448289 - RNA, 20 nt, Pseudomonas aeruginosa PA01
caggagcagcuugcgcgagu

SEQ ID NO: 1448290 - RNA, 17 nt, Pseudomonas aeruginosa PA01
caggagcagggcgccga

SEQ ID NO: 1448291 - RNA, 18 nt, Pseudomonas aeruginosa PA01
caggagcagggcgccgau

SEQ ID NO: 1448292 - RNA, 19 nt, Pseudomonas aeruginosa PA01
caggagcagggcgccgauc

SEQ ID NO: 1448293 - RNA, 16 nt, Pseudomonas aeruginosa PA01
caggagcaucggcgcg

SEQ ID NO: 1448294 - RNA, 14 nt, Pseudomonas aeruginosa PA01
caggacugcccgcg

SEQ ID NO: 1448295 - RNA, 17 nt, Pseudomonas aeruginosa PA01
caggacguccuggccga

SEQ ID NO: 1448296 - RNA, 22 nt, Pseudomonas aeruginosa PA01
caggacgucgaggucgacggcg

SEQ ID NO: 1448297 - RNA, 17 nt, Pseudomonas aeruginosa PA01
caggaaaaaacgccggu

SEQ ID NO: 1448298 - RNA, 17 nt, Pseudomonas aeruginosa PA01
caggaaaccccucggcu

SEQ ID NO: 1448299 - RNA, 16 nt, Pseudomonas aeruginosa PA01
caggaaauccgccgcg

SEQ ID NO: 1448300 - RNA, 17 nt, Pseudomonas aeruginosa PA01
caggaaauccgccgcgc

SEQ ID NO: 1448301 - RNA, 21 nt, Pseudomonas aeruginosa PA01
cagcuugggauggccagccag

SEQ ID NO: 1448302 - RNA, 22 nt, Pseudomonas aeruginosa PA01
cagcuugggauggccagccagg

SEQ ID NO: 1448303 - RNA, 20 nt, Pseudomonas aeruginosa PA01
cagcuugguauccaccucgc

SEQ ID NO: 1448304 - RNA, 18 nt, Pseudomonas aeruginosa PA01
cagcuugguggugaucca

SEQ ID NO: 1448305 - RNA, 18 nt, Pseudomonas aeruginosa PA01
cagcuuggcggucagcga

SEQ ID NO: 1448306 - RNA, 22 nt, Pseudomonas aeruginosa PA01
cagcuuguaguagcgcccgacg

SEQ ID NO: 1448307 - RNA, 14 nt, Pseudomonas aeruginosa PA01
cagcuuguccacgc

SEQ ID NO: 1448308 - RNA, 17 nt, Pseudomonas aeruginosa PA01
cagcuuguccacgccau

SEQ ID NO: 1448309 - RNA, 23 nt, Pseudomonas aeruginosa PA01
cagcuugucgccuuccucggcga

SEQ ID NO: 1448310 - RNA, 17 nt, Pseudomonas aeruginosa PA01
caggaaccaggggucga

SEQ ID NO: 1448311 - RNA, 21 nt, Pseudomonas aeruginosa PA01
caggaacagguucggcaggcc

SEQ ID NO: 1448312 - RNA, 14 nt, Pseudomonas aeruginosa PA01
caggaagagcaggc

SEQ ID NO: 1448313 - RNA, 16 nt, Pseudomonas aeruginosa PA01
caggaagagcaggcgg

SEQ ID NO: 1448314 - RNA, 16 nt, Pseudomonas aeruginosa PA01
caggaacucgaucagc

SEQ ID NO: 1448315 - RNA, 22 nt, Pseudomonas aeruginosa PA01
caggaagccccagaagaucgcc

SEQ ID NO: 1448316 - RNA, 22 nt, Pseudomonas aeruginosa PA01
caggaagccgaccacucgcgag

SEQ ID NO: 1448317 - RNA, 16 nt, Pseudomonas aeruginosa PA01
caggaagccgcgcccc

SEQ ID NO: 1448318 - RNA, 13 nt, Pseudomonas aeruginosa PA01
caggaagcgccgg

SEQ ID NO: 1448319 - RNA, 14 nt, Pseudomonas aeruginosa PA01
caggaagcgccggg

SEQ ID NO: 1448320 - RNA, 15 nt, Pseudomonas aeruginosa PA01
caggaagcgccgggc

SEQ ID NO: 1448321 - RNA, 19 nt, Pseudomonas aeruginosa PA01
caggaagcgucgugcgccg

SEQ ID NO: 1448322 - RNA, 20 nt, Pseudomonas aeruginosa PA01
caggaagcgucgugcgccgg

SEQ ID NO: 1448323 - RNA, 21 nt, Pseudomonas aeruginosa PA01
caggaagcgucgugcgccggc

SEQ ID NO: 1448324 - RNA, 22 nt, Pseudomonas aeruginosa PA01
caggaagcgucgugcgccggcc

SEQ ID NO: 1448325 - RNA, 23 nt, Pseudomonas aeruginosa PA01
caggaagcgucgugcgccggccu

SEQ ID NO: 1448326 - RNA, 16 nt, Pseudomonas aeruginosa PA01
caggaagcucggcagc

SEQ ID NO: 1448327 - RNA, 21 nt, Pseudomonas aeruginosa PA01
caggaagcugacgaacaucgc

SEQ ID NO: 1448328 - RNA, 16 nt, Pseudomonas aeruginosa PA01
caggaaggcgucgccg

SEQ ID NO: 1448329 - RNA, 15 nt, Pseudomonas aeruginosa PA01
caggaaggccgggcc

SEQ ID NO: 1448330 - RNA, 14 nt, Pseudomonas aeruginosa PA01
caggaagcgcggga

SEQ ID NO: 1448331 - RNA, 18 nt, Pseudomonas aeruginosa PA01
caggcccucggcgaccaa

SEQ ID NO: 1448332 - RNA, 22 nt, Pseudomonas aeruginosa PA01
caggcccucggcgaccaacagg

SEQ ID NO: 1448333 - RNA, 18 nt, Pseudomonas aeruginosa PA01
caggcccuggaucaccgc

SEQ ID NO: 1448334 - RNA, 19 nt, Pseudomonas aeruginosa PA01
caggcccuggaucaccgcg

SEQ ID NO: 1448335 - RNA, 21 nt, Pseudomonas aeruginosa PA01
caggcccuggaucaccgcggc

SEQ ID NO: 1448336 - RNA, 22 nt, Pseudomonas aeruginosa PA01
caggcccuggaucaccgcggcg

SEQ ID NO: 1448337 - RNA, 23 nt, Pseudomonas aeruginosa PA01
caggcccuggaucaccgcggcgc

SEQ ID NO: 1448338 - RNA, 17 nt, Pseudomonas aeruginosa PA01
caggcccugggcggcgg

SEQ ID NO: 1448339 - RNA, 18 nt, Pseudomonas aeruginosa PA01
caggcccugggcggcggg

SEQ ID NO: 1448340 - RNA, 19 nt, Pseudomonas aeruginosa PA01
caggcccugggcggcgggc

SEQ ID NO: 1448341 - RNA, 15 nt, Pseudomonas aeruginosa PA01
caggcccggcgcugc

SEQ ID NO: 1448342 - RNA, 21 nt, Pseudomonas aeruginosa PA01
aaagcccgcacgaggcgggcu

SEQ ID NO: 1448343 - RNA, 14 nt, Pseudomonas aeruginosa PA01
aaagcccggccgcu

SEQ ID NO: 1448344 - RNA, 22 nt, Pseudomonas aeruginosa PA01
aaagccccgcgaacgcggggcu

SEQ ID NO: 1448345 - RNA, 22 nt, Pseudomonas aeruginosa PA01
aaagccccgcguucgcggggcu

SEQ ID NO: 1448346 - RNA, 13 nt, Pseudomonas aeruginosa PA01
aaagccccggcau

SEQ ID NO: 1448347 - RNA, 18 nt, Pseudomonas aeruginosa PA01
aaagcaguucgcccggcu

SEQ ID NO: 1448348 - RNA, 17 nt, Pseudomonas aeruginosa PA01
caggccagccaacugcu

SEQ ID NO: 1448349 - RNA, 23 nt, Pseudomonas aeruginosa PA01
caggccagccaacugcuucaggc

SEQ ID NO: 1448350 - RNA, 14 nt, Pseudomonas aeruginosa PA01
caggccagcgccag

SEQ ID NO: 1448351 - RNA, 13 nt, Pseudomonas aeruginosa PA01
caggccagcgcca

SEQ ID NO: 1448352 - RNA, 22 nt, Pseudomonas aeruginosa PA01
caggccaggccccagggccggc

SEQ ID NO: 1448353 - RNA, 13 nt, Pseudomonas aeruginosa PA01
caggccaggcgca

SEQ ID NO: 1448354 - RNA, 13 nt, Pseudomonas aeruginosa PA01
caggccagcgggc

SEQ ID NO: 1448355 - RNA, 22 nt, Pseudomonas aeruginosa PA01
caggccagcuuccaggcgcgcu

SEQ ID NO: 1448356 - RNA, 15 nt, Pseudomonas aeruginosa PA01
caggccagcucgccc

SEQ ID NO: 1448357 - RNA, 17 nt, Pseudomonas aeruginosa PA01
caggccagcucgcccgc

SEQ ID NO: 1448358 - RNA, 19 nt, Pseudomonas aeruginosa PA01
caggccagcucgcccgccu

SEQ ID NO: 1448359 - RNA, 14 nt, Pseudomonas aeruginosa PA01
caggccaggugguc

SEQ ID NO: 1448360 - RNA, 15 nt, Pseudomonas aeruginosa PA01
caggcaauggccggc

SEQ ID NO: 1448361 - RNA, 16 nt, Pseudomonas aeruginosa PA01
caggcaauggccggcg

SEQ ID NO: 1448362 - RNA, 17 nt, Pseudomonas aeruginosa PA01
caggcaauggccggcgg

SEQ ID NO: 1448363 - RNA, 13 nt, Pseudomonas aeruginosa PA01
caggcaccaccuc

SEQ ID NO: 1448364 - RNA, 15 nt, Pseudomonas aeruginosa PA01
caggcaccaccucgc

SEQ ID NO: 1448365 - RNA, 21 nt, Pseudomonas aeruginosa PA01
caggaugcccugcucuuccag

SEQ ID NO: 1448366 - RNA, 23 nt, Pseudomonas aeruginosa PA01
caggaugcccugcucuuccagcg

SEQ ID NO: 1448367 - RNA, 21 nt, Pseudomonas aeruginosa PA01
caggcaugaacgaaaacgccg

SEQ ID NO: 1448368 - RNA, 22 nt, Pseudomonas aeruginosa PA01
caggcaugaacgaaaacgccgc

SEQ ID NO: 1448369 - RNA, 19 nt, Pseudomonas aeruginosa PA01
caggcaccguaggccaggc

SEQ ID NO: 1448370 - RNA, 17 nt, Pseudomonas aeruginosa PA01
caggcaugcggccccgg

SEQ ID NO: 1448371 - RNA, 18 nt, Pseudomonas aeruginosa PA01
caggcaugcggccccggc

SEQ ID NO: 1448372 - RNA, 14 nt, Pseudomonas aeruginosa PA01
caggccaaccaccc

SEQ ID NO: 1448373 - RNA, 18 nt, Pseudomonas aeruginosa PA01
caggcauugccguccguc

SEQ ID NO: 1448374 - RNA, 18 nt, Pseudomonas aeruginosa PA01
caggcauuccgggcacgg

SEQ ID NO: 1448375 - RNA, 17 nt, Pseudomonas aeruginosa PA01
caggcauuccuccaggg

SEQ ID NO: 1448376 - RNA, 23 nt, Pseudomonas aeruginosa PA01
caggccacgcaccagcucccggc

SEQ ID NO: 1448377 - RNA, 15 nt, Pseudomonas aeruginosa PA01
caggccacggccgcu

SEQ ID NO: 1448378 - RNA, 18 nt, Pseudomonas aeruginosa PA01
caggccacggccgcugcg

SEQ ID NO: 1448379 - RNA, 15 nt, Pseudomonas aeruginosa PA01
caggccacggccggc

SEQ ID NO: 1448380 - RNA, 17 nt, Pseudomonas aeruginosa PA01
caggccacggccggcga

SEQ ID NO: 1448381 - RNA, 19 nt, Pseudomonas aeruginosa PA01
caggccacggccggcgagg

SEQ ID NO: 1448382 - RNA, 16 nt, Pseudomonas aeruginosa PA01
caggccggcguuggaa

SEQ ID NO: 1448383 - RNA, 20 nt, Pseudomonas aeruginosa PA01
caggccgggcggacgcuggg

SEQ ID NO: 1448384 - RNA, 14 nt, Pseudomonas aeruginosa PA01
caggccgggcggau

SEQ ID NO: 1448385 - RNA, 16 nt, Pseudomonas aeruginosa PA01
caggccgggcuggcca

SEQ ID NO: 1448386 - RNA, 21 nt, Pseudomonas aeruginosa PA01
caggccgggcuggccaccgcc

SEQ ID NO: 1448387 - RNA, 16 nt, Pseudomonas aeruginosa PA01
caggccggcggccgag

SEQ ID NO: 1448388 - RNA, 13 nt, Pseudomonas aeruginosa PA01
caggccggcggcc

SEQ ID NO: 1448389 - RNA, 22 nt, Pseudomonas aeruginosa PA01
caggccggcgcgauccuggcgg

SEQ ID NO: 1448390 - RNA, 24 nt, Pseudomonas aeruginosa PA01
caggccggcgcgauccuggcggca

SEQ ID NO: 1448391 - RNA, 13 nt, Pseudomonas aeruginosa PA01
caggccggcgccg

SEQ ID NO: 1448392 - RNA, 14 nt, Pseudomonas aeruginosa PA01
caggccggcgccga

SEQ ID NO: 1448393 - RNA, 16 nt, Pseudomonas aeruginosa PA01
caggccggcgccgaug

SEQ ID NO: 1448394 - RNA, 15 nt, Pseudomonas aeruginosa PA01
caggccggcgccgcc

SEQ ID NO: 1448395 - RNA, 14 nt, Pseudomonas aeruginosa PA01
caggccggugaucu

SEQ ID NO: 1448396 - RNA, 19 nt, Pseudomonas aeruginosa PA01
caggccggugaucucgcgg

SEQ ID NO: 1448397 - RNA, 22 nt, Pseudomonas aeruginosa PA01
caggccggugaucucgcggcgc

SEQ ID NO: 1448398 - RNA, 14 nt, Pseudomonas aeruginosa PA01
caggccggugccgc

SEQ ID NO: 1448399 - RNA, 16 nt, Pseudomonas aeruginosa PA01
caggccggugccgccg

SEQ ID NO: 1448400 - RNA, 17 nt, Pseudomonas aeruginosa PA01
caggccggugccgccgg

SEQ ID NO: 1448401 - RNA, 20 nt, Pseudomonas aeruginosa PA01
caggccggugccgccggcca

SEQ ID NO: 1448402 - RNA, 21 nt, Pseudomonas aeruginosa PA01
caggccggugccgccggccac

SEQ ID NO: 1448403 - RNA, 16 nt, Pseudomonas aeruginosa PA01
caggccguagaccacc

SEQ ID NO: 1448404 - RNA, 19 nt, Pseudomonas aeruginosa PA01
caggccguagaccaccagc

SEQ ID NO: 1448405 - RNA, 22 nt, Pseudomonas aeruginosa PA01
caggccguagaccaccagcagc

SEQ ID NO: 1448406 - RNA, 23 nt, Pseudomonas aeruginosa PA01
caggccguagaccaccagcagca

SEQ ID NO: 1448407 - RNA, 19 nt, Pseudomonas aeruginosa PA01
caggccguaggcgauggcc

SEQ ID NO: 1448408 - RNA, 17 nt, Pseudomonas aeruginosa PA01
caggccgauguccucga

SEQ ID NO: 1448409 - RNA, 19 nt, Pseudomonas aeruginosa PA01
caggccgauuuucugccgc

SEQ ID NO: 1448410 - RNA, 22 nt, Pseudomonas aeruginosa PA01
caggccgcaaguaccgccggca

SEQ ID NO: 1448411 - RNA, 17 nt, Pseudomonas aeruginosa PA01
caggccggccuccagcg

SEQ ID NO: 1448412 - RNA, 20 nt, Pseudomonas aeruginosa PA01
caggccggccuccagcgccu

SEQ ID NO: 1448413 - RNA, 13 nt, Pseudomonas aeruginosa PA01
caggccggcgagg

SEQ ID NO: 1448414 - RNA, 18 nt, Pseudomonas aeruginosa PA01
caggccggcgcaucgucg

SEQ ID NO: 1448415 - RNA, 17 nt, Pseudomonas aeruginosa PA01
caggccggcgagccagg

SEQ ID NO: 1448416 - RNA, 19 nt, Pseudomonas aeruginosa PA01
caggccggcgaccagcguc

SEQ ID NO: 1448417 - RNA, 14 nt, Pseudomonas aeruginosa PA01
caggccgaggagga

SEQ ID NO: 1448418 - RNA, 12 nt, Pseudomonas aeruginosa PA01
caggccgaggcg

SEQ ID NO: 1448419 - RNA, 13 nt, Pseudomonas aeruginosa PA01
caggccgaggcgc

SEQ ID NO: 1448420 - RNA, 12 nt, Pseudomonas aeruginosa PA01
caggccgagggc

SEQ ID NO: 1448421 - RNA, 21 nt, Pseudomonas aeruginosa PA01
caggccgaggucggcggcggg

SEQ ID NO: 1448422 - RNA, 16 nt, Pseudomonas aeruginosa PA01
caggccgagcgcgccg

SEQ ID NO: 1448423 - RNA, 19 nt, Pseudomonas aeruginosa PA01
caggccgagcgcgccgccg

SEQ ID NO: 1448424 - RNA, 20 nt, Pseudomonas aeruginosa PA01
caggccgagcgcgccgccga

SEQ ID NO: 1448425 - RNA, 14 nt, Pseudomonas aeruginosa PA01
caggccgagcagga

SEQ ID NO: 1448426 - RNA, 23 nt, Pseudomonas aeruginosa PA01
caggcccuugagggccucggcga

SEQ ID NO: 1448427 - RNA, 18 nt, Pseudomonas aeruginosa PA01
caggccgaucagcggcgg

SEQ ID NO: 1448428 - RNA, 13 nt, Pseudomonas aeruginosa PA01
caggccgaucagg

SEQ ID NO: 1448429 - RNA, 14 nt, Pseudomonas aeruginosa PA01
caggccgaucagga

SEQ ID NO: 1448430 - RNA, 17 nt, Pseudomonas aeruginosa PA01
caggccgaucaucauca

SEQ ID NO: 1448431 - RNA, 14 nt, Pseudomonas aeruginosa PA01
caggccgaucgccu

SEQ ID NO: 1448432 - RNA, 22 nt, Pseudomonas aeruginosa PA01
caggccgaucgccucguucagc

SEQ ID NO: 1448433 - RNA, 14 nt, Pseudomonas aeruginosa PA01
caggccgaucucgu

SEQ ID NO: 1448434 - RNA, 23 nt, Pseudomonas aeruginosa PA01
caggccgaucucgugggccagca

SEQ ID NO: 1448435 - RNA, 19 nt, Pseudomonas aeruginosa PA01
caggccgaugaacgccgcg

SEQ ID NO: 1448436 - RNA, 21 nt, Pseudomonas aeruginosa PA01
caggccgaugaacgccgcgaa

SEQ ID NO: 1448437 - RNA, 17 nt, Pseudomonas aeruginosa PA01
caggccgaugcgcaacg

SEQ ID NO: 1448438 - RNA, 16 nt, Pseudomonas aeruginosa PA01
caggccgauggccccg

SEQ ID NO: 1448439 - RNA, 20 nt, Pseudomonas aeruginosa PA01
caggccgauggccccggcga

SEQ ID NO: 1448440 - RNA, 21 nt, Pseudomonas aeruginosa PA01
caggccgaucaccaccagcgc

SEQ ID NO: 1448441 - RNA, 18 nt, Pseudomonas aeruginosa PA01
caggccgaucaccagcgc

SEQ ID NO: 1448442 - RNA, 21 nt, Pseudomonas aeruginosa PA01
caggccgaucaccagcgccag

SEQ ID NO: 1448443 - RNA, 22 nt, Pseudomonas aeruginosa PA01
caggccgaucaccagcgccagg

SEQ ID NO: 1448444 - RNA, 24 nt, Pseudomonas aeruginosa PA01
caggccgaucaccagcgccaggcc

SEQ ID NO: 1448445 - RNA, 15 nt, Pseudomonas aeruginosa PA01
caggcgaugaacggc

SEQ ID NO: 1448446 - RNA, 19 nt, Pseudomonas aeruginosa PA01
caggcgaugaacggcguca

SEQ ID NO: 1448447 - RNA, 22 nt, Pseudomonas aeruginosa PA01
caggcgaucgacgccucggcgc

SEQ ID NO: 1448448 - RNA, 13 nt, Pseudomonas aeruginosa PA01
caggcgaugauca

SEQ ID NO: 1448449 - RNA, 15 nt, Pseudomonas aeruginosa PA01
caggcgaugaucagc

SEQ ID NO: 1448450 - RNA, 16 nt, Pseudomonas aeruginosa PA01
caggcgaugaucagcc

SEQ ID NO: 1448451 - RNA, 21 nt, Pseudomonas aeruginosa PA01
caggcgaugcgccggaucggc

SEQ ID NO: 1448452 - RNA, 21 nt, Pseudomonas aeruginosa PA01
caggcgaaggucgaaggcgcg

SEQ ID NO: 1448453 - RNA, 16 nt, Pseudomonas aeruginosa PA01
caggcgauagccgacc

SEQ ID NO: 1448454 - RNA, 17 nt, Pseudomonas aeruginosa PA01
caggcgauagccgacca

SEQ ID NO: 1448455 - RNA, 20 nt, Pseudomonas aeruginosa PA01
caggcgauagccgaccaggc

SEQ ID NO: 1448456 - RNA, 19 nt, Pseudomonas aeruginosa PA01
caggcgauaucccgccgcc

SEQ ID NO: 1448457 - RNA, 18 nt, Pseudomonas aeruginosa PA01
caggcgauccacagcagg

SEQ ID NO: 1448458 - RNA, 15 nt, Pseudomonas aeruginosa PA01
caggcgacgccgcgc

SEQ ID NO: 1448459 - RNA, 17 nt, Pseudomonas aeruginosa PA01
caggcgacgccgcgcug

SEQ ID NO: 1448460 - RNA, 21 nt, Pseudomonas aeruginosa PA01
caggcgacgcugaugccggcg

SEQ ID NO: 1448461 - RNA, 18 nt, Pseudomonas aeruginosa PA01
caggcgacggucaggccg

SEQ ID NO: 1448462 - RNA, 21 nt, Pseudomonas aeruginosa PA01
caggcgacggucaggccgagc

SEQ ID NO: 1448463 - RNA, 15 nt, Pseudomonas aeruginosa PA01
caggccgucgagggc

SEQ ID NO: 1448464 - RNA, 19 nt, Pseudomonas aeruginosa PA01
caggccuggcccuggcgca

SEQ ID NO: 1448465 - RNA, 22 nt, Pseudomonas aeruginosa PA01
caggccugggcaagcugcacgg

SEQ ID NO: 1448466 - RNA, 20 nt, Pseudomonas aeruginosa PA01
caggccugggucaccagcac

SEQ ID NO: 1448467 - RNA, 21 nt, Pseudomonas aeruginosa PA01
caggccugggucaccagcacc

SEQ ID NO: 1448468 - RNA, 22 nt, Pseudomonas aeruginosa PA01
caggccugggucaccagcacca

SEQ ID NO: 1448469 - RNA, 17 nt, Pseudomonas aeruginosa PA01
caggccuugcagggccg

SEQ ID NO: 1448470 - RNA, 22 nt, Pseudomonas aeruginosa PA01
caggccuugcagggccgccagc

SEQ ID NO: 1448471 - RNA, 23 nt, Pseudomonas aeruginosa PA01
caggccuugcagggccgccagcc

SEQ ID NO: 1448472 - RNA, 20 nt, Pseudomonas aeruginosa PA01
caggccuugcgcggcgccgg

SEQ ID NO: 1448473 - RNA, 21 nt, Pseudomonas aeruginosa PA01
caggccuugcugaucagguug

SEQ ID NO: 1448474 - RNA, 21 nt, Pseudomonas aeruginosa PA01
caggccuuccagaacgccgcg

SEQ ID NO: 1448475 - RNA, 23 nt, Pseudomonas aeruginosa PA01
caggccuuccagaacgccgcgca

SEQ ID NO: 1448476 - RNA, 16 nt, Pseudomonas aeruginosa PA01
caggccuucccacucc

SEQ ID NO: 1448477 - RNA, 22 nt, Pseudomonas aeruginosa PA01
caggccuucgacgguucgcgaa

SEQ ID NO: 1448478 - RNA, 16 nt, Pseudomonas aeruginosa PA01
caggccuucggcgccg

SEQ ID NO: 1448479 - RNA, 17 nt, Pseudomonas aeruginosa PA01
caggccuucggcgccgg

SEQ ID NO: 1448480 - RNA, 17 nt, Pseudomonas aeruginosa PA01
caggcgaaagucggcgc

SEQ ID NO: 1448481 - RNA, 19 nt, Pseudomonas aeruginosa PA01
caggcgaaagucggcgcga

SEQ ID NO: 1448482 - RNA, 22 nt, Pseudomonas aeruginosa PA01
caggcgaaggcgaucccguaga

SEQ ID NO: 1448483 - RNA, 23 nt, Pseudomonas aeruginosa PA01
caggcgaagcggcuggccgcggu

SEQ ID NO: 1448484 - RNA, 17 nt, Pseudomonas aeruginosa PA01
caggcgaaccuggagaa

SEQ ID NO: 1448485 - RNA, 20 nt, Pseudomonas aeruginosa PA01
caggcgaacugccgacggcg

SEQ ID NO: 1448486 - RNA, 15 nt, Pseudomonas aeruginosa PA01
caggcuuuccaccgc

SEQ ID NO: 1448487 - RNA, 21 nt, Pseudomonas aeruginosa PA01
caggcuuuccaccgccagcac

SEQ ID NO: 1448488 - RNA, 17 nt, Pseudomonas aeruginosa PA01
caggcuuuccgccgagc

SEQ ID NO: 1448489 - RNA, 12 nt, Pseudomonas aeruginosa PA01
caggcuggcugg

SEQ ID NO: 1448490 - RNA, 21 nt, Pseudomonas aeruginosa PA01
cagggaaggcgcgcucagcgc

SEQ ID NO: 1448491 - RNA, 13 nt, Pseudomonas aeruginosa PA01
cagggaaucguca

SEQ ID NO: 1448492 - RNA, 19 nt, Pseudomonas aeruginosa PA01
cagggaaucgucacggcgu

SEQ ID NO: 1448493 - RNA, 18 nt, Pseudomonas aeruginosa PA01
cagggaauggaugcgcgg

SEQ ID NO: 1448494 - RNA, 21 nt, Pseudomonas aeruginosa PA01
cagggaauggaugcgcggcag

SEQ ID NO: 1448495 - RNA, 17 nt, Pseudomonas aeruginosa PA01
cagggacaccccgucuc

SEQ ID NO: 1448496 - RNA, 21 nt, Pseudomonas aeruginosa PA01
caggcuuucguaggcaggcgc

SEQ ID NO: 1448497 - RNA, 22 nt, Pseudomonas aeruginosa PA01
caggcuuucguaggcaggcgcg

SEQ ID NO: 1448498 - RNA, 11 nt, Pseudomonas aeruginosa PA01
caggcuggccu

SEQ ID NO: 1448499 - RNA, 23 nt, Pseudomonas aeruginosa PA01
caggcuggcguacuugggcauca

SEQ ID NO: 1448500 - RNA, 14 nt, Pseudomonas aeruginosa PA01
caggcuggcguuga

SEQ ID NO: 1448501 - RNA, 12 nt, Pseudomonas aeruginosa PA01
caggcuggcggc

SEQ ID NO: 1448502 - RNA, 16 nt, Pseudomonas aeruginosa PA01
caggcuggcggcaucg

SEQ ID NO: 1448503 - RNA, 21 nt, Pseudomonas aeruginosa PA01
caggcuggcggcaucggcgcc

SEQ ID NO: 1448504 - RNA, 15 nt, Pseudomonas aeruginosa PA01
caggcuggcggccag

SEQ ID NO: 1448505 - RNA, 16 nt, Pseudomonas aeruginosa PA01
caggcuggcggccagg

SEQ ID NO: 1448506 - RNA, 22 nt, Pseudomonas aeruginosa PA01
caggcuggcggccagggcaugg

SEQ ID NO: 1448507 - RNA, 18 nt, Pseudomonas aeruginosa PA01
caggcugcugcugcggcg

SEQ ID NO: 1448508 - RNA, 17 nt, Pseudomonas aeruginosa PA01
caggcugcugucgaggg

SEQ ID NO: 1448509 - RNA, 14 nt, Pseudomonas aeruginosa PA01
caggcugcggcgga

SEQ ID NO: 1448510 - RNA, 16 nt, Pseudomonas aeruginosa PA01
caggcugcggcggaag

SEQ ID NO: 1448511 - RNA, 22 nt, Pseudomonas aeruginosa PA01
caggcuggccaguugcgcuccg

SEQ ID NO: 1448512 - RNA, 13 nt, Pseudomonas aeruginosa PA01
caggcuggccccg

SEQ ID NO: 1448513 - RNA, 17 nt, Pseudomonas aeruginosa PA01
caggcuggccccgguga

SEQ ID NO: 1448514 - RNA, 16 nt, Pseudomonas aeruginosa PA01
caggcuggaggcuggg

SEQ ID NO: 1448515 - RNA, 15 nt, Pseudomonas aeruginosa PA01
caggcucaguucggc

SEQ ID NO: 1448516 - RNA, 17 nt, Pseudomonas aeruginosa PA01
caggcucaguucggcca

SEQ ID NO: 1448517 - RNA, 19 nt, Pseudomonas aeruginosa PA01
caggcucaguucggccagc

SEQ ID NO: 1448518 - RNA, 20 nt, Pseudomonas aeruginosa PA01
caggcucaguucggccagcg

SEQ ID NO: 1448519 - RNA, 22 nt, Pseudomonas aeruginosa PA01
caggcucaguucggccagcggc

SEQ ID NO: 1448520 - RNA, 20 nt, Pseudomonas aeruginosa PA01
caggcucgacaggucggcga

SEQ ID NO: 1448521 - RNA, 21 nt, Pseudomonas aeruginosa PA01
caggcucgagccgaacuccgg

SEQ ID NO: 1448522 - RNA, 18 nt, Pseudomonas aeruginosa PA01
caggcucgaggccgagcc

SEQ ID NO: 1448523 - RNA, 23 nt, Pseudomonas aeruginosa PA01
caggcucgaggccgagccggcau

SEQ ID NO: 1448524 - RNA, 22 nt, Pseudomonas aeruginosa PA01
caggcuccgacuggugggcacg

SEQ ID NO: 1448525 - RNA, 13 nt, Pseudomonas aeruginosa PA01
caggcucacgcau

SEQ ID NO: 1448526 - RNA, 23 nt, Pseudomonas aeruginosa PA01
caggcucacgcguucggcgaugc

SEQ ID NO: 1448527 - RNA, 13 nt, Pseudomonas aeruginosa PA01
caggcucagcgca

SEQ ID NO: 1448528 - RNA, 18 nt, Pseudomonas aeruginosa PA01
caggcucagcgcaugcgg

SEQ ID NO: 1448529 - RNA, 17 nt, Pseudomonas aeruginosa PA01
caggcucagcucggcga

SEQ ID NO: 1448530 - RNA, 16 nt, Pseudomonas aeruginosa PA01
caggcucaggccgggc

SEQ ID NO: 1448531 - RNA, 17 nt, Pseudomonas aeruginosa PA01
caggcucaggccgggca

SEQ ID NO: 1448532 - RNA, 22 nt, Pseudomonas aeruginosa PA01
caggcucaggccgggcaccccg

SEQ ID NO: 1448533 - RNA, 14 nt, Pseudomonas aeruginosa PA01
caggcucgccgcca

SEQ ID NO: 1448534 - RNA, 17 nt, Pseudomonas aeruginosa PA01
caggcucgccgccagca

SEQ ID NO: 1448535 - RNA, 20 nt, Pseudomonas aeruginosa PA01
caggcucgccgccagcagga

SEQ ID NO: 1448536 - RNA, 19 nt, Pseudomonas aeruginosa PA01
caggcucgccccggcggcg

SEQ ID NO: 1448537 - RNA, 21 nt, Pseudomonas aeruginosa PA01
caggcucgccccggcggcgau

SEQ ID NO: 1448538 - RNA, 21 nt, Pseudomonas aeruginosa PA01
caggcucgguucugcgcacca

SEQ ID NO: 1448539 - RNA, 23 nt, Pseudomonas aeruginosa PA01
caggcucggccuguaccgcuucc

SEQ ID NO: 1448540 - RNA, 18 nt, Pseudomonas aeruginosa PA01
caggcugcgcuugcugcc

SEQ ID NO: 1448541 - RNA, 22 nt, Pseudomonas aeruginosa PA01
caggcugcgcuugcugccaugg

SEQ ID NO: 1448542 - RNA, 15 nt, Pseudomonas aeruginosa PA01
caggcucuuggucgc

SEQ ID NO: 1448543 - RNA, 23 nt, Pseudomonas aeruginosa PA01
caggcucuuggucgcggucugga

SEQ ID NO: 1448544 - RNA, 18 nt, Pseudomonas aeruginosa PA01
caggcucuuugcgacuga

SEQ ID NO: 1448545 - RNA, 14 nt, Pseudomonas aeruginosa PA01
caggcucucgcgca

SEQ ID NO: 1448546 - RNA, 19 nt, Pseudomonas aeruginosa PA01
caggcucucgcgcagcagg

SEQ ID NO: 1448547 - RNA, 20 nt, Pseudomonas aeruginosa PA01
caggcucucgcgcagcagga

SEQ ID NO: 1448548 - RNA, 14 nt, Pseudomonas aeruginosa PA01
caggcgcgcggcca

SEQ ID NO: 1448549 - RNA, 14 nt, Pseudomonas aeruginosa PA01
caggcgcgccgugc

SEQ ID NO: 1448550 - RNA, 15 nt, Pseudomonas aeruginosa PA01
caggcgcgccgugcg

SEQ ID NO: 1448551 - RNA, 18 nt, Pseudomonas aeruginosa PA01
caggcgcgccgugcggcg

SEQ ID NO: 1448552 - RNA, 14 nt, Pseudomonas aeruginosa PA01
caggcgcgccugga

SEQ ID NO: 1448553 - RNA, 21 nt, Pseudomonas aeruginosa PA01
caggcgcgccuggcccuggcg

SEQ ID NO: 1448554 - RNA, 12 nt, Pseudomonas aeruginosa PA01
caggcgcggcau

SEQ ID NO: 1448555 - RNA, 14 nt, Pseudomonas aeruginosa PA01
caggcgcggcgucg

SEQ ID NO: 1448556 - RNA, 20 nt, Pseudomonas aeruginosa PA01
caggcgcgcucgggaucgcc

SEQ ID NO: 1448557 - RNA, 21 nt, Pseudomonas aeruginosa PA01
caggcgcgcucgggaucgccu

SEQ ID NO: 1448558 - RNA, 17 nt, Pseudomonas aeruginosa PA01
caggcgcgcggucuuca

SEQ ID NO: 1448559 - RNA, 20 nt, Pseudomonas aeruginosa PA01
caggcgcuccagacucucca

SEQ ID NO: 1448560 - RNA, 22 nt, Pseudomonas aeruginosa PA01
caggcgcuccuggugcggcacc

SEQ ID NO: 1448561 - RNA, 14 nt, Pseudomonas aeruginosa PA01
caggcgcucggcga

SEQ ID NO: 1448562 - RNA, 23 nt, Pseudomonas aeruginosa PA01
caggcgcucggcgaccuugcgca

SEQ ID NO: 1448563 - RNA, 16 nt, Pseudomonas aeruginosa PA01
caggcgcucggcggcg

SEQ ID NO: 1448564 - RNA, 19 nt, Pseudomonas aeruginosa PA01
caggcgcucggcggcgcgc

SEQ ID NO: 1448565 - RNA, 15 nt, Pseudomonas aeruginosa PA01
caggcgcucgcgggc

SEQ ID NO: 1448566 - RNA, 19 nt, Pseudomonas aeruginosa PA01
caggcgcucgcgggccgcc

SEQ ID NO: 1448567 - RNA, 22 nt, Pseudomonas aeruginosa PA01
caggcgcguugcuuccaggcac

SEQ ID NO: 1448568 - RNA, 14 nt, Pseudomonas aeruginosa PA01
caggcgcgggcugg

SEQ ID NO: 1448569 - RNA, 17 nt, Pseudomonas aeruginosa PA01
caggcgcgggcuggcca

SEQ ID NO: 1448570 - RNA, 20 nt, Pseudomonas aeruginosa PA01
caggcgcgggcuggccaccg

SEQ ID NO: 1448571 - RNA, 22 nt, Pseudomonas aeruginosa PA01
caggcgcgggucaucggcccga

SEQ ID NO: 1448572 - RNA, 16 nt, Pseudomonas aeruginosa PA01
caggcgcgggucuuca

SEQ ID NO: 1448573 - RNA, 11 nt, Pseudomonas aeruginosa PA01
caggcgcgguu

SEQ ID NO: 1448574 - RNA, 20 nt, Pseudomonas aeruginosa PA01
caggcgcgguugccgcugcg

SEQ ID NO: 1448575 - RNA, 21 nt, Pseudomonas aeruginosa PA01
caggcgcgguugccgcugcgg

SEQ ID NO: 1448576 - RNA, 17 nt, Pseudomonas aeruginosa PA01
caggcgcgucgcggccu

SEQ ID NO: 1448577 - RNA, 21 nt, Pseudomonas aeruginosa PA01
caggcgcucgucgaggaucug

SEQ ID NO: 1448578 - RNA, 15 nt, Pseudomonas aeruginosa PA01
caggcgcuggcgccg

SEQ ID NO: 1448579 - RNA, 16 nt, Pseudomonas aeruginosa PA01
caggcgcuggcgccga

SEQ ID NO: 1448580 - RNA, 17 nt, Pseudomonas aeruginosa PA01
caggcgcuggcgccgau

SEQ ID NO: 1448581 - RNA, 13 nt, Pseudomonas aeruginosa PA01
caggcgcuggcgg

SEQ ID NO: 1448582 - RNA, 17 nt, Pseudomonas aeruginosa PA01
caggcgcuggcgggcgc

SEQ ID NO: 1448583 - RNA, 14 nt, Pseudomonas aeruginosa PA01
caggcgcugcagcc

SEQ ID NO: 1448584 - RNA, 16 nt, Pseudomonas aeruginosa PA01
caggcgcugcgcggcc

SEQ ID NO: 1448585 - RNA, 13 nt, Pseudomonas aeruginosa PA01
caggcgcugcugg

SEQ ID NO: 1448586 - RNA, 17 nt, Pseudomonas aeruginosa PA01
caggcgcugcuggugga

SEQ ID NO: 1448587 - RNA, 13 nt, Pseudomonas aeruginosa PA01
caggcgcuggcga

SEQ ID NO: 1448588 - RNA, 15 nt, Pseudomonas aeruginosa PA01
caggcgcuggcgaau

SEQ ID NO: 1448589 - RNA, 17 nt, Pseudomonas aeruginosa PA01
caggcgcuuguccaucg

SEQ ID NO: 1448590 - RNA, 14 nt, Pseudomonas aeruginosa PA01
caggcgcuggugau

SEQ ID NO: 1448591 - RNA, 17 nt, Pseudomonas aeruginosa PA01
caggcgcugguccagca

SEQ ID NO: 1448592 - RNA, 20 nt, Pseudomonas aeruginosa PA01
caggcgcugguccagcacgc

SEQ ID NO: 1448593 - RNA, 17 nt, Pseudomonas aeruginosa PA01
caggcgugccuguuccu

SEQ ID NO: 1448594 - RNA, 15 nt, Pseudomonas aeruginosa PA01
caggcgugggccagc

SEQ ID NO: 1448595 - RNA, 18 nt, Pseudomonas aeruginosa PA01
caggcgugggccagccca

SEQ ID NO: 1448596 - RNA, 16 nt, Pseudomonas aeruginosa PA01
caggcguggggcgaau

SEQ ID NO: 1448597 - RNA, 22 nt, Pseudomonas aeruginosa PA01
caggcguuauccgccgccgacg

SEQ ID NO: 1448598 - RNA, 23 nt, Pseudomonas aeruginosa PA01
caggcguuauccgccgccgacgu

SEQ ID NO: 1448599 - RNA, 17 nt, Pseudomonas aeruginosa PA01
caggcguuccuuuuccu

SEQ ID NO: 1448600 - RNA, 23 nt, Pseudomonas aeruginosa PA01
caggcguuccuuuuccucgauca

SEQ ID NO: 1448601 - RNA, 22 nt, Pseudomonas aeruginosa PA01
caggcgucguuguugcgggcga

SEQ ID NO: 1448602 - RNA, 20 nt, Pseudomonas aeruginosa PA01
caggcguugcagugcgccgc

SEQ ID NO: 1448603 - RNA, 18 nt, Pseudomonas aeruginosa PA01
cagcuugccggcauagcc

SEQ ID NO: 1448604 - RNA, 15 nt, Pseudomonas aeruginosa PA01
cagcuugccuuccag

SEQ ID NO: 1448605 - RNA, 16 nt, Pseudomonas aeruginosa PA01
cagcuugcuggcguag

SEQ ID NO: 1448606 - RNA, 17 nt, Pseudomonas aeruginosa PA01
cagcuugcuggcguaga

SEQ ID NO: 1448607 - RNA, 15 nt, Pseudomonas aeruginosa PA01
cagcuuggcacggcc

SEQ ID NO: 1448608 - RNA, 16 nt, Pseudomonas aeruginosa PA01
cagcuuggccagcagg

SEQ ID NO: 1448609 - RNA, 16 nt, Pseudomonas aeruginosa PA01
cagcuugcgccagagc

SEQ ID NO: 1448610 - RNA, 20 nt, Pseudomonas aeruginosa PA01
cagcuucuucagcagcgggc

SEQ ID NO: 1448611 - RNA, 16 nt, Pseudomonas aeruginosa PA01
cagcuucuccagcagg

SEQ ID NO: 1448612 - RNA, 19 nt, Pseudomonas aeruginosa PA01
cagcuuccaggcgcgcugg

SEQ ID NO: 1448613 - RNA, 15 nt, Pseudomonas aeruginosa PA01
cagcuucgccgcccu

SEQ ID NO: 1448614 - RNA, 18 nt, Pseudomonas aeruginosa PA01
cagcuucgccgcccugga

SEQ ID NO: 1448615 - RNA, 14 nt, Pseudomonas aeruginosa PA01
cagcuucaggcgca

SEQ ID NO: 1448616 - RNA, 12 nt, Pseudomonas aeruginosa PA01
cagcugcggcgg

SEQ ID NO: 1448617 - RNA, 13 nt, Pseudomonas aeruginosa PA01
cagcugcggcggc

SEQ ID NO: 1448618 - RNA, 14 nt, Pseudomonas aeruginosa PA01
cagcugcggcggca

SEQ ID NO: 1448619 - RNA, 16 nt, Pseudomonas aeruginosa PA01
cagcugcggcggcacc

SEQ ID NO: 1448620 - RNA, 20 nt, Pseudomonas aeruginosa PA01
cagcugcggcggcaccacgu

SEQ ID NO: 1448621 - RNA, 15 nt, Pseudomonas aeruginosa PA01
cagcuggcgcgucgc

SEQ ID NO: 1448622 - RNA, 18 nt, Pseudomonas aeruginosa PA01
cagcuggcgcgucgcugc

SEQ ID NO: 1448623 - RNA, 22 nt, Pseudomonas aeruginosa PA01
cagcuggcgcguugugccgcca

SEQ ID NO: 1448624 - RNA, 16 nt, Pseudomonas aeruginosa PA01
cagcuggcgcagccgu

SEQ ID NO: 1448625 - RNA, 21 nt, Pseudomonas aeruginosa PA01
cagcuggauagaguacucggc

SEQ ID NO: 1448626 - RNA, 22 nt, Pseudomonas aeruginosa PA01
cagcuggauccgugccaggcgc

SEQ ID NO: 1448627 - RNA, 16 nt, Pseudomonas aeruginosa PA01
cagcucggucagcggc

SEQ ID NO: 1448628 - RNA, 13 nt, Pseudomonas aeruginosa PA01
cagcucggcggga

SEQ ID NO: 1448629 - RNA, 19 nt, Pseudomonas aeruginosa PA01
cagcucggcguagcgcugg

SEQ ID NO: 1448630 - RNA, 16 nt, Pseudomonas aeruginosa PA01
cagcucggcgaugccg

SEQ ID NO: 1448631 - RNA, 21 nt, Pseudomonas aeruginosa PA01
cagcucggcgaugccgccggg

SEQ ID NO: 1448632 - RNA, 20 nt, Pseudomonas aeruginosa PA01
cagcucggcgcccuggccgc

SEQ ID NO: 1448633 - RNA, 13 nt, Pseudomonas aeruginosa PA01
cagcucggccggc

SEQ ID NO: 1448634 - RNA, 24 nt, Pseudomonas aeruginosa PA01
cagcucggccggcaggcugugcca

SEQ ID NO: 1448635 - RNA, 20 nt, Pseudomonas aeruginosa PA01
cagcucgcugucgccgagca

SEQ ID NO: 1448636 - RNA, 20 nt, Pseudomonas aeruginosa PA01
cagcucggacaagggccaga

SEQ ID NO: 1448637 - RNA, 21 nt, Pseudomonas aeruginosa PA01
cagcucggcgacauagccggc

SEQ ID NO: 1448638 - RNA, 22 nt, Pseudomonas aeruginosa PA01
cagcucggcgacauagccggcg

SEQ ID NO: 1448639 - RNA, 14 nt, Pseudomonas aeruginosa PA01
cagcucggcgagga

SEQ ID NO: 1448640 - RNA, 14 nt, Pseudomonas aeruginosa PA01
cagcucggccgagg

SEQ ID NO: 1448641 - RNA, 23 nt, Pseudomonas aeruginosa PA01
cagcucggccgagggcagccuca

SEQ ID NO: 1448642 - RNA, 20 nt, Pseudomonas aeruginosa PA01
cagcucgcgcaaccagccgg

SEQ ID NO: 1448643 - RNA, 13 nt, Pseudomonas aeruginosa PA01
cagcucgccggcg

SEQ ID NO: 1448644 - RNA, 15 nt, Pseudomonas aeruginosa PA01
cagcucgcccgccuc

SEQ ID NO: 1448645 - RNA, 14 nt, Pseudomonas aeruginosa PA01
cagcucgccgcgcu

SEQ ID NO: 1448646 - RNA, 14 nt, Pseudomonas aeruginosa PA01
cagcucgaggccag

SEQ ID NO: 1448647 - RNA, 13 nt, Pseudomonas aeruginosa PA01
cagcucgaucagc

SEQ ID NO: 1448648 - RNA, 15 nt, Pseudomonas aeruginosa PA01
cagcucgaucagccc

SEQ ID NO: 1448649 - RNA, 17 nt, Pseudomonas aeruginosa PA01
cagcucgaucagcccgc

SEQ ID NO: 1448650 - RNA, 19 nt, Pseudomonas aeruginosa PA01
cagcucgaucucauggucg

SEQ ID NO: 1448651 - RNA, 22 nt, Pseudomonas aeruginosa PA01
cagcucgaucucauggucgggc

SEQ ID NO: 1448652 - RNA, 17 nt, Pseudomonas aeruginosa PA01
cagcucggccaucagcg

SEQ ID NO: 1448653 - RNA, 20 nt, Pseudomonas aeruginosa PA01
cagcucggccaucagcgcca

SEQ ID NO: 1448654 - RNA, 23 nt, Pseudomonas aeruginosa PA01
cagcucggccaucagcgccaggg

SEQ ID NO: 1448655 - RNA, 19 nt, Pseudomonas aeruginosa PA01
cagcucgcuaugcagcagg

SEQ ID NO: 1448656 - RNA, 23 nt, Pseudomonas aeruginosa PA01
cagcucgcuaugcagcagguagu

SEQ ID NO: 1448657 - RNA, 19 nt, Pseudomonas aeruginosa PA01
cagcucgcgggacagcuug

SEQ ID NO: 1448658 - RNA, 21 nt, Pseudomonas aeruginosa PA01
cagcucuaccgagaucaccuu

SEQ ID NO: 1448659 - RNA, 21 nt, Pseudomonas aeruginosa PA01
cagcucguuggccaccugcau

SEQ ID NO: 1448660 - RNA, 23 nt, Pseudomonas aeruginosa PA01
cagcucguuggccaccugcauca

SEQ ID NO: 1448661 - RNA, 14 nt, Pseudomonas aeruginosa PA01
cagcucguggcugg

SEQ ID NO: 1448662 - RNA, 23 nt, Pseudomonas aeruginosa PA01
cagcucguucgcccagaccugca

SEQ ID NO: 1448663 - RNA, 14 nt, Pseudomonas aeruginosa PA01
cagcucgucgugga

SEQ ID NO: 1448664 - RNA, 16 nt, Pseudomonas aeruginosa PA01
cagcucgucguggaag

SEQ ID NO: 1448665 - RNA, 14 nt, Pseudomonas aeruginosa PA01
cagcucguccaggc

SEQ ID NO: 1448666 - RNA, 20 nt, Pseudomonas aeruginosa PA01
cagcucgucgagcugcucgg

SEQ ID NO: 1448667 - RNA, 21 nt, Pseudomonas aeruginosa PA01
cagcucgucgagcugcucggc

SEQ ID NO: 1448668 - RNA, 14 nt, Pseudomonas aeruginosa PA01
cagcucgucgauga

SEQ ID NO: 1448669 - RNA, 19 nt, Pseudomonas aeruginosa PA01
cagcucgucgcccuucagg

SEQ ID NO: 1448670 - RNA, 22 nt, Pseudomonas aeruginosa PA01
cagcucgucgcccuucaggucg

SEQ ID NO: 1448671 - RNA, 20 nt, Pseudomonas aeruginosa PA01
cagcugcgagaacaggcgga

SEQ ID NO: 1448672 - RNA, 15 nt, Pseudomonas aeruginosa PA01
cagcugccagccccg

SEQ ID NO: 1448673 - RNA, 15 nt, Pseudomonas aeruginosa PA01
cagcugcaccgcgcg

SEQ ID NO: 1448674 - RNA, 18 nt, Pseudomonas aeruginosa PA01
cagcugcaccgcgcggau

SEQ ID NO: 1448675 - RNA, 19 nt, Pseudomonas aeruginosa PA01
cagcuccuggucgcggggc

SEQ ID NO: 1448676 - RNA, 23 nt, Pseudomonas aeruginosa PA01
cagcuccucggcguggcuacgga

SEQ ID NO: 1448677 - RNA, 16 nt, Pseudomonas aeruginosa PA01
cagcucgacagcgucg

SEQ ID NO: 1448678 - RNA, 17 nt, Pseudomonas aeruginosa PA01
cagcucgaagccgccgu

SEQ ID NO: 1448679 - RNA, 12 nt, Pseudomonas aeruginosa PA01
cagcucgaccuu

SEQ ID NO: 1448680 - RNA, 13 nt, Pseudomonas aeruginosa PA01
cagcucgaccuug

SEQ ID NO: 1448681 - RNA, 20 nt, Pseudomonas aeruginosa PA01
cagcucgaccuugcccuuga

SEQ ID NO: 1448682 - RNA, 19 nt, Pseudomonas aeruginosa PA01
cagcucgacccgcccgccg

SEQ ID NO: 1448683 - RNA, 23 nt, Pseudomonas aeruginosa PA01
cagcucgacccgcccgccguccu

SEQ ID NO: 1448684 - RNA, 18 nt, Pseudomonas aeruginosa PA01
cagcucccuugccgccgg

SEQ ID NO: 1448685 - RNA, 13 nt, Pseudomonas aeruginosa PA01
cagcuccgagcca

SEQ ID NO: 1448686 - RNA, 16 nt, Pseudomonas aeruginosa PA01
cagcuccggcagcagg

SEQ ID NO: 1448687 - RNA, 11 nt, Pseudomonas aeruginosa PA01
cagcuccggcg

SEQ ID NO: 1448688 - RNA, 17 nt, Pseudomonas aeruginosa PA01
cagcuccgggcuggcca

SEQ ID NO: 1448689 - RNA, 13 nt, Pseudomonas aeruginosa PA01
cagcuccggcggg

SEQ ID NO: 1448690 - RNA, 13 nt, Pseudomonas aeruginosa PA01
cagcuccuccagc

SEQ ID NO: 1448691 - RNA, 16 nt, Pseudomonas aeruginosa PA01
cagcuccuccagcagg

SEQ ID NO: 1448692 - RNA, 16 nt, Pseudomonas aeruginosa PA01
cagcuccuccagccgc

SEQ ID NO: 1448693 - RNA, 17 nt, Pseudomonas aeruginosa PA01
cagcuccgucuguucgg

SEQ ID NO: 1448694 - RNA, 19 nt, Pseudomonas aeruginosa PA01
cagcuccagcaccggcggc

SEQ ID NO: 1448695 - RNA, 22 nt, Pseudomonas aeruginosa PA01
cagcucccaggcgucgccgacu

SEQ ID NO: 1448696 - RNA, 13 nt, Pseudomonas aeruginosa PA01
cagcuccaccagg

SEQ ID NO: 1448697 - RNA, 14 nt, Pseudomonas aeruginosa PA01
cagcuccaccaggc

SEQ ID NO: 1448698 - RNA, 17 nt, Pseudomonas aeruginosa PA01
cagcuccacgucggccc

SEQ ID NO: 1448699 - RNA, 14 nt, Pseudomonas aeruginosa PA01
cagcuccaggccgc

SEQ ID NO: 1448700 - RNA, 19 nt, Pseudomonas aeruginosa PA01
cagcucagcuccaggccgc

SEQ ID NO: 1448701 - RNA, 19 nt, Pseudomonas aeruginosa PA01
cagcguuguccucggcggc

SEQ ID NO: 1448702 - RNA, 14 nt, Pseudomonas aeruginosa PA01
cagcguucggcgcu

SEQ ID NO: 1448703 - RNA, 16 nt, Pseudomonas aeruginosa PA01
cagcguucggcgcugg

SEQ ID NO: 1448704 - RNA, 20 nt, Pseudomonas aeruginosa PA01
cagcguuucgaagccgccgc

SEQ ID NO: 1448705 - RNA, 23 nt, Pseudomonas aeruginosa PA01
cagcguuucgaagccgccgccga

SEQ ID NO: 1448706 - RNA, 15 nt, Pseudomonas aeruginosa PA01
cagcucaccccagga

SEQ ID NO: 1448707 - RNA, 13 nt, Pseudomonas aeruginosa PA01
cagcuaccggcag

SEQ ID NO: 1448708 - RNA, 19 nt, Pseudomonas aeruginosa PA01
cagcgucugggugaccagc

SEQ ID NO: 1448709 - RNA, 20 nt, Pseudomonas aeruginosa PA01
cagcgucugggugaccagca

SEQ ID NO: 1448710 - RNA, 22 nt, Pseudomonas aeruginosa PA01
cagcgucugggugaccagcagg

SEQ ID NO: 1448711 - RNA, 16 nt, Pseudomonas aeruginosa PA01
cagcgucugcagcuug

SEQ ID NO: 1448712 - RNA, 19 nt, Pseudomonas aeruginosa PA01
cagcgucugccgcuggcgg

SEQ ID NO: 1448713 - RNA, 21 nt, Pseudomonas aeruginosa PA01
cagcgucucggcugccgccag

SEQ ID NO: 1448714 - RNA, 22 nt, Pseudomonas aeruginosa PA01
cagcgucucggcugccgccagc

SEQ ID NO: 1448715 - RNA, 24 nt, Pseudomonas aeruginosa PA01
cagcgucucggcugccgccagcuc

SEQ ID NO: 1448716 - RNA, 18 nt, Pseudomonas aeruginosa PA01
cagcgucgccaacgcgcc

SEQ ID NO: 1448717 - RNA, 20 nt, Pseudomonas aeruginosa PA01
cagcgucgccaacgcgccgu

SEQ ID NO: 1448718 - RNA, 18 nt, Pseudomonas aeruginosa PA01
cagcgugaagaccugguc

SEQ ID NO: 1448719 - RNA, 19 nt, Pseudomonas aeruginosa PA01
cagcgugaagaccuggucc

SEQ ID NO: 1448720 - RNA, 13 nt, Pseudomonas aeruginosa PA01
cagcguuccagcg

SEQ ID NO: 1448721 - RNA, 14 nt, Pseudomonas aeruginosa PA01
cagcguuccagcgc

SEQ ID NO: 1448722 - RNA, 15 nt, Pseudomonas aeruginosa PA01
cagcguuccagcgcu

SEQ ID NO: 1448723 - RNA, 16 nt, Pseudomonas aeruginosa PA01
cagcguuccagcgcug

SEQ ID NO: 1448724 - RNA, 17 nt, Pseudomonas aeruginosa PA01
cagcguuccagcgcugg

SEQ ID NO: 1448725 - RNA, 14 nt, Pseudomonas aeruginosa PA01
cagcgccggcggcg

SEQ ID NO: 1448726 - RNA, 16 nt, Pseudomonas aeruginosa PA01
cagcgccggcggcgcg

SEQ ID NO: 1448727 - RNA, 20 nt, Pseudomonas aeruginosa PA01
cagcgccggcggcgcgucca

SEQ ID NO: 1448728 - RNA, 17 nt, Pseudomonas aeruginosa PA01
cagcgccguucacgccu

SEQ ID NO: 1448729 - RNA, 22 nt, Pseudomonas aeruginosa PA01
cagcgccguucacgccuggcgg

SEQ ID NO: 1448730 - RNA, 14 nt, Pseudomonas aeruginosa PA01
cagcgccgggucga

SEQ ID NO: 1448731 - RNA, 17 nt, Pseudomonas aeruginosa PA01
cagcgccgggucgaccu

SEQ ID NO: 1448732 - RNA, 21 nt, Pseudomonas aeruginosa PA01
cagcgccgguagcggcgcacc

SEQ ID NO: 1448733 - RNA, 24 nt, Pseudomonas aeruginosa PA01
cagcgccgguucguugaccgucca

SEQ ID NO: 1448734 - RNA, 19 nt, Pseudomonas aeruginosa PA01
cagcgccguacgcaccgcg

SEQ ID NO: 1448735 - RNA, 20 nt, Pseudomonas aeruginosa PA01
cagcgccguacgcaccgcgu

SEQ ID NO: 1448736 - RNA, 23 nt, Pseudomonas aeruginosa PA01
cagcgccgucaccagcagccccg

SEQ ID NO: 1448737 - RNA, 22 nt, Pseudomonas aeruginosa PA01
cagcgccgcucggcgagccgcc

SEQ ID NO: 1448738 - RNA, 22 nt, Pseudomonas aeruginosa PA01
cagcgccgcuucuucccgccca

SEQ ID NO: 1448739 - RNA, 13 nt, Pseudomonas aeruginosa PA01
cagcgccgcgcug

SEQ ID NO: 1448740 - RNA, 17 nt, Pseudomonas aeruginosa PA01
cagcgccgcggcgacca

SEQ ID NO: 1448741 - RNA, 14 nt, Pseudomonas aeruginosa PA01
cagcgccgcggcug

SEQ ID NO: 1448742 - RNA, 15 nt, Pseudomonas aeruginosa PA01
cagcgccgcggcugg

SEQ ID NO: 1448743 - RNA, 17 nt, Pseudomonas aeruginosa PA01
cagcgccgcggcuggcc

SEQ ID NO: 1448744 - RNA, 14 nt, Pseudomonas aeruginosa PA01
cagcgccgcggugu

SEQ ID NO: 1448745 - RNA, 19 nt, Pseudomonas aeruginosa PA01
cagcggcgugaagccgccg

SEQ ID NO: 1448746 - RNA, 13 nt, Pseudomonas aeruginosa PA01
cagcggcuccggg

SEQ ID NO: 1448747 - RNA, 20 nt, Pseudomonas aeruginosa PA01
cagcggcuccucggccuggg

SEQ ID NO: 1448748 - RNA, 23 nt, Pseudomonas aeruginosa PA01
cagcggcuccuggaugcuccgcg

SEQ ID NO: 1448749 - RNA, 13 nt, Pseudomonas aeruginosa PA01
cagcgccuccagc

SEQ ID NO: 1448750 - RNA, 16 nt, Pseudomonas aeruginosa PA01
cagcgccuccagcguc

SEQ ID NO: 1448751 - RNA, 22 nt, Pseudomonas aeruginosa PA01
cagcgccuccagcgucugccgc

SEQ ID NO: 1448752 - RNA, 15 nt, Pseudomonas aeruginosa PA01
cagcgccucccgggc

SEQ ID NO: 1448753 - RNA, 22 nt, Pseudomonas aeruginosa PA01
cagcgccucccgggccucucga

SEQ ID NO: 1448754 - RNA, 18 nt, Pseudomonas aeruginosa PA01
cagcggcggugcgccggc

SEQ ID NO: 1448755 - RNA, 19 nt, Pseudomonas aeruginosa PA01
cagcggcggugcgccggcg

SEQ ID NO: 1448756 - RNA, 21 nt, Pseudomonas aeruginosa PA01
cagcggcgguagcuccaggcc

SEQ ID NO: 1448757 - RNA, 14 nt, Pseudomonas aeruginosa PA01
cagcggcggggcca

SEQ ID NO: 1448758 - RNA, 13 nt, Pseudomonas aeruginosa PA01
cagcgucaccgcg

SEQ ID NO: 1448759 - RNA, 23 nt, Pseudomonas aeruginosa PA01
cagcguccucagccucacccugc

SEQ ID NO: 1448760 - RNA, 21 nt, Pseudomonas aeruginosa PA01
cagcguccugcccuccugcuc

SEQ ID NO: 1448761 - RNA, 17 nt, Pseudomonas aeruginosa PA01
cagcguccuucggcgcu

SEQ ID NO: 1448762 - RNA, 16 nt, Pseudomonas aeruginosa PA01
cagcgucgacgccgag

SEQ ID NO: 1448763 - RNA, 18 nt, Pseudomonas aeruginosa PA01
cagcgucgacgccgagcu

SEQ ID NO: 1448764 - RNA, 17 nt, Pseudomonas aeruginosa PA01
cagcgucgagcuggcgc

SEQ ID NO: 1448765 - RNA, 16 nt, Pseudomonas aeruginosa PA01
cagcguccgaacgcgc

SEQ ID NO: 1448766 - RNA, 19 nt, Pseudomonas aeruginosa PA01
cagcguccgaacgcgcuga

SEQ ID NO: 1448767 - RNA, 20 nt, Pseudomonas aeruginosa PA01
cagcggcucacgccccagcg

SEQ ID NO: 1448768 - RNA, 23 nt, Pseudomonas aeruginosa PA01
cagcggcucacgccccagcgcau

SEQ ID NO: 1448769 - RNA, 14 nt, Pseudomonas aeruginosa PA01
cagcgggucgauca

SEQ ID NO: 1448770 - RNA, 20 nt, Pseudomonas aeruginosa PA01
cagcgggucgaucaggcgca

SEQ ID NO: 1448771 - RNA, 18 nt, Pseudomonas aeruginosa PA01
cagcggguagcugcuggg

SEQ ID NO: 1448772 - RNA, 16 nt, Pseudomonas aeruginosa PA01
cagcgggguggcgcgg

SEQ ID NO: 1448773 - RNA, 13 nt, Pseudomonas aeruginosa PA01
cauccaccagcgg

SEQ ID NO: 1448774 - RNA, 14 nt, Pseudomonas aeruginosa PA01
cauccacaggcggc

SEQ ID NO: 1448775 - RNA, 14 nt, Pseudomonas aeruginosa PA01
cauccagcaccgcu

SEQ ID NO: 1448776 - RNA, 23 nt, Pseudomonas aeruginosa PA01
cauccagcaccgcuuucaccagg

SEQ ID NO: 1448777 - RNA, 13 nt, Pseudomonas aeruginosa PA01
cauccgccgcugg

SEQ ID NO: 1448778 - RNA, 15 nt, Pseudomonas aeruginosa PA01
cauccgccgcugggg

SEQ ID NO: 1448779 - RNA, 13 nt, Pseudomonas aeruginosa PA01
cauccgccggcgc

SEQ ID NO: 1448780 - RNA, 15 nt, Pseudomonas aeruginosa PA01
cauccgccggcgcgu

SEQ ID NO: 1448781 - RNA, 14 nt, Pseudomonas aeruginosa PA01
cauccgcccugcgg

SEQ ID NO: 1448782 - RNA, 22 nt, Pseudomonas aeruginosa PA01
cauccccuuuuuuugcgcgcca

SEQ ID NO: 1448783 - RNA, 22 nt, Pseudomonas aeruginosa PA01
cauccccgccucgaccagcgcc

SEQ ID NO: 1448784 - RNA, 15 nt, Pseudomonas aeruginosa PA01
cauccagccugcgcu

SEQ ID NO: 1448785 - RNA, 17 nt, Pseudomonas aeruginosa PA01
cauccagccugcgcugu

SEQ ID NO: 1448786 - RNA, 19 nt, Pseudomonas aeruginosa PA01
caucauguagacgaugccg

SEQ ID NO: 1448787 - RNA, 16 nt, Pseudomonas aeruginosa PA01
caucaccggcagcagc

SEQ ID NO: 1448788 - RNA, 19 nt, Pseudomonas aeruginosa PA01
caucaccgcgguuggcgcc

SEQ ID NO: 1448789 - RNA, 14 nt, Pseudomonas aeruginosa PA01
caucaccgccauca

SEQ ID NO: 1448790 - RNA, 19 nt, Pseudomonas aeruginosa PA01
caucaccgccaucagcacg

SEQ ID NO: 1448791 - RNA, 14 nt, Pseudomonas aeruginosa PA01
caucaguugcgcgc

SEQ ID NO: 1448792 - RNA, 18 nt, Pseudomonas aeruginosa PA01
caucaguugcgcgcgggu

SEQ ID NO: 1448793 - RNA, 14 nt, Pseudomonas aeruginosa PA01
caucaguuccucgc

SEQ ID NO: 1448794 - RNA, 22 nt, Pseudomonas aeruginosa PA01
caucaccgacagucccaggcca

SEQ ID NO: 1448795 - RNA, 14 nt, Pseudomonas aeruginosa PA01
caucaccccgcaac

SEQ ID NO: 1448796 - RNA, 18 nt, Pseudomonas aeruginosa PA01
caucaccccgcaaccgca

SEQ ID NO: 1448797 - RNA, 19 nt, Pseudomonas aeruginosa PA01
caucaccccgcaaccgcag

SEQ ID NO: 1448798 - RNA, 15 nt, Pseudomonas aeruginosa PA01
caucaccaggucgcu

SEQ ID NO: 1448799 - RNA, 20 nt, Pseudomonas aeruginosa PA01
caucaccaggcugccgccgu

SEQ ID NO: 1448800 - RNA, 16 nt, Pseudomonas aeruginosa PA01
cauccugaaaagcgcu

SEQ ID NO: 1448801 - RNA, 17 nt, Pseudomonas aeruginosa PA01
cauccucguuccacggg

SEQ ID NO: 1448802 - RNA, 22 nt, Pseudomonas aeruginosa PA01
cauccucguuccacgggucgca

SEQ ID NO: 1448803 - RNA, 22 nt, Pseudomonas aeruginosa PA01
cauccgcugguagcccaggccg

SEQ ID NO: 1448804 - RNA, 20 nt, Pseudomonas aeruginosa PA01
cauccggaguucgcccgccc

SEQ ID NO: 1448805 - RNA, 17 nt, Pseudomonas aeruginosa PA01
cauccucgccccgccgg

SEQ ID NO: 1448806 - RNA, 12 nt, Pseudomonas aeruginosa PA01
cauccucgccgg

SEQ ID NO: 1448807 - RNA, 15 nt, Pseudomonas aeruginosa PA01
cauccgcgccgacca

SEQ ID NO: 1448808 - RNA, 20 nt, Pseudomonas aeruginosa PA01
cauccgccgcagaccagcga

SEQ ID NO: 1448809 - RNA, 12 nt, Pseudomonas aeruginosa PA01
cauccgcggccc

SEQ ID NO: 1448810 - RNA, 21 nt, Pseudomonas aeruginosa PA01
cauccgcguggcgaugcccug

SEQ ID NO: 1448811 - RNA, 14 nt, Pseudomonas aeruginosa PA01
cauccugucgaggc

SEQ ID NO: 1448812 - RNA, 15 nt, Pseudomonas aeruginosa PA01
cauccugucgaggcc

SEQ ID NO: 1448813 - RNA, 20 nt, Pseudomonas aeruginosa PA01
caucgaaaugccgcacccca

SEQ ID NO: 1448814 - RNA, 13 nt, Pseudomonas aeruginosa PA01
caucgacaccccg

SEQ ID NO: 1448815 - RNA, 18 nt, Pseudomonas aeruginosa PA01
caucgacagggucgucug

SEQ ID NO: 1448816 - RNA, 12 nt, Pseudomonas aeruginosa PA01
caucgaccagca

SEQ ID NO: 1448817 - RNA, 14 nt, Pseudomonas aeruginosa PA01
caucgaccagcagc

SEQ ID NO: 1448818 - RNA, 15 nt, Pseudomonas aeruginosa PA01
caucgaccagcagcg

SEQ ID NO: 1448819 - RNA, 17 nt, Pseudomonas aeruginosa PA01
caucgaccagcagcggc

SEQ ID NO: 1448820 - RNA, 14 nt, Pseudomonas aeruginosa PA01
caucgagcgcucca

SEQ ID NO: 1448821 - RNA, 18 nt, Pseudomonas aeruginosa PA01
caucgagcggcggccguc

SEQ ID NO: 1448822 - RNA, 22 nt, Pseudomonas aeruginosa PA01
caucgagcggcggccgucgcug

SEQ ID NO: 1448823 - RNA, 16 nt, Pseudomonas aeruginosa PA01
caucgaaggcgccggc

SEQ ID NO: 1448824 - RNA, 18 nt, Pseudomonas aeruginosa PA01
caucgaccagggccgggu

SEQ ID NO: 1448825 - RNA, 20 nt, Pseudomonas aeruginosa PA01
caucgaccagggccgggucg

SEQ ID NO: 1448826 - RNA, 23 nt, Pseudomonas aeruginosa PA01
caucgaccaggucgccaugcccg

SEQ ID NO: 1448827 - RNA, 17 nt, Pseudomonas aeruginosa PA01
caucgaccaugccguag

SEQ ID NO: 1448828 - RNA, 15 nt, Pseudomonas aeruginosa PA01
caucgaggugcuuga

SEQ ID NO: 1448829 - RNA, 16 nt, Pseudomonas aeruginosa PA01
caucgaggccaggccg

SEQ ID NO: 1448830 - RNA, 19 nt, Pseudomonas aeruginosa PA01
caucgaggccaggccgagc

SEQ ID NO: 1448831 - RNA, 21 nt, Pseudomonas aeruginosa PA01
caucgaggccaggccgagcgc

SEQ ID NO: 1448832 - RNA, 21 nt, Pseudomonas aeruginosa PA01
caucgaggccauccccgaggc

SEQ ID NO: 1448833 - RNA, 14 nt, Pseudomonas aeruginosa PA01
caucgaggccgccc

SEQ ID NO: 1448834 - RNA, 15 nt, Pseudomonas aeruginosa PA01
caucgaggccgccca

SEQ ID NO: 1448835 - RNA, 17 nt, Pseudomonas aeruginosa PA01
caucgaggccgcccagc

SEQ ID NO: 1448836 - RNA, 14 nt, Pseudomonas aeruginosa PA01
caucgaggccggca

SEQ ID NO: 1448837 - RNA, 17 nt, Pseudomonas aeruginosa PA01
caucgaggccggcaugc

SEQ ID NO: 1448838 - RNA, 18 nt, Pseudomonas aeruginosa PA01
caucgaucagcagcgcca

SEQ ID NO: 1448839 - RNA, 12 nt, Pseudomonas aeruginosa PA01
caucgauccgca

SEQ ID NO: 1448840 - RNA, 22 nt, Pseudomonas aeruginosa PA01
caucgauccgcacccgggcaac

SEQ ID NO: 1448841 - RNA, 19 nt, Pseudomonas aeruginosa PA01
caucgauggucacuggcga

SEQ ID NO: 1448842 - RNA, 17 nt, Pseudomonas aeruginosa PA01
caucgcaggcagcgcgc

SEQ ID NO: 1448843 - RNA, 12 nt, Pseudomonas aeruginosa PA01
caucgcaucggu

SEQ ID NO: 1448844 - RNA, 13 nt, Pseudomonas aeruginosa PA01
caucgcccggcgc

SEQ ID NO: 1448845 - RNA, 23 nt, Pseudomonas aeruginosa PA01
caucgcccgcagccacaggcgcc

SEQ ID NO: 1448846 - RNA, 12 nt, Pseudomonas aeruginosa PA01
caucgcccauga

SEQ ID NO: 1448847 - RNA, 13 nt, Pseudomonas aeruginosa PA01
caucgccaccagc

SEQ ID NO: 1448848 - RNA, 16 nt, Pseudomonas aeruginosa PA01
caucgccaccagcagg

SEQ ID NO: 1448849 - RNA, 12 nt, Pseudomonas aeruginosa PA01
cauacagcgccc

SEQ ID NO: 1448850 - RNA, 13 nt, Pseudomonas aeruginosa PA01
cauacaggcgcgc

SEQ ID NO: 1448851 - RNA, 18 nt, Pseudomonas aeruginosa PA01
caguuuucuaaccggcgu

SEQ ID NO: 1448852 - RNA, 18 nt, Pseudomonas aeruginosa PA01
caguuggugcacgcgccg

SEQ ID NO: 1448853 - RNA, 14 nt, Pseudomonas aeruginosa PA01
caguuguuccgggu

SEQ ID NO: 1448854 - RNA, 16 nt, Pseudomonas aeruginosa PA01
caguuggacugcgagg

SEQ ID NO: 1448855 - RNA, 17 nt, Pseudomonas aeruginosa PA01
caguuggacugcgaggc

SEQ ID NO: 1448856 - RNA, 12 nt, Pseudomonas aeruginosa PA01
caguugcucgcu

SEQ ID NO: 1448857 - RNA, 17 nt, Pseudomonas aeruginosa PA01
caguugcucgcuccgag

SEQ ID NO: 1448858 - RNA, 15 nt, Pseudomonas aeruginosa PA01
caguugcccggccug

SEQ ID NO: 1448859 - RNA, 17 nt, Pseudomonas aeruginosa PA01
caguugccgcagcagcg

SEQ ID NO: 1448860 - RNA, 14 nt, Pseudomonas aeruginosa PA01
caguugccaggagg

SEQ ID NO: 1448861 - RNA, 18 nt, Pseudomonas aeruginosa PA01
caguugcaggguggcgac

SEQ ID NO: 1448862 - RNA, 23 nt, Pseudomonas aeruginosa PA01
caguugcaguaccugcucacggc

SEQ ID NO: 1448863 - RNA, 22 nt, Pseudomonas aeruginosa PA01
caguugcagcacccccagcagg

SEQ ID NO: 1448864 - RNA, 14 nt, Pseudomonas aeruginosa PA01
caguugcgccgccu

SEQ ID NO: 1448865 - RNA, 19 nt, Pseudomonas aeruginosa PA01
caguugcgccgccugcggc

SEQ ID NO: 1448866 - RNA, 15 nt, Pseudomonas aeruginosa PA01
caguugcgcgccggc

SEQ ID NO: 1448867 - RNA, 14 nt, Pseudomonas aeruginosa PA01
caguugcgcggcga

SEQ ID NO: 1448868 - RNA, 15 nt, Pseudomonas aeruginosa PA01
caguugcgcggcgag

SEQ ID NO: 1448869 - RNA, 18 nt, Pseudomonas aeruginosa PA01
caguugccucugugcggu

SEQ ID NO: 1448870 - RNA, 21 nt, Pseudomonas aeruginosa PA01
cauagugcugggcgaccuuca

SEQ ID NO: 1448871 - RNA, 15 nt, Pseudomonas aeruginosa PA01
cauaggcggcgcaga

SEQ ID NO: 1448872 - RNA, 21 nt, Pseudomonas aeruginosa PA01
cauaggucaugcccaggccga

SEQ ID NO: 1448873 - RNA, 20 nt, Pseudomonas aeruginosa PA01
cauaguagagaugcaccggc

SEQ ID NO: 1448874 - RNA, 19 nt, Pseudomonas aeruginosa PA01
cauagcgagccgcgcugcu

SEQ ID NO: 1448875 - RNA, 14 nt, Pseudomonas aeruginosa PA01
cauagcgcagccgc

SEQ ID NO: 1448876 - RNA, 15 nt, Pseudomonas aeruginosa PA01
cauagcgccggcacc

SEQ ID NO: 1448877 - RNA, 23 nt, Pseudomonas aeruginosa PA01
cauagcgcgcuguagccggcgcc

SEQ ID NO: 1448878 - RNA, 21 nt, Pseudomonas aeruginosa PA01
cauaccgacaugccccgccga

SEQ ID NO: 1448879 - RNA, 14 nt, Pseudomonas aeruginosa PA01
cauagcggccauug

SEQ ID NO: 1448880 - RNA, 16 nt, Pseudomonas aeruginosa PA01
cauagcggcugcuguc

SEQ ID NO: 1448881 - RNA, 13 nt, Pseudomonas aeruginosa PA01
cauagcucagcug

SEQ ID NO: 1448882 - RNA, 18 nt, Pseudomonas aeruginosa PA01
cauaggcccggcgugccg

SEQ ID NO: 1448883 - RNA, 20 nt, Pseudomonas aeruginosa PA01
caucaacccaccgaccacca

SEQ ID NO: 1448884 - RNA, 17 nt, Pseudomonas aeruginosa PA01
cagggacgcgccggcgg

SEQ ID NO: 1448885 - RNA, 14 nt, Pseudomonas aeruginosa PA01
cagggacgcggcgu

SEQ ID NO: 1448886 - RNA, 23 nt, Pseudomonas aeruginosa PA01
cagggcauuggccaucagcgccg

SEQ ID NO: 1448887 - RNA, 20 nt, Pseudomonas aeruginosa PA01
cagggaggcgcacaucaccc

SEQ ID NO: 1448888 - RNA, 21 nt, Pseudomonas aeruginosa PA01
cagggaggcgcuggccagcgc

SEQ ID NO: 1448889 - RNA, 14 nt, Pseudomonas aeruginosa PA01
cagggccagcaaca

SEQ ID NO: 1448890 - RNA, 13 nt, Pseudomonas aeruginosa PA01
cagggccagcggg

SEQ ID NO: 1448891 - RNA, 19 nt, Pseudomonas aeruginosa PA01
cagggccagcggguugauc

SEQ ID NO: 1448892 - RNA, 23 nt, Pseudomonas aeruginosa PA01
cagggccaggaugaccaggcuga

SEQ ID NO: 1448893 - RNA, 15 nt, Pseudomonas aeruginosa PA01
cagggccagcagcgg

SEQ ID NO: 1448894 - RNA, 15 nt, Pseudomonas aeruginosa PA01
cagggccaggccgag

SEQ ID NO: 1448895 - RNA, 16 nt, Pseudomonas aeruginosa PA01
cagggccaggccgagc

SEQ ID NO: 1448896 - RNA, 18 nt, Pseudomonas aeruginosa PA01
cagggccaggccgagcaa

SEQ ID NO: 1448897 - RNA, 23 nt, Pseudomonas aeruginosa PA01
cagggccaggccgagcaauccgg

SEQ ID NO: 1448898 - RNA, 16 nt, Pseudomonas aeruginosa PA01
cagggccagggaaauc

SEQ ID NO: 1448899 - RNA, 20 nt, Pseudomonas aeruginosa PA01
cagggccagggaggcgcugg

SEQ ID NO: 1448900 - RNA, 14 nt, Pseudomonas aeruginosa PA01
cagggccagggcga

SEQ ID NO: 1448901 - RNA, 16 nt, Pseudomonas aeruginosa PA01
cagggccagggcgagg

SEQ ID NO: 1448902 - RNA, 19 nt, Pseudomonas aeruginosa PA01
cagggcccagagcagcacc

SEQ ID NO: 1448903 - RNA, 17 nt, Pseudomonas aeruginosa PA01
cagggccagcgccuggc

SEQ ID NO: 1448904 - RNA, 20 nt, Pseudomonas aeruginosa PA01
cagggccagcgccuggcgca

SEQ ID NO: 1448905 - RNA, 21 nt, Pseudomonas aeruginosa PA01
cagggugcgauggaugcgcgg

SEQ ID NO: 1448906 - RNA, 22 nt, Pseudomonas aeruginosa PA01
cagggugcgauggaugcgcggc

SEQ ID NO: 1448907 - RNA, 14 nt, Pseudomonas aeruginosa PA01
cagggugccgacca

SEQ ID NO: 1448908 - RNA, 13 nt, Pseudomonas aeruginosa PA01
cagggugcgccgg

SEQ ID NO: 1448909 - RNA, 14 nt, Pseudomonas aeruginosa PA01
cagggugcgccggg

SEQ ID NO: 1448910 - RNA, 15 nt, Pseudomonas aeruginosa PA01
cagggugcgccgggg

SEQ ID NO: 1448911 - RNA, 21 nt, Pseudomonas aeruginosa PA01
cagggugcggauggcgaucga

SEQ ID NO: 1448912 - RNA, 18 nt, Pseudomonas aeruginosa PA01
cagggugcgggcgcgggc

SEQ ID NO: 1448913 - RNA, 14 nt, Pseudomonas aeruginosa PA01
caggguuuccagca

SEQ ID NO: 1448914 - RNA, 16 nt, Pseudomonas aeruginosa PA01
caggguuuccagcagc

SEQ ID NO: 1448915 - RNA, 17 nt, Pseudomonas aeruginosa PA01
cagguaacccgcggcga

SEQ ID NO: 1448916 - RNA, 19 nt, Pseudomonas aeruginosa PA01
cagguacagcagcuucagu

SEQ ID NO: 1448917 - RNA, 14 nt, Pseudomonas aeruginosa PA01
cagguacagccgca

SEQ ID NO: 1448918 - RNA, 18 nt, Pseudomonas aeruginosa PA01
cagguacagccgcagaug

SEQ ID NO: 1448919 - RNA, 15 nt, Pseudomonas aeruginosa PA01
cagguaggcgcgggc

SEQ ID NO: 1448920 - RNA, 14 nt, Pseudomonas aeruginosa PA01
cagguaggcgaugc

SEQ ID NO: 1448921 - RNA, 21 nt, Pseudomonas aeruginosa PA01
cagguaggcgaugcgcguggu

SEQ ID NO: 1448922 - RNA, 23 nt, Pseudomonas aeruginosa PA01
cagguaggcaucgacgccagcgg

SEQ ID NO: 1448923 - RNA, 19 nt, Pseudomonas aeruginosa PA01
cagguaggggaaaccgugg

SEQ ID NO: 1448924 - RNA, 17 nt, Pseudomonas aeruginosa PA01
cagguagcugagcaggc

SEQ ID NO: 1448925 - RNA, 22 nt, Pseudomonas aeruginosa PA01
cagguagcugagcaggccgacg

SEQ ID NO: 1448926 - RNA, 13 nt, Pseudomonas aeruginosa PA01
cagguacaccagg

SEQ ID NO: 1448927 - RNA, 16 nt, Pseudomonas aeruginosa PA01
cagguagcgcugcgcc

SEQ ID NO: 1448928 - RNA, 18 nt, Pseudomonas aeruginosa PA01
cagguagcgcugcgcccg

SEQ ID NO: 1448929 - RNA, 19 nt, Pseudomonas aeruginosa PA01
cagguagcgcugcgcccgc

SEQ ID NO: 1448930 - RNA, 13 nt, Pseudomonas aeruginosa PA01
cagguagcggcga

SEQ ID NO: 1448931 - RNA, 16 nt, Pseudomonas aeruginosa PA01
caggucagccaccugc

SEQ ID NO: 1448932 - RNA, 15 nt, Pseudomonas aeruginosa PA01
caggucaugcccugg

SEQ ID NO: 1448933 - RNA, 21 nt, Pseudomonas aeruginosa PA01
caggucaugcccuggccgacg

SEQ ID NO: 1448934 - RNA, 23 nt, Pseudomonas aeruginosa PA01
caggucaugaaggaaaccggcca

SEQ ID NO: 1448935 - RNA, 17 nt, Pseudomonas aeruginosa PA01
cagguaggcgguggcga

SEQ ID NO: 1448936 - RNA, 17 nt, Pseudomonas aeruginosa PA01
cagguaguccagccagu

SEQ ID NO: 1448937 - RNA, 20 nt, Pseudomonas aeruginosa PA01
cagguaguccagcuccucga

SEQ ID NO: 1448938 - RNA, 20 nt, Pseudomonas aeruginosa PA01
cagguagucgcccggcucgc

SEQ ID NO: 1448939 - RNA, 22 nt, Pseudomonas aeruginosa PA01
cagguagucgcucauggcgccg

SEQ ID NO: 1448940 - RNA, 14 nt, Pseudomonas aeruginosa PA01
cagguagucggcga

SEQ ID NO: 1448941 - RNA, 22 nt, Pseudomonas aeruginosa PA01
cagguagucggcgaugcgcugg

SEQ ID NO: 1448942 - RNA, 22 nt, Pseudomonas aeruginosa PA01
cagguagugcggcgggcgcccg

SEQ ID NO: 1448943 - RNA, 17 nt, Pseudomonas aeruginosa PA01
cagguagugcucggcca

SEQ ID NO: 1448944 - RNA, 17 nt, Pseudomonas aeruginosa PA01
cagguaguggcccucga

SEQ ID NO: 1448945 - RNA, 20 nt, Pseudomonas aeruginosa PA01
cagguauucgcgcucggcga

SEQ ID NO: 1448946 - RNA, 21 nt, Pseudomonas aeruginosa PA01
cagguauccgcuuacuggcga

SEQ ID NO: 1448947 - RNA, 17 nt, Pseudomonas aeruginosa PA01
caggugggucacgucgg

SEQ ID NO: 1448948 - RNA, 20 nt, Pseudomonas aeruginosa PA01
caggugggucacgucggcgu

SEQ ID NO: 1448949 - RNA, 15 nt, Pseudomonas aeruginosa PA01
caggugguacggcug

SEQ ID NO: 1448950 - RNA, 21 nt, Pseudomonas aeruginosa PA01
cagguggucgaucuccuccuc

SEQ ID NO: 1448951 - RNA, 15 nt, Pseudomonas aeruginosa PA01
cagguguacaucggg

SEQ ID NO: 1448952 - RNA, 15 nt, Pseudomonas aeruginosa PA01
caggugguggcggau

SEQ ID NO: 1448953 - RNA, 23 nt, Pseudomonas aeruginosa PA01
caggugguggcggaucugcucga

SEQ ID NO: 1448954 - RNA, 20 nt, Pseudomonas aeruginosa PA01
cagguguucggccccggcca

SEQ ID NO: 1448955 - RNA, 22 nt, Pseudomonas aeruginosa PA01
cagguguucggccccggccagg

SEQ ID NO: 1448956 - RNA, 17 nt, Pseudomonas aeruginosa PA01
cagguucaucgccgcca

SEQ ID NO: 1448957 - RNA, 19 nt, Pseudomonas aeruginosa PA01
cagguuuccggcagcacgu

SEQ ID NO: 1448958 - RNA, 14 nt, Pseudomonas aeruginosa PA01
cagguucaccgccu

SEQ ID NO: 1448959 - RNA, 17 nt, Pseudomonas aeruginosa PA01
cagguucagcaggucgc

SEQ ID NO: 1448960 - RNA, 17 nt, Pseudomonas aeruginosa PA01
cagguucaggguggcga

SEQ ID NO: 1448961 - RNA, 21 nt, Pseudomonas aeruginosa PA01
cagguucaggguggcgaucac

SEQ ID NO: 1448962 - RNA, 23 nt, Pseudomonas aeruginosa PA01
caggugcguacuuggcccggcgu

SEQ ID NO: 1448963 - RNA, 16 nt, Pseudomonas aeruginosa PA01
caggugcgcggcagga

SEQ ID NO: 1448964 - RNA, 14 nt, Pseudomonas aeruginosa PA01
caggugcgcaggcg

SEQ ID NO: 1448965 - RNA, 20 nt, Pseudomonas aeruginosa PA01
caggugcccuggaagccggc

SEQ ID NO: 1448966 - RNA, 14 nt, Pseudomonas aeruginosa PA01
caggugcagcgagg

SEQ ID NO: 1448967 - RNA, 17 nt, Pseudomonas aeruginosa PA01
caggugcaggaacagcc

SEQ ID NO: 1448968 - RNA, 16 nt, Pseudomonas aeruginosa PA01
caggugacgcagggcg

SEQ ID NO: 1448969 - RNA, 13 nt, Pseudomonas aeruginosa PA01
caggugcaccgcg

SEQ ID NO: 1448970 - RNA, 16 nt, Pseudomonas aeruginosa PA01
caggugcaccgcgcug

SEQ ID NO: 1448971 - RNA, 17 nt, Pseudomonas aeruginosa PA01
caggugcaccgcgcugg

SEQ ID NO: 1448972 - RNA, 17 nt, Pseudomonas aeruginosa PA01
caggucggucggcggcg

SEQ ID NO: 1448973 - RNA, 16 nt, Pseudomonas aeruginosa PA01
caggucggucuggcgg

SEQ ID NO: 1448974 - RNA, 17 nt, Pseudomonas aeruginosa PA01
caggucggucuggcggc

SEQ ID NO: 1448975 - RNA, 13 nt, Pseudomonas aeruginosa PA01
caggucgcgcugg

SEQ ID NO: 1448976 - RNA, 17 nt, Pseudomonas aeruginosa PA01
caggucgcgcugggcga

SEQ ID NO: 1448977 - RNA, 14 nt, Pseudomonas aeruginosa PA01
caggucgcggauca

SEQ ID NO: 1448978 - RNA, 16 nt, Pseudomonas aeruginosa PA01
caggucgcuggcaccg

SEQ ID NO: 1448979 - RNA, 18 nt, Pseudomonas aeruginosa PA01
caggucgcuggcaccggc

SEQ ID NO: 1448980 - RNA, 23 nt, Pseudomonas aeruginosa PA01
caggucgcuggcgucgaccgccu

SEQ ID NO: 1448981 - RNA, 11 nt, Pseudomonas aeruginosa PA01
caggucgcugu

SEQ ID NO: 1448982 - RNA, 19 nt, Pseudomonas aeruginosa PA01
caggucgcugcccucgacc

SEQ ID NO: 1448983 - RNA, 23 nt, Pseudomonas aeruginosa PA01
caggucgccguagaacagcacgu

SEQ ID NO: 1448984 - RNA, 20 nt, Pseudomonas aeruginosa PA01
caggucgccgcacaccgcgc

SEQ ID NO: 1448985 - RNA, 21 nt, Pseudomonas aeruginosa PA01
caggucgccgcacaccgcgcg

SEQ ID NO: 1448986 - RNA, 19 nt, Pseudomonas aeruginosa PA01
caggucgccgccgccggga

SEQ ID NO: 1448987 - RNA, 20 nt, Pseudomonas aeruginosa PA01
caggucgcccugcagcgcgc

SEQ ID NO: 1448988 - RNA, 21 nt, Pseudomonas aeruginosa PA01
caggucgcccugcagcgcgcg

SEQ ID NO: 1448989 - RNA, 17 nt, Pseudomonas aeruginosa PA01
caggucgcccaccuugc

SEQ ID NO: 1448990 - RNA, 15 nt, Pseudomonas aeruginosa PA01
caggucgccagcgcc

SEQ ID NO: 1448991 - RNA, 16 nt, Pseudomonas aeruginosa PA01
caggucgccagcgccu

SEQ ID NO: 1448992 - RNA, 17 nt, Pseudomonas aeruginosa PA01
caggucgguguugcgcu

SEQ ID NO: 1448993 - RNA, 17 nt, Pseudomonas aeruginosa PA01
caggucgucgcgcuuga

SEQ ID NO: 1448994 - RNA, 14 nt, Pseudomonas aeruginosa PA01
caggucgucggcga

SEQ ID NO: 1448995 - RNA, 14 nt, Pseudomonas aeruginosa PA01
caggucgucgagga

SEQ ID NO: 1448996 - RNA, 16 nt, Pseudomonas aeruginosa PA01
caggucguggaaggcu

SEQ ID NO: 1448997 - RNA, 17 nt, Pseudomonas aeruginosa PA01
caggucguugcgccggc

SEQ ID NO: 1448998 - RNA, 18 nt, Pseudomonas aeruginosa PA01
caggucguugcgccggcc

SEQ ID NO: 1448999 - RNA, 16 nt, Pseudomonas aeruginosa PA01
caggucuuccaccgcg

SEQ ID NO: 1449000 - RNA, 15 nt, Pseudomonas aeruginosa PA01
caggucucaccgccc

SEQ ID NO: 1449001 - RNA, 21 nt, Pseudomonas aeruginosa PA01
caggucucaccgcccugcgcg

SEQ ID NO: 1449002 - RNA, 14 nt, Pseudomonas aeruginosa PA01
caguucguugacca

SEQ ID NO: 1449003 - RNA, 20 nt, Pseudomonas aeruginosa PA01
caguucguugaccacgcuca

SEQ ID NO: 1449004 - RNA, 17 nt, Pseudomonas aeruginosa PA01
caguucgugccaggcga

SEQ ID NO: 1449005 - RNA, 21 nt, Pseudomonas aeruginosa PA01
caguucggugccgccggcgcc

SEQ ID NO: 1449006 - RNA, 20 nt, Pseudomonas aeruginosa PA01
caguucgucgccacgcccgc

SEQ ID NO: 1449007 - RNA, 23 nt, Pseudomonas aeruginosa PA01
caguucgucgccacgcccgccgu

SEQ ID NO: 1449008 - RNA, 19 nt, Pseudomonas aeruginosa PA01
caguucguccaucgccagg

SEQ ID NO: 1449009 - RNA, 20 nt, Pseudomonas aeruginosa PA01
caguucguccaucgccaggc

SEQ ID NO: 1449010 - RNA, 22 nt, Pseudomonas aeruginosa PA01
caguucguccaucgccaggcca

SEQ ID NO: 1449011 - RNA, 17 nt, Pseudomonas aeruginosa PA01
caguugcaacagcgcgg

SEQ ID NO: 1449012 - RNA, 22 nt, Pseudomonas aeruginosa PA01
caguugaggcagguggcgcagc

SEQ ID NO: 1449013 - RNA, 19 nt, Pseudomonas aeruginosa PA01
caguucucgcagcaggcgu

SEQ ID NO: 1449014 - RNA, 13 nt, Pseudomonas aeruginosa PA01
caguucugggcgg

SEQ ID NO: 1449015 - RNA, 16 nt, Pseudomonas aeruginosa PA01
caguucuucgccgccc

SEQ ID NO: 1449016 - RNA, 17 nt, Pseudomonas aeruginosa PA01
caguucgccggccagca

SEQ ID NO: 1449017 - RNA, 14 nt, Pseudomonas aeruginosa PA01
caguucgcgcagga

SEQ ID NO: 1449018 - RNA, 16 nt, Pseudomonas aeruginosa PA01
caguucggccagcggc

SEQ ID NO: 1449019 - RNA, 18 nt, Pseudomonas aeruginosa PA01
caguucggcccagcagcg

SEQ ID NO: 1449020 - RNA, 13 nt, Pseudomonas aeruginosa PA01
caguucggccgcg

SEQ ID NO: 1449021 - RNA, 17 nt, Pseudomonas aeruginosa PA01
caguucgcugccgccgc

SEQ ID NO: 1449022 - RNA, 22 nt, Pseudomonas aeruginosa PA01
caguucgcugccgccgcgcugc

SEQ ID NO: 1449023 - RNA, 14 nt, Pseudomonas aeruginosa PA01
caguucgcggcgca

SEQ ID NO: 1449024 - RNA, 16 nt, Pseudomonas aeruginosa PA01
caguucgaccuccagg

SEQ ID NO: 1449025 - RNA, 17 nt, Pseudomonas aeruginosa PA01
caguucgaccuccaggc

SEQ ID NO: 1449026 - RNA, 17 nt, Pseudomonas aeruginosa PA01
caguuccuugggcaucg

SEQ ID NO: 1449027 - RNA, 16 nt, Pseudomonas aeruginosa PA01
caguucgaugggccgg

SEQ ID NO: 1449028 - RNA, 15 nt, Pseudomonas aeruginosa PA01
caguucgccccgccg

SEQ ID NO: 1449029 - RNA, 16 nt, Pseudomonas aeruginosa PA01
caguucgccccgccgc

SEQ ID NO: 1449030 - RNA, 13 nt, Pseudomonas aeruginosa PA01
caguucgcccggc

SEQ ID NO: 1449031 - RNA, 13 nt, Pseudomonas aeruginosa PA01
caguucgccgccc

SEQ ID NO: 1449032 - RNA, 19 nt, Pseudomonas aeruginosa PA01
caguucgccgcccgaggcg

SEQ ID NO: 1449033 - RNA, 20 nt, Pseudomonas aeruginosa PA01
caguucgccgcccgaggcga

SEQ ID NO: 1449034 - RNA, 22 nt, Pseudomonas aeruginosa PA01
caguucagggcgagcagggcac

SEQ ID NO: 1449035 - RNA, 21 nt, Pseudomonas aeruginosa PA01
caguucagggcguagcggaag

SEQ ID NO: 1449036 - RNA, 20 nt, Pseudomonas aeruginosa PA01
caguuccacgaagaacgcca

SEQ ID NO: 1449037 - RNA, 13 nt, Pseudomonas aeruginosa PA01
caguuccaggcgu

SEQ ID NO: 1449038 - RNA, 21 nt, Pseudomonas aeruginosa PA01
caguuccaggucggcggcacg

SEQ ID NO: 1449039 - RNA, 18 nt, Pseudomonas aeruginosa PA01
caguuccuucaccggacg

SEQ ID NO: 1449040 - RNA, 19 nt, Pseudomonas aeruginosa PA01
caguuccuucaccggacgg

SEQ ID NO: 1449041 - RNA, 13 nt, Pseudomonas aeruginosa PA01
caguuccucgccg

SEQ ID NO: 1449042 - RNA, 14 nt, Pseudomonas aeruginosa PA01
caguuccucgccgc

SEQ ID NO: 1449043 - RNA, 20 nt, Pseudomonas aeruginosa PA01
caguuccucgccgcugcugg

SEQ ID NO: 1449044 - RNA, 16 nt, Pseudomonas aeruginosa PA01
cagugguuccaggagg

SEQ ID NO: 1449045 - RNA, 22 nt, Pseudomonas aeruginosa PA01
cagugggucgaugcccucgcgg

SEQ ID NO: 1449046 - RNA, 17 nt, Pseudomonas aeruginosa PA01
caguggcgccagccagc

SEQ ID NO: 1449047 - RNA, 15 nt, Pseudomonas aeruginosa PA01
caguggcgccgccau

SEQ ID NO: 1449048 - RNA, 19 nt, Pseudomonas aeruginosa PA01
cagugcgagucggcgacga

SEQ ID NO: 1449049 - RNA, 12 nt, Pseudomonas aeruginosa PA01
caguaacgccug

SEQ ID NO: 1449050 - RNA, 15 nt, Pseudomonas aeruginosa PA01
caguacagcucggcg

SEQ ID NO: 1449051 - RNA, 17 nt, Pseudomonas aeruginosa PA01
caguacagcucggcgcc

SEQ ID NO: 1449052 - RNA, 19 nt, Pseudomonas aeruginosa PA01
caguaccagcaaugcccag

SEQ ID NO: 1449053 - RNA, 21 nt, Pseudomonas aeruginosa PA01
caguaccagcaaugcccagcg

SEQ ID NO: 1449054 - RNA, 14 nt, Pseudomonas aeruginosa PA01
caguacccggccgc

SEQ ID NO: 1449055 - RNA, 15 nt, Pseudomonas aeruginosa PA01
caguacccggccgcc

SEQ ID NO: 1449056 - RNA, 16 nt, Pseudomonas aeruginosa PA01
caguacccggccgccu

SEQ ID NO: 1449057 - RNA, 21 nt, Pseudomonas aeruginosa PA01
caguaccgccacguacagcgc

SEQ ID NO: 1449058 - RNA, 19 nt, Pseudomonas aeruginosa PA01
cagucccggcuugccggca

SEQ ID NO: 1449059 - RNA, 19 nt, Pseudomonas aeruginosa PA01
cagucccuugaucagcgcg

SEQ ID NO: 1449060 - RNA, 14 nt, Pseudomonas aeruginosa PA01
cagucccugccagg

SEQ ID NO: 1449061 - RNA, 16 nt, Pseudomonas aeruginosa PA01
cagucccugccagggg

SEQ ID NO: 1449062 - RNA, 23 nt, Pseudomonas aeruginosa PA01
cagucccuggccggcgauggccg

SEQ ID NO: 1449063 - RNA, 13 nt, Pseudomonas aeruginosa PA01
cagucggcgcugg

SEQ ID NO: 1449064 - RNA, 17 nt, Pseudomonas aeruginosa PA01
cagucggcguccgccuc

SEQ ID NO: 1449065 - RNA, 15 nt, Pseudomonas aeruginosa PA01
cagucggcgcuggag

SEQ ID NO: 1449066 - RNA, 16 nt, Pseudomonas aeruginosa PA01
cagucggcggucuuga

SEQ ID NO: 1449067 - RNA, 15 nt, Pseudomonas aeruginosa PA01
cagucgcuuccgcgc

SEQ ID NO: 1449068 - RNA, 18 nt, Pseudomonas aeruginosa PA01
cagucgcuuccgcgcggc

SEQ ID NO: 1449069 - RNA, 15 nt, Pseudomonas aeruginosa PA01
cagucggccaggcgc

SEQ ID NO: 1449070 - RNA, 17 nt, Pseudomonas aeruginosa PA01
cagucggccaggcgcca

SEQ ID NO: 1449071 - RNA, 19 nt, Pseudomonas aeruginosa PA01
cagucggccaggcgccagg

SEQ ID NO: 1449072 - RNA, 18 nt, Pseudomonas aeruginosa PA01
cagucggccguugcgggc

SEQ ID NO: 1449073 - RNA, 13 nt, Pseudomonas aeruginosa PA01
cagucgccuggcc

SEQ ID NO: 1449074 - RNA, 18 nt, Pseudomonas aeruginosa PA01
cagucggcaccgaucgcc

SEQ ID NO: 1449075 - RNA, 19 nt, Pseudomonas aeruginosa PA01
cagucggcaccgaucgccc

SEQ ID NO: 1449076 - RNA, 20 nt, Pseudomonas aeruginosa PA01
caguccuggcgguagcccgg

SEQ ID NO: 1449077 - RNA, 19 nt, Pseudomonas aeruginosa PA01
caguccuugagcgccagca

SEQ ID NO: 1449078 - RNA, 15 nt, Pseudomonas aeruginosa PA01
cagugccucccggcc

SEQ ID NO: 1449079 - RNA, 23 nt, Pseudomonas aeruginosa PA01
cagugccucgcgcguggccgcca

SEQ ID NO: 1449080 - RNA, 12 nt, Pseudomonas aeruginosa PA01
cagugccgggcg

SEQ ID NO: 1449081 - RNA, 19 nt, Pseudomonas aeruginosa PA01
cauguuguuauggccgacc

SEQ ID NO: 1449082 - RNA, 18 nt, Pseudomonas aeruginosa PA01
cauguuccuccagagugc

SEQ ID NO: 1449083 - RNA, 22 nt, Pseudomonas aeruginosa PA01
cauuagcgucgcgcggccagcg

SEQ ID NO: 1449084 - RNA, 22 nt, Pseudomonas aeruginosa PA01
caugucguggacauacaggcgc

SEQ ID NO: 1449085 - RNA, 23 nt, Pseudomonas aeruginosa PA01
caugucguggacauacaggcgcg

SEQ ID NO: 1449086 - RNA, 15 nt, Pseudomonas aeruginosa PA01
caugucgcuggccug

SEQ ID NO: 1449087 - RNA, 20 nt, Pseudomonas aeruginosa PA01
caugucgcugaaacgcgcgu

SEQ ID NO: 1449088 - RNA, 16 nt, Pseudomonas aeruginosa PA01
caugucgccggggaag

SEQ ID NO: 1449089 - RNA, 22 nt, Pseudomonas aeruginosa PA01
caugucgcacuggucggccagu

SEQ ID NO: 1449090 - RNA, 16 nt, Pseudomonas aeruginosa PA01
cauguucaugcgcugg

SEQ ID NO: 1449091 - RNA, 18 nt, Pseudomonas aeruginosa PA01
cauguuccacaugcgcuc

SEQ ID NO: 1449092 - RNA, 16 nt, Pseudomonas aeruginosa PA01
cauguucaccagcgcu

SEQ ID NO: 1449093 - RNA, 13 nt, Pseudomonas aeruginosa PA01
cauguggcgcagc

SEQ ID NO: 1449094 - RNA, 14 nt, Pseudomonas aeruginosa PA01
caugugcuggcgga

SEQ ID NO: 1449095 - RNA, 18 nt, Pseudomonas aeruginosa PA01
caugugcuugaccgccgc

SEQ ID NO: 1449096 - RNA, 19 nt, Pseudomonas aeruginosa PA01
caugugcuugaccgccgcc

SEQ ID NO: 1449097 - RNA, 22 nt, Pseudomonas aeruginosa PA01
caugugcuugaccgccgccugg

SEQ ID NO: 1449098 - RNA, 14 nt, Pseudomonas aeruginosa PA01
cauguccggggcga

SEQ ID NO: 1449099 - RNA, 20 nt, Pseudomonas aeruginosa PA01
cauguccgcaggcaggucgc

SEQ ID NO: 1449100 - RNA, 13 nt, Pseudomonas aeruginosa PA01
cauguccucggcg

SEQ ID NO: 1449101 - RNA, 15 nt, Pseudomonas aeruginosa PA01
caugucagcggugaa

SEQ ID NO: 1449102 - RNA, 16 nt, Pseudomonas aeruginosa PA01
cauguccaccgccgcc

SEQ ID NO: 1449103 - RNA, 16 nt, Pseudomonas aeruginosa PA01
cauguacguaucccag

SEQ ID NO: 1449104 - RNA, 17 nt, Pseudomonas aeruginosa PA01
cauguaccucuggcuga

SEQ ID NO: 1449105 - RNA, 13 nt, Pseudomonas aeruginosa PA01
cauucaggcggau

SEQ ID NO: 1449106 - RNA, 19 nt, Pseudomonas aeruginosa PA01
cauucaucucgccgucggc

SEQ ID NO: 1449107 - RNA, 16 nt, Pseudomonas aeruginosa PA01
cauucccacgacccgc

SEQ ID NO: 1449108 - RNA, 20 nt, Pseudomonas aeruginosa PA01
cauuccgcggcacuccggca

SEQ ID NO: 1449109 - RNA, 15 nt, Pseudomonas aeruginosa PA01
cauucauggcgccac

SEQ ID NO: 1449110 - RNA, 21 nt, Pseudomonas aeruginosa PA01
cauuccgggcgaaagcgguac

SEQ ID NO: 1449111 - RNA, 15 nt, Pseudomonas aeruginosa PA01
cauuccucagcgccg

SEQ ID NO: 1449112 - RNA, 16 nt, Pseudomonas aeruginosa PA01
cauuccucagcgccgg

SEQ ID NO: 1449113 - RNA, 12 nt, Pseudomonas aeruginosa PA01
cauucgccgggc

SEQ ID NO: 1449114 - RNA, 16 nt, Pseudomonas aeruginosa PA01
cauucgaauggcgccg

SEQ ID NO: 1449115 - RNA, 19 nt, Pseudomonas aeruginosa PA01
cauucgaauggcgccggcc

SEQ ID NO: 1449116 - RNA, 16 nt, Pseudomonas aeruginosa PA01
cauucgcucugcgcca

SEQ ID NO: 1449117 - RNA, 21 nt, Pseudomonas aeruginosa PA01
cauucgcucugcgccaggcgg

SEQ ID NO: 1449118 - RNA, 17 nt, Pseudomonas aeruginosa PA01
cauugaaaucaucggcc

SEQ ID NO: 1449119 - RNA, 15 nt, Pseudomonas aeruginosa PA01
cauugccaccaccau

SEQ ID NO: 1449120 - RNA, 17 nt, Pseudomonas aeruginosa PA01
cauugccaccaccaugc

SEQ ID NO: 1449121 - RNA, 12 nt, Pseudomonas aeruginosa PA01
cauugccgaugu

SEQ ID NO: 1449122 - RNA, 23 nt, Pseudomonas aeruginosa PA01
cauugccgggcuuccuggccggg

SEQ ID NO: 1449123 - RNA, 18 nt, Pseudomonas aeruginosa PA01
cauugccguccgucggca

SEQ ID NO: 1449124 - RNA, 15 nt, Pseudomonas aeruginosa PA01
cauugcccggccagg

SEQ ID NO: 1449125 - RNA, 16 nt, Pseudomonas aeruginosa PA01
cauugcccggccaggc

SEQ ID NO: 1449126 - RNA, 18 nt, Pseudomonas aeruginosa PA01
cauugcccggccaggcgc

SEQ ID NO: 1449127 - RNA, 22 nt, Pseudomonas aeruginosa PA01
cauucguccagccgccgcugca

SEQ ID NO: 1449128 - RNA, 16 nt, Pseudomonas aeruginosa PA01
cauucgucgccgcugg

SEQ ID NO: 1449129 - RNA, 12 nt, Pseudomonas aeruginosa PA01
cauucgucgcug

SEQ ID NO: 1449130 - RNA, 15 nt, Pseudomonas aeruginosa PA01
cauucggccagcgcg

SEQ ID NO: 1449131 - RNA, 18 nt, Pseudomonas aeruginosa PA01
cauucggccagcgcggcg

SEQ ID NO: 1449132 - RNA, 18 nt, Pseudomonas aeruginosa PA01
cauucuccagccgcaccc

SEQ ID NO: 1449133 - RNA, 20 nt, Pseudomonas aeruginosa PA01
cauucucccucgccgaccgc

SEQ ID NO: 1449134 - RNA, 14 nt, Pseudomonas aeruginosa PA01
cauugagcgccagc

SEQ ID NO: 1449135 - RNA, 16 nt, Pseudomonas aeruginosa PA01
cauugaaaacggcgcc

SEQ ID NO: 1449136 - RNA, 17 nt, Pseudomonas aeruginosa PA01
caucgccgaccacuucc

SEQ ID NO: 1449137 - RNA, 13 nt, Pseudomonas aeruginosa PA01
caucgccgagggc

SEQ ID NO: 1449138 - RNA, 16 nt, Pseudomonas aeruginosa PA01
caucgccgccaggcag

SEQ ID NO: 1449139 - RNA, 13 nt, Pseudomonas aeruginosa PA01
caucgccgcccag

SEQ ID NO: 1449140 - RNA, 14 nt, Pseudomonas aeruginosa PA01
caucgccgcggcga

SEQ ID NO: 1449141 - RNA, 15 nt, Pseudomonas aeruginosa PA01
caucgccgcggcgaa

SEQ ID NO: 1449142 - RNA, 17 nt, Pseudomonas aeruginosa PA01
caugccguugcccucgc

SEQ ID NO: 1449143 - RNA, 19 nt, Pseudomonas aeruginosa PA01
caugccguugcccucgcgc

SEQ ID NO: 1449144 - RNA, 15 nt, Pseudomonas aeruginosa PA01
caugccguugggcca

SEQ ID NO: 1449145 - RNA, 22 nt, Pseudomonas aeruginosa PA01
caugccugcuuucccugcugcg

SEQ ID NO: 1449146 - RNA, 16 nt, Pseudomonas aeruginosa PA01
caugccuugcagcgcc

SEQ ID NO: 1449147 - RNA, 17 nt, Pseudomonas aeruginosa PA01
caugcgaaaacggcgac

SEQ ID NO: 1449148 - RNA, 19 nt, Pseudomonas aeruginosa PA01
caugcgaaaacggcgaccc

SEQ ID NO: 1449149 - RNA, 22 nt, Pseudomonas aeruginosa PA01
caugcgaaaacggcgacccugg

SEQ ID NO: 1449150 - RNA, 14 nt, Pseudomonas aeruginosa PA01
caugcgcagcgcgu

SEQ ID NO: 1449151 - RNA, 20 nt, Pseudomonas aeruginosa PA01
caugcggaucgccuccggca

SEQ ID NO: 1449152 - RNA, 21 nt, Pseudomonas aeruginosa PA01
caugcgcugguagcgcuccag

SEQ ID NO: 1449153 - RNA, 18 nt, Pseudomonas aeruginosa PA01
caugcggaacaccgccug

SEQ ID NO: 1449154 - RNA, 19 nt, Pseudomonas aeruginosa PA01
caugcggaaggcuuccugg

SEQ ID NO: 1449155 - RNA, 23 nt, Pseudomonas aeruginosa PA01
caugcgcguguugcgccgcacca

SEQ ID NO: 1449156 - RNA, 14 nt, Pseudomonas aeruginosa PA01
caugcgcggcagga

SEQ ID NO: 1449157 - RNA, 23 nt, Pseudomonas aeruginosa PA01
caugcgcggcaggaaauccgccg

SEQ ID NO: 1449158 - RNA, 12 nt, Pseudomonas aeruginosa PA01
caugcgccggcu

SEQ ID NO: 1449159 - RNA, 12 nt, Pseudomonas aeruginosa PA01
caugcgcggcga

SEQ ID NO: 1449160 - RNA, 18 nt, Pseudomonas aeruginosa PA01
cauggaacagcagccagg

SEQ ID NO: 1449161 - RNA, 21 nt, Pseudomonas aeruginosa PA01
cauggaacagcagccaggcga

SEQ ID NO: 1449162 - RNA, 19 nt, Pseudomonas aeruginosa PA01
cauggaaaccccggccugg

SEQ ID NO: 1449163 - RNA, 18 nt, Pseudomonas aeruginosa PA01
cauggacaggucgacggc

SEQ ID NO: 1449164 - RNA, 19 nt, Pseudomonas aeruginosa PA01
cauggaccgagaccgacgc

SEQ ID NO: 1449165 - RNA, 17 nt, Pseudomonas aeruginosa PA01
cauggagcaacagcguc

SEQ ID NO: 1449166 - RNA, 12 nt, Pseudomonas aeruginosa PA01
cauggaucggca

SEQ ID NO: 1449167 - RNA, 18 nt, Pseudomonas aeruginosa PA01
cauggagacggcccgccc

SEQ ID NO: 1449168 - RNA, 21 nt, Pseudomonas aeruginosa PA01
cauggagacggcccgccccgc

SEQ ID NO: 1449169 - RNA, 14 nt, Pseudomonas aeruginosa PA01
caugcugcucggca

SEQ ID NO: 1449170 - RNA, 17 nt, Pseudomonas aeruginosa PA01
caugcugcgcgggacgc

SEQ ID NO: 1449171 - RNA, 20 nt, Pseudomonas aeruginosa PA01
caugcugggucuccgcucgg

SEQ ID NO: 1449172 - RNA, 14 nt, Pseudomonas aeruginosa PA01
caugcucggccagc

SEQ ID NO: 1449173 - RNA, 18 nt, Pseudomonas aeruginosa PA01
caugcuccgccuggcgga

SEQ ID NO: 1449174 - RNA, 20 nt, Pseudomonas aeruginosa PA01
caugcucgggguuuccucga

SEQ ID NO: 1449175 - RNA, 14 nt, Pseudomonas aeruginosa PA01
caugcucagccgcg

SEQ ID NO: 1449176 - RNA, 13 nt, Pseudomonas aeruginosa PA01
caugcggccccgg

SEQ ID NO: 1449177 - RNA, 16 nt, Pseudomonas aeruginosa PA01
caugcggccccggcgc

SEQ ID NO: 1449178 - RNA, 12 nt, Pseudomonas aeruginosa PA01
caugcggccgau

SEQ ID NO: 1449179 - RNA, 17 nt, Pseudomonas aeruginosa PA01
caugguguccggcggcg

SEQ ID NO: 1449180 - RNA, 18 nt, Pseudomonas aeruginosa PA01
cauggucggccaggucgc

SEQ ID NO: 1449181 - RNA, 14 nt, Pseudomonas aeruginosa PA01
cauggugccgagca

SEQ ID NO: 1449182 - RNA, 20 nt, Pseudomonas aeruginosa PA01
caugggugcuguucagcggg

SEQ ID NO: 1449183 - RNA, 15 nt, Pseudomonas aeruginosa PA01
caugggugucggcga

SEQ ID NO: 1449184 - RNA, 15 nt, Pseudomonas aeruginosa PA01
caugggucagcgcca

SEQ ID NO: 1449185 - RNA, 18 nt, Pseudomonas aeruginosa PA01
caugggcucgcgcggggc

SEQ ID NO: 1449186 - RNA, 23 nt, Pseudomonas aeruginosa PA01
caugggggccagcagggccgccg

SEQ ID NO: 1449187 - RNA, 19 nt, Pseudomonas aeruginosa PA01
cauggcuuuccaggcgccg

SEQ ID NO: 1449188 - RNA, 16 nt, Pseudomonas aeruginosa PA01
cauggcgcugaggaag

SEQ ID NO: 1449189 - RNA, 13 nt, Pseudomonas aeruginosa PA01
cauggcgguccag

SEQ ID NO: 1449190 - RNA, 15 nt, Pseudomonas aeruginosa PA01
caugggccggccgac

SEQ ID NO: 1449191 - RNA, 16 nt, Pseudomonas aeruginosa PA01
caugggaaccucggca

SEQ ID NO: 1449192 - RNA, 17 nt, Pseudomonas aeruginosa PA01
caugggcauccugccgc

SEQ ID NO: 1449193 - RNA, 22 nt, Pseudomonas aeruginosa PA01
cauggcgaccugguggcgccgg

SEQ ID NO: 1449194 - RNA, 13 nt, Pseudomonas aeruginosa PA01
cauggcgcacgcc

SEQ ID NO: 1449195 - RNA, 20 nt, Pseudomonas aeruginosa PA01
cauggcgcucuucaccgucg

SEQ ID NO: 1449196 - RNA, 15 nt, Pseudomonas aeruginosa PA01
cauggcgcuugcgca

SEQ ID NO: 1449197 - RNA, 21 nt, Pseudomonas aeruginosa PA01
cauggcggacauguugcaggg

SEQ ID NO: 1449198 - RNA, 16 nt, Pseudomonas aeruginosa PA01
cauggcgucggcgauc

SEQ ID NO: 1449199 - RNA, 22 nt, Pseudomonas aeruginosa PA01
cauggcaugaggggaaucgccg

SEQ ID NO: 1449200 - RNA, 22 nt, Pseudomonas aeruginosa PA01
cauggccaccgaaucggacagg

SEQ ID NO: 1449201 - RNA, 14 nt, Pseudomonas aeruginosa PA01
cauggcauggccau

SEQ ID NO: 1449202 - RNA, 14 nt, Pseudomonas aeruginosa PA01
cauggcacgcaggg

SEQ ID NO: 1449203 - RNA, 16 nt, Pseudomonas aeruginosa PA01
cauggccuugccggca

SEQ ID NO: 1449204 - RNA, 15 nt, Pseudomonas aeruginosa PA01
cauggccuggcgcuc

SEQ ID NO: 1449205 - RNA, 19 nt, Pseudomonas aeruginosa PA01
cauggccgaccgccaggcc

SEQ ID NO: 1449206 - RNA, 21 nt, Pseudomonas aeruginosa PA01
cauggccgaccgccaggccga

SEQ ID NO: 1449207 - RNA, 22 nt, Pseudomonas aeruginosa PA01
cauggccgaccgccaggccgac

SEQ ID NO: 1449208 - RNA, 12 nt, Pseudomonas aeruginosa PA01
cauggccgggcc

SEQ ID NO: 1449209 - RNA, 13 nt, Pseudomonas aeruginosa PA01
cauugcgcacggu

SEQ ID NO: 1449210 - RNA, 23 nt, Pseudomonas aeruginosa PA01
cauugcgcuccgacuccugcaac

SEQ ID NO: 1449211 - RNA, 14 nt, Pseudomonas aeruginosa PA01
cauugcggcccgcc

SEQ ID NO: 1449212 - RNA, 16 nt, Pseudomonas aeruginosa PA01
cauugcggcccgccac

SEQ ID NO: 1449213 - RNA, 16 nt, Pseudomonas aeruginosa PA01
cauugcugccgaggcc

SEQ ID NO: 1449214 - RNA, 17 nt, Pseudomonas aeruginosa PA01
cauugcugccgaggccg

SEQ ID NO: 1449215 - RNA, 13 nt, Pseudomonas aeruginosa PA01
cauugggcagcca

SEQ ID NO: 1449216 - RNA, 15 nt, Pseudomonas aeruginosa PA01
cauugggcagccacg

SEQ ID NO: 1449217 - RNA, 16 nt, Pseudomonas aeruginosa PA01
cauugggcagccacga

SEQ ID NO: 1449218 - RNA, 14 nt, Pseudomonas aeruginosa PA01
cauuggccgacgcc

SEQ ID NO: 1449219 - RNA, 21 nt, Pseudomonas aeruginosa PA01
cauuggcgaaguugccgccgc

SEQ ID NO: 1449220 - RNA, 22 nt, Pseudomonas aeruginosa PA01
cauuggcgaaguugccgccgcu

SEQ ID NO: 1449221 - RNA, 16 nt, Pseudomonas aeruginosa PA01
cauuguuggcgcucgg

SEQ ID NO: 1449222 - RNA, 14 nt, Pseudomonas aeruginosa PA01
cauugucccugcgg

SEQ ID NO: 1449223 - RNA, 19 nt, Pseudomonas aeruginosa PA01
cauuggugcugcgcgcggc

SEQ ID NO: 1449224 - RNA, 20 nt, Pseudomonas aeruginosa PA01
cauuggugcugcgcgcggcc

SEQ ID NO: 1449225 - RNA, 13 nt, Pseudomonas aeruginosa PA01
cauuucguugcgc

SEQ ID NO: 1449226 - RNA, 13 nt, Pseudomonas aeruginosa PA01
cauuucguagccc

SEQ ID NO: 1449227 - RNA, 19 nt, Pseudomonas aeruginosa PA01
cauuucguagcccaggcgg

SEQ ID NO: 1449228 - RNA, 13 nt, Pseudomonas aeruginosa PA01
cauuuccgccgga

SEQ ID NO: 1449229 - RNA, 18 nt, Pseudomonas aeruginosa PA01
ccaacugcgcccccagcg

SEQ ID NO: 1449230 - RNA, 20 nt, Pseudomonas aeruginosa PA01
ccaacugcgcccccagcgcc

SEQ ID NO: 1449231 - RNA, 19 nt, Pseudomonas aeruginosa PA01
ccaacugcuucaggcgcgc

SEQ ID NO: 1449232 - RNA, 22 nt, Pseudomonas aeruginosa PA01
ccaacuggauuuccuucggcac

SEQ ID NO: 1449233 - RNA, 15 nt, Pseudomonas aeruginosa PA01
ccaagccgagcggca

SEQ ID NO: 1449234 - RNA, 14 nt, Pseudomonas aeruginosa PA01
ccaagcccggcgag

SEQ ID NO: 1449235 - RNA, 22 nt, Pseudomonas aeruginosa PA01
ccaacuggcggcugggcugcgg

SEQ ID NO: 1449236 - RNA, 14 nt, Pseudomonas aeruginosa PA01
ccaaccgcgcucgg

SEQ ID NO: 1449237 - RNA, 15 nt, Pseudomonas aeruginosa PA01
ccaaccgcgcucggc

SEQ ID NO: 1449238 - RNA, 13 nt, Pseudomonas aeruginosa PA01
ccaacccggccag

SEQ ID NO: 1449239 - RNA, 14 nt, Pseudomonas aeruginosa PA01
ccaacccggccagc

SEQ ID NO: 1449240 - RNA, 16 nt, Pseudomonas aeruginosa PA01
ccaaccgucgcccugg

SEQ ID NO: 1449241 - RNA, 23 nt, Pseudomonas aeruginosa PA01
ccaaccguucugccgcagcgccu

SEQ ID NO: 1449242 - RNA, 20 nt, Pseudomonas aeruginosa PA01
ccaaccgggcagcagccgga

SEQ ID NO: 1449243 - RNA, 21 nt, Pseudomonas aeruginosa PA01
ccaaccgggcaucgccgacca

SEQ ID NO: 1449244 - RNA, 19 nt, Pseudomonas aeruginosa PA01
ccaaggaugcgccagcggc

SEQ ID NO: 1449245 - RNA, 20 nt, Pseudomonas aeruginosa PA01
ccaaggaugcgccagcggcc

SEQ ID NO: 1449246 - RNA, 19 nt, Pseudomonas aeruginosa PA01
ccaagcuuguugcgcaggc

SEQ ID NO: 1449247 - RNA, 19 nt, Pseudomonas aeruginosa PA01
ccaauugcccguagggcga

SEQ ID NO: 1449248 - RNA, 18 nt, Pseudomonas aeruginosa PA01
ccaauugccguagggcga

SEQ ID NO: 1449249 - RNA, 16 nt, Pseudomonas aeruginosa PA01
ccaauucgacgccgaa

SEQ ID NO: 1449250 - RNA, 23 nt, Pseudomonas aeruginosa PA01
ccacaggccggcuaaccgcgaag

SEQ ID NO: 1449251 - RNA, 21 nt, Pseudomonas aeruginosa PA01
ccacaggcgccagucauugcg

SEQ ID NO: 1449252 - RNA, 16 nt, Pseudomonas aeruginosa PA01
ccacagcugccagccc

SEQ ID NO: 1449253 - RNA, 19 nt, Pseudomonas aeruginosa PA01
ccacaggcguuauccgccg

SEQ ID NO: 1449254 - RNA, 17 nt, Pseudomonas aeruginosa PA01
ccacaggagcacggccg

SEQ ID NO: 1449255 - RNA, 20 nt, Pseudomonas aeruginosa PA01
ccacagugccaggcucgccg

SEQ ID NO: 1449256 - RNA, 18 nt, Pseudomonas aeruginosa PA01
ccacacccggucgcgcug

SEQ ID NO: 1449257 - RNA, 14 nt, Pseudomonas aeruginosa PA01
ccaccaccgacagg

SEQ ID NO: 1449258 - RNA, 13 nt, Pseudomonas aeruginosa PA01
ccaccaccgacgc

SEQ ID NO: 1449259 - RNA, 14 nt, Pseudomonas aeruginosa PA01
ccaccaccaugccu

SEQ ID NO: 1449260 - RNA, 15 nt, Pseudomonas aeruginosa PA01
ccaccaccgcgccga

SEQ ID NO: 1449261 - RNA, 21 nt, Pseudomonas aeruginosa PA01
ccaccaccgucuggcgcaucc

SEQ ID NO: 1449262 - RNA, 16 nt, Pseudomonas aeruginosa PA01
ccaccagagccagccg

SEQ ID NO: 1449263 - RNA, 19 nt, Pseudomonas aeruginosa PA01
ccaccagagccagccgcga

SEQ ID NO: 1449264 - RNA, 17 nt, Pseudomonas aeruginosa PA01
ccaccagaaggcgggca

SEQ ID NO: 1449265 - RNA, 19 nt, Pseudomonas aeruginosa PA01
ccacaggcccuggaucacc

SEQ ID NO: 1449266 - RNA, 15 nt, Pseudomonas aeruginosa PA01
ccacauccuugccgu

SEQ ID NO: 1449267 - RNA, 19 nt, Pseudomonas aeruginosa PA01
ccacaugggcgaccgguuc

SEQ ID NO: 1449268 - RNA, 14 nt, Pseudomonas aeruginosa PA01
ccaccaccacgacg

SEQ ID NO: 1449269 - RNA, 19 nt, Pseudomonas aeruginosa PA01
ccaccaggcuuacccgcga

SEQ ID NO: 1449270 - RNA, 21 nt, Pseudomonas aeruginosa PA01
ccaccagggucgguucgcggc

SEQ ID NO: 1449271 - RNA, 19 nt, Pseudomonas aeruginosa PA01
ccaccagggccuugccgcg

SEQ ID NO: 1449272 - RNA, 21 nt, Pseudomonas aeruginosa PA01
ccaccaggaagcgucgugcgc

SEQ ID NO: 1449273 - RNA, 15 nt, Pseudomonas aeruginosa PA01
ccaccaggccgcugc

SEQ ID NO: 1449274 - RNA, 12 nt, Pseudomonas aeruginosa PA01
ccaccaggcgcc

SEQ ID NO: 1449275 - RNA, 15 nt, Pseudomonas aeruginosa PA01
ccaccaggcgccggg

SEQ ID NO: 1449276 - RNA, 16 nt, Pseudomonas aeruginosa PA01
ccaccaggcgccgggu

SEQ ID NO: 1449277 - RNA, 13 nt, Pseudomonas aeruginosa PA01
ccaccagcaccug

SEQ ID NO: 1449278 - RNA, 12 nt, Pseudomonas aeruginosa PA01
ccaccagcagca

SEQ ID NO: 1449279 - RNA, 16 nt, Pseudomonas aeruginosa PA01
ccaccagcagcagcgg

SEQ ID NO: 1449280 - RNA, 21 nt, Pseudomonas aeruginosa PA01
ccaccagcagggccaggccga

SEQ ID NO: 1449281 - RNA, 21 nt, Pseudomonas aeruginosa PA01
ccaccagcaggaucgagcccu

SEQ ID NO: 1449282 - RNA, 13 nt, Pseudomonas aeruginosa PA01
ccaccagcgucgc

SEQ ID NO: 1449283 - RNA, 17 nt, Pseudomonas aeruginosa PA01
ccaccagcgucgccagg

SEQ ID NO: 1449284 - RNA, 15 nt, Pseudomonas aeruginosa PA01
ccaccagcguggcgc

SEQ ID NO: 1449285 - RNA, 20 nt, Pseudomonas aeruginosa PA01
ccaccagcaucaccaccggg

SEQ ID NO: 1449286 - RNA, 13 nt, Pseudomonas aeruginosa PA01
ccacccagcagca

SEQ ID NO: 1449287 - RNA, 16 nt, Pseudomonas aeruginosa PA01
ccacccagccgcggcc

SEQ ID NO: 1449288 - RNA, 13 nt, Pseudomonas aeruginosa PA01
ccacccaggcgcc

SEQ ID NO: 1449289 - RNA, 20 nt, Pseudomonas aeruginosa PA01
ccaccccaggguuggcggca

SEQ ID NO: 1449290 - RNA, 13 nt, Pseudomonas aeruginosa PA01
ccaccccgccgcg

SEQ ID NO: 1449291 - RNA, 22 nt, Pseudomonas aeruginosa PA01
ccacccccgcaaccgcugccgc

SEQ ID NO: 1449292 - RNA, 13 nt, Pseudomonas aeruginosa PA01
ccaccaucgccgc

SEQ ID NO: 1449293 - RNA, 16 nt, Pseudomonas aeruginosa PA01
ccaccaugugcuggcg

SEQ ID NO: 1449294 - RNA, 14 nt, Pseudomonas aeruginosa PA01
ccaccaucgcggcg

SEQ ID NO: 1449295 - RNA, 23 nt, Pseudomonas aeruginosa PA01
ccacgccgauaccggccucgaug

SEQ ID NO: 1449296 - RNA, 13 nt, Pseudomonas aeruginosa PA01
ccacgcccgccgu

SEQ ID NO: 1449297 - RNA, 14 nt, Pseudomonas aeruginosa PA01
ccacgcccugcgcc

SEQ ID NO: 1449298 - RNA, 17 nt, Pseudomonas aeruginosa PA01
ccacgcccugcgccagc

SEQ ID NO: 1449299 - RNA, 13 nt, Pseudomonas aeruginosa PA01
ccacgccgaaggc

SEQ ID NO: 1449300 - RNA, 21 nt, Pseudomonas aeruginosa PA01
ccacgaucagcucguugcccg

SEQ ID NO: 1449301 - RNA, 16 nt, Pseudomonas aeruginosa PA01
ccacgaucaggcccuu

SEQ ID NO: 1449302 - RNA, 21 nt, Pseudomonas aeruginosa PA01
ccacgaucaggcccuuuucca

SEQ ID NO: 1449303 - RNA, 14 nt, Pseudomonas aeruginosa PA01
ccacgaggaugucg

SEQ ID NO: 1449304 - RNA, 16 nt, Pseudomonas aeruginosa PA01
ccacgaggaugucggc

SEQ ID NO: 1449305 - RNA, 13 nt, Pseudomonas aeruginosa PA01
ccacgccgucgcc

SEQ ID NO: 1449306 - RNA, 15 nt, Pseudomonas aeruginosa PA01
ccacgccuucgcggc

SEQ ID NO: 1449307 - RNA, 17 nt, Pseudomonas aeruginosa PA01
ccacgccuucgcggccg

SEQ ID NO: 1449308 - RNA, 12 nt, Pseudomonas aeruginosa PA01
ccacgccuggcc

SEQ ID NO: 1449309 - RNA, 12 nt, Pseudomonas aeruginosa PA01
ccacgcgaccag

SEQ ID NO: 1449310 - RNA, 13 nt, Pseudomonas aeruginosa PA01
ccacgcgaccagc

SEQ ID NO: 1449311 - RNA, 15 nt, Pseudomonas aeruginosa PA01
ccacgcgaccagcgc

SEQ ID NO: 1449312 - RNA, 19 nt, Pseudomonas aeruginosa PA01
ccacgcgaccagcgccagg

SEQ ID NO: 1449313 - RNA, 19 nt, Pseudomonas aeruginosa PA01
ccacgcgagaagccgccca

SEQ ID NO: 1449314 - RNA, 16 nt, Pseudomonas aeruginosa PA01
ccacgcgauauccgcc

SEQ ID NO: 1449315 - RNA, 19 nt, Pseudomonas aeruginosa PA01
ccacgcgauauccgccagg

SEQ ID NO: 1449316 - RNA, 13 nt, Pseudomonas aeruginosa PA01
ccacgccggccgg

SEQ ID NO: 1449317 - RNA, 21 nt, Pseudomonas aeruginosa PA01
ccacgccggccggcucagcgc

SEQ ID NO: 1449318 - RNA, 13 nt, Pseudomonas aeruginosa PA01
ccacgccggcgcu

SEQ ID NO: 1449319 - RNA, 17 nt, Pseudomonas aeruginosa PA01
ccacgccgcuggcguug

SEQ ID NO: 1449320 - RNA, 19 nt, Pseudomonas aeruginosa PA01
ccacgccgcugucguccag

SEQ ID NO: 1449321 - RNA, 15 nt, Pseudomonas aeruginosa PA01
ccacggcggccucga

SEQ ID NO: 1449322 - RNA, 13 nt, Pseudomonas aeruginosa PA01
ccacgccugccau

SEQ ID NO: 1449323 - RNA, 16 nt, Pseudomonas aeruginosa PA01
ccacgcgcaagccagc

SEQ ID NO: 1449324 - RNA, 23 nt, Pseudomonas aeruginosa PA01
ccacgcggugccauucggugcgc

SEQ ID NO: 1449325 - RNA, 14 nt, Pseudomonas aeruginosa PA01
ccaccgacccucgg

SEQ ID NO: 1449326 - RNA, 18 nt, Pseudomonas aeruginosa PA01
ccaccgacccucggcgag

SEQ ID NO: 1449327 - RNA, 19 nt, Pseudomonas aeruginosa PA01
ccaccgacaggccgaccag

SEQ ID NO: 1449328 - RNA, 20 nt, Pseudomonas aeruginosa PA01
ccaccgacaggccgaccagc

SEQ ID NO: 1449329 - RNA, 17 nt, Pseudomonas aeruginosa PA01
ccaccgaaucggacagg

SEQ ID NO: 1449330 - RNA, 20 nt, Pseudomonas aeruginosa PA01
ccacccgaaagccgaagcgc

SEQ ID NO: 1449331 - RNA, 13 nt, Pseudomonas aeruginosa PA01
ccaccccgcuccg

SEQ ID NO: 1449332 - RNA, 13 nt, Pseudomonas aeruginosa PA01
ccaccccggucau

SEQ ID NO: 1449333 - RNA, 17 nt, Pseudomonas aeruginosa PA01
ccacccuugcguccugc

SEQ ID NO: 1449334 - RNA, 17 nt, Pseudomonas aeruginosa PA01
ccacccuuggagccgcc

SEQ ID NO: 1449335 - RNA, 15 nt, Pseudomonas aeruginosa PA01
ccacccgcagccgcg

SEQ ID NO: 1449336 - RNA, 21 nt, Pseudomonas aeruginosa PA01
ccacccgcagccgcgugcgcg

SEQ ID NO: 1449337 - RNA, 22 nt, Pseudomonas aeruginosa PA01
ccaccgguacgcucaccaccac

SEQ ID NO: 1449338 - RNA, 21 nt, Pseudomonas aeruginosa PA01
ccaccgguggcgacgcgcagg

SEQ ID NO: 1449339 - RNA, 18 nt, Pseudomonas aeruginosa PA01
ccaccguggcgacgaugc

SEQ ID NO: 1449340 - RNA, 14 nt, Pseudomonas aeruginosa PA01
ccaccguggcgccg

SEQ ID NO: 1449341 - RNA, 15 nt, Pseudomonas aeruginosa PA01
ccaccguggcgccgg

SEQ ID NO: 1449342 - RNA, 16 nt, Pseudomonas aeruginosa PA01
ccaccguggcgccggc

SEQ ID NO: 1449343 - RNA, 18 nt, Pseudomonas aeruginosa PA01
ccaccguggcgccggcgc

SEQ ID NO: 1449344 - RNA, 21 nt, Pseudomonas aeruginosa PA01
ccaccguggcgccggcgcgcu

SEQ ID NO: 1449345 - RNA, 22 nt, Pseudomonas aeruginosa PA01
ccaccgggugcagguucaccgc

SEQ ID NO: 1449346 - RNA, 15 nt, Pseudomonas aeruginosa PA01
ccaccgggccgucgg

SEQ ID NO: 1449347 - RNA, 16 nt, Pseudomonas aeruginosa PA01
ccaccgggccgucggg

SEQ ID NO: 1449348 - RNA, 17 nt, Pseudomonas aeruginosa PA01
ccaccgggaucagcggc

SEQ ID NO: 1449349 - RNA, 18 nt, Pseudomonas aeruginosa PA01
ccaccgggaucagcggcg

SEQ ID NO: 1449350 - RNA, 23 nt, Pseudomonas aeruginosa PA01
ccaccggcugcauguccgccagu

SEQ ID NO: 1449351 - RNA, 13 nt, Pseudomonas aeruginosa PA01
ccaccggcuggcg

SEQ ID NO: 1449352 - RNA, 15 nt, Pseudomonas aeruginosa PA01
ccaccggcuggcggc

SEQ ID NO: 1449353 - RNA, 19 nt, Pseudomonas aeruginosa PA01
ccaccggcuggcggcucgg

SEQ ID NO: 1449354 - RNA, 19 nt, Pseudomonas aeruginosa PA01
ccaccggcuugccgggugc

SEQ ID NO: 1449355 - RNA, 13 nt, Pseudomonas aeruginosa PA01
ccaccgggaagga

SEQ ID NO: 1449356 - RNA, 14 nt, Pseudomonas aeruginosa PA01
ccacgacgucggcg

SEQ ID NO: 1449357 - RNA, 13 nt, Pseudomonas aeruginosa PA01
ccacgacgcacuc

SEQ ID NO: 1449358 - RNA, 23 nt, Pseudomonas aeruginosa PA01
ccacgacgcacucauagcucagc

SEQ ID NO: 1449359 - RNA, 13 nt, Pseudomonas aeruginosa PA01
ccacgacccgggu

SEQ ID NO: 1449360 - RNA, 13 nt, Pseudomonas aeruginosa PA01
ccacgacccugcu

SEQ ID NO: 1449361 - RNA, 18 nt, Pseudomonas aeruginosa PA01
ccacgacccugcuggccg

SEQ ID NO: 1449362 - RNA, 22 nt, Pseudomonas aeruginosa PA01
ccacgacccugcuggccggugc

SEQ ID NO: 1449363 - RNA, 12 nt, Pseudomonas aeruginosa PA01
ccaccuugccgc

SEQ ID NO: 1449364 - RNA, 15 nt, Pseudomonas aeruginosa PA01
ccaccuugccgcgcc

SEQ ID NO: 1449365 - RNA, 20 nt, Pseudomonas aeruginosa PA01
ccaccuugcgguagcgcucg

SEQ ID NO: 1449366 - RNA, 17 nt, Pseudomonas aeruginosa PA01
ccacgacgaagcgccgg

SEQ ID NO: 1449367 - RNA, 18 nt, Pseudomonas aeruginosa PA01
ccacgacgaagcgccggc

SEQ ID NO: 1449368 - RNA, 12 nt, Pseudomonas aeruginosa PA01
ccaccuguucca

SEQ ID NO: 1449369 - RNA, 15 nt, Pseudomonas aeruginosa PA01
ccaccuguuccacga

SEQ ID NO: 1449370 - RNA, 14 nt, Pseudomonas aeruginosa PA01
ccaccuguuccgcg

SEQ ID NO: 1449371 - RNA, 18 nt, Pseudomonas aeruginosa PA01
ccaccugguucaucgagc

SEQ ID NO: 1449372 - RNA, 14 nt, Pseudomonas aeruginosa PA01
ccaccuucgcccgc

SEQ ID NO: 1449373 - RNA, 16 nt, Pseudomonas aeruginosa PA01
ccaccuggcgcaggua

SEQ ID NO: 1449374 - RNA, 12 nt, Pseudomonas aeruginosa PA01
ccaccuggcggc

SEQ ID NO: 1449375 - RNA, 15 nt, Pseudomonas aeruginosa PA01
ccaccugguagguca

SEQ ID NO: 1449376 - RNA, 19 nt, Pseudomonas aeruginosa PA01
ccaccuguagcagggugcg

SEQ ID NO: 1449377 - RNA, 13 nt, Pseudomonas aeruginosa PA01
ccaccucgacggc

SEQ ID NO: 1449378 - RNA, 17 nt, Pseudomonas aeruginosa PA01
ccaccucgacccuggcg

SEQ ID NO: 1449379 - RNA, 18 nt, Pseudomonas aeruginosa PA01
ccaccucgacccuggcgc

SEQ ID NO: 1449380 - RNA, 15 nt, Pseudomonas aeruginosa PA01
ccagacauccggguc

SEQ ID NO: 1449381 - RNA, 13 nt, Pseudomonas aeruginosa PA01
ccagaccagcagc

SEQ ID NO: 1449382 - RNA, 20 nt, Pseudomonas aeruginosa PA01
ccagaccagcagcggcagcc

SEQ ID NO: 1449383 - RNA, 14 nt, Pseudomonas aeruginosa PA01
ccagaccagcagga

SEQ ID NO: 1449384 - RNA, 21 nt, Pseudomonas aeruginosa PA01
ccagacaggccagcucgcccg

SEQ ID NO: 1449385 - RNA, 14 nt, Pseudomonas aeruginosa PA01
ccagaaugugccgg

SEQ ID NO: 1449386 - RNA, 16 nt, Pseudomonas aeruginosa PA01
ccagaaugugccggua

SEQ ID NO: 1449387 - RNA, 14 nt, Pseudomonas aeruginosa PA01
ccagacuuccgggc

SEQ ID NO: 1449388 - RNA, 15 nt, Pseudomonas aeruginosa PA01
ccagaccuccaggua

SEQ ID NO: 1449389 - RNA, 16 nt, Pseudomonas aeruginosa PA01
ccagaccucgagcagg

SEQ ID NO: 1449390 - RNA, 15 nt, Pseudomonas aeruginosa PA01
ccagaccgcagccgg

SEQ ID NO: 1449391 - RNA, 20 nt, Pseudomonas aeruginosa PA01
ccagaccgagauuggccgcc

SEQ ID NO: 1449392 - RNA, 21 nt, Pseudomonas aeruginosa PA01
ccagaccguggauuucagcag

SEQ ID NO: 1449393 - RNA, 13 nt, Pseudomonas aeruginosa PA01
ccagaccggcagc

SEQ ID NO: 1449394 - RNA, 16 nt, Pseudomonas aeruginosa PA01
ccagaccggcagcgcc

SEQ ID NO: 1449395 - RNA, 22 nt, Pseudomonas aeruginosa PA01
ccagagcaggcggaucgccgcc

SEQ ID NO: 1449396 - RNA, 15 nt, Pseudomonas aeruginosa PA01
ccagagccagccgcg

SEQ ID NO: 1449397 - RNA, 16 nt, Pseudomonas aeruginosa PA01
ccagagccagccgcga

SEQ ID NO: 1449398 - RNA, 20 nt, Pseudomonas aeruginosa PA01
ccagagccaugggccggccg

SEQ ID NO: 1449399 - RNA, 12 nt, Pseudomonas aeruginosa PA01
ccagagccgccg

SEQ ID NO: 1449400 - RNA, 14 nt, Pseudomonas aeruginosa PA01
ccagagcgcugccu

SEQ ID NO: 1449401 - RNA, 20 nt, Pseudomonas aeruginosa PA01
ccagagaucgcccagcggcu

SEQ ID NO: 1449402 - RNA, 14 nt, Pseudomonas aeruginosa PA01
ccagaggaucggcc

SEQ ID NO: 1449403 - RNA, 15 nt, Pseudomonas aeruginosa PA01
ccagagccgcucggc

SEQ ID NO: 1449404 - RNA, 16 nt, Pseudomonas aeruginosa PA01
ccagagccgcucggcg

SEQ ID NO: 1449405 - RNA, 22 nt, Pseudomonas aeruginosa PA01
ccagagcgcgcccugcaggccg

SEQ ID NO: 1449406 - RNA, 23 nt, Pseudomonas aeruginosa PA01
ccagagcgcgcccugcaggccga

SEQ ID NO: 1449407 - RNA, 17 nt, Pseudomonas aeruginosa PA01
ccagagcagcaccagca

SEQ ID NO: 1449408 - RNA, 19 nt, Pseudomonas aeruginosa PA01
ccagagcagcaccagcacc

SEQ ID NO: 1449409 - RNA, 13 nt, Pseudomonas aeruginosa PA01
ccagagcaccagg

SEQ ID NO: 1449410 - RNA, 20 nt, Pseudomonas aeruginosa PA01
ccagcaaugcccgcgccugg

SEQ ID NO: 1449411 - RNA, 16 nt, Pseudomonas aeruginosa PA01
ccagcaaugccagcgc

SEQ ID NO: 1449412 - RNA, 18 nt, Pseudomonas aeruginosa PA01
ccagcaaugcccagcgca

SEQ ID NO: 1449413 - RNA, 22 nt, Pseudomonas aeruginosa PA01
ccagcaauuccacgcgacagcg

SEQ ID NO: 1449414 - RNA, 21 nt, Pseudomonas aeruginosa PA01
ccagcaacgugaagcccuucu

SEQ ID NO: 1449415 - RNA, 21 nt, Pseudomonas aeruginosa PA01
ccagcaacugaccuggccguc

SEQ ID NO: 1449416 - RNA, 23 nt, Pseudomonas aeruginosa PA01
ccagcaagccguagaacgccagg

SEQ ID NO: 1449417 - RNA, 20 nt, Pseudomonas aeruginosa PA01
ccagcaaggcgucauagcag

SEQ ID NO: 1449418 - RNA, 12 nt, Pseudomonas aeruginosa PA01
ccagaguucgcc

SEQ ID NO: 1449419 - RNA, 17 nt, Pseudomonas aeruginosa PA01
ccagaguucgcccagcu

SEQ ID NO: 1449420 - RNA, 20 nt, Pseudomonas aeruginosa PA01
ccagaguucgcccagcucgc

SEQ ID NO: 1449421 - RNA, 22 nt, Pseudomonas aeruginosa PA01
ccagaguucgcccagcucgccg

SEQ ID NO: 1449422 - RNA, 18 nt, Pseudomonas aeruginosa PA01
ccagagugcgcagcagcg

SEQ ID NO: 1449423 - RNA, 21 nt, Pseudomonas aeruginosa PA01
ccagagugcgcagcagcgucg

SEQ ID NO: 1449424 - RNA, 13 nt, Pseudomonas aeruginosa PA01
ccagcaacgccgc

SEQ ID NO: 1449425 - RNA, 15 nt, Pseudomonas aeruginosa PA01
ccagcaacgccgccc

SEQ ID NO: 1449426 - RNA, 14 nt, Pseudomonas aeruginosa PA01
ccagcaacgccucg

SEQ ID NO: 1449427 - RNA, 16 nt, Pseudomonas aeruginosa PA01
ccagauagugcggcca

SEQ ID NO: 1449428 - RNA, 20 nt, Pseudomonas aeruginosa PA01
ccagauagugcggccaggcg

SEQ ID NO: 1449429 - RNA, 16 nt, Pseudomonas aeruginosa PA01
ccagauauccagggcc

SEQ ID NO: 1449430 - RNA, 14 nt, Pseudomonas aeruginosa PA01
ccacugacgcgcag

SEQ ID NO: 1449431 - RNA, 19 nt, Pseudomonas aeruginosa PA01
ccacugacgcgcagcgccg

SEQ ID NO: 1449432 - RNA, 23 nt, Pseudomonas aeruginosa PA01
ccacugacgcgcagcgccgccgc

SEQ ID NO: 1449433 - RNA, 22 nt, Pseudomonas aeruginosa PA01
ccacuaucgccaacgccaccgc

SEQ ID NO: 1449434 - RNA, 18 nt, Pseudomonas aeruginosa PA01
ccacuucguccggccgcc

SEQ ID NO: 1449435 - RNA, 16 nt, Pseudomonas aeruginosa PA01
ccacugauaccgcugg

SEQ ID NO: 1449436 - RNA, 17 nt, Pseudomonas aeruginosa PA01
ccacuuccggcccggcc

SEQ ID NO: 1449437 - RNA, 22 nt, Pseudomonas aeruginosa PA01
ccacugccgccucagcgaaacu

SEQ ID NO: 1449438 - RNA, 17 nt, Pseudomonas aeruginosa PA01
ccagaagucgcuggccu

SEQ ID NO: 1449439 - RNA, 19 nt, Pseudomonas aeruginosa PA01
ccacuugccgccgccggag

SEQ ID NO: 1449440 - RNA, 14 nt, Pseudomonas aeruginosa PA01
ccacuugcgccggc

SEQ ID NO: 1449441 - RNA, 15 nt, Pseudomonas aeruginosa PA01
ccacguacuccagca

SEQ ID NO: 1449442 - RNA, 13 nt, Pseudomonas aeruginosa PA01
ccacguacagcgc

SEQ ID NO: 1449443 - RNA, 14 nt, Pseudomonas aeruginosa PA01
ccacguacagcgcg

SEQ ID NO: 1449444 - RNA, 17 nt, Pseudomonas aeruginosa PA01
ccacguacagcgcgaca

SEQ ID NO: 1449445 - RNA, 14 nt, Pseudomonas aeruginosa PA01
ccacguagccggcg

SEQ ID NO: 1449446 - RNA, 22 nt, Pseudomonas aeruginosa PA01
ccacguagccggcguccgccgg

SEQ ID NO: 1449447 - RNA, 17 nt, Pseudomonas aeruginosa PA01
ccacguaguaggcgcgg

SEQ ID NO: 1449448 - RNA, 22 nt, Pseudomonas aeruginosa PA01
ccacgguguugccguggucgcg

SEQ ID NO: 1449449 - RNA, 14 nt, Pseudomonas aeruginosa PA01
ccacgggaauggcg

SEQ ID NO: 1449450 - RNA, 15 nt, Pseudomonas aeruginosa PA01
ccacgggcaguucca

SEQ ID NO: 1449451 - RNA, 17 nt, Pseudomonas aeruginosa PA01
ccacguccuccaggcuc

SEQ ID NO: 1449452 - RNA, 19 nt, Pseudomonas aeruginosa PA01
ccacguugcaguccaggcc

SEQ ID NO: 1449453 - RNA, 15 nt, Pseudomonas aeruginosa PA01
ccacguugcgccgca

SEQ ID NO: 1449454 - RNA, 21 nt, Pseudomonas aeruginosa PA01
ccacgucgccccagggaaucg

SEQ ID NO: 1449455 - RNA, 14 nt, Pseudomonas aeruginosa PA01
ccacguucggcgcg

SEQ ID NO: 1449456 - RNA, 15 nt, Pseudomonas aeruginosa PA01
ccagccgucgucguc

SEQ ID NO: 1449457 - RNA, 12 nt, Pseudomonas aeruginosa PA01
ccagccguccgc

SEQ ID NO: 1449458 - RNA, 23 nt, Pseudomonas aeruginosa PA01
ccagccucauucgcucugcgcca

SEQ ID NO: 1449459 - RNA, 13 nt, Pseudomonas aeruginosa PA01
ccagccucggcag

SEQ ID NO: 1449460 - RNA, 18 nt, Pseudomonas aeruginosa PA01
ccagccucggcagggcgc

SEQ ID NO: 1449461 - RNA, 23 nt, Pseudomonas aeruginosa PA01
ccagccgugggcguagagccugg

SEQ ID NO: 1449462 - RNA, 15 nt, Pseudomonas aeruginosa PA01
ccagcgaguagucgc

SEQ ID NO: 1449463 - RNA, 15 nt, Pseudomonas aeruginosa PA01
ccagcgagucgaccc

SEQ ID NO: 1449464 - RNA, 13 nt, Pseudomonas aeruginosa PA01
ccagcgaggcgug

SEQ ID NO: 1449465 - RNA, 21 nt, Pseudomonas aeruginosa PA01
ccagcgaaagcgucagcgcgc

SEQ ID NO: 1449466 - RNA, 15 nt, Pseudomonas aeruginosa PA01
ccagccuucccggcg

SEQ ID NO: 1449467 - RNA, 16 nt, Pseudomonas aeruginosa PA01
ccagccuucccggcgc

SEQ ID NO: 1449468 - RNA, 18 nt, Pseudomonas aeruginosa PA01
ccagcgaacccaggccgc

SEQ ID NO: 1449469 - RNA, 18 nt, Pseudomonas aeruginosa PA01
ccagcgagccgaucacca

SEQ ID NO: 1449470 - RNA, 19 nt, Pseudomonas aeruginosa PA01
ccagcgagccgaucaccag

SEQ ID NO: 1449471 - RNA, 13 nt, Pseudomonas aeruginosa PA01
ccagccgcgcggc

SEQ ID NO: 1449472 - RNA, 15 nt, Pseudomonas aeruginosa PA01
ccagccgcggccguu

SEQ ID NO: 1449473 - RNA, 13 nt, Pseudomonas aeruginosa PA01
ccagccgcucgcg

SEQ ID NO: 1449474 - RNA, 16 nt, Pseudomonas aeruginosa PA01
ccagccgacuggcggu

SEQ ID NO: 1449475 - RNA, 14 nt, Pseudomonas aeruginosa PA01
ccagccgagcaacu

SEQ ID NO: 1449476 - RNA, 22 nt, Pseudomonas aeruginosa PA01
ccagccgagcaacucggcggcg

SEQ ID NO: 1449477 - RNA, 16 nt, Pseudomonas aeruginosa PA01
ccagccgaggcagccg

SEQ ID NO: 1449478 - RNA, 17 nt, Pseudomonas aeruginosa PA01
ccagccgaggcagccgu

SEQ ID NO: 1449479 - RNA, 12 nt, Pseudomonas aeruginosa PA01
ccagccgcgcgc

SEQ ID NO: 1449480 - RNA, 19 nt, Pseudomonas aeruginosa PA01
ccagccggcauccagcauc

SEQ ID NO: 1449481 - RNA, 14 nt, Pseudomonas aeruginosa PA01
ccagccggccaucc

SEQ ID NO: 1449482 - RNA, 21 nt, Pseudomonas aeruginosa PA01
ccagccggccauccagccagg

SEQ ID NO: 1449483 - RNA, 14 nt, Pseudomonas aeruginosa PA01
ccagccggcaagcg

SEQ ID NO: 1449484 - RNA, 21 nt, Pseudomonas aeruginosa PA01
ccagccggcaagcgugccccg

SEQ ID NO: 1449485 - RNA, 17 nt, Pseudomonas aeruginosa PA01
ccagccgcucgcguccg

SEQ ID NO: 1449486 - RNA, 21 nt, Pseudomonas aeruginosa PA01
ccagccgcucgcguccgcagu

SEQ ID NO: 1449487 - RNA, 17 nt, Pseudomonas aeruginosa PA01
ccagccgcuuccggcgc

SEQ ID NO: 1449488 - RNA, 13 nt, Pseudomonas aeruginosa PA01
ccagccggagaga

SEQ ID NO: 1449489 - RNA, 20 nt, Pseudomonas aeruginosa PA01
ccagccgaacaguucggcgg

SEQ ID NO: 1449490 - RNA, 16 nt, Pseudomonas aeruginosa PA01
ccagcccuucgacguc

SEQ ID NO: 1449491 - RNA, 22 nt, Pseudomonas aeruginosa PA01
ccagcccuggaaaggccucggc

SEQ ID NO: 1449492 - RNA, 13 nt, Pseudomonas aeruginosa PA01
ccagcccuggcgc

SEQ ID NO: 1449493 - RNA, 16 nt, Pseudomonas aeruginosa PA01
ccagcccuggcgcaga

SEQ ID NO: 1449494 - RNA, 14 nt, Pseudomonas aeruginosa PA01
ccagcccuggcgcg

SEQ ID NO: 1449495 - RNA, 17 nt, Pseudomonas aeruginosa PA01
ccagcccuggcgcggca

SEQ ID NO: 1449496 - RNA, 12 nt, Pseudomonas aeruginosa PA01
ccagccagcccg

SEQ ID NO: 1449497 - RNA, 15 nt, Pseudomonas aeruginosa PA01
ccagccaggcggcca

SEQ ID NO: 1449498 - RNA, 20 nt, Pseudomonas aeruginosa PA01
ccagccaggcgcucucgccg

SEQ ID NO: 1449499 - RNA, 22 nt, Pseudomonas aeruginosa PA01
ccagccaggcgcucucgccgcc

SEQ ID NO: 1449500 - RNA, 22 nt, Pseudomonas aeruginosa PA01
ccagcccguagucguucagcgc

SEQ ID NO: 1449501 - RNA, 11 nt, Pseudomonas aeruginosa PA01
ccagccagguc

SEQ ID NO: 1449502 - RNA, 13 nt, Pseudomonas aeruginosa PA01
ccagccaggucgg

SEQ ID NO: 1449503 - RNA, 12 nt, Pseudomonas aeruginosa PA01
ccagccaggcga

SEQ ID NO: 1449504 - RNA, 20 nt, Pseudomonas aeruginosa PA01
ccagccaggaagagcccgcc

SEQ ID NO: 1449505 - RNA, 21 nt, Pseudomonas aeruginosa PA01
ccagccaggaagagcccgcca

SEQ ID NO: 1449506 - RNA, 22 nt, Pseudomonas aeruginosa PA01
ccagccaggaagagcccgccac

SEQ ID NO: 1449507 - RNA, 23 nt, Pseudomonas aeruginosa PA01
ccagccaggacaauggacaagcg

SEQ ID NO: 1449508 - RNA, 21 nt, Pseudomonas aeruginosa PA01
ccagcgccgucaccagcagcc

SEQ ID NO: 1449509 - RNA, 11 nt, Pseudomonas aeruginosa PA01
ccagcgccgcg

SEQ ID NO: 1449510 - RNA, 20 nt, Pseudomonas aeruginosa PA01
ccagcgccgccucgaaggcc

SEQ ID NO: 1449511 - RNA, 14 nt, Pseudomonas aeruginosa PA01
ccagcgccgccugc

SEQ ID NO: 1449512 - RNA, 14 nt, Pseudomonas aeruginosa PA01
ccagcgccgccgcg

SEQ ID NO: 1449513 - RNA, 18 nt, Pseudomonas aeruginosa PA01
ccagcgccgccgcugcgu

SEQ ID NO: 1449514 - RNA, 12 nt, Pseudomonas aeruginosa PA01
ccagcgccgccg

SEQ ID NO: 1449515 - RNA, 20 nt, Pseudomonas aeruginosa PA01
ccagcgccacggcgaucgcc

SEQ ID NO: 1449516 - RNA, 15 nt, Pseudomonas aeruginosa PA01
ccagcgccaggagca

SEQ ID NO: 1449517 - RNA, 21 nt, Pseudomonas aeruginosa PA01
ccagcgccaggagcagggcgc

SEQ ID NO: 1449518 - RNA, 15 nt, Pseudomonas aeruginosa PA01
ccagcgccaggccgc

SEQ ID NO: 1449519 - RNA, 18 nt, Pseudomonas aeruginosa PA01
ccagcgccaggccgccga

SEQ ID NO: 1449520 - RNA, 15 nt, Pseudomonas aeruginosa PA01
ccagcgccaggcgcg

SEQ ID NO: 1449521 - RNA, 15 nt, Pseudomonas aeruginosa PA01
ccagcgccacgccgc

SEQ ID NO: 1449522 - RNA, 18 nt, Pseudomonas aeruginosa PA01
ccagcgccacgccgcugu

SEQ ID NO: 1449523 - RNA, 17 nt, Pseudomonas aeruginosa PA01
ccagcgccacuuccagg

SEQ ID NO: 1449524 - RNA, 13 nt, Pseudomonas aeruginosa PA01
ccagcgccaccag

SEQ ID NO: 1449525 - RNA, 14 nt, Pseudomonas aeruginosa PA01
ccagcgccaccagc

SEQ ID NO: 1449526 - RNA, 23 nt, Pseudomonas aeruginosa PA01
ccagcgccaccagcagggccagg

SEQ ID NO: 1449527 - RNA, 21 nt, Pseudomonas aeruginosa PA01
ccagcgcggcgccccaggcgc

SEQ ID NO: 1449528 - RNA, 24 nt, Pseudomonas aeruginosa PA01
ccagcgcgucgaccaccgcguggu

SEQ ID NO: 1449529 - RNA, 18 nt, Pseudomonas aeruginosa PA01
ccagcgcgucggcacgcc

SEQ ID NO: 1449530 - RNA, 12 nt, Pseudomonas aeruginosa PA01
ccagcgcgugca

SEQ ID NO: 1449531 - RNA, 19 nt, Pseudomonas aeruginosa PA01
ccagcgcgugcaggcgccc

SEQ ID NO: 1449532 - RNA, 14 nt, Pseudomonas aeruginosa PA01
ccagcgccuggcgc

SEQ ID NO: 1449533 - RNA, 15 nt, Pseudomonas aeruginosa PA01
ccagcgcgcgccgac

SEQ ID NO: 1449534 - RNA, 14 nt, Pseudomonas aeruginosa PA01
ccagcgcggccgcc

SEQ ID NO: 1449535 - RNA, 16 nt, Pseudomonas aeruginosa PA01
ccagcgcggccgccgc

SEQ ID NO: 1449536 - RNA, 16 nt, Pseudomonas aeruginosa PA01
ccagcgcgcucuucgc

SEQ ID NO: 1449537 - RNA, 23 nt, Pseudomonas aeruginosa PA01
ccagcgcgcucuucgccgcggcg

SEQ ID NO: 1449538 - RNA, 15 nt, Pseudomonas aeruginosa PA01
ccagcgccucgccga

SEQ ID NO: 1449539 - RNA, 17 nt, Pseudomonas aeruginosa PA01
ccagcgccucgccgagc

SEQ ID NO: 1449540 - RNA, 18 nt, Pseudomonas aeruginosa PA01
ccagcgccugggccgcgc

SEQ ID NO: 1449541 - RNA, 17 nt, Pseudomonas aeruginosa PA01
ccagcgcgagcguucca

SEQ ID NO: 1449542 - RNA, 22 nt, Pseudomonas aeruginosa PA01
ccagcgcgauacccuggccggc

SEQ ID NO: 1449543 - RNA, 23 nt, Pseudomonas aeruginosa PA01
ccagcgcgauacccuggccggcc

SEQ ID NO: 1449544 - RNA, 14 nt, Pseudomonas aeruginosa PA01
ccagcgcgcgcugg

SEQ ID NO: 1449545 - RNA, 17 nt, Pseudomonas aeruginosa PA01
ccagcgcgcgcuggcgc

SEQ ID NO: 1449546 - RNA, 20 nt, Pseudomonas aeruginosa PA01
ccagcgcgcgcuggcgcagc

SEQ ID NO: 1449547 - RNA, 16 nt, Pseudomonas aeruginosa PA01
ccagcgccucgaccag

SEQ ID NO: 1449548 - RNA, 22 nt, Pseudomonas aeruginosa PA01
ccagcgccucgaccagaucggc

SEQ ID NO: 1449549 - RNA, 15 nt, Pseudomonas aeruginosa PA01
ccagcgccguucacg

SEQ ID NO: 1449550 - RNA, 20 nt, Pseudomonas aeruginosa PA01
ccagcgccguucacgccugg

SEQ ID NO: 1449551 - RNA, 17 nt, Pseudomonas aeruginosa PA01
ccagcgccucgggccgg

SEQ ID NO: 1449552 - RNA, 21 nt, Pseudomonas aeruginosa PA01
ccagcgccugcaaagaggcgc

SEQ ID NO: 1449553 - RNA, 18 nt, Pseudomonas aeruginosa PA01
ccagcagcaacagcgccg

SEQ ID NO: 1449554 - RNA, 19 nt, Pseudomonas aeruginosa PA01
ccagcagcaacagcgccgc

SEQ ID NO: 1449555 - RNA, 21 nt, Pseudomonas aeruginosa PA01
ccagcagacggcuguugucga

SEQ ID NO: 1449556 - RNA, 11 nt, Pseudomonas aeruginosa PA01
ccagcagcacg

SEQ ID NO: 1449557 - RNA, 23 nt, Pseudomonas aeruginosa PA01
ccagcagcacgcccugggacagg

SEQ ID NO: 1449558 - RNA, 12 nt, Pseudomonas aeruginosa PA01
ccagcagcaggc

SEQ ID NO: 1449559 - RNA, 13 nt, Pseudomonas aeruginosa PA01
ccagcagcaggcc

SEQ ID NO: 1449560 - RNA, 14 nt, Pseudomonas aeruginosa PA01
ccagcagcaggccg

SEQ ID NO: 1449561 - RNA, 18 nt, Pseudomonas aeruginosa PA01
ccagcagcaggccggcga

SEQ ID NO: 1449562 - RNA, 19 nt, Pseudomonas aeruginosa PA01
ccagcagcaggccggcgac

SEQ ID NO: 1449563 - RNA, 12 nt, Pseudomonas aeruginosa PA01
ccagcagcaggu

SEQ ID NO: 1449564 - RNA, 18 nt, Pseudomonas aeruginosa PA01
ccagcacucgcuccuccg

SEQ ID NO: 1449565 - RNA, 15 nt, Pseudomonas aeruginosa PA01
ccagcacggcgcagg

SEQ ID NO: 1449566 - RNA, 17 nt, Pseudomonas aeruginosa PA01
ccagcacggcgcagggc

SEQ ID NO: 1449567 - RNA, 22 nt, Pseudomonas aeruginosa PA01
ccagcacggugaaccaggcgcc

SEQ ID NO: 1449568 - RNA, 20 nt, Pseudomonas aeruginosa PA01
ccagcacggugcuggcgucg

SEQ ID NO: 1449569 - RNA, 15 nt, Pseudomonas aeruginosa PA01
aaauacucgucgacg

SEQ ID NO: 1449570 - RNA, 19 nt, Pseudomonas aeruginosa PA01
ccagcacguugccauccag

SEQ ID NO: 1449571 - RNA, 22 nt, Pseudomonas aeruginosa PA01
ccagcacguugccauccagcgc

SEQ ID NO: 1449572 - RNA, 15 nt, Pseudomonas aeruginosa PA01
ccagcacuacgccca

SEQ ID NO: 1449573 - RNA, 17 nt, Pseudomonas aeruginosa PA01
ccagcacggaugcccag

SEQ ID NO: 1449574 - RNA, 13 nt, Pseudomonas aeruginosa PA01
ccagcacgcccuu

SEQ ID NO: 1449575 - RNA, 15 nt, Pseudomonas aeruginosa PA01
ccagcacgccgagca

SEQ ID NO: 1449576 - RNA, 17 nt, Pseudomonas aeruginosa PA01
ccagcacgccgaucccg

SEQ ID NO: 1449577 - RNA, 22 nt, Pseudomonas aeruginosa PA01
ccagcacgccgaucccgaucgg

SEQ ID NO: 1449578 - RNA, 17 nt, Pseudomonas aeruginosa PA01
ccagcacgcggagggcg

SEQ ID NO: 1449579 - RNA, 13 nt, Pseudomonas aeruginosa PA01
ccagcaccacccg

SEQ ID NO: 1449580 - RNA, 14 nt, Pseudomonas aeruginosa PA01
ccagcaccacccgg

SEQ ID NO: 1449581 - RNA, 18 nt, Pseudomonas aeruginosa PA01
ccagcaccacccggccgc

SEQ ID NO: 1449582 - RNA, 16 nt, Pseudomonas aeruginosa PA01
ccagcaccacccggcg

SEQ ID NO: 1449583 - RNA, 18 nt, Pseudomonas aeruginosa PA01
ccagcaccacccggcgca

SEQ ID NO: 1449584 - RNA, 22 nt, Pseudomonas aeruginosa PA01
ccagcaccacccggcgcacgcc

SEQ ID NO: 1449585 - RNA, 20 nt, Pseudomonas aeruginosa PA01
ccagcaccgagcugaucgcg

SEQ ID NO: 1449586 - RNA, 14 nt, Pseudomonas aeruginosa PA01
ccagcaccgcaagg

SEQ ID NO: 1449587 - RNA, 18 nt, Pseudomonas aeruginosa PA01
ccagcaccgccuggcgca

SEQ ID NO: 1449588 - RNA, 16 nt, Pseudomonas aeruginosa PA01
ccagcaccggcggcgc

SEQ ID NO: 1449589 - RNA, 16 nt, Pseudomonas aeruginosa PA01
ccagcagcccggccug

SEQ ID NO: 1449590 - RNA, 13 nt, Pseudomonas aeruginosa PA01
ccagcagccccga

SEQ ID NO: 1449591 - RNA, 17 nt, Pseudomonas aeruginosa PA01
ccagcagccccgaggcc

SEQ ID NO: 1449592 - RNA, 20 nt, Pseudomonas aeruginosa PA01
ccagcagccccgaggccagc

SEQ ID NO: 1449593 - RNA, 22 nt, Pseudomonas aeruginosa PA01
ccagcagccccgaggccagcag

SEQ ID NO: 1449594 - RNA, 13 nt, Pseudomonas aeruginosa PA01
ccagcagcgccga

SEQ ID NO: 1449595 - RNA, 13 nt, Pseudomonas aeruginosa PA01
ccagcagcgccuc

SEQ ID NO: 1449596 - RNA, 21 nt, Pseudomonas aeruginosa PA01
ccagcagcgccuccucuacca

SEQ ID NO: 1449597 - RNA, 12 nt, Pseudomonas aeruginosa PA01
ccagcagcggca

SEQ ID NO: 1449598 - RNA, 21 nt, Pseudomonas aeruginosa PA01
ccagcagcggcagccacucgg

SEQ ID NO: 1449599 - RNA, 22 nt, Pseudomonas aeruginosa PA01
ccagcaggaaaacgcucaggcc

SEQ ID NO: 1449600 - RNA, 15 nt, Pseudomonas aeruginosa PA01
ccagcagcggcggcg

SEQ ID NO: 1449601 - RNA, 22 nt, Pseudomonas aeruginosa PA01
ccagcagcggcggcgccggcag

SEQ ID NO: 1449602 - RNA, 23 nt, Pseudomonas aeruginosa PA01
ccagcagcggcggcgccggcagg

SEQ ID NO: 1449603 - RNA, 14 nt, Pseudomonas aeruginosa PA01
ccagcaggaccugg

SEQ ID NO: 1449604 - RNA, 22 nt, Pseudomonas aeruginosa PA01
ccagcaggaccuggccguuggc

SEQ ID NO: 1449605 - RNA, 16 nt, Pseudomonas aeruginosa PA01
ccagcaggaagccgac

SEQ ID NO: 1449606 - RNA, 14 nt, Pseudomonas aeruginosa PA01
ccagcaggacgucg

SEQ ID NO: 1449607 - RNA, 18 nt, Pseudomonas aeruginosa PA01
ccagcaggacgucgaggu

SEQ ID NO: 1449608 - RNA, 12 nt, Pseudomonas aeruginosa PA01
ccagcaggaucg

SEQ ID NO: 1449609 - RNA, 21 nt, Pseudomonas aeruginosa PA01
ccagcaggaucgacagcagcg

SEQ ID NO: 1449610 - RNA, 14 nt, Pseudomonas aeruginosa PA01
ccagcaggaucgag

SEQ ID NO: 1449611 - RNA, 15 nt, Pseudomonas aeruginosa PA01
ccagcaggaucgagc

SEQ ID NO: 1449612 - RNA, 14 nt, Pseudomonas aeruginosa PA01
ccagcaggaucgga

SEQ ID NO: 1449613 - RNA, 20 nt, Pseudomonas aeruginosa PA01
ccagcaggccagccaacugc

SEQ ID NO: 1449614 - RNA, 12 nt, Pseudomonas aeruginosa PA01
ccagcaggcagg

SEQ ID NO: 1449615 - RNA, 16 nt, Pseudomonas aeruginosa PA01
ccagcaggcaggcgcg

SEQ ID NO: 1449616 - RNA, 17 nt, Pseudomonas aeruginosa PA01
ccagcaggcaggcgcgg

SEQ ID NO: 1449617 - RNA, 21 nt, Pseudomonas aeruginosa PA01
ccagcaggcaggcgcggguca

SEQ ID NO: 1449618 - RNA, 23 nt, Pseudomonas aeruginosa PA01
ccagcaggcguugcagugcgccg

SEQ ID NO: 1449619 - RNA, 19 nt, Pseudomonas aeruginosa PA01
ccagcaggcucaucgcccg

SEQ ID NO: 1449620 - RNA, 20 nt, Pseudomonas aeruginosa PA01
ccagcaggcucaucgcccgc

SEQ ID NO: 1449621 - RNA, 20 nt, Pseudomonas aeruginosa PA01
ccagcaggcucuuggucgcg

SEQ ID NO: 1449622 - RNA, 16 nt, Pseudomonas aeruginosa PA01
ccagcaggcuggcggc

SEQ ID NO: 1449623 - RNA, 15 nt, Pseudomonas aeruginosa PA01
ccagcaggcgcucgg

SEQ ID NO: 1449624 - RNA, 16 nt, Pseudomonas aeruginosa PA01
ccagcaggcgcucggc

SEQ ID NO: 1449625 - RNA, 19 nt, Pseudomonas aeruginosa PA01
ccagcaggcgcucggcgac

SEQ ID NO: 1449626 - RNA, 20 nt, Pseudomonas aeruginosa PA01
ccagcaggcgcucggcgacg

SEQ ID NO: 1449627 - RNA, 17 nt, Pseudomonas aeruginosa PA01
ccagcaggccggccagc

SEQ ID NO: 1449628 - RNA, 16 nt, Pseudomonas aeruginosa PA01
ccagcaggccgaaggc

SEQ ID NO: 1449629 - RNA, 14 nt, Pseudomonas aeruginosa PA01
ccagcaggccgagc

SEQ ID NO: 1449630 - RNA, 13 nt, Pseudomonas aeruginosa PA01
ccagcaggccgau

SEQ ID NO: 1449631 - RNA, 17 nt, Pseudomonas aeruginosa PA01
ccagcaggccgaucagc

SEQ ID NO: 1449632 - RNA, 20 nt, Pseudomonas aeruginosa PA01
ccagcaggccgaucagcggc

SEQ ID NO: 1449633 - RNA, 21 nt, Pseudomonas aeruginosa PA01
ccagcaggccgaucagcggcg

SEQ ID NO: 1449634 - RNA, 19 nt, Pseudomonas aeruginosa PA01
ccagcaggcgauacaccgc

SEQ ID NO: 1449635 - RNA, 17 nt, Pseudomonas aeruginosa PA01
ccagcaggcgcagcagc

SEQ ID NO: 1449636 - RNA, 21 nt, Pseudomonas aeruginosa PA01
ccagcaggcgcagcagcgacu

SEQ ID NO: 1449637 - RNA, 14 nt, Pseudomonas aeruginosa PA01
ccagcaggcgcagg

SEQ ID NO: 1449638 - RNA, 16 nt, Pseudomonas aeruginosa PA01
ccagcaggcgcagguc

SEQ ID NO: 1449639 - RNA, 21 nt, Pseudomonas aeruginosa PA01
ccagcaggcgcaggucggccu

SEQ ID NO: 1449640 - RNA, 22 nt, Pseudomonas aeruginosa PA01
ccagcaggcgcaggucggccuc

SEQ ID NO: 1449641 - RNA, 13 nt, Pseudomonas aeruginosa PA01
ccagcaggcgccg

SEQ ID NO: 1449642 - RNA, 19 nt, Pseudomonas aeruginosa PA01
ccagcaggcgccgcgcauc

SEQ ID NO: 1449643 - RNA, 14 nt, Pseudomonas aeruginosa PA01
ccagcaggcgccgg

SEQ ID NO: 1449644 - RNA, 16 nt, Pseudomonas aeruginosa PA01
ccagcaggcgccggcg

SEQ ID NO: 1449645 - RNA, 12 nt, Pseudomonas aeruginosa PA01
ccagcaggcgcg

SEQ ID NO: 1449646 - RNA, 15 nt, Pseudomonas aeruginosa PA01
ccagcaggcgcgccc

SEQ ID NO: 1449647 - RNA, 17 nt, Pseudomonas aeruginosa PA01
ccagcagguacagcagc

SEQ ID NO: 1449648 - RNA, 15 nt, Pseudomonas aeruginosa PA01
ccagcaggguggcca

SEQ ID NO: 1449649 - RNA, 16 nt, Pseudomonas aeruginosa PA01
ccagcagggccagcag

SEQ ID NO: 1449650 - RNA, 18 nt, Pseudomonas aeruginosa PA01
ccagcagggccagcagcg

SEQ ID NO: 1449651 - RNA, 20 nt, Pseudomonas aeruginosa PA01
ccagcagggccagcgccugg

SEQ ID NO: 1449652 - RNA, 14 nt, Pseudomonas aeruginosa PA01
ccagcagggccagg

SEQ ID NO: 1449653 - RNA, 22 nt, Pseudomonas aeruginosa PA01
ccagcagggccaggccgagcgc

SEQ ID NO: 1449654 - RNA, 17 nt, Pseudomonas aeruginosa PA01
ccagcagggccgccgag

SEQ ID NO: 1449655 - RNA, 13 nt, Pseudomonas aeruginosa PA01
ccagcaugcccag

SEQ ID NO: 1449656 - RNA, 21 nt, Pseudomonas aeruginosa PA01
ccagcaugcccagcguggcca

SEQ ID NO: 1449657 - RNA, 17 nt, Pseudomonas aeruginosa PA01
ccagcaugcucgggcug

SEQ ID NO: 1449658 - RNA, 22 nt, Pseudomonas aeruginosa PA01
ccagcauggcgaagcucggccg

SEQ ID NO: 1449659 - RNA, 19 nt, Pseudomonas aeruginosa PA01
ccagcauuaccccgaccag

SEQ ID NO: 1449660 - RNA, 22 nt, Pseudomonas aeruginosa PA01
ccagcauuaccccgaccagguc

SEQ ID NO: 1449661 - RNA, 18 nt, Pseudomonas aeruginosa PA01
ccagccacugcuuggcga

SEQ ID NO: 1449662 - RNA, 16 nt, Pseudomonas aeruginosa PA01
ccagccagccgcgcgc

SEQ ID NO: 1449663 - RNA, 15 nt, Pseudomonas aeruginosa PA01
ccagccagagcagcg

SEQ ID NO: 1449664 - RNA, 15 nt, Pseudomonas aeruginosa PA01
ccagccagcagcccg

SEQ ID NO: 1449665 - RNA, 19 nt, Pseudomonas aeruginosa PA01
ccagccagcagcccggccu

SEQ ID NO: 1449666 - RNA, 17 nt, Pseudomonas aeruginosa PA01
cccgugcaccgaggcgc

SEQ ID NO: 1449667 - RNA, 23 nt, Pseudomonas aeruginosa PA01
cccgugccucggcggacagcccg

SEQ ID NO: 1449668 - RNA, 13 nt, Pseudomonas aeruginosa PA01
cccgugcgccgcg

SEQ ID NO: 1449669 - RNA, 14 nt, Pseudomonas aeruginosa PA01
cccgugcgccgcgg

SEQ ID NO: 1449670 - RNA, 17 nt, Pseudomonas aeruginosa PA01
cccgugcgccgcggguc

SEQ ID NO: 1449671 - RNA, 14 nt, Pseudomonas aeruginosa PA01
cccgugcggcacgc

SEQ ID NO: 1449672 - RNA, 17 nt, Pseudomonas aeruginosa PA01
cccgucucgcugccgaa

SEQ ID NO: 1449673 - RNA, 17 nt, Pseudomonas aeruginosa PA01
cccgucggccucgccga

SEQ ID NO: 1449674 - RNA, 15 nt, Pseudomonas aeruginosa PA01
cccgucgcgccggcc

SEQ ID NO: 1449675 - RNA, 16 nt, Pseudomonas aeruginosa PA01
cccgguuuccgcagcg

SEQ ID NO: 1449676 - RNA, 19 nt, Pseudomonas aeruginosa PA01
cccgguuuccgcagcgcuu

SEQ ID NO: 1449677 - RNA, 16 nt, Pseudomonas aeruginosa PA01
cccguaccagcgcgau

SEQ ID NO: 1449678 - RNA, 14 nt, Pseudomonas aeruginosa PA01
cccgguucagcggg

SEQ ID NO: 1449679 - RNA, 16 nt, Pseudomonas aeruginosa PA01
cccgguucagcgggac

SEQ ID NO: 1449680 - RNA, 14 nt, Pseudomonas aeruginosa PA01
cccgguugaccccg

SEQ ID NO: 1449681 - RNA, 19 nt, Pseudomonas aeruginosa PA01
cccgguucguagaguucgc

SEQ ID NO: 1449682 - RNA, 14 nt, Pseudomonas aeruginosa PA01
cccgguucucgccc

SEQ ID NO: 1449683 - RNA, 13 nt, Pseudomonas aeruginosa PA01
cccucggcggcga

SEQ ID NO: 1449684 - RNA, 14 nt, Pseudomonas aeruginosa PA01
cccucggcggcgag

SEQ ID NO: 1449685 - RNA, 21 nt, Pseudomonas aeruginosa PA01
cccucggccaggaccagggcg

SEQ ID NO: 1449686 - RNA, 12 nt, Pseudomonas aeruginosa PA01
cccucggcgacg

SEQ ID NO: 1449687 - RNA, 19 nt, Pseudomonas aeruginosa PA01
cccucggaugccgcacagg

SEQ ID NO: 1449688 - RNA, 15 nt, Pseudomonas aeruginosa PA01
cccucggcgcccgcc

SEQ ID NO: 1449689 - RNA, 20 nt, Pseudomonas aeruginosa PA01
cccucguugauuccgccgga

SEQ ID NO: 1449690 - RNA, 18 nt, Pseudomonas aeruginosa PA01
cccucucaggagcgccgc

SEQ ID NO: 1449691 - RNA, 20 nt, Pseudomonas aeruginosa PA01
cccucucucgccucggcggg

SEQ ID NO: 1449692 - RNA, 15 nt, Pseudomonas aeruginosa PA01
cccucgggccgcagg

SEQ ID NO: 1449693 - RNA, 14 nt, Pseudomonas aeruginosa PA01
cccucguggcgcga

SEQ ID NO: 1449694 - RNA, 22 nt, Pseudomonas aeruginosa PA01
cccucagggaagaugcacacca

SEQ ID NO: 1449695 - RNA, 14 nt, Pseudomonas aeruginosa PA01
cccucaggucggcg

SEQ ID NO: 1449696 - RNA, 15 nt, Pseudomonas aeruginosa PA01
cccuccagcaccgcc

SEQ ID NO: 1449697 - RNA, 15 nt, Pseudomonas aeruginosa PA01
cccuagaccaacugc

SEQ ID NO: 1449698 - RNA, 14 nt, Pseudomonas aeruginosa PA01
cccucacaccacca

SEQ ID NO: 1449699 - RNA, 21 nt, Pseudomonas aeruginosa PA01
cccucagcggcggugcgccgg

SEQ ID NO: 1449700 - RNA, 22 nt, Pseudomonas aeruginosa PA01
cccucagcggcggugcgccggc

SEQ ID NO: 1449701 - RNA, 19 nt, Pseudomonas aeruginosa PA01
cccucaggauagccggcgc

SEQ ID NO: 1449702 - RNA, 22 nt, Pseudomonas aeruginosa PA01
cccucaggauagccggcgcguu

SEQ ID NO: 1449703 - RNA, 15 nt, Pseudomonas aeruginosa PA01
cccucaggcgccgcu

SEQ ID NO: 1449704 - RNA, 19 nt, Pseudomonas aeruginosa PA01
cccucagagcaugucgaga

SEQ ID NO: 1449705 - RNA, 15 nt, Pseudomonas aeruginosa PA01
cccuagucgagggga

SEQ ID NO: 1449706 - RNA, 14 nt, Pseudomonas aeruginosa PA01
cccuagggucggcg

SEQ ID NO: 1449707 - RNA, 17 nt, Pseudomonas aeruginosa PA01
cccguggcgacgcagca

SEQ ID NO: 1449708 - RNA, 22 nt, Pseudomonas aeruginosa PA01
cccguggcgacgcagcacggcg

SEQ ID NO: 1449709 - RNA, 18 nt, Pseudomonas aeruginosa PA01
cccguggcgccgcagggc

SEQ ID NO: 1449710 - RNA, 11 nt, Pseudomonas aeruginosa PA01
cccguggcgcg

SEQ ID NO: 1449711 - RNA, 13 nt, Pseudomonas aeruginosa PA01
cccguggcgcgga

SEQ ID NO: 1449712 - RNA, 16 nt, Pseudomonas aeruginosa PA01
cccgugguagucgagc

SEQ ID NO: 1449713 - RNA, 21 nt, Pseudomonas aeruginosa PA01
cccgugguccgccagcaggcg

SEQ ID NO: 1449714 - RNA, 21 nt, Pseudomonas aeruginosa PA01
cccuguuucggguccaggcgc

SEQ ID NO: 1449715 - RNA, 17 nt, Pseudomonas aeruginosa PA01
ccgaaaccaggaucgaa

SEQ ID NO: 1449716 - RNA, 15 nt, Pseudomonas aeruginosa PA01
cccuuccagccgccc

SEQ ID NO: 1449717 - RNA, 16 nt, Pseudomonas aeruginosa PA01
cccugguugcggaacg

SEQ ID NO: 1449718 - RNA, 17 nt, Pseudomonas aeruginosa PA01
cccugguugcggaacgg

SEQ ID NO: 1449719 - RNA, 12 nt, Pseudomonas aeruginosa PA01
cccuggucggcg

SEQ ID NO: 1449720 - RNA, 16 nt, Pseudomonas aeruginosa PA01
cccuggucggcggucu

SEQ ID NO: 1449721 - RNA, 23 nt, Pseudomonas aeruginosa PA01
cccugguaguccagcagguggcg

SEQ ID NO: 1449722 - RNA, 18 nt, Pseudomonas aeruginosa PA01
cccuguccccucacggcg

SEQ ID NO: 1449723 - RNA, 19 nt, Pseudomonas aeruginosa PA01
cccuguccccucacggcgc

SEQ ID NO: 1449724 - RNA, 16 nt, Pseudomonas aeruginosa PA01
cccugucccgccgcgc

SEQ ID NO: 1449725 - RNA, 20 nt, Pseudomonas aeruginosa PA01
cccugucuaucugcguaacg

SEQ ID NO: 1449726 - RNA, 16 nt, Pseudomonas aeruginosa PA01
cccugggcgaacagca

SEQ ID NO: 1449727 - RNA, 15 nt, Pseudomonas aeruginosa PA01
cccugggcgaugcgg

SEQ ID NO: 1449728 - RNA, 18 nt, Pseudomonas aeruginosa PA01
cccugggccccggccggc

SEQ ID NO: 1449729 - RNA, 14 nt, Pseudomonas aeruginosa PA01
cccugggcguggca

SEQ ID NO: 1449730 - RNA, 16 nt, Pseudomonas aeruginosa PA01
cccugguacagcgccu

SEQ ID NO: 1449731 - RNA, 14 nt, Pseudomonas aeruginosa PA01
cccuggcgcugucg

SEQ ID NO: 1449732 - RNA, 22 nt, Pseudomonas aeruginosa PA01
cccuggcggauaucgcgccgcg

SEQ ID NO: 1449733 - RNA, 13 nt, Pseudomonas aeruginosa PA01
cccuggcgcggca

SEQ ID NO: 1449734 - RNA, 18 nt, Pseudomonas aeruginosa PA01
cccuggcuuuccagggcc

SEQ ID NO: 1449735 - RNA, 20 nt, Pseudomonas aeruginosa PA01
cccuggcuuuccagggccug

SEQ ID NO: 1449736 - RNA, 19 nt, Pseudomonas aeruginosa PA01
cccugggaauggcggauag

SEQ ID NO: 1449737 - RNA, 14 nt, Pseudomonas aeruginosa PA01
cccugggagccgcc

SEQ ID NO: 1449738 - RNA, 17 nt, Pseudomonas aeruginosa PA01
cccugggaugccgccaa

SEQ ID NO: 1449739 - RNA, 20 nt, Pseudomonas aeruginosa PA01
cccugcacagggacgcggcg

SEQ ID NO: 1449740 - RNA, 18 nt, Pseudomonas aeruginosa PA01
cccugcacccuuggcgca

SEQ ID NO: 1449741 - RNA, 19 nt, Pseudomonas aeruginosa PA01
cccugcacccuuggcgcag

SEQ ID NO: 1449742 - RNA, 20 nt, Pseudomonas aeruginosa PA01
cccugcaccuugggaucguc

SEQ ID NO: 1449743 - RNA, 20 nt, Pseudomonas aeruginosa PA01
cccugcaacacguagcgcag

SEQ ID NO: 1449744 - RNA, 15 nt, Pseudomonas aeruginosa PA01
cccugcaaagcggcg

SEQ ID NO: 1449745 - RNA, 18 nt, Pseudomonas aeruginosa PA01
cccugcaaagcggcgacg

SEQ ID NO: 1449746 - RNA, 20 nt, Pseudomonas aeruginosa PA01
cccugacgaugcagggcugc

SEQ ID NO: 1449747 - RNA, 20 nt, Pseudomonas aeruginosa PA01
cccugaggcuuuccugcgcc

SEQ ID NO: 1449748 - RNA, 23 nt, Pseudomonas aeruginosa PA01
cccugaggcuuuccugcgccucg

SEQ ID NO: 1449749 - RNA, 17 nt, Pseudomonas aeruginosa PA01
cccugacccgcaccggc

SEQ ID NO: 1449750 - RNA, 19 nt, Pseudomonas aeruginosa PA01
cccugacccgcaccggcau

SEQ ID NO: 1449751 - RNA, 14 nt, Pseudomonas aeruginosa PA01
cccugaagggagag

SEQ ID NO: 1449752 - RNA, 14 nt, Pseudomonas aeruginosa PA01
cccugaccgcgagc

SEQ ID NO: 1449753 - RNA, 15 nt, Pseudomonas aeruginosa PA01
cccugaccgcgagcg

SEQ ID NO: 1449754 - RNA, 21 nt, Pseudomonas aeruginosa PA01
cccugaccgcgagcgccgccu

SEQ ID NO: 1449755 - RNA, 17 nt, Pseudomonas aeruginosa PA01
cccugcguggaaccgcg

SEQ ID NO: 1449756 - RNA, 15 nt, Pseudomonas aeruginosa PA01
cccugcuccucgccg

SEQ ID NO: 1449757 - RNA, 14 nt, Pseudomonas aeruginosa PA01
cccugcucgcgcag

SEQ ID NO: 1449758 - RNA, 16 nt, Pseudomonas aeruginosa PA01
cccugcuggccggugc

SEQ ID NO: 1449759 - RNA, 20 nt, Pseudomonas aeruginosa PA01
cccugcuggccggugccgcc

SEQ ID NO: 1449760 - RNA, 16 nt, Pseudomonas aeruginosa PA01
cccuggcgcaggcggc

SEQ ID NO: 1449761 - RNA, 15 nt, Pseudomonas aeruginosa PA01
cccugcugcagggcc

SEQ ID NO: 1449762 - RNA, 17 nt, Pseudomonas aeruginosa PA01
cccugcugcugcucagc

SEQ ID NO: 1449763 - RNA, 21 nt, Pseudomonas aeruginosa PA01
cccugcugcugcucagcgcgc

SEQ ID NO: 1449764 - RNA, 14 nt, Pseudomonas aeruginosa PA01
cccugcaugccggc

SEQ ID NO: 1449765 - RNA, 18 nt, Pseudomonas aeruginosa PA01
cccugccagaggaucggc

SEQ ID NO: 1449766 - RNA, 13 nt, Pseudomonas aeruginosa PA01
cccugcagcgcgc

SEQ ID NO: 1449767 - RNA, 15 nt, Pseudomonas aeruginosa PA01
cccugcagcgcgcgc

SEQ ID NO: 1449768 - RNA, 22 nt, Pseudomonas aeruginosa PA01
cccugcaggccgaauccgccgg

SEQ ID NO: 1449769 - RNA, 23 nt, Pseudomonas aeruginosa PA01
cccugcaggccgaauccgccggc

SEQ ID NO: 1449770 - RNA, 17 nt, Pseudomonas aeruginosa PA01
cccugcggcccgagggc

SEQ ID NO: 1449771 - RNA, 16 nt, Pseudomonas aeruginosa PA01
cccugcggcgccgguu

SEQ ID NO: 1449772 - RNA, 14 nt, Pseudomonas aeruginosa PA01
cccugcggcaggcg

SEQ ID NO: 1449773 - RNA, 15 nt, Pseudomonas aeruginosa PA01
cccugcggcaggcgc

SEQ ID NO: 1449774 - RNA, 19 nt, Pseudomonas aeruginosa PA01
cccugccccuucggcugca

SEQ ID NO: 1449775 - RNA, 17 nt, Pseudomonas aeruginosa PA01
cccugcggauggcgcgg

SEQ ID NO: 1449776 - RNA, 21 nt, Pseudomonas aeruginosa PA01
cccugcggauggcgcggggcc

SEQ ID NO: 1449777 - RNA, 13 nt, Pseudomonas aeruginosa PA01
cccugccccagca

SEQ ID NO: 1449778 - RNA, 16 nt, Pseudomonas aeruginosa PA01
cccugccccagcaucg

SEQ ID NO: 1449779 - RNA, 19 nt, Pseudomonas aeruginosa PA01
cccugccccagcaucgccg

SEQ ID NO: 1449780 - RNA, 14 nt, Pseudomonas aeruginosa PA01
cccggguugcccuc

SEQ ID NO: 1449781 - RNA, 24 nt, Pseudomonas aeruginosa PA01
cccggguugcccucgcagccggcg

SEQ ID NO: 1449782 - RNA, 20 nt, Pseudomonas aeruginosa PA01
cccggguucugcucgaacau

SEQ ID NO: 1449783 - RNA, 22 nt, Pseudomonas aeruginosa PA01
cccgggaucgaugcgcgcccug

SEQ ID NO: 1449784 - RNA, 19 nt, Pseudomonas aeruginosa PA01
cccgggaugcccggccgca

SEQ ID NO: 1449785 - RNA, 19 nt, Pseudomonas aeruginosa PA01
cccgguacagcgccugguc

SEQ ID NO: 1449786 - RNA, 15 nt, Pseudomonas aeruginosa PA01
cccggguuuccugcc

SEQ ID NO: 1449787 - RNA, 16 nt, Pseudomonas aeruginosa PA01
cccggguuuccugccc

SEQ ID NO: 1449788 - RNA, 13 nt, Pseudomonas aeruginosa PA01
cccgguacagcgc

SEQ ID NO: 1449789 - RNA, 16 nt, Pseudomonas aeruginosa PA01
cccggucgagguugcg

SEQ ID NO: 1449790 - RNA, 14 nt, Pseudomonas aeruginosa PA01
cccggucucgcgca

SEQ ID NO: 1449791 - RNA, 17 nt, Pseudomonas aeruginosa PA01
cccggucucgcgcagcg

SEQ ID NO: 1449792 - RNA, 18 nt, Pseudomonas aeruginosa PA01
cccggcgcgaccgucggc

SEQ ID NO: 1449793 - RNA, 21 nt, Pseudomonas aeruginosa PA01
cccggcgcgaccgucggccgg

SEQ ID NO: 1449794 - RNA, 22 nt, Pseudomonas aeruginosa PA01
cccggcgcgaccgucggccggg

SEQ ID NO: 1449795 - RNA, 12 nt, Pseudomonas aeruginosa PA01
cccggcgcgacg

SEQ ID NO: 1449796 - RNA, 16 nt, Pseudomonas aeruginosa PA01
cccggcgcccggcgca

SEQ ID NO: 1449797 - RNA, 12 nt, Pseudomonas aeruginosa PA01
cccggcgccagu

SEQ ID NO: 1449798 - RNA, 20 nt, Pseudomonas aeruginosa PA01
cccggcgaugcugcugauca

SEQ ID NO: 1449799 - RNA, 14 nt, Pseudomonas aeruginosa PA01
cccggcgcacgccg

SEQ ID NO: 1449800 - RNA, 16 nt, Pseudomonas aeruginosa PA01
cccggcgcacgccggc

SEQ ID NO: 1449801 - RNA, 22 nt, Pseudomonas aeruginosa PA01
cccggcgcacgccggccucgcg

SEQ ID NO: 1449802 - RNA, 20 nt, Pseudomonas aeruginosa PA01
cccggcgcagaacugccggg

SEQ ID NO: 1449803 - RNA, 19 nt, Pseudomonas aeruginosa PA01
cccggcgcaugccgcagga

SEQ ID NO: 1449804 - RNA, 20 nt, Pseudomonas aeruginosa PA01
cccggcgccgaccguggcga

SEQ ID NO: 1449805 - RNA, 20 nt, Pseudomonas aeruginosa PA01
cccggcgcggcggccgccuc

SEQ ID NO: 1449806 - RNA, 23 nt, Pseudomonas aeruginosa PA01
cccggcgcggcggccgccucggc

SEQ ID NO: 1449807 - RNA, 16 nt, Pseudomonas aeruginosa PA01
cccggcgcggcgcagc

SEQ ID NO: 1449808 - RNA, 22 nt, Pseudomonas aeruginosa PA01
cccggcucaacugguuggccgc

SEQ ID NO: 1449809 - RNA, 12 nt, Pseudomonas aeruginosa PA01
cccggcucggca

SEQ ID NO: 1449810 - RNA, 22 nt, Pseudomonas aeruginosa PA01
cccggcucggcacgcguggcga

SEQ ID NO: 1449811 - RNA, 14 nt, Pseudomonas aeruginosa PA01
cccggcucgccgcc

SEQ ID NO: 1449812 - RNA, 17 nt, Pseudomonas aeruginosa PA01
cccggcucgccgccggg

SEQ ID NO: 1449813 - RNA, 18 nt, Pseudomonas aeruginosa PA01
cccggcucgccgccgggc

SEQ ID NO: 1449814 - RNA, 20 nt, Pseudomonas aeruginosa PA01
cccggcucgccgccgggcgc

SEQ ID NO: 1449815 - RNA, 20 nt, Pseudomonas aeruginosa PA01
cccggcuaucgcuuucagca

SEQ ID NO: 1449816 - RNA, 19 nt, Pseudomonas aeruginosa PA01
cccggcgugggcggucggc

SEQ ID NO: 1449817 - RNA, 21 nt, Pseudomonas aeruginosa PA01
cccggcgugggcggucggcga

SEQ ID NO: 1449818 - RNA, 23 nt, Pseudomonas aeruginosa PA01
cccggcgugggcggucggcgagg

SEQ ID NO: 1449819 - RNA, 20 nt, Pseudomonas aeruginosa PA01
cccggcgcuccaacagcagg

SEQ ID NO: 1449820 - RNA, 13 nt, Pseudomonas aeruginosa PA01
cccggcgcugccc

SEQ ID NO: 1449821 - RNA, 21 nt, Pseudomonas aeruginosa PA01
cccggcgcugcuucuugucga

SEQ ID NO: 1449822 - RNA, 18 nt, Pseudomonas aeruginosa PA01
cccggcgcuucgcgcagg

SEQ ID NO: 1449823 - RNA, 21 nt, Pseudomonas aeruginosa PA01
cccggcgcuucgcgcaggacg

SEQ ID NO: 1449824 - RNA, 17 nt, Pseudomonas aeruginosa PA01
cccggcggaacaugguc

SEQ ID NO: 1449825 - RNA, 12 nt, Pseudomonas aeruginosa PA01
cccggcggacaa

SEQ ID NO: 1449826 - RNA, 21 nt, Pseudomonas aeruginosa PA01
cccggcgcgguuucgcagcgc

SEQ ID NO: 1449827 - RNA, 19 nt, Pseudomonas aeruginosa PA01
cccggcccgggcguuggcu

SEQ ID NO: 1449828 - RNA, 14 nt, Pseudomonas aeruginosa PA01
cccggcccggucag

SEQ ID NO: 1449829 - RNA, 16 nt, Pseudomonas aeruginosa PA01
cccggcccgcgccgcc

SEQ ID NO: 1449830 - RNA, 15 nt, Pseudomonas aeruginosa PA01
cccggcccuugagca

SEQ ID NO: 1449831 - RNA, 20 nt, Pseudomonas aeruginosa PA01
cccggcccuugagcauggcg

SEQ ID NO: 1449832 - RNA, 19 nt, Pseudomonas aeruginosa PA01
cccggccgcaggcagcaca

SEQ ID NO: 1449833 - RNA, 14 nt, Pseudomonas aeruginosa PA01
cccggccgcugccg

SEQ ID NO: 1449834 - RNA, 23 nt, Pseudomonas aeruginosa PA01
cccggccgcuggaugccgaccac

SEQ ID NO: 1449835 - RNA, 13 nt, Pseudomonas aeruginosa PA01
cccggccgccuuc

SEQ ID NO: 1449836 - RNA, 16 nt, Pseudomonas aeruginosa PA01
cccggccgcgccagcc

SEQ ID NO: 1449837 - RNA, 24 nt, Pseudomonas aeruginosa PA01
cccggccucaacgaccgcccaggc

SEQ ID NO: 1449838 - RNA, 16 nt, Pseudomonas aeruginosa PA01
cccggccuccaggcug

SEQ ID NO: 1449839 - RNA, 14 nt, Pseudomonas aeruginosa PA01
cccggccuccccgg

SEQ ID NO: 1449840 - RNA, 12 nt, Pseudomonas aeruginosa PA01
cccggccuggau

SEQ ID NO: 1449841 - RNA, 13 nt, Pseudomonas aeruginosa PA01
cccggccuggcgc

SEQ ID NO: 1449842 - RNA, 17 nt, Pseudomonas aeruginosa PA01
cccggccuggcgcgcgc

SEQ ID NO: 1449843 - RNA, 13 nt, Pseudomonas aeruginosa PA01
cccggccuggcug

SEQ ID NO: 1449844 - RNA, 17 nt, Pseudomonas aeruginosa PA01
cccggccuggcuggccu

SEQ ID NO: 1449845 - RNA, 16 nt, Pseudomonas aeruginosa PA01
cccggccuucaccgcg

SEQ ID NO: 1449846 - RNA, 17 nt, Pseudomonas aeruginosa PA01
cccggccuucaccgcgc

SEQ ID NO: 1449847 - RNA, 22 nt, Pseudomonas aeruginosa PA01
cccggccuucaccgcgccgcgc

SEQ ID NO: 1449848 - RNA, 20 nt, Pseudomonas aeruginosa PA01
cccggccucgccggucgcgc

SEQ ID NO: 1449849 - RNA, 16 nt, Pseudomonas aeruginosa PA01
cccggcgauccgcgca

SEQ ID NO: 1449850 - RNA, 19 nt, Pseudomonas aeruginosa PA01
cccggcgagagcguccggc

SEQ ID NO: 1449851 - RNA, 13 nt, Pseudomonas aeruginosa PA01
cccggccagcagc

SEQ ID NO: 1449852 - RNA, 14 nt, Pseudomonas aeruginosa PA01
cccggccagcagcg

SEQ ID NO: 1449853 - RNA, 15 nt, Pseudomonas aeruginosa PA01
cccggccagcagcgc

SEQ ID NO: 1449854 - RNA, 17 nt, Pseudomonas aeruginosa PA01
cccggccagcagcgccu

SEQ ID NO: 1449855 - RNA, 18 nt, Pseudomonas aeruginosa PA01
cccggccaggccacggcg

SEQ ID NO: 1449856 - RNA, 14 nt, Pseudomonas aeruginosa PA01
cccggccaggccgc

SEQ ID NO: 1449857 - RNA, 19 nt, Pseudomonas aeruginosa PA01
cccggccagcgaccgucga

SEQ ID NO: 1449858 - RNA, 12 nt, Pseudomonas aeruginosa PA01
cccggccaggua

SEQ ID NO: 1449859 - RNA, 20 nt, Pseudomonas aeruginosa PA01
cccggccagguaccggccag

SEQ ID NO: 1449860 - RNA, 17 nt, Pseudomonas aeruginosa PA01
cccggccaggcgcggcg

SEQ ID NO: 1449861 - RNA, 11 nt, Pseudomonas aeruginosa PA01
cccggccauga

SEQ ID NO: 1449862 - RNA, 17 nt, Pseudomonas aeruginosa PA01
cccggccaugccgccga

SEQ ID NO: 1449863 - RNA, 19 nt, Pseudomonas aeruginosa PA01
cccggccaugccgccgacg

SEQ ID NO: 1449864 - RNA, 13 nt, Pseudomonas aeruginosa PA01
cccggcaccaccg

SEQ ID NO: 1449865 - RNA, 14 nt, Pseudomonas aeruginosa PA01
cccggcacgcucca

SEQ ID NO: 1449866 - RNA, 20 nt, Pseudomonas aeruginosa PA01
cccggcacgcuccagggcgg

SEQ ID NO: 1449867 - RNA, 16 nt, Pseudomonas aeruginosa PA01
cccggcacucgccggg

SEQ ID NO: 1449868 - RNA, 17 nt, Pseudomonas aeruginosa PA01
cccggauaccccgguug

SEQ ID NO: 1449869 - RNA, 20 nt, Pseudomonas aeruginosa PA01
cccggagugugucggggccg

SEQ ID NO: 1449870 - RNA, 17 nt, Pseudomonas aeruginosa PA01
cccggaguuccagcggg

SEQ ID NO: 1449871 - RNA, 20 nt, Pseudomonas aeruginosa PA01
cccggaguuccagcggggau

SEQ ID NO: 1449872 - RNA, 16 nt, Pseudomonas aeruginosa PA01
cccggcaauagccggg

SEQ ID NO: 1449873 - RNA, 23 nt, Pseudomonas aeruginosa PA01
cccggcagcucccuugccgccgg

SEQ ID NO: 1449874 - RNA, 16 nt, Pseudomonas aeruginosa PA01
cccggcaggucgagga

SEQ ID NO: 1449875 - RNA, 21 nt, Pseudomonas aeruginosa PA01
cccggcaggcaggccugggca

SEQ ID NO: 1449876 - RNA, 17 nt, Pseudomonas aeruginosa PA01
cccggcaggcgcacgcg

SEQ ID NO: 1449877 - RNA, 21 nt, Pseudomonas aeruginosa PA01
cccggcaggcgcacgcgcagu

SEQ ID NO: 1449878 - RNA, 13 nt, Pseudomonas aeruginosa PA01
cccggcagcgccg

SEQ ID NO: 1449879 - RNA, 19 nt, Pseudomonas aeruginosa PA01
cccggcagcggcuggccgu

SEQ ID NO: 1449880 - RNA, 22 nt, Pseudomonas aeruginosa PA01
cccggcagcggcuggccgucga

SEQ ID NO: 1449881 - RNA, 19 nt, Pseudomonas aeruginosa PA01
cccggcagcaggccgccgc

SEQ ID NO: 1449882 - RNA, 15 nt, Pseudomonas aeruginosa PA01
cccgauuccgcgcac

SEQ ID NO: 1449883 - RNA, 13 nt, Pseudomonas aeruginosa PA01
cccgcaaccgcag

SEQ ID NO: 1449884 - RNA, 17 nt, Pseudomonas aeruginosa PA01
cccgcaaccgcugccgc

SEQ ID NO: 1449885 - RNA, 21 nt, Pseudomonas aeruginosa PA01
cccgcaaccgcugccgccguc

SEQ ID NO: 1449886 - RNA, 19 nt, Pseudomonas aeruginosa PA01
cccgcagcgaucagcacca

SEQ ID NO: 1449887 - RNA, 13 nt, Pseudomonas aeruginosa PA01
cccgcagcggcag

SEQ ID NO: 1449888 - RNA, 12 nt, Pseudomonas aeruginosa PA01
cccgcagcggcg

SEQ ID NO: 1449889 - RNA, 13 nt, Pseudomonas aeruginosa PA01
cccgcagcggcgc

SEQ ID NO: 1449890 - RNA, 12 nt, Pseudomonas aeruginosa PA01
cccgccagcaag

SEQ ID NO: 1449891 - RNA, 13 nt, Pseudomonas aeruginosa PA01
cccgcaucgaggc

SEQ ID NO: 1449892 - RNA, 18 nt, Pseudomonas aeruginosa PA01
cccgcaucgaggccgccc

SEQ ID NO: 1449893 - RNA, 19 nt, Pseudomonas aeruginosa PA01
cccgcaguuccucgccgcu

SEQ ID NO: 1449894 - RNA, 21 nt, Pseudomonas aeruginosa PA01
cccgcaguuccucgccgcugc

SEQ ID NO: 1449895 - RNA, 23 nt, Pseudomonas aeruginosa PA01
cccgcaguuccuugggcaucgag

SEQ ID NO: 1449896 - RNA, 20 nt, Pseudomonas aeruginosa PA01
cccgcagggcucgugccauc

SEQ ID NO: 1449897 - RNA, 23 nt, Pseudomonas aeruginosa PA01
cccgcaggguccauggaccgaga

SEQ ID NO: 1449898 - RNA, 14 nt, Pseudomonas aeruginosa PA01
cccgcaggccggcc

SEQ ID NO: 1449899 - RNA, 17 nt, Pseudomonas aeruginosa PA01
cccgcaggccggccagg

SEQ ID NO: 1449900 - RNA, 19 nt, Pseudomonas aeruginosa PA01
cccgcaucccaguagccgg

SEQ ID NO: 1449901 - RNA, 15 nt, Pseudomonas aeruginosa PA01
cccgccguucgcccg

SEQ ID NO: 1449902 - RNA, 21 nt, Pseudomonas aeruginosa PA01
cccgccgugcgcuccgccagg

SEQ ID NO: 1449903 - RNA, 18 nt, Pseudomonas aeruginosa PA01
cccgccgggagcggccgu

SEQ ID NO: 1449904 - RNA, 21 nt, Pseudomonas aeruginosa PA01
cccgccgggagcggccgugca

SEQ ID NO: 1449905 - RNA, 13 nt, Pseudomonas aeruginosa PA01
cccgccggggcgu

SEQ ID NO: 1449906 - RNA, 21 nt, Pseudomonas aeruginosa PA01
cccgccgccaggcgcuggcga

SEQ ID NO: 1449907 - RNA, 13 nt, Pseudomonas aeruginosa PA01
cccgccgccgcgc

SEQ ID NO: 1449908 - RNA, 14 nt, Pseudomonas aeruginosa PA01
cccgccgccgcgcc

SEQ ID NO: 1449909 - RNA, 22 nt, Pseudomonas aeruginosa PA01
cccgccgauauuggucaccacg

SEQ ID NO: 1449910 - RNA, 12 nt, Pseudomonas aeruginosa PA01
cccgccgaagcg

SEQ ID NO: 1449911 - RNA, 19 nt, Pseudomonas aeruginosa PA01
cccgccgaccagcacggcg

SEQ ID NO: 1449912 - RNA, 13 nt, Pseudomonas aeruginosa PA01
cccgccagcggca

SEQ ID NO: 1449913 - RNA, 14 nt, Pseudomonas aeruginosa PA01
cccgccagcaggcg

SEQ ID NO: 1449914 - RNA, 14 nt, Pseudomonas aeruginosa PA01
cccgccucgucgcc

SEQ ID NO: 1449915 - RNA, 16 nt, Pseudomonas aeruginosa PA01
cccgccugaaggcggg

SEQ ID NO: 1449916 - RNA, 18 nt, Pseudomonas aeruginosa PA01
cccgccuggaaggcgcug

SEQ ID NO: 1449917 - RNA, 12 nt, Pseudomonas aeruginosa PA01
cccgccucgcgc

SEQ ID NO: 1449918 - RNA, 15 nt, Pseudomonas aeruginosa PA01
cccgccucgcgcaac

SEQ ID NO: 1449919 - RNA, 14 nt, Pseudomonas aeruginosa PA01
cccgccucggcggc

SEQ ID NO: 1449920 - RNA, 12 nt, Pseudomonas aeruginosa PA01
cccgccucgacc

SEQ ID NO: 1449921 - RNA, 15 nt, Pseudomonas aeruginosa PA01
cccgccucaggccgg

SEQ ID NO: 1449922 - RNA, 18 nt, Pseudomonas aeruginosa PA01
cccgcgccagcgccgcca

SEQ ID NO: 1449923 - RNA, 19 nt, Pseudomonas aeruginosa PA01
cccgcgccagcgccgccag

SEQ ID NO: 1449924 - RNA, 14 nt, Pseudomonas aeruginosa PA01
cccgcgccagcgcc

SEQ ID NO: 1449925 - RNA, 18 nt, Pseudomonas aeruginosa PA01
cccgcguguucgaccggg

SEQ ID NO: 1449926 - RNA, 16 nt, Pseudomonas aeruginosa PA01
cccgcguucgcggggc

SEQ ID NO: 1449927 - RNA, 19 nt, Pseudomonas aeruginosa PA01
cccgcgccuccaggcgcgc

SEQ ID NO: 1449928 - RNA, 21 nt, Pseudomonas aeruginosa PA01
cccgcgccugggccgcgaggu

SEQ ID NO: 1449929 - RNA, 18 nt, Pseudomonas aeruginosa PA01
cccgcgccuucaguucgu

SEQ ID NO: 1449930 - RNA, 16 nt, Pseudomonas aeruginosa PA01
cccgcgcgacagcucu

SEQ ID NO: 1449931 - RNA, 21 nt, Pseudomonas aeruginosa PA01
cccgcgucccuugcggguacg

SEQ ID NO: 1449932 - RNA, 24 nt, Pseudomonas aeruginosa PA01
cccgcguccuccuggaggacgcgg

SEQ ID NO: 1449933 - RNA, 12 nt, Pseudomonas aeruginosa PA01
cccgcgccgccu

SEQ ID NO: 1449934 - RNA, 11 nt, Pseudomonas aeruginosa PA01
cccgcgccgcg

SEQ ID NO: 1449935 - RNA, 13 nt, Pseudomonas aeruginosa PA01
cccgcgccgccgg

SEQ ID NO: 1449936 - RNA, 15 nt, Pseudomonas aeruginosa PA01
cccgcuccagccggc

SEQ ID NO: 1449937 - RNA, 17 nt, Pseudomonas aeruginosa PA01
cccgcuccagccggcaa

SEQ ID NO: 1449938 - RNA, 23 nt, Pseudomonas aeruginosa PA01
cccgcucaugagauccgccagca

SEQ ID NO: 1449939 - RNA, 17 nt, Pseudomonas aeruginosa PA01
cccgcuccgcggccggc

SEQ ID NO: 1449940 - RNA, 13 nt, Pseudomonas aeruginosa PA01
cccgcugcgcugc

SEQ ID NO: 1449941 - RNA, 13 nt, Pseudomonas aeruginosa PA01
cccgcuggcccaa

SEQ ID NO: 1449942 - RNA, 16 nt, Pseudomonas aeruginosa PA01
cccggagaccgugccg

SEQ ID NO: 1449943 - RNA, 17 nt, Pseudomonas aeruginosa PA01
cccggagaccgugccgc

SEQ ID NO: 1449944 - RNA, 21 nt, Pseudomonas aeruginosa PA01
cccggagaccgugccgccggg

SEQ ID NO: 1449945 - RNA, 19 nt, Pseudomonas aeruginosa PA01
cccggagcgcgaaagcgcc

SEQ ID NO: 1449946 - RNA, 19 nt, Pseudomonas aeruginosa PA01
cccggagcgcgaggcgagu

SEQ ID NO: 1449947 - RNA, 18 nt, Pseudomonas aeruginosa PA01
cccggagcggcugccgag

SEQ ID NO: 1449948 - RNA, 20 nt, Pseudomonas aeruginosa PA01
cccggaggaacgaacaugag

SEQ ID NO: 1449949 - RNA, 20 nt, Pseudomonas aeruginosa PA01
cccggagccaacgcccgggc

SEQ ID NO: 1449950 - RNA, 14 nt, Pseudomonas aeruginosa PA01
cccggaggcggcga

SEQ ID NO: 1449951 - RNA, 15 nt, Pseudomonas aeruginosa PA01
cccggacgggugcgc

SEQ ID NO: 1449952 - RNA, 22 nt, Pseudomonas aeruginosa PA01
cccggaccggcucucuucggcc

SEQ ID NO: 1449953 - RNA, 12 nt, Pseudomonas aeruginosa PA01
cccgcuucggcc

SEQ ID NO: 1449954 - RNA, 16 nt, Pseudomonas aeruginosa PA01
cccgcuguccgccggc

SEQ ID NO: 1449955 - RNA, 15 nt, Pseudomonas aeruginosa PA01
cccgcuuuccccggc

SEQ ID NO: 1449956 - RNA, 18 nt, Pseudomonas aeruginosa PA01
cccgcuuuccccggcggc

SEQ ID NO: 1449957 - RNA, 19 nt, Pseudomonas aeruginosa PA01
cccgcuugccgucgaccug

SEQ ID NO: 1449958 - RNA, 21 nt, Pseudomonas aeruginosa PA01
cccgcuucgucggucgcgacg

SEQ ID NO: 1449959 - RNA, 12 nt, Pseudomonas aeruginosa PA01
cccgauaggcgc

SEQ ID NO: 1449960 - RNA, 17 nt, Pseudomonas aeruginosa PA01
cccgauaggcgccggcg

SEQ ID NO: 1449961 - RNA, 15 nt, Pseudomonas aeruginosa PA01
cccgacugucgugcc

SEQ ID NO: 1449962 - RNA, 18 nt, Pseudomonas aeruginosa PA01
cccgacugucgugccucc

SEQ ID NO: 1449963 - RNA, 20 nt, Pseudomonas aeruginosa PA01
cccgacggcuugaucacgcc

SEQ ID NO: 1449964 - RNA, 18 nt, Pseudomonas aeruginosa PA01
cccgacgcccuccagcac

SEQ ID NO: 1449965 - RNA, 15 nt, Pseudomonas aeruginosa PA01
cccgacgccgcccgg

SEQ ID NO: 1449966 - RNA, 21 nt, Pseudomonas aeruginosa PA01
cccgacgccgcccggcaccgg

SEQ ID NO: 1449967 - RNA, 19 nt, Pseudomonas aeruginosa PA01
cccgaccgguuccagcggc

SEQ ID NO: 1449968 - RNA, 24 nt, Pseudomonas aeruginosa PA01
cccgaccgguuccagcggccgcga

SEQ ID NO: 1449969 - RNA, 16 nt, Pseudomonas aeruginosa PA01
ccccucuucggagcga

SEQ ID NO: 1449970 - RNA, 11 nt, Pseudomonas aeruginosa PA01
cccgaacgccg

SEQ ID NO: 1449971 - RNA, 13 nt, Pseudomonas aeruginosa PA01
cccgaacgccgac

SEQ ID NO: 1449972 - RNA, 14 nt, Pseudomonas aeruginosa PA01
cccgaacucgccgu

SEQ ID NO: 1449973 - RNA, 23 nt, Pseudomonas aeruginosa PA01
ccccucggcuaaccgccuucgcg

SEQ ID NO: 1449974 - RNA, 23 nt, Pseudomonas aeruginosa PA01
ccccucgcgcaucuggcugcgcg

SEQ ID NO: 1449975 - RNA, 21 nt, Pseudomonas aeruginosa PA01
ccccucccgcgccagcgccgc

SEQ ID NO: 1449976 - RNA, 20 nt, Pseudomonas aeruginosa PA01
ccccucacuccgucuccagc

SEQ ID NO: 1449977 - RNA, 15 nt, Pseudomonas aeruginosa PA01
ccccuagaccaacug

SEQ ID NO: 1449978 - RNA, 16 nt, Pseudomonas aeruginosa PA01
ccccggccagguaccg

SEQ ID NO: 1449979 - RNA, 20 nt, Pseudomonas aeruginosa PA01
ccccggccagguaccggcca

SEQ ID NO: 1449980 - RNA, 11 nt, Pseudomonas aeruginosa PA01
ccccggcgauc

SEQ ID NO: 1449981 - RNA, 17 nt, Pseudomonas aeruginosa PA01
ccccggcgaugcugcug

SEQ ID NO: 1449982 - RNA, 12 nt, Pseudomonas aeruginosa PA01
ccccggccuggc

SEQ ID NO: 1449983 - RNA, 14 nt, Pseudomonas aeruginosa PA01
ccccggccuggcgc

SEQ ID NO: 1449984 - RNA, 13 nt, Pseudomonas aeruginosa PA01
ccccggcggcgau

SEQ ID NO: 1449985 - RNA, 13 nt, Pseudomonas aeruginosa PA01
ccccggcgcucgc

SEQ ID NO: 1449986 - RNA, 14 nt, Pseudomonas aeruginosa PA01
ccccaggcgcccag

SEQ ID NO: 1449987 - RNA, 17 nt, Pseudomonas aeruginosa PA01
ccccaggcgcccaggca

SEQ ID NO: 1449988 - RNA, 13 nt, Pseudomonas aeruginosa PA01
ccccaggcgcggc

SEQ ID NO: 1449989 - RNA, 16 nt, Pseudomonas aeruginosa PA01
ccccaggcugcccagg

SEQ ID NO: 1449990 - RNA, 14 nt, Pseudomonas aeruginosa PA01
ccccagggccggcg

SEQ ID NO: 1449991 - RNA, 16 nt, Pseudomonas aeruginosa PA01
ccccagggccggcgcc

SEQ ID NO: 1449992 - RNA, 21 nt, Pseudomonas aeruginosa PA01
ccccagggccggcgcccuucg

SEQ ID NO: 1449993 - RNA, 22 nt, Pseudomonas aeruginosa PA01
ccccaggccgccgccugcucgc

SEQ ID NO: 1449994 - RNA, 23 nt, Pseudomonas aeruginosa PA01
ccccaguccucguacaugcgcga

SEQ ID NO: 1449995 - RNA, 12 nt, Pseudomonas aeruginosa PA01
cccaggcgaucc

SEQ ID NO: 1449996 - RNA, 13 nt, Pseudomonas aeruginosa PA01
cccaggcgccgcu

SEQ ID NO: 1449997 - RNA, 13 nt, Pseudomonas aeruginosa PA01
cccaggcgccgau

SEQ ID NO: 1449998 - RNA, 15 nt, Pseudomonas aeruginosa PA01
cccaggcgccgaucc

SEQ ID NO: 1449999 - RNA, 16 nt, Pseudomonas aeruginosa PA01
cccaggcgcucggcga

SEQ ID NO: 1450000 - RNA, 21 nt, Pseudomonas aeruginosa PA01
cccaggcgcucggcggcgcgc

SEQ ID NO: 1450001 - RNA, 12 nt, Pseudomonas aeruginosa PA01
cccaggcgcugc

SEQ ID NO: 1450002 - RNA, 23 nt, Pseudomonas aeruginosa PA01
ccccacgucguuucucggcgaug

SEQ ID NO: 1450003 - RNA, 15 nt, Pseudomonas aeruginosa PA01
ccccacucggccagc

SEQ ID NO: 1450004 - RNA, 17 nt, Pseudomonas aeruginosa PA01
ccccacuuccggcccgg

SEQ ID NO: 1450005 - RNA, 22 nt, Pseudomonas aeruginosa PA01
ccccacuuccggcccggccagg

SEQ ID NO: 1450006 - RNA, 17 nt, Pseudomonas aeruginosa PA01
ccccacuucgagaguga

SEQ ID NO: 1450007 - RNA, 17 nt, Pseudomonas aeruginosa PA01
ccccacgggcgacccag

SEQ ID NO: 1450008 - RNA, 23 nt, Pseudomonas aeruginosa PA01
ccccacgguagagacggcggcga

SEQ ID NO: 1450009 - RNA, 13 nt, Pseudomonas aeruginosa PA01
ccccacggcgcgg

SEQ ID NO: 1450010 - RNA, 14 nt, Pseudomonas aeruginosa PA01
ccccacggcgcggc

SEQ ID NO: 1450011 - RNA, 18 nt, Pseudomonas aeruginosa PA01
cccaggcgucgcgccagc

SEQ ID NO: 1450012 - RNA, 22 nt, Pseudomonas aeruginosa PA01
ccccaccggucuuggcgcgcga

SEQ ID NO: 1450013 - RNA, 20 nt, Pseudomonas aeruginosa PA01
cccaggcgggcacgucgcgg

SEQ ID NO: 1450014 - RNA, 13 nt, Pseudomonas aeruginosa PA01
ccccgccucgacc

SEQ ID NO: 1450015 - RNA, 13 nt, Pseudomonas aeruginosa PA01
ccccgcgccgccg

SEQ ID NO: 1450016 - RNA, 19 nt, Pseudomonas aeruginosa PA01
ccccgaggccagcaggccg

SEQ ID NO: 1450017 - RNA, 13 nt, Pseudomonas aeruginosa PA01
ccccgaggcgacg

SEQ ID NO: 1450018 - RNA, 13 nt, Pseudomonas aeruginosa PA01
ccccgccggccgg

SEQ ID NO: 1450019 - RNA, 12 nt, Pseudomonas aeruginosa PA01
ccccgccggcgu

SEQ ID NO: 1450020 - RNA, 11 nt, Pseudomonas aeruginosa PA01
ccccgaucacc

SEQ ID NO: 1450021 - RNA, 13 nt, Pseudomonas aeruginosa PA01
ccccgaucaccgg

SEQ ID NO: 1450022 - RNA, 15 nt, Pseudomonas aeruginosa PA01
ccccgccgccaggcg

SEQ ID NO: 1450023 - RNA, 22 nt, Pseudomonas aeruginosa PA01
ccccgccgccaggcgcuggcga

SEQ ID NO: 1450024 - RNA, 15 nt, Pseudomonas aeruginosa PA01
cccccggcccggcca

SEQ ID NO: 1450025 - RNA, 24 nt, Pseudomonas aeruginosa PA01
cccccuguuucgaugagcuucgcc

SEQ ID NO: 1450026 - RNA, 18 nt, Pseudomonas aeruginosa PA01
ccagugcgcgguccgcgu

SEQ ID NO: 1450027 - RNA, 20 nt, Pseudomonas aeruginosa PA01
ccagugcgcgguccgcgugg

SEQ ID NO: 1450028 - RNA, 14 nt, Pseudomonas aeruginosa PA01
ccagugcccggcag

SEQ ID NO: 1450029 - RNA, 13 nt, Pseudomonas aeruginosa PA01
ccagugccucccg

SEQ ID NO: 1450030 - RNA, 15 nt, Pseudomonas aeruginosa PA01
ccagugccucccggc

SEQ ID NO: 1450031 - RNA, 15 nt, Pseudomonas aeruginosa PA01
ccagugccucgcgcg

SEQ ID NO: 1450032 - RNA, 23 nt, Pseudomonas aeruginosa PA01
ccagugccugcaccacgcaggcg

SEQ ID NO: 1450033 - RNA, 17 nt, Pseudomonas aeruginosa PA01
ccagugcgagucggcga

SEQ ID NO: 1450034 - RNA, 16 nt, Pseudomonas aeruginosa PA01
ccagucuucgccggcc

SEQ ID NO: 1450035 - RNA, 17 nt, Pseudomonas aeruginosa PA01
ccagucuucgccggccu

SEQ ID NO: 1450036 - RNA, 19 nt, Pseudomonas aeruginosa PA01
ccagucuucgccggccugc

SEQ ID NO: 1450037 - RNA, 15 nt, Pseudomonas aeruginosa PA01
ccagugcaccgccgg

SEQ ID NO: 1450038 - RNA, 16 nt, Pseudomonas aeruginosa PA01
ccagugcaccgccggg

SEQ ID NO: 1450039 - RNA, 20 nt, Pseudomonas aeruginosa PA01
ccagugcaugcguucgccga

SEQ ID NO: 1450040 - RNA, 23 nt, Pseudomonas aeruginosa PA01
ccagucccgcaaagcccgcuccg

SEQ ID NO: 1450041 - RNA, 13 nt, Pseudomonas aeruginosa PA01
ccagucaccaggu

SEQ ID NO: 1450042 - RNA, 14 nt, Pseudomonas aeruginosa PA01
ccagucaccagguc

SEQ ID NO: 1450043 - RNA, 21 nt, Pseudomonas aeruginosa PA01
ccagucccggcuugccggcag

SEQ ID NO: 1450044 - RNA, 17 nt, Pseudomonas aeruginosa PA01
ccagucccuggccggcg

SEQ ID NO: 1450045 - RNA, 22 nt, Pseudomonas aeruginosa PA01
ccagucccuucagcgcaccgcc

SEQ ID NO: 1450046 - RNA, 15 nt, Pseudomonas aeruginosa PA01
ccagucggcgcugga

SEQ ID NO: 1450047 - RNA, 14 nt, Pseudomonas aeruginosa PA01
ccagucggggcagg

SEQ ID NO: 1450048 - RNA, 18 nt, Pseudomonas aeruginosa PA01
ccagucggggcaggcgca

SEQ ID NO: 1450049 - RNA, 22 nt, Pseudomonas aeruginosa PA01
ccagucggggcaggcgcaggcg

SEQ ID NO: 1450050 - RNA, 20 nt, Pseudomonas aeruginosa PA01
ccaguucggccaucagcacg

SEQ ID NO: 1450051 - RNA, 16 nt, Pseudomonas aeruginosa PA01
ccaguucuucgccgcc

SEQ ID NO: 1450052 - RNA, 18 nt, Pseudomonas aeruginosa PA01
ccaguucuucgccgcccg

SEQ ID NO: 1450053 - RNA, 14 nt, Pseudomonas aeruginosa PA01
ccaguugcaccgca

SEQ ID NO: 1450054 - RNA, 21 nt, Pseudomonas aeruginosa PA01
ccaguuggaaguugccgccag

SEQ ID NO: 1450055 - RNA, 14 nt, Pseudomonas aeruginosa PA01
ccaguugcgcggcg

SEQ ID NO: 1450056 - RNA, 21 nt, Pseudomonas aeruginosa PA01
ccaguugcccgagugccggcg

SEQ ID NO: 1450057 - RNA, 22 nt, Pseudomonas aeruginosa PA01
ccaguugcccgagugccggcgc

SEQ ID NO: 1450058 - RNA, 17 nt, Pseudomonas aeruginosa PA01
ccaguugcccggccugg

SEQ ID NO: 1450059 - RNA, 19 nt, Pseudomonas aeruginosa PA01
ccaguucggggucggccug

SEQ ID NO: 1450060 - RNA, 22 nt, Pseudomonas aeruginosa PA01
ccaguucguugaccacgcucag

SEQ ID NO: 1450061 - RNA, 18 nt, Pseudomonas aeruginosa PA01
ccaguucgcugccgccgc

SEQ ID NO: 1450062 - RNA, 18 nt, Pseudomonas aeruginosa PA01
ccaguucaucgagcaggu

SEQ ID NO: 1450063 - RNA, 18 nt, Pseudomonas aeruginosa PA01
ccaguuccugcaccacgu

SEQ ID NO: 1450064 - RNA, 13 nt, Pseudomonas aeruginosa PA01
ccaguucgcgcag

SEQ ID NO: 1450065 - RNA, 17 nt, Pseudomonas aeruginosa PA01
ccaguucgcggcgcagu

SEQ ID NO: 1450066 - RNA, 12 nt, Pseudomonas aeruginosa PA01
ccaguuccucgc

SEQ ID NO: 1450067 - RNA, 13 nt, Pseudomonas aeruginosa PA01
ccaguuccucgcg

SEQ ID NO: 1450068 - RNA, 17 nt, Pseudomonas aeruginosa PA01
ccaguuccucgcgaggg

SEQ ID NO: 1450069 - RNA, 14 nt, Pseudomonas aeruginosa PA01
ccaguucgccggcc

SEQ ID NO: 1450070 - RNA, 16 nt, Pseudomonas aeruginosa PA01
ccaguucgccggccag

SEQ ID NO: 1450071 - RNA, 15 nt, Pseudomonas aeruginosa PA01
ccaguucgccgguga

SEQ ID NO: 1450072 - RNA, 22 nt, Pseudomonas aeruginosa PA01
ccaguucagggcgagcagggca

SEQ ID NO: 1450073 - RNA, 14 nt, Pseudomonas aeruginosa PA01
ccaguguggcggcg

SEQ ID NO: 1450074 - RNA, 15 nt, Pseudomonas aeruginosa PA01
ccaguguggcggcgu

SEQ ID NO: 1450075 - RNA, 15 nt, Pseudomonas aeruginosa PA01
ccaguggcgccgcca

SEQ ID NO: 1450076 - RNA, 13 nt, Pseudomonas aeruginosa PA01
ccaucagcaccag

SEQ ID NO: 1450077 - RNA, 15 nt, Pseudomonas aeruginosa PA01
ccaucagccgcgcgc

SEQ ID NO: 1450078 - RNA, 14 nt, Pseudomonas aeruginosa PA01
ccaucagcgccgcc

SEQ ID NO: 1450079 - RNA, 19 nt, Pseudomonas aeruginosa PA01
ccaucagcgccgccucgcu

SEQ ID NO: 1450080 - RNA, 20 nt, Pseudomonas aeruginosa PA01
ccaucagcgccgccucgcug

SEQ ID NO: 1450081 - RNA, 12 nt, Pseudomonas aeruginosa PA01
ccaucaggccgc

SEQ ID NO: 1450082 - RNA, 19 nt, Pseudomonas aeruginosa PA01
ccaucagcuggaucuggug

SEQ ID NO: 1450083 - RNA, 15 nt, Pseudomonas aeruginosa PA01
ccaucacggccccga

SEQ ID NO: 1450084 - RNA, 16 nt, Pseudomonas aeruginosa PA01
ccaucacgucgcgcac

SEQ ID NO: 1450085 - RNA, 12 nt, Pseudomonas aeruginosa PA01
ccaucaccgcgg

SEQ ID NO: 1450086 - RNA, 20 nt, Pseudomonas aeruginosa PA01
ccaucaacggauauccccgu

SEQ ID NO: 1450087 - RNA, 14 nt, Pseudomonas aeruginosa PA01
ccaguugcgccgcc

SEQ ID NO: 1450088 - RNA, 17 nt, Pseudomonas aeruginosa PA01
ccaguuguuccggcugg

SEQ ID NO: 1450089 - RNA, 22 nt, Pseudomonas aeruginosa PA01
ccauaccgacaugccccgccga

SEQ ID NO: 1450090 - RNA, 22 nt, Pseudomonas aeruginosa PA01
ccauagcgaguaggcgaagccc

SEQ ID NO: 1450091 - RNA, 13 nt, Pseudomonas aeruginosa PA01
ccauagcgcgccg

SEQ ID NO: 1450092 - RNA, 14 nt, Pseudomonas aeruginosa PA01
ccaggggauggucg

SEQ ID NO: 1450093 - RNA, 17 nt, Pseudomonas aeruginosa PA01
ccaggggcacgcuggcg

SEQ ID NO: 1450094 - RNA, 20 nt, Pseudomonas aeruginosa PA01
ccaggggcacgcuggcgaga

SEQ ID NO: 1450095 - RNA, 17 nt, Pseudomonas aeruginosa PA01
ccaggggagcgccggcg

SEQ ID NO: 1450096 - RNA, 22 nt, Pseudomonas aeruginosa PA01
ccagggcuucccaggccagcgg

SEQ ID NO: 1450097 - RNA, 16 nt, Pseudomonas aeruginosa PA01
ccagggcuucgacaua

SEQ ID NO: 1450098 - RNA, 16 nt, Pseudomonas aeruginosa PA01
ccagggcuucgcggug

SEQ ID NO: 1450099 - RNA, 23 nt, Pseudomonas aeruginosa PA01
ccagggcuucgcgguggaugccg

SEQ ID NO: 1450100 - RNA, 18 nt, Pseudomonas aeruginosa PA01
ccagggagucgcuggcca

SEQ ID NO: 1450101 - RNA, 20 nt, Pseudomonas aeruginosa PA01
ccaggcuuuccaccgccagc

SEQ ID NO: 1450102 - RNA, 14 nt, Pseudomonas aeruginosa PA01
ccagggacgcccgg

SEQ ID NO: 1450103 - RNA, 19 nt, Pseudomonas aeruginosa PA01
ccagggacgcccggagcgc

SEQ ID NO: 1450104 - RNA, 19 nt, Pseudomonas aeruginosa PA01
ccagggacgcgcagcggcg

SEQ ID NO: 1450105 - RNA, 23 nt, Pseudomonas aeruginosa PA01
ccagggacgcgcagcggcgccga

SEQ ID NO: 1450106 - RNA, 15 nt, Pseudomonas aeruginosa PA01
ccagggacgcgccgg

SEQ ID NO: 1450107 - RNA, 17 nt, Pseudomonas aeruginosa PA01
ccagggacgcgccggcg

SEQ ID NO: 1450108 - RNA, 18 nt, Pseudomonas aeruginosa PA01
ccagggacgcgccggcgg

SEQ ID NO: 1450109 - RNA, 22 nt, Pseudomonas aeruginosa PA01
ccagggacgcgccggcggauca

SEQ ID NO: 1450110 - RNA, 16 nt, Pseudomonas aeruginosa PA01
ccagggagaacagcag

SEQ ID NO: 1450111 - RNA, 12 nt, Pseudomonas aeruginosa PA01
ccagggagcagg

SEQ ID NO: 1450112 - RNA, 21 nt, Pseudomonas aeruginosa PA01
ccagggagcgcucgcgcagcc

SEQ ID NO: 1450113 - RNA, 14 nt, Pseudomonas aeruginosa PA01
ccagggucagcugg

SEQ ID NO: 1450114 - RNA, 19 nt, Pseudomonas aeruginosa PA01
ccagggucagcuggcgcgc

SEQ ID NO: 1450115 - RNA, 15 nt, Pseudomonas aeruginosa PA01
ccagggucacgccgc

SEQ ID NO: 1450116 - RNA, 13 nt, Pseudomonas aeruginosa PA01
ccagggucgaggg

SEQ ID NO: 1450117 - RNA, 12 nt, Pseudomonas aeruginosa PA01
ccagggucgcca

SEQ ID NO: 1450118 - RNA, 17 nt, Pseudomonas aeruginosa PA01
ccagggucgccagcagg

SEQ ID NO: 1450119 - RNA, 18 nt, Pseudomonas aeruginosa PA01
ccagggucgccagcaggu

SEQ ID NO: 1450120 - RNA, 16 nt, Pseudomonas aeruginosa PA01
ccagggucgcccgugc

SEQ ID NO: 1450121 - RNA, 18 nt, Pseudomonas aeruginosa PA01
ccagggucggcaccugca

SEQ ID NO: 1450122 - RNA, 18 nt, Pseudomonas aeruginosa PA01
ccagggucgggccgcgcu

SEQ ID NO: 1450123 - RNA, 19 nt, Pseudomonas aeruginosa PA01
ccagggucgggccgcgcuc

SEQ ID NO: 1450124 - RNA, 20 nt, Pseudomonas aeruginosa PA01
ccagggucgggccgcgcucg

SEQ ID NO: 1450125 - RNA, 19 nt, Pseudomonas aeruginosa PA01
ccagggucgguucgcggcg

SEQ ID NO: 1450126 - RNA, 14 nt, Pseudomonas aeruginosa PA01
ccagggucuccagg

SEQ ID NO: 1450127 - RNA, 17 nt, Pseudomonas aeruginosa PA01
ccagggucuccaggacc

SEQ ID NO: 1450128 - RNA, 13 nt, Pseudomonas aeruginosa PA01
ccaggggucggca

SEQ ID NO: 1450129 - RNA, 16 nt, Pseudomonas aeruginosa PA01
ccaggggugccuugcc

SEQ ID NO: 1450130 - RNA, 15 nt, Pseudomonas aeruginosa PA01
ccaggggucaggccg

SEQ ID NO: 1450131 - RNA, 17 nt, Pseudomonas aeruginosa PA01
ccaggggucgacgcagg

SEQ ID NO: 1450132 - RNA, 19 nt, Pseudomonas aeruginosa PA01
ccaggguaucgcugucgcc

SEQ ID NO: 1450133 - RNA, 15 nt, Pseudomonas aeruginosa PA01
ccagggggccgggcc

SEQ ID NO: 1450134 - RNA, 16 nt, Pseudomonas aeruginosa PA01
ccagggggccgggccg

SEQ ID NO: 1450135 - RNA, 13 nt, Pseudomonas aeruginosa PA01
ccagggggccugg

SEQ ID NO: 1450136 - RNA, 22 nt, Pseudomonas aeruginosa PA01
ccaggggcuagucgcgcagcgc

SEQ ID NO: 1450137 - RNA, 20 nt, Pseudomonas aeruginosa PA01
ccaggguguuguucgccagc

SEQ ID NO: 1450138 - RNA, 21 nt, Pseudomonas aeruginosa PA01
ccaggguuggcggcaucgcgu

SEQ ID NO: 1450139 - RNA, 18 nt, Pseudomonas aeruginosa PA01
ccaggguggcggcggcga

SEQ ID NO: 1450140 - RNA, 19 nt, Pseudomonas aeruginosa PA01
ccaggguggcggcggcgag

SEQ ID NO: 1450141 - RNA, 14 nt, Pseudomonas aeruginosa PA01
ccaggguggcguuc

SEQ ID NO: 1450142 - RNA, 12 nt, Pseudomonas aeruginosa PA01
ccagggugcgcu

SEQ ID NO: 1450143 - RNA, 13 nt, Pseudomonas aeruginosa PA01
ccagggugcgcuc

SEQ ID NO: 1450144 - RNA, 22 nt, Pseudomonas aeruginosa PA01
ccagguaaaggccaccagagcc

SEQ ID NO: 1450145 - RNA, 17 nt, Pseudomonas aeruginosa PA01
ccaggguuuccagcagc

SEQ ID NO: 1450146 - RNA, 16 nt, Pseudomonas aeruginosa PA01
ccaggucgaacagcgg

SEQ ID NO: 1450147 - RNA, 18 nt, Pseudomonas aeruginosa PA01
ccaggucgaacagcggcu

SEQ ID NO: 1450148 - RNA, 14 nt, Pseudomonas aeruginosa PA01
ccagguccgccugg

SEQ ID NO: 1450149 - RNA, 13 nt, Pseudomonas aeruginosa PA01
ccagguccggcag

SEQ ID NO: 1450150 - RNA, 20 nt, Pseudomonas aeruginosa PA01
ccagguccgccacuucaagc

SEQ ID NO: 1450151 - RNA, 18 nt, Pseudomonas aeruginosa PA01
ccaggucaugcccuggcc

SEQ ID NO: 1450152 - RNA, 15 nt, Pseudomonas aeruginosa PA01
ccagguccaggcuca

SEQ ID NO: 1450153 - RNA, 23 nt, Pseudomonas aeruginosa PA01
ccaguaguccuccgcgcccaggc

SEQ ID NO: 1450154 - RNA, 13 nt, Pseudomonas aeruginosa PA01
ccagguuggccug

SEQ ID NO: 1450155 - RNA, 22 nt, Pseudomonas aeruginosa PA01
ccagguuggcgaacaggcagcg

SEQ ID NO: 1450156 - RNA, 19 nt, Pseudomonas aeruginosa PA01
ccagguuuccggcagcacg

SEQ ID NO: 1450157 - RNA, 15 nt, Pseudomonas aeruginosa PA01
ccagguugugaucga

SEQ ID NO: 1450158 - RNA, 17 nt, Pseudomonas aeruginosa PA01
ccagguugugaucgacc

SEQ ID NO: 1450159 - RNA, 22 nt, Pseudomonas aeruginosa PA01
ccagguugugaucgaccucgcg

SEQ ID NO: 1450160 - RNA, 23 nt, Pseudomonas aeruginosa PA01
ccagguugugaucgaccucgcgg

SEQ ID NO: 1450161 - RNA, 16 nt, Pseudomonas aeruginosa PA01
ccaggugcuuggcuuc

SEQ ID NO: 1450162 - RNA, 20 nt, Pseudomonas aeruginosa PA01
ccaggugcuuggcuucgagc

SEQ ID NO: 1450163 - RNA, 23 nt, Pseudomonas aeruginosa PA01
ccaggugcuggucgugguccagc

SEQ ID NO: 1450164 - RNA, 13 nt, Pseudomonas aeruginosa PA01
ccagguugaccag

SEQ ID NO: 1450165 - RNA, 15 nt, Pseudomonas aeruginosa PA01
ccaggucgaucagca

SEQ ID NO: 1450166 - RNA, 18 nt, Pseudomonas aeruginosa PA01
ccaggucgaucagcagca

SEQ ID NO: 1450167 - RNA, 21 nt, Pseudomonas aeruginosa PA01
ccaggucgaucagcagcagcg

SEQ ID NO: 1450168 - RNA, 22 nt, Pseudomonas aeruginosa PA01
ccaggucgaucagcagcagcgc

SEQ ID NO: 1450169 - RNA, 23 nt, Pseudomonas aeruginosa PA01
ccaggucgaucagcagcagcgcc

SEQ ID NO: 1450170 - RNA, 22 nt, Pseudomonas aeruginosa PA01
ccaggucgauccugaccccggc

SEQ ID NO: 1450171 - RNA, 16 nt, Pseudomonas aeruginosa PA01
ccaggucgagggcaug

SEQ ID NO: 1450172 - RNA, 20 nt, Pseudomonas aeruginosa PA01
ccaggucguugcgccggccc

SEQ ID NO: 1450173 - RNA, 22 nt, Pseudomonas aeruginosa PA01
ccaggucuucuggaaaucggcg

SEQ ID NO: 1450174 - RNA, 18 nt, Pseudomonas aeruginosa PA01
ccaggugcgcaggcgcuc

SEQ ID NO: 1450175 - RNA, 17 nt, Pseudomonas aeruginosa PA01
ccaggugcgccgagcgc

SEQ ID NO: 1450176 - RNA, 14 nt, Pseudomonas aeruginosa PA01
ccaggugcgcggca

SEQ ID NO: 1450177 - RNA, 15 nt, Pseudomonas aeruginosa PA01
ccaggugcagcgagg

SEQ ID NO: 1450178 - RNA, 22 nt, Pseudomonas aeruginosa PA01
ccaggugcaggaagcgccgggc

SEQ ID NO: 1450179 - RNA, 24 nt, Pseudomonas aeruginosa PA01
ccaggugcaggaagcgccgggccg

SEQ ID NO: 1450180 - RNA, 20 nt, Pseudomonas aeruginosa PA01
ccaggugccaauccgggcgu

SEQ ID NO: 1450181 - RNA, 13 nt, Pseudomonas aeruginosa PA01
ccaggugcacggc

SEQ ID NO: 1450182 - RNA, 15 nt, Pseudomonas aeruginosa PA01
ccaggugcacggcca

SEQ ID NO: 1450183 - RNA, 20 nt, Pseudomonas aeruginosa PA01
ccaggcggagcauggugucg

SEQ ID NO: 1450184 - RNA, 16 nt, Pseudomonas aeruginosa PA01
ccaggcgccagggacg

SEQ ID NO: 1450185 - RNA, 16 nt, Pseudomonas aeruginosa PA01
ccaggcgccagggccg

SEQ ID NO: 1450186 - RNA, 18 nt, Pseudomonas aeruginosa PA01
ccaggcgccgaugcccag

SEQ ID NO: 1450187 - RNA, 20 nt, Pseudomonas aeruginosa PA01
ccaggcgccgaugcccaggc

SEQ ID NO: 1450188 - RNA, 21 nt, Pseudomonas aeruginosa PA01
ccaggcgccgaugcccaggcc

SEQ ID NO: 1450189 - RNA, 22 nt, Pseudomonas aeruginosa PA01
ccaggcgccgaugcccaggccg

SEQ ID NO: 1450190 - RNA, 15 nt, Pseudomonas aeruginosa PA01
ccaggcgccgcucga

SEQ ID NO: 1450191 - RNA, 17 nt, Pseudomonas aeruginosa PA01
ccaggcggcgguagccg

SEQ ID NO: 1450192 - RNA, 18 nt, Pseudomonas aeruginosa PA01
ccaggcggccgcuggcga

SEQ ID NO: 1450193 - RNA, 15 nt, Pseudomonas aeruginosa PA01
ccaggcggccgucgg

SEQ ID NO: 1450194 - RNA, 19 nt, Pseudomonas aeruginosa PA01
ccaggcggccgucggccug

SEQ ID NO: 1450195 - RNA, 20 nt, Pseudomonas aeruginosa PA01
ccaggcggccgucggccugg

SEQ ID NO: 1450196 - RNA, 13 nt, Pseudomonas aeruginosa PA01
ccaggcggccgaa

SEQ ID NO: 1450197 - RNA, 18 nt, Pseudomonas aeruginosa PA01
ccaggcgcaccagcaggc

SEQ ID NO: 1450198 - RNA, 19 nt, Pseudomonas aeruginosa PA01
ccaggcgcaccagcaggcg

SEQ ID NO: 1450199 - RNA, 21 nt, Pseudomonas aeruginosa PA01
ccaggcgcaccagcaggcgca

SEQ ID NO: 1450200 - RNA, 23 nt, Pseudomonas aeruginosa PA01
ccaggcgaugcgccggaucggcu

SEQ ID NO: 1450201 - RNA, 17 nt, Pseudomonas aeruginosa PA01
ccaggcgauggugcgcu

SEQ ID NO: 1450202 - RNA, 18 nt, Pseudomonas aeruginosa PA01
ccaggcgauggugcgcuc

SEQ ID NO: 1450203 - RNA, 17 nt, Pseudomonas aeruginosa PA01
ccaggcccugcuccucc

SEQ ID NO: 1450204 - RNA, 12 nt, Pseudomonas aeruginosa PA01
ccaggccgcaag

SEQ ID NO: 1450205 - RNA, 14 nt, Pseudomonas aeruginosa PA01
ccaggcgcccaggc

SEQ ID NO: 1450206 - RNA, 18 nt, Pseudomonas aeruginosa PA01
ccaggcgcccaggcagca

SEQ ID NO: 1450207 - RNA, 20 nt, Pseudomonas aeruginosa PA01
ccaggcgcccaggcagcaga

SEQ ID NO: 1450208 - RNA, 11 nt, Pseudomonas aeruginosa PA01
ccaggcgaugc

SEQ ID NO: 1450209 - RNA, 12 nt, Pseudomonas aeruginosa PA01
ccaggcgcagcc

SEQ ID NO: 1450210 - RNA, 15 nt, Pseudomonas aeruginosa PA01
ccaggcuucggcgcg

SEQ ID NO: 1450211 - RNA, 19 nt, Pseudomonas aeruginosa PA01
ccaggcuucggcgcgcugg

SEQ ID NO: 1450212 - RNA, 12 nt, Pseudomonas aeruginosa PA01
ccagggaaaagc

SEQ ID NO: 1450213 - RNA, 19 nt, Pseudomonas aeruginosa PA01
ccagggaaaagcccaggug

SEQ ID NO: 1450214 - RNA, 17 nt, Pseudomonas aeruginosa PA01
ccaggcuguagccggcg

SEQ ID NO: 1450215 - RNA, 18 nt, Pseudomonas aeruginosa PA01
ccaggcuguagccggcga

SEQ ID NO: 1450216 - RNA, 20 nt, Pseudomonas aeruginosa PA01
ccaggcuguagccggcgaug

SEQ ID NO: 1450217 - RNA, 18 nt, Pseudomonas aeruginosa PA01
ccaggcugucagggcgca

SEQ ID NO: 1450218 - RNA, 21 nt, Pseudomonas aeruginosa PA01
ccaggcuggccaguugcgcuc

SEQ ID NO: 1450219 - RNA, 21 nt, Pseudomonas aeruginosa PA01
ccaggcuggccuuggccaugc

SEQ ID NO: 1450220 - RNA, 15 nt, Pseudomonas aeruginosa PA01
ccaggcuggcggcca

SEQ ID NO: 1450221 - RNA, 17 nt, Pseudomonas aeruginosa PA01
ccaggcuggcggccagg

SEQ ID NO: 1450222 - RNA, 22 nt, Pseudomonas aeruginosa PA01
ccaggcuggcggccagggcaug

SEQ ID NO: 1450223 - RNA, 22 nt, Pseudomonas aeruginosa PA01
ccaggcgugcagaccgucgauc

SEQ ID NO: 1450224 - RNA, 15 nt, Pseudomonas aeruginosa PA01
ccaggcgugcugcac

SEQ ID NO: 1450225 - RNA, 18 nt, Pseudomonas aeruginosa PA01
ccaggcguggggcgaaua

SEQ ID NO: 1450226 - RNA, 17 nt, Pseudomonas aeruginosa PA01
ccaggcguuccaccagg

SEQ ID NO: 1450227 - RNA, 16 nt, Pseudomonas aeruginosa PA01
ccaggcguuccagcuc

SEQ ID NO: 1450228 - RNA, 18 nt, Pseudomonas aeruginosa PA01
ccaggcguuccagcucgg

SEQ ID NO: 1450229 - RNA, 19 nt, Pseudomonas aeruginosa PA01
ccaggcguuccagcucggc

SEQ ID NO: 1450230 - RNA, 21 nt, Pseudomonas aeruginosa PA01
ccaggcguuccagcucggcga

SEQ ID NO: 1450231 - RNA, 15 nt, Pseudomonas aeruginosa PA01
ccaggcguccgcugg

SEQ ID NO: 1450232 - RNA, 13 nt, Pseudomonas aeruginosa PA01
ccaggcgucgccg

SEQ ID NO: 1450233 - RNA, 21 nt, Pseudomonas aeruginosa PA01
ccaggcgucgcgccagcaccg

SEQ ID NO: 1450234 - RNA, 21 nt, Pseudomonas aeruginosa PA01
ccaggcggcaagggcgucugg

SEQ ID NO: 1450235 - RNA, 18 nt, Pseudomonas aeruginosa PA01
ccaggcguauucggcgac

SEQ ID NO: 1450236 - RNA, 15 nt, Pseudomonas aeruginosa PA01
ccaggcggugucgcg

SEQ ID NO: 1450237 - RNA, 23 nt, Pseudomonas aeruginosa PA01
ccaggcggugucgcgguugcgcu

SEQ ID NO: 1450238 - RNA, 18 nt, Pseudomonas aeruginosa PA01
ccaggcggggucagaggg

SEQ ID NO: 1450239 - RNA, 15 nt, Pseudomonas aeruginosa PA01
ccaggcgguccagcc

SEQ ID NO: 1450240 - RNA, 23 nt, Pseudomonas aeruginosa PA01
ccaggcccugggcggcgggcccg

SEQ ID NO: 1450241 - RNA, 14 nt, Pseudomonas aeruginosa PA01
ccaggcccggcagg

SEQ ID NO: 1450242 - RNA, 16 nt, Pseudomonas aeruginosa PA01
ccaggcccggcgcugc

SEQ ID NO: 1450243 - RNA, 16 nt, Pseudomonas aeruginosa PA01
ccaggcccucagcggc

SEQ ID NO: 1450244 - RNA, 23 nt, Pseudomonas aeruginosa PA01
ccaggcccucagcggcggugcgc

SEQ ID NO: 1450245 - RNA, 16 nt, Pseudomonas aeruginosa PA01
ccaggccaucgaaauc

SEQ ID NO: 1450246 - RNA, 20 nt, Pseudomonas aeruginosa PA01
ccaggcccauccuggcgauc

SEQ ID NO: 1450247 - RNA, 17 nt, Pseudomonas aeruginosa PA01
ccaggccccaggccgcc

SEQ ID NO: 1450248 - RNA, 14 nt, Pseudomonas aeruginosa PA01
ccaggcccgccgcg

SEQ ID NO: 1450249 - RNA, 20 nt, Pseudomonas aeruginosa PA01
ccaggcccgccgcggcgagc

SEQ ID NO: 1450250 - RNA, 17 nt, Pseudomonas aeruginosa PA01
ccaggcccgccggucaa

SEQ ID NO: 1450251 - RNA, 12 nt, Pseudomonas aeruginosa PA01
ccaggcccggca

SEQ ID NO: 1450252 - RNA, 14 nt, Pseudomonas aeruginosa PA01
ccaggccgagcagg

SEQ ID NO: 1450253 - RNA, 15 nt, Pseudomonas aeruginosa PA01
ccaggccgagcgcgc

SEQ ID NO: 1450254 - RNA, 18 nt, Pseudomonas aeruginosa PA01
ccaggccgagcgcgccgc

SEQ ID NO: 1450255 - RNA, 22 nt, Pseudomonas aeruginosa PA01
ccaggccgagcgugcgcaugcc

SEQ ID NO: 1450256 - RNA, 20 nt, Pseudomonas aeruginosa PA01
ccaggccgaaggccuggccg

SEQ ID NO: 1450257 - RNA, 14 nt, Pseudomonas aeruginosa PA01
ccaggccgacagcg

SEQ ID NO: 1450258 - RNA, 16 nt, Pseudomonas aeruginosa PA01
ccaggccgacagcggc

SEQ ID NO: 1450259 - RNA, 17 nt, Pseudomonas aeruginosa PA01
ccaggccgacagcggcu

SEQ ID NO: 1450260 - RNA, 23 nt, Pseudomonas aeruginosa PA01
ccaggccgacagcggcuggcgcu

SEQ ID NO: 1450261 - RNA, 19 nt, Pseudomonas aeruginosa PA01
ccaggccgacccgcaggcc

SEQ ID NO: 1450262 - RNA, 20 nt, Pseudomonas aeruginosa PA01
ccaggccgacccgcaggccg

SEQ ID NO: 1450263 - RNA, 15 nt, Pseudomonas aeruginosa PA01
ccaggccgaucgccu

SEQ ID NO: 1450264 - RNA, 16 nt, Pseudomonas aeruginosa PA01
ccaggccgaucgccuc

SEQ ID NO: 1450265 - RNA, 17 nt, Pseudomonas aeruginosa PA01
ccaggccgaucgccucg

SEQ ID NO: 1450266 - RNA, 20 nt, Pseudomonas aeruginosa PA01
ccaggccgaugaacgccgcg

SEQ ID NO: 1450267 - RNA, 16 nt, Pseudomonas aeruginosa PA01
ccaggcgauacgcggc

SEQ ID NO: 1450268 - RNA, 19 nt, Pseudomonas aeruginosa PA01
ccaggcgauaucccgccgc

SEQ ID NO: 1450269 - RNA, 21 nt, Pseudomonas aeruginosa PA01
ccaggcgauaucccgccgccg

SEQ ID NO: 1450270 - RNA, 22 nt, Pseudomonas aeruginosa PA01
ccaggcgauaucccgccgccgc

SEQ ID NO: 1450271 - RNA, 18 nt, Pseudomonas aeruginosa PA01
ccaggcgauccacagcag

SEQ ID NO: 1450272 - RNA, 19 nt, Pseudomonas aeruginosa PA01
ccaggcgauccacagcagg

SEQ ID NO: 1450273 - RNA, 13 nt, Pseudomonas aeruginosa PA01
ccaggcgauccag

SEQ ID NO: 1450274 - RNA, 17 nt, Pseudomonas aeruginosa PA01
ccaggcgauccagcggg

SEQ ID NO: 1450275 - RNA, 18 nt, Pseudomonas aeruginosa PA01
ccaggccaaccaccccga

SEQ ID NO: 1450276 - RNA, 13 nt, Pseudomonas aeruginosa PA01
ccaggccaggugg

SEQ ID NO: 1450277 - RNA, 17 nt, Pseudomonas aeruginosa PA01
ccaggccaggcugcgcu

SEQ ID NO: 1450278 - RNA, 15 nt, Pseudomonas aeruginosa PA01
ccaggcccagcgcgg

SEQ ID NO: 1450279 - RNA, 15 nt, Pseudomonas aeruginosa PA01
ccaggcccacgccca

SEQ ID NO: 1450280 - RNA, 15 nt, Pseudomonas aeruginosa PA01
ccaggcccacgccga

SEQ ID NO: 1450281 - RNA, 20 nt, Pseudomonas aeruginosa PA01
ccagcgcuuccaccgccugc

SEQ ID NO: 1450282 - RNA, 15 nt, Pseudomonas aeruginosa PA01
ccagcgcuuccucgg

SEQ ID NO: 1450283 - RNA, 12 nt, Pseudomonas aeruginosa PA01
ccagcgcuggca

SEQ ID NO: 1450284 - RNA, 21 nt, Pseudomonas aeruginosa PA01
ccagcgcucguagccggcgcg

SEQ ID NO: 1450285 - RNA, 20 nt, Pseudomonas aeruginosa PA01
ccagcgcuccuugcgccagg

SEQ ID NO: 1450286 - RNA, 19 nt, Pseudomonas aeruginosa PA01
ccagcgcucgaacgccgcc

SEQ ID NO: 1450287 - RNA, 21 nt, Pseudomonas aeruginosa PA01
ccagcgcucgaacgccgcccg

SEQ ID NO: 1450288 - RNA, 17 nt, Pseudomonas aeruginosa PA01
cccagaaaaaagccccg

SEQ ID NO: 1450289 - RNA, 22 nt, Pseudomonas aeruginosa PA01
cccagaaaaaagccccgcaucg

SEQ ID NO: 1450290 - RNA, 21 nt, Pseudomonas aeruginosa PA01
cccagaaaccgaucagcaccg

SEQ ID NO: 1450291 - RNA, 22 nt, Pseudomonas aeruginosa PA01
cccagaaaccgaucagcaccgc

SEQ ID NO: 1450292 - RNA, 20 nt, Pseudomonas aeruginosa PA01
cccacuuccggcccggccag

SEQ ID NO: 1450293 - RNA, 22 nt, Pseudomonas aeruginosa PA01
cccacuuccggcccggccaggc

SEQ ID NO: 1450294 - RNA, 19 nt, Pseudomonas aeruginosa PA01
cccacucuucagucccucg

SEQ ID NO: 1450295 - RNA, 12 nt, Pseudomonas aeruginosa PA01
cccacugaagac

SEQ ID NO: 1450296 - RNA, 14 nt, Pseudomonas aeruginosa PA01
cccacuccagcgcg

SEQ ID NO: 1450297 - RNA, 13 nt, Pseudomonas aeruginosa PA01
cccacuccggcag

SEQ ID NO: 1450298 - RNA, 18 nt, Pseudomonas aeruginosa PA01
cccacuccggcaggcgcu

SEQ ID NO: 1450299 - RNA, 12 nt, Pseudomonas aeruginosa PA01
cccacuccgucc

SEQ ID NO: 1450300 - RNA, 15 nt, Pseudomonas aeruginosa PA01
cccacucgauggugg

SEQ ID NO: 1450301 - RNA, 14 nt, Pseudomonas aeruginosa PA01
cccacucgcguagc

SEQ ID NO: 1450302 - RNA, 21 nt, Pseudomonas aeruginosa PA01
cccaccggucuuggcgcgcga

SEQ ID NO: 1450303 - RNA, 12 nt, Pseudomonas aeruginosa PA01
ccaugucgcugg

SEQ ID NO: 1450304 - RNA, 18 nt, Pseudomonas aeruginosa PA01
ccaugucgcuggccugca

SEQ ID NO: 1450305 - RNA, 18 nt, Pseudomonas aeruginosa PA01
ccauguggcgcagcauca

SEQ ID NO: 1450306 - RNA, 20 nt, Pseudomonas aeruginosa PA01
ccaugggugucggcgaucag

SEQ ID NO: 1450307 - RNA, 20 nt, Pseudomonas aeruginosa PA01
ccaugguguuggcggccugg

SEQ ID NO: 1450308 - RNA, 18 nt, Pseudomonas aeruginosa PA01
ccauggugaugcgcaugc

SEQ ID NO: 1450309 - RNA, 22 nt, Pseudomonas aeruginosa PA01
ccaugguuuaccaggaccagcg

SEQ ID NO: 1450310 - RNA, 18 nt, Pseudomonas aeruginosa PA01
ccaugguuuccgccggac

SEQ ID NO: 1450311 - RNA, 17 nt, Pseudomonas aeruginosa PA01
ccauguaccucuggcug

SEQ ID NO: 1450312 - RNA, 16 nt, Pseudomonas aeruginosa PA01
ccauguagaccaccag

SEQ ID NO: 1450313 - RNA, 14 nt, Pseudomonas aeruginosa PA01
ccauguagcguugc

SEQ ID NO: 1450314 - RNA, 15 nt, Pseudomonas aeruginosa PA01
cccaaggcacgcccc

SEQ ID NO: 1450315 - RNA, 15 nt, Pseudomonas aeruginosa PA01
cccaagccgagcggc

SEQ ID NO: 1450316 - RNA, 21 nt, Pseudomonas aeruginosa PA01
ccauguugcggcccagcggca

SEQ ID NO: 1450317 - RNA, 19 nt, Pseudomonas aeruginosa PA01
ccauguuggccuugagcag

SEQ ID NO: 1450318 - RNA, 19 nt, Pseudomonas aeruginosa PA01
cccaggccaaccaccccga

SEQ ID NO: 1450319 - RNA, 14 nt, Pseudomonas aeruginosa PA01
cccaggccagcggg

SEQ ID NO: 1450320 - RNA, 20 nt, Pseudomonas aeruginosa PA01
cccaggcaccguaggccagg

SEQ ID NO: 1450321 - RNA, 12 nt, Pseudomonas aeruginosa PA01
cccaggcacggc

SEQ ID NO: 1450322 - RNA, 13 nt, Pseudomonas aeruginosa PA01
cccaggcagaucg

SEQ ID NO: 1450323 - RNA, 21 nt, Pseudomonas aeruginosa PA01
cccaggcagcagagcgccacg

SEQ ID NO: 1450324 - RNA, 23 nt, Pseudomonas aeruginosa PA01
cccaggcagcagagcgccacggg

SEQ ID NO: 1450325 - RNA, 13 nt, Pseudomonas aeruginosa PA01
cccaggaaggagc

SEQ ID NO: 1450326 - RNA, 18 nt, Pseudomonas aeruginosa PA01
cccaggauuuguccgcgc

SEQ ID NO: 1450327 - RNA, 13 nt, Pseudomonas aeruginosa PA01
cccaggccggguc

SEQ ID NO: 1450328 - RNA, 19 nt, Pseudomonas aeruginosa PA01
cccaggccgcgcagcaacg

SEQ ID NO: 1450329 - RNA, 22 nt, Pseudomonas aeruginosa PA01
cccaggccgcgcagcaacggcg

SEQ ID NO: 1450330 - RNA, 13 nt, Pseudomonas aeruginosa PA01
cccaggccgccgc

SEQ ID NO: 1450331 - RNA, 18 nt, Pseudomonas aeruginosa PA01
cccaggccgacagcggcu

SEQ ID NO: 1450332 - RNA, 18 nt, Pseudomonas aeruginosa PA01
cccaggcccagccgguga

SEQ ID NO: 1450333 - RNA, 15 nt, Pseudomonas aeruginosa PA01
cccagcgcagccugc

SEQ ID NO: 1450334 - RNA, 13 nt, Pseudomonas aeruginosa PA01
cccagcgcacgcc

SEQ ID NO: 1450335 - RNA, 18 nt, Pseudomonas aeruginosa PA01
cccagcgaguagucgcgg

SEQ ID NO: 1450336 - RNA, 22 nt, Pseudomonas aeruginosa PA01
cccagcgaguagucgcggggcg

SEQ ID NO: 1450337 - RNA, 12 nt, Pseudomonas aeruginosa PA01
cccagcgcaucg

SEQ ID NO: 1450338 - RNA, 13 nt, Pseudomonas aeruginosa PA01
cccagcgcaucgc

SEQ ID NO: 1450339 - RNA, 15 nt, Pseudomonas aeruginosa PA01
cccagcgcaucgcgc

SEQ ID NO: 1450340 - RNA, 16 nt, Pseudomonas aeruginosa PA01
cccagcgcaucgcgca

SEQ ID NO: 1450341 - RNA, 16 nt, Pseudomonas aeruginosa PA01
cccagcgcccgcacca

SEQ ID NO: 1450342 - RNA, 13 nt, Pseudomonas aeruginosa PA01
cccagcgccgcca

SEQ ID NO: 1450343 - RNA, 16 nt, Pseudomonas aeruginosa PA01
cccagcgccgccagca

SEQ ID NO: 1450344 - RNA, 18 nt, Pseudomonas aeruginosa PA01
cccagccgcggcgccacg

SEQ ID NO: 1450345 - RNA, 19 nt, Pseudomonas aeruginosa PA01
cccagccgcucgcguccgc

SEQ ID NO: 1450346 - RNA, 22 nt, Pseudomonas aeruginosa PA01
cccagccggugaaacggaucac

SEQ ID NO: 1450347 - RNA, 13 nt, Pseudomonas aeruginosa PA01
cccagccucggca

SEQ ID NO: 1450348 - RNA, 15 nt, Pseudomonas aeruginosa PA01
cccagccucggcagg

SEQ ID NO: 1450349 - RNA, 22 nt, Pseudomonas aeruginosa PA01
cccagccuugcuggacuucccg

SEQ ID NO: 1450350 - RNA, 18 nt, Pseudomonas aeruginosa PA01
cccagccgacgcgcagcg

SEQ ID NO: 1450351 - RNA, 13 nt, Pseudomonas aeruginosa PA01
cccagccgaggca

SEQ ID NO: 1450352 - RNA, 14 nt, Pseudomonas aeruginosa PA01
cccagccccaccgc

SEQ ID NO: 1450353 - RNA, 16 nt, Pseudomonas aeruginosa PA01
cccagccccaccgcca

SEQ ID NO: 1450354 - RNA, 20 nt, Pseudomonas aeruginosa PA01
cccagaucauguagagcagg

SEQ ID NO: 1450355 - RNA, 18 nt, Pseudomonas aeruginosa PA01
cccagaucgccagcgcca

SEQ ID NO: 1450356 - RNA, 21 nt, Pseudomonas aeruginosa PA01
cccagaugaucaggccgagca

SEQ ID NO: 1450357 - RNA, 15 nt, Pseudomonas aeruginosa PA01
cccagcccagggcga

SEQ ID NO: 1450358 - RNA, 23 nt, Pseudomonas aeruginosa PA01
cccagcccagggcgaucgucgag

SEQ ID NO: 1450359 - RNA, 17 nt, Pseudomonas aeruginosa PA01
cccagccagggccgcga

SEQ ID NO: 1450360 - RNA, 17 nt, Pseudomonas aeruginosa PA01
cccagcaccacagcacc

SEQ ID NO: 1450361 - RNA, 16 nt, Pseudomonas aeruginosa PA01
cccagcaccgagcuga

SEQ ID NO: 1450362 - RNA, 17 nt, Pseudomonas aeruginosa PA01
ccaucgcaggcagcgcg

SEQ ID NO: 1450363 - RNA, 22 nt, Pseudomonas aeruginosa PA01
ccaucgcaggcagcgcgcgucg

SEQ ID NO: 1450364 - RNA, 17 nt, Pseudomonas aeruginosa PA01
ccaucgcauagccggcg

SEQ ID NO: 1450365 - RNA, 13 nt, Pseudomonas aeruginosa PA01
ccaucgcccugca

SEQ ID NO: 1450366 - RNA, 17 nt, Pseudomonas aeruginosa PA01
ccaucgcccugcacgga

SEQ ID NO: 1450367 - RNA, 13 nt, Pseudomonas aeruginosa PA01
ccaucgccaggcc

SEQ ID NO: 1450368 - RNA, 14 nt, Pseudomonas aeruginosa PA01
ccaucgccaggguc

SEQ ID NO: 1450369 - RNA, 20 nt, Pseudomonas aeruginosa PA01
ccaucgcggcgauggccgcc

SEQ ID NO: 1450370 - RNA, 22 nt, Pseudomonas aeruginosa PA01
ccaucgcggcgauggccgccag

SEQ ID NO: 1450371 - RNA, 16 nt, Pseudomonas aeruginosa PA01
ccaucgccucgccggc

SEQ ID NO: 1450372 - RNA, 22 nt, Pseudomonas aeruginosa PA01
ccaucgccucgcggaccucggg

SEQ ID NO: 1450373 - RNA, 18 nt, Pseudomonas aeruginosa PA01
ccaucgccggcccgcgcg

SEQ ID NO: 1450374 - RNA, 22 nt, Pseudomonas aeruginosa PA01
ccaucgccggcccgcgcggcaa

SEQ ID NO: 1450375 - RNA, 13 nt, Pseudomonas aeruginosa PA01
ccaucgccggcga

SEQ ID NO: 1450376 - RNA, 16 nt, Pseudomonas aeruginosa PA01
ccaucgccggcgagcc

SEQ ID NO: 1450377 - RNA, 21 nt, Pseudomonas aeruginosa PA01
ccaucgccggcgagccgcugg

SEQ ID NO: 1450378 - RNA, 13 nt, Pseudomonas aeruginosa PA01
ccaucgccgcgga

SEQ ID NO: 1450379 - RNA, 19 nt, Pseudomonas aeruginosa PA01
ccaucgucgcuuccggcgc

SEQ ID NO: 1450380 - RNA, 20 nt, Pseudomonas aeruginosa PA01
ccaucgucgcuuccggcgcc

SEQ ID NO: 1450381 - RNA, 17 nt, Pseudomonas aeruginosa PA01
ccaucggguugaucgac

SEQ ID NO: 1450382 - RNA, 14 nt, Pseudomonas aeruginosa PA01
ccaucggucgcgcc

SEQ ID NO: 1450383 - RNA, 15 nt, Pseudomonas aeruginosa PA01
ccaucggccuggggc

SEQ ID NO: 1450384 - RNA, 16 nt, Pseudomonas aeruginosa PA01
ccaucggcgucggcug

SEQ ID NO: 1450385 - RNA, 17 nt, Pseudomonas aeruginosa PA01
ccaucggcgucggcugg

SEQ ID NO: 1450386 - RNA, 17 nt, Pseudomonas aeruginosa PA01
ccaucgcuccagcgaau

SEQ ID NO: 1450387 - RNA, 17 nt, Pseudomonas aeruginosa PA01
ccaucgcuuuccuggcc

SEQ ID NO: 1450388 - RNA, 22 nt, Pseudomonas aeruginosa PA01
ccauccagucuucgccggccug

SEQ ID NO: 1450389 - RNA, 23 nt, Pseudomonas aeruginosa PA01
ccauccaggcuuuccaccgccag

SEQ ID NO: 1450390 - RNA, 16 nt, Pseudomonas aeruginosa PA01
ccauccgccgcaggaa

SEQ ID NO: 1450391 - RNA, 17 nt, Pseudomonas aeruginosa PA01
ccauccgcgccgaccag

SEQ ID NO: 1450392 - RNA, 16 nt, Pseudomonas aeruginosa PA01
ccauccagccaggcgc

SEQ ID NO: 1450393 - RNA, 15 nt, Pseudomonas aeruginosa PA01
ccaucagggcgaaag

SEQ ID NO: 1450394 - RNA, 12 nt, Pseudomonas aeruginosa PA01
ccaucaggcgcu

SEQ ID NO: 1450395 - RNA, 18 nt, Pseudomonas aeruginosa PA01
ccaucgaggccaggccga

SEQ ID NO: 1450396 - RNA, 16 nt, Pseudomonas aeruginosa PA01
ccaucgaucagcagcg

SEQ ID NO: 1450397 - RNA, 17 nt, Pseudomonas aeruginosa PA01
ccauccuccagcgccgc

SEQ ID NO: 1450398 - RNA, 16 nt, Pseudomonas aeruginosa PA01
ccauccuggccggucg

SEQ ID NO: 1450399 - RNA, 18 nt, Pseudomonas aeruginosa PA01
ccauccuggucgcguucc

SEQ ID NO: 1450400 - RNA, 23 nt, Pseudomonas aeruginosa PA01
ccauccuggucgcguuccagcuc

SEQ ID NO: 1450401 - RNA, 14 nt, Pseudomonas aeruginosa PA01
ccauccuucggcgu

SEQ ID NO: 1450402 - RNA, 18 nt, Pseudomonas aeruginosa PA01
ccauccggaguucgcccg

SEQ ID NO: 1450403 - RNA, 19 nt, Pseudomonas aeruginosa PA01
ccauccggaguucgcccgc

SEQ ID NO: 1450404 - RNA, 16 nt, Pseudomonas aeruginosa PA01
ccaugcccgcugggca

SEQ ID NO: 1450405 - RNA, 13 nt, Pseudomonas aeruginosa PA01
ccaugccgcccgg

SEQ ID NO: 1450406 - RNA, 18 nt, Pseudomonas aeruginosa PA01
ccaugccgcccggccgcu

SEQ ID NO: 1450407 - RNA, 19 nt, Pseudomonas aeruginosa PA01
ccaugcuggcgcucucgaa

SEQ ID NO: 1450408 - RNA, 15 nt, Pseudomonas aeruginosa PA01
ccaugccgccgacgc

SEQ ID NO: 1450409 - RNA, 20 nt, Pseudomonas aeruginosa PA01
ccaugccgccgacgccggac

SEQ ID NO: 1450410 - RNA, 16 nt, Pseudomonas aeruginosa PA01
ccaugccggcgccgau

SEQ ID NO: 1450411 - RNA, 19 nt, Pseudomonas aeruginosa PA01
ccaugccguagaucaggac

SEQ ID NO: 1450412 - RNA, 18 nt, Pseudomonas aeruginosa PA01
ccaugccuuccaccggcg

SEQ ID NO: 1450413 - RNA, 12 nt, Pseudomonas aeruginosa PA01
ccaugccuugca

SEQ ID NO: 1450414 - RNA, 15 nt, Pseudomonas aeruginosa PA01
ccaugccguucagcg

SEQ ID NO: 1450415 - RNA, 17 nt, Pseudomonas aeruginosa PA01
ccaugccguucaggccg

SEQ ID NO: 1450416 - RNA, 20 nt, Pseudomonas aeruginosa PA01
ccaugccguucaggccggcg

SEQ ID NO: 1450417 - RNA, 22 nt, Pseudomonas aeruginosa PA01
ccaugccguucaggccggcgcc

SEQ ID NO: 1450418 - RNA, 11 nt, Pseudomonas aeruginosa PA01
ccauggcaucc

SEQ ID NO: 1450419 - RNA, 16 nt, Pseudomonas aeruginosa PA01
ccaugggccggccgac

SEQ ID NO: 1450420 - RNA, 17 nt, Pseudomonas aeruginosa PA01
ccaugggccggccgacg

SEQ ID NO: 1450421 - RNA, 13 nt, Pseudomonas aeruginosa PA01
ccauggggaucac

SEQ ID NO: 1450422 - RNA, 19 nt, Pseudomonas aeruginosa PA01
ccaugcaagaacgccgacc

SEQ ID NO: 1450423 - RNA, 22 nt, Pseudomonas aeruginosa PA01
ccaugcaagaacgccgacccua

SEQ ID NO: 1450424 - RNA, 19 nt, Pseudomonas aeruginosa PA01
ccaugcagcggcaugguca

SEQ ID NO: 1450425 - RNA, 14 nt, Pseudomonas aeruginosa PA01
ccaugcaggccagg

SEQ ID NO: 1450426 - RNA, 19 nt, Pseudomonas aeruginosa PA01
ccaugcaggcugccggacg

SEQ ID NO: 1450427 - RNA, 18 nt, Pseudomonas aeruginosa PA01
ccaugccaggagaaccug

SEQ ID NO: 1450428 - RNA, 18 nt, Pseudomonas aeruginosa PA01
ccaugaugugcgcaggcu

SEQ ID NO: 1450429 - RNA, 19 nt, Pseudomonas aeruginosa PA01
ccaugaugugcgcaggcug

SEQ ID NO: 1450430 - RNA, 22 nt, Pseudomonas aeruginosa PA01
ccaugagguuggccacguaggg

SEQ ID NO: 1450431 - RNA, 19 nt, Pseudomonas aeruginosa PA01
ccaugaucaucgccugcug

SEQ ID NO: 1450432 - RNA, 14 nt, Pseudomonas aeruginosa PA01
ccaugaucaucggc

SEQ ID NO: 1450433 - RNA, 16 nt, Pseudomonas aeruginosa PA01
ccaugaucaucggcug

SEQ ID NO: 1450434 - RNA, 20 nt, Pseudomonas aeruginosa PA01
ccaugaucaucggcuggccg

SEQ ID NO: 1450435 - RNA, 20 nt, Pseudomonas aeruginosa PA01
ccaugaccgucagccaggcu

SEQ ID NO: 1450436 - RNA, 22 nt, Pseudomonas aeruginosa PA01
ccaugagcgacccaacggggcc

SEQ ID NO: 1450437 - RNA, 17 nt, Pseudomonas aeruginosa PA01
ccaucugcaacgcggcg

SEQ ID NO: 1450438 - RNA, 18 nt, Pseudomonas aeruginosa PA01
ccaucugcacgucguagc

SEQ ID NO: 1450439 - RNA, 22 nt, Pseudomonas aeruginosa PA01
ccaucugccggccaccaucacg

SEQ ID NO: 1450440 - RNA, 13 nt, Pseudomonas aeruginosa PA01
ccaucucgccgcg

SEQ ID NO: 1450441 - RNA, 17 nt, Pseudomonas aeruginosa PA01
ccaucucgccgcgcacg

SEQ ID NO: 1450442 - RNA, 15 nt, Pseudomonas aeruginosa PA01
ccaucuguaccaccg

SEQ ID NO: 1450443 - RNA, 19 nt, Pseudomonas aeruginosa PA01
ccaucuuuuccugcuggcg

SEQ ID NO: 1450444 - RNA, 20 nt, Pseudomonas aeruginosa PA01
ccaucuuuuccugcuggcga

SEQ ID NO: 1450445 - RNA, 17 nt, Pseudomonas aeruginosa PA01
ccaugaaaaaggccggu

SEQ ID NO: 1450446 - RNA, 16 nt, Pseudomonas aeruginosa PA01
ccaugaacucuucccc

SEQ ID NO: 1450447 - RNA, 19 nt, Pseudomonas aeruginosa PA01
caacugcgcccccagcgcc

SEQ ID NO: 1450448 - RNA, 21 nt, Pseudomonas aeruginosa PA01
caacugcucgaucaaccccug

SEQ ID NO: 1450449 - RNA, 13 nt, Pseudomonas aeruginosa PA01
caacugcguccga

SEQ ID NO: 1450450 - RNA, 18 nt, Pseudomonas aeruginosa PA01
caagcgaaccgaggagga

SEQ ID NO: 1450451 - RNA, 15 nt, Pseudomonas aeruginosa PA01
caagccuggcgcgcu

SEQ ID NO: 1450452 - RNA, 23 nt, Pseudomonas aeruginosa PA01
caagccuggcgcgcugcggcagg

SEQ ID NO: 1450453 - RNA, 16 nt, Pseudomonas aeruginosa PA01
caagccuuccagguag

SEQ ID NO: 1450454 - RNA, 15 nt, Pseudomonas aeruginosa PA01
caagccuccagcgcc

SEQ ID NO: 1450455 - RNA, 16 nt, Pseudomonas aeruginosa PA01
caagccuccagcgccg

SEQ ID NO: 1450456 - RNA, 22 nt, Pseudomonas aeruginosa PA01
caagcuccccgccgccaggcgc

SEQ ID NO: 1450457 - RNA, 13 nt, Pseudomonas aeruginosa PA01
caagcgaucucuc

SEQ ID NO: 1450458 - RNA, 15 nt, Pseudomonas aeruginosa PA01
caagcgucgccggcc

SEQ ID NO: 1450459 - RNA, 16 nt, Pseudomonas aeruginosa PA01
caagcgucgccggccg

SEQ ID NO: 1450460 - RNA, 19 nt, Pseudomonas aeruginosa PA01
caagccguuacgacaucga

SEQ ID NO: 1450461 - RNA, 19 nt, Pseudomonas aeruginosa PA01
caagccguagaacgccagg

SEQ ID NO: 1450462 - RNA, 19 nt, Pseudomonas aeruginosa PA01
caaggcauugcgcuugcga

SEQ ID NO: 1450463 - RNA, 17 nt, Pseudomonas aeruginosa PA01
caaggccagcggcaucc

SEQ ID NO: 1450464 - RNA, 14 nt, Pseudomonas aeruginosa PA01
caaggccagggcgg

SEQ ID NO: 1450465 - RNA, 18 nt, Pseudomonas aeruginosa PA01
caaggccagggcggcgcc

SEQ ID NO: 1450466 - RNA, 17 nt, Pseudomonas aeruginosa PA01
caaggccaggucgacga

SEQ ID NO: 1450467 - RNA, 16 nt, Pseudomonas aeruginosa PA01
caaggccucggcaucc

SEQ ID NO: 1450468 - RNA, 18 nt, Pseudomonas aeruginosa PA01
caaggccgccaggccucg

SEQ ID NO: 1450469 - RNA, 18 nt, Pseudomonas aeruginosa PA01
caaggcugaggccgacga

SEQ ID NO: 1450470 - RNA, 18 nt, Pseudomonas aeruginosa PA01
caagggcacgugcagcgg

SEQ ID NO: 1450471 - RNA, 22 nt, Pseudomonas aeruginosa PA01
caagggcacgugcagcggcagc

SEQ ID NO: 1450472 - RNA, 18 nt, Pseudomonas aeruginosa PA01
caagggcacuucguccag

SEQ ID NO: 1450473 - RNA, 21 nt, Pseudomonas aeruginosa PA01
caagggcacuucguccaggcc

SEQ ID NO: 1450474 - RNA, 17 nt, Pseudomonas aeruginosa PA01
caagggccagagcacga

SEQ ID NO: 1450475 - RNA, 23 nt, Pseudomonas aeruginosa PA01
caagggccaggaaaucgagcgcc

SEQ ID NO: 1450476 - RNA, 17 nt, Pseudomonas aeruginosa PA01
caaggcggugaccagcg

SEQ ID NO: 1450477 - RNA, 23 nt, Pseudomonas aeruginosa PA01
caaggcgucauagcagcgccgcg

SEQ ID NO: 1450478 - RNA, 20 nt, Pseudomonas aeruginosa PA01
caaggaccugcugcccggca

SEQ ID NO: 1450479 - RNA, 17 nt, Pseudomonas aeruginosa PA01
caaggaacuggaagccu

SEQ ID NO: 1450480 - RNA, 20 nt, Pseudomonas aeruginosa PA01
caagcuuguugcgcaggcga

SEQ ID NO: 1450481 - RNA, 18 nt, Pseudomonas aeruginosa PA01
caaggagcgcgagcggca

SEQ ID NO: 1450482 - RNA, 16 nt, Pseudomonas aeruginosa PA01
caaggcacacgcccgg

SEQ ID NO: 1450483 - RNA, 19 nt, Pseudomonas aeruginosa PA01
caaggcacacgcccggcac

SEQ ID NO: 1450484 - RNA, 14 nt, Pseudomonas aeruginosa PA01
caaggaugcgccag

SEQ ID NO: 1450485 - RNA, 19 nt, Pseudomonas aeruginosa PA01
caaggaugcgccagcggcc

SEQ ID NO: 1450486 - RNA, 19 nt, Pseudomonas aeruginosa PA01
caagcucgacgagccgcga

SEQ ID NO: 1450487 - RNA, 19 nt, Pseudomonas aeruginosa PA01
caagcucgucacccgcgcc

SEQ ID NO: 1450488 - RNA, 15 nt, Pseudomonas aeruginosa PA01
caagcugcacggcga

SEQ ID NO: 1450489 - RNA, 15 nt, Pseudomonas aeruginosa PA01
caagcuggcgaucga

SEQ ID NO: 1450490 - RNA, 16 nt, Pseudomonas aeruginosa PA01
caagcuggcgaucgac

SEQ ID NO: 1450491 - RNA, 19 nt, Pseudomonas aeruginosa PA01
caagcuggcgaucgaccug

SEQ ID NO: 1450492 - RNA, 20 nt, Pseudomonas aeruginosa PA01
caagcuggcgaucgaccugc

SEQ ID NO: 1450493 - RNA, 17 nt, Pseudomonas aeruginosa PA01
caacggagcugguacgc

SEQ ID NO: 1450494 - RNA, 19 nt, Pseudomonas aeruginosa PA01
caacggccguugaagcaga

SEQ ID NO: 1450495 - RNA, 16 nt, Pseudomonas aeruginosa PA01
caacggcgaaucgucg

SEQ ID NO: 1450496 - RNA, 15 nt, Pseudomonas aeruginosa PA01
caacggcgugccggg

SEQ ID NO: 1450497 - RNA, 18 nt, Pseudomonas aeruginosa PA01
caacggcuccuugaaggc

SEQ ID NO: 1450498 - RNA, 19 nt, Pseudomonas aeruginosa PA01
caacggcgaccgcuggacc

SEQ ID NO: 1450499 - RNA, 14 nt, Pseudomonas aeruginosa PA01
caacggcgggccgc

SEQ ID NO: 1450500 - RNA, 17 nt, Pseudomonas aeruginosa PA01
caacgggacgccaggcg

SEQ ID NO: 1450501 - RNA, 22 nt, Pseudomonas aeruginosa PA01
caacggcguuauccgccgcuca

SEQ ID NO: 1450502 - RNA, 16 nt, Pseudomonas aeruginosa PA01
caacgguagcggauca

SEQ ID NO: 1450503 - RNA, 14 nt, Pseudomonas aeruginosa PA01
caacgggcggcggg

SEQ ID NO: 1450504 - RNA, 22 nt, Pseudomonas aeruginosa PA01
caacgggcggcgggacuggggc

SEQ ID NO: 1450505 - RNA, 15 nt, Pseudomonas aeruginosa PA01
caacugaucagccgg

SEQ ID NO: 1450506 - RNA, 18 nt, Pseudomonas aeruginosa PA01
caacugaucagccgggcg

SEQ ID NO: 1450507 - RNA, 14 nt, Pseudomonas aeruginosa PA01
caacugacggcgga

SEQ ID NO: 1450508 - RNA, 21 nt, Pseudomonas aeruginosa PA01
caacugacggcggaaggcggc

SEQ ID NO: 1450509 - RNA, 17 nt, Pseudomonas aeruginosa PA01
caacugccaaccgcgcu

SEQ ID NO: 1450510 - RNA, 13 nt, Pseudomonas aeruginosa PA01
caacugccgcccg

SEQ ID NO: 1450511 - RNA, 19 nt, Pseudomonas aeruginosa PA01
caacugccggucggccuug

SEQ ID NO: 1450512 - RNA, 20 nt, Pseudomonas aeruginosa PA01
caacucuuccagggucggca

SEQ ID NO: 1450513 - RNA, 18 nt, Pseudomonas aeruginosa PA01
caacguccucgaugcccg

SEQ ID NO: 1450514 - RNA, 21 nt, Pseudomonas aeruginosa PA01
caacguccucgaugcccgccu

SEQ ID NO: 1450515 - RNA, 17 nt, Pseudomonas aeruginosa PA01
caacgucuucaggcgcu

SEQ ID NO: 1450516 - RNA, 16 nt, Pseudomonas aeruginosa PA01
caauucgacgccgaaa

SEQ ID NO: 1450517 - RNA, 18 nt, Pseudomonas aeruginosa PA01
caauucgcggacgccgaa

SEQ ID NO: 1450518 - RNA, 19 nt, Pseudomonas aeruginosa PA01
caauucgcggacgccgaag

SEQ ID NO: 1450519 - RNA, 16 nt, Pseudomonas aeruginosa PA01
caaucugcccggcauc

SEQ ID NO: 1450520 - RNA, 20 nt, Pseudomonas aeruginosa PA01
caaugcguggguccacgccg

SEQ ID NO: 1450521 - RNA, 22 nt, Pseudomonas aeruginosa PA01
caaugcguggguccacgccggg

SEQ ID NO: 1450522 - RNA, 17 nt, Pseudomonas aeruginosa PA01
caaugcccgcgccuggg

SEQ ID NO: 1450523 - RNA, 16 nt, Pseudomonas aeruginosa PA01
caaugcccggaccugg

SEQ ID NO: 1450524 - RNA, 22 nt, Pseudomonas aeruginosa PA01
caauggauguugccgccgccga

SEQ ID NO: 1450525 - RNA, 21 nt, Pseudomonas aeruginosa PA01
caauggacaagcgucgccggc

SEQ ID NO: 1450526 - RNA, 13 nt, Pseudomonas aeruginosa PA01
caaugccagcgcc

SEQ ID NO: 1450527 - RNA, 15 nt, Pseudomonas aeruginosa PA01
caaugccagcgccac

SEQ ID NO: 1450528 - RNA, 17 nt, Pseudomonas aeruginosa PA01
caaugccagcgccacgc

SEQ ID NO: 1450529 - RNA, 13 nt, Pseudomonas aeruginosa PA01
caaugcccagcgc

SEQ ID NO: 1450530 - RNA, 19 nt, Pseudomonas aeruginosa PA01
caaugccagugccucgcgc

SEQ ID NO: 1450531 - RNA, 15 nt, Pseudomonas aeruginosa PA01
caagguuugcgccgc

SEQ ID NO: 1450532 - RNA, 21 nt, Pseudomonas aeruginosa PA01
caagguuccagccccgccgga

SEQ ID NO: 1450533 - RNA, 22 nt, Pseudomonas aeruginosa PA01
caagggcgucugggacggcagc

SEQ ID NO: 1450534 - RNA, 15 nt, Pseudomonas aeruginosa PA01
caagggcgccgccga

SEQ ID NO: 1450535 - RNA, 20 nt, Pseudomonas aeruginosa PA01
caauccgauuccgcgcagga

SEQ ID NO: 1450536 - RNA, 23 nt, Pseudomonas aeruginosa PA01
caauccggcuggacacgguccag

SEQ ID NO: 1450537 - RNA, 16 nt, Pseudomonas aeruginosa PA01
caauccguuaccgcgg

SEQ ID NO: 1450538 - RNA, 22 nt, Pseudomonas aeruginosa PA01
caaccugccagaaaacccagcg

SEQ ID NO: 1450539 - RNA, 15 nt, Pseudomonas aeruginosa PA01
caaccguuccagcgc

SEQ ID NO: 1450540 - RNA, 16 nt, Pseudomonas aeruginosa PA01
caaccguuccagcgcc

SEQ ID NO: 1450541 - RNA, 15 nt, Pseudomonas aeruginosa PA01
caaccguucugccgc

SEQ ID NO: 1450542 - RNA, 20 nt, Pseudomonas aeruginosa PA01
caaccguucugccgcagcgc

SEQ ID NO: 1450543 - RNA, 21 nt, Pseudomonas aeruginosa PA01
caaccguucugccgcagcgcc

SEQ ID NO: 1450544 - RNA, 11 nt, Pseudomonas aeruginosa PA01
caaccgucgaa

SEQ ID NO: 1450545 - RNA, 18 nt, Pseudomonas aeruginosa PA01
caaccgucgcccuggugc

SEQ ID NO: 1450546 - RNA, 17 nt, Pseudomonas aeruginosa PA01
caaccgguuucccucga

SEQ ID NO: 1450547 - RNA, 15 nt, Pseudomonas aeruginosa PA01
caaccgggcagcagc

SEQ ID NO: 1450548 - RNA, 16 nt, Pseudomonas aeruginosa PA01
caaccgggcagcagcc

SEQ ID NO: 1450549 - RNA, 17 nt, Pseudomonas aeruginosa PA01
caaccgggcagcagccg

SEQ ID NO: 1450550 - RNA, 18 nt, Pseudomonas aeruginosa PA01
caaccgggcaucgccgac

SEQ ID NO: 1450551 - RNA, 21 nt, Pseudomonas aeruginosa PA01
caaccggguaccugcucgcgg

SEQ ID NO: 1450552 - RNA, 13 nt, Pseudomonas aeruginosa PA01
caaccgcucgcgg

SEQ ID NO: 1450553 - RNA, 15 nt, Pseudomonas aeruginosa PA01
caaccgcugccgccg

SEQ ID NO: 1450554 - RNA, 17 nt, Pseudomonas aeruginosa PA01
caaccgcugccgccguc

SEQ ID NO: 1450555 - RNA, 22 nt, Pseudomonas aeruginosa PA01
caaccgcuugcggucauccgcc

SEQ ID NO: 1450556 - RNA, 21 nt, Pseudomonas aeruginosa PA01
caacccuugcucccgccgcuc

SEQ ID NO: 1450557 - RNA, 18 nt, Pseudomonas aeruginosa PA01
caaccgauauggcuggcg

SEQ ID NO: 1450558 - RNA, 20 nt, Pseudomonas aeruginosa PA01
caaccgauauggcuggcgca

SEQ ID NO: 1450559 - RNA, 13 nt, Pseudomonas aeruginosa PA01
caaccgcggcggc

SEQ ID NO: 1450560 - RNA, 14 nt, Pseudomonas aeruginosa PA01
caaccgcggcggcc

SEQ ID NO: 1450561 - RNA, 15 nt, Pseudomonas aeruginosa PA01
caaccgcgcucggcg

SEQ ID NO: 1450562 - RNA, 19 nt, Pseudomonas aeruginosa PA01
caaccgccguagccgucgu

SEQ ID NO: 1450563 - RNA, 19 nt, Pseudomonas aeruginosa PA01
caaccgcagacuccggcgc

SEQ ID NO: 1450564 - RNA, 16 nt, Pseudomonas aeruginosa PA01
caacccggccagcccg

SEQ ID NO: 1450565 - RNA, 15 nt, Pseudomonas aeruginosa PA01
caacccggcccagcg

SEQ ID NO: 1450566 - RNA, 18 nt, Pseudomonas aeruginosa PA01
caacccggcccagcguuc

SEQ ID NO: 1450567 - RNA, 13 nt, Pseudomonas aeruginosa PA01
caacccgcuccgu

SEQ ID NO: 1450568 - RNA, 18 nt, Pseudomonas aeruginosa PA01
caacccggcgcuggccgc

SEQ ID NO: 1450569 - RNA, 19 nt, Pseudomonas aeruginosa PA01
caacccggcgcuggccgcg

SEQ ID NO: 1450570 - RNA, 15 nt, Pseudomonas aeruginosa PA01
caacccgccagcaag

SEQ ID NO: 1450571 - RNA, 14 nt, Pseudomonas aeruginosa PA01
caacccgcccggcu

SEQ ID NO: 1450572 - RNA, 15 nt, Pseudomonas aeruginosa PA01
caacccgcccggcuc

SEQ ID NO: 1450573 - RNA, 14 nt, Pseudomonas aeruginosa PA01
caacccgccgcuga

SEQ ID NO: 1450574 - RNA, 13 nt, Pseudomonas aeruginosa PA01
caaccaguaggcg

SEQ ID NO: 1450575 - RNA, 20 nt, Pseudomonas aeruginosa PA01
caaccccuucggucgcgccc

SEQ ID NO: 1450576 - RNA, 16 nt, Pseudomonas aeruginosa PA01
caacccagggcgcugc

SEQ ID NO: 1450577 - RNA, 24 nt, Pseudomonas aeruginosa PA01
caacccagggcgcugccgaucagc

SEQ ID NO: 1450578 - RNA, 23 nt, Pseudomonas aeruginosa PA01
caacgcugcaauucgucggccug

SEQ ID NO: 1450579 - RNA, 19 nt, Pseudomonas aeruginosa PA01
caacgcgguuauccgccgc

SEQ ID NO: 1450580 - RNA, 15 nt, Pseudomonas aeruginosa PA01
caacgcgcgcaggac

SEQ ID NO: 1450581 - RNA, 14 nt, Pseudomonas aeruginosa PA01
caacgcgcagaggc

SEQ ID NO: 1450582 - RNA, 15 nt, Pseudomonas aeruginosa PA01
caacgccggcccgug

SEQ ID NO: 1450583 - RNA, 17 nt, Pseudomonas aeruginosa PA01
caacgcccgggccgggg

SEQ ID NO: 1450584 - RNA, 13 nt, Pseudomonas aeruginosa PA01
caacgccgacggc

SEQ ID NO: 1450585 - RNA, 19 nt, Pseudomonas aeruginosa PA01
caacgccgacggcgugccg

SEQ ID NO: 1450586 - RNA, 19 nt, Pseudomonas aeruginosa PA01
caacgccgcccccagcgcg

SEQ ID NO: 1450587 - RNA, 12 nt, Pseudomonas aeruginosa PA01
caacgccgccaa

SEQ ID NO: 1450588 - RNA, 16 nt, Pseudomonas aeruginosa PA01
caacgccucgcggcua

SEQ ID NO: 1450589 - RNA, 18 nt, Pseudomonas aeruginosa PA01
caacgccuggccacgcca

SEQ ID NO: 1450590 - RNA, 13 nt, Pseudomonas aeruginosa PA01
caacgccuggugc

SEQ ID NO: 1450591 - RNA, 19 nt, Pseudomonas aeruginosa PA01
caacgaaaagccgccccga

SEQ ID NO: 1450592 - RNA, 14 nt, Pseudomonas aeruginosa PA01
caacgagccgagca

SEQ ID NO: 1450593 - RNA, 15 nt, Pseudomonas aeruginosa PA01
caacgagccgagcag

SEQ ID NO: 1450594 - RNA, 17 nt, Pseudomonas aeruginosa PA01
caacgaagucgcgaggu

SEQ ID NO: 1450595 - RNA, 20 nt, Pseudomonas aeruginosa PA01
caacgacagccccggcccgg

SEQ ID NO: 1450596 - RNA, 16 nt, Pseudomonas aeruginosa PA01
caacgaccgcccaggc

SEQ ID NO: 1450597 - RNA, 16 nt, Pseudomonas aeruginosa PA01
caacgccagcaggcgc

SEQ ID NO: 1450598 - RNA, 13 nt, Pseudomonas aeruginosa PA01
caacgccaccgcg

SEQ ID NO: 1450599 - RNA, 16 nt, Pseudomonas aeruginosa PA01
caacauggcgucggcg

SEQ ID NO: 1450600 - RNA, 21 nt, Pseudomonas aeruginosa PA01
caacauccugaaaagcgcugc

SEQ ID NO: 1450601 - RNA, 19 nt, Pseudomonas aeruginosa PA01
caaccaugguuuccgccgg

SEQ ID NO: 1450602 - RNA, 22 nt, Pseudomonas aeruginosa PA01
caaccaugguuuccgccggacc

SEQ ID NO: 1450603 - RNA, 13 nt, Pseudomonas aeruginosa PA01
caaccagcaccgc

SEQ ID NO: 1450604 - RNA, 17 nt, Pseudomonas aeruginosa PA01
caaccagccggagagau

SEQ ID NO: 1450605 - RNA, 13 nt, Pseudomonas aeruginosa PA01
caaccaccggcgc

SEQ ID NO: 1450606 - RNA, 20 nt, Pseudomonas aeruginosa PA01
caacagggcgucgucgaggc

SEQ ID NO: 1450607 - RNA, 18 nt, Pseudomonas aeruginosa PA01
caacagucgucgcgcagc

SEQ ID NO: 1450608 - RNA, 19 nt, Pseudomonas aeruginosa PA01
caacagucgucgcgcagcu

SEQ ID NO: 1450609 - RNA, 17 nt, Pseudomonas aeruginosa PA01
caacaguucugccgcag

SEQ ID NO: 1450610 - RNA, 19 nt, Pseudomonas aeruginosa PA01
caacaccuugcgcaccgcc

SEQ ID NO: 1450611 - RNA, 15 nt, Pseudomonas aeruginosa PA01
caacaccuggcgcuc

SEQ ID NO: 1450612 - RNA, 12 nt, Pseudomonas aeruginosa PA01
caacagccggcg

SEQ ID NO: 1450613 - RNA, 19 nt, Pseudomonas aeruginosa PA01
caacagcgaagcuggcgca

SEQ ID NO: 1450614 - RNA, 15 nt, Pseudomonas aeruginosa PA01
caacagcgccgcgcg

SEQ ID NO: 1450615 - RNA, 17 nt, Pseudomonas aeruginosa PA01
caacagcgccgcgcgcu

SEQ ID NO: 1450616 - RNA, 15 nt, Pseudomonas aeruginosa PA01
caacagcgucgccaa

SEQ ID NO: 1450617 - RNA, 19 nt, Pseudomonas aeruginosa PA01
caaagcucgcgcaagcgcc

SEQ ID NO: 1450618 - RNA, 17 nt, Pseudomonas aeruginosa PA01
caaagcggcgacgccac

SEQ ID NO: 1450619 - RNA, 23 nt, Pseudomonas aeruginosa PA01
caacaaggcauucaccagcgacg

SEQ ID NO: 1450620 - RNA, 18 nt, Pseudomonas aeruginosa PA01
caccacgcgauauccgcc

SEQ ID NO: 1450621 - RNA, 23 nt, Pseudomonas aeruginosa PA01
caccacgcgauauccgccaggcg

SEQ ID NO: 1450622 - RNA, 19 nt, Pseudomonas aeruginosa PA01
caccacggcgaagccgcgc

SEQ ID NO: 1450623 - RNA, 21 nt, Pseudomonas aeruginosa PA01
caccacggcgaagccgcgccc

SEQ ID NO: 1450624 - RNA, 13 nt, Pseudomonas aeruginosa PA01
caccacggcgaug

SEQ ID NO: 1450625 - RNA, 14 nt, Pseudomonas aeruginosa PA01
caccaccggcuggc

SEQ ID NO: 1450626 - RNA, 22 nt, Pseudomonas aeruginosa PA01
caccaccgggaugaacugcagc

SEQ ID NO: 1450627 - RNA, 21 nt, Pseudomonas aeruginosa PA01
caccaccgggggaagaaccca

SEQ ID NO: 1450628 - RNA, 16 nt, Pseudomonas aeruginosa PA01
caccacgacguugccc

SEQ ID NO: 1450629 - RNA, 15 nt, Pseudomonas aeruginosa PA01
caccacgcauugucg

SEQ ID NO: 1450630 - RNA, 21 nt, Pseudomonas aeruginosa PA01
caccacgaugcugaucuucug

SEQ ID NO: 1450631 - RNA, 13 nt, Pseudomonas aeruginosa PA01
caccacgaucagg

SEQ ID NO: 1450632 - RNA, 16 nt, Pseudomonas aeruginosa PA01
caccacgaucaggccc

SEQ ID NO: 1450633 - RNA, 15 nt, Pseudomonas aeruginosa PA01
cacauuggcuuccga

SEQ ID NO: 1450634 - RNA, 13 nt, Pseudomonas aeruginosa PA01
cacauggucggcc

SEQ ID NO: 1450635 - RNA, 16 nt, Pseudomonas aeruginosa PA01
cacauggucggccagg

SEQ ID NO: 1450636 - RNA, 16 nt, Pseudomonas aeruginosa PA01
cacauggugggcgccg

SEQ ID NO: 1450637 - RNA, 19 nt, Pseudomonas aeruginosa PA01
cacauggugggcgccgcug

SEQ ID NO: 1450638 - RNA, 20 nt, Pseudomonas aeruginosa PA01
cacauggugggcgccgcugu

SEQ ID NO: 1450639 - RNA, 16 nt, Pseudomonas aeruginosa PA01
caccaccgccgccagc

SEQ ID NO: 1450640 - RNA, 23 nt, Pseudomonas aeruginosa PA01
caccaccagguugaagaacggcc

SEQ ID NO: 1450641 - RNA, 14 nt, Pseudomonas aeruginosa PA01
caccaccgccgcca

SEQ ID NO: 1450642 - RNA, 17 nt, Pseudomonas aeruginosa PA01
caccaccagggucucca

SEQ ID NO: 1450643 - RNA, 20 nt, Pseudomonas aeruginosa PA01
caccaccagggucuccagga

SEQ ID NO: 1450644 - RNA, 15 nt, Pseudomonas aeruginosa PA01
caccaccaggucggc

SEQ ID NO: 1450645 - RNA, 16 nt, Pseudomonas aeruginosa PA01
caccaccaggucggcg

SEQ ID NO: 1450646 - RNA, 14 nt, Pseudomonas aeruginosa PA01
caccaccagcauca

SEQ ID NO: 1450647 - RNA, 23 nt, Pseudomonas aeruginosa PA01
caccaccagcaucaccaccggga

SEQ ID NO: 1450648 - RNA, 13 nt, Pseudomonas aeruginosa PA01
caccaccagcgcc

SEQ ID NO: 1450649 - RNA, 16 nt, Pseudomonas aeruginosa PA01
caccaccagcgccgcc

SEQ ID NO: 1450650 - RNA, 17 nt, Pseudomonas aeruginosa PA01
caccaccagcgccgcca

SEQ ID NO: 1450651 - RNA, 14 nt, Pseudomonas aeruginosa PA01
caccaccagcgcgc

SEQ ID NO: 1450652 - RNA, 17 nt, Pseudomonas aeruginosa PA01
caccaccagcgcgcgcu

SEQ ID NO: 1450653 - RNA, 18 nt, Pseudomonas aeruginosa PA01
caccaccacgccgucgcc

SEQ ID NO: 1450654 - RNA, 14 nt, Pseudomonas aeruginosa PA01
caccaccaccgcgc

SEQ ID NO: 1450655 - RNA, 12 nt, Pseudomonas aeruginosa PA01
caccaccaccga

SEQ ID NO: 1450656 - RNA, 16 nt, Pseudomonas aeruginosa PA01
caccaccaccgacgcc

SEQ ID NO: 1450657 - RNA, 18 nt, Pseudomonas aeruginosa PA01
cacaaaaaaggcggauga

SEQ ID NO: 1450658 - RNA, 15 nt, Pseudomonas aeruginosa PA01
cacagccccagccuc

SEQ ID NO: 1450659 - RNA, 15 nt, Pseudomonas aeruginosa PA01
cacagccauagcgcc

SEQ ID NO: 1450660 - RNA, 16 nt, Pseudomonas aeruginosa PA01
cacagccauagugcug

SEQ ID NO: 1450661 - RNA, 20 nt, Pseudomonas aeruginosa PA01
cacaggcggaaggccucggu

SEQ ID NO: 1450662 - RNA, 17 nt, Pseudomonas aeruginosa PA01
cacaggcggcggaagaa

SEQ ID NO: 1450663 - RNA, 19 nt, Pseudomonas aeruginosa PA01
cacaggcggcggaagaagc

SEQ ID NO: 1450664 - RNA, 18 nt, Pseudomonas aeruginosa PA01
cacaggcccugcagcgcc

SEQ ID NO: 1450665 - RNA, 19 nt, Pseudomonas aeruginosa PA01
cacaggcccugcagcgcca

SEQ ID NO: 1450666 - RNA, 21 nt, Pseudomonas aeruginosa PA01
cacaggcccuggaucaccgcg

SEQ ID NO: 1450667 - RNA, 22 nt, Pseudomonas aeruginosa PA01
cacaggcccuggaucaccgcgg

SEQ ID NO: 1450668 - RNA, 16 nt, Pseudomonas aeruginosa PA01
cacaggagcacggccg

SEQ ID NO: 1450669 - RNA, 16 nt, Pseudomonas aeruginosa PA01
cacaugcaccaggccc

SEQ ID NO: 1450670 - RNA, 15 nt, Pseudomonas aeruginosa PA01
cacauccaguguggc

SEQ ID NO: 1450671 - RNA, 17 nt, Pseudomonas aeruginosa PA01
cacaugcaggcucgaca

SEQ ID NO: 1450672 - RNA, 14 nt, Pseudomonas aeruginosa PA01
cacaugcaggucgu

SEQ ID NO: 1450673 - RNA, 21 nt, Pseudomonas aeruginosa PA01
cacaugccacgcaccaccagg

SEQ ID NO: 1450674 - RNA, 19 nt, Pseudomonas aeruginosa PA01
cacauagagggucagccgg

SEQ ID NO: 1450675 - RNA, 21 nt, Pseudomonas aeruginosa PA01
cacaggcguuauccgccgaua

SEQ ID NO: 1450676 - RNA, 20 nt, Pseudomonas aeruginosa PA01
cacaggcguuauccgccgcc

SEQ ID NO: 1450677 - RNA, 13 nt, Pseudomonas aeruginosa PA01
cacagugccaggc

SEQ ID NO: 1450678 - RNA, 14 nt, Pseudomonas aeruginosa PA01
cacagugccaggcu

SEQ ID NO: 1450679 - RNA, 16 nt, Pseudomonas aeruginosa PA01
cacagugccaggcucg

SEQ ID NO: 1450680 - RNA, 21 nt, Pseudomonas aeruginosa PA01
cacagugccaggcucgccgcc

SEQ ID NO: 1450681 - RNA, 22 nt, Pseudomonas aeruginosa PA01
cacagugccaggcucgccgcca

SEQ ID NO: 1450682 - RNA, 17 nt, Pseudomonas aeruginosa PA01
cacaggacgagacgccg

SEQ ID NO: 1450683 - RNA, 23 nt, Pseudomonas aeruginosa PA01
caccacucccggcgacgacgaag

SEQ ID NO: 1450684 - RNA, 14 nt, Pseudomonas aeruginosa PA01
caccacucgccagc

SEQ ID NO: 1450685 - RNA, 15 nt, Pseudomonas aeruginosa PA01
caccacucgccagcg

SEQ ID NO: 1450686 - RNA, 17 nt, Pseudomonas aeruginosa PA01
caccacucgccagcgcg

SEQ ID NO: 1450687 - RNA, 22 nt, Pseudomonas aeruginosa PA01
caccacucgccagcgcgcgccg

SEQ ID NO: 1450688 - RNA, 19 nt, Pseudomonas aeruginosa PA01
caccacguagccggcgucc

SEQ ID NO: 1450689 - RNA, 18 nt, Pseudomonas aeruginosa PA01
caccacguugcgccgcag

SEQ ID NO: 1450690 - RNA, 13 nt, Pseudomonas aeruginosa PA01
caccagccggccg

SEQ ID NO: 1450691 - RNA, 14 nt, Pseudomonas aeruginosa PA01
caccagccggccgc

SEQ ID NO: 1450692 - RNA, 15 nt, Pseudomonas aeruginosa PA01
caccagccggccgcg

SEQ ID NO: 1450693 - RNA, 17 nt, Pseudomonas aeruginosa PA01
caccagccggccgcguc

SEQ ID NO: 1450694 - RNA, 20 nt, Pseudomonas aeruginosa PA01
caccagccggcgcucggcca

SEQ ID NO: 1450695 - RNA, 19 nt, Pseudomonas aeruginosa PA01
caccagcgaaagcgucagc

SEQ ID NO: 1450696 - RNA, 22 nt, Pseudomonas aeruginosa PA01
caccagcgaaagcgucagcgcg

SEQ ID NO: 1450697 - RNA, 21 nt, Pseudomonas aeruginosa PA01
caccagcgaagugcgcugcuu

SEQ ID NO: 1450698 - RNA, 17 nt, Pseudomonas aeruginosa PA01
caccagcguggcgcgca

SEQ ID NO: 1450699 - RNA, 12 nt, Pseudomonas aeruginosa PA01
caccagcguggu

SEQ ID NO: 1450700 - RNA, 15 nt, Pseudomonas aeruginosa PA01
caccagcuccccguc

SEQ ID NO: 1450701 - RNA, 16 nt, Pseudomonas aeruginosa PA01
caccagcucccggcuc

SEQ ID NO: 1450702 - RNA, 17 nt, Pseudomonas aeruginosa PA01
caccagcgggucgucga

SEQ ID NO: 1450703 - RNA, 23 nt, Pseudomonas aeruginosa PA01
caccagcggguucuugaagaagc

SEQ ID NO: 1450704 - RNA, 17 nt, Pseudomonas aeruginosa PA01
caccagcgcccguagca

SEQ ID NO: 1450705 - RNA, 13 nt, Pseudomonas aeruginosa PA01
caccagggccagg

SEQ ID NO: 1450706 - RNA, 13 nt, Pseudomonas aeruginosa PA01
caccagggcgaug

SEQ ID NO: 1450707 - RNA, 18 nt, Pseudomonas aeruginosa PA01
caccagggccucggggcc

SEQ ID NO: 1450708 - RNA, 17 nt, Pseudomonas aeruginosa PA01
caccaggguaucgcugu

SEQ ID NO: 1450709 - RNA, 20 nt, Pseudomonas aeruginosa PA01
caccagggucacgccgcggc

SEQ ID NO: 1450710 - RNA, 14 nt, Pseudomonas aeruginosa PA01
caccagggucggca

SEQ ID NO: 1450711 - RNA, 16 nt, Pseudomonas aeruginosa PA01
caccagggucggcacc

SEQ ID NO: 1450712 - RNA, 15 nt, Pseudomonas aeruginosa PA01
caccagggucgggcc

SEQ ID NO: 1450713 - RNA, 19 nt, Pseudomonas aeruginosa PA01
caccagggucgggccgcgc

SEQ ID NO: 1450714 - RNA, 22 nt, Pseudomonas aeruginosa PA01
caccagggucgggccgcgcucg

SEQ ID NO: 1450715 - RNA, 14 nt, Pseudomonas aeruginosa PA01
caccaggcgccagg

SEQ ID NO: 1450716 - RNA, 13 nt, Pseudomonas aeruginosa PA01
caccaggcgccgg

SEQ ID NO: 1450717 - RNA, 20 nt, Pseudomonas aeruginosa PA01
caccaggcgguacaccgcca

SEQ ID NO: 1450718 - RNA, 14 nt, Pseudomonas aeruginosa PA01
caccaggcugccgc

SEQ ID NO: 1450719 - RNA, 16 nt, Pseudomonas aeruginosa PA01
caccaggcugccgccg

SEQ ID NO: 1450720 - RNA, 14 nt, Pseudomonas aeruginosa PA01
caccaggcucgccc

SEQ ID NO: 1450721 - RNA, 19 nt, Pseudomonas aeruginosa PA01
caccagggcuucgcgcaga

SEQ ID NO: 1450722 - RNA, 21 nt, Pseudomonas aeruginosa PA01
caccagggugcgcucguugau

SEQ ID NO: 1450723 - RNA, 20 nt, Pseudomonas aeruginosa PA01
caccaggguggcgcgcacca

SEQ ID NO: 1450724 - RNA, 13 nt, Pseudomonas aeruginosa PA01
caccaguggcgcc

SEQ ID NO: 1450725 - RNA, 14 nt, Pseudomonas aeruginosa PA01
cacccgccucgucg

SEQ ID NO: 1450726 - RNA, 16 nt, Pseudomonas aeruginosa PA01
cacccgccucgucgcc

SEQ ID NO: 1450727 - RNA, 14 nt, Pseudomonas aeruginosa PA01
cacccgcgacucga

SEQ ID NO: 1450728 - RNA, 18 nt, Pseudomonas aeruginosa PA01
cacccgcaucgaggccgc

SEQ ID NO: 1450729 - RNA, 14 nt, Pseudomonas aeruginosa PA01
cacccgcgccgccg

SEQ ID NO: 1450730 - RNA, 16 nt, Pseudomonas aeruginosa PA01
cacccgcgccugcagg

SEQ ID NO: 1450731 - RNA, 20 nt, Pseudomonas aeruginosa PA01
cacccgcgaggccggcccca

SEQ ID NO: 1450732 - RNA, 22 nt, Pseudomonas aeruginosa PA01
cacccgcuccggcucuccccgc

SEQ ID NO: 1450733 - RNA, 15 nt, Pseudomonas aeruginosa PA01
cacccgcucgaccuu

SEQ ID NO: 1450734 - RNA, 23 nt, Pseudomonas aeruginosa PA01
cacccgaggaaaugauguugcgc

SEQ ID NO: 1450735 - RNA, 13 nt, Pseudomonas aeruginosa PA01
cacccgcaccagc

SEQ ID NO: 1450736 - RNA, 22 nt, Pseudomonas aeruginosa PA01
cacccgcaccgguucgacacgc

SEQ ID NO: 1450737 - RNA, 22 nt, Pseudomonas aeruginosa PA01
cacccgcagccccgccggaaga

SEQ ID NO: 1450738 - RNA, 15 nt, Pseudomonas aeruginosa PA01
cacccgcagccgcgu

SEQ ID NO: 1450739 - RNA, 14 nt, Pseudomonas aeruginosa PA01
cacccgcagcggca

SEQ ID NO: 1450740 - RNA, 23 nt, Pseudomonas aeruginosa PA01
cacccgcagcggcagcggcucgu

SEQ ID NO: 1450741 - RNA, 19 nt, Pseudomonas aeruginosa PA01
caccaugccgaugacaugg

SEQ ID NO: 1450742 - RNA, 17 nt, Pseudomonas aeruginosa PA01
caccaugcuccgccugg

SEQ ID NO: 1450743 - RNA, 18 nt, Pseudomonas aeruginosa PA01
caccaucacgucgcgcac

SEQ ID NO: 1450744 - RNA, 21 nt, Pseudomonas aeruginosa PA01
caccaucaccgccaucagcac

SEQ ID NO: 1450745 - RNA, 12 nt, Pseudomonas aeruginosa PA01
caccccgccgcg

SEQ ID NO: 1450746 - RNA, 14 nt, Pseudomonas aeruginosa PA01
caccccgccgcgca

SEQ ID NO: 1450747 - RNA, 21 nt, Pseudomonas aeruginosa PA01
caccccgccgcgcaucacccc

SEQ ID NO: 1450748 - RNA, 16 nt, Pseudomonas aeruginosa PA01
caccccgccgcuggcg

SEQ ID NO: 1450749 - RNA, 13 nt, Pseudomonas aeruginosa PA01
caccccgccggcg

SEQ ID NO: 1450750 - RNA, 21 nt, Pseudomonas aeruginosa PA01
caccccgcccuuggcggcgcc

SEQ ID NO: 1450751 - RNA, 22 nt, Pseudomonas aeruginosa PA01
caccccgcccuuggcggcgcca

SEQ ID NO: 1450752 - RNA, 20 nt, Pseudomonas aeruginosa PA01
cacccgaaagccgaagcgcg

SEQ ID NO: 1450753 - RNA, 14 nt, Pseudomonas aeruginosa PA01
caccccgagcccgg

SEQ ID NO: 1450754 - RNA, 17 nt, Pseudomonas aeruginosa PA01
caccccgagcggcgcga

SEQ ID NO: 1450755 - RNA, 14 nt, Pseudomonas aeruginosa PA01
caccccgaccagcg

SEQ ID NO: 1450756 - RNA, 16 nt, Pseudomonas aeruginosa PA01
caccccgaccagcgcg

SEQ ID NO: 1450757 - RNA, 13 nt, Pseudomonas aeruginosa PA01
cacccccaucgcc

SEQ ID NO: 1450758 - RNA, 21 nt, Pseudomonas aeruginosa PA01
cacccccaucgcccgcagcca

SEQ ID NO: 1450759 - RNA, 18 nt, Pseudomonas aeruginosa PA01
cacccccgcaaccgcugc

SEQ ID NO: 1450760 - RNA, 19 nt, Pseudomonas aeruginosa PA01
cacccccgcaaccgcugcc

SEQ ID NO: 1450761 - RNA, 17 nt, Pseudomonas aeruginosa PA01
caccccgaaaccggcga

SEQ ID NO: 1450762 - RNA, 22 nt, Pseudomonas aeruginosa PA01
caccccgaaacgguccaccagg

SEQ ID NO: 1450763 - RNA, 13 nt, Pseudomonas aeruginosa PA01
caccggcgagcaa

SEQ ID NO: 1450764 - RNA, 18 nt, Pseudomonas aeruginosa PA01
caccggcgccacccucgg

SEQ ID NO: 1450765 - RNA, 22 nt, Pseudomonas aeruginosa PA01
caccggcgccacccucggcuuc

SEQ ID NO: 1450766 - RNA, 18 nt, Pseudomonas aeruginosa PA01
caccggcgauggccggca

SEQ ID NO: 1450767 - RNA, 14 nt, Pseudomonas aeruginosa PA01
caccgggccgaccu

SEQ ID NO: 1450768 - RNA, 16 nt, Pseudomonas aeruginosa PA01
caccgggccgaccugc

SEQ ID NO: 1450769 - RNA, 17 nt, Pseudomonas aeruginosa PA01
caccgggccgaccugcc

SEQ ID NO: 1450770 - RNA, 14 nt, Pseudomonas aeruginosa PA01
caccgggccgccgg

SEQ ID NO: 1450771 - RNA, 16 nt, Pseudomonas aeruginosa PA01
caccgggccgccggcg

SEQ ID NO: 1450772 - RNA, 23 nt, Pseudomonas aeruginosa PA01
caccgggccgccggcgacgaggu

SEQ ID NO: 1450773 - RNA, 13 nt, Pseudomonas aeruginosa PA01
caccgggccaucg

SEQ ID NO: 1450774 - RNA, 21 nt, Pseudomonas aeruginosa PA01
caccgggguguguuuccgaac

SEQ ID NO: 1450775 - RNA, 20 nt, Pseudomonas aeruginosa PA01
caccgggugcagguucaccg

SEQ ID NO: 1450776 - RNA, 22 nt, Pseudomonas aeruginosa PA01
caccgggugcagguucaccgcc

SEQ ID NO: 1450777 - RNA, 16 nt, Pseudomonas aeruginosa PA01
caccggggccuucagg

SEQ ID NO: 1450778 - RNA, 20 nt, Pseudomonas aeruginosa PA01
caccggggccuucaggcgcu

SEQ ID NO: 1450779 - RNA, 22 nt, Pseudomonas aeruginosa PA01
caccggggugauccagcuggcg

SEQ ID NO: 1450780 - RNA, 23 nt, Pseudomonas aeruginosa PA01
caccgucacggcgaaaccggcca

SEQ ID NO: 1450781 - RNA, 17 nt, Pseudomonas aeruginosa PA01
caccguccuucggccgc

SEQ ID NO: 1450782 - RNA, 21 nt, Pseudomonas aeruginosa PA01
caccguccuucggccgcacca

SEQ ID NO: 1450783 - RNA, 14 nt, Pseudomonas aeruginosa PA01
caccgucgaaccag

SEQ ID NO: 1450784 - RNA, 15 nt, Pseudomonas aeruginosa PA01
caccgucgaaccagc

SEQ ID NO: 1450785 - RNA, 20 nt, Pseudomonas aeruginosa PA01
caccgucgaaccagccgcgu

SEQ ID NO: 1450786 - RNA, 20 nt, Pseudomonas aeruginosa PA01
caccgucgagcaccaggcgg

SEQ ID NO: 1450787 - RNA, 16 nt, Pseudomonas aeruginosa PA01
caccgugcccgccggc

SEQ ID NO: 1450788 - RNA, 20 nt, Pseudomonas aeruginosa PA01
caccgugcccgccggcgcgc

SEQ ID NO: 1450789 - RNA, 13 nt, Pseudomonas aeruginosa PA01
caccgugcgcacc

SEQ ID NO: 1450790 - RNA, 14 nt, Pseudomonas aeruginosa PA01
caccgugcgcgcgg

SEQ ID NO: 1450791 - RNA, 16 nt, Pseudomonas aeruginosa PA01
caccgugcgcgcggcc

SEQ ID NO: 1450792 - RNA, 16 nt, Pseudomonas aeruginosa PA01
caccguggugcccggg

SEQ ID NO: 1450793 - RNA, 17 nt, Pseudomonas aeruginosa PA01
caccguguugaucgccg

SEQ ID NO: 1450794 - RNA, 18 nt, Pseudomonas aeruginosa PA01
caccguguugaucgccgc

SEQ ID NO: 1450795 - RNA, 19 nt, Pseudomonas aeruginosa PA01
caccguguugaucgccgcg

SEQ ID NO: 1450796 - RNA, 23 nt, Pseudomonas aeruginosa PA01
caccgcguaauaggcgaagcggc

SEQ ID NO: 1450797 - RNA, 18 nt, Pseudomonas aeruginosa PA01
caccgcguccauccccgc

SEQ ID NO: 1450798 - RNA, 21 nt, Pseudomonas aeruginosa PA01
caccgcguccauccccgccuc

SEQ ID NO: 1450799 - RNA, 17 nt, Pseudomonas aeruginosa PA01
caccgcgguuggcgccu

SEQ ID NO: 1450800 - RNA, 20 nt, Pseudomonas aeruginosa PA01
caccgcggugugcuugucca

SEQ ID NO: 1450801 - RNA, 12 nt, Pseudomonas aeruginosa PA01
caccgcucucga

SEQ ID NO: 1450802 - RNA, 18 nt, Pseudomonas aeruginosa PA01
caccgcucugcagugcgu

SEQ ID NO: 1450803 - RNA, 22 nt, Pseudomonas aeruginosa PA01
caccgcucaagacggcccgcag

SEQ ID NO: 1450804 - RNA, 18 nt, Pseudomonas aeruginosa PA01
caccgcuccggcgccgag

SEQ ID NO: 1450805 - RNA, 12 nt, Pseudomonas aeruginosa PA01
caccgcucgcca

SEQ ID NO: 1450806 - RNA, 15 nt, Pseudomonas aeruginosa PA01
caccgcugcgccgcc

SEQ ID NO: 1450807 - RNA, 23 nt, Pseudomonas aeruginosa PA01
caccggccgcgccuucagcgcca

SEQ ID NO: 1450808 - RNA, 20 nt, Pseudomonas aeruginosa PA01
caccggcauguagcgcgccg

SEQ ID NO: 1450809 - RNA, 21 nt, Pseudomonas aeruginosa PA01
caccggcauguagcgcgccga

SEQ ID NO: 1450810 - RNA, 22 nt, Pseudomonas aeruginosa PA01
caccggcagggcgauccgcccg

SEQ ID NO: 1450811 - RNA, 17 nt, Pseudomonas aeruginosa PA01
caccggcagugagaaga

SEQ ID NO: 1450812 - RNA, 17 nt, Pseudomonas aeruginosa PA01
caccggcagcagcggau

SEQ ID NO: 1450813 - RNA, 18 nt, Pseudomonas aeruginosa PA01
caccggcagcagcggauc

SEQ ID NO: 1450814 - RNA, 21 nt, Pseudomonas aeruginosa PA01
caccggcaggaucggcgcggu

SEQ ID NO: 1450815 - RNA, 14 nt, Pseudomonas aeruginosa PA01
caccggcagcagcg

SEQ ID NO: 1450816 - RNA, 14 nt, Pseudomonas aeruginosa PA01
caccggaucgcccu

SEQ ID NO: 1450817 - RNA, 22 nt, Pseudomonas aeruginosa PA01
caccggaucgcccuggcgccag

SEQ ID NO: 1450818 - RNA, 19 nt, Pseudomonas aeruginosa PA01
caccgccggguacagcgcc

SEQ ID NO: 1450819 - RNA, 22 nt, Pseudomonas aeruginosa PA01
caccgccucggagaacagcagc

SEQ ID NO: 1450820 - RNA, 23 nt, Pseudomonas aeruginosa PA01
caccgccucggagaacagcagcg

SEQ ID NO: 1450821 - RNA, 19 nt, Pseudomonas aeruginosa PA01
caccgccugcaacucgucg

SEQ ID NO: 1450822 - RNA, 16 nt, Pseudomonas aeruginosa PA01
caccgccugcagcacc

SEQ ID NO: 1450823 - RNA, 14 nt, Pseudomonas aeruginosa PA01
caccgccuggucga

SEQ ID NO: 1450824 - RNA, 18 nt, Pseudomonas aeruginosa PA01
caccgccuggucgccggg

SEQ ID NO: 1450825 - RNA, 18 nt, Pseudomonas aeruginosa PA01
caccgccuuggcaucgcc

SEQ ID NO: 1450826 - RNA, 19 nt, Pseudomonas aeruginosa PA01
caccgccuuggcaucgccg

SEQ ID NO: 1450827 - RNA, 14 nt, Pseudomonas aeruginosa PA01
caccgccgccagca

SEQ ID NO: 1450828 - RNA, 17 nt, Pseudomonas aeruginosa PA01
caccgccgccagcaaca

SEQ ID NO: 1450829 - RNA, 14 nt, Pseudomonas aeruginosa PA01
caccgccgaggaac

SEQ ID NO: 1450830 - RNA, 13 nt, Pseudomonas aeruginosa PA01
caccgcccugcgc

SEQ ID NO: 1450831 - RNA, 14 nt, Pseudomonas aeruginosa PA01
caccgcccugcgcg

SEQ ID NO: 1450832 - RNA, 14 nt, Pseudomonas aeruginosa PA01
caccgaugccgaag

SEQ ID NO: 1450833 - RNA, 16 nt, Pseudomonas aeruginosa PA01
caccgaugccgaaggc

SEQ ID NO: 1450834 - RNA, 15 nt, Pseudomonas aeruginosa PA01
caccgaucgcccgcg

SEQ ID NO: 1450835 - RNA, 22 nt, Pseudomonas aeruginosa PA01
caccgauggcguguucauagaa

SEQ ID NO: 1450836 - RNA, 13 nt, Pseudomonas aeruginosa PA01
caccgccaccagc

SEQ ID NO: 1450837 - RNA, 17 nt, Pseudomonas aeruginosa PA01
caccgccaccagcgagu

SEQ ID NO: 1450838 - RNA, 19 nt, Pseudomonas aeruginosa PA01
caccgccaccccgccggcg

SEQ ID NO: 1450839 - RNA, 14 nt, Pseudomonas aeruginosa PA01
caccgccaccugcc

SEQ ID NO: 1450840 - RNA, 18 nt, Pseudomonas aeruginosa PA01
caccgccaccugccccgg

SEQ ID NO: 1450841 - RNA, 19 nt, Pseudomonas aeruginosa PA01
caccgccaccugccccggg

SEQ ID NO: 1450842 - RNA, 16 nt, Pseudomonas aeruginosa PA01
caccgacgccgccugc

SEQ ID NO: 1450843 - RNA, 17 nt, Pseudomonas aeruginosa PA01
caccgacgccgccugcg

SEQ ID NO: 1450844 - RNA, 19 nt, Pseudomonas aeruginosa PA01
caccgacgccgccugcgcc

SEQ ID NO: 1450845 - RNA, 22 nt, Pseudomonas aeruginosa PA01
caccgacgccgccugcgccucg

SEQ ID NO: 1450846 - RNA, 13 nt, Pseudomonas aeruginosa PA01
caccgacgccgcc

SEQ ID NO: 1450847 - RNA, 18 nt, Pseudomonas aeruginosa PA01
caccgacgaugggcacga

SEQ ID NO: 1450848 - RNA, 14 nt, Pseudomonas aeruginosa PA01
caccgaccgcgagu

SEQ ID NO: 1450849 - RNA, 22 nt, Pseudomonas aeruginosa PA01
caccgaccgcgaguucgccggc

SEQ ID NO: 1450850 - RNA, 16 nt, Pseudomonas aeruginosa PA01
caccgacccucggcga

SEQ ID NO: 1450851 - RNA, 22 nt, Pseudomonas aeruginosa PA01
caccgacgggucgccauggucg

SEQ ID NO: 1450852 - RNA, 20 nt, Pseudomonas aeruginosa PA01
caccgauagcggcgcgaggc

SEQ ID NO: 1450853 - RNA, 15 nt, Pseudomonas aeruginosa PA01
cacccgcucggccuu

SEQ ID NO: 1450854 - RNA, 14 nt, Pseudomonas aeruginosa PA01
cacccggcgcccgg

SEQ ID NO: 1450855 - RNA, 13 nt, Pseudomonas aeruginosa PA01
cacccggcggucc

SEQ ID NO: 1450856 - RNA, 17 nt, Pseudomonas aeruginosa PA01
cacccggcgguccgccg

SEQ ID NO: 1450857 - RNA, 20 nt, Pseudomonas aeruginosa PA01
cacccggcuggguucggcga

SEQ ID NO: 1450858 - RNA, 21 nt, Pseudomonas aeruginosa PA01
cacccggcuggguucggcgag

SEQ ID NO: 1450859 - RNA, 24 nt, Pseudomonas aeruginosa PA01
cacccggcuggguucggcgaggau

SEQ ID NO: 1450860 - RNA, 11 nt, Pseudomonas aeruginosa PA01
cacccgggcga

SEQ ID NO: 1450861 - RNA, 23 nt, Pseudomonas aeruginosa PA01
cacccggucgcgcuggaccuggc

SEQ ID NO: 1450862 - RNA, 19 nt, Pseudomonas aeruginosa PA01
cacccgguugaccccgcgg

SEQ ID NO: 1450863 - RNA, 17 nt, Pseudomonas aeruginosa PA01
cacccgguucucgcccc

SEQ ID NO: 1450864 - RNA, 20 nt, Pseudomonas aeruginosa PA01
cacccgucccgcgcgccgag

SEQ ID NO: 1450865 - RNA, 19 nt, Pseudomonas aeruginosa PA01
caccgaagucgcccgccgg

SEQ ID NO: 1450866 - RNA, 18 nt, Pseudomonas aeruginosa PA01
caccgaagcugaggccgg

SEQ ID NO: 1450867 - RNA, 16 nt, Pseudomonas aeruginosa PA01
caccgacaaucgccga

SEQ ID NO: 1450868 - RNA, 16 nt, Pseudomonas aeruginosa PA01
cacccuugcgcccggc

SEQ ID NO: 1450869 - RNA, 17 nt, Pseudomonas aeruginosa PA01
cacccuuggagccgccc

SEQ ID NO: 1450870 - RNA, 14 nt, Pseudomonas aeruginosa PA01
cacccugcugcugc

SEQ ID NO: 1450871 - RNA, 20 nt, Pseudomonas aeruginosa PA01
cacccugcugcugcucagcg

SEQ ID NO: 1450872 - RNA, 15 nt, Pseudomonas aeruginosa PA01
cacccugcugggcgg

SEQ ID NO: 1450873 - RNA, 21 nt, Pseudomonas aeruginosa PA01
cacccuggcaccgauggcgug

SEQ ID NO: 1450874 - RNA, 12 nt, Pseudomonas aeruginosa PA01
cacccugcgcga

SEQ ID NO: 1450875 - RNA, 22 nt, Pseudomonas aeruginosa PA01
cacccguuccuugcgcggcagg

SEQ ID NO: 1450876 - RNA, 15 nt, Pseudomonas aeruginosa PA01
cacccguucgccggc

SEQ ID NO: 1450877 - RNA, 23 nt, Pseudomonas aeruginosa PA01
cacccucggcuucguccugcugc

SEQ ID NO: 1450878 - RNA, 13 nt, Pseudomonas aeruginosa PA01
cacccugccgcgc

SEQ ID NO: 1450879 - RNA, 14 nt, Pseudomonas aeruginosa PA01
cacccugccgcgcc

SEQ ID NO: 1450880 - RNA, 16 nt, Pseudomonas aeruginosa PA01
augaauguggugucgc

SEQ ID NO: 1450881 - RNA, 19 nt, Pseudomonas aeruginosa PA01
augaccgauggcgccgcga

SEQ ID NO: 1450882 - RNA, 15 nt, Pseudomonas aeruginosa PA01
augagugucgccauc

SEQ ID NO: 1450883 - RNA, 14 nt, Pseudomonas aeruginosa PA01
augaucaggccgag

SEQ ID NO: 1450884 - RNA, 21 nt, Pseudomonas aeruginosa PA01
augauccgcucgaucccggcg

SEQ ID NO: 1450885 - RNA, 18 nt, Pseudomonas aeruginosa PA01
augauccacuugccgccg

SEQ ID NO: 1450886 - RNA, 20 nt, Pseudomonas aeruginosa PA01
augaucaccaggacccagau

SEQ ID NO: 1450887 - RNA, 17 nt, Pseudomonas aeruginosa PA01
aucucgagcaugucggc

SEQ ID NO: 1450888 - RNA, 13 nt, Pseudomonas aeruginosa PA01
aucucgaucgagu

SEQ ID NO: 1450889 - RNA, 20 nt, Pseudomonas aeruginosa PA01
aucucgaucgagucgccgau

SEQ ID NO: 1450890 - RNA, 22 nt, Pseudomonas aeruginosa PA01
aucucgauggugaacgccaggc

SEQ ID NO: 1450891 - RNA, 23 nt, Pseudomonas aeruginosa PA01
aucucgauggugaacgccaggca

SEQ ID NO: 1450892 - RNA, 17 nt, Pseudomonas aeruginosa PA01
aucuccugccgcggcga

SEQ ID NO: 1450893 - RNA, 16 nt, Pseudomonas aeruginosa PA01
aucuccugcugggcgu

SEQ ID NO: 1450894 - RNA, 19 nt, Pseudomonas aeruginosa PA01
aucuccugcugggcgucga

SEQ ID NO: 1450895 - RNA, 15 nt, Pseudomonas aeruginosa PA01
aucuccuggcgggug

SEQ ID NO: 1450896 - RNA, 15 nt, Pseudomonas aeruginosa PA01
aucuccucgauccgc

SEQ ID NO: 1450897 - RNA, 21 nt, Pseudomonas aeruginosa PA01
aucuccucgauccgcugggcc

SEQ ID NO: 1450898 - RNA, 23 nt, Pseudomonas aeruginosa PA01
aucugcgggaacuuggcgcgcag

SEQ ID NO: 1450899 - RNA, 18 nt, Pseudomonas aeruginosa PA01
aucucgccgaaggugcag

SEQ ID NO: 1450900 - RNA, 23 nt, Pseudomonas aeruginosa PA01
aucucgccgaaggugcaggccgc

SEQ ID NO: 1450901 - RNA, 18 nt, Pseudomonas aeruginosa PA01
aucucgcccagggcgugg

SEQ ID NO: 1450902 - RNA, 13 nt, Pseudomonas aeruginosa PA01
aucugcgccgcaa

SEQ ID NO: 1450903 - RNA, 21 nt, Pseudomonas aeruginosa PA01
aucugcugggucaucgaggcc

SEQ ID NO: 1450904 - RNA, 19 nt, Pseudomonas aeruginosa PA01
aucugcugguccuggcgcg

SEQ ID NO: 1450905 - RNA, 22 nt, Pseudomonas aeruginosa PA01
aucugcugcagcaucaggcgcu

SEQ ID NO: 1450906 - RNA, 18 nt, Pseudomonas aeruginosa PA01
aucugguagaccaccgug

SEQ ID NO: 1450907 - RNA, 16 nt, Pseudomonas aeruginosa PA01
aucugcuugcgcgccg

SEQ ID NO: 1450908 - RNA, 19 nt, Pseudomonas aeruginosa PA01
aucugguggaacagcauca

SEQ ID NO: 1450909 - RNA, 21 nt, Pseudomonas aeruginosa PA01
aucugucgauaccagcgccgc

SEQ ID NO: 1450910 - RNA, 16 nt, Pseudomonas aeruginosa PA01
aucugucgcagcgggc

SEQ ID NO: 1450911 - RNA, 21 nt, Pseudomonas aeruginosa PA01
aucuucguaggucaugcgugc

SEQ ID NO: 1450912 - RNA, 23 nt, Pseudomonas aeruginosa PA01
aucuucguaggucaugcgugcgg

SEQ ID NO: 1450913 - RNA, 14 nt, Pseudomonas aeruginosa PA01
aucuuccucggacu

SEQ ID NO: 1450914 - RNA, 16 nt, Pseudomonas aeruginosa PA01
aucuucgauugcuaca

SEQ ID NO: 1450915 - RNA, 16 nt, Pseudomonas aeruginosa PA01
aucggggccaggucgg

SEQ ID NO: 1450916 - RNA, 17 nt, Pseudomonas aeruginosa PA01
aucggggccaggucggu

SEQ ID NO: 1450917 - RNA, 22 nt, Pseudomonas aeruginosa PA01
aucggggaagggacgucgccag

SEQ ID NO: 1450918 - RNA, 17 nt, Pseudomonas aeruginosa PA01
aucgggguauagcgcag

SEQ ID NO: 1450919 - RNA, 17 nt, Pseudomonas aeruginosa PA01
aucggguagagcgcggc

SEQ ID NO: 1450920 - RNA, 18 nt, Pseudomonas aeruginosa PA01
aucgucgaaacgcuggcg

SEQ ID NO: 1450921 - RNA, 20 nt, Pseudomonas aeruginosa PA01
aucgucgaaacgcuggcggc

SEQ ID NO: 1450922 - RNA, 16 nt, Pseudomonas aeruginosa PA01
aucgucgaagcucggc

SEQ ID NO: 1450923 - RNA, 17 nt, Pseudomonas aeruginosa PA01
aucgucgaagcucggcg

SEQ ID NO: 1450924 - RNA, 22 nt, Pseudomonas aeruginosa PA01
aucgucgaagcugaggucguug

SEQ ID NO: 1450925 - RNA, 17 nt, Pseudomonas aeruginosa PA01
aucguuguucagcaggg

SEQ ID NO: 1450926 - RNA, 17 nt, Pseudomonas aeruginosa PA01
aucguuggcgccguccu

SEQ ID NO: 1450927 - RNA, 14 nt, Pseudomonas aeruginosa PA01
aucguugccagccg

SEQ ID NO: 1450928 - RNA, 13 nt, Pseudomonas aeruginosa PA01
aucuccuccucgg

SEQ ID NO: 1450929 - RNA, 16 nt, Pseudomonas aeruginosa PA01
aucuccuccucggcgg

SEQ ID NO: 1450930 - RNA, 17 nt, Pseudomonas aeruginosa PA01
aucuccuccucggcggc

SEQ ID NO: 1450931 - RNA, 14 nt, Pseudomonas aeruginosa PA01
aucuccucgacggc

SEQ ID NO: 1450932 - RNA, 15 nt, Pseudomonas aeruginosa PA01
aucuauaaugcgccc

SEQ ID NO: 1450933 - RNA, 18 nt, Pseudomonas aeruginosa PA01
aucggcaacuggcuggcc

SEQ ID NO: 1450934 - RNA, 22 nt, Pseudomonas aeruginosa PA01
aucggcaagcugaagcgccgcg

SEQ ID NO: 1450935 - RNA, 15 nt, Pseudomonas aeruginosa PA01
aucggcaccaucacc

SEQ ID NO: 1450936 - RNA, 20 nt, Pseudomonas aeruginosa PA01
aucggcaccaucaccgacag

SEQ ID NO: 1450937 - RNA, 14 nt, Pseudomonas aeruginosa PA01
aucggcaggcugca

SEQ ID NO: 1450938 - RNA, 20 nt, Pseudomonas aeruginosa PA01
aucggcagggcgccgaccag

SEQ ID NO: 1450939 - RNA, 14 nt, Pseudomonas aeruginosa PA01
aucggcagcucgcu

SEQ ID NO: 1450940 - RNA, 19 nt, Pseudomonas aeruginosa PA01
aucggcaucaaucgcuggc

SEQ ID NO: 1450941 - RNA, 16 nt, Pseudomonas aeruginosa PA01
aucggcagcaucagcc

SEQ ID NO: 1450942 - RNA, 14 nt, Pseudomonas aeruginosa PA01
aucggccucgcggc

SEQ ID NO: 1450943 - RNA, 22 nt, Pseudomonas aeruginosa PA01
aucggccauucggccuggcagu

SEQ ID NO: 1450944 - RNA, 23 nt, Pseudomonas aeruginosa PA01
aucggcccgacgccgcccggcac

SEQ ID NO: 1450945 - RNA, 14 nt, Pseudomonas aeruginosa PA01
aucggccgccaggc

SEQ ID NO: 1450946 - RNA, 14 nt, Pseudomonas aeruginosa PA01
aucggccgccagug

SEQ ID NO: 1450947 - RNA, 17 nt, Pseudomonas aeruginosa PA01
aucggcccgggcgccac

SEQ ID NO: 1450948 - RNA, 17 nt, Pseudomonas aeruginosa PA01
aucggcccggggcucug

SEQ ID NO: 1450949 - RNA, 21 nt, Pseudomonas aeruginosa PA01
aucggcccggggcucugccgg

SEQ ID NO: 1450950 - RNA, 14 nt, Pseudomonas aeruginosa PA01
aucggcccugggcg

SEQ ID NO: 1450951 - RNA, 23 nt, Pseudomonas aeruginosa PA01
aucggcauggccgaccgccaggc

SEQ ID NO: 1450952 - RNA, 19 nt, Pseudomonas aeruginosa PA01
aucggccaacugagcggcg

SEQ ID NO: 1450953 - RNA, 16 nt, Pseudomonas aeruginosa PA01
aucggccauggccgag

SEQ ID NO: 1450954 - RNA, 19 nt, Pseudomonas aeruginosa PA01
aucggccaccuucgcccgc

SEQ ID NO: 1450955 - RNA, 19 nt, Pseudomonas aeruginosa PA01
aucggccacuaucgccaac

SEQ ID NO: 1450956 - RNA, 21 nt, Pseudomonas aeruginosa PA01
aucggcgccggccuccagcgc

SEQ ID NO: 1450957 - RNA, 21 nt, Pseudomonas aeruginosa PA01
aucggcgccucccagggucgc

SEQ ID NO: 1450958 - RNA, 22 nt, Pseudomonas aeruginosa PA01
aucggcgagccgcagcggcucg

SEQ ID NO: 1450959 - RNA, 21 nt, Pseudomonas aeruginosa PA01
aucggcgaagcggaagcgcag

SEQ ID NO: 1450960 - RNA, 13 nt, Pseudomonas aeruginosa PA01
aucggcgcgccga

SEQ ID NO: 1450961 - RNA, 19 nt, Pseudomonas aeruginosa PA01
aucggcgcgccgaaggcga

SEQ ID NO: 1450962 - RNA, 14 nt, Pseudomonas aeruginosa PA01
aucggcgcgcaggg

SEQ ID NO: 1450963 - RNA, 17 nt, Pseudomonas aeruginosa PA01
aucggcgcgcagggcca

SEQ ID NO: 1450964 - RNA, 22 nt, Pseudomonas aeruginosa PA01
aucggcgcgcagggccagcaac

SEQ ID NO: 1450965 - RNA, 12 nt, Pseudomonas aeruginosa PA01
aucggcgcgccg

SEQ ID NO: 1450966 - RNA, 15 nt, Pseudomonas aeruginosa PA01
aucggcgcggccuuc

SEQ ID NO: 1450967 - RNA, 16 nt, Pseudomonas aeruginosa PA01
aucggcgcggucgggu

SEQ ID NO: 1450968 - RNA, 15 nt, Pseudomonas aeruginosa PA01
aucggcgcucaccgc

SEQ ID NO: 1450969 - RNA, 17 nt, Pseudomonas aeruginosa PA01
aucggcgcucaccgcau

SEQ ID NO: 1450970 - RNA, 23 nt, Pseudomonas aeruginosa PA01
aucggcgcuccgccgaacgccac

SEQ ID NO: 1450971 - RNA, 15 nt, Pseudomonas aeruginosa PA01
aucggcggauaacgc

SEQ ID NO: 1450972 - RNA, 18 nt, Pseudomonas aeruginosa PA01
aucggcggauaacgccga

SEQ ID NO: 1450973 - RNA, 23 nt, Pseudomonas aeruginosa PA01
aucggcggauaacgccgcuggcg

SEQ ID NO: 1450974 - RNA, 18 nt, Pseudomonas aeruginosa PA01
aucggcggauaacgccgg

SEQ ID NO: 1450975 - RNA, 14 nt, Pseudomonas aeruginosa PA01
aucggcgcgccggc

SEQ ID NO: 1450976 - RNA, 23 nt, Pseudomonas aeruginosa PA01
aucggcuccagcuugucgucggc

SEQ ID NO: 1450977 - RNA, 18 nt, Pseudomonas aeruginosa PA01
aucggcucggcaagcgaa

SEQ ID NO: 1450978 - RNA, 14 nt, Pseudomonas aeruginosa PA01
aucggcuggccgag

SEQ ID NO: 1450979 - RNA, 17 nt, Pseudomonas aeruginosa PA01
aucggcuugccggcggc

SEQ ID NO: 1450980 - RNA, 12 nt, Pseudomonas aeruginosa PA01
aucggcguggcg

SEQ ID NO: 1450981 - RNA, 15 nt, Pseudomonas aeruginosa PA01
aucggcgucggcugg

SEQ ID NO: 1450982 - RNA, 18 nt, Pseudomonas aeruginosa PA01
aucggcggcggcccgcac

SEQ ID NO: 1450983 - RNA, 23 nt, Pseudomonas aeruginosa PA01
aucggcggugccauggaucacca

SEQ ID NO: 1450984 - RNA, 16 nt, Pseudomonas aeruginosa PA01
aucgccuuccucggcg

SEQ ID NO: 1450985 - RNA, 17 nt, Pseudomonas aeruginosa PA01
aucgccuuccucggcga

SEQ ID NO: 1450986 - RNA, 14 nt, Pseudomonas aeruginosa PA01
aucgccugcuggcc

SEQ ID NO: 1450987 - RNA, 15 nt, Pseudomonas aeruginosa PA01
aucgccugcuggccg

SEQ ID NO: 1450988 - RNA, 13 nt, Pseudomonas aeruginosa PA01
aucgccucggcgc

SEQ ID NO: 1450989 - RNA, 18 nt, Pseudomonas aeruginosa PA01
aucgccucggccaucgag

SEQ ID NO: 1450990 - RNA, 22 nt, Pseudomonas aeruginosa PA01
aucgccucguucgucgccgacu

SEQ ID NO: 1450991 - RNA, 13 nt, Pseudomonas aeruginosa PA01
aucgccucgggcg

SEQ ID NO: 1450992 - RNA, 13 nt, Pseudomonas aeruginosa PA01
aucgccucgccgg

SEQ ID NO: 1450993 - RNA, 14 nt, Pseudomonas aeruginosa PA01
aucgccucgccggc

SEQ ID NO: 1450994 - RNA, 15 nt, Pseudomonas aeruginosa PA01
aucgccucgccggcc

SEQ ID NO: 1450995 - RNA, 21 nt, Pseudomonas aeruginosa PA01
aucgccguugccuucgccguc

SEQ ID NO: 1450996 - RNA, 22 nt, Pseudomonas aeruginosa PA01
aucgccguugccuucgccgucg

SEQ ID NO: 1450997 - RNA, 23 nt, Pseudomonas aeruginosa PA01
aucgccuccggcacgcugccgcc

SEQ ID NO: 1450998 - RNA, 12 nt, Pseudomonas aeruginosa PA01
aucgccuccacc

SEQ ID NO: 1450999 - RNA, 22 nt, Pseudomonas aeruginosa PA01
aucgccuccaccagcgccggcg

SEQ ID NO: 1451000 - RNA, 15 nt, Pseudomonas aeruginosa PA01
aucgccgucaccgcg

SEQ ID NO: 1451001 - RNA, 18 nt, Pseudomonas aeruginosa PA01
aucgcgcacaugccgagc

SEQ ID NO: 1451002 - RNA, 23 nt, Pseudomonas aeruginosa PA01
aucgcgcaacggcagcgcuucgu

SEQ ID NO: 1451003 - RNA, 18 nt, Pseudomonas aeruginosa PA01
aucgcgcagaucgccgcg

SEQ ID NO: 1451004 - RNA, 22 nt, Pseudomonas aeruginosa PA01
aucgcgaucuaccugcgugcgc

SEQ ID NO: 1451005 - RNA, 16 nt, Pseudomonas aeruginosa PA01
aucgcgccaggccgca

SEQ ID NO: 1451006 - RNA, 14 nt, Pseudomonas aeruginosa PA01
aucgcgaagcgcag

SEQ ID NO: 1451007 - RNA, 20 nt, Pseudomonas aeruginosa PA01
aucgcgaagaacacgcccca

SEQ ID NO: 1451008 - RNA, 23 nt, Pseudomonas aeruginosa PA01
aucgccgccgcagccguggcgcg

SEQ ID NO: 1451009 - RNA, 17 nt, Pseudomonas aeruginosa PA01
aucgccgccauugacga

SEQ ID NO: 1451010 - RNA, 13 nt, Pseudomonas aeruginosa PA01
aucgccgccaggc

SEQ ID NO: 1451011 - RNA, 15 nt, Pseudomonas aeruginosa PA01
aucgccgccaggcag

SEQ ID NO: 1451012 - RNA, 19 nt, Pseudomonas aeruginosa PA01
aucgccgccaggcagaccu

SEQ ID NO: 1451013 - RNA, 23 nt, Pseudomonas aeruginosa PA01
aucgccgagggcgaagaucucgc

SEQ ID NO: 1451014 - RNA, 19 nt, Pseudomonas aeruginosa PA01
aucgcccuggccucggcgu

SEQ ID NO: 1451015 - RNA, 21 nt, Pseudomonas aeruginosa PA01
aucgcccuggccucggcgucc

SEQ ID NO: 1451016 - RNA, 16 nt, Pseudomonas aeruginosa PA01
aucgccgacaggucgg

SEQ ID NO: 1451017 - RNA, 17 nt, Pseudomonas aeruginosa PA01
aucgccgacaggucggc

SEQ ID NO: 1451018 - RNA, 23 nt, Pseudomonas aeruginosa PA01
aucgccgacaggucggccggcag

SEQ ID NO: 1451019 - RNA, 22 nt, Pseudomonas aeruginosa PA01
aucgcccggcagcaggccgccg

SEQ ID NO: 1451020 - RNA, 23 nt, Pseudomonas aeruginosa PA01
aucgcccggcagcaggccgccgc

SEQ ID NO: 1451021 - RNA, 14 nt, Pseudomonas aeruginosa PA01
aucgccgguccucg

SEQ ID NO: 1451022 - RNA, 18 nt, Pseudomonas aeruginosa PA01
aucgccgguccucgacau

SEQ ID NO: 1451023 - RNA, 15 nt, Pseudomonas aeruginosa PA01
aucgccggcgagccg

SEQ ID NO: 1451024 - RNA, 16 nt, Pseudomonas aeruginosa PA01
aucgccggcagcgccg

SEQ ID NO: 1451025 - RNA, 17 nt, Pseudomonas aeruginosa PA01
aucgccggcagcgccgc

SEQ ID NO: 1451026 - RNA, 20 nt, Pseudomonas aeruginosa PA01
aucgccggcccgcgcggcaa

SEQ ID NO: 1451027 - RNA, 12 nt, Pseudomonas aeruginosa PA01
aucgccgccuug

SEQ ID NO: 1451028 - RNA, 13 nt, Pseudomonas aeruginosa PA01
aucgccgcgccgc

SEQ ID NO: 1451029 - RNA, 16 nt, Pseudomonas aeruginosa PA01
aucgccgcgccgccga

SEQ ID NO: 1451030 - RNA, 22 nt, Pseudomonas aeruginosa PA01
aucgccgcggaaaacgccgcga

SEQ ID NO: 1451031 - RNA, 17 nt, Pseudomonas aeruginosa PA01
aucgccgcguagcgcca

SEQ ID NO: 1451032 - RNA, 21 nt, Pseudomonas aeruginosa PA01
aucgccgcguagcgccaggcc

SEQ ID NO: 1451033 - RNA, 13 nt, Pseudomonas aeruginosa PA01
aucgccgcggcga

SEQ ID NO: 1451034 - RNA, 22 nt, Pseudomonas aeruginosa PA01
aucgccgcggcgaagcgcucga

SEQ ID NO: 1451035 - RNA, 17 nt, Pseudomonas aeruginosa PA01
aucgcggcgacgaucac

SEQ ID NO: 1451036 - RNA, 22 nt, Pseudomonas aeruginosa PA01
aucgcggccuucucgucgccgc

SEQ ID NO: 1451037 - RNA, 14 nt, Pseudomonas aeruginosa PA01
aucgcggcgcaggc

SEQ ID NO: 1451038 - RNA, 19 nt, Pseudomonas aeruginosa PA01
aucgcggcgauggccgcca

SEQ ID NO: 1451039 - RNA, 21 nt, Pseudomonas aeruginosa PA01
aucgcggcgauggccgccagc

SEQ ID NO: 1451040 - RNA, 21 nt, Pseudomonas aeruginosa PA01
aucgcggcgcgauauccgcca

SEQ ID NO: 1451041 - RNA, 23 nt, Pseudomonas aeruginosa PA01
aucgcggaaacccuuccagccgc

SEQ ID NO: 1451042 - RNA, 17 nt, Pseudomonas aeruginosa PA01
aucgcggcguaggcgcg

SEQ ID NO: 1451043 - RNA, 23 nt, Pseudomonas aeruginosa PA01
aucgcggcguaggcgcgccaagg

SEQ ID NO: 1451044 - RNA, 14 nt, Pseudomonas aeruginosa PA01
aucgcguagcgccc

SEQ ID NO: 1451045 - RNA, 22 nt, Pseudomonas aeruginosa PA01
aucgcguagggcgcauaaccgc

SEQ ID NO: 1451046 - RNA, 22 nt, Pseudomonas aeruginosa PA01
aucgcguagggcguauaaccgc

SEQ ID NO: 1451047 - RNA, 18 nt, Pseudomonas aeruginosa PA01
aucgcguagguggcgccg

SEQ ID NO: 1451048 - RNA, 20 nt, Pseudomonas aeruginosa PA01
aucgcguagguggcgccgcc

SEQ ID NO: 1451049 - RNA, 23 nt, Pseudomonas aeruginosa PA01
aucgcguagguggcgccgccggc

SEQ ID NO: 1451050 - RNA, 19 nt, Pseudomonas aeruginosa PA01
aucgcgguuauccgccggc

SEQ ID NO: 1451051 - RNA, 20 nt, Pseudomonas aeruginosa PA01
aucgcgguuauccgccggcu

SEQ ID NO: 1451052 - RNA, 14 nt, Pseudomonas aeruginosa PA01
aucgcgucgcaggc

SEQ ID NO: 1451053 - RNA, 16 nt, Pseudomonas aeruginosa PA01
aucgcgucgcaggcga

SEQ ID NO: 1451054 - RNA, 16 nt, Pseudomonas aeruginosa PA01
aucgcgucgccgaacu

SEQ ID NO: 1451055 - RNA, 19 nt, Pseudomonas aeruginosa PA01
aucgcgccgagcuggcgcg

SEQ ID NO: 1451056 - RNA, 21 nt, Pseudomonas aeruginosa PA01
aucgcgccgagcuggcgcgcg

SEQ ID NO: 1451057 - RNA, 16 nt, Pseudomonas aeruginosa PA01
aucgcgccgucgcugg

SEQ ID NO: 1451058 - RNA, 17 nt, Pseudomonas aeruginosa PA01
aucgcgccgucgcuggc

SEQ ID NO: 1451059 - RNA, 19 nt, Pseudomonas aeruginosa PA01
aucgcgccgucgcuggcga

SEQ ID NO: 1451060 - RNA, 16 nt, Pseudomonas aeruginosa PA01
aucgcggacaccgcgg

SEQ ID NO: 1451061 - RNA, 15 nt, Pseudomonas aeruginosa PA01
aucgcgcggcuggcu

SEQ ID NO: 1451062 - RNA, 19 nt, Pseudomonas aeruginosa PA01
aucgcgcggcuggcugccc

SEQ ID NO: 1451063 - RNA, 13 nt, Pseudomonas aeruginosa PA01
aucgcgcuggcca

SEQ ID NO: 1451064 - RNA, 21 nt, Pseudomonas aeruginosa PA01
aucggauagccgugcagcagc

SEQ ID NO: 1451065 - RNA, 21 nt, Pseudomonas aeruginosa PA01
aucggagagacccgccagcgg

SEQ ID NO: 1451066 - RNA, 23 nt, Pseudomonas aeruginosa PA01
aucgcuuucaggcgcucgucgag

SEQ ID NO: 1451067 - RNA, 16 nt, Pseudomonas aeruginosa PA01
aucgcuuuccuggccg

SEQ ID NO: 1451068 - RNA, 18 nt, Pseudomonas aeruginosa PA01
aucgcuuuccuggccgac

SEQ ID NO: 1451069 - RNA, 19 nt, Pseudomonas aeruginosa PA01
aucgcuuuccuggccgacc

SEQ ID NO: 1451070 - RNA, 16 nt, Pseudomonas aeruginosa PA01
aucgcuaccgacagga

SEQ ID NO: 1451071 - RNA, 23 nt, Pseudomonas aeruginosa PA01
aucgcuauccaccgucgcgguca

SEQ ID NO: 1451072 - RNA, 21 nt, Pseudomonas aeruginosa PA01
aucgcugccggucaggcuggu

SEQ ID NO: 1451073 - RNA, 20 nt, Pseudomonas aeruginosa PA01
aucgcuggcgcagccgcugc

SEQ ID NO: 1451074 - RNA, 13 nt, Pseudomonas aeruginosa PA01
aucgcuggcgccc

SEQ ID NO: 1451075 - RNA, 21 nt, Pseudomonas aeruginosa PA01
aucgcugggcgccucgucgac

SEQ ID NO: 1451076 - RNA, 13 nt, Pseudomonas aeruginosa PA01
aucgcugucgccc

SEQ ID NO: 1451077 - RNA, 14 nt, Pseudomonas aeruginosa PA01
aucgcugucgcccg

SEQ ID NO: 1451078 - RNA, 20 nt, Pseudomonas aeruginosa PA01
aucgcucgcaacgcuguccg

SEQ ID NO: 1451079 - RNA, 13 nt, Pseudomonas aeruginosa PA01
aucgagucgccga

SEQ ID NO: 1451080 - RNA, 15 nt, Pseudomonas aeruginosa PA01
aucgagucgccggcg

SEQ ID NO: 1451081 - RNA, 19 nt, Pseudomonas aeruginosa PA01
aucgagucgccggcgaacu

SEQ ID NO: 1451082 - RNA, 20 nt, Pseudomonas aeruginosa PA01
aucgaggccauccccgaggc

SEQ ID NO: 1451083 - RNA, 16 nt, Pseudomonas aeruginosa PA01
aucgaggccgcccagc

SEQ ID NO: 1451084 - RNA, 19 nt, Pseudomonas aeruginosa PA01
aucgaggccgcccagcgca

SEQ ID NO: 1451085 - RNA, 20 nt, Pseudomonas aeruginosa PA01
aucgaggccgcccagcgcag

SEQ ID NO: 1451086 - RNA, 24 nt, Pseudomonas aeruginosa PA01
aucgaggccgcccagcgcagccug

SEQ ID NO: 1451087 - RNA, 13 nt, Pseudomonas aeruginosa PA01
aucgaggccggca

SEQ ID NO: 1451088 - RNA, 16 nt, Pseudomonas aeruginosa PA01
aucgaggcgucggcgg

SEQ ID NO: 1451089 - RNA, 18 nt, Pseudomonas aeruginosa PA01
aucgauauguccgguugg

SEQ ID NO: 1451090 - RNA, 14 nt, Pseudomonas aeruginosa PA01
aucgauccgcaccc

SEQ ID NO: 1451091 - RNA, 17 nt, Pseudomonas aeruginosa PA01
aucgacgguuucaggcc

SEQ ID NO: 1451092 - RNA, 17 nt, Pseudomonas aeruginosa PA01
aucgagccagcgcucga

SEQ ID NO: 1451093 - RNA, 22 nt, Pseudomonas aeruginosa PA01
aucgagcccuugcgcggcgcac

SEQ ID NO: 1451094 - RNA, 22 nt, Pseudomonas aeruginosa PA01
aucgagcuguccaucucgccgc

SEQ ID NO: 1451095 - RNA, 23 nt, Pseudomonas aeruginosa PA01
aucgagcuguccaucucgccgcg

SEQ ID NO: 1451096 - RNA, 20 nt, Pseudomonas aeruginosa PA01
aucgagcggcccgcggucac

SEQ ID NO: 1451097 - RNA, 14 nt, Pseudomonas aeruginosa PA01
aucgagcgccagga

SEQ ID NO: 1451098 - RNA, 13 nt, Pseudomonas aeruginosa PA01
aucgaccuugccc

SEQ ID NO: 1451099 - RNA, 14 nt, Pseudomonas aeruginosa PA01
aucgaccucgcggg

SEQ ID NO: 1451100 - RNA, 15 nt, Pseudomonas aeruginosa PA01
aucgaccucgcgggc

SEQ ID NO: 1451101 - RNA, 14 nt, Pseudomonas aeruginosa PA01
aucgaccagcagcg

SEQ ID NO: 1451102 - RNA, 14 nt, Pseudomonas aeruginosa PA01
aucgaccaggucgc

SEQ ID NO: 1451103 - RNA, 22 nt, Pseudomonas aeruginosa PA01
aucgaccaggaauuccuggccg

SEQ ID NO: 1451104 - RNA, 15 nt, Pseudomonas aeruginosa PA01
aucgacgccucggcg

SEQ ID NO: 1451105 - RNA, 13 nt, Pseudomonas aeruginosa PA01
aucgacgccagcg

SEQ ID NO: 1451106 - RNA, 13 nt, Pseudomonas aeruginosa PA01
aucgacgccagcu

SEQ ID NO: 1451107 - RNA, 12 nt, Pseudomonas aeruginosa PA01
aucgacgccgcu

SEQ ID NO: 1451108 - RNA, 17 nt, Pseudomonas aeruginosa PA01
aucgacgccgcuggcgg

SEQ ID NO: 1451109 - RNA, 17 nt, Pseudomonas aeruginosa PA01
aucgacggauacgccag

SEQ ID NO: 1451110 - RNA, 21 nt, Pseudomonas aeruginosa PA01
aucgacucgauggcgcggugg

SEQ ID NO: 1451111 - RNA, 12 nt, Pseudomonas aeruginosa PA01
aucaggccgcgg

SEQ ID NO: 1451112 - RNA, 15 nt, Pseudomonas aeruginosa PA01
aucagcgccagggca

SEQ ID NO: 1451113 - RNA, 15 nt, Pseudomonas aeruginosa PA01
aucaggcagcgcgcg

SEQ ID NO: 1451114 - RNA, 22 nt, Pseudomonas aeruginosa PA01
aucaggauguggccgucgcgcc

SEQ ID NO: 1451115 - RNA, 22 nt, Pseudomonas aeruginosa PA01
aucgacagggucgucuggguca

SEQ ID NO: 1451116 - RNA, 23 nt, Pseudomonas aeruginosa PA01
aucaggcguaggccgucgcugcc

SEQ ID NO: 1451117 - RNA, 15 nt, Pseudomonas aeruginosa PA01
aucaggcucaggcgu

SEQ ID NO: 1451118 - RNA, 22 nt, Pseudomonas aeruginosa PA01
aucaggcgcuuguccaucggcu

SEQ ID NO: 1451119 - RNA, 18 nt, Pseudomonas aeruginosa PA01
aucgaugaccuucgaggu

SEQ ID NO: 1451120 - RNA, 21 nt, Pseudomonas aeruginosa PA01
aucgaugucguggucgccguc

SEQ ID NO: 1451121 - RNA, 14 nt, Pseudomonas aeruginosa PA01
aucgauggcguggg

SEQ ID NO: 1451122 - RNA, 17 nt, Pseudomonas aeruginosa PA01
aucgauggucacuggcg

SEQ ID NO: 1451123 - RNA, 16 nt, Pseudomonas aeruginosa PA01
aucgaucgagcgaucg

SEQ ID NO: 1451124 - RNA, 19 nt, Pseudomonas aeruginosa PA01
aucgaucacugccuggcag

SEQ ID NO: 1451125 - RNA, 21 nt, Pseudomonas aeruginosa PA01
aucgaucucgaucgagucgcc

SEQ ID NO: 1451126 - RNA, 15 nt, Pseudomonas aeruginosa PA01
aucgaucucgucggc

SEQ ID NO: 1451127 - RNA, 18 nt, Pseudomonas aeruginosa PA01
aucgcacggucguccugc

SEQ ID NO: 1451128 - RNA, 15 nt, Pseudomonas aeruginosa PA01
aucgcacuucgucac

SEQ ID NO: 1451129 - RNA, 13 nt, Pseudomonas aeruginosa PA01
aucgcagcgcggu

SEQ ID NO: 1451130 - RNA, 15 nt, Pseudomonas aeruginosa PA01
aucgcaucggcgacc

SEQ ID NO: 1451131 - RNA, 15 nt, Pseudomonas aeruginosa PA01
aucgcaucgguggug

SEQ ID NO: 1451132 - RNA, 14 nt, Pseudomonas aeruginosa PA01
aucgcauagccggc

SEQ ID NO: 1451133 - RNA, 18 nt, Pseudomonas aeruginosa PA01
aucgcauagccggcgcgc

SEQ ID NO: 1451134 - RNA, 20 nt, Pseudomonas aeruginosa PA01
aucgcauagccggcgcgccc

SEQ ID NO: 1451135 - RNA, 22 nt, Pseudomonas aeruginosa PA01
aucgcauagccggcgcgcccgg

SEQ ID NO: 1451136 - RNA, 12 nt, Pseudomonas aeruginosa PA01
aucgcaggccag

SEQ ID NO: 1451137 - RNA, 13 nt, Pseudomonas aeruginosa PA01
aucgcaggccagg

SEQ ID NO: 1451138 - RNA, 16 nt, Pseudomonas aeruginosa PA01
aucgcaggccaggccc

SEQ ID NO: 1451139 - RNA, 14 nt, Pseudomonas aeruginosa PA01
aucgccacgccggc

SEQ ID NO: 1451140 - RNA, 21 nt, Pseudomonas aeruginosa PA01
aucgccaccccgccgcuggcg

SEQ ID NO: 1451141 - RNA, 22 nt, Pseudomonas aeruginosa PA01
aucgccaccccgccgcuggcgg

SEQ ID NO: 1451142 - RNA, 20 nt, Pseudomonas aeruginosa PA01
aucgccaccgguacgcucac

SEQ ID NO: 1451143 - RNA, 13 nt, Pseudomonas aeruginosa PA01
aucgccaacgcca

SEQ ID NO: 1451144 - RNA, 15 nt, Pseudomonas aeruginosa PA01
aucgccaacgccacc

SEQ ID NO: 1451145 - RNA, 21 nt, Pseudomonas aeruginosa PA01
aucgccaaccaguagggggug

SEQ ID NO: 1451146 - RNA, 15 nt, Pseudomonas aeruginosa PA01
aucgccagcgguacc

SEQ ID NO: 1451147 - RNA, 22 nt, Pseudomonas aeruginosa PA01
aucgccagcgguacccgccggc

SEQ ID NO: 1451148 - RNA, 23 nt, Pseudomonas aeruginosa PA01
aucgccagcgguacccgccggcc

SEQ ID NO: 1451149 - RNA, 16 nt, Pseudomonas aeruginosa PA01
aucgccagcucgccgc

SEQ ID NO: 1451150 - RNA, 17 nt, Pseudomonas aeruginosa PA01
aucgccagcucgccgcg

SEQ ID NO: 1451151 - RNA, 20 nt, Pseudomonas aeruginosa PA01
aucgccagcucgccgcgcuc

SEQ ID NO: 1451152 - RNA, 13 nt, Pseudomonas aeruginosa PA01
aucgccagcgcca

SEQ ID NO: 1451153 - RNA, 16 nt, Pseudomonas aeruginosa PA01
aucgccagguggaagc

SEQ ID NO: 1451154 - RNA, 21 nt, Pseudomonas aeruginosa PA01
aucgccagguggaagcgcgcg

SEQ ID NO: 1451155 - RNA, 18 nt, Pseudomonas aeruginosa PA01
aucgccaggcugauccgc

SEQ ID NO: 1451156 - RNA, 21 nt, Pseudomonas aeruginosa PA01
aucgccauuggccagggucac

SEQ ID NO: 1451157 - RNA, 15 nt, Pseudomonas aeruginosa PA01
aucgccauggcgcug

SEQ ID NO: 1451158 - RNA, 16 nt, Pseudomonas aeruginosa PA01
aucgcccgaacgccga

SEQ ID NO: 1451159 - RNA, 22 nt, Pseudomonas aeruginosa PA01
aucgcccgcagccacaggcgcc

SEQ ID NO: 1451160 - RNA, 24 nt, Pseudomonas aeruginosa PA01
aucgcccgcagccacaggcgccag

SEQ ID NO: 1451161 - RNA, 13 nt, Pseudomonas aeruginosa PA01
aucgcccagggcc

SEQ ID NO: 1451162 - RNA, 21 nt, Pseudomonas aeruginosa PA01
aucgcccagggccagcggguu

SEQ ID NO: 1451163 - RNA, 13 nt, Pseudomonas aeruginosa PA01
aucgcccaccagg

SEQ ID NO: 1451164 - RNA, 11 nt, Pseudomonas aeruginosa PA01
auugcugccga

SEQ ID NO: 1451165 - RNA, 16 nt, Pseudomonas aeruginosa PA01
auugccgguagccggc

SEQ ID NO: 1451166 - RNA, 23 nt, Pseudomonas aeruginosa PA01
auugccgguagccggcgaucagc

SEQ ID NO: 1451167 - RNA, 21 nt, Pseudomonas aeruginosa PA01
auugcacaacgggugcugcgg

SEQ ID NO: 1451168 - RNA, 21 nt, Pseudomonas aeruginosa PA01
auugcacuuccacuccaggcg

SEQ ID NO: 1451169 - RNA, 22 nt, Pseudomonas aeruginosa PA01
auugccgcgggcuauucccgcc

SEQ ID NO: 1451170 - RNA, 22 nt, Pseudomonas aeruginosa PA01
auuggucaccacguugcgccgc

SEQ ID NO: 1451171 - RNA, 12 nt, Pseudomonas aeruginosa PA01
auucauggcgcc

SEQ ID NO: 1451172 - RNA, 16 nt, Pseudomonas aeruginosa PA01
auuccucagcgccggu

SEQ ID NO: 1451173 - RNA, 15 nt, Pseudomonas aeruginosa PA01
auucgacagcaggug

SEQ ID NO: 1451174 - RNA, 15 nt, Pseudomonas aeruginosa PA01
auucgacccgccgac

SEQ ID NO: 1451175 - RNA, 17 nt, Pseudomonas aeruginosa PA01
auucgacccgccgacca

SEQ ID NO: 1451176 - RNA, 18 nt, Pseudomonas aeruginosa PA01
auuccuuggucaggucga

SEQ ID NO: 1451177 - RNA, 20 nt, Pseudomonas aeruginosa PA01
auucggcccaugccuccgac

SEQ ID NO: 1451178 - RNA, 14 nt, Pseudomonas aeruginosa PA01
auucgcugucaggg

SEQ ID NO: 1451179 - RNA, 21 nt, Pseudomonas aeruginosa PA01
auucgcugucgucggcgcggc

SEQ ID NO: 1451180 - RNA, 16 nt, Pseudomonas aeruginosa PA01
auucgcuucggccacc

SEQ ID NO: 1451181 - RNA, 15 nt, Pseudomonas aeruginosa PA01
auucgcucugcgcca

SEQ ID NO: 1451182 - RNA, 21 nt, Pseudomonas aeruginosa PA01
auucgcugacgaggacgccgc

SEQ ID NO: 1451183 - RNA, 18 nt, Pseudomonas aeruginosa PA01
auucgcguucggucaggc

SEQ ID NO: 1451184 - RNA, 18 nt, Pseudomonas aeruginosa PA01
auucgaacagcuugacga

SEQ ID NO: 1451185 - RNA, 14 nt, Pseudomonas aeruginosa PA01
auucugcaggcgcu

SEQ ID NO: 1451186 - RNA, 15 nt, Pseudomonas aeruginosa PA01
auucugcaggcgcuc

SEQ ID NO: 1451187 - RNA, 13 nt, Pseudomonas aeruginosa PA01
auugagcgcgccc

SEQ ID NO: 1451188 - RNA, 14 nt, Pseudomonas aeruginosa PA01
auugaaggccgaca

SEQ ID NO: 1451189 - RNA, 20 nt, Pseudomonas aeruginosa PA01
auucaucucgccgucggcgg

SEQ ID NO: 1451190 - RNA, 20 nt, Pseudomonas aeruginosa PA01
auucaucggcggcaggccga

SEQ ID NO: 1451191 - RNA, 17 nt, Pseudomonas aeruginosa PA01
auuagcgucgcgcggcc

SEQ ID NO: 1451192 - RNA, 16 nt, Pseudomonas aeruginosa PA01
auguucaccgcggccu

SEQ ID NO: 1451193 - RNA, 23 nt, Pseudomonas aeruginosa PA01
auguuccaaggugcugccgauca

SEQ ID NO: 1451194 - RNA, 17 nt, Pseudomonas aeruginosa PA01
auguggguauccagcgg

SEQ ID NO: 1451195 - RNA, 18 nt, Pseudomonas aeruginosa PA01
auguggguauccagcggc

SEQ ID NO: 1451196 - RNA, 18 nt, Pseudomonas aeruginosa PA01
auguggccgucgcgccgc

SEQ ID NO: 1451197 - RNA, 19 nt, Pseudomonas aeruginosa PA01
auguuguuauggccgaccc

SEQ ID NO: 1451198 - RNA, 15 nt, Pseudomonas aeruginosa PA01
auguugccgccgccg

SEQ ID NO: 1451199 - RNA, 11 nt, Pseudomonas aeruginosa PA01
auguucgaagu

SEQ ID NO: 1451200 - RNA, 18 nt, Pseudomonas aeruginosa PA01
auguucgaggcgccgacc

SEQ ID NO: 1451201 - RNA, 22 nt, Pseudomonas aeruginosa PA01
augucggccugcagccuggcgu

SEQ ID NO: 1451202 - RNA, 19 nt, Pseudomonas aeruginosa PA01
augucuucucaaagggcag

SEQ ID NO: 1451203 - RNA, 17 nt, Pseudomonas aeruginosa PA01
augucgucgaacgacuc

SEQ ID NO: 1451204 - RNA, 20 nt, Pseudomonas aeruginosa PA01
auguccgggugaugcccggu

SEQ ID NO: 1451205 - RNA, 13 nt, Pseudomonas aeruginosa PA01
auguccucggcgc

SEQ ID NO: 1451206 - RNA, 15 nt, Pseudomonas aeruginosa PA01
auguccucggcgccg

SEQ ID NO: 1451207 - RNA, 19 nt, Pseudomonas aeruginosa PA01
auguccuggaucggcagcu

SEQ ID NO: 1451208 - RNA, 23 nt, Pseudomonas aeruginosa PA01
auguccgagcaggucgcggaacu

SEQ ID NO: 1451209 - RNA, 17 nt, Pseudomonas aeruginosa PA01
auguagcgcuccucgcg

SEQ ID NO: 1451210 - RNA, 16 nt, Pseudomonas aeruginosa PA01
auguagucgacgccgg

SEQ ID NO: 1451211 - RNA, 16 nt, Pseudomonas aeruginosa PA01
auguaguccagcgccg

SEQ ID NO: 1451212 - RNA, 17 nt, Pseudomonas aeruginosa PA01
auguaguccagcgccgc

SEQ ID NO: 1451213 - RNA, 18 nt, Pseudomonas aeruginosa PA01
auguaguccagcgccgcg

SEQ ID NO: 1451214 - RNA, 13 nt, Pseudomonas aeruginosa PA01
auguacggcacca

SEQ ID NO: 1451215 - RNA, 17 nt, Pseudomonas aeruginosa PA01
auguacggcaccaccac

SEQ ID NO: 1451216 - RNA, 13 nt, Pseudomonas aeruginosa PA01
augguccgucgcg

SEQ ID NO: 1451217 - RNA, 12 nt, Pseudomonas aeruginosa PA01
auggucgccgcg

SEQ ID NO: 1451218 - RNA, 23 nt, Pseudomonas aeruginosa PA01
auggucgccgcgaccucguugca

SEQ ID NO: 1451219 - RNA, 13 nt, Pseudomonas aeruginosa PA01
auggucgccggag

SEQ ID NO: 1451220 - RNA, 19 nt, Pseudomonas aeruginosa PA01
augggcacgaucugcgccg

SEQ ID NO: 1451221 - RNA, 20 nt, Pseudomonas aeruginosa PA01
augggcacgaucugcgccgc

SEQ ID NO: 1451222 - RNA, 21 nt, Pseudomonas aeruginosa PA01
augggcacgaucugcgccgca

SEQ ID NO: 1451223 - RNA, 17 nt, Pseudomonas aeruginosa PA01
augggcacgccgguggc

SEQ ID NO: 1451224 - RNA, 22 nt, Pseudomonas aeruginosa PA01
auggucuucccagaccccggcg

SEQ ID NO: 1451225 - RNA, 16 nt, Pseudomonas aeruginosa PA01
auggucggugacccgc

SEQ ID NO: 1451226 - RNA, 22 nt, Pseudomonas aeruginosa PA01
auggucggugacccgcacggcg

SEQ ID NO: 1451227 - RNA, 15 nt, Pseudomonas aeruginosa PA01
auggucguucagcgg

SEQ ID NO: 1451228 - RNA, 18 nt, Pseudomonas aeruginosa PA01
auggugaucacgucggcg

SEQ ID NO: 1451229 - RNA, 14 nt, Pseudomonas aeruginosa PA01
auggugcgcucgcg

SEQ ID NO: 1451230 - RNA, 18 nt, Pseudomonas aeruginosa PA01
augguggaccagcgccgc

SEQ ID NO: 1451231 - RNA, 16 nt, Pseudomonas aeruginosa PA01
auggugugcagcagca

SEQ ID NO: 1451232 - RNA, 17 nt, Pseudomonas aeruginosa PA01
auggccagggggccugg

SEQ ID NO: 1451233 - RNA, 21 nt, Pseudomonas aeruginosa PA01
auggccagggggccuggcucg

SEQ ID NO: 1451234 - RNA, 23 nt, Pseudomonas aeruginosa PA01
auggccagggggccuggcucgau

SEQ ID NO: 1451235 - RNA, 16 nt, Pseudomonas aeruginosa PA01
auggccagucaucgcg

SEQ ID NO: 1451236 - RNA, 15 nt, Pseudomonas aeruginosa PA01
auggccagcgcguag

SEQ ID NO: 1451237 - RNA, 13 nt, Pseudomonas aeruginosa PA01
auggacaggucga

SEQ ID NO: 1451238 - RNA, 15 nt, Pseudomonas aeruginosa PA01
auggccacgcucucg

SEQ ID NO: 1451239 - RNA, 20 nt, Pseudomonas aeruginosa PA01
auggccguccucgucgaggu

SEQ ID NO: 1451240 - RNA, 16 nt, Pseudomonas aeruginosa PA01
auggccccuccaccuc

SEQ ID NO: 1451241 - RNA, 23 nt, Pseudomonas aeruginosa PA01
auggcccagauauccagggccag

SEQ ID NO: 1451242 - RNA, 13 nt, Pseudomonas aeruginosa PA01
auggccuggucgg

SEQ ID NO: 1451243 - RNA, 16 nt, Pseudomonas aeruginosa PA01
auggccuggucggcgc

SEQ ID NO: 1451244 - RNA, 17 nt, Pseudomonas aeruginosa PA01
auggccuggucggcgcg

SEQ ID NO: 1451245 - RNA, 13 nt, Pseudomonas aeruginosa PA01
auggccuggcgcu

SEQ ID NO: 1451246 - RNA, 21 nt, Pseudomonas aeruginosa PA01
auggccuggcgcucagcgccg

SEQ ID NO: 1451247 - RNA, 22 nt, Pseudomonas aeruginosa PA01
auggccuggcgcucagcgccgc

SEQ ID NO: 1451248 - RNA, 19 nt, Pseudomonas aeruginosa PA01
auggcgaagcgcuugccca

SEQ ID NO: 1451249 - RNA, 19 nt, Pseudomonas aeruginosa PA01
auggcgaacaugaagccgc

SEQ ID NO: 1451250 - RNA, 19 nt, Pseudomonas aeruginosa PA01
auggcgaccugguggcgcc

SEQ ID NO: 1451251 - RNA, 20 nt, Pseudomonas aeruginosa PA01
auggcgaccugguggcgccg

SEQ ID NO: 1451252 - RNA, 21 nt, Pseudomonas aeruginosa PA01
auggcgaccugguggcgccgg

SEQ ID NO: 1451253 - RNA, 22 nt, Pseudomonas aeruginosa PA01
auggcggaauaacucagcauca

SEQ ID NO: 1451254 - RNA, 21 nt, Pseudomonas aeruginosa PA01
auggcggauagccgcaagcgg

SEQ ID NO: 1451255 - RNA, 23 nt, Pseudomonas aeruginosa PA01
auggcgcuucaucuccugcugga

SEQ ID NO: 1451256 - RNA, 20 nt, Pseudomonas aeruginosa PA01
auggcggccugguagucgcc

SEQ ID NO: 1451257 - RNA, 14 nt, Pseudomonas aeruginosa PA01
auggcgucggcgau

SEQ ID NO: 1451258 - RNA, 23 nt, Pseudomonas aeruginosa PA01
auggcgucggcgaucacguccuu

SEQ ID NO: 1451259 - RNA, 15 nt, Pseudomonas aeruginosa PA01
augggcaccgcgccg

SEQ ID NO: 1451260 - RNA, 16 nt, Pseudomonas aeruginosa PA01
augggcaccgcgccgg

SEQ ID NO: 1451261 - RNA, 17 nt, Pseudomonas aeruginosa PA01
augggcaccgcgccggc

SEQ ID NO: 1451262 - RNA, 14 nt, Pseudomonas aeruginosa PA01
auggcugucggcgc

SEQ ID NO: 1451263 - RNA, 22 nt, Pseudomonas aeruginosa PA01
auggcuugaucgagucgccggc

SEQ ID NO: 1451264 - RNA, 20 nt, Pseudomonas aeruginosa PA01
auggcucgcggcgcucgucg

SEQ ID NO: 1451265 - RNA, 12 nt, Pseudomonas aeruginosa PA01
auggcuggcgca

SEQ ID NO: 1451266 - RNA, 12 nt, Pseudomonas aeruginosa PA01
auggcuggcgcu

SEQ ID NO: 1451267 - RNA, 16 nt, Pseudomonas aeruginosa PA01
auggcuaaacaagcca

SEQ ID NO: 1451268 - RNA, 16 nt, Pseudomonas aeruginosa PA01
auggcguuguugguca

SEQ ID NO: 1451269 - RNA, 16 nt, Pseudomonas aeruginosa PA01
augcgguagucgcugc

SEQ ID NO: 1451270 - RNA, 15 nt, Pseudomonas aeruginosa PA01
augcggggcgaccag

SEQ ID NO: 1451271 - RNA, 21 nt, Pseudomonas aeruginosa PA01
augcgcaacgggacgccaggc

SEQ ID NO: 1451272 - RNA, 22 nt, Pseudomonas aeruginosa PA01
augcgcaacgggacgccaggcg

SEQ ID NO: 1451273 - RNA, 23 nt, Pseudomonas aeruginosa PA01
augcuguugccguggcggcgcgc

SEQ ID NO: 1451274 - RNA, 17 nt, Pseudomonas aeruginosa PA01
augcugggucuccgcuc

SEQ ID NO: 1451275 - RNA, 14 nt, Pseudomonas aeruginosa PA01
augcgguuccuggc

SEQ ID NO: 1451276 - RNA, 17 nt, Pseudomonas aeruginosa PA01
augcgguuccuggcugg

SEQ ID NO: 1451277 - RNA, 15 nt, Pseudomonas aeruginosa PA01
augcggugcggccau

SEQ ID NO: 1451278 - RNA, 21 nt, Pseudomonas aeruginosa PA01
augcguuccuguccauuucca

SEQ ID NO: 1451279 - RNA, 20 nt, Pseudomonas aeruginosa PA01
augcguggguccacgccggg

SEQ ID NO: 1451280 - RNA, 18 nt, Pseudomonas aeruginosa PA01
augccgcacaggcuggcc

SEQ ID NO: 1451281 - RNA, 17 nt, Pseudomonas aeruginosa PA01
augccgaugccgccgac

SEQ ID NO: 1451282 - RNA, 14 nt, Pseudomonas aeruginosa PA01
augccgcaccccau

SEQ ID NO: 1451283 - RNA, 17 nt, Pseudomonas aeruginosa PA01
augccgccgucgcggcc

SEQ ID NO: 1451284 - RNA, 17 nt, Pseudomonas aeruginosa PA01
augccgcgcgccuggcu

SEQ ID NO: 1451285 - RNA, 19 nt, Pseudomonas aeruginosa PA01
augccgcgcgccuggcugg

SEQ ID NO: 1451286 - RNA, 22 nt, Pseudomonas aeruginosa PA01
augccgcgcgccuggcuggcca

SEQ ID NO: 1451287 - RNA, 19 nt, Pseudomonas aeruginosa PA01
augccgaucaugcucggcg

SEQ ID NO: 1451288 - RNA, 16 nt, Pseudomonas aeruginosa PA01
augccgaucaccgcca

SEQ ID NO: 1451289 - RNA, 13 nt, Pseudomonas aeruginosa PA01
augccgaggcggc

SEQ ID NO: 1451290 - RNA, 22 nt, Pseudomonas aeruginosa PA01
augccgaggcugugggucgggu

SEQ ID NO: 1451291 - RNA, 17 nt, Pseudomonas aeruginosa PA01
augauggugccgccggg

SEQ ID NO: 1451292 - RNA, 17 nt, Pseudomonas aeruginosa PA01
augauggucaacaccag

SEQ ID NO: 1451293 - RNA, 19 nt, Pseudomonas aeruginosa PA01
augauggucaacaccagcg

SEQ ID NO: 1451294 - RNA, 17 nt, Pseudomonas aeruginosa PA01
augccgagcaucagcga

SEQ ID NO: 1451295 - RNA, 20 nt, Pseudomonas aeruginosa PA01
augaugcaggcagugugcac

SEQ ID NO: 1451296 - RNA, 13 nt, Pseudomonas aeruginosa PA01
augaugccgaggc

SEQ ID NO: 1451297 - RNA, 17 nt, Pseudomonas aeruginosa PA01
augaugccgaggcggcc

SEQ ID NO: 1451298 - RNA, 15 nt, Pseudomonas aeruginosa PA01
augaugccgcggcga

SEQ ID NO: 1451299 - RNA, 12 nt, Pseudomonas aeruginosa PA01
augaucgccggg

SEQ ID NO: 1451300 - RNA, 16 nt, Pseudomonas aeruginosa PA01
augaucgccucggcgc

SEQ ID NO: 1451301 - RNA, 19 nt, Pseudomonas aeruginosa PA01
augaucgccucggcgcgcg

SEQ ID NO: 1451302 - RNA, 23 nt, Pseudomonas aeruginosa PA01
augaucgguucccgcccgcucau

SEQ ID NO: 1451303 - RNA, 19 nt, Pseudomonas aeruginosa PA01
augaucugacuaacagguc

SEQ ID NO: 1451304 - RNA, 14 nt, Pseudomonas aeruginosa PA01
augccguucaggcc

SEQ ID NO: 1451305 - RNA, 18 nt, Pseudomonas aeruginosa PA01
augccguucaggccggcg

SEQ ID NO: 1451306 - RNA, 20 nt, Pseudomonas aeruginosa PA01
augccguugcccucgcgcug

SEQ ID NO: 1451307 - RNA, 23 nt, Pseudomonas aeruginosa PA01
augccguugcccucgcgcuggac

SEQ ID NO: 1451308 - RNA, 16 nt, Pseudomonas aeruginosa PA01
augccguuggccgagc

SEQ ID NO: 1451309 - RNA, 19 nt, Pseudomonas aeruginosa PA01
augccgugggcgccgccgg

SEQ ID NO: 1451310 - RNA, 12 nt, Pseudomonas aeruginosa PA01
augccucggcgg

SEQ ID NO: 1451311 - RNA, 13 nt, Pseudomonas aeruginosa PA01
augccucggcggc

SEQ ID NO: 1451312 - RNA, 16 nt, Pseudomonas aeruginosa PA01
augccuagcacccggg

SEQ ID NO: 1451313 - RNA, 16 nt, Pseudomonas aeruginosa PA01
augccugcguuucgcc

SEQ ID NO: 1451314 - RNA, 19 nt, Pseudomonas aeruginosa PA01
augccugcguuucgccggg

SEQ ID NO: 1451315 - RNA, 19 nt, Pseudomonas aeruginosa PA01
augccgucgaucuugcaau

SEQ ID NO: 1451316 - RNA, 15 nt, Pseudomonas aeruginosa PA01
augccgcgccaggcg

SEQ ID NO: 1451317 - RNA, 22 nt, Pseudomonas aeruginosa PA01
augccgcgccggaaguggcagc

SEQ ID NO: 1451318 - RNA, 18 nt, Pseudomonas aeruginosa PA01
augccggaaagccuggcc

SEQ ID NO: 1451319 - RNA, 22 nt, Pseudomonas aeruginosa PA01
augccggaaagccuggccggcg

SEQ ID NO: 1451320 - RNA, 22 nt, Pseudomonas aeruginosa PA01
augccgggcgagucgaucaggu

SEQ ID NO: 1451321 - RNA, 22 nt, Pseudomonas aeruginosa PA01
augccggugcuguaguaggcgg

SEQ ID NO: 1451322 - RNA, 14 nt, Pseudomonas aeruginosa PA01
augccgguggcgcc

SEQ ID NO: 1451323 - RNA, 18 nt, Pseudomonas aeruginosa PA01
augccgguggcgcccagc

SEQ ID NO: 1451324 - RNA, 18 nt, Pseudomonas aeruginosa PA01
augccgguucccgcagcg

SEQ ID NO: 1451325 - RNA, 17 nt, Pseudomonas aeruginosa PA01
augccguacaggucggc

SEQ ID NO: 1451326 - RNA, 18 nt, Pseudomonas aeruginosa PA01
augccguacaggucggcg

SEQ ID NO: 1451327 - RNA, 20 nt, Pseudomonas aeruginosa PA01
augccguacaggucggcgcc

SEQ ID NO: 1451328 - RNA, 17 nt, Pseudomonas aeruginosa PA01
aggcgauacaggcggug

SEQ ID NO: 1451329 - RNA, 23 nt, Pseudomonas aeruginosa PA01
aggcgaucaucgccaccgguacg

SEQ ID NO: 1451330 - RNA, 13 nt, Pseudomonas aeruginosa PA01
aggcgauccagcg

SEQ ID NO: 1451331 - RNA, 18 nt, Pseudomonas aeruginosa PA01
aggcgaucgccgcggcga

SEQ ID NO: 1451332 - RNA, 19 nt, Pseudomonas aeruginosa PA01
aggcgauccacagcagguu

SEQ ID NO: 1451333 - RNA, 15 nt, Pseudomonas aeruginosa PA01
aggcgauaucccgcc

SEQ ID NO: 1451334 - RNA, 16 nt, Pseudomonas aeruginosa PA01
aggcgauaucccgccg

SEQ ID NO: 1451335 - RNA, 15 nt, Pseudomonas aeruginosa PA01
aggcgauagccgacc

SEQ ID NO: 1451336 - RNA, 16 nt, Pseudomonas aeruginosa PA01
aggcgauagccgacca

SEQ ID NO: 1451337 - RNA, 22 nt, Pseudomonas aeruginosa PA01
aggcgauagccgaccaggccga

SEQ ID NO: 1451338 - RNA, 14 nt, Pseudomonas aeruginosa PA01
aggcgaugaccgcc

SEQ ID NO: 1451339 - RNA, 21 nt, Pseudomonas aeruginosa PA01
aggcgauguugacgauggcgc

SEQ ID NO: 1451340 - RNA, 20 nt, Pseudomonas aeruginosa PA01
aggcgauguaggucaccgcg

SEQ ID NO: 1451341 - RNA, 22 nt, Pseudomonas aeruginosa PA01
aggcgauguaggucaccgcgcc

SEQ ID NO: 1451342 - RNA, 18 nt, Pseudomonas aeruginosa PA01
aggcgauggccuggucgg

SEQ ID NO: 1451343 - RNA, 21 nt, Pseudomonas aeruginosa PA01
aggcgcacaucacccgguucu

SEQ ID NO: 1451344 - RNA, 23 nt, Pseudomonas aeruginosa PA01
aggcgcaaccagaccagcaggaa

SEQ ID NO: 1451345 - RNA, 14 nt, Pseudomonas aeruginosa PA01
aggcgacccggcau

SEQ ID NO: 1451346 - RNA, 18 nt, Pseudomonas aeruginosa PA01
aggcgacccgggucaggc

SEQ ID NO: 1451347 - RNA, 22 nt, Pseudomonas aeruginosa PA01
aggcgacccgggucaggccgag

SEQ ID NO: 1451348 - RNA, 17 nt, Pseudomonas aeruginosa PA01
aggcgacaaaucggcau

SEQ ID NO: 1451349 - RNA, 21 nt, Pseudomonas aeruginosa PA01
aggcgaaccacaccaggucgc

SEQ ID NO: 1451350 - RNA, 16 nt, Pseudomonas aeruginosa PA01
aggcgaaggucgaagg

SEQ ID NO: 1451351 - RNA, 18 nt, Pseudomonas aeruginosa PA01
aggcgaacugccgacggc

SEQ ID NO: 1451352 - RNA, 14 nt, Pseudomonas aeruginosa PA01
aggcgaagcccagc

SEQ ID NO: 1451353 - RNA, 23 nt, Pseudomonas aeruginosa PA01
aggcgaagccguuguagaucggc

SEQ ID NO: 1451354 - RNA, 19 nt, Pseudomonas aeruginosa PA01
aggcgaagcggcucggcca

SEQ ID NO: 1451355 - RNA, 18 nt, Pseudomonas aeruginosa PA01
aggcgaagcggcuggccg

SEQ ID NO: 1451356 - RNA, 13 nt, Pseudomonas aeruginosa PA01
aggcgaaggcgau

SEQ ID NO: 1451357 - RNA, 13 nt, Pseudomonas aeruginosa PA01
aggcgacgcccug

SEQ ID NO: 1451358 - RNA, 21 nt, Pseudomonas aeruginosa PA01
aggcgacgcccuguucggcgg

SEQ ID NO: 1451359 - RNA, 14 nt, Pseudomonas aeruginosa PA01
aggcgacguuuuuc

SEQ ID NO: 1451360 - RNA, 19 nt, Pseudomonas aeruginosa PA01
aggcgacguuuuucccgug

SEQ ID NO: 1451361 - RNA, 12 nt, Pseudomonas aeruginosa PA01
aggcgacgccgc

SEQ ID NO: 1451362 - RNA, 15 nt, Pseudomonas aeruginosa PA01
aggcgacgccgcgcu

SEQ ID NO: 1451363 - RNA, 15 nt, Pseudomonas aeruginosa PA01
aggcgacgcugaugc

SEQ ID NO: 1451364 - RNA, 18 nt, Pseudomonas aeruginosa PA01
aggcgacggucaggccga

SEQ ID NO: 1451365 - RNA, 20 nt, Pseudomonas aeruginosa PA01
aggcgacggucaggccgagc

SEQ ID NO: 1451366 - RNA, 21 nt, Pseudomonas aeruginosa PA01
aggcgacggucaggccgagca

SEQ ID NO: 1451367 - RNA, 18 nt, Pseudomonas aeruginosa PA01
aggcgacgaagcuggcga

SEQ ID NO: 1451368 - RNA, 17 nt, Pseudomonas aeruginosa PA01
aggcgacgaucagcccg

SEQ ID NO: 1451369 - RNA, 22 nt, Pseudomonas aeruginosa PA01
aggcgacgaucagcccgccggc

SEQ ID NO: 1451370 - RNA, 21 nt, Pseudomonas aeruginosa PA01
aggcgaaagucggcgcgacug

SEQ ID NO: 1451371 - RNA, 23 nt, Pseudomonas aeruginosa PA01
aggcgagggugaacuggccgucg

SEQ ID NO: 1451372 - RNA, 16 nt, Pseudomonas aeruginosa PA01
aggcgaggguggcgcc

SEQ ID NO: 1451373 - RNA, 12 nt, Pseudomonas aeruginosa PA01
aggcgaggucgc

SEQ ID NO: 1451374 - RNA, 14 nt, Pseudomonas aeruginosa PA01
aggcgaggucgccg

SEQ ID NO: 1451375 - RNA, 16 nt, Pseudomonas aeruginosa PA01
aggcgaggucgccggg

SEQ ID NO: 1451376 - RNA, 15 nt, Pseudomonas aeruginosa PA01
aggccuugcagcaac

SEQ ID NO: 1451377 - RNA, 17 nt, Pseudomonas aeruginosa PA01
aggccuugcagggccgc

SEQ ID NO: 1451378 - RNA, 13 nt, Pseudomonas aeruginosa PA01
aggccuucggcgc

SEQ ID NO: 1451379 - RNA, 13 nt, Pseudomonas aeruginosa PA01
aggccuucgacgg

SEQ ID NO: 1451380 - RNA, 14 nt, Pseudomonas aeruginosa PA01
aggccuucgacuuc

SEQ ID NO: 1451381 - RNA, 20 nt, Pseudomonas aeruginosa PA01
aggccuucgccgaccagguc

SEQ ID NO: 1451382 - RNA, 16 nt, Pseudomonas aeruginosa PA01
aggcgaacagggccau

SEQ ID NO: 1451383 - RNA, 19 nt, Pseudomonas aeruginosa PA01
aggccuuucuucugcugug

SEQ ID NO: 1451384 - RNA, 15 nt, Pseudomonas aeruginosa PA01
aggccuugcgcggcg

SEQ ID NO: 1451385 - RNA, 22 nt, Pseudomonas aeruginosa PA01
aggccuuggcccgguuggccag

SEQ ID NO: 1451386 - RNA, 17 nt, Pseudomonas aeruginosa PA01
aggccucggucaggcgc

SEQ ID NO: 1451387 - RNA, 21 nt, Pseudomonas aeruginosa PA01
aggccucggucaggcgcuggu

SEQ ID NO: 1451388 - RNA, 18 nt, Pseudomonas aeruginosa PA01
aggccuggaacaccaggc

SEQ ID NO: 1451389 - RNA, 20 nt, Pseudomonas aeruginosa PA01
aggccuggaugucgaagcgc

SEQ ID NO: 1451390 - RNA, 13 nt, Pseudomonas aeruginosa PA01
aggccuggccgcc

SEQ ID NO: 1451391 - RNA, 17 nt, Pseudomonas aeruginosa PA01
aggccuggccguugcgc

SEQ ID NO: 1451392 - RNA, 22 nt, Pseudomonas aeruginosa PA01
aggccuguccgaagacaggccu

SEQ ID NO: 1451393 - RNA, 19 nt, Pseudomonas aeruginosa PA01
aggccugacgcaagcgcuc

SEQ ID NO: 1451394 - RNA, 22 nt, Pseudomonas aeruginosa PA01
aggccugguagaucugugcggu

SEQ ID NO: 1451395 - RNA, 13 nt, Pseudomonas aeruginosa PA01
aggccucggccug

SEQ ID NO: 1451396 - RNA, 17 nt, Pseudomonas aeruginosa PA01
aggccucggccuggucg

SEQ ID NO: 1451397 - RNA, 13 nt, Pseudomonas aeruginosa PA01
aggccucggcgau

SEQ ID NO: 1451398 - RNA, 17 nt, Pseudomonas aeruginosa PA01
aggccucggcgaugccg

SEQ ID NO: 1451399 - RNA, 12 nt, Pseudomonas aeruginosa PA01
aggccuccucgu

SEQ ID NO: 1451400 - RNA, 18 nt, Pseudomonas aeruginosa PA01
aggccuacuucucgacga

SEQ ID NO: 1451401 - RNA, 17 nt, Pseudomonas aeruginosa PA01
aggccucgaugaucgcc

SEQ ID NO: 1451402 - RNA, 19 nt, Pseudomonas aeruginosa PA01
aggccucgaugaucgccgg

SEQ ID NO: 1451403 - RNA, 20 nt, Pseudomonas aeruginosa PA01
aggccucgaugaucgccggg

SEQ ID NO: 1451404 - RNA, 12 nt, Pseudomonas aeruginosa PA01
aggccuccagca

SEQ ID NO: 1451405 - RNA, 14 nt, Pseudomonas aeruginosa PA01
aggccuccagcaac

SEQ ID NO: 1451406 - RNA, 19 nt, Pseudomonas aeruginosa PA01
aggccuccagcaacgccgc

SEQ ID NO: 1451407 - RNA, 22 nt, Pseudomonas aeruginosa PA01
aggccuacccgcgcuucuucga

SEQ ID NO: 1451408 - RNA, 14 nt, Pseudomonas aeruginosa PA01
aggccgugguggca

SEQ ID NO: 1451409 - RNA, 16 nt, Pseudomonas aeruginosa PA01
aggccgugccagagcu

SEQ ID NO: 1451410 - RNA, 17 nt, Pseudomonas aeruginosa PA01
aggccgugccagagcuu

SEQ ID NO: 1451411 - RNA, 14 nt, Pseudomonas aeruginosa PA01
aggccgucgcugcc

SEQ ID NO: 1451412 - RNA, 16 nt, Pseudomonas aeruginosa PA01
aggccgugggccggcg

SEQ ID NO: 1451413 - RNA, 19 nt, Pseudomonas aeruginosa PA01
aggccgugggccggcgcgc

SEQ ID NO: 1451414 - RNA, 21 nt, Pseudomonas aeruginosa PA01
aggccgugggccggcgcgccg

SEQ ID NO: 1451415 - RNA, 14 nt, Pseudomonas aeruginosa PA01
aggcgcauguccag

SEQ ID NO: 1451416 - RNA, 20 nt, Pseudomonas aeruginosa PA01
aggcgcauguccagccagug

SEQ ID NO: 1451417 - RNA, 11 nt, Pseudomonas aeruginosa PA01
aggcgccagag

SEQ ID NO: 1451418 - RNA, 14 nt, Pseudomonas aeruginosa PA01
aggcgccagagcgc

SEQ ID NO: 1451419 - RNA, 16 nt, Pseudomonas aeruginosa PA01
aggcgccagagcgcgc

SEQ ID NO: 1451420 - RNA, 14 nt, Pseudomonas aeruginosa PA01
aggcgcccaggcag

SEQ ID NO: 1451421 - RNA, 16 nt, Pseudomonas aeruginosa PA01
aggcgcccaggcagca

SEQ ID NO: 1451422 - RNA, 15 nt, Pseudomonas aeruginosa PA01
aggcgcccgccggcc

SEQ ID NO: 1451423 - RNA, 16 nt, Pseudomonas aeruginosa PA01
aggcgcccggucaggu

SEQ ID NO: 1451424 - RNA, 21 nt, Pseudomonas aeruginosa PA01
aggcgcccgguggaggucugc

SEQ ID NO: 1451425 - RNA, 20 nt, Pseudomonas aeruginosa PA01
aggcgcaugcccagggccag

SEQ ID NO: 1451426 - RNA, 21 nt, Pseudomonas aeruginosa PA01
aggcgcaugcccagggccagc

SEQ ID NO: 1451427 - RNA, 20 nt, Pseudomonas aeruginosa PA01
aggcgcauggacaggucgac

SEQ ID NO: 1451428 - RNA, 23 nt, Pseudomonas aeruginosa PA01
aggcgcauggacaggucgacggc

SEQ ID NO: 1451429 - RNA, 14 nt, Pseudomonas aeruginosa PA01
aggcgccaggacuc

SEQ ID NO: 1451430 - RNA, 20 nt, Pseudomonas aeruginosa PA01
aggcgccaggacucgccauc

SEQ ID NO: 1451431 - RNA, 11 nt, Pseudomonas aeruginosa PA01
aggcgccaggg

SEQ ID NO: 1451432 - RNA, 14 nt, Pseudomonas aeruginosa PA01
aggcgccagggccg

SEQ ID NO: 1451433 - RNA, 14 nt, Pseudomonas aeruginosa PA01
aggcgcaggcgaac

SEQ ID NO: 1451434 - RNA, 16 nt, Pseudomonas aeruginosa PA01
aggcgcagcguccugc

SEQ ID NO: 1451435 - RNA, 18 nt, Pseudomonas aeruginosa PA01
aggcgcacuacgccguuc

SEQ ID NO: 1451436 - RNA, 13 nt, Pseudomonas aeruginosa PA01
aggcgcagccagc

SEQ ID NO: 1451437 - RNA, 13 nt, Pseudomonas aeruginosa PA01
aggcgcagcagcg

SEQ ID NO: 1451438 - RNA, 16 nt, Pseudomonas aeruginosa PA01
aggcgcagcagcgcca

SEQ ID NO: 1451439 - RNA, 17 nt, Pseudomonas aeruginosa PA01
aggcgcagcagcgccag

SEQ ID NO: 1451440 - RNA, 14 nt, Pseudomonas aeruginosa PA01
aggcgcaggucggc

SEQ ID NO: 1451441 - RNA, 13 nt, Pseudomonas aeruginosa PA01
aggcgcaucaggc

SEQ ID NO: 1451442 - RNA, 14 nt, Pseudomonas aeruginosa PA01
aggcgcaucaggcc

SEQ ID NO: 1451443 - RNA, 18 nt, Pseudomonas aeruginosa PA01
aggcgcaucaggccaaag

SEQ ID NO: 1451444 - RNA, 13 nt, Pseudomonas aeruginosa PA01
aggcgccgccguc

SEQ ID NO: 1451445 - RNA, 14 nt, Pseudomonas aeruginosa PA01
aggcgccgaccacg

SEQ ID NO: 1451446 - RNA, 19 nt, Pseudomonas aeruginosa PA01
aggcgcccuugacguucag

SEQ ID NO: 1451447 - RNA, 21 nt, Pseudomonas aeruginosa PA01
aggcgccggcggaucagcccg

SEQ ID NO: 1451448 - RNA, 12 nt, Pseudomonas aeruginosa PA01
aggcgccgggua

SEQ ID NO: 1451449 - RNA, 16 nt, Pseudomonas aeruginosa PA01
aggcgccgggucgaug

SEQ ID NO: 1451450 - RNA, 13 nt, Pseudomonas aeruginosa PA01
aggcgccggccgg

SEQ ID NO: 1451451 - RNA, 19 nt, Pseudomonas aeruginosa PA01
aggcgccugagcagcgcuu

SEQ ID NO: 1451452 - RNA, 19 nt, Pseudomonas aeruginosa PA01
aggcgcgaucgcguuccag

SEQ ID NO: 1451453 - RNA, 21 nt, Pseudomonas aeruginosa PA01
aggcgcgcaacgcuuccagca

SEQ ID NO: 1451454 - RNA, 23 nt, Pseudomonas aeruginosa PA01
aggcgcgccuggaucagcgccuc

SEQ ID NO: 1451455 - RNA, 14 nt, Pseudomonas aeruginosa PA01
aggcgcgccuggua

SEQ ID NO: 1451456 - RNA, 13 nt, Pseudomonas aeruginosa PA01
aggcgcgcggcca

SEQ ID NO: 1451457 - RNA, 22 nt, Pseudomonas aeruginosa PA01
aggcgcgcggccagcgcggccg

SEQ ID NO: 1451458 - RNA, 12 nt, Pseudomonas aeruginosa PA01
aggcgcgccggu

SEQ ID NO: 1451459 - RNA, 16 nt, Pseudomonas aeruginosa PA01
aggcgcgccgugcggc

SEQ ID NO: 1451460 - RNA, 11 nt, Pseudomonas aeruginosa PA01
aggcgcgccug

SEQ ID NO: 1451461 - RNA, 12 nt, Pseudomonas aeruginosa PA01
aggcgcgccgac

SEQ ID NO: 1451462 - RNA, 16 nt, Pseudomonas aeruginosa PA01
aggcgcgccacgcaau

SEQ ID NO: 1451463 - RNA, 18 nt, Pseudomonas aeruginosa PA01
aggcgcuguccuguggcg

SEQ ID NO: 1451464 - RNA, 19 nt, Pseudomonas aeruginosa PA01
aggcgcuguccuguggcgc

SEQ ID NO: 1451465 - RNA, 20 nt, Pseudomonas aeruginosa PA01
aggcgcuguccuguggcgcu

SEQ ID NO: 1451466 - RNA, 22 nt, Pseudomonas aeruginosa PA01
aggcgcuucagcucgaggccag

SEQ ID NO: 1451467 - RNA, 17 nt, Pseudomonas aeruginosa PA01
aggcgcuuucccgcuuc

SEQ ID NO: 1451468 - RNA, 13 nt, Pseudomonas aeruginosa PA01
aggcggaacggcu

SEQ ID NO: 1451469 - RNA, 24 nt, Pseudomonas aeruginosa PA01
aggcggaacggcucgcgaccgaga

SEQ ID NO: 1451470 - RNA, 20 nt, Pseudomonas aeruginosa PA01
aggcggagaagccgcugacc

SEQ ID NO: 1451471 - RNA, 17 nt, Pseudomonas aeruginosa PA01
aggcggagcaugguguc

SEQ ID NO: 1451472 - RNA, 20 nt, Pseudomonas aeruginosa PA01
aggcggagcauggugucgcu

SEQ ID NO: 1451473 - RNA, 15 nt, Pseudomonas aeruginosa PA01
aggcggaguagccgg

SEQ ID NO: 1451474 - RNA, 18 nt, Pseudomonas aeruginosa PA01
aggcggaguagccggcgg

SEQ ID NO: 1451475 - RNA, 18 nt, Pseudomonas aeruginosa PA01
aggcggauaacgccagga

SEQ ID NO: 1451476 - RNA, 16 nt, Pseudomonas aeruginosa PA01
aggcggaucgccgccu

SEQ ID NO: 1451477 - RNA, 22 nt, Pseudomonas aeruginosa PA01
aggcgcuggugcugcuccauca

SEQ ID NO: 1451478 - RNA, 20 nt, Pseudomonas aeruginosa PA01
aggcgcugguccagcacgcu

SEQ ID NO: 1451479 - RNA, 21 nt, Pseudomonas aeruginosa PA01
aggcgcugguccagcacgcug

SEQ ID NO: 1451480 - RNA, 22 nt, Pseudomonas aeruginosa PA01
aggcgcuggcgcuguaggcgag

SEQ ID NO: 1451481 - RNA, 15 nt, Pseudomonas aeruginosa PA01
aggcgcuggcgggcg

SEQ ID NO: 1451482 - RNA, 17 nt, Pseudomonas aeruginosa PA01
aggcgcugggcggcugg

SEQ ID NO: 1451483 - RNA, 22 nt, Pseudomonas aeruginosa PA01
aggcgcugcgcggccugcgccg

SEQ ID NO: 1451484 - RNA, 21 nt, Pseudomonas aeruginosa PA01
aggcgcugcgguaccagcgca

SEQ ID NO: 1451485 - RNA, 22 nt, Pseudomonas aeruginosa PA01
aggcgcugcgguaccagcgcac

SEQ ID NO: 1451486 - RNA, 12 nt, Pseudomonas aeruginosa PA01
aggcgcuggcca

SEQ ID NO: 1451487 - RNA, 14 nt, Pseudomonas aeruginosa PA01
aggcgcuggccagc

SEQ ID NO: 1451488 - RNA, 15 nt, Pseudomonas aeruginosa PA01
aggcgcuggccagcg

SEQ ID NO: 1451489 - RNA, 19 nt, Pseudomonas aeruginosa PA01
aggcgcuggccagcgcuuc

SEQ ID NO: 1451490 - RNA, 22 nt, Pseudomonas aeruginosa PA01
aggcgcugcaaucgcugccggu

SEQ ID NO: 1451491 - RNA, 22 nt, Pseudomonas aeruginosa PA01
aggcgcucgcgggccgccuggu

SEQ ID NO: 1451492 - RNA, 23 nt, Pseudomonas aeruginosa PA01
aggcgcucgcgggccgccugguc

SEQ ID NO: 1451493 - RNA, 16 nt, Pseudomonas aeruginosa PA01
aggcgcgcucgaucag

SEQ ID NO: 1451494 - RNA, 22 nt, Pseudomonas aeruginosa PA01
aggcgcgcggucuucaucaccu

SEQ ID NO: 1451495 - RNA, 16 nt, Pseudomonas aeruginosa PA01
aggcgcgcgccgaacu

SEQ ID NO: 1451496 - RNA, 13 nt, Pseudomonas aeruginosa PA01
aggcgcgucgcgg

SEQ ID NO: 1451497 - RNA, 13 nt, Pseudomonas aeruginosa PA01
aggcgcggggcga

SEQ ID NO: 1451498 - RNA, 20 nt, Pseudomonas aeruginosa PA01
aggcgcggggcgaggucggc

SEQ ID NO: 1451499 - RNA, 15 nt, Pseudomonas aeruginosa PA01
aggcgcggguggcgu

SEQ ID NO: 1451500 - RNA, 20 nt, Pseudomonas aeruginosa PA01
aggcgcuccaccagggccuc

SEQ ID NO: 1451501 - RNA, 16 nt, Pseudomonas aeruginosa PA01
aggcgcuccaccgccc

SEQ ID NO: 1451502 - RNA, 17 nt, Pseudomonas aeruginosa PA01
aggcgcuccaccgcccc

SEQ ID NO: 1451503 - RNA, 19 nt, Pseudomonas aeruginosa PA01
aggcgcuccaccgcccccg

SEQ ID NO: 1451504 - RNA, 15 nt, Pseudomonas aeruginosa PA01
aggcgcuccagacuc

SEQ ID NO: 1451505 - RNA, 16 nt, Pseudomonas aeruginosa PA01
aggcgcucaacgccuc

SEQ ID NO: 1451506 - RNA, 16 nt, Pseudomonas aeruginosa PA01
aggcgcgucuccagcu

SEQ ID NO: 1451507 - RNA, 18 nt, Pseudomonas aeruginosa PA01
aggcgcuauccgccguua

SEQ ID NO: 1451508 - RNA, 13 nt, Pseudomonas aeruginosa PA01
aggcgcucggcgg

SEQ ID NO: 1451509 - RNA, 14 nt, Pseudomonas aeruginosa PA01
aggcgcucggcggc

SEQ ID NO: 1451510 - RNA, 15 nt, Pseudomonas aeruginosa PA01
aggcgcucggcggcg

SEQ ID NO: 1451511 - RNA, 16 nt, Pseudomonas aeruginosa PA01
aggcgcucggcggcgc

SEQ ID NO: 1451512 - RNA, 16 nt, Pseudomonas aeruginosa PA01
aggcgcucucgccgcc

SEQ ID NO: 1451513 - RNA, 22 nt, Pseudomonas aeruginosa PA01
aggcgcucucgccgccuucggc

SEQ ID NO: 1451514 - RNA, 13 nt, Pseudomonas aeruginosa PA01
aggcgcucuggaa

SEQ ID NO: 1451515 - RNA, 22 nt, Pseudomonas aeruginosa PA01
aggcgcucuucacuuccagcug

SEQ ID NO: 1451516 - RNA, 20 nt, Pseudomonas aeruginosa PA01
aggcgcuccccugcuaaggg

SEQ ID NO: 1451517 - RNA, 15 nt, Pseudomonas aeruginosa PA01
aggcgcuccgggcuc

SEQ ID NO: 1451518 - RNA, 15 nt, Pseudomonas aeruginosa PA01
aggcgcuccuccagc

SEQ ID NO: 1451519 - RNA, 19 nt, Pseudomonas aeruginosa PA01
aggcgcuccuccagcgccg

SEQ ID NO: 1451520 - RNA, 22 nt, Pseudomonas aeruginosa PA01
aggcgcuccuccagcgccgcca

SEQ ID NO: 1451521 - RNA, 20 nt, Pseudomonas aeruginosa PA01
aggcgcuccuugagcagcuc

SEQ ID NO: 1451522 - RNA, 23 nt, Pseudomonas aeruginosa PA01
aggcgcucgacgaucaggugcag

SEQ ID NO: 1451523 - RNA, 15 nt, Pseudomonas aeruginosa PA01
aggcagaucgcgccg

SEQ ID NO: 1451524 - RNA, 14 nt, Pseudomonas aeruginosa PA01
aggcagaccagcgc

SEQ ID NO: 1451525 - RNA, 17 nt, Pseudomonas aeruginosa PA01
aggcagaccaggccgag

SEQ ID NO: 1451526 - RNA, 18 nt, Pseudomonas aeruginosa PA01
aggcagaccaggccgagc

SEQ ID NO: 1451527 - RNA, 16 nt, Pseudomonas aeruginosa PA01
aggcagcagagcgcca

SEQ ID NO: 1451528 - RNA, 13 nt, Pseudomonas aeruginosa PA01
aggcagccggcca

SEQ ID NO: 1451529 - RNA, 17 nt, Pseudomonas aeruginosa PA01
aggcagcgggccaggcg

SEQ ID NO: 1451530 - RNA, 14 nt, Pseudomonas aeruginosa PA01
aggcagccgucggu

SEQ ID NO: 1451531 - RNA, 19 nt, Pseudomonas aeruginosa PA01
aggcaggucgcugcccucg

SEQ ID NO: 1451532 - RNA, 19 nt, Pseudomonas aeruginosa PA01
aggcaggccgggcuggcca

SEQ ID NO: 1451533 - RNA, 22 nt, Pseudomonas aeruginosa PA01
aggcaggccgggcuggccaccg

SEQ ID NO: 1451534 - RNA, 20 nt, Pseudomonas aeruginosa PA01
aggcaggcgaugaccgcccc

SEQ ID NO: 1451535 - RNA, 15 nt, Pseudomonas aeruginosa PA01
aggcaggcgcggcau

SEQ ID NO: 1451536 - RNA, 14 nt, Pseudomonas aeruginosa PA01
agcuggcgcagccg

SEQ ID NO: 1451537 - RNA, 17 nt, Pseudomonas aeruginosa PA01
agcuggcgacggcucug

SEQ ID NO: 1451538 - RNA, 18 nt, Pseudomonas aeruginosa PA01
agcuggcgaucgaccugc

SEQ ID NO: 1451539 - RNA, 20 nt, Pseudomonas aeruginosa PA01
agcuggcgaucgaccugccg

SEQ ID NO: 1451540 - RNA, 21 nt, Pseudomonas aeruginosa PA01
agcuggcgaucgaccugccgg

SEQ ID NO: 1451541 - RNA, 22 nt, Pseudomonas aeruginosa PA01
agcuggcgauuuccucgcugcg

SEQ ID NO: 1451542 - RNA, 20 nt, Pseudomonas aeruginosa PA01
agcuggcgcaacugcgccag

SEQ ID NO: 1451543 - RNA, 23 nt, Pseudomonas aeruginosa PA01
agcuggcgcaacugcgccagccg

SEQ ID NO: 1451544 - RNA, 17 nt, Pseudomonas aeruginosa PA01
agcuggcgcacacgguc

SEQ ID NO: 1451545 - RNA, 21 nt, Pseudomonas aeruginosa PA01
agcuggcgcacacggucgaga

SEQ ID NO: 1451546 - RNA, 20 nt, Pseudomonas aeruginosa PA01
agcuggccaugcguugcggc

SEQ ID NO: 1451547 - RNA, 22 nt, Pseudomonas aeruginosa PA01
agcuggacgacgcuggccugcc

SEQ ID NO: 1451548 - RNA, 15 nt, Pseudomonas aeruginosa PA01
agcuggaccaccgug

SEQ ID NO: 1451549 - RNA, 18 nt, Pseudomonas aeruginosa PA01
agcuggaccaccguggcg

SEQ ID NO: 1451550 - RNA, 18 nt, Pseudomonas aeruginosa PA01
agcuggccaguugcaccg

SEQ ID NO: 1451551 - RNA, 22 nt, Pseudomonas aeruginosa PA01
agcuggauagaguacucggcua

SEQ ID NO: 1451552 - RNA, 20 nt, Pseudomonas aeruginosa PA01
agcuggagcagcagcgccgc

SEQ ID NO: 1451553 - RNA, 21 nt, Pseudomonas aeruginosa PA01
agcuggagcagcagcgccgcg

SEQ ID NO: 1451554 - RNA, 15 nt, Pseudomonas aeruginosa PA01
aggccacuucccggc

SEQ ID NO: 1451555 - RNA, 13 nt, Pseudomonas aeruginosa PA01
aggccacggcgga

SEQ ID NO: 1451556 - RNA, 14 nt, Pseudomonas aeruginosa PA01
aggccacgccgacg

SEQ ID NO: 1451557 - RNA, 14 nt, Pseudomonas aeruginosa PA01
aggccacgccgccg

SEQ ID NO: 1451558 - RNA, 15 nt, Pseudomonas aeruginosa PA01
aggcaugcccaggcu

SEQ ID NO: 1451559 - RNA, 16 nt, Pseudomonas aeruginosa PA01
aggcaugcccaggcuc

SEQ ID NO: 1451560 - RNA, 14 nt, Pseudomonas aeruginosa PA01
aggcauccagcacc

SEQ ID NO: 1451561 - RNA, 16 nt, Pseudomonas aeruginosa PA01
aggcauccagcaccgc

SEQ ID NO: 1451562 - RNA, 21 nt, Pseudomonas aeruginosa PA01
aggcauauucuucaacagcgu

SEQ ID NO: 1451563 - RNA, 17 nt, Pseudomonas aeruginosa PA01
aggcccggcguccucgc

SEQ ID NO: 1451564 - RNA, 12 nt, Pseudomonas aeruginosa PA01
aggccagcccca

SEQ ID NO: 1451565 - RNA, 22 nt, Pseudomonas aeruginosa PA01
aggcccaucauguagacgaugc

SEQ ID NO: 1451566 - RNA, 20 nt, Pseudomonas aeruginosa PA01
aggccccagggccggcgccc

SEQ ID NO: 1451567 - RNA, 20 nt, Pseudomonas aeruginosa PA01
aggcccaugauggucggcac

SEQ ID NO: 1451568 - RNA, 12 nt, Pseudomonas aeruginosa PA01
aggccagcggca

SEQ ID NO: 1451569 - RNA, 16 nt, Pseudomonas aeruginosa PA01
aggcccaguucgcugc

SEQ ID NO: 1451570 - RNA, 18 nt, Pseudomonas aeruginosa PA01
aggcccaguucgcugccg

SEQ ID NO: 1451571 - RNA, 21 nt, Pseudomonas aeruginosa PA01
aggcccaguucgcugccgccg

SEQ ID NO: 1451572 - RNA, 23 nt, Pseudomonas aeruginosa PA01
aggccagccaacugcuucaggcg

SEQ ID NO: 1451573 - RNA, 16 nt, Pseudomonas aeruginosa PA01
aggccagcaggccgug

SEQ ID NO: 1451574 - RNA, 13 nt, Pseudomonas aeruginosa PA01
aggccagcaggua

SEQ ID NO: 1451575 - RNA, 15 nt, Pseudomonas aeruginosa PA01
aggccagcgccaggu

SEQ ID NO: 1451576 - RNA, 20 nt, Pseudomonas aeruginosa PA01
aggccgcucaccgccacccc

SEQ ID NO: 1451577 - RNA, 23 nt, Pseudomonas aeruginosa PA01
aggccgcggagcaccgcgccuuc

SEQ ID NO: 1451578 - RNA, 16 nt, Pseudomonas aeruginosa PA01
aggccgcugccugucg

SEQ ID NO: 1451579 - RNA, 21 nt, Pseudomonas aeruginosa PA01
aggccgcugccugucgcagcg

SEQ ID NO: 1451580 - RNA, 22 nt, Pseudomonas aeruginosa PA01
aggccgcugccugucgcagcgg

SEQ ID NO: 1451581 - RNA, 15 nt, Pseudomonas aeruginosa PA01
aggccgcuggcggcg

SEQ ID NO: 1451582 - RNA, 16 nt, Pseudomonas aeruginosa PA01
aggccgcuggcggcga

SEQ ID NO: 1451583 - RNA, 17 nt, Pseudomonas aeruginosa PA01
aggccgcuggcggcgac

SEQ ID NO: 1451584 - RNA, 14 nt, Pseudomonas aeruginosa PA01
aggccgcgccggau

SEQ ID NO: 1451585 - RNA, 23 nt, Pseudomonas aeruginosa PA01
aggccgccguagaguucggcugc

SEQ ID NO: 1451586 - RNA, 15 nt, Pseudomonas aeruginosa PA01
aggccgcgcagcaac

SEQ ID NO: 1451587 - RNA, 17 nt, Pseudomonas aeruginosa PA01
aggccgcgcagucccgc

SEQ ID NO: 1451588 - RNA, 13 nt, Pseudomonas aeruginosa PA01
aggccgccggcgg

SEQ ID NO: 1451589 - RNA, 13 nt, Pseudomonas aeruginosa PA01
aggccgccgccug

SEQ ID NO: 1451590 - RNA, 17 nt, Pseudomonas aeruginosa PA01
aggccgacggcgcgcug

SEQ ID NO: 1451591 - RNA, 16 nt, Pseudomonas aeruginosa PA01
aggccgaccucggcgg

SEQ ID NO: 1451592 - RNA, 14 nt, Pseudomonas aeruginosa PA01
aggccgagccggca

SEQ ID NO: 1451593 - RNA, 15 nt, Pseudomonas aeruginosa PA01
aggccgagccggcau

SEQ ID NO: 1451594 - RNA, 20 nt, Pseudomonas aeruginosa PA01
aggccgagcccaccgggaag

SEQ ID NO: 1451595 - RNA, 19 nt, Pseudomonas aeruginosa PA01
aggccgagccgacauccug

SEQ ID NO: 1451596 - RNA, 16 nt, Pseudomonas aeruginosa PA01
aggccgagcagcgcca

SEQ ID NO: 1451597 - RNA, 18 nt, Pseudomonas aeruginosa PA01
aggccgagcagcgccagc

SEQ ID NO: 1451598 - RNA, 17 nt, Pseudomonas aeruginosa PA01
aggccgagaagguucuc

SEQ ID NO: 1451599 - RNA, 23 nt, Pseudomonas aeruginosa PA01
aggccgagaagguucucggccac

SEQ ID NO: 1451600 - RNA, 15 nt, Pseudomonas aeruginosa PA01
aggccgagcgugcgc

SEQ ID NO: 1451601 - RNA, 16 nt, Pseudomonas aeruginosa PA01
aggccgagcgccaggg

SEQ ID NO: 1451602 - RNA, 19 nt, Pseudomonas aeruginosa PA01
aggccgccgcgucgaagcu

SEQ ID NO: 1451603 - RNA, 19 nt, Pseudomonas aeruginosa PA01
aggccgccgcgugccgccg

SEQ ID NO: 1451604 - RNA, 22 nt, Pseudomonas aeruginosa PA01
aggccgccgcgugccgccggac

SEQ ID NO: 1451605 - RNA, 14 nt, Pseudomonas aeruginosa PA01
aggccgaucagcgg

SEQ ID NO: 1451606 - RNA, 11 nt, Pseudomonas aeruginosa PA01
aggccgccgag

SEQ ID NO: 1451607 - RNA, 21 nt, Pseudomonas aeruginosa PA01
aggccgaucagcgccucggcg

SEQ ID NO: 1451608 - RNA, 17 nt, Pseudomonas aeruginosa PA01
aggccgaucaccaccag

SEQ ID NO: 1451609 - RNA, 20 nt, Pseudomonas aeruginosa PA01
aggccgaucaccaccagcgc

SEQ ID NO: 1451610 - RNA, 18 nt, Pseudomonas aeruginosa PA01
aggccgaucaccagcgcc

SEQ ID NO: 1451611 - RNA, 14 nt, Pseudomonas aeruginosa PA01
aggccgagcugcuc

SEQ ID NO: 1451612 - RNA, 20 nt, Pseudomonas aeruginosa PA01
aggccgagcugcucgaagca

SEQ ID NO: 1451613 - RNA, 18 nt, Pseudomonas aeruginosa PA01
aggccgaggaugcucgcc

SEQ ID NO: 1451614 - RNA, 22 nt, Pseudomonas aeruginosa PA01
aggccgaggcgcuucugcucgg

SEQ ID NO: 1451615 - RNA, 22 nt, Pseudomonas aeruginosa PA01
aggccgagguuuccaguugcag

SEQ ID NO: 1451616 - RNA, 16 nt, Pseudomonas aeruginosa PA01
aggccgagggcugccg

SEQ ID NO: 1451617 - RNA, 16 nt, Pseudomonas aeruginosa PA01
aggccgaggucggcgg

SEQ ID NO: 1451618 - RNA, 18 nt, Pseudomonas aeruginosa PA01
aggccgaggucggcggcg

SEQ ID NO: 1451619 - RNA, 18 nt, Pseudomonas aeruginosa PA01
aggccggccuccagcgcc

SEQ ID NO: 1451620 - RNA, 19 nt, Pseudomonas aeruginosa PA01
aggccggccuccagcgccu

SEQ ID NO: 1451621 - RNA, 20 nt, Pseudomonas aeruginosa PA01
aggccggcgaccagcgucgc

SEQ ID NO: 1451622 - RNA, 16 nt, Pseudomonas aeruginosa PA01
aggccggcgccgccga

SEQ ID NO: 1451623 - RNA, 23 nt, Pseudomonas aeruginosa PA01
aggccgggaauggagaugccgaa

SEQ ID NO: 1451624 - RNA, 15 nt, Pseudomonas aeruginosa PA01
aggccgggcccuggg

SEQ ID NO: 1451625 - RNA, 19 nt, Pseudomonas aeruginosa PA01
aggccggagccgcguucag

SEQ ID NO: 1451626 - RNA, 23 nt, Pseudomonas aeruginosa PA01
aggccgcucuucugguaggccag

SEQ ID NO: 1451627 - RNA, 14 nt, Pseudomonas aeruginosa PA01
aggccgcuuccggc

SEQ ID NO: 1451628 - RNA, 21 nt, Pseudomonas aeruginosa PA01
aggccgcuuccggcccggcca

SEQ ID NO: 1451629 - RNA, 23 nt, Pseudomonas aeruginosa PA01
aggccggcaugcagguggcgcuc

SEQ ID NO: 1451630 - RNA, 15 nt, Pseudomonas aeruginosa PA01
aggccggugccgccg

SEQ ID NO: 1451631 - RNA, 18 nt, Pseudomonas aeruginosa PA01
aggccggugccgccggcc

SEQ ID NO: 1451632 - RNA, 13 nt, Pseudomonas aeruginosa PA01
aggccgggcuggc

SEQ ID NO: 1451633 - RNA, 15 nt, Pseudomonas aeruginosa PA01
aggccgggcuggcca

SEQ ID NO: 1451634 - RNA, 16 nt, Pseudomonas aeruginosa PA01
aggccgggcuggccac

SEQ ID NO: 1451635 - RNA, 16 nt, Pseudomonas aeruginosa PA01
aggccgggcaccccga

SEQ ID NO: 1451636 - RNA, 13 nt, Pseudomonas aeruginosa PA01
aggccgucgaggg

SEQ ID NO: 1451637 - RNA, 22 nt, Pseudomonas aeruginosa PA01
aggccgucgagggcaaaggcgc

SEQ ID NO: 1451638 - RNA, 13 nt, Pseudomonas aeruginosa PA01
aggccguaggcga

SEQ ID NO: 1451639 - RNA, 21 nt, Pseudomonas aeruginosa PA01
aggccguaggcgauggccugg

SEQ ID NO: 1451640 - RNA, 19 nt, Pseudomonas aeruginosa PA01
aggccguaccagucgcccg

SEQ ID NO: 1451641 - RNA, 19 nt, Pseudomonas aeruginosa PA01
aggccguagaccaccagca

SEQ ID NO: 1451642 - RNA, 14 nt, Pseudomonas aeruginosa PA01
aggccguagcgcuc

SEQ ID NO: 1451643 - RNA, 22 nt, Pseudomonas aeruginosa PA01
aggcugguggucaccgccagcg

SEQ ID NO: 1451644 - RNA, 16 nt, Pseudomonas aeruginosa PA01
aggcuguagccggcga

SEQ ID NO: 1451645 - RNA, 14 nt, Pseudomonas aeruginosa PA01
aggcuguagcgcuc

SEQ ID NO: 1451646 - RNA, 19 nt, Pseudomonas aeruginosa PA01
aggcugucgcggacccgcg

SEQ ID NO: 1451647 - RNA, 19 nt, Pseudomonas aeruginosa PA01
aggcugggguugcggcgcc

SEQ ID NO: 1451648 - RNA, 17 nt, Pseudomonas aeruginosa PA01
aggcuggguuggcgcga

SEQ ID NO: 1451649 - RNA, 18 nt, Pseudomonas aeruginosa PA01
aggcugugcaucugcgac

SEQ ID NO: 1451650 - RNA, 19 nt, Pseudomonas aeruginosa PA01
aggcugugcaucugcgaca

SEQ ID NO: 1451651 - RNA, 22 nt, Pseudomonas aeruginosa PA01
aggcugucgucgaggguggcgc

SEQ ID NO: 1451652 - RNA, 13 nt, Pseudomonas aeruginosa PA01
aggcugugggcga

SEQ ID NO: 1451653 - RNA, 14 nt, Pseudomonas aeruginosa PA01
aggcugugggcgac

SEQ ID NO: 1451654 - RNA, 22 nt, Pseudomonas aeruginosa PA01
aggcugugggucgggucggcga

SEQ ID NO: 1451655 - RNA, 23 nt, Pseudomonas aeruginosa PA01
aggcugugggucgggucggcgaa

SEQ ID NO: 1451656 - RNA, 19 nt, Pseudomonas aeruginosa PA01
aggcuguugcccugggccg

SEQ ID NO: 1451657 - RNA, 18 nt, Pseudomonas aeruginosa PA01
agggccaggagcaucggc

SEQ ID NO: 1451658 - RNA, 19 nt, Pseudomonas aeruginosa PA01
agggccaggagcaucggcg

SEQ ID NO: 1451659 - RNA, 16 nt, Pseudomonas aeruginosa PA01
agggccaggccgagca

SEQ ID NO: 1451660 - RNA, 16 nt, Pseudomonas aeruginosa PA01
agggccaggccgagcg

SEQ ID NO: 1451661 - RNA, 16 nt, Pseudomonas aeruginosa PA01
agggccagcaacaggc

SEQ ID NO: 1451662 - RNA, 18 nt, Pseudomonas aeruginosa PA01
agggccagggaggcgcug

SEQ ID NO: 1451663 - RNA, 16 nt, Pseudomonas aeruginosa PA01
agggccagggcggcgg

SEQ ID NO: 1451664 - RNA, 15 nt, Pseudomonas aeruginosa PA01
aggcugucagggcgc

SEQ ID NO: 1451665 - RNA, 13 nt, Pseudomonas aeruginosa PA01
agggccagcagcg

SEQ ID NO: 1451666 - RNA, 16 nt, Pseudomonas aeruginosa PA01
agggccagcagcgcug

SEQ ID NO: 1451667 - RNA, 19 nt, Pseudomonas aeruginosa PA01
agggccagcagcggcggcg

SEQ ID NO: 1451668 - RNA, 23 nt, Pseudomonas aeruginosa PA01
agggccagcagcggcggcgccgg

SEQ ID NO: 1451669 - RNA, 20 nt, Pseudomonas aeruginosa PA01
agggccagccagagccaguc

SEQ ID NO: 1451670 - RNA, 17 nt, Pseudomonas aeruginosa PA01
agggccagcgccuggcg

SEQ ID NO: 1451671 - RNA, 16 nt, Pseudomonas aeruginosa PA01
aggcugugcgccaggc

SEQ ID NO: 1451672 - RNA, 18 nt, Pseudomonas aeruginosa PA01
aggcuguuuuuccuguga

SEQ ID NO: 1451673 - RNA, 12 nt, Pseudomonas aeruginosa PA01
agggcgccgccg

SEQ ID NO: 1451674 - RNA, 20 nt, Pseudomonas aeruginosa PA01
agggcgccgccgacgccaug

SEQ ID NO: 1451675 - RNA, 17 nt, Pseudomonas aeruginosa PA01
agggcgcccucgccaau

SEQ ID NO: 1451676 - RNA, 16 nt, Pseudomonas aeruginosa PA01
agggcgccaggugcag

SEQ ID NO: 1451677 - RNA, 17 nt, Pseudomonas aeruginosa PA01
agggcgaugguccccgg

SEQ ID NO: 1451678 - RNA, 20 nt, Pseudomonas aeruginosa PA01
agggcgcauaaccgcuugcg

SEQ ID NO: 1451679 - RNA, 19 nt, Pseudomonas aeruginosa PA01
agggcgcaauugcaccgcu

SEQ ID NO: 1451680 - RNA, 18 nt, Pseudomonas aeruginosa PA01
agggcgauggccagcgcg

SEQ ID NO: 1451681 - RNA, 14 nt, Pseudomonas aeruginosa PA01
agggcgaguucggc

SEQ ID NO: 1451682 - RNA, 15 nt, Pseudomonas aeruginosa PA01
agggcgaguucggcg

SEQ ID NO: 1451683 - RNA, 20 nt, Pseudomonas aeruginosa PA01
agggcgaguucggcgagcag

SEQ ID NO: 1451684 - RNA, 22 nt, Pseudomonas aeruginosa PA01
agggcgaguucggcgagcaggu

SEQ ID NO: 1451685 - RNA, 21 nt, Pseudomonas aeruginosa PA01
agggcgaggagguuggucugc

SEQ ID NO: 1451686 - RNA, 13 nt, Pseudomonas aeruginosa PA01
agggcgaggccgc

SEQ ID NO: 1451687 - RNA, 15 nt, Pseudomonas aeruginosa PA01
agggcgaggucaccu

SEQ ID NO: 1451688 - RNA, 14 nt, Pseudomonas aeruginosa PA01
agggccgagcgcag

SEQ ID NO: 1451689 - RNA, 23 nt, Pseudomonas aeruginosa PA01
agggcccauuccacgugcucgcg

SEQ ID NO: 1451690 - RNA, 15 nt, Pseudomonas aeruginosa PA01
agggccgccgagguc

SEQ ID NO: 1451691 - RNA, 15 nt, Pseudomonas aeruginosa PA01
agggccgcgagaggu

SEQ ID NO: 1451692 - RNA, 16 nt, Pseudomonas aeruginosa PA01
agggccgcgccgagcc

SEQ ID NO: 1451693 - RNA, 16 nt, Pseudomonas aeruginosa PA01
agggcgagcagggcac

SEQ ID NO: 1451694 - RNA, 20 nt, Pseudomonas aeruginosa PA01
agggcgagcagggcacagcc

SEQ ID NO: 1451695 - RNA, 17 nt, Pseudomonas aeruginosa PA01
agggcgagcagggcgcu

SEQ ID NO: 1451696 - RNA, 18 nt, Pseudomonas aeruginosa PA01
agggccgcggcggauaac

SEQ ID NO: 1451697 - RNA, 22 nt, Pseudomonas aeruginosa PA01
agggccgcggcguugucggcca

SEQ ID NO: 1451698 - RNA, 23 nt, Pseudomonas aeruginosa PA01
agggccgcgcugcugccauccgc

SEQ ID NO: 1451699 - RNA, 23 nt, Pseudomonas aeruginosa PA01
agggcgcgcacuuccucggcgac

SEQ ID NO: 1451700 - RNA, 14 nt, Pseudomonas aeruginosa PA01
agggcgcgccccgu

SEQ ID NO: 1451701 - RNA, 15 nt, Pseudomonas aeruginosa PA01
agggcgccgucgggg

SEQ ID NO: 1451702 - RNA, 15 nt, Pseudomonas aeruginosa PA01
agggcgccgggcugc

SEQ ID NO: 1451703 - RNA, 14 nt, Pseudomonas aeruginosa PA01
agggcgucgauguc

SEQ ID NO: 1451704 - RNA, 21 nt, Pseudomonas aeruginosa PA01
agggcgucgcccucggcgcug

SEQ ID NO: 1451705 - RNA, 12 nt, Pseudomonas aeruginosa PA01
agggcgucgccg

SEQ ID NO: 1451706 - RNA, 22 nt, Pseudomonas aeruginosa PA01
agggcgucggcgugcugggucu

SEQ ID NO: 1451707 - RNA, 17 nt, Pseudomonas aeruginosa PA01
agggcguaggcgucgcg

SEQ ID NO: 1451708 - RNA, 18 nt, Pseudomonas aeruginosa PA01
agggcguagugcaucagc

SEQ ID NO: 1451709 - RNA, 20 nt, Pseudomonas aeruginosa PA01
agggcguauaaccgcucgcg

SEQ ID NO: 1451710 - RNA, 20 nt, Pseudomonas aeruginosa PA01
agggcgucaguuccacgcgg

SEQ ID NO: 1451711 - RNA, 20 nt, Pseudomonas aeruginosa PA01
agggcguccaguagcgccug

SEQ ID NO: 1451712 - RNA, 22 nt, Pseudomonas aeruginosa PA01
agggcgucccguuccggcgcag

SEQ ID NO: 1451713 - RNA, 18 nt, Pseudomonas aeruginosa PA01
agggcgucgaaggcggcg

SEQ ID NO: 1451714 - RNA, 20 nt, Pseudomonas aeruginosa PA01
agggcuauguauucggcggu

SEQ ID NO: 1451715 - RNA, 21 nt, Pseudomonas aeruginosa PA01
agggcguuucagaacgucggc

SEQ ID NO: 1451716 - RNA, 14 nt, Pseudomonas aeruginosa PA01
agggcucagcccag

SEQ ID NO: 1451717 - RNA, 18 nt, Pseudomonas aeruginosa PA01
agggcucagcccaggcgc

SEQ ID NO: 1451718 - RNA, 19 nt, Pseudomonas aeruginosa PA01
agggcucagcccaggcgcc

SEQ ID NO: 1451719 - RNA, 15 nt, Pseudomonas aeruginosa PA01
agggcgucgccggga

SEQ ID NO: 1451720 - RNA, 21 nt, Pseudomonas aeruginosa PA01
agggcguucuuggccgcgccg

SEQ ID NO: 1451721 - RNA, 19 nt, Pseudomonas aeruginosa PA01
agggcguggucggcggccu

SEQ ID NO: 1451722 - RNA, 22 nt, Pseudomonas aeruginosa PA01
agggcgugguguagccguugag

SEQ ID NO: 1451723 - RNA, 17 nt, Pseudomonas aeruginosa PA01
agggcugccgcccgguc

SEQ ID NO: 1451724 - RNA, 17 nt, Pseudomonas aeruginosa PA01
agggcugagacgcugcc

SEQ ID NO: 1451725 - RNA, 18 nt, Pseudomonas aeruginosa PA01
agggcuucccaggccagc

SEQ ID NO: 1451726 - RNA, 23 nt, Pseudomonas aeruginosa PA01
agggcuguaaucgccgcuucgcg

SEQ ID NO: 1451727 - RNA, 18 nt, Pseudomonas aeruginosa PA01
agggcugggcagcgccgc

SEQ ID NO: 1451728 - RNA, 23 nt, Pseudomonas aeruginosa PA01
aggggaugccauggcauccccuu

SEQ ID NO: 1451729 - RNA, 14 nt, Pseudomonas aeruginosa PA01
aggggagcacggca

SEQ ID NO: 1451730 - RNA, 14 nt, Pseudomonas aeruginosa PA01
aggggagcgccggc

SEQ ID NO: 1451731 - RNA, 20 nt, Pseudomonas aeruginosa PA01
agggcuugcgcgccaccagc

SEQ ID NO: 1451732 - RNA, 14 nt, Pseudomonas aeruginosa PA01
agggcuucgcggug

SEQ ID NO: 1451733 - RNA, 23 nt, Pseudomonas aeruginosa PA01
aggggaaaccguggucgccgcuc

SEQ ID NO: 1451734 - RNA, 21 nt, Pseudomonas aeruginosa PA01
agggucgggccgcgcucgguc

SEQ ID NO: 1451735 - RNA, 13 nt, Pseudomonas aeruginosa PA01
agggucgccaggg

SEQ ID NO: 1451736 - RNA, 17 nt, Pseudomonas aeruginosa PA01
agggucgcgccguccau

SEQ ID NO: 1451737 - RNA, 19 nt, Pseudomonas aeruginosa PA01
agggucgcguuggcgugcu

SEQ ID NO: 1451738 - RNA, 19 nt, Pseudomonas aeruginosa PA01
agggucgcuuccucggcac

SEQ ID NO: 1451739 - RNA, 15 nt, Pseudomonas aeruginosa PA01
agggucggcccggag

SEQ ID NO: 1451740 - RNA, 14 nt, Pseudomonas aeruginosa PA01
aggggcuagucgcg

SEQ ID NO: 1451741 - RNA, 22 nt, Pseudomonas aeruginosa PA01
aggggcuagucgcgcagcgccu

SEQ ID NO: 1451742 - RNA, 12 nt, Pseudomonas aeruginosa PA01
aggggcgcgccg

SEQ ID NO: 1451743 - RNA, 23 nt, Pseudomonas aeruginosa PA01
aggggcauguccaccgccgccag

SEQ ID NO: 1451744 - RNA, 15 nt, Pseudomonas aeruginosa PA01
aggggcacgcuggcg

SEQ ID NO: 1451745 - RNA, 15 nt, Pseudomonas aeruginosa PA01
aggggaaucgccguc

SEQ ID NO: 1451746 - RNA, 16 nt, Pseudomonas aeruginosa PA01
aggcguauucggcgac

SEQ ID NO: 1451747 - RNA, 23 nt, Pseudomonas aeruginosa PA01
aggcguauucggcgaccagcccg

SEQ ID NO: 1451748 - RNA, 19 nt, Pseudomonas aeruginosa PA01
aggcguagaaacgcgccuc

SEQ ID NO: 1451749 - RNA, 21 nt, Pseudomonas aeruginosa PA01
aggcguagaaacgcgccuccg

SEQ ID NO: 1451750 - RNA, 16 nt, Pseudomonas aeruginosa PA01
aggcgucccauggcgc

SEQ ID NO: 1451751 - RNA, 17 nt, Pseudomonas aeruginosa PA01
aggcgucccauggcgcc

SEQ ID NO: 1451752 - RNA, 20 nt, Pseudomonas aeruginosa PA01
aggcgucccauggcgccacg

SEQ ID NO: 1451753 - RNA, 17 nt, Pseudomonas aeruginosa PA01
aggcguccgcuggccug

SEQ ID NO: 1451754 - RNA, 21 nt, Pseudomonas aeruginosa PA01
aggcgucauagcagcgccgcg

SEQ ID NO: 1451755 - RNA, 14 nt, Pseudomonas aeruginosa PA01
aggcgucauccgcc

SEQ ID NO: 1451756 - RNA, 16 nt, Pseudomonas aeruginosa PA01
aggcguccuggcgagu

SEQ ID NO: 1451757 - RNA, 22 nt, Pseudomonas aeruginosa PA01
aggcguucaugaaagccagcaa

SEQ ID NO: 1451758 - RNA, 19 nt, Pseudomonas aeruginosa PA01
aggcguuccagcucggcga

SEQ ID NO: 1451759 - RNA, 20 nt, Pseudomonas aeruginosa PA01
aggcguuccagcucggcgag

SEQ ID NO: 1451760 - RNA, 22 nt, Pseudomonas aeruginosa PA01
aggcguuccaggugguggcgga

SEQ ID NO: 1451761 - RNA, 16 nt, Pseudomonas aeruginosa PA01
aggcguuccaguucgg

SEQ ID NO: 1451762 - RNA, 13 nt, Pseudomonas aeruginosa PA01
aggcguucgaggg

SEQ ID NO: 1451763 - RNA, 21 nt, Pseudomonas aeruginosa PA01
aggcguucggcgaugucgcgg

SEQ ID NO: 1451764 - RNA, 15 nt, Pseudomonas aeruginosa PA01
aggcguucgucgacc

SEQ ID NO: 1451765 - RNA, 18 nt, Pseudomonas aeruginosa PA01
aggcguucgucgaccugc

SEQ ID NO: 1451766 - RNA, 21 nt, Pseudomonas aeruginosa PA01
aggcguugcagugcgccgcag

SEQ ID NO: 1451767 - RNA, 16 nt, Pseudomonas aeruginosa PA01
aggcucugcuccagca

SEQ ID NO: 1451768 - RNA, 13 nt, Pseudomonas aeruginosa PA01
aggcucucgcgca

SEQ ID NO: 1451769 - RNA, 20 nt, Pseudomonas aeruginosa PA01
aggcucgccggguuguccag

SEQ ID NO: 1451770 - RNA, 20 nt, Pseudomonas aeruginosa PA01
aggcucggccuguaccgcuu

SEQ ID NO: 1451771 - RNA, 16 nt, Pseudomonas aeruginosa PA01
aggcucggucgcgcgg

SEQ ID NO: 1451772 - RNA, 18 nt, Pseudomonas aeruginosa PA01
aggcugaagcggccgccg

SEQ ID NO: 1451773 - RNA, 18 nt, Pseudomonas aeruginosa PA01
aggcucuuggucgcgguc

SEQ ID NO: 1451774 - RNA, 16 nt, Pseudomonas aeruginosa PA01
aggcucuuugcgacug

SEQ ID NO: 1451775 - RNA, 14 nt, Pseudomonas aeruginosa PA01
aggcugacccgguc

SEQ ID NO: 1451776 - RNA, 18 nt, Pseudomonas aeruginosa PA01
aggcugacgucgacgcag

SEQ ID NO: 1451777 - RNA, 21 nt, Pseudomonas aeruginosa PA01
aggcuggcgucgacgccgaag

SEQ ID NO: 1451778 - RNA, 16 nt, Pseudomonas aeruginosa PA01
aggcugaguucgucga

SEQ ID NO: 1451779 - RNA, 13 nt, Pseudomonas aeruginosa PA01
aggcuggcggcca

SEQ ID NO: 1451780 - RNA, 18 nt, Pseudomonas aeruginosa PA01
aggcuccaauucgacgcc

SEQ ID NO: 1451781 - RNA, 19 nt, Pseudomonas aeruginosa PA01
aggcuccaauucgacgccg

SEQ ID NO: 1451782 - RNA, 15 nt, Pseudomonas aeruginosa PA01
aggcucgaggccgag

SEQ ID NO: 1451783 - RNA, 12 nt, Pseudomonas aeruginosa PA01
aggcucgccccg

SEQ ID NO: 1451784 - RNA, 16 nt, Pseudomonas aeruginosa PA01
aggcucgccccggcgg

SEQ ID NO: 1451785 - RNA, 16 nt, Pseudomonas aeruginosa PA01
aggcucgccgccagca

SEQ ID NO: 1451786 - RNA, 17 nt, Pseudomonas aeruginosa PA01
aggcucagcucggcgau

SEQ ID NO: 1451787 - RNA, 13 nt, Pseudomonas aeruginosa PA01
aggcucaggcguu

SEQ ID NO: 1451788 - RNA, 16 nt, Pseudomonas aeruginosa PA01
aggcucagggucucgc

SEQ ID NO: 1451789 - RNA, 17 nt, Pseudomonas aeruginosa PA01
aggcucaguucggccag

SEQ ID NO: 1451790 - RNA, 14 nt, Pseudomonas aeruginosa PA01
aggcggccagccuu

SEQ ID NO: 1451791 - RNA, 24 nt, Pseudomonas aeruginosa PA01
aggcggccaccaccgugaccagca

SEQ ID NO: 1451792 - RNA, 17 nt, Pseudomonas aeruginosa PA01
aggcggauuugccgccg

SEQ ID NO: 1451793 - RNA, 17 nt, Pseudomonas aeruginosa PA01
aggcggcacucggcgac

SEQ ID NO: 1451794 - RNA, 18 nt, Pseudomonas aeruginosa PA01
aggcggcacucggcgacc

SEQ ID NO: 1451795 - RNA, 22 nt, Pseudomonas aeruginosa PA01
aggcggcacucggcgaccaccc

SEQ ID NO: 1451796 - RNA, 13 nt, Pseudomonas aeruginosa PA01
aggcggcagccgc

SEQ ID NO: 1451797 - RNA, 16 nt, Pseudomonas aeruginosa PA01
aggcggccgcuggcga

SEQ ID NO: 1451798 - RNA, 18 nt, Pseudomonas aeruginosa PA01
aggcggccguccucggga

SEQ ID NO: 1451799 - RNA, 18 nt, Pseudomonas aeruginosa PA01
aggcggccgacgauguug

SEQ ID NO: 1451800 - RNA, 21 nt, Pseudomonas aeruginosa PA01
aggcggccgaauccuccagcc

SEQ ID NO: 1451801 - RNA, 21 nt, Pseudomonas aeruginosa PA01
aggcggcgaggugaucgaggg

SEQ ID NO: 1451802 - RNA, 23 nt, Pseudomonas aeruginosa PA01
aggcggcggauaaccgcgagcgg

SEQ ID NO: 1451803 - RNA, 15 nt, Pseudomonas aeruginosa PA01
aggcggcgcggcggg

SEQ ID NO: 1451804 - RNA, 22 nt, Pseudomonas aeruginosa PA01
aggcggcgucgucgcugcgcgg

SEQ ID NO: 1451805 - RNA, 18 nt, Pseudomonas aeruginosa PA01
aggcggcggucaucgcgc

SEQ ID NO: 1451806 - RNA, 14 nt, Pseudomonas aeruginosa PA01
aggcggcuggcgcg

SEQ ID NO: 1451807 - RNA, 14 nt, Pseudomonas aeruginosa PA01
aggcggcuguugcc

SEQ ID NO: 1451808 - RNA, 18 nt, Pseudomonas aeruginosa PA01
aggcgggccagcuggcga

SEQ ID NO: 1451809 - RNA, 19 nt, Pseudomonas aeruginosa PA01
aggcgggccagcuggcgac

SEQ ID NO: 1451810 - RNA, 16 nt, Pseudomonas aeruginosa PA01
aggcggggucagaggg

SEQ ID NO: 1451811 - RNA, 12 nt, Pseudomonas aeruginosa PA01
aggcgggcgcca

SEQ ID NO: 1451812 - RNA, 18 nt, Pseudomonas aeruginosa PA01
aggcgggcgccaucgcuu

SEQ ID NO: 1451813 - RNA, 12 nt, Pseudomonas aeruginosa PA01
aggcgggcggcg

SEQ ID NO: 1451814 - RNA, 13 nt, Pseudomonas aeruginosa PA01
aggcgggcggcgu

SEQ ID NO: 1451815 - RNA, 13 nt, Pseudomonas aeruginosa PA01
aggcgggcgucgg

SEQ ID NO: 1451816 - RNA, 23 nt, Pseudomonas aeruginosa PA01
aggcgggcgucggcgucggcugc

SEQ ID NO: 1451817 - RNA, 16 nt, Pseudomonas aeruginosa PA01
aggcgggcgucgucgg

SEQ ID NO: 1451818 - RNA, 17 nt, Pseudomonas aeruginosa PA01
aggcgggcuccgccgcc

SEQ ID NO: 1451819 - RNA, 15 nt, Pseudomonas aeruginosa PA01
aggcggucgccgaac

SEQ ID NO: 1451820 - RNA, 21 nt, Pseudomonas aeruginosa PA01
aggcggucgccgaacagccgc

SEQ ID NO: 1451821 - RNA, 15 nt, Pseudomonas aeruginosa PA01
aggcggucaugcgcc

SEQ ID NO: 1451822 - RNA, 16 nt, Pseudomonas aeruginosa PA01
aggcgguccagccaga

SEQ ID NO: 1451823 - RNA, 19 nt, Pseudomonas aeruginosa PA01
aggcgguaguaggguucgc

SEQ ID NO: 1451824 - RNA, 22 nt, Pseudomonas aeruginosa PA01
aggcgguaguaggguucgccga

SEQ ID NO: 1451825 - RNA, 23 nt, Pseudomonas aeruginosa PA01
aggcgguaguaggguucgccgac

SEQ ID NO: 1451826 - RNA, 20 nt, Pseudomonas aeruginosa PA01
aggcgguggccacgucgccc

SEQ ID NO: 1451827 - RNA, 13 nt, Pseudomonas aeruginosa PA01
aggcggucgcggg

SEQ ID NO: 1451828 - RNA, 16 nt, Pseudomonas aeruginosa PA01
aggcggugaccagcgg

SEQ ID NO: 1451829 - RNA, 18 nt, Pseudomonas aeruginosa PA01
aggcggugaccagcggca

SEQ ID NO: 1451830 - RNA, 16 nt, Pseudomonas aeruginosa PA01
aggcgguucucgucga

SEQ ID NO: 1451831 - RNA, 20 nt, Pseudomonas aeruginosa PA01
aggcgguguagaccaccagc

SEQ ID NO: 1451832 - RNA, 14 nt, Pseudomonas aeruginosa PA01
aggcggugucgcgg

SEQ ID NO: 1451833 - RNA, 15 nt, Pseudomonas aeruginosa PA01
aggucgacgccgccg

SEQ ID NO: 1451834 - RNA, 19 nt, Pseudomonas aeruginosa PA01
aggucgacgaccuugccca

SEQ ID NO: 1451835 - RNA, 15 nt, Pseudomonas aeruginosa PA01
agguccuugggccag

SEQ ID NO: 1451836 - RNA, 16 nt, Pseudomonas aeruginosa PA01
aggucgaacagcggcu

SEQ ID NO: 1451837 - RNA, 22 nt, Pseudomonas aeruginosa PA01
aggucgaacagcggcuggcccu

SEQ ID NO: 1451838 - RNA, 20 nt, Pseudomonas aeruginosa PA01
aggucgaagaccuguugcag

SEQ ID NO: 1451839 - RNA, 14 nt, Pseudomonas aeruginosa PA01
aggucgaaggcgcg

SEQ ID NO: 1451840 - RNA, 17 nt, Pseudomonas aeruginosa PA01
aggucgaggauguagua

SEQ ID NO: 1451841 - RNA, 19 nt, Pseudomonas aeruginosa PA01
aggucgaggccgcggagca

SEQ ID NO: 1451842 - RNA, 22 nt, Pseudomonas aeruginosa PA01
aggucgaucagcagcagcgcca

SEQ ID NO: 1451843 - RNA, 13 nt, Pseudomonas aeruginosa PA01
aggucgcagcguu

SEQ ID NO: 1451844 - RNA, 20 nt, Pseudomonas aeruginosa PA01
aggucgcagcguuccagcgc

SEQ ID NO: 1451845 - RNA, 15 nt, Pseudomonas aeruginosa PA01
aggucggccggcagc

SEQ ID NO: 1451846 - RNA, 19 nt, Pseudomonas aeruginosa PA01
aggucggccggcagcuccg

SEQ ID NO: 1451847 - RNA, 14 nt, Pseudomonas aeruginosa PA01
aggucggccucggc

SEQ ID NO: 1451848 - RNA, 14 nt, Pseudomonas aeruginosa PA01
aggucggccuggcu

SEQ ID NO: 1451849 - RNA, 24 nt, Pseudomonas aeruginosa PA01
aggucgauccugaccccggccugg

SEQ ID NO: 1451850 - RNA, 13 nt, Pseudomonas aeruginosa PA01
aggucggccgccu

SEQ ID NO: 1451851 - RNA, 11 nt, Pseudomonas aeruginosa PA01
aggugaucgag

SEQ ID NO: 1451852 - RNA, 19 nt, Pseudomonas aeruginosa PA01
aggugagcgacccgcugaa

SEQ ID NO: 1451853 - RNA, 17 nt, Pseudomonas aeruginosa PA01
aggugaagcccaggcgc

SEQ ID NO: 1451854 - RNA, 14 nt, Pseudomonas aeruginosa PA01
aggugaagcugccg

SEQ ID NO: 1451855 - RNA, 16 nt, Pseudomonas aeruginosa PA01
aggugaagcugccguc

SEQ ID NO: 1451856 - RNA, 17 nt, Pseudomonas aeruginosa PA01
aggugaagcugccgucg

SEQ ID NO: 1451857 - RNA, 16 nt, Pseudomonas aeruginosa PA01
aggucggucggcggcg

SEQ ID NO: 1451858 - RNA, 22 nt, Pseudomonas aeruginosa PA01
aggucggucuggcggcccuggu

SEQ ID NO: 1451859 - RNA, 18 nt, Pseudomonas aeruginosa PA01
aggucggcgcaagcgguu

SEQ ID NO: 1451860 - RNA, 22 nt, Pseudomonas aeruginosa PA01
aggucggcgccggugcuggcga

SEQ ID NO: 1451861 - RNA, 12 nt, Pseudomonas aeruginosa PA01
aggucggcgcgc

SEQ ID NO: 1451862 - RNA, 14 nt, Pseudomonas aeruginosa PA01
aggucggcgcgccc

SEQ ID NO: 1451863 - RNA, 20 nt, Pseudomonas aeruginosa PA01
aggucggcgcgcccggcgca

SEQ ID NO: 1451864 - RNA, 21 nt, Pseudomonas aeruginosa PA01
aggucggcgcgcccggcgcag

SEQ ID NO: 1451865 - RNA, 16 nt, Pseudomonas aeruginosa PA01
aggucggcggcacgcu

SEQ ID NO: 1451866 - RNA, 14 nt, Pseudomonas aeruginosa PA01
aggucggcggcagc

SEQ ID NO: 1451867 - RNA, 20 nt, Pseudomonas aeruginosa PA01
aggucggcggcagcugcggc

SEQ ID NO: 1451868 - RNA, 20 nt, Pseudomonas aeruginosa PA01
aggucgggcaacggcugggu

SEQ ID NO: 1451869 - RNA, 18 nt, Pseudomonas aeruginosa PA01
aggugaaaagcgcugacg

SEQ ID NO: 1451870 - RNA, 20 nt, Pseudomonas aeruginosa PA01
aggucaccagguugcccggc

SEQ ID NO: 1451871 - RNA, 15 nt, Pseudomonas aeruginosa PA01
aggucaccgcgccgg

SEQ ID NO: 1451872 - RNA, 19 nt, Pseudomonas aeruginosa PA01
aggucaccgcgccgguaau

SEQ ID NO: 1451873 - RNA, 14 nt, Pseudomonas aeruginosa PA01
aggucacgcccugc

SEQ ID NO: 1451874 - RNA, 16 nt, Pseudomonas aeruginosa PA01
agggugaucagcuccg

SEQ ID NO: 1451875 - RNA, 20 nt, Pseudomonas aeruginosa PA01
agggugaucgacucgauggc

SEQ ID NO: 1451876 - RNA, 19 nt, Pseudomonas aeruginosa PA01
agggucugcuugcgcuggc

SEQ ID NO: 1451877 - RNA, 15 nt, Pseudomonas aeruginosa PA01
agggucuucaggccg

SEQ ID NO: 1451878 - RNA, 16 nt, Pseudomonas aeruginosa PA01
agggucuucaggcgcc

SEQ ID NO: 1451879 - RNA, 17 nt, Pseudomonas aeruginosa PA01
agggucuucaggcgccg

SEQ ID NO: 1451880 - RNA, 16 nt, Pseudomonas aeruginosa PA01
agggucugcucgacga

SEQ ID NO: 1451881 - RNA, 19 nt, Pseudomonas aeruginosa PA01
agggucugcucgacgaucu

SEQ ID NO: 1451882 - RNA, 16 nt, Pseudomonas aeruginosa PA01
agguccgccuggucca

SEQ ID NO: 1451883 - RNA, 20 nt, Pseudomonas aeruginosa PA01
agguccgccugguccagcag

SEQ ID NO: 1451884 - RNA, 20 nt, Pseudomonas aeruginosa PA01
agguccgcgccaugccggcg

SEQ ID NO: 1451885 - RNA, 12 nt, Pseudomonas aeruginosa PA01
agguccaggcga

SEQ ID NO: 1451886 - RNA, 14 nt, Pseudomonas aeruginosa PA01
agguccaggcucag

SEQ ID NO: 1451887 - RNA, 17 nt, Pseudomonas aeruginosa PA01
aggucaguucggugccg

SEQ ID NO: 1451888 - RNA, 15 nt, Pseudomonas aeruginosa PA01
aggucaugcccuggc

SEQ ID NO: 1451889 - RNA, 16 nt, Pseudomonas aeruginosa PA01
aggucaugcccuggcc

SEQ ID NO: 1451890 - RNA, 18 nt, Pseudomonas aeruginosa PA01
aggucaugcccuggccga

SEQ ID NO: 1451891 - RNA, 19 nt, Pseudomonas aeruginosa PA01
agguuggucugcucggcga

SEQ ID NO: 1451892 - RNA, 15 nt, Pseudomonas aeruginosa PA01
agguuggccccgccg

SEQ ID NO: 1451893 - RNA, 18 nt, Pseudomonas aeruginosa PA01
agguuggccuggcccggc

SEQ ID NO: 1451894 - RNA, 19 nt, Pseudomonas aeruginosa PA01
agguuggcgaacaggcagc

SEQ ID NO: 1451895 - RNA, 17 nt, Pseudomonas aeruginosa PA01
agguugcgcuggcgcag

SEQ ID NO: 1451896 - RNA, 14 nt, Pseudomonas aeruginosa PA01
agguugcucgccuu

SEQ ID NO: 1451897 - RNA, 19 nt, Pseudomonas aeruginosa PA01
agguugugcucgaucacca

SEQ ID NO: 1451898 - RNA, 20 nt, Pseudomonas aeruginosa PA01
agguugugguugggcaggcg

SEQ ID NO: 1451899 - RNA, 12 nt, Pseudomonas aeruginosa PA01
agguugccggug

SEQ ID NO: 1451900 - RNA, 21 nt, Pseudomonas aeruginosa PA01
agguugcgcaaccagcgcucg

SEQ ID NO: 1451901 - RNA, 19 nt, Pseudomonas aeruginosa PA01
aggugcggcugggugucga

SEQ ID NO: 1451902 - RNA, 17 nt, Pseudomonas aeruginosa PA01
aggugcgccgagcgcuc

SEQ ID NO: 1451903 - RNA, 21 nt, Pseudomonas aeruginosa PA01
aggugcgccgagcgcucgccg

SEQ ID NO: 1451904 - RNA, 19 nt, Pseudomonas aeruginosa PA01
aggugcgcuggcgccagua

SEQ ID NO: 1451905 - RNA, 13 nt, Pseudomonas aeruginosa PA01
aggugcccagggc

SEQ ID NO: 1451906 - RNA, 14 nt, Pseudomonas aeruginosa PA01
aggugcgcaggcgc

SEQ ID NO: 1451907 - RNA, 13 nt, Pseudomonas aeruginosa PA01
aggugcccggcgg

SEQ ID NO: 1451908 - RNA, 20 nt, Pseudomonas aeruginosa PA01
aggugcccuggcagacgcug

SEQ ID NO: 1451909 - RNA, 24 nt, Pseudomonas aeruginosa PA01
aggugcccuggcagacgcugcucg

SEQ ID NO: 1451910 - RNA, 22 nt, Pseudomonas aeruginosa PA01
aggugccgaggucgucgcugag

SEQ ID NO: 1451911 - RNA, 17 nt, Pseudomonas aeruginosa PA01
aggugcaggaagcgccg

SEQ ID NO: 1451912 - RNA, 20 nt, Pseudomonas aeruginosa PA01
aggugcaggaagcgccgggc

SEQ ID NO: 1451913 - RNA, 17 nt, Pseudomonas aeruginosa PA01
aggugcacggccaggcc

SEQ ID NO: 1451914 - RNA, 12 nt, Pseudomonas aeruginosa PA01
aggugcaccgcg

SEQ ID NO: 1451915 - RNA, 18 nt, Pseudomonas aeruginosa PA01
aggugcaccgcgcuggag

SEQ ID NO: 1451916 - RNA, 14 nt, Pseudomonas aeruginosa PA01
aguacggcgcggug

SEQ ID NO: 1451917 - RNA, 14 nt, Pseudomonas aeruginosa PA01
aguaguggaagccg

SEQ ID NO: 1451918 - RNA, 15 nt, Pseudomonas aeruginosa PA01
aguagagaugcaccg

SEQ ID NO: 1451919 - RNA, 20 nt, Pseudomonas aeruginosa PA01
aguagagaugcaccggccac

SEQ ID NO: 1451920 - RNA, 13 nt, Pseudomonas aeruginosa PA01
aguuccaggucgg

SEQ ID NO: 1451921 - RNA, 16 nt, Pseudomonas aeruginosa PA01
aguuccaggucggcgg

SEQ ID NO: 1451922 - RNA, 16 nt, Pseudomonas aeruginosa PA01
aguuccaugucgcugg

SEQ ID NO: 1451923 - RNA, 18 nt, Pseudomonas aeruginosa PA01
aguuccgcaucggccacc

SEQ ID NO: 1451924 - RNA, 16 nt, Pseudomonas aeruginosa PA01
aguuccgccagaugcg

SEQ ID NO: 1451925 - RNA, 15 nt, Pseudomonas aeruginosa PA01
aguuccucgcgaggg

SEQ ID NO: 1451926 - RNA, 20 nt, Pseudomonas aeruginosa PA01
aguucgaaccguggcggccg

SEQ ID NO: 1451927 - RNA, 12 nt, Pseudomonas aeruginosa PA01
aguuccugcacc

SEQ ID NO: 1451928 - RNA, 19 nt, Pseudomonas aeruginosa PA01
aguucgcugccgccgcgcu

SEQ ID NO: 1451929 - RNA, 14 nt, Pseudomonas aeruginosa PA01
aguucgcggcgcag

SEQ ID NO: 1451930 - RNA, 14 nt, Pseudomonas aeruginosa PA01
aguucggccagcgg

SEQ ID NO: 1451931 - RNA, 19 nt, Pseudomonas aeruginosa PA01
aguucgaccuccaggccga

SEQ ID NO: 1451932 - RNA, 17 nt, Pseudomonas aeruginosa PA01
aguucgaagcgccaggc

SEQ ID NO: 1451933 - RNA, 18 nt, Pseudomonas aeruginosa PA01
aguucgcauaggcggcca

SEQ ID NO: 1451934 - RNA, 20 nt, Pseudomonas aeruginosa PA01
aguucgccaaaaaaagcccc

SEQ ID NO: 1451935 - RNA, 23 nt, Pseudomonas aeruginosa PA01
aguucgccaaaaaaagccccggc

SEQ ID NO: 1451936 - RNA, 13 nt, Pseudomonas aeruginosa PA01
aguucgcccgccc

SEQ ID NO: 1451937 - RNA, 14 nt, Pseudomonas aeruginosa PA01
aguucgccgccgag

SEQ ID NO: 1451938 - RNA, 15 nt, Pseudomonas aeruginosa PA01
aguucgccgcgagca

SEQ ID NO: 1451939 - RNA, 13 nt, Pseudomonas aeruginosa PA01
aguucgccggcca

SEQ ID NO: 1451940 - RNA, 13 nt, Pseudomonas aeruginosa PA01
aguguggcggcgu

SEQ ID NO: 1451941 - RNA, 19 nt, Pseudomonas aeruginosa PA01
aguucaguagcggcagggu

SEQ ID NO: 1451942 - RNA, 17 nt, Pseudomonas aeruginosa PA01
aguucaucgagcaggua

SEQ ID NO: 1451943 - RNA, 17 nt, Pseudomonas aeruginosa PA01
agugguuccaggagggc

SEQ ID NO: 1451944 - RNA, 19 nt, Pseudomonas aeruginosa PA01
agugguuccaggagggcug

SEQ ID NO: 1451945 - RNA, 16 nt, Pseudomonas aeruginosa PA01
aguguccgagccguug

SEQ ID NO: 1451946 - RNA, 17 nt, Pseudomonas aeruginosa PA01
aguugaccagcauguug

SEQ ID NO: 1451947 - RNA, 17 nt, Pseudomonas aeruginosa PA01
aguugacccgccccugc

SEQ ID NO: 1451948 - RNA, 15 nt, Pseudomonas aeruginosa PA01
aguugagucgcgcgc

SEQ ID NO: 1451949 - RNA, 15 nt, Pseudomonas aeruginosa PA01
aguucuucgccgccc

SEQ ID NO: 1451950 - RNA, 17 nt, Pseudomonas aeruginosa PA01
aguucggggucggccug

SEQ ID NO: 1451951 - RNA, 20 nt, Pseudomonas aeruginosa PA01
aguucggugccgccggcgcc

SEQ ID NO: 1451952 - RNA, 17 nt, Pseudomonas aeruginosa PA01
aguucggccaucagcac

SEQ ID NO: 1451953 - RNA, 18 nt, Pseudomonas aeruginosa PA01
aguucggccaucagcacg

SEQ ID NO: 1451954 - RNA, 16 nt, Pseudomonas aeruginosa PA01
aguucggccgcggcug

SEQ ID NO: 1451955 - RNA, 23 nt, Pseudomonas aeruginosa PA01
aguucggcgaugaccagcucggc

SEQ ID NO: 1451956 - RNA, 14 nt, Pseudomonas aeruginosa PA01
aguugcaggccggc

SEQ ID NO: 1451957 - RNA, 15 nt, Pseudomonas aeruginosa PA01
aguugcaggccggcg

SEQ ID NO: 1451958 - RNA, 16 nt, Pseudomonas aeruginosa PA01
aguugcaggccggcga

SEQ ID NO: 1451959 - RNA, 22 nt, Pseudomonas aeruginosa PA01
aguugcagggauuccgggucga

SEQ ID NO: 1451960 - RNA, 18 nt, Pseudomonas aeruginosa PA01
aguugccagacgaucagc

SEQ ID NO: 1451961 - RNA, 20 nt, Pseudomonas aeruginosa PA01
aguugccagacgaucagcgg

SEQ ID NO: 1451962 - RNA, 22 nt, Pseudomonas aeruginosa PA01
aguugccaggauuucuccugcg

SEQ ID NO: 1451963 - RNA, 16 nt, Pseudomonas aeruginosa PA01
aguugcaacagcgcgg

SEQ ID NO: 1451964 - RNA, 14 nt, Pseudomonas aeruginosa PA01
aguugcgggcgcag

SEQ ID NO: 1451965 - RNA, 14 nt, Pseudomonas aeruginosa PA01
aguugcccggccug

SEQ ID NO: 1451966 - RNA, 18 nt, Pseudomonas aeruginosa PA01
aguugccgcagcagcggc

SEQ ID NO: 1451967 - RNA, 18 nt, Pseudomonas aeruginosa PA01
aguugccgccagcgcggc

SEQ ID NO: 1451968 - RNA, 13 nt, Pseudomonas aeruginosa PA01
agugcgccggcau

SEQ ID NO: 1451969 - RNA, 14 nt, Pseudomonas aeruginosa PA01
agugcgcagcagcg

SEQ ID NO: 1451970 - RNA, 21 nt, Pseudomonas aeruginosa PA01
agugcgccauauuucgaaggg

SEQ ID NO: 1451971 - RNA, 16 nt, Pseudomonas aeruginosa PA01
agugcgcccagcagca

SEQ ID NO: 1451972 - RNA, 11 nt, Pseudomonas aeruginosa PA01
agugcgcgguc

SEQ ID NO: 1451973 - RNA, 21 nt, Pseudomonas aeruginosa PA01
agugagccccggcgucggcgc

SEQ ID NO: 1451974 - RNA, 17 nt, Pseudomonas aeruginosa PA01
agugaggccgagccgac

SEQ ID NO: 1451975 - RNA, 19 nt, Pseudomonas aeruginosa PA01
agugaggccgagccgacau

SEQ ID NO: 1451976 - RNA, 12 nt, Pseudomonas aeruginosa PA01
agugcuggcgca

SEQ ID NO: 1451977 - RNA, 22 nt, Pseudomonas aeruginosa PA01
agugcugggcgaccuucagcgg

SEQ ID NO: 1451978 - RNA, 23 nt, Pseudomonas aeruginosa PA01
agugcucgaucagguaggcgccg

SEQ ID NO: 1451979 - RNA, 16 nt, Pseudomonas aeruginosa PA01
agugcucgauggcgaa

SEQ ID NO: 1451980 - RNA, 17 nt, Pseudomonas aeruginosa PA01
agugcggggcgcucgcc

SEQ ID NO: 1451981 - RNA, 18 nt, Pseudomonas aeruginosa PA01
agugcgggcaguccuggc

SEQ ID NO: 1451982 - RNA, 19 nt, Pseudomonas aeruginosa PA01
agugcggcgggcgcccgcc

SEQ ID NO: 1451983 - RNA, 20 nt, Pseudomonas aeruginosa PA01
agugcggcgggcgcccgcca

SEQ ID NO: 1451984 - RNA, 14 nt, Pseudomonas aeruginosa PA01
agucugugaucagg

SEQ ID NO: 1451985 - RNA, 15 nt, Pseudomonas aeruginosa PA01
agugaccgcgcgcca

SEQ ID NO: 1451986 - RNA, 23 nt, Pseudomonas aeruginosa PA01
agugaagagcucccugccgcccu

SEQ ID NO: 1451987 - RNA, 17 nt, Pseudomonas aeruginosa PA01
agucuccagcgaauagc

SEQ ID NO: 1451988 - RNA, 21 nt, Pseudomonas aeruginosa PA01
auaacgccaacggcguuaucc

SEQ ID NO: 1451989 - RNA, 21 nt, Pseudomonas aeruginosa PA01
auaacgccaccggcguuaucc

SEQ ID NO: 1451990 - RNA, 20 nt, Pseudomonas aeruginosa PA01
auaaccgcaagcgguuauuc

SEQ ID NO: 1451991 - RNA, 19 nt, Pseudomonas aeruginosa PA01
auaaccgcucgcgguuauc

SEQ ID NO: 1451992 - RNA, 12 nt, Pseudomonas aeruginosa PA01
auaaccgcugcg

SEQ ID NO: 1451993 - RNA, 20 nt, Pseudomonas aeruginosa PA01
auaaccgcugcgcgguuauc

SEQ ID NO: 1451994 - RNA, 19 nt, Pseudomonas aeruginosa PA01
auaaccgcuugcgguuauc

SEQ ID NO: 1451995 - RNA, 20 nt, Pseudomonas aeruginosa PA01
aguuucuucgcgugggccag

SEQ ID NO: 1451996 - RNA, 17 nt, Pseudomonas aeruginosa PA01
aguuucucggucgccgc

SEQ ID NO: 1451997 - RNA, 16 nt, Pseudomonas aeruginosa PA01
aguuugcccagcgccg

SEQ ID NO: 1451998 - RNA, 17 nt, Pseudomonas aeruginosa PA01
aguuugcccagcgccgc

SEQ ID NO: 1451999 - RNA, 15 nt, Pseudomonas aeruginosa PA01
auaccuccagccagc

SEQ ID NO: 1452000 - RNA, 14 nt, Pseudomonas aeruginosa PA01
auaccgcugcgcgg

SEQ ID NO: 1452001 - RNA, 14 nt, Pseudomonas aeruginosa PA01
auaccgccggcggc

SEQ ID NO: 1452002 - RNA, 12 nt, Pseudomonas aeruginosa PA01
auaccgcgcgcg

SEQ ID NO: 1452003 - RNA, 13 nt, Pseudomonas aeruginosa PA01
auaccgcgcgcgc

SEQ ID NO: 1452004 - RNA, 15 nt, Pseudomonas aeruginosa PA01
auaccgcgcgcgcaa

SEQ ID NO: 1452005 - RNA, 15 nt, Pseudomonas aeruginosa PA01
auacccggcgccccg

SEQ ID NO: 1452006 - RNA, 12 nt, Pseudomonas aeruginosa PA01
auaccgccagcu

SEQ ID NO: 1452007 - RNA, 15 nt, Pseudomonas aeruginosa PA01
auaccgccgccggcc

SEQ ID NO: 1452008 - RNA, 21 nt, Pseudomonas aeruginosa PA01
auacccugggagccgccggac

SEQ ID NO: 1452009 - RNA, 16 nt, Pseudomonas aeruginosa PA01
auacugggcggcgacc

SEQ ID NO: 1452010 - RNA, 23 nt, Pseudomonas aeruginosa PA01
auacuccuucaaccacuccagcg

SEQ ID NO: 1452011 - RNA, 17 nt, Pseudomonas aeruginosa PA01
auacggaugcugacauc

SEQ ID NO: 1452012 - RNA, 20 nt, Pseudomonas aeruginosa PA01
auagccgcaagcggauaucc

SEQ ID NO: 1452013 - RNA, 22 nt, Pseudomonas aeruginosa PA01
auagccggcgaaccaggcggcc

SEQ ID NO: 1452014 - RNA, 23 nt, Pseudomonas aeruginosa PA01
auagccgaacuccgccagcacca

SEQ ID NO: 1452015 - RNA, 15 nt, Pseudomonas aeruginosa PA01
auagccaccgccgac

SEQ ID NO: 1452016 - RNA, 14 nt, Pseudomonas aeruginosa PA01
auagacgccgcuga

SEQ ID NO: 1452017 - RNA, 17 nt, Pseudomonas aeruginosa PA01
auagaguacucggcuac

SEQ ID NO: 1452018 - RNA, 22 nt, Pseudomonas aeruginosa PA01
auagaguugcuuggcgcgcugg

SEQ ID NO: 1452019 - RNA, 16 nt, Pseudomonas aeruginosa PA01
auagaaggucaccgcu

SEQ ID NO: 1452020 - RNA, 19 nt, Pseudomonas aeruginosa PA01
auagaaggucaccgcucgc

SEQ ID NO: 1452021 - RNA, 23 nt, Pseudomonas aeruginosa PA01
auagggcacccgguugaccccgc

SEQ ID NO: 1452022 - RNA, 23 nt, Pseudomonas aeruginosa PA01
auaggcgccagccuacugggcgu

SEQ ID NO: 1452023 - RNA, 17 nt, Pseudomonas aeruginosa PA01
auaggcgccggcgcgcg

SEQ ID NO: 1452024 - RNA, 18 nt, Pseudomonas aeruginosa PA01
auagccggcgaugccgcc

SEQ ID NO: 1452025 - RNA, 19 nt, Pseudomonas aeruginosa PA01
auagccggcgaugccgccc

SEQ ID NO: 1452026 - RNA, 15 nt, Pseudomonas aeruginosa PA01
auagcgagccgcgcu

SEQ ID NO: 1452027 - RNA, 12 nt, Pseudomonas aeruginosa PA01
auagcgccggca

SEQ ID NO: 1452028 - RNA, 14 nt, Pseudomonas aeruginosa PA01
auaugggugaugac

SEQ ID NO: 1452029 - RNA, 13 nt, Pseudomonas aeruginosa PA01
auauggcuggcgc

SEQ ID NO: 1452030 - RNA, 21 nt, Pseudomonas aeruginosa PA01
aucaauugccgguagccggcg

SEQ ID NO: 1452031 - RNA, 22 nt, Pseudomonas aeruginosa PA01
aucaauugccgguagccggcga

SEQ ID NO: 1452032 - RNA, 15 nt, Pseudomonas aeruginosa PA01
aucacaucgcccggc

SEQ ID NO: 1452033 - RNA, 20 nt, Pseudomonas aeruginosa PA01
aucaccaccaccgucuggcg

SEQ ID NO: 1452034 - RNA, 22 nt, Pseudomonas aeruginosa PA01
aucaccaccaccgucuggcgca

SEQ ID NO: 1452035 - RNA, 19 nt, Pseudomonas aeruginosa PA01
aucaccaccagcaucagca

SEQ ID NO: 1452036 - RNA, 18 nt, Pseudomonas aeruginosa PA01
aucaccaccagcgccgcc

SEQ ID NO: 1452037 - RNA, 15 nt, Pseudomonas aeruginosa PA01
aucaccuucaccggc

SEQ ID NO: 1452038 - RNA, 16 nt, Pseudomonas aeruginosa PA01
aucaccuucgccagca

SEQ ID NO: 1452039 - RNA, 13 nt, Pseudomonas aeruginosa PA01
aucaccuggccgg

SEQ ID NO: 1452040 - RNA, 15 nt, Pseudomonas aeruginosa PA01
aucaccuggccggug

SEQ ID NO: 1452041 - RNA, 23 nt, Pseudomonas aeruginosa PA01
aucacggugguaccgugcuucau

SEQ ID NO: 1452042 - RNA, 22 nt, Pseudomonas aeruginosa PA01
aucacgaucggcaccaucaccg

SEQ ID NO: 1452043 - RNA, 23 nt, Pseudomonas aeruginosa PA01
aucacgaucggcaccaucaccga

SEQ ID NO: 1452044 - RNA, 13 nt, Pseudomonas aeruginosa PA01
aucacgucggcgu

SEQ ID NO: 1452045 - RNA, 20 nt, Pseudomonas aeruginosa PA01
aucaccacguaaucgccauu

SEQ ID NO: 1452046 - RNA, 19 nt, Pseudomonas aeruginosa PA01
aucaccagcaauugccggc

SEQ ID NO: 1452047 - RNA, 14 nt, Pseudomonas aeruginosa PA01
aucaccagcgccag

SEQ ID NO: 1452048 - RNA, 23 nt, Pseudomonas aeruginosa PA01
aucaccagcgccgucaccagcag

SEQ ID NO: 1452049 - RNA, 13 nt, Pseudomonas aeruginosa PA01
aucaccaggucgc

SEQ ID NO: 1452050 - RNA, 17 nt, Pseudomonas aeruginosa PA01
aucaccaggcugccgcc

SEQ ID NO: 1452051 - RNA, 16 nt, Pseudomonas aeruginosa PA01
aucacccccagcgagc

SEQ ID NO: 1452052 - RNA, 18 nt, Pseudomonas aeruginosa PA01
aucaccgacagucccagg

SEQ ID NO: 1452053 - RNA, 21 nt, Pseudomonas aeruginosa PA01
aucaccuccuguucgcgcgcc

SEQ ID NO: 1452054 - RNA, 22 nt, Pseudomonas aeruginosa PA01
aucaccucgaaccccuggcgcu

SEQ ID NO: 1452055 - RNA, 18 nt, Pseudomonas aeruginosa PA01
aucagcgcggccacuucg

SEQ ID NO: 1452056 - RNA, 13 nt, Pseudomonas aeruginosa PA01
aucagcgcgguga

SEQ ID NO: 1452057 - RNA, 20 nt, Pseudomonas aeruginosa PA01
aucaggaaggucucgccgcc

SEQ ID NO: 1452058 - RNA, 21 nt, Pseudomonas aeruginosa PA01
aucaggaaggucucgccgccg

SEQ ID NO: 1452059 - RNA, 19 nt, Pseudomonas aeruginosa PA01
aucagcgcggugagcaggg

SEQ ID NO: 1452060 - RNA, 14 nt, Pseudomonas aeruginosa PA01
aucagcgccgccuc

SEQ ID NO: 1452061 - RNA, 12 nt, Pseudomonas aeruginosa PA01
aucagcgccggg

SEQ ID NO: 1452062 - RNA, 18 nt, Pseudomonas aeruginosa PA01
aucagcgagcuucgccgc

SEQ ID NO: 1452063 - RNA, 19 nt, Pseudomonas aeruginosa PA01
aucagcgagcuucgccgcg

SEQ ID NO: 1452064 - RNA, 16 nt, Pseudomonas aeruginosa PA01
aucagcagggucaggg

SEQ ID NO: 1452065 - RNA, 19 nt, Pseudomonas aeruginosa PA01
aucagcaggaagcugacga

SEQ ID NO: 1452066 - RNA, 14 nt, Pseudomonas aeruginosa PA01
aucagcagcgccac

SEQ ID NO: 1452067 - RNA, 20 nt, Pseudomonas aeruginosa PA01
aucagcaccaggaagcccca

SEQ ID NO: 1452068 - RNA, 17 nt, Pseudomonas aeruginosa PA01
aucagcaauuccgcagc

SEQ ID NO: 1452069 - RNA, 13 nt, Pseudomonas aeruginosa PA01
aucagcaccgcca

SEQ ID NO: 1452070 - RNA, 21 nt, Pseudomonas aeruginosa PA01
aucacgucgcgcaccuggcgg

SEQ ID NO: 1452071 - RNA, 14 nt, Pseudomonas aeruginosa PA01
aucacucgccgccg

SEQ ID NO: 1452072 - RNA, 16 nt, Pseudomonas aeruginosa PA01
agccguccugcggccg

SEQ ID NO: 1452073 - RNA, 13 nt, Pseudomonas aeruginosa PA01
agccguccgccca

SEQ ID NO: 1452074 - RNA, 15 nt, Pseudomonas aeruginosa PA01
agccguccgcgggcg

SEQ ID NO: 1452075 - RNA, 19 nt, Pseudomonas aeruginosa PA01
agccguccgggucggucac

SEQ ID NO: 1452076 - RNA, 14 nt, Pseudomonas aeruginosa PA01
agccguagggcgca

SEQ ID NO: 1452077 - RNA, 16 nt, Pseudomonas aeruginosa PA01
agccguagaacgccag

SEQ ID NO: 1452078 - RNA, 23 nt, Pseudomonas aeruginosa PA01
agccgugggcguagagccuggag

SEQ ID NO: 1452079 - RNA, 22 nt, Pseudomonas aeruginosa PA01
agccguggcacccaggccacgc

SEQ ID NO: 1452080 - RNA, 14 nt, Pseudomonas aeruginosa PA01
agccguggcaggcg

SEQ ID NO: 1452081 - RNA, 20 nt, Pseudomonas aeruginosa PA01
agccuggaguugugccagcg

SEQ ID NO: 1452082 - RNA, 21 nt, Pseudomonas aeruginosa PA01
agccuggauacgggcgccagg

SEQ ID NO: 1452083 - RNA, 14 nt, Pseudomonas aeruginosa PA01
agccugcuggccug

SEQ ID NO: 1452084 - RNA, 16 nt, Pseudomonas aeruginosa PA01
agccugcuggccuggg

SEQ ID NO: 1452085 - RNA, 14 nt, Pseudomonas aeruginosa PA01
agccguuccaggcg

SEQ ID NO: 1452086 - RNA, 20 nt, Pseudomonas aeruginosa PA01
agccguucgcuggacaggcg

SEQ ID NO: 1452087 - RNA, 19 nt, Pseudomonas aeruginosa PA01
agccuggggugcagcaggu

SEQ ID NO: 1452088 - RNA, 22 nt, Pseudomonas aeruginosa PA01
agccuggcuggccucagggcgc

SEQ ID NO: 1452089 - RNA, 12 nt, Pseudomonas aeruginosa PA01
agccuggccagc

SEQ ID NO: 1452090 - RNA, 13 nt, Pseudomonas aeruginosa PA01
agccuggccagcg

SEQ ID NO: 1452091 - RNA, 15 nt, Pseudomonas aeruginosa PA01
agccuggccaggcgc

SEQ ID NO: 1452092 - RNA, 16 nt, Pseudomonas aeruginosa PA01
agccuggcgcgcugcg

SEQ ID NO: 1452093 - RNA, 19 nt, Pseudomonas aeruginosa PA01
agccuggcgcgcugcggca

SEQ ID NO: 1452094 - RNA, 21 nt, Pseudomonas aeruginosa PA01
agccuggcgcgcugcggcagg

SEQ ID NO: 1452095 - RNA, 16 nt, Pseudomonas aeruginosa PA01
agccggggccguucag

SEQ ID NO: 1452096 - RNA, 18 nt, Pseudomonas aeruginosa PA01
agccgcucgcguccgcag

SEQ ID NO: 1452097 - RNA, 22 nt, Pseudomonas aeruginosa PA01
agccggugaaacggaucacgau

SEQ ID NO: 1452098 - RNA, 17 nt, Pseudomonas aeruginosa PA01
agccgguacugcgccag

SEQ ID NO: 1452099 - RNA, 13 nt, Pseudomonas aeruginosa PA01
agccggucaggcg

SEQ ID NO: 1452100 - RNA, 16 nt, Pseudomonas aeruginosa PA01
agccggucaggcgccc

SEQ ID NO: 1452101 - RNA, 23 nt, Pseudomonas aeruginosa PA01
agccggucccgggcuccggguug

SEQ ID NO: 1452102 - RNA, 14 nt, Pseudomonas aeruginosa PA01
agccggugccggcg

SEQ ID NO: 1452103 - RNA, 16 nt, Pseudomonas aeruginosa PA01
agccggugccggcggc

SEQ ID NO: 1452104 - RNA, 19 nt, Pseudomonas aeruginosa PA01
agccggugccggcggcgga

SEQ ID NO: 1452105 - RNA, 18 nt, Pseudomonas aeruginosa PA01
agccgguggucuucagca

SEQ ID NO: 1452106 - RNA, 20 nt, Pseudomonas aeruginosa PA01
agccgguggucuucagcaca

SEQ ID NO: 1452107 - RNA, 21 nt, Pseudomonas aeruginosa PA01
agcgaaucugcagggcaucgc

SEQ ID NO: 1452108 - RNA, 16 nt, Pseudomonas aeruginosa PA01
agcgaaugcuugccgg

SEQ ID NO: 1452109 - RNA, 21 nt, Pseudomonas aeruginosa PA01
agcgaaugcuugccggcgccu

SEQ ID NO: 1452110 - RNA, 15 nt, Pseudomonas aeruginosa PA01
agcgacagcauggcc

SEQ ID NO: 1452111 - RNA, 18 nt, Pseudomonas aeruginosa PA01
aaacgccacucgcgacgg

SEQ ID NO: 1452112 - RNA, 18 nt, Pseudomonas aeruginosa PA01
agcgaauacaccgagcgc

SEQ ID NO: 1452113 - RNA, 13 nt, Pseudomonas aeruginosa PA01
aaacgcccggcau

SEQ ID NO: 1452114 - RNA, 13 nt, Pseudomonas aeruginosa PA01
aaacgcucggcgu

SEQ ID NO: 1452115 - RNA, 16 nt, Pseudomonas aeruginosa PA01
aaacgcgcgcucucgc

SEQ ID NO: 1452116 - RNA, 20 nt, Pseudomonas aeruginosa PA01
agcgagcgggcgagggcggc

SEQ ID NO: 1452117 - RNA, 23 nt, Pseudomonas aeruginosa PA01
agcgagcuaucgccucccgccaa

SEQ ID NO: 1452118 - RNA, 15 nt, Pseudomonas aeruginosa PA01
agcgagcgcccgccg

SEQ ID NO: 1452119 - RNA, 13 nt, Pseudomonas aeruginosa PA01
agcgaggcccgcg

SEQ ID NO: 1452120 - RNA, 17 nt, Pseudomonas aeruginosa PA01
agcgaggcccgcgccgc

SEQ ID NO: 1452121 - RNA, 15 nt, Pseudomonas aeruginosa PA01
agcgacguggcaggg

SEQ ID NO: 1452122 - RNA, 19 nt, Pseudomonas aeruginosa PA01
agcgacuccgggaacagcc

SEQ ID NO: 1452123 - RNA, 23 nt, Pseudomonas aeruginosa PA01
agcgacuccgggaacagcccguc

SEQ ID NO: 1452124 - RNA, 17 nt, Pseudomonas aeruginosa PA01
agcgagccgcgcugcug

SEQ ID NO: 1452125 - RNA, 15 nt, Pseudomonas aeruginosa PA01
agcgacucgaugcgc

SEQ ID NO: 1452126 - RNA, 15 nt, Pseudomonas aeruginosa PA01
agcgaguccgacccg

SEQ ID NO: 1452127 - RNA, 16 nt, Pseudomonas aeruginosa PA01
agcgagucgacccagg

SEQ ID NO: 1452128 - RNA, 21 nt, Pseudomonas aeruginosa PA01
agcgcaagucggccugcacca

SEQ ID NO: 1452129 - RNA, 22 nt, Pseudomonas aeruginosa PA01
agcgcaagcggcggcuucagcc

SEQ ID NO: 1452130 - RNA, 13 nt, Pseudomonas aeruginosa PA01
agcgcaccagggu

SEQ ID NO: 1452131 - RNA, 15 nt, Pseudomonas aeruginosa PA01
agcgcaccgccaagg

SEQ ID NO: 1452132 - RNA, 14 nt, Pseudomonas aeruginosa PA01
agcgcaccgcccug

SEQ ID NO: 1452133 - RNA, 21 nt, Pseudomonas aeruginosa PA01
agcgcagccgcucggccgcca

SEQ ID NO: 1452134 - RNA, 16 nt, Pseudomonas aeruginosa PA01
agcgcgcgccaguccc

SEQ ID NO: 1452135 - RNA, 14 nt, Pseudomonas aeruginosa PA01
agcgcgcgccgaca

SEQ ID NO: 1452136 - RNA, 16 nt, Pseudomonas aeruginosa PA01
agcgcgcgccgagcaa

SEQ ID NO: 1452137 - RNA, 19 nt, Pseudomonas aeruginosa PA01
agcgcgccggguugcgccg

SEQ ID NO: 1452138 - RNA, 16 nt, Pseudomonas aeruginosa PA01
agcgcgccuucgacgc

SEQ ID NO: 1452139 - RNA, 20 nt, Pseudomonas aeruginosa PA01
agcgcgcgauaccgacaagc

SEQ ID NO: 1452140 - RNA, 22 nt, Pseudomonas aeruginosa PA01
agcgcgccgcgcaguucgucca

SEQ ID NO: 1452141 - RNA, 14 nt, Pseudomonas aeruginosa PA01
agcgcgccgccgau

SEQ ID NO: 1452142 - RNA, 12 nt, Pseudomonas aeruginosa PA01
agcgcgccgccg

SEQ ID NO: 1452143 - RNA, 13 nt, Pseudomonas aeruginosa PA01
agcgcgccgagcc

SEQ ID NO: 1452144 - RNA, 18 nt, Pseudomonas aeruginosa PA01
agcgcgcccugcaggccg

SEQ ID NO: 1452145 - RNA, 20 nt, Pseudomonas aeruginosa PA01
agcgcgcccggcgccacccc

SEQ ID NO: 1452146 - RNA, 18 nt, Pseudomonas aeruginosa PA01
agcgcgcucuucgccgcg

SEQ ID NO: 1452147 - RNA, 18 nt, Pseudomonas aeruginosa PA01
agcgcgcuguagccggcg

SEQ ID NO: 1452148 - RNA, 23 nt, Pseudomonas aeruginosa PA01
agcgcggagcguccaccagcgcc

SEQ ID NO: 1452149 - RNA, 15 nt, Pseudomonas aeruginosa PA01
agcgcggcagcgcca

SEQ ID NO: 1452150 - RNA, 16 nt, Pseudomonas aeruginosa PA01
agcgcggcagcgccau

SEQ ID NO: 1452151 - RNA, 17 nt, Pseudomonas aeruginosa PA01
agcgcggcagcgccauc

SEQ ID NO: 1452152 - RNA, 15 nt, Pseudomonas aeruginosa PA01
agcgcgccgccgauc

SEQ ID NO: 1452153 - RNA, 14 nt, Pseudomonas aeruginosa PA01
agcgcgcgcuggcg

SEQ ID NO: 1452154 - RNA, 13 nt, Pseudomonas aeruginosa PA01
agcgcgcgcuggu

SEQ ID NO: 1452155 - RNA, 14 nt, Pseudomonas aeruginosa PA01
agcgcgcgcugguc

SEQ ID NO: 1452156 - RNA, 15 nt, Pseudomonas aeruginosa PA01
agcgcgcgcuggucg

SEQ ID NO: 1452157 - RNA, 17 nt, Pseudomonas aeruginosa PA01
agcgcgcggcucggcgg

SEQ ID NO: 1452158 - RNA, 20 nt, Pseudomonas aeruginosa PA01
agcgcgcggcucggcgggcu

SEQ ID NO: 1452159 - RNA, 14 nt, Pseudomonas aeruginosa PA01
agcgcgcggcgagc

SEQ ID NO: 1452160 - RNA, 17 nt, Pseudomonas aeruginosa PA01
agcgcgcguuccagguc

SEQ ID NO: 1452161 - RNA, 21 nt, Pseudomonas aeruginosa PA01
agcgcgcguuccaggucgcug

SEQ ID NO: 1452162 - RNA, 22 nt, Pseudomonas aeruginosa PA01
agcgcgcguagcgugccgccau

SEQ ID NO: 1452163 - RNA, 17 nt, Pseudomonas aeruginosa PA01
agcgcgauaucgcaggc

SEQ ID NO: 1452164 - RNA, 20 nt, Pseudomonas aeruginosa PA01
agcgcgauaucgcaggccag

SEQ ID NO: 1452165 - RNA, 14 nt, Pseudomonas aeruginosa PA01
agcgcgagcggcag

SEQ ID NO: 1452166 - RNA, 20 nt, Pseudomonas aeruginosa PA01
agcgcgagcggcagauccgc

SEQ ID NO: 1452167 - RNA, 23 nt, Pseudomonas aeruginosa PA01
agcgcgagcggcagauccgccgu

SEQ ID NO: 1452168 - RNA, 23 nt, Pseudomonas aeruginosa PA01
agcgcgagcguuccaugaacucu

SEQ ID NO: 1452169 - RNA, 14 nt, Pseudomonas aeruginosa PA01
agcgcgaggcgcag

SEQ ID NO: 1452170 - RNA, 17 nt, Pseudomonas aeruginosa PA01
agcgcgaucagccgcuc

SEQ ID NO: 1452171 - RNA, 20 nt, Pseudomonas aeruginosa PA01
agcgcgaguaguaggucggu

SEQ ID NO: 1452172 - RNA, 21 nt, Pseudomonas aeruginosa PA01
agcgcgaguaguaggucgguu

SEQ ID NO: 1452173 - RNA, 20 nt, Pseudomonas aeruginosa PA01
agcgcgauacccuggccggc

SEQ ID NO: 1452174 - RNA, 22 nt, Pseudomonas aeruginosa PA01
agcgcgauacccuggccggccu

SEQ ID NO: 1452175 - RNA, 14 nt, Pseudomonas aeruginosa PA01
agcgcgcaggcgcu

SEQ ID NO: 1452176 - RNA, 23 nt, Pseudomonas aeruginosa PA01
agcgcgaucucuacuaccgccag

SEQ ID NO: 1452177 - RNA, 21 nt, Pseudomonas aeruginosa PA01
agcgcgccaucggcgguacgc

SEQ ID NO: 1452178 - RNA, 19 nt, Pseudomonas aeruginosa PA01
agcgcgccagcacggcgca

SEQ ID NO: 1452179 - RNA, 20 nt, Pseudomonas aeruginosa PA01
agcgcgccagcacggcgcag

SEQ ID NO: 1452180 - RNA, 17 nt, Pseudomonas aeruginosa PA01
agcgcgaaggcgccuuc

SEQ ID NO: 1452181 - RNA, 17 nt, Pseudomonas aeruginosa PA01
agcgcgacaggcuggcu

SEQ ID NO: 1452182 - RNA, 17 nt, Pseudomonas aeruginosa PA01
agcgcgacaucggcgau

SEQ ID NO: 1452183 - RNA, 19 nt, Pseudomonas aeruginosa PA01
agcgccuugaccucgacgc

SEQ ID NO: 1452184 - RNA, 24 nt, Pseudomonas aeruginosa PA01
agcgccuugaccucgacgccgagc

SEQ ID NO: 1452185 - RNA, 22 nt, Pseudomonas aeruginosa PA01
agcgccuggcgcaguucaucga

SEQ ID NO: 1452186 - RNA, 13 nt, Pseudomonas aeruginosa PA01
agcgccuggcguc

SEQ ID NO: 1452187 - RNA, 15 nt, Pseudomonas aeruginosa PA01
agcgccuggcgucga

SEQ ID NO: 1452188 - RNA, 14 nt, Pseudomonas aeruginosa PA01
agcgccuucaccgu

SEQ ID NO: 1452189 - RNA, 22 nt, Pseudomonas aeruginosa PA01
agcgccuucaccguucccagca

SEQ ID NO: 1452190 - RNA, 21 nt, Pseudomonas aeruginosa PA01
agcgcccggcaaucaggcgcg

SEQ ID NO: 1452191 - RNA, 22 nt, Pseudomonas aeruginosa PA01
agcgcccucgcugagcaggaac

SEQ ID NO: 1452192 - RNA, 18 nt, Pseudomonas aeruginosa PA01
agcgccgaggucuuggcc

SEQ ID NO: 1452193 - RNA, 19 nt, Pseudomonas aeruginosa PA01
agcgccgaggucuuggcca

SEQ ID NO: 1452194 - RNA, 18 nt, Pseudomonas aeruginosa PA01
agcgcccgccgucauggc

SEQ ID NO: 1452195 - RNA, 17 nt, Pseudomonas aeruginosa PA01
agcgccaucagcgacca

SEQ ID NO: 1452196 - RNA, 13 nt, Pseudomonas aeruginosa PA01
agcgcccgcgcau

SEQ ID NO: 1452197 - RNA, 21 nt, Pseudomonas aeruginosa PA01
agcgccagguuggccuggccc

SEQ ID NO: 1452198 - RNA, 22 nt, Pseudomonas aeruginosa PA01
agcgccagguuggccuggcccg

SEQ ID NO: 1452199 - RNA, 22 nt, Pseudomonas aeruginosa PA01
agcgccaguuggacgcggccug

SEQ ID NO: 1452200 - RNA, 19 nt, Pseudomonas aeruginosa PA01
agcgcagggucgcguuggc

SEQ ID NO: 1452201 - RNA, 20 nt, Pseudomonas aeruginosa PA01
agcgccagggguaggaggaa

SEQ ID NO: 1452202 - RNA, 14 nt, Pseudomonas aeruginosa PA01
agcgcagcuccggc

SEQ ID NO: 1452203 - RNA, 15 nt, Pseudomonas aeruginosa PA01
agcgcagcuccggca

SEQ ID NO: 1452204 - RNA, 17 nt, Pseudomonas aeruginosa PA01
agcgcagcuccggcagc

SEQ ID NO: 1452205 - RNA, 14 nt, Pseudomonas aeruginosa PA01
agcgcagcggcagg

SEQ ID NO: 1452206 - RNA, 14 nt, Pseudomonas aeruginosa PA01
agcgcaggaagcug

SEQ ID NO: 1452207 - RNA, 17 nt, Pseudomonas aeruginosa PA01
agcgcaggaagcugcgc

SEQ ID NO: 1452208 - RNA, 12 nt, Pseudomonas aeruginosa PA01
agcgcaggccgc

SEQ ID NO: 1452209 - RNA, 19 nt, Pseudomonas aeruginosa PA01
agcgcaggccgccggcggc

SEQ ID NO: 1452210 - RNA, 13 nt, Pseudomonas aeruginosa PA01
agcgccaggccgc

SEQ ID NO: 1452211 - RNA, 22 nt, Pseudomonas aeruginosa PA01
agcgccaggccgaucagcgccu

SEQ ID NO: 1452212 - RNA, 17 nt, Pseudomonas aeruginosa PA01
agcgccaggccgccgaa

SEQ ID NO: 1452213 - RNA, 16 nt, Pseudomonas aeruginosa PA01
agcgccaggcgcgguu

SEQ ID NO: 1452214 - RNA, 13 nt, Pseudomonas aeruginosa PA01
agcgccagcgaga

SEQ ID NO: 1452215 - RNA, 16 nt, Pseudomonas aeruginosa PA01
agcgcaggugcaccgc

SEQ ID NO: 1452216 - RNA, 15 nt, Pseudomonas aeruginosa PA01
agcgcaggcggcugg

SEQ ID NO: 1452217 - RNA, 20 nt, Pseudomonas aeruginosa PA01
agcgcaggcggcuggcgcga

SEQ ID NO: 1452218 - RNA, 13 nt, Pseudomonas aeruginosa PA01
agcgccaggagca

SEQ ID NO: 1452219 - RNA, 20 nt, Pseudomonas aeruginosa PA01
agcgccguucacgccuggcg

SEQ ID NO: 1452220 - RNA, 20 nt, Pseudomonas aeruginosa PA01
agcgccuccagcgucugccg

SEQ ID NO: 1452221 - RNA, 20 nt, Pseudomonas aeruginosa PA01
agcgccgccgguaucccggc

SEQ ID NO: 1452222 - RNA, 20 nt, Pseudomonas aeruginosa PA01
agcgccgcccuguucgucug

SEQ ID NO: 1452223 - RNA, 16 nt, Pseudomonas aeruginosa PA01
agcgccgccucgaagg

SEQ ID NO: 1452224 - RNA, 14 nt, Pseudomonas aeruginosa PA01
agcgccgccucgcu

SEQ ID NO: 1452225 - RNA, 19 nt, Pseudomonas aeruginosa PA01
agcgccgccucgcugggcg

SEQ ID NO: 1452226 - RNA, 18 nt, Pseudomonas aeruginosa PA01
agcgccgccugcuggcug

SEQ ID NO: 1452227 - RNA, 16 nt, Pseudomonas aeruginosa PA01
agcgccgccuugagcg

SEQ ID NO: 1452228 - RNA, 13 nt, Pseudomonas aeruginosa PA01
agcgccgccaccg

SEQ ID NO: 1452229 - RNA, 23 nt, Pseudomonas aeruginosa PA01
agcgccgccaaccacuccgccac

SEQ ID NO: 1452230 - RNA, 21 nt, Pseudomonas aeruginosa PA01
agcgccgcaguuguuccucgc

SEQ ID NO: 1452231 - RNA, 12 nt, Pseudomonas aeruginosa PA01
agcgccgccacc

SEQ ID NO: 1452232 - RNA, 13 nt, Pseudomonas aeruginosa PA01
agcgccgccagca

SEQ ID NO: 1452233 - RNA, 16 nt, Pseudomonas aeruginosa PA01
agcgccgccagcaggu

SEQ ID NO: 1452234 - RNA, 14 nt, Pseudomonas aeruginosa PA01
agcgccgccaggca

SEQ ID NO: 1452235 - RNA, 14 nt, Pseudomonas aeruginosa PA01
agcgccgccaggcg

SEQ ID NO: 1452236 - RNA, 16 nt, Pseudomonas aeruginosa PA01
agcgccgccaggcgcg

SEQ ID NO: 1452237 - RNA, 20 nt, Pseudomonas aeruginosa PA01
agcgccgccaguucgcgcag

SEQ ID NO: 1452238 - RNA, 22 nt, Pseudomonas aeruginosa PA01
agcgccgccaguucgcgcaggu

SEQ ID NO: 1452239 - RNA, 13 nt, Pseudomonas aeruginosa PA01
agcgccucggcgc

SEQ ID NO: 1452240 - RNA, 15 nt, Pseudomonas aeruginosa PA01
agcgccucggcgcag

SEQ ID NO: 1452241 - RNA, 18 nt, Pseudomonas aeruginosa PA01
agcgccucggcgcaguag

SEQ ID NO: 1452242 - RNA, 23 nt, Pseudomonas aeruginosa PA01
agcgccuccucuaccaggcgguu

SEQ ID NO: 1452243 - RNA, 16 nt, Pseudomonas aeruginosa PA01
agcgccucgaaggccu

SEQ ID NO: 1452244 - RNA, 14 nt, Pseudomonas aeruginosa PA01
agcgccucgaccag

SEQ ID NO: 1452245 - RNA, 14 nt, Pseudomonas aeruginosa PA01
agcgccucgaucgc

SEQ ID NO: 1452246 - RNA, 23 nt, Pseudomonas aeruginosa PA01
agcgccucgaucgccucgggcga

SEQ ID NO: 1452247 - RNA, 16 nt, Pseudomonas aeruginosa PA01
agcgccucgccgagca

SEQ ID NO: 1452248 - RNA, 13 nt, Pseudomonas aeruginosa PA01
agcgccucggcau

SEQ ID NO: 1452249 - RNA, 20 nt, Pseudomonas aeruginosa PA01
agcgccucggcaucgaccag

SEQ ID NO: 1452250 - RNA, 15 nt, Pseudomonas aeruginosa PA01
agcgccugcugcgcg

SEQ ID NO: 1452251 - RNA, 15 nt, Pseudomonas aeruginosa PA01
agcgccuggucggcg

SEQ ID NO: 1452252 - RNA, 16 nt, Pseudomonas aeruginosa PA01
agcgccuggucggcgg

SEQ ID NO: 1452253 - RNA, 19 nt, Pseudomonas aeruginosa PA01
agcgccugguucugcuccg

SEQ ID NO: 1452254 - RNA, 23 nt, Pseudomonas aeruginosa PA01
agcgccuguaccccguagcgcuc

SEQ ID NO: 1452255 - RNA, 20 nt, Pseudomonas aeruginosa PA01
agcgcguagaccaccucgac

SEQ ID NO: 1452256 - RNA, 14 nt, Pseudomonas aeruginosa PA01
agcgcggugcgcgc

SEQ ID NO: 1452257 - RNA, 16 nt, Pseudomonas aeruginosa PA01
agcgcggugcgcgcca

SEQ ID NO: 1452258 - RNA, 20 nt, Pseudomonas aeruginosa PA01
agcgcggugagcagggugac

SEQ ID NO: 1452259 - RNA, 18 nt, Pseudomonas aeruginosa PA01
agcgcuagcgcauggcga

SEQ ID NO: 1452260 - RNA, 16 nt, Pseudomonas aeruginosa PA01
agcgcucccagaccuc

SEQ ID NO: 1452261 - RNA, 13 nt, Pseudomonas aeruginosa PA01
agcgcuccagcuc

SEQ ID NO: 1452262 - RNA, 15 nt, Pseudomonas aeruginosa PA01
agcgcuccagcuccu

SEQ ID NO: 1452263 - RNA, 14 nt, Pseudomonas aeruginosa PA01
agcgcuccaccgcg

SEQ ID NO: 1452264 - RNA, 22 nt, Pseudomonas aeruginosa PA01
agcgcggccgccgccgacaggu

SEQ ID NO: 1452265 - RNA, 13 nt, Pseudomonas aeruginosa PA01
agcgcggccggcc

SEQ ID NO: 1452266 - RNA, 14 nt, Pseudomonas aeruginosa PA01
agcgcggccggcca

SEQ ID NO: 1452267 - RNA, 19 nt, Pseudomonas aeruginosa PA01
agcgcggccuucagcggug

SEQ ID NO: 1452268 - RNA, 15 nt, Pseudomonas aeruginosa PA01
agcgcuucugcaggc

SEQ ID NO: 1452269 - RNA, 14 nt, Pseudomonas aeruginosa PA01
agcgcuugcauggc

SEQ ID NO: 1452270 - RNA, 16 nt, Pseudomonas aeruginosa PA01
agcgcuucccgcggcu

SEQ ID NO: 1452271 - RNA, 21 nt, Pseudomonas aeruginosa PA01
agcgcuucccgcggcuccagc

SEQ ID NO: 1452272 - RNA, 15 nt, Pseudomonas aeruginosa PA01
agcgcuuccuugccc

SEQ ID NO: 1452273 - RNA, 19 nt, Pseudomonas aeruginosa PA01
agcgcuucauccugcgcgc

SEQ ID NO: 1452274 - RNA, 12 nt, Pseudomonas aeruginosa PA01
agcgcuucgcga

SEQ ID NO: 1452275 - RNA, 14 nt, Pseudomonas aeruginosa PA01
agcgcuucgcgcag

SEQ ID NO: 1452276 - RNA, 19 nt, Pseudomonas aeruginosa PA01
agcgcugguugacgaacag

SEQ ID NO: 1452277 - RNA, 17 nt, Pseudomonas aeruginosa PA01
agcgcuccuucuccggg

SEQ ID NO: 1452278 - RNA, 19 nt, Pseudomonas aeruginosa PA01
agcgcuccuugcgccaggc

SEQ ID NO: 1452279 - RNA, 19 nt, Pseudomonas aeruginosa PA01
agcgcuccucgcgcugccc

SEQ ID NO: 1452280 - RNA, 21 nt, Pseudomonas aeruginosa PA01
agcgcuccucgcgcugcccgg

SEQ ID NO: 1452281 - RNA, 23 nt, Pseudomonas aeruginosa PA01
agcgcuccucgcgcugcccggcg

SEQ ID NO: 1452282 - RNA, 22 nt, Pseudomonas aeruginosa PA01
agcggcaccucgauggcggcgg

SEQ ID NO: 1452283 - RNA, 18 nt, Pseudomonas aeruginosa PA01
agcggcacgcucuggccg

SEQ ID NO: 1452284 - RNA, 19 nt, Pseudomonas aeruginosa PA01
agcggcagccacucggcca

SEQ ID NO: 1452285 - RNA, 19 nt, Pseudomonas aeruginosa PA01
agcggaucucgucgccgac

SEQ ID NO: 1452286 - RNA, 20 nt, Pseudomonas aeruginosa PA01
agcggaucucgucgccgacc

SEQ ID NO: 1452287 - RNA, 16 nt, Pseudomonas aeruginosa PA01
agcggaucgucgcggc

SEQ ID NO: 1452288 - RNA, 20 nt, Pseudomonas aeruginosa PA01
agcggaucgucgcggcgcga

SEQ ID NO: 1452289 - RNA, 17 nt, Pseudomonas aeruginosa PA01
agcggagcgucgggcgg

SEQ ID NO: 1452290 - RNA, 19 nt, Pseudomonas aeruginosa PA01
agcggaggauucagcagga

SEQ ID NO: 1452291 - RNA, 13 nt, Pseudomonas aeruginosa PA01
agcggaucagccg

SEQ ID NO: 1452292 - RNA, 15 nt, Pseudomonas aeruginosa PA01
agcggaucagccggc

SEQ ID NO: 1452293 - RNA, 13 nt, Pseudomonas aeruginosa PA01
agcggaucaggcc

SEQ ID NO: 1452294 - RNA, 15 nt, Pseudomonas aeruginosa PA01
agcggaucaggccca

SEQ ID NO: 1452295 - RNA, 22 nt, Pseudomonas aeruginosa PA01
agcggguuggcuuccagccagc

SEQ ID NO: 1452296 - RNA, 15 nt, Pseudomonas aeruginosa PA01
agcgguaccagcagc

SEQ ID NO: 1452297 - RNA, 19 nt, Pseudomonas aeruginosa PA01
agcgguaccagcagcgccg

SEQ ID NO: 1452298 - RNA, 16 nt, Pseudomonas aeruginosa PA01
agcgguacccgccggc

SEQ ID NO: 1452299 - RNA, 19 nt, Pseudomonas aeruginosa PA01
agcgguaccgggccaggca

SEQ ID NO: 1452300 - RNA, 14 nt, Pseudomonas aeruginosa PA01
agcgguaugccgca

SEQ ID NO: 1452301 - RNA, 23 nt, Pseudomonas aeruginosa PA01
agcgguaugccgcaggcaguggc

SEQ ID NO: 1452302 - RNA, 15 nt, Pseudomonas aeruginosa PA01
agcgguagugggcga

SEQ ID NO: 1452303 - RNA, 23 nt, Pseudomonas aeruginosa PA01
agcgguagugggcgaggcgcucg

SEQ ID NO: 1452304 - RNA, 17 nt, Pseudomonas aeruginosa PA01
agcgggucggcgaagua

SEQ ID NO: 1452305 - RNA, 19 nt, Pseudomonas aeruginosa PA01
agcgggucgaucaggcgca

SEQ ID NO: 1452306 - RNA, 21 nt, Pseudomonas aeruginosa PA01
agcgggucgaucaggcgcaug

SEQ ID NO: 1452307 - RNA, 14 nt, Pseudomonas aeruginosa PA01
agcgggguggcgcg

SEQ ID NO: 1452308 - RNA, 20 nt, Pseudomonas aeruginosa PA01
agcggguaguagaucagcuu

SEQ ID NO: 1452309 - RNA, 20 nt, Pseudomonas aeruginosa PA01
agcggguauugcagacgcug

SEQ ID NO: 1452310 - RNA, 23 nt, Pseudomonas aeruginosa PA01
agcggguauugcagacgcugccg

SEQ ID NO: 1452311 - RNA, 18 nt, Pseudomonas aeruginosa PA01
agcggcuggcccucggcg

SEQ ID NO: 1452312 - RNA, 15 nt, Pseudomonas aeruginosa PA01
agcggcuggccgucg

SEQ ID NO: 1452313 - RNA, 23 nt, Pseudomonas aeruginosa PA01
agcggggcuuuuuuaugcgacug

SEQ ID NO: 1452314 - RNA, 17 nt, Pseudomonas aeruginosa PA01
agcggcuuguccuggcg

SEQ ID NO: 1452315 - RNA, 12 nt, Pseudomonas aeruginosa PA01
agcggcaugguc

SEQ ID NO: 1452316 - RNA, 18 nt, Pseudomonas aeruginosa PA01
agcggcauucgaacggcu

SEQ ID NO: 1452317 - RNA, 14 nt, Pseudomonas aeruginosa PA01
agcggccacggcgg

SEQ ID NO: 1452318 - RNA, 18 nt, Pseudomonas aeruginosa PA01
agcggcaugcccugccgg

SEQ ID NO: 1452319 - RNA, 21 nt, Pseudomonas aeruginosa PA01
agcggcgccagcuccagcgcc

SEQ ID NO: 1452320 - RNA, 18 nt, Pseudomonas aeruginosa PA01
agcggcagcggcucguca

SEQ ID NO: 1452321 - RNA, 17 nt, Pseudomonas aeruginosa PA01
agcggcagcgguucgcc

SEQ ID NO: 1452322 - RNA, 16 nt, Pseudomonas aeruginosa PA01
agcggcagcgccaggu

SEQ ID NO: 1452323 - RNA, 17 nt, Pseudomonas aeruginosa PA01
agcggcagcgccaggua

SEQ ID NO: 1452324 - RNA, 14 nt, Pseudomonas aeruginosa PA01
agcggcagcgccag

SEQ ID NO: 1452325 - RNA, 18 nt, Pseudomonas aeruginosa PA01
agcggcagcgucucggcu

SEQ ID NO: 1452326 - RNA, 22 nt, Pseudomonas aeruginosa PA01
agcggcagcgucucggcugccg

SEQ ID NO: 1452327 - RNA, 14 nt, Pseudomonas aeruginosa PA01
agcggcagcucggc

SEQ ID NO: 1452328 - RNA, 16 nt, Pseudomonas aeruginosa PA01
agcggcagcucggcga

SEQ ID NO: 1452329 - RNA, 17 nt, Pseudomonas aeruginosa PA01
agcggcagcucggcgac

SEQ ID NO: 1452330 - RNA, 17 nt, Pseudomonas aeruginosa PA01
agcggcaggccgccgau

SEQ ID NO: 1452331 - RNA, 18 nt, Pseudomonas aeruginosa PA01
agcggcaggccgccgauc

SEQ ID NO: 1452332 - RNA, 19 nt, Pseudomonas aeruginosa PA01
agcggcaggcacgcugcca

SEQ ID NO: 1452333 - RNA, 19 nt, Pseudomonas aeruginosa PA01
agcggcaggccacggccgc

SEQ ID NO: 1452334 - RNA, 14 nt, Pseudomonas aeruginosa PA01
agcggcagggcggc

SEQ ID NO: 1452335 - RNA, 16 nt, Pseudomonas aeruginosa PA01
agcggcagggcggcga

SEQ ID NO: 1452336 - RNA, 14 nt, Pseudomonas aeruginosa PA01
agcggcgcgaggcc

SEQ ID NO: 1452337 - RNA, 15 nt, Pseudomonas aeruginosa PA01
agcggcgcccuggcu

SEQ ID NO: 1452338 - RNA, 13 nt, Pseudomonas aeruginosa PA01
agcggcgcgaagu

SEQ ID NO: 1452339 - RNA, 14 nt, Pseudomonas aeruginosa PA01
agcggcgcgaaguc

SEQ ID NO: 1452340 - RNA, 18 nt, Pseudomonas aeruginosa PA01
agcggcggauacaggcgc

SEQ ID NO: 1452341 - RNA, 20 nt, Pseudomonas aeruginosa PA01
agcggcggauacaggcgcag

SEQ ID NO: 1452342 - RNA, 22 nt, Pseudomonas aeruginosa PA01
agcggcggauacaggcgcagca

SEQ ID NO: 1452343 - RNA, 15 nt, Pseudomonas aeruginosa PA01
agcggcgcgucgacc

SEQ ID NO: 1452344 - RNA, 13 nt, Pseudomonas aeruginosa PA01
agcggcucggcca

SEQ ID NO: 1452345 - RNA, 15 nt, Pseudomonas aeruginosa PA01
agcggcucggccagg

SEQ ID NO: 1452346 - RNA, 13 nt, Pseudomonas aeruginosa PA01
agcggcucgccga

SEQ ID NO: 1452347 - RNA, 11 nt, Pseudomonas aeruginosa PA01
agcggcugcug

SEQ ID NO: 1452348 - RNA, 22 nt, Pseudomonas aeruginosa PA01
agcguggcgcgcaucggugccg

SEQ ID NO: 1452349 - RNA, 16 nt, Pseudomonas aeruginosa PA01
agcgugggcggccggc

SEQ ID NO: 1452350 - RNA, 20 nt, Pseudomonas aeruginosa PA01
agcgugggcggccggccagg

SEQ ID NO: 1452351 - RNA, 23 nt, Pseudomonas aeruginosa PA01
agcgugggcggccggccaggucg

SEQ ID NO: 1452352 - RNA, 16 nt, Pseudomonas aeruginosa PA01
agcguucggcgcuggc

SEQ ID NO: 1452353 - RNA, 20 nt, Pseudomonas aeruginosa PA01
agcguucggcgcuggcgcgg

SEQ ID NO: 1452354 - RNA, 13 nt, Pseudomonas aeruginosa PA01
agcguugcagcgu

SEQ ID NO: 1452355 - RNA, 15 nt, Pseudomonas aeruginosa PA01
agcguugcaggucga

SEQ ID NO: 1452356 - RNA, 16 nt, Pseudomonas aeruginosa PA01
agcguugcgggcaggu

SEQ ID NO: 1452357 - RNA, 22 nt, Pseudomonas aeruginosa PA01
agcguugcgcgagcaccgcgca

SEQ ID NO: 1452358 - RNA, 21 nt, Pseudomonas aeruginosa PA01
agcguugggccucgcugcgca

SEQ ID NO: 1452359 - RNA, 17 nt, Pseudomonas aeruginosa PA01
agcguuguccucggcgg

SEQ ID NO: 1452360 - RNA, 19 nt, Pseudomonas aeruginosa PA01
agcguuguccucggcggcu

SEQ ID NO: 1452361 - RNA, 23 nt, Pseudomonas aeruginosa PA01
agcguggccagcgaacccaggcc

SEQ ID NO: 1452362 - RNA, 16 nt, Pseudomonas aeruginosa PA01
agcguggccagcgccc

SEQ ID NO: 1452363 - RNA, 15 nt, Pseudomonas aeruginosa PA01
agcguuccuggaagc

SEQ ID NO: 1452364 - RNA, 13 nt, Pseudomonas aeruginosa PA01
agcguuccuggcg

SEQ ID NO: 1452365 - RNA, 15 nt, Pseudomonas aeruginosa PA01
agcguuccuggcgcg

SEQ ID NO: 1452366 - RNA, 19 nt, Pseudomonas aeruginosa PA01
agcguuccuggcgcgcggc

SEQ ID NO: 1452367 - RNA, 18 nt, Pseudomonas aeruginosa PA01
agcgugcgcaugcccgcg

SEQ ID NO: 1452368 - RNA, 19 nt, Pseudomonas aeruginosa PA01
agcgugcagaccaggguac

SEQ ID NO: 1452369 - RNA, 21 nt, Pseudomonas aeruginosa PA01
agcgucugccgcuggcggccu

SEQ ID NO: 1452370 - RNA, 20 nt, Pseudomonas aeruginosa PA01
agcgucgccaacgcgccguc

SEQ ID NO: 1452371 - RNA, 21 nt, Pseudomonas aeruginosa PA01
agcgucgccaacgcgccgucg

SEQ ID NO: 1452372 - RNA, 16 nt, Pseudomonas aeruginosa PA01
agcgucucggcugccg

SEQ ID NO: 1452373 - RNA, 16 nt, Pseudomonas aeruginosa PA01
agcgucgacgccgagc

SEQ ID NO: 1452374 - RNA, 17 nt, Pseudomonas aeruginosa PA01
agcgucgacgccgagcu

SEQ ID NO: 1452375 - RNA, 18 nt, Pseudomonas aeruginosa PA01
agcgucgaugaucccgau

SEQ ID NO: 1452376 - RNA, 18 nt, Pseudomonas aeruginosa PA01
agcgucgagcuggcgcag

SEQ ID NO: 1452377 - RNA, 15 nt, Pseudomonas aeruginosa PA01
agcgucgagucgcgc

SEQ ID NO: 1452378 - RNA, 17 nt, Pseudomonas aeruginosa PA01
agcgucgagucgcgcag

SEQ ID NO: 1452379 - RNA, 18 nt, Pseudomonas aeruginosa PA01
agcguccgaacgcgcuga

SEQ ID NO: 1452380 - RNA, 15 nt, Pseudomonas aeruginosa PA01
agcguccggcagggc

SEQ ID NO: 1452381 - RNA, 21 nt, Pseudomonas aeruginosa PA01
agcguccgagguggcugaagc

SEQ ID NO: 1452382 - RNA, 12 nt, Pseudomonas aeruginosa PA01
agcguccgccgc

SEQ ID NO: 1452383 - RNA, 20 nt, Pseudomonas aeruginosa PA01
agcgguccucgggcaccagc

SEQ ID NO: 1452384 - RNA, 18 nt, Pseudomonas aeruginosa PA01
agcggucgugcagcagcg

SEQ ID NO: 1452385 - RNA, 21 nt, Pseudomonas aeruginosa PA01
agcggucgugcagcagcgccu

SEQ ID NO: 1452386 - RNA, 14 nt, Pseudomonas aeruginosa PA01
agcucggcacgcag

SEQ ID NO: 1452387 - RNA, 19 nt, Pseudomonas aeruginosa PA01
agcucggugagcaggcgcc

SEQ ID NO: 1452388 - RNA, 15 nt, Pseudomonas aeruginosa PA01
agcucggugccguca

SEQ ID NO: 1452389 - RNA, 16 nt, Pseudomonas aeruginosa PA01
agcucgcugucgccga

SEQ ID NO: 1452390 - RNA, 17 nt, Pseudomonas aeruginosa PA01
agcucgcugucgccgag

SEQ ID NO: 1452391 - RNA, 19 nt, Pseudomonas aeruginosa PA01
agcucgcugucgccgagca

SEQ ID NO: 1452392 - RNA, 20 nt, Pseudomonas aeruginosa PA01
agcucgcugucgccgagcac

SEQ ID NO: 1452393 - RNA, 19 nt, Pseudomonas aeruginosa PA01
agcucgcuaugcagcaggu

SEQ ID NO: 1452394 - RNA, 16 nt, Pseudomonas aeruginosa PA01
agcucgcgcaaccagc

SEQ ID NO: 1452395 - RNA, 13 nt, Pseudomonas aeruginosa PA01
agcucgcgcaagc

SEQ ID NO: 1452396 - RNA, 17 nt, Pseudomonas aeruginosa PA01
agcucgcgcaagcgccc

SEQ ID NO: 1452397 - RNA, 20 nt, Pseudomonas aeruginosa PA01
agcucgcgcaagcgcccggc

SEQ ID NO: 1452398 - RNA, 21 nt, Pseudomonas aeruginosa PA01
agcucgcgcaagcgcccggcg

SEQ ID NO: 1452399 - RNA, 18 nt, Pseudomonas aeruginosa PA01
agcucgccggcguccucc

SEQ ID NO: 1452400 - RNA, 11 nt, Pseudomonas aeruginosa PA01
agcuccucggc

SEQ ID NO: 1452401 - RNA, 15 nt, Pseudomonas aeruginosa PA01
agcuccucggccuug

SEQ ID NO: 1452402 - RNA, 22 nt, Pseudomonas aeruginosa PA01
agcuccucggccuugcuggcga

SEQ ID NO: 1452403 - RNA, 19 nt, Pseudomonas aeruginosa PA01
agcucccuugccgccgguu

SEQ ID NO: 1452404 - RNA, 15 nt, Pseudomonas aeruginosa PA01
agcucccugauccgc

SEQ ID NO: 1452405 - RNA, 14 nt, Pseudomonas aeruginosa PA01
agcucccugccgcc

SEQ ID NO: 1452406 - RNA, 15 nt, Pseudomonas aeruginosa PA01
agcucccugccgccc

SEQ ID NO: 1452407 - RNA, 12 nt, Pseudomonas aeruginosa PA01
agcuccuccagc

SEQ ID NO: 1452408 - RNA, 14 nt, Pseudomonas aeruginosa PA01
agcuccggcgggcg

SEQ ID NO: 1452409 - RNA, 14 nt, Pseudomonas aeruginosa PA01
agcucccaggcguc

SEQ ID NO: 1452410 - RNA, 17 nt, Pseudomonas aeruginosa PA01
agcuccagggcugccac

SEQ ID NO: 1452411 - RNA, 20 nt, Pseudomonas aeruginosa PA01
agcuccagcggaaucgcgcc

SEQ ID NO: 1452412 - RNA, 22 nt, Pseudomonas aeruginosa PA01
agcuccagcggaaucgcgcccu

SEQ ID NO: 1452413 - RNA, 13 nt, Pseudomonas aeruginosa PA01
agcugagucgcuu

SEQ ID NO: 1452414 - RNA, 14 nt, Pseudomonas aeruginosa PA01
agcugaggccggug

SEQ ID NO: 1452415 - RNA, 14 nt, Pseudomonas aeruginosa PA01
agcugaggccguag

SEQ ID NO: 1452416 - RNA, 22 nt, Pseudomonas aeruginosa PA01
agcugaucgcgcagaucgccgc

SEQ ID NO: 1452417 - RNA, 17 nt, Pseudomonas aeruginosa PA01
agcugcuccagcccggc

SEQ ID NO: 1452418 - RNA, 23 nt, Pseudomonas aeruginosa PA01
agcugcucgaagcaauaccgguu

SEQ ID NO: 1452419 - RNA, 17 nt, Pseudomonas aeruginosa PA01
agcugcucgauggcggc

SEQ ID NO: 1452420 - RNA, 12 nt, Pseudomonas aeruginosa PA01
agcugcugccgg

SEQ ID NO: 1452421 - RNA, 14 nt, Pseudomonas aeruginosa PA01
agcugcugccggcu

SEQ ID NO: 1452422 - RNA, 21 nt, Pseudomonas aeruginosa PA01
agcugcuggggaacugggcga

SEQ ID NO: 1452423 - RNA, 14 nt, Pseudomonas aeruginosa PA01
agcugcucggcggu

SEQ ID NO: 1452424 - RNA, 15 nt, Pseudomonas aeruginosa PA01
agcugcucggcggug

SEQ ID NO: 1452425 - RNA, 14 nt, Pseudomonas aeruginosa PA01
agcugaccaccagg

SEQ ID NO: 1452426 - RNA, 18 nt, Pseudomonas aeruginosa PA01
agcugaccaccagggcga

SEQ ID NO: 1452427 - RNA, 15 nt, Pseudomonas aeruginosa PA01
agcugaagcgccgcg

SEQ ID NO: 1452428 - RNA, 21 nt, Pseudomonas aeruginosa PA01
agcugacgaacaucgccagcg

SEQ ID NO: 1452429 - RNA, 22 nt, Pseudomonas aeruginosa PA01
agcucguugcacagcgcccaga

SEQ ID NO: 1452430 - RNA, 18 nt, Pseudomonas aeruginosa PA01
agcucguugcccggcuug

SEQ ID NO: 1452431 - RNA, 18 nt, Pseudomonas aeruginosa PA01
agcucuaccgagaucacc

SEQ ID NO: 1452432 - RNA, 15 nt, Pseudomonas aeruginosa PA01
agcucguggcuggcg

SEQ ID NO: 1452433 - RNA, 16 nt, Pseudomonas aeruginosa PA01
agcucguggcuggcgc

SEQ ID NO: 1452434 - RNA, 14 nt, Pseudomonas aeruginosa PA01
agcucguucgccca

SEQ ID NO: 1452435 - RNA, 15 nt, Pseudomonas aeruginosa PA01
agcucgucgaugauc

SEQ ID NO: 1452436 - RNA, 17 nt, Pseudomonas aeruginosa PA01
agcaggaacucgaucag

SEQ ID NO: 1452437 - RNA, 17 nt, Pseudomonas aeruginosa PA01
agcaggaagaagccgau

SEQ ID NO: 1452438 - RNA, 16 nt, Pseudomonas aeruginosa PA01
agcaggaagccgacca

SEQ ID NO: 1452439 - RNA, 15 nt, Pseudomonas aeruginosa PA01
agcaggaccuggccg

SEQ ID NO: 1452440 - RNA, 16 nt, Pseudomonas aeruginosa PA01
agcaggaccuggccgu

SEQ ID NO: 1452441 - RNA, 20 nt, Pseudomonas aeruginosa PA01
agcaggacccaucgaugcuc

SEQ ID NO: 1452442 - RNA, 14 nt, Pseudomonas aeruginosa PA01
agcaggagcgccau

SEQ ID NO: 1452443 - RNA, 20 nt, Pseudomonas aeruginosa PA01
agcaggaggauacggcgcag

SEQ ID NO: 1452444 - RNA, 13 nt, Pseudomonas aeruginosa PA01
agcagcuugccgg

SEQ ID NO: 1452445 - RNA, 15 nt, Pseudomonas aeruginosa PA01
agcagcuugcgcgag

SEQ ID NO: 1452446 - RNA, 23 nt, Pseudomonas aeruginosa PA01
agcagcggcucacgccccagcgc

SEQ ID NO: 1452447 - RNA, 16 nt, Pseudomonas aeruginosa PA01
agcagcggcaccagca

SEQ ID NO: 1452448 - RNA, 19 nt, Pseudomonas aeruginosa PA01
agcagcgggcguccggcga

SEQ ID NO: 1452449 - RNA, 20 nt, Pseudomonas aeruginosa PA01
agcagcggcgcuuuccacuc

SEQ ID NO: 1452450 - RNA, 12 nt, Pseudomonas aeruginosa PA01
agcagcggcacg

SEQ ID NO: 1452451 - RNA, 12 nt, Pseudomonas aeruginosa PA01
agcagcgcggcg

SEQ ID NO: 1452452 - RNA, 14 nt, Pseudomonas aeruginosa PA01
agcagcgcgcggcu

SEQ ID NO: 1452453 - RNA, 17 nt, Pseudomonas aeruginosa PA01
agcagcgcgcggcucgg

SEQ ID NO: 1452454 - RNA, 21 nt, Pseudomonas aeruginosa PA01
agcagcgcgcggcucggcggg

SEQ ID NO: 1452455 - RNA, 16 nt, Pseudomonas aeruginosa PA01
agcagcgcggcggcgg

SEQ ID NO: 1452456 - RNA, 24 nt, Pseudomonas aeruginosa PA01
agcagcgcggcggcggccagcagc

SEQ ID NO: 1452457 - RNA, 21 nt, Pseudomonas aeruginosa PA01
agcagcgcucacgcaccucgu

SEQ ID NO: 1452458 - RNA, 15 nt, Pseudomonas aeruginosa PA01
agcagcgcugaucac

SEQ ID NO: 1452459 - RNA, 14 nt, Pseudomonas aeruginosa PA01
agcagcgaccugac

SEQ ID NO: 1452460 - RNA, 23 nt, Pseudomonas aeruginosa PA01
agcagcgaacgccgcagcucggc

SEQ ID NO: 1452461 - RNA, 17 nt, Pseudomonas aeruginosa PA01
agcagcgacucgcuggg

SEQ ID NO: 1452462 - RNA, 23 nt, Pseudomonas aeruginosa PA01
agcagcgacucgcugggcgccgg

SEQ ID NO: 1452463 - RNA, 22 nt, Pseudomonas aeruginosa PA01
agcagccgcaggaugccgccug

SEQ ID NO: 1452464 - RNA, 19 nt, Pseudomonas aeruginosa PA01
agcagccguauggccccuc

SEQ ID NO: 1452465 - RNA, 16 nt, Pseudomonas aeruginosa PA01
agcagccguccagcuu

SEQ ID NO: 1452466 - RNA, 19 nt, Pseudomonas aeruginosa PA01
agcagcgccagcaggucgc

SEQ ID NO: 1452467 - RNA, 21 nt, Pseudomonas aeruginosa PA01
agcagcgccaguacuccgagg

SEQ ID NO: 1452468 - RNA, 22 nt, Pseudomonas aeruginosa PA01
agcagcgccucggcaucgacca

SEQ ID NO: 1452469 - RNA, 12 nt, Pseudomonas aeruginosa PA01
agcagcgccucc

SEQ ID NO: 1452470 - RNA, 17 nt, Pseudomonas aeruginosa PA01
agcaggauccaggugcg

SEQ ID NO: 1452471 - RNA, 20 nt, Pseudomonas aeruginosa PA01
agcaggaucgacagcagcgc

SEQ ID NO: 1452472 - RNA, 22 nt, Pseudomonas aeruginosa PA01
agcaggauguccuuguucggcu

SEQ ID NO: 1452473 - RNA, 21 nt, Pseudomonas aeruginosa PA01
agcaggguguugaucaccgcg

SEQ ID NO: 1452474 - RNA, 14 nt, Pseudomonas aeruginosa PA01
agcaggcccagcca

SEQ ID NO: 1452475 - RNA, 18 nt, Pseudomonas aeruginosa PA01
agcaggcccaugaugguc

SEQ ID NO: 1452476 - RNA, 22 nt, Pseudomonas aeruginosa PA01
agcaggcccaugauggucggca

SEQ ID NO: 1452477 - RNA, 19 nt, Pseudomonas aeruginosa PA01
agcaggccacgcaccagcu

SEQ ID NO: 1452478 - RNA, 11 nt, Pseudomonas aeruginosa PA01
agcaggccagc

SEQ ID NO: 1452479 - RNA, 16 nt, Pseudomonas aeruginosa PA01
agcaggucgcgcuggg

SEQ ID NO: 1452480 - RNA, 17 nt, Pseudomonas aeruginosa PA01
agcaggucgcgcugggc

SEQ ID NO: 1452481 - RNA, 13 nt, Pseudomonas aeruginosa PA01
agcaggucgagca

SEQ ID NO: 1452482 - RNA, 13 nt, Pseudomonas aeruginosa PA01
agcaggucgaggg

SEQ ID NO: 1452483 - RNA, 14 nt, Pseudomonas aeruginosa PA01
agcaggucggcagc

SEQ ID NO: 1452484 - RNA, 16 nt, Pseudomonas aeruginosa PA01
agcaggucggcagcgu

SEQ ID NO: 1452485 - RNA, 18 nt, Pseudomonas aeruginosa PA01
agcaggucggccugcugc

SEQ ID NO: 1452486 - RNA, 11 nt, Pseudomonas aeruginosa PA01
agcaggucggc

SEQ ID NO: 1452487 - RNA, 23 nt, Pseudomonas aeruginosa PA01
agcaggccaugggugucggcgau

SEQ ID NO: 1452488 - RNA, 21 nt, Pseudomonas aeruginosa PA01
agcagguagccugcggccagc

SEQ ID NO: 1452489 - RNA, 23 nt, Pseudomonas aeruginosa PA01
agcagguagccugcggccagcgc

SEQ ID NO: 1452490 - RNA, 18 nt, Pseudomonas aeruginosa PA01
agcagguccgcgccucgc

SEQ ID NO: 1452491 - RNA, 24 nt, Pseudomonas aeruginosa PA01
agcagguagaccacgcaggccagc

SEQ ID NO: 1452492 - RNA, 16 nt, Pseudomonas aeruginosa PA01
agcagguagugcggcg

SEQ ID NO: 1452493 - RNA, 18 nt, Pseudomonas aeruginosa PA01
agcagguagugcggcggg

SEQ ID NO: 1452494 - RNA, 15 nt, Pseudomonas aeruginosa PA01
agcaggucgucggcg

SEQ ID NO: 1452495 - RNA, 17 nt, Pseudomonas aeruginosa PA01
agcaggucucgacgcgc

SEQ ID NO: 1452496 - RNA, 18 nt, Pseudomonas aeruginosa PA01
agcagguggucgaugggc

SEQ ID NO: 1452497 - RNA, 21 nt, Pseudomonas aeruginosa PA01
agcagguugaccccgcggccg

SEQ ID NO: 1452498 - RNA, 23 nt, Pseudomonas aeruginosa PA01
agcagguggcgcacugccaggag

SEQ ID NO: 1452499 - RNA, 14 nt, Pseudomonas aeruginosa PA01
agcagguggcuggu

SEQ ID NO: 1452500 - RNA, 17 nt, Pseudomonas aeruginosa PA01
agcagucgcagcucggu

SEQ ID NO: 1452501 - RNA, 12 nt, Pseudomonas aeruginosa PA01
agcagucgccug

SEQ ID NO: 1452502 - RNA, 16 nt, Pseudomonas aeruginosa PA01
agcaguuccaggcguc

SEQ ID NO: 1452503 - RNA, 23 nt, Pseudomonas aeruginosa PA01
agcaucaccuugcggaacccgcg

SEQ ID NO: 1452504 - RNA, 12 nt, Pseudomonas aeruginosa PA01
agcaucagcgac

SEQ ID NO: 1452505 - RNA, 13 nt, Pseudomonas aeruginosa PA01
agcaucaggcgcu

SEQ ID NO: 1452506 - RNA, 14 nt, Pseudomonas aeruginosa PA01
agcaucaggcgcuc

SEQ ID NO: 1452507 - RNA, 16 nt, Pseudomonas aeruginosa PA01
agcaucaggucggcgc

SEQ ID NO: 1452508 - RNA, 20 nt, Pseudomonas aeruginosa PA01
agcauccacagggucggcag

SEQ ID NO: 1452509 - RNA, 14 nt, Pseudomonas aeruginosa PA01
agcaucucgccggc

SEQ ID NO: 1452510 - RNA, 13 nt, Pseudomonas aeruginosa PA01
agcaucuggcccg

SEQ ID NO: 1452511 - RNA, 23 nt, Pseudomonas aeruginosa PA01
agcaucuucuucaaccgcugguc

SEQ ID NO: 1452512 - RNA, 19 nt, Pseudomonas aeruginosa PA01
agcauguaggcgcaccagg

SEQ ID NO: 1452513 - RNA, 16 nt, Pseudomonas aeruginosa PA01
agcauggugaaaccga

SEQ ID NO: 1452514 - RNA, 14 nt, Pseudomonas aeruginosa PA01
agcaugucgccggg

SEQ ID NO: 1452515 - RNA, 20 nt, Pseudomonas aeruginosa PA01
agcaugucgcugaaacgcgc

SEQ ID NO: 1452516 - RNA, 15 nt, Pseudomonas aeruginosa PA01
agccaggcccgguug

SEQ ID NO: 1452517 - RNA, 18 nt, Pseudomonas aeruginosa PA01
agccacucggccaggcgc

SEQ ID NO: 1452518 - RNA, 14 nt, Pseudomonas aeruginosa PA01
agccagacccagug

SEQ ID NO: 1452519 - RNA, 13 nt, Pseudomonas aeruginosa PA01
agccagaccggca

SEQ ID NO: 1452520 - RNA, 22 nt, Pseudomonas aeruginosa PA01
agccagaccggcagcgccgcca

SEQ ID NO: 1452521 - RNA, 12 nt, Pseudomonas aeruginosa PA01
agccacuggcgg

SEQ ID NO: 1452522 - RNA, 12 nt, Pseudomonas aeruginosa PA01
agccacaggcgc

SEQ ID NO: 1452523 - RNA, 17 nt, Pseudomonas aeruginosa PA01
agccacaggcgccaguc

SEQ ID NO: 1452524 - RNA, 13 nt, Pseudomonas aeruginosa PA01
agccaccagcgac

SEQ ID NO: 1452525 - RNA, 20 nt, Pseudomonas aeruginosa PA01
agccacagaggucgcugacc

SEQ ID NO: 1452526 - RNA, 16 nt, Pseudomonas aeruginosa PA01
agccaccagccgaaca

SEQ ID NO: 1452527 - RNA, 20 nt, Pseudomonas aeruginosa PA01
agccaaugcguggguccacg

SEQ ID NO: 1452528 - RNA, 24 nt, Pseudomonas aeruginosa PA01
agcauuccgacaaggagcgcgagc

SEQ ID NO: 1452529 - RNA, 20 nt, Pseudomonas aeruginosa PA01
agcauucuggaugcagccgg

SEQ ID NO: 1452530 - RNA, 22 nt, Pseudomonas aeruginosa PA01
agccgcgugcgcgccgccgggc

SEQ ID NO: 1452531 - RNA, 23 nt, Pseudomonas aeruginosa PA01
agccgcguugcauguccucggcg

SEQ ID NO: 1452532 - RNA, 22 nt, Pseudomonas aeruginosa PA01
agccgcguugucccugucccgc

SEQ ID NO: 1452533 - RNA, 23 nt, Pseudomonas aeruginosa PA01
agccgccguugaugacgaacugc

SEQ ID NO: 1452534 - RNA, 14 nt, Pseudomonas aeruginosa PA01
agccgcacuuccag

SEQ ID NO: 1452535 - RNA, 18 nt, Pseudomonas aeruginosa PA01
agccgcacuuccaggcgc

SEQ ID NO: 1452536 - RNA, 17 nt, Pseudomonas aeruginosa PA01
agccgcaauccgccgcu

SEQ ID NO: 1452537 - RNA, 23 nt, Pseudomonas aeruginosa PA01
agccgcaauccgccgcucccggc

SEQ ID NO: 1452538 - RNA, 12 nt, Pseudomonas aeruginosa PA01
agccgccgggcg

SEQ ID NO: 1452539 - RNA, 16 nt, Pseudomonas aeruginosa PA01
agccgccgggcggcgu

SEQ ID NO: 1452540 - RNA, 18 nt, Pseudomonas aeruginosa PA01
agccgagcaacucggcgg

SEQ ID NO: 1452541 - RNA, 23 nt, Pseudomonas aeruginosa PA01
agccgagaagcagaacgccccgc

SEQ ID NO: 1452542 - RNA, 21 nt, Pseudomonas aeruginosa PA01
agccgagcaugucgcuccaga

SEQ ID NO: 1452543 - RNA, 17 nt, Pseudomonas aeruginosa PA01
agccgagcggcaaggcc

SEQ ID NO: 1452544 - RNA, 12 nt, Pseudomonas aeruginosa PA01
agccgcaaggcc

SEQ ID NO: 1452545 - RNA, 16 nt, Pseudomonas aeruginosa PA01
agccgcaaggccaggg

SEQ ID NO: 1452546 - RNA, 21 nt, Pseudomonas aeruginosa PA01
agccgcaaggccagggcggcg

SEQ ID NO: 1452547 - RNA, 19 nt, Pseudomonas aeruginosa PA01
agccgaugcucgcgccagc

SEQ ID NO: 1452548 - RNA, 13 nt, Pseudomonas aeruginosa PA01
agccgacgaaggc

SEQ ID NO: 1452549 - RNA, 20 nt, Pseudomonas aeruginosa PA01
agccgaccuugcgucuucgc

SEQ ID NO: 1452550 - RNA, 15 nt, Pseudomonas aeruginosa PA01
agccgacgccgagca

SEQ ID NO: 1452551 - RNA, 23 nt, Pseudomonas aeruginosa PA01
agccgacguagggcaucgccgac

SEQ ID NO: 1452552 - RNA, 18 nt, Pseudomonas aeruginosa PA01
agccgaccguccgccugc

SEQ ID NO: 1452553 - RNA, 13 nt, Pseudomonas aeruginosa PA01
agccgaccggcgc

SEQ ID NO: 1452554 - RNA, 15 nt, Pseudomonas aeruginosa PA01
agccgaccggcgccg

SEQ ID NO: 1452555 - RNA, 16 nt, Pseudomonas aeruginosa PA01
agccgacauccugucg

SEQ ID NO: 1452556 - RNA, 20 nt, Pseudomonas aeruginosa PA01
agccgacauccugucgaggc

SEQ ID NO: 1452557 - RNA, 19 nt, Pseudomonas aeruginosa PA01
agccgaccaggccgaucgc

SEQ ID NO: 1452558 - RNA, 20 nt, Pseudomonas aeruginosa PA01
agccgaccccgggguucugc

SEQ ID NO: 1452559 - RNA, 14 nt, Pseudomonas aeruginosa PA01
agcccgucgaagcc

SEQ ID NO: 1452560 - RNA, 15 nt, Pseudomonas aeruginosa PA01
agccgaagucggcgu

SEQ ID NO: 1452561 - RNA, 18 nt, Pseudomonas aeruginosa PA01
agcccggguugcccucgc

SEQ ID NO: 1452562 - RNA, 21 nt, Pseudomonas aeruginosa PA01
agcccgguccguccagcgcgc

SEQ ID NO: 1452563 - RNA, 15 nt, Pseudomonas aeruginosa PA01
agcccgguucagcgg

SEQ ID NO: 1452564 - RNA, 15 nt, Pseudomonas aeruginosa PA01
agcccacgcgccugg

SEQ ID NO: 1452565 - RNA, 17 nt, Pseudomonas aeruginosa PA01
agcccacgcgccuggcc

SEQ ID NO: 1452566 - RNA, 18 nt, Pseudomonas aeruginosa PA01
agcccacgcgccuggccg

SEQ ID NO: 1452567 - RNA, 15 nt, Pseudomonas aeruginosa PA01
agcccagcaggucga

SEQ ID NO: 1452568 - RNA, 13 nt, Pseudomonas aeruginosa PA01
agcccagccgcuc

SEQ ID NO: 1452569 - RNA, 23 nt, Pseudomonas aeruginosa PA01
agcccauacaccaggccggcggc

SEQ ID NO: 1452570 - RNA, 12 nt, Pseudomonas aeruginosa PA01
agcccaggcgcu

SEQ ID NO: 1452571 - RNA, 17 nt, Pseudomonas aeruginosa PA01
agcccaggcgcucggcg

SEQ ID NO: 1452572 - RNA, 23 nt, Pseudomonas aeruginosa PA01
agcccaggcgcucggcggcgcgc

SEQ ID NO: 1452573 - RNA, 13 nt, Pseudomonas aeruginosa PA01
agcccaggcgucg

SEQ ID NO: 1452574 - RNA, 22 nt, Pseudomonas aeruginosa PA01
agcccagguacugggcgauguc

SEQ ID NO: 1452575 - RNA, 12 nt, Pseudomonas aeruginosa PA01
agcccaggccga

SEQ ID NO: 1452576 - RNA, 20 nt, Pseudomonas aeruginosa PA01
agcccagcucguccaggcaa

SEQ ID NO: 1452577 - RNA, 21 nt, Pseudomonas aeruginosa PA01
agcccagcgcuuccucgggca

SEQ ID NO: 1452578 - RNA, 23 nt, Pseudomonas aeruginosa PA01
agcccaggcagaucgcgccgagc

SEQ ID NO: 1452579 - RNA, 21 nt, Pseudomonas aeruginosa PA01
agccaguaguccuccgcgccc

SEQ ID NO: 1452580 - RNA, 19 nt, Pseudomonas aeruginosa PA01
agcccacccccagcccggc

SEQ ID NO: 1452581 - RNA, 14 nt, Pseudomonas aeruginosa PA01
agcccacccccggc

SEQ ID NO: 1452582 - RNA, 19 nt, Pseudomonas aeruginosa PA01
agccaggcgcucucgccgc

SEQ ID NO: 1452583 - RNA, 20 nt, Pseudomonas aeruginosa PA01
agccaggcgcucucgccgcc

SEQ ID NO: 1452584 - RNA, 16 nt, Pseudomonas aeruginosa PA01
agccaggcgaagcggc

SEQ ID NO: 1452585 - RNA, 23 nt, Pseudomonas aeruginosa PA01
agccaggcgaagcggcuggccgc

SEQ ID NO: 1452586 - RNA, 20 nt, Pseudomonas aeruginosa PA01
agccaggccuugugcgccag

SEQ ID NO: 1452587 - RNA, 13 nt, Pseudomonas aeruginosa PA01
agccaggcggcca

SEQ ID NO: 1452588 - RNA, 14 nt, Pseudomonas aeruginosa PA01
agccaggcggccac

SEQ ID NO: 1452589 - RNA, 18 nt, Pseudomonas aeruginosa PA01
agccaggcguauucggcg

SEQ ID NO: 1452590 - RNA, 14 nt, Pseudomonas aeruginosa PA01
agccaggcuggcug

SEQ ID NO: 1452591 - RNA, 21 nt, Pseudomonas aeruginosa PA01
agccagguacggaugccgcga

SEQ ID NO: 1452592 - RNA, 14 nt, Pseudomonas aeruginosa PA01
agccagggccgcga

SEQ ID NO: 1452593 - RNA, 16 nt, Pseudomonas aeruginosa PA01
agccaggggcacgcug

SEQ ID NO: 1452594 - RNA, 18 nt, Pseudomonas aeruginosa PA01
agccaggggucaggccga

SEQ ID NO: 1452595 - RNA, 18 nt, Pseudomonas aeruginosa PA01
agccagguguucggcccc

SEQ ID NO: 1452596 - RNA, 17 nt, Pseudomonas aeruginosa PA01
agcccgccaccuggcgg

SEQ ID NO: 1452597 - RNA, 13 nt, Pseudomonas aeruginosa PA01
agccccuggcgcu

SEQ ID NO: 1452598 - RNA, 17 nt, Pseudomonas aeruginosa PA01
agcccgccagguggcgg

SEQ ID NO: 1452599 - RNA, 18 nt, Pseudomonas aeruginosa PA01
agcccgccagguggcggg

SEQ ID NO: 1452600 - RNA, 13 nt, Pseudomonas aeruginosa PA01
agccccugcgccu

SEQ ID NO: 1452601 - RNA, 14 nt, Pseudomonas aeruginosa PA01
agccccugcgccuc

SEQ ID NO: 1452602 - RNA, 13 nt, Pseudomonas aeruginosa PA01
agccccucgccau

SEQ ID NO: 1452603 - RNA, 21 nt, Pseudomonas aeruginosa PA01
agccccucgccauucucgcca

SEQ ID NO: 1452604 - RNA, 18 nt, Pseudomonas aeruginosa PA01
agccccgguuacucgccg

SEQ ID NO: 1452605 - RNA, 20 nt, Pseudomonas aeruginosa PA01
agccccgguuacucgccggc

SEQ ID NO: 1452606 - RNA, 22 nt, Pseudomonas aeruginosa PA01
agccccgguuacucgccggcau

SEQ ID NO: 1452607 - RNA, 21 nt, Pseudomonas aeruginosa PA01
agccccggcaggcaggccugg

SEQ ID NO: 1452608 - RNA, 11 nt, Pseudomonas aeruginosa PA01
agccccggcau

SEQ ID NO: 1452609 - RNA, 18 nt, Pseudomonas aeruginosa PA01
agccccggcaucgccggg

SEQ ID NO: 1452610 - RNA, 23 nt, Pseudomonas aeruginosa PA01
agccccggccucaacgaccgccc

SEQ ID NO: 1452611 - RNA, 22 nt, Pseudomonas aeruginosa PA01
agccccacgucguuucucggcg

SEQ ID NO: 1452612 - RNA, 22 nt, Pseudomonas aeruginosa PA01
agcccgccgugcgcuccgccag

SEQ ID NO: 1452613 - RNA, 16 nt, Pseudomonas aeruginosa PA01
agcccgccggcgaugc

SEQ ID NO: 1452614 - RNA, 17 nt, Pseudomonas aeruginosa PA01
agcccgccggcgaugcg

SEQ ID NO: 1452615 - RNA, 18 nt, Pseudomonas aeruginosa PA01
agcccgccuucaggcggg

SEQ ID NO: 1452616 - RNA, 21 nt, Pseudomonas aeruginosa PA01
agccccuugcgcucuggcgca

SEQ ID NO: 1452617 - RNA, 17 nt, Pseudomonas aeruginosa PA01
agcccgccgaacagcaa

SEQ ID NO: 1452618 - RNA, 13 nt, Pseudomonas aeruginosa PA01
agcccggcgagag

SEQ ID NO: 1452619 - RNA, 18 nt, Pseudomonas aeruginosa PA01
agcccggcgagagcgucc

SEQ ID NO: 1452620 - RNA, 14 nt, Pseudomonas aeruginosa PA01
agcccggccucgcc

SEQ ID NO: 1452621 - RNA, 16 nt, Pseudomonas aeruginosa PA01
agcccggccucgccgg

SEQ ID NO: 1452622 - RNA, 17 nt, Pseudomonas aeruginosa PA01
agcccggccucgccggu

SEQ ID NO: 1452623 - RNA, 22 nt, Pseudomonas aeruginosa PA01
agcccggccuggaucucugcga

SEQ ID NO: 1452624 - RNA, 19 nt, Pseudomonas aeruginosa PA01
agcccgggcaacugccgau

SEQ ID NO: 1452625 - RNA, 13 nt, Pseudomonas aeruginosa PA01
agcccggcggcgg

SEQ ID NO: 1452626 - RNA, 14 nt, Pseudomonas aeruginosa PA01
agcacagccccagc

SEQ ID NO: 1452627 - RNA, 18 nt, Pseudomonas aeruginosa PA01
agcacaccuccagcggcu

SEQ ID NO: 1452628 - RNA, 13 nt, Pseudomonas aeruginosa PA01
agcaccagcacca

SEQ ID NO: 1452629 - RNA, 18 nt, Pseudomonas aeruginosa PA01
agcaccacgccgcuggcg

SEQ ID NO: 1452630 - RNA, 19 nt, Pseudomonas aeruginosa PA01
agcacccgcaccgguucga

SEQ ID NO: 1452631 - RNA, 18 nt, Pseudomonas aeruginosa PA01
agcacccgguagccgauc

SEQ ID NO: 1452632 - RNA, 22 nt, Pseudomonas aeruginosa PA01
agcacccaggauuuguccgcgc

SEQ ID NO: 1452633 - RNA, 12 nt, Pseudomonas aeruginosa PA01
agcacccaggcg

SEQ ID NO: 1452634 - RNA, 19 nt, Pseudomonas aeruginosa PA01
agcacccaugaaaaaggcc

SEQ ID NO: 1452635 - RNA, 18 nt, Pseudomonas aeruginosa PA01
agcaccccgagcccggcc

SEQ ID NO: 1452636 - RNA, 14 nt, Pseudomonas aeruginosa PA01
agcaccaggaagcc

SEQ ID NO: 1452637 - RNA, 19 nt, Pseudomonas aeruginosa PA01
agcaccgggacgaagcgga

SEQ ID NO: 1452638 - RNA, 22 nt, Pseudomonas aeruginosa PA01
agcaccgggacgaagcggaagc

SEQ ID NO: 1452639 - RNA, 20 nt, Pseudomonas aeruginosa PA01
agcaccggcaggacgaugau

SEQ ID NO: 1452640 - RNA, 23 nt, Pseudomonas aeruginosa PA01
agcaccgcuuucaccagggucgc

SEQ ID NO: 1452641 - RNA, 15 nt, Pseudomonas aeruginosa PA01
agcaccggcggcgcc

SEQ ID NO: 1452642 - RNA, 20 nt, Pseudomonas aeruginosa PA01
agcaccggcggcgccaggcc

SEQ ID NO: 1452643 - RNA, 14 nt, Pseudomonas aeruginosa PA01
agcaccguggcgcc

SEQ ID NO: 1452644 - RNA, 19 nt, Pseudomonas aeruginosa PA01
agcaccguggucagcacca

SEQ ID NO: 1452645 - RNA, 14 nt, Pseudomonas aeruginosa PA01
agcaccucgacgcc

SEQ ID NO: 1452646 - RNA, 17 nt, Pseudomonas aeruginosa PA01
agcaccucgacgcccgc

SEQ ID NO: 1452647 - RNA, 14 nt, Pseudomonas aeruginosa PA01
agcaccgagcaggc

SEQ ID NO: 1452648 - RNA, 15 nt, Pseudomonas aeruginosa PA01
agcaccgccuggcgc

SEQ ID NO: 1452649 - RNA, 16 nt, Pseudomonas aeruginosa PA01
agcaccgccuggcgca

SEQ ID NO: 1452650 - RNA, 18 nt, Pseudomonas aeruginosa PA01
agcaacagcgucgccaac

SEQ ID NO: 1452651 - RNA, 20 nt, Pseudomonas aeruginosa PA01
agcaacaguugccgcagcag

SEQ ID NO: 1452652 - RNA, 22 nt, Pseudomonas aeruginosa PA01
agcaacaguugccgcagcagcg

SEQ ID NO: 1452653 - RNA, 17 nt, Pseudomonas aeruginosa PA01
agcaacgcgacgaucuc

SEQ ID NO: 1452654 - RNA, 15 nt, Pseudomonas aeruginosa PA01
agcaacgccgccccc

SEQ ID NO: 1452655 - RNA, 22 nt, Pseudomonas aeruginosa PA01
agcaacgccgcccccagcgcgc

SEQ ID NO: 1452656 - RNA, 18 nt, Pseudomonas aeruginosa PA01
agcaaaaaaagcccaucc

SEQ ID NO: 1452657 - RNA, 22 nt, Pseudomonas aeruginosa PA01
agcaacuccagagccaugggcc

SEQ ID NO: 1452658 - RNA, 13 nt, Pseudomonas aeruginosa PA01
agcaacucgccgc

SEQ ID NO: 1452659 - RNA, 15 nt, Pseudomonas aeruginosa PA01
agcaacucggcggcg

SEQ ID NO: 1452660 - RNA, 16 nt, Pseudomonas aeruginosa PA01
agcaacucggcggcga

SEQ ID NO: 1452661 - RNA, 22 nt, Pseudomonas aeruginosa PA01
agcaacuguccgaccacuucgg

SEQ ID NO: 1452662 - RNA, 14 nt, Pseudomonas aeruginosa PA01
agcaauacccgccg

SEQ ID NO: 1452663 - RNA, 14 nt, Pseudomonas aeruginosa PA01
agcaaugccagcgc

SEQ ID NO: 1452664 - RNA, 17 nt, Pseudomonas aeruginosa PA01
agcaaugccagcgccac

SEQ ID NO: 1452665 - RNA, 21 nt, Pseudomonas aeruginosa PA01
agcaaugccagcgccacgccg

SEQ ID NO: 1452666 - RNA, 13 nt, Pseudomonas aeruginosa PA01
agcaaugcccagc

SEQ ID NO: 1452667 - RNA, 16 nt, Pseudomonas aeruginosa PA01
agcaaugcccagcgca

SEQ ID NO: 1452668 - RNA, 17 nt, Pseudomonas aeruginosa PA01
agcaaugcccgcgccug

SEQ ID NO: 1452669 - RNA, 17 nt, Pseudomonas aeruginosa PA01
agcaauuccgcagccuu

SEQ ID NO: 1452670 - RNA, 20 nt, Pseudomonas aeruginosa PA01
agcaauugccagaggcugcg

SEQ ID NO: 1452671 - RNA, 20 nt, Pseudomonas aeruginosa PA01
agcacaaugaaaaacgccgg

SEQ ID NO: 1452672 - RNA, 21 nt, Pseudomonas aeruginosa PA01
agcacaaugaaaaacgccggc

SEQ ID NO: 1452673 - RNA, 15 nt, Pseudomonas aeruginosa PA01
agcagcaacagcgcc

SEQ ID NO: 1452674 - RNA, 16 nt, Pseudomonas aeruginosa PA01
agcagcaacagcgccg

SEQ ID NO: 1452675 - RNA, 13 nt, Pseudomonas aeruginosa PA01
agcagcacggcga

SEQ ID NO: 1452676 - RNA, 14 nt, Pseudomonas aeruginosa PA01
agcagcacggcgac

SEQ ID NO: 1452677 - RNA, 22 nt, Pseudomonas aeruginosa PA01
agcagcaccaucagccagccca

SEQ ID NO: 1452678 - RNA, 19 nt, Pseudomonas aeruginosa PA01
agcagcaccaggcuggcca

SEQ ID NO: 1452679 - RNA, 15 nt, Pseudomonas aeruginosa PA01
agcagcaggccggcg

SEQ ID NO: 1452680 - RNA, 16 nt, Pseudomonas aeruginosa PA01
agcagcaggcgcucgg

SEQ ID NO: 1452681 - RNA, 19 nt, Pseudomonas aeruginosa PA01
agcagcaggucgucggcga

SEQ ID NO: 1452682 - RNA, 19 nt, Pseudomonas aeruginosa PA01
agcagcccgggcaacugcc

SEQ ID NO: 1452683 - RNA, 22 nt, Pseudomonas aeruginosa PA01
agcagcccagcgcuuccucggg

SEQ ID NO: 1452684 - RNA, 23 nt, Pseudomonas aeruginosa PA01
agcagccccgaggccagcaggcc

SEQ ID NO: 1452685 - RNA, 16 nt, Pseudomonas aeruginosa PA01
agcagcccggccugga

SEQ ID NO: 1452686 - RNA, 19 nt, Pseudomonas aeruginosa PA01
agcagccaggccuugugcg

SEQ ID NO: 1452687 - RNA, 12 nt, Pseudomonas aeruginosa PA01
agcagccaggcg

SEQ ID NO: 1452688 - RNA, 14 nt, Pseudomonas aeruginosa PA01
agcagccaggcgaa

SEQ ID NO: 1452689 - RNA, 17 nt, Pseudomonas aeruginosa PA01
agcagccaggcgaaggc

SEQ ID NO: 1452690 - RNA, 15 nt, Pseudomonas aeruginosa PA01
agcagcaugccgcuc

SEQ ID NO: 1452691 - RNA, 16 nt, Pseudomonas aeruginosa PA01
agcagcaugggauggc

SEQ ID NO: 1452692 - RNA, 21 nt, Pseudomonas aeruginosa PA01
agcagccaaccgucgcccugg

SEQ ID NO: 1452693 - RNA, 23 nt, Pseudomonas aeruginosa PA01
agcagccaaccgucgcccuggug

SEQ ID NO: 1452694 - RNA, 18 nt, Pseudomonas aeruginosa PA01
agcagccaaggaugcgcc

SEQ ID NO: 1452695 - RNA, 22 nt, Pseudomonas aeruginosa PA01
agcagccaaggaugcgccagcg

SEQ ID NO: 1452696 - RNA, 23 nt, Pseudomonas aeruginosa PA01
agcagccaaggaugcgccagcgg

SEQ ID NO: 1452697 - RNA, 15 nt, Pseudomonas aeruginosa PA01
aaaccggccagcgcg

SEQ ID NO: 1452698 - RNA, 21 nt, Pseudomonas aeruginosa PA01
aaacccgugguccgccagcag

SEQ ID NO: 1452699 - RNA, 17 nt, Pseudomonas aeruginosa PA01
aaaccgaucagcaccgc

SEQ ID NO: 1452700 - RNA, 19 nt, Pseudomonas aeruginosa PA01
agcagacggcacgacgccg

SEQ ID NO: 1452701 - RNA, 16 nt, Pseudomonas aeruginosa PA01
agcagagggucgccag

SEQ ID NO: 1452702 - RNA, 12 nt, Pseudomonas aeruginosa PA01
agcagagucgcc

SEQ ID NO: 1452703 - RNA, 14 nt, Pseudomonas aeruginosa PA01
agcagagucgccgg

SEQ ID NO: 1452704 - RNA, 22 nt, Pseudomonas aeruginosa PA01
agcagaguuuagccgccagugc

SEQ ID NO: 1452705 - RNA, 12 nt, Pseudomonas aeruginosa PA01
agcacggcggcu

SEQ ID NO: 1452706 - RNA, 19 nt, Pseudomonas aeruginosa PA01
agcacggcggcuacccgcg

SEQ ID NO: 1452707 - RNA, 15 nt, Pseudomonas aeruginosa PA01
agcacggugaaccag

SEQ ID NO: 1452708 - RNA, 18 nt, Pseudomonas aeruginosa PA01
agcacggugaaccaggcg

SEQ ID NO: 1452709 - RNA, 19 nt, Pseudomonas aeruginosa PA01
agcacggugaaccaggcgc

SEQ ID NO: 1452710 - RNA, 20 nt, Pseudomonas aeruginosa PA01
agcacggugaaccaggcgcc

SEQ ID NO: 1452711 - RNA, 14 nt, Pseudomonas aeruginosa PA01
agcacggugacacc

SEQ ID NO: 1452712 - RNA, 22 nt, Pseudomonas aeruginosa PA01
agcacgucgauauccagcggca

SEQ ID NO: 1452713 - RNA, 17 nt, Pseudomonas aeruginosa PA01
agcacgucguccagcgc

SEQ ID NO: 1452714 - RNA, 22 nt, Pseudomonas aeruginosa PA01
agcacgucguccagcgccgaga

SEQ ID NO: 1452715 - RNA, 14 nt, Pseudomonas aeruginosa PA01
agcacgucuugcag

SEQ ID NO: 1452716 - RNA, 18 nt, Pseudomonas aeruginosa PA01
agcacgucuugcaggcuc

SEQ ID NO: 1452717 - RNA, 22 nt, Pseudomonas aeruginosa PA01
agcacuucccaggugcccugga

SEQ ID NO: 1452718 - RNA, 16 nt, Pseudomonas aeruginosa PA01
agcacuucggcgcgcg

SEQ ID NO: 1452719 - RNA, 19 nt, Pseudomonas aeruginosa PA01
agcacuucggcgcgcggca

SEQ ID NO: 1452720 - RNA, 21 nt, Pseudomonas aeruginosa PA01
agcagaaagccccugccgcgg

SEQ ID NO: 1452721 - RNA, 19 nt, Pseudomonas aeruginosa PA01
agcagaacuugcgcaccgc

SEQ ID NO: 1452722 - RNA, 14 nt, Pseudomonas aeruginosa PA01
agcagaacgccccg

SEQ ID NO: 1452723 - RNA, 20 nt, Pseudomonas aeruginosa PA01
agcacgcccuugcuguucgc

SEQ ID NO: 1452724 - RNA, 23 nt, Pseudomonas aeruginosa PA01
agcacgcccuugcuguucgccuu

SEQ ID NO: 1452725 - RNA, 19 nt, Pseudomonas aeruginosa PA01
agcacgccgagcaacggca

SEQ ID NO: 1452726 - RNA, 22 nt, Pseudomonas aeruginosa PA01
agcacgccgagcaacggcagca

SEQ ID NO: 1452727 - RNA, 17 nt, Pseudomonas aeruginosa PA01
agcacgccuuccagauc

SEQ ID NO: 1452728 - RNA, 15 nt, Pseudomonas aeruginosa PA01
agcacgcgcauccgu

SEQ ID NO: 1452729 - RNA, 16 nt, Pseudomonas aeruginosa PA01
agcacgcuggcgucgg

SEQ ID NO: 1452730 - RNA, 17 nt, Pseudomonas aeruginosa PA01
agcacgcggagggcggc

SEQ ID NO: 1452731 - RNA, 13 nt, Pseudomonas aeruginosa PA01
agcacgcguccga

SEQ ID NO: 1452732 - RNA, 13 nt, Pseudomonas aeruginosa PA01
agcacggccucgc

SEQ ID NO: 1452733 - RNA, 14 nt, Pseudomonas aeruginosa PA01
agcacggccucgcg

SEQ ID NO: 1452734 - RNA, 13 nt, Pseudomonas aeruginosa PA01
agcacggcgacga

SEQ ID NO: 1452735 - RNA, 13 nt, Pseudomonas aeruginosa PA01
agcaccugcgccg

SEQ ID NO: 1452736 - RNA, 17 nt, Pseudomonas aeruginosa PA01
agcaccugcgggcugcg

SEQ ID NO: 1452737 - RNA, 17 nt, Pseudomonas aeruginosa PA01
agcacgaugcacaggcg

SEQ ID NO: 1452738 - RNA, 18 nt, Pseudomonas aeruginosa PA01
acuggauucggccugccg

SEQ ID NO: 1452739 - RNA, 14 nt, Pseudomonas aeruginosa PA01
acuggaugucgcug

SEQ ID NO: 1452740 - RNA, 18 nt, Pseudomonas aeruginosa PA01
acuggaugucgcuggcca

SEQ ID NO: 1452741 - RNA, 21 nt, Pseudomonas aeruginosa PA01
acuggauacgcuuggccaggu

SEQ ID NO: 1452742 - RNA, 18 nt, Pseudomonas aeruginosa PA01
acuggaaggccgcgccga

SEQ ID NO: 1452743 - RNA, 17 nt, Pseudomonas aeruginosa PA01
acugcuucaggcgcgcg

SEQ ID NO: 1452744 - RNA, 16 nt, Pseudomonas aeruginosa PA01
acugcuuaccuugccg

SEQ ID NO: 1452745 - RNA, 18 nt, Pseudomonas aeruginosa PA01
acugcuugccgagcuggg

SEQ ID NO: 1452746 - RNA, 19 nt, Pseudomonas aeruginosa PA01
acugggaauggcgaugccg

SEQ ID NO: 1452747 - RNA, 18 nt, Pseudomonas aeruginosa PA01
acuggggcaucucggcca

SEQ ID NO: 1452748 - RNA, 16 nt, Pseudomonas aeruginosa PA01
acuggggcaugggcgc

SEQ ID NO: 1452749 - RNA, 20 nt, Pseudomonas aeruginosa PA01
acugguugaccugcagcgcc

SEQ ID NO: 1452750 - RNA, 20 nt, Pseudomonas aeruginosa PA01
acuggcguagggcgaauaac

SEQ ID NO: 1452751 - RNA, 14 nt, Pseudomonas aeruginosa PA01
acugccgucggcgc

SEQ ID NO: 1452752 - RNA, 20 nt, Pseudomonas aeruginosa PA01
acugcgagcaccaugccgau

SEQ ID NO: 1452753 - RNA, 21 nt, Pseudomonas aeruginosa PA01
acugcgagccgacuuccagcu

SEQ ID NO: 1452754 - RNA, 12 nt, Pseudomonas aeruginosa PA01
acugcgccagcc

SEQ ID NO: 1452755 - RNA, 22 nt, Pseudomonas aeruginosa PA01
acugcgccaguuccuucgccga

SEQ ID NO: 1452756 - RNA, 17 nt, Pseudomonas aeruginosa PA01
acugcucgccgccggcg

SEQ ID NO: 1452757 - RNA, 13 nt, Pseudomonas aeruginosa PA01
acuugaacaccgu

SEQ ID NO: 1452758 - RNA, 19 nt, Pseudomonas aeruginosa PA01
acuugcgcaccgcgccggg

SEQ ID NO: 1452759 - RNA, 15 nt, Pseudomonas aeruginosa PA01
acuugccggcgccau

SEQ ID NO: 1452760 - RNA, 14 nt, Pseudomonas aeruginosa PA01
acuugccagggcag

SEQ ID NO: 1452761 - RNA, 16 nt, Pseudomonas aeruginosa PA01
acuugucgaccacgcu

SEQ ID NO: 1452762 - RNA, 15 nt, Pseudomonas aeruginosa PA01
acuuggcagucgccg

SEQ ID NO: 1452763 - RNA, 16 nt, Pseudomonas aeruginosa PA01
acuugcgggugcgcag

SEQ ID NO: 1452764 - RNA, 18 nt, Pseudomonas aeruginosa PA01
acuugcgggugcgcaggc

SEQ ID NO: 1452765 - RNA, 14 nt, Pseudomonas aeruginosa PA01
acuucaggccggcg

SEQ ID NO: 1452766 - RNA, 17 nt, Pseudomonas aeruginosa PA01
acuucacgacaggcggc

SEQ ID NO: 1452767 - RNA, 22 nt, Pseudomonas aeruginosa PA01
acuucguccgccaccacggcga

SEQ ID NO: 1452768 - RNA, 19 nt, Pseudomonas aeruginosa PA01
acuucgucgaagaccaggg

SEQ ID NO: 1452769 - RNA, 22 nt, Pseudomonas aeruginosa PA01
acuucgugccacaggcccugga

SEQ ID NO: 1452770 - RNA, 23 nt, Pseudomonas aeruginosa PA01
acuucggcgguggggccgccgau

SEQ ID NO: 1452771 - RNA, 14 nt, Pseudomonas aeruginosa PA01
acuucggcgacagc

SEQ ID NO: 1452772 - RNA, 19 nt, Pseudomonas aeruginosa PA01
acuucucgacgaaggcgcg

SEQ ID NO: 1452773 - RNA, 20 nt, Pseudomonas aeruginosa PA01
acuguccgaccacuucggcg

SEQ ID NO: 1452774 - RNA, 23 nt, Pseudomonas aeruginosa PA01
acguugccgcgcgggccggcgau

SEQ ID NO: 1452775 - RNA, 16 nt, Pseudomonas aeruginosa PA01
acguugagaaggcgcc

SEQ ID NO: 1452776 - RNA, 21 nt, Pseudomonas aeruginosa PA01
acucaggaaaaaacgccgguc

SEQ ID NO: 1452777 - RNA, 14 nt, Pseudomonas aeruginosa PA01
acucaugcaggccg

SEQ ID NO: 1452778 - RNA, 14 nt, Pseudomonas aeruginosa PA01
acucaucaggcugc

SEQ ID NO: 1452779 - RNA, 20 nt, Pseudomonas aeruginosa PA01
acucaucaggcugccgagca

SEQ ID NO: 1452780 - RNA, 21 nt, Pseudomonas aeruginosa PA01
acucauccucgccgcuggcgc

SEQ ID NO: 1452781 - RNA, 12 nt, Pseudomonas aeruginosa PA01
acucauagcuca

SEQ ID NO: 1452782 - RNA, 14 nt, Pseudomonas aeruginosa PA01
acuccgagggccgc

SEQ ID NO: 1452783 - RNA, 14 nt, Pseudomonas aeruginosa PA01
acuccgagcaggac

SEQ ID NO: 1452784 - RNA, 17 nt, Pseudomonas aeruginosa PA01
acuccgagcaggacagc

SEQ ID NO: 1452785 - RNA, 19 nt, Pseudomonas aeruginosa PA01
acuccgagcaggacagcag

SEQ ID NO: 1452786 - RNA, 23 nt, Pseudomonas aeruginosa PA01
acucccggcccuugagcauggcg

SEQ ID NO: 1452787 - RNA, 13 nt, Pseudomonas aeruginosa PA01
acucccggccugg

SEQ ID NO: 1452788 - RNA, 16 nt, Pseudomonas aeruginosa PA01
acuccagcaacggcau

SEQ ID NO: 1452789 - RNA, 18 nt, Pseudomonas aeruginosa PA01
acuccagcaacggcaucg

SEQ ID NO: 1452790 - RNA, 13 nt, Pseudomonas aeruginosa PA01
acuccaggcggcg

SEQ ID NO: 1452791 - RNA, 14 nt, Pseudomonas aeruginosa PA01
acuccaggcggcgg

SEQ ID NO: 1452792 - RNA, 15 nt, Pseudomonas aeruginosa PA01
acuccaggggucggc

SEQ ID NO: 1452793 - RNA, 13 nt, Pseudomonas aeruginosa PA01
acucgcggucccg

SEQ ID NO: 1452794 - RNA, 14 nt, Pseudomonas aeruginosa PA01
acucgccgccgaca

SEQ ID NO: 1452795 - RNA, 20 nt, Pseudomonas aeruginosa PA01
acucgccgccgacacccgcg

SEQ ID NO: 1452796 - RNA, 16 nt, Pseudomonas aeruginosa PA01
acucgcgacgggugcg

SEQ ID NO: 1452797 - RNA, 15 nt, Pseudomonas aeruginosa PA01
acucgcgagcuggcg

SEQ ID NO: 1452798 - RNA, 16 nt, Pseudomonas aeruginosa PA01
acucgcgagcuggcgc

SEQ ID NO: 1452799 - RNA, 18 nt, Pseudomonas aeruginosa PA01
acucgcgagcuggcgccg

SEQ ID NO: 1452800 - RNA, 22 nt, Pseudomonas aeruginosa PA01
acucgcgagcuggcgccgucau

SEQ ID NO: 1452801 - RNA, 19 nt, Pseudomonas aeruginosa PA01
acucgcugggcgccggcag

SEQ ID NO: 1452802 - RNA, 16 nt, Pseudomonas aeruginosa PA01
acucgcugccggcgcg

SEQ ID NO: 1452803 - RNA, 20 nt, Pseudomonas aeruginosa PA01
acucgcugccggcgcgcacg

SEQ ID NO: 1452804 - RNA, 21 nt, Pseudomonas aeruginosa PA01
acucggccagcaaugcccgcg

SEQ ID NO: 1452805 - RNA, 21 nt, Pseudomonas aeruginosa PA01
acucggcgcccagggcuucgc

SEQ ID NO: 1452806 - RNA, 18 nt, Pseudomonas aeruginosa PA01
acucggcgaccacccggc

SEQ ID NO: 1452807 - RNA, 15 nt, Pseudomonas aeruginosa PA01
acucggccucggcgu

SEQ ID NO: 1452808 - RNA, 15 nt, Pseudomonas aeruginosa PA01
acucggccaggcgcc

SEQ ID NO: 1452809 - RNA, 19 nt, Pseudomonas aeruginosa PA01
acucggccaggcgccaggg

SEQ ID NO: 1452810 - RNA, 23 nt, Pseudomonas aeruginosa PA01
acucguagggguaggggucggcc

SEQ ID NO: 1452811 - RNA, 13 nt, Pseudomonas aeruginosa PA01
acucgugggccgg

SEQ ID NO: 1452812 - RNA, 12 nt, Pseudomonas aeruginosa PA01
acucgucgccaa

SEQ ID NO: 1452813 - RNA, 15 nt, Pseudomonas aeruginosa PA01
acucggcggcgagcg

SEQ ID NO: 1452814 - RNA, 19 nt, Pseudomonas aeruginosa PA01
acucggcggcgagcgccgc

SEQ ID NO: 1452815 - RNA, 22 nt, Pseudomonas aeruginosa PA01
acucggcggggcgcagcaggau

SEQ ID NO: 1452816 - RNA, 12 nt, Pseudomonas aeruginosa PA01
acucggcgugcc

SEQ ID NO: 1452817 - RNA, 22 nt, Pseudomonas aeruginosa PA01
acucggcgugccgggccggcca

SEQ ID NO: 1452818 - RNA, 15 nt, Pseudomonas aeruginosa PA01
acucggcgucgcgcu

SEQ ID NO: 1452819 - RNA, 17 nt, Pseudomonas aeruginosa PA01
acuccuccgccugcacg

SEQ ID NO: 1452820 - RNA, 14 nt, Pseudomonas aeruginosa PA01
acucgacgcgccag

SEQ ID NO: 1452821 - RNA, 16 nt, Pseudomonas aeruginosa PA01
acucgacgcgccaggu

SEQ ID NO: 1452822 - RNA, 14 nt, Pseudomonas aeruginosa PA01
acucgacgcugccc

SEQ ID NO: 1452823 - RNA, 22 nt, Pseudomonas aeruginosa PA01
acucgacgcugcccagcccgcc

SEQ ID NO: 1452824 - RNA, 21 nt, Pseudomonas aeruginosa PA01
acucgcccgaccccacgccgg

SEQ ID NO: 1452825 - RNA, 22 nt, Pseudomonas aeruginosa PA01
acucgcccgaccccacgccggc

SEQ ID NO: 1452826 - RNA, 14 nt, Pseudomonas aeruginosa PA01
acucgccagcgcgc

SEQ ID NO: 1452827 - RNA, 13 nt, Pseudomonas aeruginosa PA01
acucgauggcgcg

SEQ ID NO: 1452828 - RNA, 14 nt, Pseudomonas aeruginosa PA01
acucgauggcgcgg

SEQ ID NO: 1452829 - RNA, 15 nt, Pseudomonas aeruginosa PA01
acucgcagccgcgcu

SEQ ID NO: 1452830 - RNA, 16 nt, Pseudomonas aeruginosa PA01
acuccgggcuggucgu

SEQ ID NO: 1452831 - RNA, 21 nt, Pseudomonas aeruginosa PA01
acuccggguugaccgccagac

SEQ ID NO: 1452832 - RNA, 18 nt, Pseudomonas aeruginosa PA01
acuccgggaacagcccgu

SEQ ID NO: 1452833 - RNA, 22 nt, Pseudomonas aeruginosa PA01
acuccggcgcagcccagccgcu

SEQ ID NO: 1452834 - RNA, 23 nt, Pseudomonas aeruginosa PA01
acuccggagaaccggcggauaac

SEQ ID NO: 1452835 - RNA, 21 nt, Pseudomonas aeruginosa PA01
acuccggaggcgcacaggcgg

SEQ ID NO: 1452836 - RNA, 15 nt, Pseudomonas aeruginosa PA01
acuccggcauaccgc

SEQ ID NO: 1452837 - RNA, 21 nt, Pseudomonas aeruginosa PA01
acuccggcagcacccgcacca

SEQ ID NO: 1452838 - RNA, 12 nt, Pseudomonas aeruginosa PA01
acuccgccagcu

SEQ ID NO: 1452839 - RNA, 22 nt, Pseudomonas aeruginosa PA01
acuccgccagcuuguccgccgg

SEQ ID NO: 1452840 - RNA, 12 nt, Pseudomonas aeruginosa PA01
acuccgccaggc

SEQ ID NO: 1452841 - RNA, 22 nt, Pseudomonas aeruginosa PA01
acuccgcccaguucuucgccgc

SEQ ID NO: 1452842 - RNA, 14 nt, Pseudomonas aeruginosa PA01
acucgaaggccagc

SEQ ID NO: 1452843 - RNA, 16 nt, Pseudomonas aeruginosa PA01
acucgaaggccagcuc

SEQ ID NO: 1452844 - RNA, 17 nt, Pseudomonas aeruginosa PA01
acuccguccagugcggc

SEQ ID NO: 1452845 - RNA, 18 nt, Pseudomonas aeruginosa PA01
acgugcggccugcaacag

SEQ ID NO: 1452846 - RNA, 19 nt, Pseudomonas aeruginosa PA01
acgugcggggugcgcugga

SEQ ID NO: 1452847 - RNA, 19 nt, Pseudomonas aeruginosa PA01
acgucuuccgggaccggcu

SEQ ID NO: 1452848 - RNA, 19 nt, Pseudomonas aeruginosa PA01
acgucuucgauggcggccg

SEQ ID NO: 1452849 - RNA, 20 nt, Pseudomonas aeruginosa PA01
acgucuucgauggcggccgc

SEQ ID NO: 1452850 - RNA, 14 nt, Pseudomonas aeruginosa PA01
acgucuucaggcgc

SEQ ID NO: 1452851 - RNA, 22 nt, Pseudomonas aeruginosa PA01
acgucgaucugcucguccaggc

SEQ ID NO: 1452852 - RNA, 19 nt, Pseudomonas aeruginosa PA01
acgucgaugccuucggcgg

SEQ ID NO: 1452853 - RNA, 20 nt, Pseudomonas aeruginosa PA01
acgucgaugccuucggcggc

SEQ ID NO: 1452854 - RNA, 17 nt, Pseudomonas aeruginosa PA01
acgucgauauccagcgg

SEQ ID NO: 1452855 - RNA, 19 nt, Pseudomonas aeruginosa PA01
acgucgauauccagcggca

SEQ ID NO: 1452856 - RNA, 21 nt, Pseudomonas aeruginosa PA01
acgucgauauugccgcgggua

SEQ ID NO: 1452857 - RNA, 16 nt, Pseudomonas aeruginosa PA01
acgucgaaaccgaacg

SEQ ID NO: 1452858 - RNA, 17 nt, Pseudomonas aeruginosa PA01
acgucgacgcagcgcgc

SEQ ID NO: 1452859 - RNA, 21 nt, Pseudomonas aeruginosa PA01
acguccucgaugcccgccucg

SEQ ID NO: 1452860 - RNA, 16 nt, Pseudomonas aeruginosa PA01
acguccucgcgccgcu

SEQ ID NO: 1452861 - RNA, 13 nt, Pseudomonas aeruginosa PA01
acguccuccaggc

SEQ ID NO: 1452862 - RNA, 13 nt, Pseudomonas aeruginosa PA01
acgucggcggcgg

SEQ ID NO: 1452863 - RNA, 14 nt, Pseudomonas aeruginosa PA01
acgucggcggcgga

SEQ ID NO: 1452864 - RNA, 23 nt, Pseudomonas aeruginosa PA01
acgucggcggcggauaacgccug

SEQ ID NO: 1452865 - RNA, 23 nt, Pseudomonas aeruginosa PA01
acgucggcgucgaggugcggcug

SEQ ID NO: 1452866 - RNA, 21 nt, Pseudomonas aeruginosa PA01
acguccggcgagaaaggcugc

SEQ ID NO: 1452867 - RNA, 22 nt, Pseudomonas aeruginosa PA01
acguccagaugaaacugcccgg

SEQ ID NO: 1452868 - RNA, 18 nt, Pseudomonas aeruginosa PA01
acguccagggcaccacgg

SEQ ID NO: 1452869 - RNA, 19 nt, Pseudomonas aeruginosa PA01
acguccagggcaccacgga

SEQ ID NO: 1452870 - RNA, 14 nt, Pseudomonas aeruginosa PA01
acguccagcggcau

SEQ ID NO: 1452871 - RNA, 23 nt, Pseudomonas aeruginosa PA01
acggugacacccugccgcgccgg

SEQ ID NO: 1452872 - RNA, 21 nt, Pseudomonas aeruginosa PA01
acggugacguuggccggggua

SEQ ID NO: 1452873 - RNA, 14 nt, Pseudomonas aeruginosa PA01
acggugcaggccga

SEQ ID NO: 1452874 - RNA, 17 nt, Pseudomonas aeruginosa PA01
acggugaucaggcgcuu

SEQ ID NO: 1452875 - RNA, 19 nt, Pseudomonas aeruginosa PA01
acggugcagccacccagca

SEQ ID NO: 1452876 - RNA, 20 nt, Pseudomonas aeruginosa PA01
acggugcagccacccagcag

SEQ ID NO: 1452877 - RNA, 23 nt, Pseudomonas aeruginosa PA01
acgguggaccaacgggcugccag

SEQ ID NO: 1452878 - RNA, 23 nt, Pseudomonas aeruginosa PA01
acgggcgaggcuaacgccgagga

SEQ ID NO: 1452879 - RNA, 18 nt, Pseudomonas aeruginosa PA01
acggggacaugucgaggg

SEQ ID NO: 1452880 - RNA, 11 nt, Pseudomonas aeruginosa PA01
acgggccgcgc

SEQ ID NO: 1452881 - RNA, 13 nt, Pseudomonas aeruginosa PA01
acgggccgcgccg

SEQ ID NO: 1452882 - RNA, 15 nt, Pseudomonas aeruginosa PA01
acggcuucagcgcca

SEQ ID NO: 1452883 - RNA, 18 nt, Pseudomonas aeruginosa PA01
acggcuucagcgccaggc

SEQ ID NO: 1452884 - RNA, 13 nt, Pseudomonas aeruginosa PA01
acggcuggucggc

SEQ ID NO: 1452885 - RNA, 14 nt, Pseudomonas aeruginosa PA01
acggcuggucggcu

SEQ ID NO: 1452886 - RNA, 22 nt, Pseudomonas aeruginosa PA01
acggcuugaucacgccgaagcc

SEQ ID NO: 1452887 - RNA, 15 nt, Pseudomonas aeruginosa PA01
acggcuugucgggua

SEQ ID NO: 1452888 - RNA, 22 nt, Pseudomonas aeruginosa PA01
acggcuugucggguagggcgaa

SEQ ID NO: 1452889 - RNA, 21 nt, Pseudomonas aeruginosa PA01
acggcuuguucagcucggcgu

SEQ ID NO: 1452890 - RNA, 14 nt, Pseudomonas aeruginosa PA01
acggcgugccgcag

SEQ ID NO: 1452891 - RNA, 15 nt, Pseudomonas aeruginosa PA01
acggcguuauccgcc

SEQ ID NO: 1452892 - RNA, 14 nt, Pseudomonas aeruginosa PA01
acggcguucggggc

SEQ ID NO: 1452893 - RNA, 15 nt, Pseudomonas aeruginosa PA01
acggcguguccaggg

SEQ ID NO: 1452894 - RNA, 15 nt, Pseudomonas aeruginosa PA01
acggcucgccgggua

SEQ ID NO: 1452895 - RNA, 18 nt, Pseudomonas aeruginosa PA01
acggcucgcgcagcggcg

SEQ ID NO: 1452896 - RNA, 13 nt, Pseudomonas aeruginosa PA01
acggcucggcgag

SEQ ID NO: 1452897 - RNA, 19 nt, Pseudomonas aeruginosa PA01
acggcucaauccggcugga

SEQ ID NO: 1452898 - RNA, 15 nt, Pseudomonas aeruginosa PA01
acggcugcccaacug

SEQ ID NO: 1452899 - RNA, 15 nt, Pseudomonas aeruginosa PA01
acggcugaggcuggc

SEQ ID NO: 1452900 - RNA, 21 nt, Pseudomonas aeruginosa PA01
acggcgcgcuccggcgcgcca

SEQ ID NO: 1452901 - RNA, 23 nt, Pseudomonas aeruginosa PA01
acggcgcggaacaucgcccggcg

SEQ ID NO: 1452902 - RNA, 20 nt, Pseudomonas aeruginosa PA01
acggcgcugaacagcuggcg

SEQ ID NO: 1452903 - RNA, 17 nt, Pseudomonas aeruginosa PA01
acggcgcuucaacugcu

SEQ ID NO: 1452904 - RNA, 18 nt, Pseudomonas aeruginosa PA01
acggcgcuuucaucaggc

SEQ ID NO: 1452905 - RNA, 20 nt, Pseudomonas aeruginosa PA01
acggccccgagaaaacccug

SEQ ID NO: 1452906 - RNA, 19 nt, Pseudomonas aeruginosa PA01
acgcugggcugggucggcu

SEQ ID NO: 1452907 - RNA, 21 nt, Pseudomonas aeruginosa PA01
acggccgcugcgcaggccgag

SEQ ID NO: 1452908 - RNA, 22 nt, Pseudomonas aeruginosa PA01
acggccggcgaggcguuccagg

SEQ ID NO: 1452909 - RNA, 15 nt, Pseudomonas aeruginosa PA01
acggccggcucggug

SEQ ID NO: 1452910 - RNA, 16 nt, Pseudomonas aeruginosa PA01
acggccguccugcggc

SEQ ID NO: 1452911 - RNA, 19 nt, Pseudomonas aeruginosa PA01
acggccgucccagguuggc

SEQ ID NO: 1452912 - RNA, 21 nt, Pseudomonas aeruginosa PA01
acggcgcaggcuuggucaggg

SEQ ID NO: 1452913 - RNA, 23 nt, Pseudomonas aeruginosa PA01
acggcgcagcagggcgucggcgu

SEQ ID NO: 1452914 - RNA, 21 nt, Pseudomonas aeruginosa PA01
acggcgcagccgcaaggccag

SEQ ID NO: 1452915 - RNA, 15 nt, Pseudomonas aeruginosa PA01
acggcgcccgagggc

SEQ ID NO: 1452916 - RNA, 17 nt, Pseudomonas aeruginosa PA01
acggcgcccgagggcgc

SEQ ID NO: 1452917 - RNA, 19 nt, Pseudomonas aeruginosa PA01
acggcgcccgagggcgccg

SEQ ID NO: 1452918 - RNA, 14 nt, Pseudomonas aeruginosa PA01
acggcgcauaucca

SEQ ID NO: 1452919 - RNA, 16 nt, Pseudomonas aeruginosa PA01
acggcgcaucgucgau

SEQ ID NO: 1452920 - RNA, 20 nt, Pseudomonas aeruginosa PA01
acggcgcaucgucgaugcgu

SEQ ID NO: 1452921 - RNA, 14 nt, Pseudomonas aeruginosa PA01
acggcgccgaugcc

SEQ ID NO: 1452922 - RNA, 15 nt, Pseudomonas aeruginosa PA01
acggcgacccugggg

SEQ ID NO: 1452923 - RNA, 16 nt, Pseudomonas aeruginosa PA01
acggcgaaucgucgau

SEQ ID NO: 1452924 - RNA, 18 nt, Pseudomonas aeruginosa PA01
acggcgaauucgucgccg

SEQ ID NO: 1452925 - RNA, 21 nt, Pseudomonas aeruginosa PA01
acggcgaauucgucgccgccg

SEQ ID NO: 1452926 - RNA, 16 nt, Pseudomonas aeruginosa PA01
acggcgaaaccggcca

SEQ ID NO: 1452927 - RNA, 13 nt, Pseudomonas aeruginosa PA01
acggccugcgccc

SEQ ID NO: 1452928 - RNA, 17 nt, Pseudomonas aeruginosa PA01
acggcgauacccaggcc

SEQ ID NO: 1452929 - RNA, 15 nt, Pseudomonas aeruginosa PA01
acggcgaccgcugga

SEQ ID NO: 1452930 - RNA, 21 nt, Pseudomonas aeruginosa PA01
acggcgacgcugucguggacg

SEQ ID NO: 1452931 - RNA, 23 nt, Pseudomonas aeruginosa PA01
acggcgagacuaccgaucggcug

SEQ ID NO: 1452932 - RNA, 16 nt, Pseudomonas aeruginosa PA01
acggcgagagcgccga

SEQ ID NO: 1452933 - RNA, 19 nt, Pseudomonas aeruginosa PA01
acgcugggacggcugccca

SEQ ID NO: 1452934 - RNA, 19 nt, Pseudomonas aeruginosa PA01
acgcuggcgagaauggcga

SEQ ID NO: 1452935 - RNA, 16 nt, Pseudomonas aeruginosa PA01
acgcuggcgaggacgc

SEQ ID NO: 1452936 - RNA, 20 nt, Pseudomonas aeruginosa PA01
acgcucggggugcgcggcga

SEQ ID NO: 1452937 - RNA, 23 nt, Pseudomonas aeruginosa PA01
acgcucuccgucaaugcggccug

SEQ ID NO: 1452938 - RNA, 20 nt, Pseudomonas aeruginosa PA01
acgcucuggccguucuccag

SEQ ID NO: 1452939 - RNA, 15 nt, Pseudomonas aeruginosa PA01
acgcucuucaccucg

SEQ ID NO: 1452940 - RNA, 17 nt, Pseudomonas aeruginosa PA01
acgcugaagaucgccac

SEQ ID NO: 1452941 - RNA, 19 nt, Pseudomonas aeruginosa PA01
acgcguaggggaccacccc

SEQ ID NO: 1452942 - RNA, 17 nt, Pseudomonas aeruginosa PA01
acgcgguuauccgccgc

SEQ ID NO: 1452943 - RNA, 22 nt, Pseudomonas aeruginosa PA01
acgcguucggcgaugccgcgcc

SEQ ID NO: 1452944 - RNA, 17 nt, Pseudomonas aeruginosa PA01
acgcguucccccguggc

SEQ ID NO: 1452945 - RNA, 16 nt, Pseudomonas aeruginosa PA01
acgcgugauacagcuc

SEQ ID NO: 1452946 - RNA, 12 nt, Pseudomonas aeruginosa PA01
acgcgccgaucc

SEQ ID NO: 1452947 - RNA, 19 nt, Pseudomonas aeruginosa PA01
acgcgccgauccaggcgug

SEQ ID NO: 1452948 - RNA, 22 nt, Pseudomonas aeruginosa PA01
acgcgcccacuccuccgccugc

SEQ ID NO: 1452949 - RNA, 14 nt, Pseudomonas aeruginosa PA01
acgcgccaggugcg

SEQ ID NO: 1452950 - RNA, 19 nt, Pseudomonas aeruginosa PA01
acgcgccacggaaggccac

SEQ ID NO: 1452951 - RNA, 12 nt, Pseudomonas aeruginosa PA01
acgccugggcgu

SEQ ID NO: 1452952 - RNA, 17 nt, Pseudomonas aeruginosa PA01
acgccugucgcuccggc

SEQ ID NO: 1452953 - RNA, 20 nt, Pseudomonas aeruginosa PA01
acgccugucggcacgacacc

SEQ ID NO: 1452954 - RNA, 22 nt, Pseudomonas aeruginosa PA01
acgccuuccggguugaaggcgc

SEQ ID NO: 1452955 - RNA, 19 nt, Pseudomonas aeruginosa PA01
acgccuucgggcgaugcgg

SEQ ID NO: 1452956 - RNA, 17 nt, Pseudomonas aeruginosa PA01
acgccuucgcggccgag

SEQ ID NO: 1452957 - RNA, 14 nt, Pseudomonas aeruginosa PA01
acgcgaggucucga

SEQ ID NO: 1452958 - RNA, 18 nt, Pseudomonas aeruginosa PA01
acgcgaggagaucggcgu

SEQ ID NO: 1452959 - RNA, 17 nt, Pseudomonas aeruginosa PA01
acgcgauauccgccagg

SEQ ID NO: 1452960 - RNA, 21 nt, Pseudomonas aeruginosa PA01
acgcgacgaucucuucccggc

SEQ ID NO: 1452961 - RNA, 15 nt, Pseudomonas aeruginosa PA01
acgcggccugggccg

SEQ ID NO: 1452962 - RNA, 16 nt, Pseudomonas aeruginosa PA01
acgcggccugggccga

SEQ ID NO: 1452963 - RNA, 21 nt, Pseudomonas aeruginosa PA01
acgcggccugggccgaaggcc

SEQ ID NO: 1452964 - RNA, 14 nt, Pseudomonas aeruginosa PA01
acgcggcgaagggc

SEQ ID NO: 1452965 - RNA, 14 nt, Pseudomonas aeruginosa PA01
acgcggccagcagc

SEQ ID NO: 1452966 - RNA, 18 nt, Pseudomonas aeruginosa PA01
acgcggccagcagcacgc

SEQ ID NO: 1452967 - RNA, 19 nt, Pseudomonas aeruginosa PA01
acgcggccagcagcacgcc

SEQ ID NO: 1452968 - RNA, 18 nt, Pseudomonas aeruginosa PA01
acgcggauaucgcuggcg

SEQ ID NO: 1452969 - RNA, 20 nt, Pseudomonas aeruginosa PA01
acgcggaugcccuggucggc

SEQ ID NO: 1452970 - RNA, 16 nt, Pseudomonas aeruginosa PA01
acgcgccuccggcagc

SEQ ID NO: 1452971 - RNA, 20 nt, Pseudomonas aeruginosa PA01
acgcgccuccggcagcgucg

SEQ ID NO: 1452972 - RNA, 21 nt, Pseudomonas aeruginosa PA01
acgcgccuccggcagcgucgg

SEQ ID NO: 1452973 - RNA, 17 nt, Pseudomonas aeruginosa PA01
acgcgccugcuucaggu

SEQ ID NO: 1452974 - RNA, 21 nt, Pseudomonas aeruginosa PA01
acgcgccugcuucagguagug

SEQ ID NO: 1452975 - RNA, 17 nt, Pseudomonas aeruginosa PA01
acgcgccgggucggaug

SEQ ID NO: 1452976 - RNA, 12 nt, Pseudomonas aeruginosa PA01
acgccgccggcg

SEQ ID NO: 1452977 - RNA, 23 nt, Pseudomonas aeruginosa PA01
acgccgcgauggcucgcggcgcu

SEQ ID NO: 1452978 - RNA, 17 nt, Pseudomonas aeruginosa PA01
acgccgcgaccgaagcc

SEQ ID NO: 1452979 - RNA, 12 nt, Pseudomonas aeruginosa PA01
acgccgccugcg

SEQ ID NO: 1452980 - RNA, 14 nt, Pseudomonas aeruginosa PA01
acgccgccugcgcc

SEQ ID NO: 1452981 - RNA, 16 nt, Pseudomonas aeruginosa PA01
acgccgcgcugcgcca

SEQ ID NO: 1452982 - RNA, 15 nt, Pseudomonas aeruginosa PA01
acgccgcggcugaug

SEQ ID NO: 1452983 - RNA, 16 nt, Pseudomonas aeruginosa PA01
acgccgcggcugaugc

SEQ ID NO: 1452984 - RNA, 15 nt, Pseudomonas aeruginosa PA01
acgccgaucaccccg

SEQ ID NO: 1452985 - RNA, 21 nt, Pseudomonas aeruginosa PA01
acgccgcaggcguuauccgcc

SEQ ID NO: 1452986 - RNA, 22 nt, Pseudomonas aeruginosa PA01
acgccgccgagcaugcgggcga

SEQ ID NO: 1452987 - RNA, 19 nt, Pseudomonas aeruginosa PA01
acgccgcccgucgcgccgg

SEQ ID NO: 1452988 - RNA, 20 nt, Pseudomonas aeruginosa PA01
acgccgcccgucgcgccggc

SEQ ID NO: 1452989 - RNA, 21 nt, Pseudomonas aeruginosa PA01
acgccgcccgucgcgccggcc

SEQ ID NO: 1452990 - RNA, 19 nt, Pseudomonas aeruginosa PA01
acgccgccccagccucggc

SEQ ID NO: 1452991 - RNA, 21 nt, Pseudomonas aeruginosa PA01
acgccgccccagccucggcag

SEQ ID NO: 1452992 - RNA, 17 nt, Pseudomonas aeruginosa PA01
acgccgcccccagcgcg

SEQ ID NO: 1452993 - RNA, 16 nt, Pseudomonas aeruginosa PA01
acgccgaagccgcugg

SEQ ID NO: 1452994 - RNA, 18 nt, Pseudomonas aeruginosa PA01
acgccgaaguucuucagc

SEQ ID NO: 1452995 - RNA, 15 nt, Pseudomonas aeruginosa PA01
acgccgaagucggcg

SEQ ID NO: 1452996 - RNA, 21 nt, Pseudomonas aeruginosa PA01
acgccgacccuagggucggcg

SEQ ID NO: 1452997 - RNA, 22 nt, Pseudomonas aeruginosa PA01
acgccgacccuagggucggcgu

SEQ ID NO: 1452998 - RNA, 15 nt, Pseudomonas aeruginosa PA01
acgccgaccgacugg

SEQ ID NO: 1452999 - RNA, 13 nt, Pseudomonas aeruginosa PA01
acgcccugcgcca

SEQ ID NO: 1453000 - RNA, 14 nt, Pseudomonas aeruginosa PA01
acgcccugcgccag

SEQ ID NO: 1453001 - RNA, 20 nt, Pseudomonas aeruginosa PA01
acgcccugcgccagcaucgc

SEQ ID NO: 1453002 - RNA, 14 nt, Pseudomonas aeruginosa PA01
acgcccugggcgac

SEQ ID NO: 1453003 - RNA, 17 nt, Pseudomonas aeruginosa PA01
acgcccuguucggcggg

SEQ ID NO: 1453004 - RNA, 18 nt, Pseudomonas aeruginosa PA01
acgcccuugcuguucgcc

SEQ ID NO: 1453005 - RNA, 16 nt, Pseudomonas aeruginosa PA01
acgccgaacccgccuc

SEQ ID NO: 1453006 - RNA, 17 nt, Pseudomonas aeruginosa PA01
acgccgaaacgccgacg

SEQ ID NO: 1453007 - RNA, 16 nt, Pseudomonas aeruginosa PA01
acgccgaugcucggug

SEQ ID NO: 1453008 - RNA, 14 nt, Pseudomonas aeruginosa PA01
acgccgauggcguu

SEQ ID NO: 1453009 - RNA, 21 nt, Pseudomonas aeruginosa PA01
acgccgauggcguuauucgcc

SEQ ID NO: 1453010 - RNA, 14 nt, Pseudomonas aeruginosa PA01
acgccgaucccggc

SEQ ID NO: 1453011 - RNA, 19 nt, Pseudomonas aeruginosa PA01
acgccgaucccggcggcga

SEQ ID NO: 1453012 - RNA, 16 nt, Pseudomonas aeruginosa PA01
acgccgagcagcacca

SEQ ID NO: 1453013 - RNA, 19 nt, Pseudomonas aeruginosa PA01
acgccgaggagacgcggca

SEQ ID NO: 1453014 - RNA, 20 nt, Pseudomonas aeruginosa PA01
acgccgaggagacgcggcau

SEQ ID NO: 1453015 - RNA, 14 nt, Pseudomonas aeruginosa PA01
acgccgaggcugcg

SEQ ID NO: 1453016 - RNA, 19 nt, Pseudomonas aeruginosa PA01
acgccgaggcugcgggcga

SEQ ID NO: 1453017 - RNA, 15 nt, Pseudomonas aeruginosa PA01
acgccgagcugacca

SEQ ID NO: 1453018 - RNA, 18 nt, Pseudomonas aeruginosa PA01
acgccgauaccggccucg

SEQ ID NO: 1453019 - RNA, 20 nt, Pseudomonas aeruginosa PA01
acgccgagcaacggcagcau

SEQ ID NO: 1453020 - RNA, 17 nt, Pseudomonas aeruginosa PA01
acgccgagaacgcggcg

SEQ ID NO: 1453021 - RNA, 14 nt, Pseudomonas aeruginosa PA01
acgccgacggcgug

SEQ ID NO: 1453022 - RNA, 19 nt, Pseudomonas aeruginosa PA01
acgccgacggcgugccgug

SEQ ID NO: 1453023 - RNA, 21 nt, Pseudomonas aeruginosa PA01
acgccgguggcguuauccgcc

SEQ ID NO: 1453024 - RNA, 22 nt, Pseudomonas aeruginosa PA01
acgccgguggcguuauccgccc

SEQ ID NO: 1453025 - RNA, 20 nt, Pseudomonas aeruginosa PA01
acgccgguggcguuauucgc

SEQ ID NO: 1453026 - RNA, 15 nt, Pseudomonas aeruginosa PA01
acgccggugccagga

SEQ ID NO: 1453027 - RNA, 22 nt, Pseudomonas aeruginosa PA01
acgccggugccaggaccagccc

SEQ ID NO: 1453028 - RNA, 16 nt, Pseudomonas aeruginosa PA01
acgccgggggucgcgg

SEQ ID NO: 1453029 - RNA, 17 nt, Pseudomonas aeruginosa PA01
acgccggucucgauggc

SEQ ID NO: 1453030 - RNA, 14 nt, Pseudomonas aeruginosa PA01
acgccguagcgcag

SEQ ID NO: 1453031 - RNA, 22 nt, Pseudomonas aeruginosa PA01
acgccgggaauccccaguagcg

SEQ ID NO: 1453032 - RNA, 17 nt, Pseudomonas aeruginosa PA01
acgccgggcaacgccag

SEQ ID NO: 1453033 - RNA, 12 nt, Pseudomonas aeruginosa PA01
acgccggccucg

SEQ ID NO: 1453034 - RNA, 15 nt, Pseudomonas aeruginosa PA01
acgccggccucgcgc

SEQ ID NO: 1453035 - RNA, 17 nt, Pseudomonas aeruginosa PA01
acgccggacgcaccagc

SEQ ID NO: 1453036 - RNA, 12 nt, Pseudomonas aeruginosa PA01
acgccgcuggcg

SEQ ID NO: 1453037 - RNA, 13 nt, Pseudomonas aeruginosa PA01
acgccgcuggcgg

SEQ ID NO: 1453038 - RNA, 17 nt, Pseudomonas aeruginosa PA01
acgccgcuggcggcgcu

SEQ ID NO: 1453039 - RNA, 21 nt, Pseudomonas aeruginosa PA01
acgccgcugucguccagcggg

SEQ ID NO: 1453040 - RNA, 21 nt, Pseudomonas aeruginosa PA01
acgccgcuuacccagguaagc

SEQ ID NO: 1453041 - RNA, 22 nt, Pseudomonas aeruginosa PA01
acgccgcuuacccagguaagcg

SEQ ID NO: 1453042 - RNA, 13 nt, Pseudomonas aeruginosa PA01
acgccucgcagag

SEQ ID NO: 1453043 - RNA, 20 nt, Pseudomonas aeruginosa PA01
acgccuauggcguuauucgc

SEQ ID NO: 1453044 - RNA, 23 nt, Pseudomonas aeruginosa PA01
acgccucaaggcaucgcgaaaac

SEQ ID NO: 1453045 - RNA, 21 nt, Pseudomonas aeruginosa PA01
acgccguuggcguuaugcgcc

SEQ ID NO: 1453046 - RNA, 22 nt, Pseudomonas aeruginosa PA01
acgccucgcggcuaucgaucac

SEQ ID NO: 1453047 - RNA, 12 nt, Pseudomonas aeruginosa PA01
acgccucggcgc

SEQ ID NO: 1453048 - RNA, 15 nt, Pseudomonas aeruginosa PA01
acgccucggcgcgau

SEQ ID NO: 1453049 - RNA, 22 nt, Pseudomonas aeruginosa PA01
acgccucggcgcgauccuccgc

SEQ ID NO: 1453050 - RNA, 15 nt, Pseudomonas aeruginosa PA01
acgccuggcggcugg

SEQ ID NO: 1453051 - RNA, 19 nt, Pseudomonas aeruginosa PA01
acgccuggcggcuggcgug

SEQ ID NO: 1453052 - RNA, 18 nt, Pseudomonas aeruginosa PA01
acgccguccaccagccag

SEQ ID NO: 1453053 - RNA, 16 nt, Pseudomonas aeruginosa PA01
acgccgucgccgcuga

SEQ ID NO: 1453054 - RNA, 22 nt, Pseudomonas aeruginosa PA01
acgccguggaccaggaucaccu

SEQ ID NO: 1453055 - RNA, 18 nt, Pseudomonas aeruginosa PA01
acgccgugcaucaccggc

SEQ ID NO: 1453056 - RNA, 23 nt, Pseudomonas aeruginosa PA01
accugguggacacccugcugcug

SEQ ID NO: 1453057 - RNA, 19 nt, Pseudomonas aeruginosa PA01
accuggucguugcgcgcau

SEQ ID NO: 1453058 - RNA, 16 nt, Pseudomonas aeruginosa PA01
accuggggcggccuca

SEQ ID NO: 1453059 - RNA, 16 nt, Pseudomonas aeruginosa PA01
accuggguugccgcgc

SEQ ID NO: 1453060 - RNA, 18 nt, Pseudomonas aeruginosa PA01
accuggguugccgcgccg

SEQ ID NO: 1453061 - RNA, 17 nt, Pseudomonas aeruginosa PA01
accugggacucccgcag

SEQ ID NO: 1453062 - RNA, 21 nt, Pseudomonas aeruginosa PA01
accugggcguuggccagcgcc

SEQ ID NO: 1453063 - RNA, 22 nt, Pseudomonas aeruginosa PA01
accugggcguuggccagcgcca

SEQ ID NO: 1453064 - RNA, 13 nt, Pseudomonas aeruginosa PA01
accuggcgcaggu

SEQ ID NO: 1453065 - RNA, 20 nt, Pseudomonas aeruginosa PA01
accuggcgaugcccuggccg

SEQ ID NO: 1453066 - RNA, 19 nt, Pseudomonas aeruginosa PA01
accuggcgcugaacaagcc

SEQ ID NO: 1453067 - RNA, 17 nt, Pseudomonas aeruginosa PA01
accuggccgcguucgcc

SEQ ID NO: 1453068 - RNA, 23 nt, Pseudomonas aeruginosa PA01
accuggccgcguucgccgaggcg

SEQ ID NO: 1453069 - RNA, 13 nt, Pseudomonas aeruginosa PA01
accuggccggcga

SEQ ID NO: 1453070 - RNA, 23 nt, Pseudomonas aeruginosa PA01
accuggcucuguuccucggcggc

SEQ ID NO: 1453071 - RNA, 17 nt, Pseudomonas aeruginosa PA01
accuggcgguacagccc

SEQ ID NO: 1453072 - RNA, 13 nt, Pseudomonas aeruginosa PA01
accuggcggucgc

SEQ ID NO: 1453073 - RNA, 18 nt, Pseudomonas aeruginosa PA01
accuggcggucgccgccg

SEQ ID NO: 1453074 - RNA, 17 nt, Pseudomonas aeruginosa PA01
accuggaucgccaggcu

SEQ ID NO: 1453075 - RNA, 14 nt, Pseudomonas aeruginosa PA01
accuggcagugcgc

SEQ ID NO: 1453076 - RNA, 15 nt, Pseudomonas aeruginosa PA01
accuggcagugcgcc

SEQ ID NO: 1453077 - RNA, 13 nt, Pseudomonas aeruginosa PA01
accugcugggcca

SEQ ID NO: 1453078 - RNA, 14 nt, Pseudomonas aeruginosa PA01
accugcucgcugaa

SEQ ID NO: 1453079 - RNA, 13 nt, Pseudomonas aeruginosa PA01
accugcucgaacc

SEQ ID NO: 1453080 - RNA, 15 nt, Pseudomonas aeruginosa PA01
accugcucacggccg

SEQ ID NO: 1453081 - RNA, 17 nt, Pseudomonas aeruginosa PA01
accugcucacggccgaa

SEQ ID NO: 1453082 - RNA, 18 nt, Pseudomonas aeruginosa PA01
accugcucacggccgaac

SEQ ID NO: 1453083 - RNA, 23 nt, Pseudomonas aeruginosa PA01
accugcguggcgaacgcccggcu

SEQ ID NO: 1453084 - RNA, 16 nt, Pseudomonas aeruginosa PA01
accugcgggcugcgug

SEQ ID NO: 1453085 - RNA, 17 nt, Pseudomonas aeruginosa PA01
accugcgaauugcgcug

SEQ ID NO: 1453086 - RNA, 22 nt, Pseudomonas aeruginosa PA01
accugcgaauugcgcuggaagu

SEQ ID NO: 1453087 - RNA, 12 nt, Pseudomonas aeruginosa PA01
accugccggcac

SEQ ID NO: 1453088 - RNA, 14 nt, Pseudomonas aeruginosa PA01
accugccggcacgc

SEQ ID NO: 1453089 - RNA, 16 nt, Pseudomonas aeruginosa PA01
accgggcaucgccgac

SEQ ID NO: 1453090 - RNA, 15 nt, Pseudomonas aeruginosa PA01
accgggcaugccgug

SEQ ID NO: 1453091 - RNA, 16 nt, Pseudomonas aeruginosa PA01
acgaugcacaggcgua

SEQ ID NO: 1453092 - RNA, 23 nt, Pseudomonas aeruginosa PA01
acgaugcacaggcguaccagcuu

SEQ ID NO: 1453093 - RNA, 16 nt, Pseudomonas aeruginosa PA01
acgaugcagggcugcu

SEQ ID NO: 1453094 - RNA, 14 nt, Pseudomonas aeruginosa PA01
acgaugaagcccca

SEQ ID NO: 1453095 - RNA, 24 nt, Pseudomonas aeruginosa PA01
acgaucugucgauaccagcgccgc

SEQ ID NO: 1453096 - RNA, 17 nt, Pseudomonas aeruginosa PA01
acgaucagcggcccgag

SEQ ID NO: 1453097 - RNA, 20 nt, Pseudomonas aeruginosa PA01
acgaucagcggcccgagcag

SEQ ID NO: 1453098 - RNA, 14 nt, Pseudomonas aeruginosa PA01
acgaucaggcccuu

SEQ ID NO: 1453099 - RNA, 15 nt, Pseudomonas aeruginosa PA01
acgaucugcgagcgc

SEQ ID NO: 1453100 - RNA, 21 nt, Pseudomonas aeruginosa PA01
acgaucugcuugcgcgccgcc

SEQ ID NO: 1453101 - RNA, 23 nt, Pseudomonas aeruginosa PA01
acgaucugcuugcgcgccgccgc

SEQ ID NO: 1453102 - RNA, 15 nt, Pseudomonas aeruginosa PA01
acgaucagcccgccg

SEQ ID NO: 1453103 - RNA, 16 nt, Pseudomonas aeruginosa PA01
acgaucagcccgccgg

SEQ ID NO: 1453104 - RNA, 19 nt, Pseudomonas aeruginosa PA01
acgaucacccccagcgagc

SEQ ID NO: 1453105 - RNA, 17 nt, Pseudomonas aeruginosa PA01
acgauauugaacaccug

SEQ ID NO: 1453106 - RNA, 18 nt, Pseudomonas aeruginosa PA01
acgagccggacggcggcg

SEQ ID NO: 1453107 - RNA, 22 nt, Pseudomonas aeruginosa PA01
acgagccgcugcggcucgccga

SEQ ID NO: 1453108 - RNA, 14 nt, Pseudomonas aeruginosa PA01
acgagcccaggcag

SEQ ID NO: 1453109 - RNA, 18 nt, Pseudomonas aeruginosa PA01
acgagccgagcaggccac

SEQ ID NO: 1453110 - RNA, 19 nt, Pseudomonas aeruginosa PA01
accuguugcagagcggcca

SEQ ID NO: 1453111 - RNA, 20 nt, Pseudomonas aeruginosa PA01
accuguuccagcaacgccuc

SEQ ID NO: 1453112 - RNA, 22 nt, Pseudomonas aeruginosa PA01
accuguucgaaguucuccagca

SEQ ID NO: 1453113 - RNA, 15 nt, Pseudomonas aeruginosa PA01
accuguucggcgcug

SEQ ID NO: 1453114 - RNA, 21 nt, Pseudomonas aeruginosa PA01
accuguucggcgcugaccucg

SEQ ID NO: 1453115 - RNA, 17 nt, Pseudomonas aeruginosa PA01
accugugcugcgcgccg

SEQ ID NO: 1453116 - RNA, 18 nt, Pseudomonas aeruginosa PA01
accugugcugcgcgccgc

SEQ ID NO: 1453117 - RNA, 21 nt, Pseudomonas aeruginosa PA01
accuguggaauguccugccgc

SEQ ID NO: 1453118 - RNA, 23 nt, Pseudomonas aeruginosa PA01
accuguggaauguccugccgcag

SEQ ID NO: 1453119 - RNA, 19 nt, Pseudomonas aeruginosa PA01
accuguggauaacguccgc

SEQ ID NO: 1453120 - RNA, 16 nt, Pseudomonas aeruginosa PA01
accuucaucaggcggc

SEQ ID NO: 1453121 - RNA, 14 nt, Pseudomonas aeruginosa PA01
accuucgacggcag

SEQ ID NO: 1453122 - RNA, 17 nt, Pseudomonas aeruginosa PA01
accuucgaucacccggu

SEQ ID NO: 1453123 - RNA, 20 nt, Pseudomonas aeruginosa PA01
accuucgcccgcugcgcugc

SEQ ID NO: 1453124 - RNA, 22 nt, Pseudomonas aeruginosa PA01
accuucgcccucagcagcgccg

SEQ ID NO: 1453125 - RNA, 18 nt, Pseudomonas aeruginosa PA01
accuuccgccagcaggcg

SEQ ID NO: 1453126 - RNA, 13 nt, Pseudomonas aeruginosa PA01
accuuccugccag

SEQ ID NO: 1453127 - RNA, 18 nt, Pseudomonas aeruginosa PA01
accuugacgaagccggcg

SEQ ID NO: 1453128 - RNA, 19 nt, Pseudomonas aeruginosa PA01
accuugacgaagccggcga

SEQ ID NO: 1453129 - RNA, 18 nt, Pseudomonas aeruginosa PA01
acgagauugaugaagcgc

SEQ ID NO: 1453130 - RNA, 20 nt, Pseudomonas aeruginosa PA01
acgagauugaugaagcgcug

SEQ ID NO: 1453131 - RNA, 22 nt, Pseudomonas aeruginosa PA01
acgcaguucgcgggccgcggcg

SEQ ID NO: 1453132 - RNA, 20 nt, Pseudomonas aeruginosa PA01
acgcaguacagcugcaccgc

SEQ ID NO: 1453133 - RNA, 22 nt, Pseudomonas aeruginosa PA01
acgcaguacagcugcaccgcgc

SEQ ID NO: 1453134 - RNA, 21 nt, Pseudomonas aeruginosa PA01
acgcaggcuuuccagcccggc

SEQ ID NO: 1453135 - RNA, 22 nt, Pseudomonas aeruginosa PA01
acgcaggcuuuccagcccggcg

SEQ ID NO: 1453136 - RNA, 21 nt, Pseudomonas aeruginosa PA01
acgcagggccggaugccaccg

SEQ ID NO: 1453137 - RNA, 22 nt, Pseudomonas aeruginosa PA01
acgcagggccggaugccaccgc

SEQ ID NO: 1453138 - RNA, 19 nt, Pseudomonas aeruginosa PA01
acgcagggccucuucgcaa

SEQ ID NO: 1453139 - RNA, 16 nt, Pseudomonas aeruginosa PA01
acgcagggcggcgccu

SEQ ID NO: 1453140 - RNA, 20 nt, Pseudomonas aeruginosa PA01
acgcagggcggcgccuggag

SEQ ID NO: 1453141 - RNA, 17 nt, Pseudomonas aeruginosa PA01
acgcaggcgccgauggc

SEQ ID NO: 1453142 - RNA, 16 nt, Pseudomonas aeruginosa PA01
acgcaggcgcuggccg

SEQ ID NO: 1453143 - RNA, 22 nt, Pseudomonas aeruginosa PA01
acgcagcgggucgaucaggcgc

SEQ ID NO: 1453144 - RNA, 21 nt, Pseudomonas aeruginosa PA01
acgcagcgcuagcgcauggcg

SEQ ID NO: 1453145 - RNA, 17 nt, Pseudomonas aeruginosa PA01
acgcagccguuggccag

SEQ ID NO: 1453146 - RNA, 16 nt, Pseudomonas aeruginosa PA01
acgcagcgcgcgccga

SEQ ID NO: 1453147 - RNA, 18 nt, Pseudomonas aeruginosa PA01
acgcagcgcgcgucggcg

SEQ ID NO: 1453148 - RNA, 22 nt, Pseudomonas aeruginosa PA01
acgcaggaacuggucgauccgc

SEQ ID NO: 1453149 - RNA, 16 nt, Pseudomonas aeruginosa PA01
acgcaggccagcgcca

SEQ ID NO: 1453150 - RNA, 12 nt, Pseudomonas aeruginosa PA01
acgcaggccgcu

SEQ ID NO: 1453151 - RNA, 22 nt, Pseudomonas aeruginosa PA01
acgcagcucugcgaucagggcc

SEQ ID NO: 1453152 - RNA, 19 nt, Pseudomonas aeruginosa PA01
acgaugccguucucgguga

SEQ ID NO: 1453153 - RNA, 16 nt, Pseudomonas aeruginosa PA01
acgaugccgaucucgc

SEQ ID NO: 1453154 - RNA, 19 nt, Pseudomonas aeruginosa PA01
acgaugccgaucucgccca

SEQ ID NO: 1453155 - RNA, 13 nt, Pseudomonas aeruginosa PA01
acgauggccggca

SEQ ID NO: 1453156 - RNA, 22 nt, Pseudomonas aeruginosa PA01
acgauggccggcagcagcgcca

SEQ ID NO: 1453157 - RNA, 18 nt, Pseudomonas aeruginosa PA01
acgauggccagcccggag

SEQ ID NO: 1453158 - RNA, 21 nt, Pseudomonas aeruginosa PA01
acgaugcucgguugccaggcc

SEQ ID NO: 1453159 - RNA, 13 nt, Pseudomonas aeruginosa PA01
acgauggccgccg

SEQ ID NO: 1453160 - RNA, 20 nt, Pseudomonas aeruginosa PA01
acgcagcagcuucggcgcga

SEQ ID NO: 1453161 - RNA, 15 nt, Pseudomonas aeruginosa PA01
acgcagcacggcggc

SEQ ID NO: 1453162 - RNA, 13 nt, Pseudomonas aeruginosa PA01
acgcagcgccgcg

SEQ ID NO: 1453163 - RNA, 15 nt, Pseudomonas aeruginosa PA01
acgcagcgccgcgua

SEQ ID NO: 1453164 - RNA, 14 nt, Pseudomonas aeruginosa PA01
acgcaucugcucga

SEQ ID NO: 1453165 - RNA, 12 nt, Pseudomonas aeruginosa PA01
acgcaugcgcgg

SEQ ID NO: 1453166 - RNA, 14 nt, Pseudomonas aeruginosa PA01
acgcaugcgcggcg

SEQ ID NO: 1453167 - RNA, 15 nt, Pseudomonas aeruginosa PA01
acgcaugcgcggcgu

SEQ ID NO: 1453168 - RNA, 17 nt, Pseudomonas aeruginosa PA01
acgccaccagccaggcg

SEQ ID NO: 1453169 - RNA, 20 nt, Pseudomonas aeruginosa PA01
acgccaccagccaggcggcc

SEQ ID NO: 1453170 - RNA, 21 nt, Pseudomonas aeruginosa PA01
acgccacaggcguuauccgcc

SEQ ID NO: 1453171 - RNA, 22 nt, Pseudomonas aeruginosa PA01
acgccacccgcaucgaggccgc

SEQ ID NO: 1453172 - RNA, 16 nt, Pseudomonas aeruginosa PA01
acgcccgcuugcgccg

SEQ ID NO: 1453173 - RNA, 23 nt, Pseudomonas aeruginosa PA01
acgcccgcuugcgccgccucgcg

SEQ ID NO: 1453174 - RNA, 23 nt, Pseudomonas aeruginosa PA01
acgcccgcgguauucuccagcag

SEQ ID NO: 1453175 - RNA, 19 nt, Pseudomonas aeruginosa PA01
acgcccgcggcagcagcca

SEQ ID NO: 1453176 - RNA, 20 nt, Pseudomonas aeruginosa PA01
acgcccgcgagccguccugc

SEQ ID NO: 1453177 - RNA, 21 nt, Pseudomonas aeruginosa PA01
acgcccggcaucugccgggcg

SEQ ID NO: 1453178 - RNA, 20 nt, Pseudomonas aeruginosa PA01
acgcccggcuuuccucggcc

SEQ ID NO: 1453179 - RNA, 12 nt, Pseudomonas aeruginosa PA01
acgcccucggcg

SEQ ID NO: 1453180 - RNA, 12 nt, Pseudomonas aeruginosa PA01
acgcccuccagc

SEQ ID NO: 1453181 - RNA, 18 nt, Pseudomonas aeruginosa PA01
acgcccuccagcaccgcc

SEQ ID NO: 1453182 - RNA, 23 nt, Pseudomonas aeruginosa PA01
acgcccuccagcaccgccuggcg

SEQ ID NO: 1453183 - RNA, 20 nt, Pseudomonas aeruginosa PA01
acgcccucucaggagcgccg

SEQ ID NO: 1453184 - RNA, 23 nt, Pseudomonas aeruginosa PA01
acgcccugaggcuuuccugcgcc

SEQ ID NO: 1453185 - RNA, 14 nt, Pseudomonas aeruginosa PA01
acgcccaggcgcuc

SEQ ID NO: 1453186 - RNA, 13 nt, Pseudomonas aeruginosa PA01
acgcccagcagcg

SEQ ID NO: 1453187 - RNA, 15 nt, Pseudomonas aeruginosa PA01
acgcccagcagggcc

SEQ ID NO: 1453188 - RNA, 22 nt, Pseudomonas aeruginosa PA01
acgcccaguugcgccgccugcg

SEQ ID NO: 1453189 - RNA, 22 nt, Pseudomonas aeruginosa PA01
acgccccuagaccaacugcgcc

SEQ ID NO: 1453190 - RNA, 21 nt, Pseudomonas aeruginosa PA01
acgccccuccuucgagccugg

SEQ ID NO: 1453191 - RNA, 15 nt, Pseudomonas aeruginosa PA01
acgcccaucuucagg

SEQ ID NO: 1453192 - RNA, 19 nt, Pseudomonas aeruginosa PA01
acgcccgcagccacggcac

SEQ ID NO: 1453193 - RNA, 18 nt, Pseudomonas aeruginosa PA01
acgcccgcagccagccuc

SEQ ID NO: 1453194 - RNA, 22 nt, Pseudomonas aeruginosa PA01
acgccagcaggcgcaggucggc

SEQ ID NO: 1453195 - RNA, 16 nt, Pseudomonas aeruginosa PA01
acgccagcucggccgg

SEQ ID NO: 1453196 - RNA, 17 nt, Pseudomonas aeruginosa PA01
acgccagcucggccggc

SEQ ID NO: 1453197 - RNA, 17 nt, Pseudomonas aeruginosa PA01
acgccagcggcgaucgc

SEQ ID NO: 1453198 - RNA, 16 nt, Pseudomonas aeruginosa PA01
acgccaggaucggcau

SEQ ID NO: 1453199 - RNA, 15 nt, Pseudomonas aeruginosa PA01
acgccaggacguuau

SEQ ID NO: 1453200 - RNA, 21 nt, Pseudomonas aeruginosa PA01
acgccauucgaauggcgccgg

SEQ ID NO: 1453201 - RNA, 17 nt, Pseudomonas aeruginosa PA01
acgccauacugggcggc

SEQ ID NO: 1453202 - RNA, 16 nt, Pseudomonas aeruginosa PA01
acagcccccgccggcc

SEQ ID NO: 1453203 - RNA, 17 nt, Pseudomonas aeruginosa PA01
acagcccccgccggccg

SEQ ID NO: 1453204 - RNA, 13 nt, Pseudomonas aeruginosa PA01
acagcccgcgccg

SEQ ID NO: 1453205 - RNA, 14 nt, Pseudomonas aeruginosa PA01
acagcccgcgccgc

SEQ ID NO: 1453206 - RNA, 17 nt, Pseudomonas aeruginosa PA01
acagcccgcgccgcgag

SEQ ID NO: 1453207 - RNA, 18 nt, Pseudomonas aeruginosa PA01
acagcccgcgcucggccg

SEQ ID NO: 1453208 - RNA, 13 nt, Pseudomonas aeruginosa PA01
acagcccccaggc

SEQ ID NO: 1453209 - RNA, 18 nt, Pseudomonas aeruginosa PA01
acagcccccaggcaccgu

SEQ ID NO: 1453210 - RNA, 17 nt, Pseudomonas aeruginosa PA01
acagccaggggcacgcu

SEQ ID NO: 1453211 - RNA, 13 nt, Pseudomonas aeruginosa PA01
acagccccagccu

SEQ ID NO: 1453212 - RNA, 14 nt, Pseudomonas aeruginosa PA01
acagccgcagcggc

SEQ ID NO: 1453213 - RNA, 18 nt, Pseudomonas aeruginosa PA01
acagcccgucgcgcgccg

SEQ ID NO: 1453214 - RNA, 19 nt, Pseudomonas aeruginosa PA01
acagcccgucgcgcgccgg

SEQ ID NO: 1453215 - RNA, 22 nt, Pseudomonas aeruginosa PA01
acagcgccacggccagcaggau

SEQ ID NO: 1453216 - RNA, 20 nt, Pseudomonas aeruginosa PA01
acagcgcccagacacgccuc

SEQ ID NO: 1453217 - RNA, 19 nt, Pseudomonas aeruginosa PA01
acagcgccuggucggcggc

SEQ ID NO: 1453218 - RNA, 23 nt, Pseudomonas aeruginosa PA01
acagcgccuggucggcggccuug

SEQ ID NO: 1453219 - RNA, 20 nt, Pseudomonas aeruginosa PA01
acagcucgcgcaaccagccg

SEQ ID NO: 1453220 - RNA, 13 nt, Pseudomonas aeruginosa PA01
acagcucguccuu

SEQ ID NO: 1453221 - RNA, 17 nt, Pseudomonas aeruginosa PA01
acagcucguggcuggcg

SEQ ID NO: 1453222 - RNA, 19 nt, Pseudomonas aeruginosa PA01
acagcucguggcuggcgcc

SEQ ID NO: 1453223 - RNA, 20 nt, Pseudomonas aeruginosa PA01
acagcucguggcuggcgccg

SEQ ID NO: 1453224 - RNA, 21 nt, Pseudomonas aeruginosa PA01
acagcucguggcuggcgccgc

SEQ ID NO: 1453225 - RNA, 14 nt, Pseudomonas aeruginosa PA01
acagcuccuccagc

SEQ ID NO: 1453226 - RNA, 17 nt, Pseudomonas aeruginosa PA01
acagcuccuccagccgc

SEQ ID NO: 1453227 - RNA, 19 nt, Pseudomonas aeruginosa PA01
acagcuccuccagcguggc

SEQ ID NO: 1453228 - RNA, 19 nt, Pseudomonas aeruginosa PA01
acagcguucacgcgaccac

SEQ ID NO: 1453229 - RNA, 18 nt, Pseudomonas aeruginosa PA01
acagcguggccagcgccc

SEQ ID NO: 1453230 - RNA, 16 nt, Pseudomonas aeruginosa PA01
acagcgucgccaacgc

SEQ ID NO: 1453231 - RNA, 19 nt, Pseudomonas aeruginosa PA01
acagcgcgacaucggcgau

SEQ ID NO: 1453232 - RNA, 21 nt, Pseudomonas aeruginosa PA01
acagcgcgacaucggcgaugg

SEQ ID NO: 1453233 - RNA, 15 nt, Pseudomonas aeruginosa PA01
acaggccagcucgcc

SEQ ID NO: 1453234 - RNA, 21 nt, Pseudomonas aeruginosa PA01
acaggccagcucgcccgccuc

SEQ ID NO: 1453235 - RNA, 18 nt, Pseudomonas aeruginosa PA01
acaggcauugccguccgu

SEQ ID NO: 1453236 - RNA, 16 nt, Pseudomonas aeruginosa PA01
acaggccccaggcgau

SEQ ID NO: 1453237 - RNA, 16 nt, Pseudomonas aeruginosa PA01
acaggcccugcagcgc

SEQ ID NO: 1453238 - RNA, 19 nt, Pseudomonas aeruginosa PA01
acaggcccugcagcgccau

SEQ ID NO: 1453239 - RNA, 23 nt, Pseudomonas aeruginosa PA01
acaggcuggcgucgacgccgaag

SEQ ID NO: 1453240 - RNA, 16 nt, Pseudomonas aeruginosa PA01
acaggccaccgcgcag

SEQ ID NO: 1453241 - RNA, 16 nt, Pseudomonas aeruginosa PA01
acaggcugugcgccag

SEQ ID NO: 1453242 - RNA, 17 nt, Pseudomonas aeruginosa PA01
acagcucuggggucagu

SEQ ID NO: 1453243 - RNA, 20 nt, Pseudomonas aeruginosa PA01
acagcucggucucgaucggc

SEQ ID NO: 1453244 - RNA, 22 nt, Pseudomonas aeruginosa PA01
acagcucggucucgaucggccc

SEQ ID NO: 1453245 - RNA, 20 nt, Pseudomonas aeruginosa PA01
acaggaugggcgaagccggc

SEQ ID NO: 1453246 - RNA, 18 nt, Pseudomonas aeruginosa PA01
acaggcaaagaccgacca

SEQ ID NO: 1453247 - RNA, 15 nt, Pseudomonas aeruginosa PA01
acaggcagccggcca

SEQ ID NO: 1453248 - RNA, 13 nt, Pseudomonas aeruginosa PA01
acaggcagcgccg

SEQ ID NO: 1453249 - RNA, 12 nt, Pseudomonas aeruginosa PA01
acagggccaggc

SEQ ID NO: 1453250 - RNA, 13 nt, Pseudomonas aeruginosa PA01
acagggccaggcc

SEQ ID NO: 1453251 - RNA, 15 nt, Pseudomonas aeruginosa PA01
acagggcgagcaggg

SEQ ID NO: 1453252 - RNA, 23 nt, Pseudomonas aeruginosa PA01
acaucaccacgcgauauccgcca

SEQ ID NO: 1453253 - RNA, 22 nt, Pseudomonas aeruginosa PA01
acauagccggcgaaccaggcgg

SEQ ID NO: 1453254 - RNA, 22 nt, Pseudomonas aeruginosa PA01
acaugcaggucgugcagcccgg

SEQ ID NO: 1453255 - RNA, 15 nt, Pseudomonas aeruginosa PA01
acauggcgucggcga

SEQ ID NO: 1453256 - RNA, 17 nt, Pseudomonas aeruginosa PA01
acaugggaaccucggca

SEQ ID NO: 1453257 - RNA, 13 nt, Pseudomonas aeruginosa PA01
acaugggccgcgc

SEQ ID NO: 1453258 - RNA, 22 nt, Pseudomonas aeruginosa PA01
acauggucgagaaggcugccgg

SEQ ID NO: 1453259 - RNA, 16 nt, Pseudomonas aeruginosa PA01
acauggugggcgccgc

SEQ ID NO: 1453260 - RNA, 14 nt, Pseudomonas aeruginosa PA01
acaugggcgaccgg

SEQ ID NO: 1453261 - RNA, 16 nt, Pseudomonas aeruginosa PA01
acaugaaaaagccgga

SEQ ID NO: 1453262 - RNA, 13 nt, Pseudomonas aeruginosa PA01
acaugaagccgcg

SEQ ID NO: 1453263 - RNA, 18 nt, Pseudomonas aeruginosa PA01
acaucuuccgacuggucc

SEQ ID NO: 1453264 - RNA, 15 nt, Pseudomonas aeruginosa PA01
acaugcaggccggcc

SEQ ID NO: 1453265 - RNA, 18 nt, Pseudomonas aeruginosa PA01
acaugcaggccggccucc

SEQ ID NO: 1453266 - RNA, 23 nt, Pseudomonas aeruginosa PA01
acaugcaggcucgacaggucggc

SEQ ID NO: 1453267 - RNA, 14 nt, Pseudomonas aeruginosa PA01
acaugcaccaggcc

SEQ ID NO: 1453268 - RNA, 20 nt, Pseudomonas aeruginosa PA01
acaugcaccaggcccugcuc

SEQ ID NO: 1453269 - RNA, 21 nt, Pseudomonas aeruginosa PA01
acaugcaccaggccgccaugc

SEQ ID NO: 1453270 - RNA, 13 nt, Pseudomonas aeruginosa PA01
acaugacgaagcg

SEQ ID NO: 1453271 - RNA, 21 nt, Pseudomonas aeruginosa PA01
acauccucccugcccgcucgg

SEQ ID NO: 1453272 - RNA, 16 nt, Pseudomonas aeruginosa PA01
acaucgaccaggucgc

SEQ ID NO: 1453273 - RNA, 16 nt, Pseudomonas aeruginosa PA01
acaucgacgcccucgg

SEQ ID NO: 1453274 - RNA, 13 nt, Pseudomonas aeruginosa PA01
acaucgccagcgc

SEQ ID NO: 1453275 - RNA, 14 nt, Pseudomonas aeruginosa PA01
acaucggcgcuccg

SEQ ID NO: 1453276 - RNA, 15 nt, Pseudomonas aeruginosa PA01
acaucgucugcgcgg

SEQ ID NO: 1453277 - RNA, 17 nt, Pseudomonas aeruginosa PA01
acauugcugccgaggcc

SEQ ID NO: 1453278 - RNA, 17 nt, Pseudomonas aeruginosa PA01
acauuaauugcgagcga

SEQ ID NO: 1453279 - RNA, 13 nt, Pseudomonas aeruginosa PA01
accaaggugcugg

SEQ ID NO: 1453280 - RNA, 15 nt, Pseudomonas aeruginosa PA01
accagcgcgcgcugg

SEQ ID NO: 1453281 - RNA, 16 nt, Pseudomonas aeruginosa PA01
accagcgcgcgcuggc

SEQ ID NO: 1453282 - RNA, 18 nt, Pseudomonas aeruginosa PA01
accagcgcgcgcuggcgc

SEQ ID NO: 1453283 - RNA, 20 nt, Pseudomonas aeruginosa PA01
accagcgcgcucuucgccgc

SEQ ID NO: 1453284 - RNA, 13 nt, Pseudomonas aeruginosa PA01
accagcgcgucga

SEQ ID NO: 1453285 - RNA, 13 nt, Pseudomonas aeruginosa PA01
accagcgcgcagc

SEQ ID NO: 1453286 - RNA, 21 nt, Pseudomonas aeruginosa PA01
accagcgcgauacccuggccg

SEQ ID NO: 1453287 - RNA, 16 nt, Pseudomonas aeruginosa PA01
accagcgccggcggcg

SEQ ID NO: 1453288 - RNA, 12 nt, Pseudomonas aeruginosa PA01
accagcgccggg

SEQ ID NO: 1453289 - RNA, 22 nt, Pseudomonas aeruginosa PA01
accagcgccggguucaucgaca

SEQ ID NO: 1453290 - RNA, 20 nt, Pseudomonas aeruginosa PA01
accagcgccgucaccagcag

SEQ ID NO: 1453291 - RNA, 18 nt, Pseudomonas aeruginosa PA01
accagcgcuucggcggcu

SEQ ID NO: 1453292 - RNA, 12 nt, Pseudomonas aeruginosa PA01
accagcggcggu

SEQ ID NO: 1453293 - RNA, 15 nt, Pseudomonas aeruginosa PA01
accagcggcccggcg

SEQ ID NO: 1453294 - RNA, 13 nt, Pseudomonas aeruginosa PA01
accagcucagcuc

SEQ ID NO: 1453295 - RNA, 14 nt, Pseudomonas aeruginosa PA01
accagcucggcggg

SEQ ID NO: 1453296 - RNA, 22 nt, Pseudomonas aeruginosa PA01
accagcucggcgggacggcgca

SEQ ID NO: 1453297 - RNA, 20 nt, Pseudomonas aeruginosa PA01
accagcgugggcaacaggcc

SEQ ID NO: 1453298 - RNA, 23 nt, Pseudomonas aeruginosa PA01
accagcgugggcaacaggccgau

SEQ ID NO: 1453299 - RNA, 16 nt, Pseudomonas aeruginosa PA01
accagcgugguaccgc

SEQ ID NO: 1453300 - RNA, 21 nt, Pseudomonas aeruginosa PA01
accagcggcuggcugaagccg

SEQ ID NO: 1453301 - RNA, 12 nt, Pseudomonas aeruginosa PA01
accagcggcugg

SEQ ID NO: 1453302 - RNA, 17 nt, Pseudomonas aeruginosa PA01
accagcgggucgucgaa

SEQ ID NO: 1453303 - RNA, 21 nt, Pseudomonas aeruginosa PA01
accagcgggucgucgaagcgc

SEQ ID NO: 1453304 - RNA, 17 nt, Pseudomonas aeruginosa PA01
accagcgguacguagcg

SEQ ID NO: 1453305 - RNA, 16 nt, Pseudomonas aeruginosa PA01
accagcgucgccaggc

SEQ ID NO: 1453306 - RNA, 19 nt, Pseudomonas aeruginosa PA01
accagcgucgccaggccgu

SEQ ID NO: 1453307 - RNA, 23 nt, Pseudomonas aeruginosa PA01
accagcgucgcgcgugccccgug

SEQ ID NO: 1453308 - RNA, 19 nt, Pseudomonas aeruginosa PA01
accagcgccaggccgccga

SEQ ID NO: 1453309 - RNA, 15 nt, Pseudomonas aeruginosa PA01
accagcgccaggcgc

SEQ ID NO: 1453310 - RNA, 16 nt, Pseudomonas aeruginosa PA01
accagcgccaggcgcg

SEQ ID NO: 1453311 - RNA, 17 nt, Pseudomonas aeruginosa PA01
accagcgccaggcgcgg

SEQ ID NO: 1453312 - RNA, 15 nt, Pseudomonas aeruginosa PA01
accagcgccgccaac

SEQ ID NO: 1453313 - RNA, 18 nt, Pseudomonas aeruginosa PA01
accagcgccgccaccgcc

SEQ ID NO: 1453314 - RNA, 15 nt, Pseudomonas aeruginosa PA01
accagcgccgccagg

SEQ ID NO: 1453315 - RNA, 16 nt, Pseudomonas aeruginosa PA01
accagcgccgccaggc

SEQ ID NO: 1453316 - RNA, 15 nt, Pseudomonas aeruginosa PA01
accagcgccgcggcg

SEQ ID NO: 1453317 - RNA, 23 nt, Pseudomonas aeruginosa PA01
accagcgccgcggcgaccagcgc

SEQ ID NO: 1453318 - RNA, 13 nt, Pseudomonas aeruginosa PA01
accagcgccggcg

SEQ ID NO: 1453319 - RNA, 20 nt, Pseudomonas aeruginosa PA01
accagcgaaagcgucagcgc

SEQ ID NO: 1453320 - RNA, 21 nt, Pseudomonas aeruginosa PA01
accagcgacgcgacauccucc

SEQ ID NO: 1453321 - RNA, 17 nt, Pseudomonas aeruginosa PA01
accagcgcaccaggguc

SEQ ID NO: 1453322 - RNA, 14 nt, Pseudomonas aeruginosa PA01
accagcccuggcgc

SEQ ID NO: 1453323 - RNA, 16 nt, Pseudomonas aeruginosa PA01
accagcccggcggcgg

SEQ ID NO: 1453324 - RNA, 15 nt, Pseudomonas aeruginosa PA01
accagccggcgcucg

SEQ ID NO: 1453325 - RNA, 19 nt, Pseudomonas aeruginosa PA01
accagccggcgcucggcca

SEQ ID NO: 1453326 - RNA, 16 nt, Pseudomonas aeruginosa PA01
accagccggccgcguc

SEQ ID NO: 1453327 - RNA, 16 nt, Pseudomonas aeruginosa PA01
accagccaguccggca

SEQ ID NO: 1453328 - RNA, 17 nt, Pseudomonas aeruginosa PA01
accagccaguccggcag

SEQ ID NO: 1453329 - RNA, 18 nt, Pseudomonas aeruginosa PA01
accagccaguccggcagc

SEQ ID NO: 1453330 - RNA, 21 nt, Pseudomonas aeruginosa PA01
accagccagucgagacgccag

SEQ ID NO: 1453331 - RNA, 14 nt, Pseudomonas aeruginosa PA01
accagccagucggc

SEQ ID NO: 1453332 - RNA, 15 nt, Pseudomonas aeruginosa PA01
accagccagucggcg

SEQ ID NO: 1453333 - RNA, 16 nt, Pseudomonas aeruginosa PA01
accagccagucggcgg

SEQ ID NO: 1453334 - RNA, 21 nt, Pseudomonas aeruginosa PA01
accagccaugcaggcugccgg

SEQ ID NO: 1453335 - RNA, 13 nt, Pseudomonas aeruginosa PA01
accacguucggcg

SEQ ID NO: 1453336 - RNA, 19 nt, Pseudomonas aeruginosa PA01
accacguugcgccgcagca

SEQ ID NO: 1453337 - RNA, 19 nt, Pseudomonas aeruginosa PA01
accacucgcgagcuggcgc

SEQ ID NO: 1453338 - RNA, 12 nt, Pseudomonas aeruginosa PA01
accagaucacca

SEQ ID NO: 1453339 - RNA, 14 nt, Pseudomonas aeruginosa PA01
accagacguugcgc

SEQ ID NO: 1453340 - RNA, 15 nt, Pseudomonas aeruginosa PA01
accagaucggcgcgc

SEQ ID NO: 1453341 - RNA, 15 nt, Pseudomonas aeruginosa PA01
accagaggcugaccu

SEQ ID NO: 1453342 - RNA, 16 nt, Pseudomonas aeruginosa PA01
accagacgcucggcca

SEQ ID NO: 1453343 - RNA, 15 nt, Pseudomonas aeruginosa PA01
accagaccagcagga

SEQ ID NO: 1453344 - RNA, 13 nt, Pseudomonas aeruginosa PA01
accagaccgcagc

SEQ ID NO: 1453345 - RNA, 13 nt, Pseudomonas aeruginosa PA01
accagagccagcc

SEQ ID NO: 1453346 - RNA, 15 nt, Pseudomonas aeruginosa PA01
accagagccagccgc

SEQ ID NO: 1453347 - RNA, 14 nt, Pseudomonas aeruginosa PA01
accagagccgccga

SEQ ID NO: 1453348 - RNA, 15 nt, Pseudomonas aeruginosa PA01
accagagccgccgaa

SEQ ID NO: 1453349 - RNA, 22 nt, Pseudomonas aeruginosa PA01
accagacgcagcagcucgucca

SEQ ID NO: 1453350 - RNA, 21 nt, Pseudomonas aeruginosa PA01
accagaacgaaaaaggcgcgc

SEQ ID NO: 1453351 - RNA, 14 nt, Pseudomonas aeruginosa PA01
accagaagccggcc

SEQ ID NO: 1453352 - RNA, 18 nt, Pseudomonas aeruginosa PA01
accagaagccggccgggu

SEQ ID NO: 1453353 - RNA, 21 nt, Pseudomonas aeruginosa PA01
accacuucggcgguggggccg

SEQ ID NO: 1453354 - RNA, 17 nt, Pseudomonas aeruginosa PA01
accacuuccagguagcc

SEQ ID NO: 1453355 - RNA, 15 nt, Pseudomonas aeruginosa PA01
accagcaugcccagc

SEQ ID NO: 1453356 - RNA, 20 nt, Pseudomonas aeruginosa PA01
accagcaugcccagcguggc

SEQ ID NO: 1453357 - RNA, 20 nt, Pseudomonas aeruginosa PA01
accagcauguccugcaggcu

SEQ ID NO: 1453358 - RNA, 13 nt, Pseudomonas aeruginosa PA01
accagcaggucga

SEQ ID NO: 1453359 - RNA, 22 nt, Pseudomonas aeruginosa PA01
accagcaggaucgagcccuggu

SEQ ID NO: 1453360 - RNA, 12 nt, Pseudomonas aeruginosa PA01
accagcaggccc

SEQ ID NO: 1453361 - RNA, 14 nt, Pseudomonas aeruginosa PA01
accagcaggccgau

SEQ ID NO: 1453362 - RNA, 23 nt, Pseudomonas aeruginosa PA01
accagcaggcgacaaaucggcau

SEQ ID NO: 1453363 - RNA, 18 nt, Pseudomonas aeruginosa PA01
accagcaggcccaguucg

SEQ ID NO: 1453364 - RNA, 13 nt, Pseudomonas aeruginosa PA01
accagcagccccg

SEQ ID NO: 1453365 - RNA, 20 nt, Pseudomonas aeruginosa PA01
accagcagccccgaggccag

SEQ ID NO: 1453366 - RNA, 15 nt, Pseudomonas aeruginosa PA01
accagcaccgccugc

SEQ ID NO: 1453367 - RNA, 15 nt, Pseudomonas aeruginosa PA01
accagcaccugcggg

SEQ ID NO: 1453368 - RNA, 16 nt, Pseudomonas aeruginosa PA01
accagcaccugcgggc

SEQ ID NO: 1453369 - RNA, 22 nt, Pseudomonas aeruginosa PA01
accagcacggcgaauucgucgc

SEQ ID NO: 1453370 - RNA, 15 nt, Pseudomonas aeruginosa PA01
accagcacguugcca

SEQ ID NO: 1453371 - RNA, 19 nt, Pseudomonas aeruginosa PA01
accagcaaugcccagcgca

SEQ ID NO: 1453372 - RNA, 20 nt, Pseudomonas aeruginosa PA01
accagcaaugcccagcgcag

SEQ ID NO: 1453373 - RNA, 20 nt, Pseudomonas aeruginosa PA01
accagcaacgggucgggcuc

SEQ ID NO: 1453374 - RNA, 13 nt, Pseudomonas aeruginosa PA01
accaccgcgccga

SEQ ID NO: 1453375 - RNA, 19 nt, Pseudomonas aeruginosa PA01
accaccgggccgucgggca

SEQ ID NO: 1453376 - RNA, 16 nt, Pseudomonas aeruginosa PA01
accaccgcgaauccgc

SEQ ID NO: 1453377 - RNA, 12 nt, Pseudomonas aeruginosa PA01
accaccgccagg

SEQ ID NO: 1453378 - RNA, 13 nt, Pseudomonas aeruginosa PA01
accaccgccaggc

SEQ ID NO: 1453379 - RNA, 23 nt, Pseudomonas aeruginosa PA01
accaccgagagcggcgccaggcg

SEQ ID NO: 1453380 - RNA, 17 nt, Pseudomonas aeruginosa PA01
accaccaggaaggcguc

SEQ ID NO: 1453381 - RNA, 13 nt, Pseudomonas aeruginosa PA01
accaccaggucgg

SEQ ID NO: 1453382 - RNA, 15 nt, Pseudomonas aeruginosa PA01
accaccaggucggcg

SEQ ID NO: 1453383 - RNA, 16 nt, Pseudomonas aeruginosa PA01
accaccaggucggcgc

SEQ ID NO: 1453384 - RNA, 11 nt, Pseudomonas aeruginosa PA01
accaccaggcg

SEQ ID NO: 1453385 - RNA, 13 nt, Pseudomonas aeruginosa PA01
accacccagccgc

SEQ ID NO: 1453386 - RNA, 19 nt, Pseudomonas aeruginosa PA01
accaccaugugcuggcgga

SEQ ID NO: 1453387 - RNA, 16 nt, Pseudomonas aeruginosa PA01
accacccgcagccccg

SEQ ID NO: 1453388 - RNA, 21 nt, Pseudomonas aeruginosa PA01
accacccggcgcacgccggcc

SEQ ID NO: 1453389 - RNA, 15 nt, Pseudomonas aeruginosa PA01
accaccgacgccgga

SEQ ID NO: 1453390 - RNA, 17 nt, Pseudomonas aeruginosa PA01
accacccuguccugcuc

SEQ ID NO: 1453391 - RNA, 14 nt, Pseudomonas aeruginosa PA01
accacccggcugca

SEQ ID NO: 1453392 - RNA, 19 nt, Pseudomonas aeruginosa PA01
accaccagcaggcccaguu

SEQ ID NO: 1453393 - RNA, 20 nt, Pseudomonas aeruginosa PA01
accaccagcaucagcaggaa

SEQ ID NO: 1453394 - RNA, 13 nt, Pseudomonas aeruginosa PA01
accaccagcgccg

SEQ ID NO: 1453395 - RNA, 15 nt, Pseudomonas aeruginosa PA01
accaccagcgccgcc

SEQ ID NO: 1453396 - RNA, 20 nt, Pseudomonas aeruginosa PA01
accaccagcgcgcgcuggcg

SEQ ID NO: 1453397 - RNA, 13 nt, Pseudomonas aeruginosa PA01
accaccaccgcgc

SEQ ID NO: 1453398 - RNA, 15 nt, Pseudomonas aeruginosa PA01
accaccaccgcgccg

SEQ ID NO: 1453399 - RNA, 22 nt, Pseudomonas aeruginosa PA01
accaccacgaucugcuugcgcg

SEQ ID NO: 1453400 - RNA, 14 nt, Pseudomonas aeruginosa PA01
accaccacucgcga

SEQ ID NO: 1453401 - RNA, 23 nt, Pseudomonas aeruginosa PA01
accaccacucgcgagcuggcgcc

SEQ ID NO: 1453402 - RNA, 22 nt, Pseudomonas aeruginosa PA01
accaccacgguguugccguggu

SEQ ID NO: 1453403 - RNA, 16 nt, Pseudomonas aeruginosa PA01
accacaugggcgaccg

SEQ ID NO: 1453404 - RNA, 19 nt, Pseudomonas aeruginosa PA01
accaccaccgacgccggac

SEQ ID NO: 1453405 - RNA, 21 nt, Pseudomonas aeruginosa PA01
accaaugccagugccucgcgc

SEQ ID NO: 1453406 - RNA, 14 nt, Pseudomonas aeruginosa PA01
accacagcaccacg

SEQ ID NO: 1453407 - RNA, 15 nt, Pseudomonas aeruginosa PA01
accacguagccggcg

SEQ ID NO: 1453408 - RNA, 22 nt, Pseudomonas aeruginosa PA01
accacgguguugccguggucgc

SEQ ID NO: 1453409 - RNA, 14 nt, Pseudomonas aeruginosa PA01
accacggugaucag

SEQ ID NO: 1453410 - RNA, 14 nt, Pseudomonas aeruginosa PA01
accacggcgaagcc

SEQ ID NO: 1453411 - RNA, 17 nt, Pseudomonas aeruginosa PA01
accacgcccugcgccag

SEQ ID NO: 1453412 - RNA, 18 nt, Pseudomonas aeruginosa PA01
accacgcccugcgccagc

SEQ ID NO: 1453413 - RNA, 14 nt, Pseudomonas aeruginosa PA01
accacgccugccau

SEQ ID NO: 1453414 - RNA, 17 nt, Pseudomonas aeruginosa PA01
accacgcgauauccgcc

SEQ ID NO: 1453415 - RNA, 14 nt, Pseudomonas aeruginosa PA01
accacgcgcaagcc

SEQ ID NO: 1453416 - RNA, 17 nt, Pseudomonas aeruginosa PA01
accacgcgcaagccagc

SEQ ID NO: 1453417 - RNA, 18 nt, Pseudomonas aeruginosa PA01
accacgcgcaagccagcc

SEQ ID NO: 1453418 - RNA, 16 nt, Pseudomonas aeruginosa PA01
accaccguggcgccgg

SEQ ID NO: 1453419 - RNA, 21 nt, Pseudomonas aeruginosa PA01
accaccguggcgccggcgcgc

SEQ ID NO: 1453420 - RNA, 19 nt, Pseudomonas aeruginosa PA01
accaccgugcccgccggcg

SEQ ID NO: 1453421 - RNA, 21 nt, Pseudomonas aeruginosa PA01
accaccgugcccgccggcgcg

SEQ ID NO: 1453422 - RNA, 22 nt, Pseudomonas aeruginosa PA01
accaccgugcccgccggcgcgc

SEQ ID NO: 1453423 - RNA, 12 nt, Pseudomonas aeruginosa PA01
accaccgguuug

SEQ ID NO: 1453424 - RNA, 15 nt, Pseudomonas aeruginosa PA01
accaccgucuggcgc

SEQ ID NO: 1453425 - RNA, 16 nt, Pseudomonas aeruginosa PA01
accaccucgacggcga

SEQ ID NO: 1453426 - RNA, 20 nt, Pseudomonas aeruginosa PA01
accaccucgacggcgaucuc

SEQ ID NO: 1453427 - RNA, 16 nt, Pseudomonas aeruginosa PA01
accaccucggcgucgg

SEQ ID NO: 1453428 - RNA, 17 nt, Pseudomonas aeruginosa PA01
accaccuggauggugcc

SEQ ID NO: 1453429 - RNA, 14 nt, Pseudomonas aeruginosa PA01
accaccuucaggcu

SEQ ID NO: 1453430 - RNA, 17 nt, Pseudomonas aeruginosa PA01
accacgcaggccagcgc

SEQ ID NO: 1453431 - RNA, 16 nt, Pseudomonas aeruginosa PA01
accacgaucaggcccu

SEQ ID NO: 1453432 - RNA, 15 nt, Pseudomonas aeruginosa PA01
accacgaagcgaccg

SEQ ID NO: 1453433 - RNA, 18 nt, Pseudomonas aeruginosa PA01
accggccaggcgcugguc

SEQ ID NO: 1453434 - RNA, 12 nt, Pseudomonas aeruginosa PA01
accggccagcgc

SEQ ID NO: 1453435 - RNA, 13 nt, Pseudomonas aeruginosa PA01
accggccagcgca

SEQ ID NO: 1453436 - RNA, 14 nt, Pseudomonas aeruginosa PA01
accggccagcgcau

SEQ ID NO: 1453437 - RNA, 14 nt, Pseudomonas aeruginosa PA01
accggccaucagca

SEQ ID NO: 1453438 - RNA, 17 nt, Pseudomonas aeruginosa PA01
accggccaucagcacca

SEQ ID NO: 1453439 - RNA, 22 nt, Pseudomonas aeruginosa PA01
accggcccggagaucgccgcgc

SEQ ID NO: 1453440 - RNA, 13 nt, Pseudomonas aeruginosa PA01
accggccgcagca

SEQ ID NO: 1453441 - RNA, 22 nt, Pseudomonas aeruginosa PA01
accggccgcagcagguucgaau

SEQ ID NO: 1453442 - RNA, 14 nt, Pseudomonas aeruginosa PA01
accggccucaagca

SEQ ID NO: 1453443 - RNA, 21 nt, Pseudomonas aeruginosa PA01
accggccucaagcaagcgauc

SEQ ID NO: 1453444 - RNA, 22 nt, Pseudomonas aeruginosa PA01
accggccucgacaucgucucgc

SEQ ID NO: 1453445 - RNA, 18 nt, Pseudomonas aeruginosa PA01
accggcgaaccagugcac

SEQ ID NO: 1453446 - RNA, 13 nt, Pseudomonas aeruginosa PA01
accggcagcagcg

SEQ ID NO: 1453447 - RNA, 22 nt, Pseudomonas aeruginosa PA01
accggcagggcgauccgcccgc

SEQ ID NO: 1453448 - RNA, 19 nt, Pseudomonas aeruginosa PA01
accggcagggucacgccgg

SEQ ID NO: 1453449 - RNA, 14 nt, Pseudomonas aeruginosa PA01
accggcaggucggg

SEQ ID NO: 1453450 - RNA, 14 nt, Pseudomonas aeruginosa PA01
accggcagcagcgg

SEQ ID NO: 1453451 - RNA, 23 nt, Pseudomonas aeruginosa PA01
accggcagcagcggaucggcggu

SEQ ID NO: 1453452 - RNA, 13 nt, Pseudomonas aeruginosa PA01
accggcagcgccg

SEQ ID NO: 1453453 - RNA, 18 nt, Pseudomonas aeruginosa PA01
accggcagcgccgagguc

SEQ ID NO: 1453454 - RNA, 17 nt, Pseudomonas aeruginosa PA01
accggcaggaucggcgc

SEQ ID NO: 1453455 - RNA, 23 nt, Pseudomonas aeruginosa PA01
accgcuuucaccagggucgccag

SEQ ID NO: 1453456 - RNA, 17 nt, Pseudomonas aeruginosa PA01
accgcuuucagcgccgc

SEQ ID NO: 1453457 - RNA, 19 nt, Pseudomonas aeruginosa PA01
accgcuuucguagggcgaa

SEQ ID NO: 1453458 - RNA, 19 nt, Pseudomonas aeruginosa PA01
accggaaaagaagccgcgc

SEQ ID NO: 1453459 - RNA, 20 nt, Pseudomonas aeruginosa PA01
accggaaaagaagccgcgca

SEQ ID NO: 1453460 - RNA, 17 nt, Pseudomonas aeruginosa PA01
accggaagcgaucuccu

SEQ ID NO: 1453461 - RNA, 16 nt, Pseudomonas aeruginosa PA01
accggcggauaaccgc

SEQ ID NO: 1453462 - RNA, 19 nt, Pseudomonas aeruginosa PA01
accggcggauaacgccugc

SEQ ID NO: 1453463 - RNA, 13 nt, Pseudomonas aeruginosa PA01
accggcggaugac

SEQ ID NO: 1453464 - RNA, 22 nt, Pseudomonas aeruginosa PA01
accggcggauuacuccgccggc

SEQ ID NO: 1453465 - RNA, 16 nt, Pseudomonas aeruginosa PA01
accggcgcggccagcu

SEQ ID NO: 1453466 - RNA, 14 nt, Pseudomonas aeruginosa PA01
accggcggcgccag

SEQ ID NO: 1453467 - RNA, 17 nt, Pseudomonas aeruginosa PA01
accggcggcgccaggcc

SEQ ID NO: 1453468 - RNA, 20 nt, Pseudomonas aeruginosa PA01
accggcggcgccaggccggc

SEQ ID NO: 1453469 - RNA, 22 nt, Pseudomonas aeruginosa PA01
accggcggcgccaggccggcga

SEQ ID NO: 1453470 - RNA, 14 nt, Pseudomonas aeruginosa PA01
accggcguccacuc

SEQ ID NO: 1453471 - RNA, 19 nt, Pseudomonas aeruginosa PA01
accggcguccacuccggca

SEQ ID NO: 1453472 - RNA, 20 nt, Pseudomonas aeruginosa PA01
accggcguccacuccggcag

SEQ ID NO: 1453473 - RNA, 13 nt, Pseudomonas aeruginosa PA01
accggcgccggga

SEQ ID NO: 1453474 - RNA, 19 nt, Pseudomonas aeruginosa PA01
accggcgccgccuggccgg

SEQ ID NO: 1453475 - RNA, 20 nt, Pseudomonas aeruginosa PA01
accggcgccgccuggccggu

SEQ ID NO: 1453476 - RNA, 15 nt, Pseudomonas aeruginosa PA01
accggcgcgccggac

SEQ ID NO: 1453477 - RNA, 13 nt, Pseudomonas aeruginosa PA01
accggcgccccug

SEQ ID NO: 1453478 - RNA, 17 nt, Pseudomonas aeruginosa PA01
accggcgccccugcggc

SEQ ID NO: 1453479 - RNA, 22 nt, Pseudomonas aeruginosa PA01
accggcgccccugcggcgccgg

SEQ ID NO: 1453480 - RNA, 17 nt, Pseudomonas aeruginosa PA01
accggcgaccaccgccg

SEQ ID NO: 1453481 - RNA, 18 nt, Pseudomonas aeruginosa PA01
accggcgaccaccgccgg

SEQ ID NO: 1453482 - RNA, 20 nt, Pseudomonas aeruginosa PA01
accggcgacgaaagacgcug

SEQ ID NO: 1453483 - RNA, 18 nt, Pseudomonas aeruginosa PA01
accggcgaugcucagcgc

SEQ ID NO: 1453484 - RNA, 16 nt, Pseudomonas aeruginosa PA01
accggcuggccgcgac

SEQ ID NO: 1453485 - RNA, 13 nt, Pseudomonas aeruginosa PA01
accggcuggcggc

SEQ ID NO: 1453486 - RNA, 11 nt, Pseudomonas aeruginosa PA01
accggcuggcc

SEQ ID NO: 1453487 - RNA, 16 nt, Pseudomonas aeruginosa PA01
accgggaucgcuaccg

SEQ ID NO: 1453488 - RNA, 14 nt, Pseudomonas aeruginosa PA01
accgggaucugccg

SEQ ID NO: 1453489 - RNA, 18 nt, Pseudomonas aeruginosa PA01
accgggaggcgccgcgcc

SEQ ID NO: 1453490 - RNA, 19 nt, Pseudomonas aeruginosa PA01
accgggaggcgccgcgcca

SEQ ID NO: 1453491 - RNA, 22 nt, Pseudomonas aeruginosa PA01
accggcuaucccccggccgaug

SEQ ID NO: 1453492 - RNA, 18 nt, Pseudomonas aeruginosa PA01
accggcuccagggcgaau

SEQ ID NO: 1453493 - RNA, 14 nt, Pseudomonas aeruginosa PA01
accggcucgucggc

SEQ ID NO: 1453494 - RNA, 14 nt, Pseudomonas aeruginosa PA01
accggcguccucgg

SEQ ID NO: 1453495 - RNA, 22 nt, Pseudomonas aeruginosa PA01
accggcgggauguacgccaggg

SEQ ID NO: 1453496 - RNA, 18 nt, Pseudomonas aeruginosa PA01
accggcguuauccgccga

SEQ ID NO: 1453497 - RNA, 19 nt, Pseudomonas aeruginosa PA01
accggcguuauccgccgau

SEQ ID NO: 1453498 - RNA, 22 nt, Pseudomonas aeruginosa PA01
accggcguugaacugcccgcag

SEQ ID NO: 1453499 - RNA, 14 nt, Pseudomonas aeruginosa PA01
accggcuacaggcc

SEQ ID NO: 1453500 - RNA, 16 nt, Pseudomonas aeruginosa PA01
accgccauggcgcuga

SEQ ID NO: 1453501 - RNA, 20 nt, Pseudomonas aeruginosa PA01
accgccaucgauggucaggc

SEQ ID NO: 1453502 - RNA, 17 nt, Pseudomonas aeruginosa PA01
accgcccccggcgccac

SEQ ID NO: 1453503 - RNA, 19 nt, Pseudomonas aeruginosa PA01
accgcccacccugcgcgag

SEQ ID NO: 1453504 - RNA, 21 nt, Pseudomonas aeruginosa PA01
accgcccacccugcgcgagga

SEQ ID NO: 1453505 - RNA, 14 nt, Pseudomonas aeruginosa PA01
accgccaccccgcc

SEQ ID NO: 1453506 - RNA, 14 nt, Pseudomonas aeruginosa PA01
accgccagggcgcu

SEQ ID NO: 1453507 - RNA, 18 nt, Pseudomonas aeruginosa PA01
accgccagggcgcucacc

SEQ ID NO: 1453508 - RNA, 22 nt, Pseudomonas aeruginosa PA01
accgccagggcgcucaccgagg

SEQ ID NO: 1453509 - RNA, 16 nt, Pseudomonas aeruginosa PA01
accgccaccugccccg

SEQ ID NO: 1453510 - RNA, 23 nt, Pseudomonas aeruginosa PA01
accgccaccuugcgucccugggc

SEQ ID NO: 1453511 - RNA, 16 nt, Pseudomonas aeruginosa PA01
accgccaaggucgguc

SEQ ID NO: 1453512 - RNA, 22 nt, Pseudomonas aeruginosa PA01
accgccaaggucggucucgcca

SEQ ID NO: 1453513 - RNA, 23 nt, Pseudomonas aeruginosa PA01
accgccaaggucggucucgccac

SEQ ID NO: 1453514 - RNA, 16 nt, Pseudomonas aeruginosa PA01
accgagcgcaguucgu

SEQ ID NO: 1453515 - RNA, 15 nt, Pseudomonas aeruginosa PA01
accgagcaugcgcgg

SEQ ID NO: 1453516 - RNA, 19 nt, Pseudomonas aeruginosa PA01
accgagauucugcaggcgc

SEQ ID NO: 1453517 - RNA, 22 nt, Pseudomonas aeruginosa PA01
accgagauucugcaggcgcucc

SEQ ID NO: 1453518 - RNA, 13 nt, Pseudomonas aeruginosa PA01
accgagaucaccu

SEQ ID NO: 1453519 - RNA, 14 nt, Pseudomonas aeruginosa PA01
accgagaucaccuu

SEQ ID NO: 1453520 - RNA, 16 nt, Pseudomonas aeruginosa PA01
accgccuggaccaggu

SEQ ID NO: 1453521 - RNA, 13 nt, Pseudomonas aeruginosa PA01
accgccuggcgca

SEQ ID NO: 1453522 - RNA, 21 nt, Pseudomonas aeruginosa PA01
accgccguacggguuucgcug

SEQ ID NO: 1453523 - RNA, 22 nt, Pseudomonas aeruginosa PA01
accgccuucgcguucgcuccgg

SEQ ID NO: 1453524 - RNA, 20 nt, Pseudomonas aeruginosa PA01
accgccuuggcaucgccgcc

SEQ ID NO: 1453525 - RNA, 22 nt, Pseudomonas aeruginosa PA01
accgccuuggcaucgccgccca

SEQ ID NO: 1453526 - RNA, 16 nt, Pseudomonas aeruginosa PA01
accgccuggucgccgg

SEQ ID NO: 1453527 - RNA, 12 nt, Pseudomonas aeruginosa PA01
accgccgccagc

SEQ ID NO: 1453528 - RNA, 14 nt, Pseudomonas aeruginosa PA01
accgccgccagcaa

SEQ ID NO: 1453529 - RNA, 20 nt, Pseudomonas aeruginosa PA01
accgccggguacagcgccac

SEQ ID NO: 1453530 - RNA, 15 nt, Pseudomonas aeruginosa PA01
accgccgagggcgcc

SEQ ID NO: 1453531 - RNA, 18 nt, Pseudomonas aeruginosa PA01
accgcggccucgcuggcg

SEQ ID NO: 1453532 - RNA, 16 nt, Pseudomonas aeruginosa PA01
accgcggcgagccggu

SEQ ID NO: 1453533 - RNA, 16 nt, Pseudomonas aeruginosa PA01
accgcgggcgaggucg

SEQ ID NO: 1453534 - RNA, 21 nt, Pseudomonas aeruginosa PA01
accgcggcgcccucugccggu

SEQ ID NO: 1453535 - RNA, 22 nt, Pseudomonas aeruginosa PA01
accgcggugugcuuguccacca

SEQ ID NO: 1453536 - RNA, 15 nt, Pseudomonas aeruginosa PA01
accgcggugucggug

SEQ ID NO: 1453537 - RNA, 19 nt, Pseudomonas aeruginosa PA01
accgcggugucggugcccu

SEQ ID NO: 1453538 - RNA, 20 nt, Pseudomonas aeruginosa PA01
accgcguccauccccgccuc

SEQ ID NO: 1453539 - RNA, 16 nt, Pseudomonas aeruginosa PA01
accgcuccggcgccga

SEQ ID NO: 1453540 - RNA, 15 nt, Pseudomonas aeruginosa PA01
accgcucgucaggcg

SEQ ID NO: 1453541 - RNA, 23 nt, Pseudomonas aeruginosa PA01
accgcucgucaggcgcucaggga

SEQ ID NO: 1453542 - RNA, 13 nt, Pseudomonas aeruginosa PA01
accgcucgccaga

SEQ ID NO: 1453543 - RNA, 22 nt, Pseudomonas aeruginosa PA01
accgcucgcgguuauccgccgc

SEQ ID NO: 1453544 - RNA, 14 nt, Pseudomonas aeruginosa PA01
accgcgccggcggu

SEQ ID NO: 1453545 - RNA, 13 nt, Pseudomonas aeruginosa PA01
accgcgcgcgcaa

SEQ ID NO: 1453546 - RNA, 19 nt, Pseudomonas aeruginosa PA01
accgcgcgcgcaaggccga

SEQ ID NO: 1453547 - RNA, 16 nt, Pseudomonas aeruginosa PA01
accgcggauccacgcc

SEQ ID NO: 1453548 - RNA, 21 nt, Pseudomonas aeruginosa PA01
accgcggauccacgccuggcc

SEQ ID NO: 1453549 - RNA, 13 nt, Pseudomonas aeruginosa PA01
accgcgccgcgcu

SEQ ID NO: 1453550 - RNA, 13 nt, Pseudomonas aeruginosa PA01
accgcgccggcga

SEQ ID NO: 1453551 - RNA, 14 nt, Pseudomonas aeruginosa PA01
accgcgacgcgcug

SEQ ID NO: 1453552 - RNA, 15 nt, Pseudomonas aeruginosa PA01
accgcgacgcgcugg

SEQ ID NO: 1453553 - RNA, 20 nt, Pseudomonas aeruginosa PA01
accgcgaauggcagcaggca

SEQ ID NO: 1453554 - RNA, 21 nt, Pseudomonas aeruginosa PA01
accgcgaagcgguuagccggc

SEQ ID NO: 1453555 - RNA, 23 nt, Pseudomonas aeruginosa PA01
accgcgaagcgguuagccggcga

SEQ ID NO: 1453556 - RNA, 12 nt, Pseudomonas aeruginosa PA01
acccgccgcugg

SEQ ID NO: 1453557 - RNA, 19 nt, Pseudomonas aeruginosa PA01
acccgcccuugcucgcggc

SEQ ID NO: 1453558 - RNA, 18 nt, Pseudomonas aeruginosa PA01
acccgccgaccggacucc

SEQ ID NO: 1453559 - RNA, 18 nt, Pseudomonas aeruginosa PA01
acccggauaccccgguug

SEQ ID NO: 1453560 - RNA, 15 nt, Pseudomonas aeruginosa PA01
acccggccugggccg

SEQ ID NO: 1453561 - RNA, 23 nt, Pseudomonas aeruginosa PA01
acccggcgcacgccggccucgcg

SEQ ID NO: 1453562 - RNA, 11 nt, Pseudomonas aeruginosa PA01
acccggcgccc

SEQ ID NO: 1453563 - RNA, 17 nt, Pseudomonas aeruginosa PA01
acccggcgccccggccc

SEQ ID NO: 1453564 - RNA, 22 nt, Pseudomonas aeruginosa PA01
acccggcgccgcuagggcgccc

SEQ ID NO: 1453565 - RNA, 17 nt, Pseudomonas aeruginosa PA01
acccggcgguccgccgc

SEQ ID NO: 1453566 - RNA, 20 nt, Pseudomonas aeruginosa PA01
acccggccagcccggccucg

SEQ ID NO: 1453567 - RNA, 21 nt, Pseudomonas aeruginosa PA01
acccggccagcccggccucgc

SEQ ID NO: 1453568 - RNA, 22 nt, Pseudomonas aeruginosa PA01
acccggcccagcguucggcgcu

SEQ ID NO: 1453569 - RNA, 20 nt, Pseudomonas aeruginosa PA01
acccggccgccuuccucggc

SEQ ID NO: 1453570 - RNA, 17 nt, Pseudomonas aeruginosa PA01
acccggcccauggcgac

SEQ ID NO: 1453571 - RNA, 14 nt, Pseudomonas aeruginosa PA01
acccgggucaggcc

SEQ ID NO: 1453572 - RNA, 17 nt, Pseudomonas aeruginosa PA01
acccgggucaggccgag

SEQ ID NO: 1453573 - RNA, 19 nt, Pseudomonas aeruginosa PA01
acccgguacuccuccagca

SEQ ID NO: 1453574 - RNA, 21 nt, Pseudomonas aeruginosa PA01
acccgguacuccuccagcauc

SEQ ID NO: 1453575 - RNA, 17 nt, Pseudomonas aeruginosa PA01
acccgguagccgaucaa

SEQ ID NO: 1453576 - RNA, 21 nt, Pseudomonas aeruginosa PA01
acccgggugccuuccgcgccc

SEQ ID NO: 1453577 - RNA, 22 nt, Pseudomonas aeruginosa PA01
acccgggugccuuccgcgccca

SEQ ID NO: 1453578 - RNA, 19 nt, Pseudomonas aeruginosa PA01
acccggguuuccugcccga

SEQ ID NO: 1453579 - RNA, 21 nt, Pseudomonas aeruginosa PA01
acccgguccugcaacuggaag

SEQ ID NO: 1453580 - RNA, 22 nt, Pseudomonas aeruginosa PA01
acccgguccugcaacuggaagg

SEQ ID NO: 1453581 - RNA, 17 nt, Pseudomonas aeruginosa PA01
acccgguacagcgccug

SEQ ID NO: 1453582 - RNA, 18 nt, Pseudomonas aeruginosa PA01
acccgguacagcgccugg

SEQ ID NO: 1453583 - RNA, 21 nt, Pseudomonas aeruginosa PA01
acccgguacagcgccuggucg

SEQ ID NO: 1453584 - RNA, 13 nt, Pseudomonas aeruginosa PA01
acccggucgcgcu

SEQ ID NO: 1453585 - RNA, 14 nt, Pseudomonas aeruginosa PA01
acccggucgcgcug

SEQ ID NO: 1453586 - RNA, 19 nt, Pseudomonas aeruginosa PA01
acccgggcgaccugcucgc

SEQ ID NO: 1453587 - RNA, 17 nt, Pseudomonas aeruginosa PA01
acccgggcccaagccga

SEQ ID NO: 1453588 - RNA, 21 nt, Pseudomonas aeruginosa PA01
acccgggcccaagccgagcgg

SEQ ID NO: 1453589 - RNA, 21 nt, Pseudomonas aeruginosa PA01
acccggcuggguucggcgagg

SEQ ID NO: 1453590 - RNA, 16 nt, Pseudomonas aeruginosa PA01
acccggcgcggcgcag

SEQ ID NO: 1453591 - RNA, 12 nt, Pseudomonas aeruginosa PA01
accgacgcucgc

SEQ ID NO: 1453592 - RNA, 15 nt, Pseudomonas aeruginosa PA01
accgacgcucgcggc

SEQ ID NO: 1453593 - RNA, 21 nt, Pseudomonas aeruginosa PA01
accgacgugcaaaugcgcaac

SEQ ID NO: 1453594 - RNA, 19 nt, Pseudomonas aeruginosa PA01
accgacggcuccggauggc

SEQ ID NO: 1453595 - RNA, 19 nt, Pseudomonas aeruginosa PA01
accgacgggucgccauggu

SEQ ID NO: 1453596 - RNA, 17 nt, Pseudomonas aeruginosa PA01
accgacggucggcaggu

SEQ ID NO: 1453597 - RNA, 12 nt, Pseudomonas aeruginosa PA01
accgacuggccg

SEQ ID NO: 1453598 - RNA, 16 nt, Pseudomonas aeruginosa PA01
acccuugcgcccggcu

SEQ ID NO: 1453599 - RNA, 16 nt, Pseudomonas aeruginosa PA01
acccuuggagccgccc

SEQ ID NO: 1453600 - RNA, 13 nt, Pseudomonas aeruginosa PA01
accgaaacagggc

SEQ ID NO: 1453601 - RNA, 20 nt, Pseudomonas aeruginosa PA01
acccugcugcugcucagcgc

SEQ ID NO: 1453602 - RNA, 21 nt, Pseudomonas aeruginosa PA01
acccuguccccucacggcgcg

SEQ ID NO: 1453603 - RNA, 18 nt, Pseudomonas aeruginosa PA01
acccugggagccgccgga

SEQ ID NO: 1453604 - RNA, 23 nt, Pseudomonas aeruginosa PA01
acccuggccggccucggcggcgc

SEQ ID NO: 1453605 - RNA, 13 nt, Pseudomonas aeruginosa PA01
acccugcgcgagg

SEQ ID NO: 1453606 - RNA, 16 nt, Pseudomonas aeruginosa PA01
acccgguuaccggcga

SEQ ID NO: 1453607 - RNA, 13 nt, Pseudomonas aeruginosa PA01
acccgguugccga

SEQ ID NO: 1453608 - RNA, 23 nt, Pseudomonas aeruginosa PA01
acccggucggccuguucgcccaa

SEQ ID NO: 1453609 - RNA, 15 nt, Pseudomonas aeruginosa PA01
acccgucccgcgcgc

SEQ ID NO: 1453610 - RNA, 16 nt, Pseudomonas aeruginosa PA01
acccgugcgccccagc

SEQ ID NO: 1453611 - RNA, 17 nt, Pseudomonas aeruginosa PA01
acccgugcgccccagcu

SEQ ID NO: 1453612 - RNA, 17 nt, Pseudomonas aeruginosa PA01
acccgugguccgccagc

SEQ ID NO: 1453613 - RNA, 12 nt, Pseudomonas aeruginosa PA01
acccucggcgag

SEQ ID NO: 1453614 - RNA, 14 nt, Pseudomonas aeruginosa PA01
acccucggcgaggg

SEQ ID NO: 1453615 - RNA, 22 nt, Pseudomonas aeruginosa PA01
acccugcacccuuggcgcaggu

SEQ ID NO: 1453616 - RNA, 20 nt, Pseudomonas aeruginosa PA01
acccugaccgcgagcgccgc

SEQ ID NO: 1453617 - RNA, 16 nt, Pseudomonas aeruginosa PA01
acccucaggucggcgc

SEQ ID NO: 1453618 - RNA, 18 nt, Pseudomonas aeruginosa PA01
acccguuccuugcgcggc

SEQ ID NO: 1453619 - RNA, 19 nt, Pseudomonas aeruginosa PA01
acccguucgccggccucca

SEQ ID NO: 1453620 - RNA, 22 nt, Pseudomonas aeruginosa PA01
accagcuugaugcuuucgaagc

SEQ ID NO: 1453621 - RNA, 14 nt, Pseudomonas aeruginosa PA01
accagcucgaagcc

SEQ ID NO: 1453622 - RNA, 20 nt, Pseudomonas aeruginosa PA01
accagcucgaagccgccguu

SEQ ID NO: 1453623 - RNA, 15 nt, Pseudomonas aeruginosa PA01
accagcuugucgccu

SEQ ID NO: 1453624 - RNA, 18 nt, Pseudomonas aeruginosa PA01
accaggaagccccagaag

SEQ ID NO: 1453625 - RNA, 14 nt, Pseudomonas aeruginosa PA01
accaggaaggccgg

SEQ ID NO: 1453626 - RNA, 17 nt, Pseudomonas aeruginosa PA01
accaggaaggccgggcc

SEQ ID NO: 1453627 - RNA, 14 nt, Pseudomonas aeruginosa PA01
accaggaucaccuu

SEQ ID NO: 1453628 - RNA, 17 nt, Pseudomonas aeruginosa PA01
accaggacccagaugau

SEQ ID NO: 1453629 - RNA, 13 nt, Pseudomonas aeruginosa PA01
accaggagcgcca

SEQ ID NO: 1453630 - RNA, 16 nt, Pseudomonas aeruginosa PA01
accaggagcgccagca

SEQ ID NO: 1453631 - RNA, 19 nt, Pseudomonas aeruginosa PA01
accaggccaggcugcgcuu

SEQ ID NO: 1453632 - RNA, 21 nt, Pseudomonas aeruginosa PA01
accaggccauagcgcgccggg

SEQ ID NO: 1453633 - RNA, 15 nt, Pseudomonas aeruginosa PA01
acccagaccugccgc

SEQ ID NO: 1453634 - RNA, 13 nt, Pseudomonas aeruginosa PA01
acccagagcgcgc

SEQ ID NO: 1453635 - RNA, 15 nt, Pseudomonas aeruginosa PA01
acccagagcgcgccc

SEQ ID NO: 1453636 - RNA, 17 nt, Pseudomonas aeruginosa PA01
acccaguagggcccgug

SEQ ID NO: 1453637 - RNA, 15 nt, Pseudomonas aeruginosa PA01
acccagguggucgac

SEQ ID NO: 1453638 - RNA, 20 nt, Pseudomonas aeruginosa PA01
acccagguucuggucgccga

SEQ ID NO: 1453639 - RNA, 21 nt, Pseudomonas aeruginosa PA01
acccagguucuggucgccgac

SEQ ID NO: 1453640 - RNA, 22 nt, Pseudomonas aeruginosa PA01
acccagguucuggucgccgaca

SEQ ID NO: 1453641 - RNA, 16 nt, Pseudomonas aeruginosa PA01
acccaggccgcgcagc

SEQ ID NO: 1453642 - RNA, 24 nt, Pseudomonas aeruginosa PA01
acccaggccgcgcagcaacggcgc

SEQ ID NO: 1453643 - RNA, 14 nt, Pseudomonas aeruginosa PA01
acccaggccacgcc

SEQ ID NO: 1453644 - RNA, 15 nt, Pseudomonas aeruginosa PA01
acccaggcccagccg

SEQ ID NO: 1453645 - RNA, 15 nt, Pseudomonas aeruginosa PA01
acccaggccgacagc

SEQ ID NO: 1453646 - RNA, 18 nt, Pseudomonas aeruginosa PA01
acccaggcuucggcgcgc

SEQ ID NO: 1453647 - RNA, 18 nt, Pseudomonas aeruginosa PA01
acccagucuucgcuggcg

SEQ ID NO: 1453648 - RNA, 19 nt, Pseudomonas aeruginosa PA01
acccagucuucgcuggcga

SEQ ID NO: 1453649 - RNA, 18 nt, Pseudomonas aeruginosa PA01
acccaguugggccaggag

SEQ ID NO: 1453650 - RNA, 13 nt, Pseudomonas aeruginosa PA01
acccgcagcggca

SEQ ID NO: 1453651 - RNA, 19 nt, Pseudomonas aeruginosa PA01
acccgcagccccgccggaa

SEQ ID NO: 1453652 - RNA, 18 nt, Pseudomonas aeruginosa PA01
acccgcccucguggcggg

SEQ ID NO: 1453653 - RNA, 16 nt, Pseudomonas aeruginosa PA01
acccgcacggcgacgc

SEQ ID NO: 1453654 - RNA, 21 nt, Pseudomonas aeruginosa PA01
accccugggaugccgccaagc

SEQ ID NO: 1453655 - RNA, 23 nt, Pseudomonas aeruginosa PA01
accccuucgagcaacacaugcag

SEQ ID NO: 1453656 - RNA, 21 nt, Pseudomonas aeruginosa PA01
acccgaaagccgaagcgcgag

SEQ ID NO: 1453657 - RNA, 14 nt, Pseudomonas aeruginosa PA01
acccgacaggcagc

SEQ ID NO: 1453658 - RNA, 16 nt, Pseudomonas aeruginosa PA01
acccgacaggcagcgc

SEQ ID NO: 1453659 - RNA, 21 nt, Pseudomonas aeruginosa PA01
accccuugcagccagccgucg

SEQ ID NO: 1453660 - RNA, 21 nt, Pseudomonas aeruginosa PA01
accccaggaaaacaucacggc

SEQ ID NO: 1453661 - RNA, 15 nt, Pseudomonas aeruginosa PA01
accccaggggucggc

SEQ ID NO: 1453662 - RNA, 16 nt, Pseudomonas aeruginosa PA01
accccaggggucggca

SEQ ID NO: 1453663 - RNA, 14 nt, Pseudomonas aeruginosa PA01
accccaggguuggc

SEQ ID NO: 1453664 - RNA, 17 nt, Pseudomonas aeruginosa PA01
accccaggguuggcggc

SEQ ID NO: 1453665 - RNA, 15 nt, Pseudomonas aeruginosa PA01
accccgccgcuggcg

SEQ ID NO: 1453666 - RNA, 16 nt, Pseudomonas aeruginosa PA01
accccgccgcuggcgg

SEQ ID NO: 1453667 - RNA, 15 nt, Pseudomonas aeruginosa PA01
accccgccaaggcgg

SEQ ID NO: 1453668 - RNA, 22 nt, Pseudomonas aeruginosa PA01
accccgccgcgcaucaccccgc

SEQ ID NO: 1453669 - RNA, 17 nt, Pseudomonas aeruginosa PA01
accccgggucgcgcagc

SEQ ID NO: 1453670 - RNA, 22 nt, Pseudomonas aeruginosa PA01
accccgggucgcgcagcggcuc

SEQ ID NO: 1453671 - RNA, 22 nt, Pseudomonas aeruginosa PA01
accccggucaggccgaucacca

SEQ ID NO: 1453672 - RNA, 18 nt, Pseudomonas aeruginosa PA01
accccggucauggugccg

SEQ ID NO: 1453673 - RNA, 23 nt, Pseudomonas aeruginosa PA01
accccggucauggugccgagcag

SEQ ID NO: 1453674 - RNA, 18 nt, Pseudomonas aeruginosa PA01
accccggugugcgcugca

SEQ ID NO: 1453675 - RNA, 16 nt, Pseudomonas aeruginosa PA01
accccguagcgcucgg

SEQ ID NO: 1453676 - RNA, 20 nt, Pseudomonas aeruginosa PA01
accccgucgacgcccugggc

SEQ ID NO: 1453677 - RNA, 14 nt, Pseudomonas aeruginosa PA01
aagcugcacggcga

SEQ ID NO: 1453678 - RNA, 16 nt, Pseudomonas aeruginosa PA01
aagcugcacggcgacc

SEQ ID NO: 1453679 - RNA, 20 nt, Pseudomonas aeruginosa PA01
aagcugccccacaggcccug

SEQ ID NO: 1453680 - RNA, 22 nt, Pseudomonas aeruginosa PA01
aagcugaggccgguguagcgac

SEQ ID NO: 1453681 - RNA, 20 nt, Pseudomonas aeruginosa PA01
aagcucucgccgcgcucgcg

SEQ ID NO: 1453682 - RNA, 21 nt, Pseudomonas aeruginosa PA01
aagcggccgagauccugcagc

SEQ ID NO: 1453683 - RNA, 19 nt, Pseudomonas aeruginosa PA01
aagcucgacgagccgcgac

SEQ ID NO: 1453684 - RNA, 21 nt, Pseudomonas aeruginosa PA01
aagcuccccgccgccaggcgc

SEQ ID NO: 1453685 - RNA, 13 nt, Pseudomonas aeruginosa PA01
aagcucggcagca

SEQ ID NO: 1453686 - RNA, 22 nt, Pseudomonas aeruginosa PA01
aagcgcgccugcucuucggcgg

SEQ ID NO: 1453687 - RNA, 21 nt, Pseudomonas aeruginosa PA01
aagcgcgaguaguaggucggu

SEQ ID NO: 1453688 - RNA, 12 nt, Pseudomonas aeruginosa PA01
aagcgccgggcc

SEQ ID NO: 1453689 - RNA, 16 nt, Pseudomonas aeruginosa PA01
aagcgccgggccgcau

SEQ ID NO: 1453690 - RNA, 13 nt, Pseudomonas aeruginosa PA01
aagcgcuccggca

SEQ ID NO: 1453691 - RNA, 19 nt, Pseudomonas aeruginosa PA01
aagcgcucggccugcgucg

SEQ ID NO: 1453692 - RNA, 18 nt, Pseudomonas aeruginosa PA01
aagcgugggcggccggcc

SEQ ID NO: 1453693 - RNA, 19 nt, Pseudomonas aeruginosa PA01
aagcgugggcggccggcca

SEQ ID NO: 1453694 - RNA, 15 nt, Pseudomonas aeruginosa PA01
aagcgucgugcgccg

SEQ ID NO: 1453695 - RNA, 18 nt, Pseudomonas aeruginosa PA01
aagcgucgugcgccggcc

SEQ ID NO: 1453696 - RNA, 19 nt, Pseudomonas aeruginosa PA01
aagcgucgugcgccggccu

SEQ ID NO: 1453697 - RNA, 22 nt, Pseudomonas aeruginosa PA01
aagcggcaauguccgagcaggu

SEQ ID NO: 1453698 - RNA, 16 nt, Pseudomonas aeruginosa PA01
aagcggaucucgucgc

SEQ ID NO: 1453699 - RNA, 21 nt, Pseudomonas aeruginosa PA01
aagcggaucucgucgccgacc

SEQ ID NO: 1453700 - RNA, 18 nt, Pseudomonas aeruginosa PA01
aagccuggagcagggcgc

SEQ ID NO: 1453701 - RNA, 14 nt, Pseudomonas aeruginosa PA01
aagccuggccggcg

SEQ ID NO: 1453702 - RNA, 15 nt, Pseudomonas aeruginosa PA01
aagccuggccggcga

SEQ ID NO: 1453703 - RNA, 21 nt, Pseudomonas aeruginosa PA01
aagcccggccgcugccgggcu

SEQ ID NO: 1453704 - RNA, 16 nt, Pseudomonas aeruginosa PA01
aagcccggccuggugc

SEQ ID NO: 1453705 - RNA, 22 nt, Pseudomonas aeruginosa PA01
aagcccggccuggugccgggcu

SEQ ID NO: 1453706 - RNA, 13 nt, Pseudomonas aeruginosa PA01
aagcccgcuccgu

SEQ ID NO: 1453707 - RNA, 18 nt, Pseudomonas aeruginosa PA01
aagcgacugcgcuggccg

SEQ ID NO: 1453708 - RNA, 13 nt, Pseudomonas aeruginosa PA01
aagcgagcgcccg

SEQ ID NO: 1453709 - RNA, 17 nt, Pseudomonas aeruginosa PA01
aagcccaggcugacccg

SEQ ID NO: 1453710 - RNA, 12 nt, Pseudomonas aeruginosa PA01
aagcccagcgcc

SEQ ID NO: 1453711 - RNA, 13 nt, Pseudomonas aeruginosa PA01
aagcccagcgccg

SEQ ID NO: 1453712 - RNA, 19 nt, Pseudomonas aeruginosa PA01
aagcccagguacugggcga

SEQ ID NO: 1453713 - RNA, 16 nt, Pseudomonas aeruginosa PA01
aagcccaucgacugca

SEQ ID NO: 1453714 - RNA, 15 nt, Pseudomonas aeruginosa PA01
aagccccugcgccuc

SEQ ID NO: 1453715 - RNA, 19 nt, Pseudomonas aeruginosa PA01
aagcccgcacgaggcgggc

SEQ ID NO: 1453716 - RNA, 18 nt, Pseudomonas aeruginosa PA01
aagcccgccagguggcgg

SEQ ID NO: 1453717 - RNA, 13 nt, Pseudomonas aeruginosa PA01
aagcauggccggc

SEQ ID NO: 1453718 - RNA, 14 nt, Pseudomonas aeruginosa PA01
aagcauggccggcu

SEQ ID NO: 1453719 - RNA, 23 nt, Pseudomonas aeruginosa PA01
aagcagggcgauggccagcgcgu

SEQ ID NO: 1453720 - RNA, 22 nt, Pseudomonas aeruginosa PA01
aagauggcuaaacaagccaccu

SEQ ID NO: 1453721 - RNA, 17 nt, Pseudomonas aeruginosa PA01
aagauguucgccgccgc

SEQ ID NO: 1453722 - RNA, 17 nt, Pseudomonas aeruginosa PA01
aagcacggcucggcgag

SEQ ID NO: 1453723 - RNA, 16 nt, Pseudomonas aeruginosa PA01
aagcagaaagccccug

SEQ ID NO: 1453724 - RNA, 13 nt, Pseudomonas aeruginosa PA01
aacuagcccucga

SEQ ID NO: 1453725 - RNA, 11 nt, Pseudomonas aeruginosa PA01
aagagcgccgc

SEQ ID NO: 1453726 - RNA, 15 nt, Pseudomonas aeruginosa PA01
aagcugucggcccgc

SEQ ID NO: 1453727 - RNA, 16 nt, Pseudomonas aeruginosa PA01
aagcugucggcccgcg

SEQ ID NO: 1453728 - RNA, 21 nt, Pseudomonas aeruginosa PA01
aaggcgagggugaacuggccg

SEQ ID NO: 1453729 - RNA, 12 nt, Pseudomonas aeruginosa PA01
aaggcgaucacg

SEQ ID NO: 1453730 - RNA, 18 nt, Pseudomonas aeruginosa PA01
aaggcgaucaucgccacc

SEQ ID NO: 1453731 - RNA, 22 nt, Pseudomonas aeruginosa PA01
aaggcgaucccguagaccggcu

SEQ ID NO: 1453732 - RNA, 21 nt, Pseudomonas aeruginosa PA01
aaggcgaucgaaggaucgccu

SEQ ID NO: 1453733 - RNA, 22 nt, Pseudomonas aeruginosa PA01
aaggcgauguaggucaccgcgc

SEQ ID NO: 1453734 - RNA, 16 nt, Pseudomonas aeruginosa PA01
aagcuuuuccagcgca

SEQ ID NO: 1453735 - RNA, 21 nt, Pseudomonas aeruginosa PA01
aagcuuuuccagcgcaccgcc

SEQ ID NO: 1453736 - RNA, 20 nt, Pseudomonas aeruginosa PA01
aaggaccagcuuguggccgg

SEQ ID NO: 1453737 - RNA, 13 nt, Pseudomonas aeruginosa PA01
aaggcguccaggg

SEQ ID NO: 1453738 - RNA, 15 nt, Pseudomonas aeruginosa PA01
aagggacgucgccag

SEQ ID NO: 1453739 - RNA, 16 nt, Pseudomonas aeruginosa PA01
aaggcgugggcgccgg

SEQ ID NO: 1453740 - RNA, 15 nt, Pseudomonas aeruginosa PA01
aagggaugccggcgg

SEQ ID NO: 1453741 - RNA, 17 nt, Pseudomonas aeruginosa PA01
aagggaugccggcggca

SEQ ID NO: 1453742 - RNA, 19 nt, Pseudomonas aeruginosa PA01
aagggaacccgcggcgcgc

SEQ ID NO: 1453743 - RNA, 12 nt, Pseudomonas aeruginosa PA01
aagggcgccgcc

SEQ ID NO: 1453744 - RNA, 20 nt, Pseudomonas aeruginosa PA01
aaggcggugaccagcggcac

SEQ ID NO: 1453745 - RNA, 18 nt, Pseudomonas aeruginosa PA01
aaggcggcgaagucugcc

SEQ ID NO: 1453746 - RNA, 13 nt, Pseudomonas aeruginosa PA01
aaggcgcuggcgc

SEQ ID NO: 1453747 - RNA, 11 nt, Pseudomonas aeruginosa PA01
aaggcgcuggg

SEQ ID NO: 1453748 - RNA, 21 nt, Pseudomonas aeruginosa PA01
aaggcgcugggcggcuggccg

SEQ ID NO: 1453749 - RNA, 17 nt, Pseudomonas aeruginosa PA01
aaggagacucagcgcga

SEQ ID NO: 1453750 - RNA, 13 nt, Pseudomonas aeruginosa PA01
aaggcgccggcau

SEQ ID NO: 1453751 - RNA, 15 nt, Pseudomonas aeruginosa PA01
aaggcgcgcagggcc

SEQ ID NO: 1453752 - RNA, 21 nt, Pseudomonas aeruginosa PA01
aaggcgcgcagggccgcggcg

SEQ ID NO: 1453753 - RNA, 20 nt, Pseudomonas aeruginosa PA01
aaggguuccucucgucaggg

SEQ ID NO: 1453754 - RNA, 22 nt, Pseudomonas aeruginosa PA01
aaggguuggccgcagcagcggc

SEQ ID NO: 1453755 - RNA, 13 nt, Pseudomonas aeruginosa PA01
aagggugucgggg

SEQ ID NO: 1453756 - RNA, 15 nt, Pseudomonas aeruginosa PA01
aaguaccgccggcag

SEQ ID NO: 1453757 - RNA, 19 nt, Pseudomonas aeruginosa PA01
aaguagcgacggaagcccu

SEQ ID NO: 1453758 - RNA, 14 nt, Pseudomonas aeruginosa PA01
aaguagaagcgcgc

SEQ ID NO: 1453759 - RNA, 17 nt, Pseudomonas aeruginosa PA01
aaguauuucaaccaggc

SEQ ID NO: 1453760 - RNA, 18 nt, Pseudomonas aeruginosa PA01
aauacaccgcugcgccgc

SEQ ID NO: 1453761 - RNA, 21 nt, Pseudomonas aeruginosa PA01
aauacaccgcugcgccgccgu

SEQ ID NO: 1453762 - RNA, 23 nt, Pseudomonas aeruginosa PA01
aauacaccuuggugucgaugccg

SEQ ID NO: 1453763 - RNA, 15 nt, Pseudomonas aeruginosa PA01
aauacccgccgcugg

SEQ ID NO: 1453764 - RNA, 21 nt, Pseudomonas aeruginosa PA01
aagucgaucagcgcgcggacc

SEQ ID NO: 1453765 - RNA, 23 nt, Pseudomonas aeruginosa PA01
aagucccauugcaucugcgccgg

SEQ ID NO: 1453766 - RNA, 17 nt, Pseudomonas aeruginosa PA01
aaguccuggccgagcau

SEQ ID NO: 1453767 - RNA, 15 nt, Pseudomonas aeruginosa PA01
aaguccgggcgcggc

SEQ ID NO: 1453768 - RNA, 20 nt, Pseudomonas aeruginosa PA01
aauggccgcuucaagcggcc

SEQ ID NO: 1453769 - RNA, 15 nt, Pseudomonas aeruginosa PA01
aauggcagcaggcac

SEQ ID NO: 1453770 - RNA, 16 nt, Pseudomonas aeruginosa PA01
aaugguggaccagcgc

SEQ ID NO: 1453771 - RNA, 16 nt, Pseudomonas aeruginosa PA01
aauggaacagucgcgc

SEQ ID NO: 1453772 - RNA, 18 nt, Pseudomonas aeruginosa PA01
aauggcaacccagggcgc

SEQ ID NO: 1453773 - RNA, 21 nt, Pseudomonas aeruginosa PA01
aauggcaacccagggcgcugc

SEQ ID NO: 1453774 - RNA, 17 nt, Pseudomonas aeruginosa PA01
aauggcagaacaucgcc

SEQ ID NO: 1453775 - RNA, 21 nt, Pseudomonas aeruginosa PA01
aaucugcagggcaucgcgcau

SEQ ID NO: 1453776 - RNA, 23 nt, Pseudomonas aeruginosa PA01
aaugccgcaccccauccucgccg

SEQ ID NO: 1453777 - RNA, 19 nt, Pseudomonas aeruginosa PA01
aaugccggccggggccggc

SEQ ID NO: 1453778 - RNA, 21 nt, Pseudomonas aeruginosa PA01
aaugccggccggggccggcac

SEQ ID NO: 1453779 - RNA, 17 nt, Pseudomonas aeruginosa PA01
aauguccggcgaccacc

SEQ ID NO: 1453780 - RNA, 19 nt, Pseudomonas aeruginosa PA01
aauguccggcgaccaccac

SEQ ID NO: 1453781 - RNA, 22 nt, Pseudomonas aeruginosa PA01
aaucgguuggggaggugcggcg

SEQ ID NO: 1453782 - RNA, 20 nt, Pseudomonas aeruginosa PA01
aaucgcucaacggcgugccg

SEQ ID NO: 1453783 - RNA, 20 nt, Pseudomonas aeruginosa PA01
aaucgcgcaacggcagcgcu

SEQ ID NO: 1453784 - RNA, 17 nt, Pseudomonas aeruginosa PA01
aaucgucacggcgugcc

SEQ ID NO: 1453785 - RNA, 18 nt, Pseudomonas aeruginosa PA01
aaucgucacggcgugccg

SEQ ID NO: 1453786 - RNA, 19 nt, Pseudomonas aeruginosa PA01
aaucgucacggcgugccgc

SEQ ID NO: 1453787 - RNA, 23 nt, Pseudomonas aeruginosa PA01
aaucgucgccggaggggcggccg

SEQ ID NO: 1453788 - RNA, 16 nt, Pseudomonas aeruginosa PA01
aaucgaugucgcggcg

SEQ ID NO: 1453789 - RNA, 22 nt, Pseudomonas aeruginosa PA01
aaucgccucccuggcgacgucc

SEQ ID NO: 1453790 - RNA, 15 nt, Pseudomonas aeruginosa PA01
aaucgccagcaggcu

SEQ ID NO: 1453791 - RNA, 21 nt, Pseudomonas aeruginosa PA01
aaucgagcugcucgauggcgg

SEQ ID NO: 1453792 - RNA, 16 nt, Pseudomonas aeruginosa PA01
aauccucggugcgcac

SEQ ID NO: 1453793 - RNA, 17 nt, Pseudomonas aeruginosa PA01
aauccuuccgucgucac

SEQ ID NO: 1453794 - RNA, 16 nt, Pseudomonas aeruginosa PA01
aauccuucgcggcggc

SEQ ID NO: 1453795 - RNA, 15 nt, Pseudomonas aeruginosa PA01
aauccggcgcugccg

SEQ ID NO: 1453796 - RNA, 17 nt, Pseudomonas aeruginosa PA01
aauccggcgcugccgaa

SEQ ID NO: 1453797 - RNA, 16 nt, Pseudomonas aeruginosa PA01
aaucagcggcgggcgg

SEQ ID NO: 1453798 - RNA, 14 nt, Pseudomonas aeruginosa PA01
aauagccggcgcug

SEQ ID NO: 1453799 - RNA, 18 nt, Pseudomonas aeruginosa PA01
aauagcgccgcaggcgcu

SEQ ID NO: 1453800 - RNA, 14 nt, Pseudomonas aeruginosa PA01
aauaggcgcugcgg

SEQ ID NO: 1453801 - RNA, 13 nt, Pseudomonas aeruginosa PA01
aauagggcggcgc

SEQ ID NO: 1453802 - RNA, 17 nt, Pseudomonas aeruginosa PA01
aaucaucgcgucgccga

SEQ ID NO: 1453803 - RNA, 18 nt, Pseudomonas aeruginosa PA01
aaucauccacaggcggcu

SEQ ID NO: 1453804 - RNA, 17 nt, Pseudomonas aeruginosa PA01
aauccaccuugccgcgc

SEQ ID NO: 1453805 - RNA, 22 nt, Pseudomonas aeruginosa PA01
aauccagggagaacagcagggu

SEQ ID NO: 1453806 - RNA, 22 nt, Pseudomonas aeruginosa PA01
aacggaucgcgucgcaggcgau

SEQ ID NO: 1453807 - RNA, 17 nt, Pseudomonas aeruginosa PA01
aacgggacgccaggcgu

SEQ ID NO: 1453808 - RNA, 13 nt, Pseudomonas aeruginosa PA01
aacggcuggucgg

SEQ ID NO: 1453809 - RNA, 16 nt, Pseudomonas aeruginosa PA01
aacggcuugaggaaaa

SEQ ID NO: 1453810 - RNA, 17 nt, Pseudomonas aeruginosa PA01
aacggcggauaaccgcg

SEQ ID NO: 1453811 - RNA, 19 nt, Pseudomonas aeruginosa PA01
aacggcgugagggucgcgc

SEQ ID NO: 1453812 - RNA, 13 nt, Pseudomonas aeruginosa PA01
aacggcgugccgg

SEQ ID NO: 1453813 - RNA, 16 nt, Pseudomonas aeruginosa PA01
aacggcgucacgccga

SEQ ID NO: 1453814 - RNA, 16 nt, Pseudomonas aeruginosa PA01
aacgcgcagaggcgcu

SEQ ID NO: 1453815 - RNA, 18 nt, Pseudomonas aeruginosa PA01
aacgcgccgucgcgaccu

SEQ ID NO: 1453816 - RNA, 13 nt, Pseudomonas aeruginosa PA01
aacgcgcccggcc

SEQ ID NO: 1453817 - RNA, 18 nt, Pseudomonas aeruginosa PA01
aacgcgcccggccaggcc

SEQ ID NO: 1453818 - RNA, 20 nt, Pseudomonas aeruginosa PA01
aacgcgcccggccaggccgc

SEQ ID NO: 1453819 - RNA, 22 nt, Pseudomonas aeruginosa PA01
aacgcgcccggccaggccgccc

SEQ ID NO: 1453820 - RNA, 14 nt, Pseudomonas aeruginosa PA01
aacggaccccaugu

SEQ ID NO: 1453821 - RNA, 18 nt, Pseudomonas aeruginosa PA01
aacgcgcgcucucgccgg

SEQ ID NO: 1453822 - RNA, 19 nt, Pseudomonas aeruginosa PA01
aacgcuugagcuggcgcug

SEQ ID NO: 1453823 - RNA, 15 nt, Pseudomonas aeruginosa PA01
aacguccucgcgccg

SEQ ID NO: 1453824 - RNA, 16 nt, Pseudomonas aeruginosa PA01
aacgggcugccagcau

SEQ ID NO: 1453825 - RNA, 14 nt, Pseudomonas aeruginosa PA01
aaccgcugccgccg

SEQ ID NO: 1453826 - RNA, 23 nt, Pseudomonas aeruginosa PA01
aaccgcugccgccgucuccgccg

SEQ ID NO: 1453827 - RNA, 21 nt, Pseudomonas aeruginosa PA01
aaccgcgggcgaggucgccac

SEQ ID NO: 1453828 - RNA, 19 nt, Pseudomonas aeruginosa PA01
aacgaaaaagggcggccac

SEQ ID NO: 1453829 - RNA, 21 nt, Pseudomonas aeruginosa PA01
aaccgccaucgauggucaggc

SEQ ID NO: 1453830 - RNA, 10 nt, Pseudomonas aeruginosa PA01
aaccgcggcg

SEQ ID NO: 1453831 - RNA, 23 nt, Pseudomonas aeruginosa PA01
aaccgcgaagcgguuagccggcg

SEQ ID NO: 1453832 - RNA, 18 nt, Pseudomonas aeruginosa PA01
aacgauaccgccgccggc

SEQ ID NO: 1453833 - RNA, 14 nt, Pseudomonas aeruginosa PA01
aacgacagccccgg

SEQ ID NO: 1453834 - RNA, 18 nt, Pseudomonas aeruginosa PA01
aacgaagaagccggcccc

SEQ ID NO: 1453835 - RNA, 15 nt, Pseudomonas aeruginosa PA01
aacgccgauggcguu

SEQ ID NO: 1453836 - RNA, 15 nt, Pseudomonas aeruginosa PA01
aacgccgcaggcguu

SEQ ID NO: 1453837 - RNA, 18 nt, Pseudomonas aeruginosa PA01
aacgccgacggcgugccg

SEQ ID NO: 1453838 - RNA, 17 nt, Pseudomonas aeruginosa PA01
aacgccgagaacgcggc

SEQ ID NO: 1453839 - RNA, 19 nt, Pseudomonas aeruginosa PA01
aacgccgagaacgcggcga

SEQ ID NO: 1453840 - RNA, 14 nt, Pseudomonas aeruginosa PA01
aacgccgccggcgu

SEQ ID NO: 1453841 - RNA, 21 nt, Pseudomonas aeruginosa PA01
aacgccgcgaagcccagcgcc

SEQ ID NO: 1453842 - RNA, 22 nt, Pseudomonas aeruginosa PA01
aacgccgcgaagcccagcgccg

SEQ ID NO: 1453843 - RNA, 17 nt, Pseudomonas aeruginosa PA01
aacgccgcccgucgcgc

SEQ ID NO: 1453844 - RNA, 19 nt, Pseudomonas aeruginosa PA01
aacgccgcccgucgcgccg

SEQ ID NO: 1453845 - RNA, 23 nt, Pseudomonas aeruginosa PA01
aacgccgggcaacgccaggccgc

SEQ ID NO: 1453846 - RNA, 24 nt, Pseudomonas aeruginosa PA01
aacgccgggcaacgccaggccgcu

SEQ ID NO: 1453847 - RNA, 16 nt, Pseudomonas aeruginosa PA01
aacgcgaaugcccggc

SEQ ID NO: 1453848 - RNA, 17 nt, Pseudomonas aeruginosa PA01
aacgcgaaugcccggca

SEQ ID NO: 1453849 - RNA, 17 nt, Pseudomonas aeruginosa PA01
aacgccgcgcaccucga

SEQ ID NO: 1453850 - RNA, 18 nt, Pseudomonas aeruginosa PA01
aacgccggcgaucgccgg

SEQ ID NO: 1453851 - RNA, 20 nt, Pseudomonas aeruginosa PA01
aacgccggcgaucgccggcg

SEQ ID NO: 1453852 - RNA, 21 nt, Pseudomonas aeruginosa PA01
aacgccggcgaucgccggcgu

SEQ ID NO: 1453853 - RNA, 20 nt, Pseudomonas aeruginosa PA01
aacgauucgacgcagcgcgc

SEQ ID NO: 1453854 - RNA, 18 nt, Pseudomonas aeruginosa PA01
aacgaugguggucggcag

SEQ ID NO: 1453855 - RNA, 20 nt, Pseudomonas aeruginosa PA01
aacgcacuucguccgccacc

SEQ ID NO: 1453856 - RNA, 12 nt, Pseudomonas aeruginosa PA01
aacgcaggcgca

SEQ ID NO: 1453857 - RNA, 18 nt, Pseudomonas aeruginosa PA01
aacgcagggccggaugcc

SEQ ID NO: 1453858 - RNA, 18 nt, Pseudomonas aeruginosa PA01
aaccacgggaauggcgga

SEQ ID NO: 1453859 - RNA, 13 nt, Pseudomonas aeruginosa PA01
aaccacaccugca

SEQ ID NO: 1453860 - RNA, 18 nt, Pseudomonas aeruginosa PA01
aaccacaggagcacggcc

SEQ ID NO: 1453861 - RNA, 21 nt, Pseudomonas aeruginosa PA01
aaccagauccgggaaggccug

SEQ ID NO: 1453862 - RNA, 23 nt, Pseudomonas aeruginosa PA01
aaccagacuuccgggcugcgcuc

SEQ ID NO: 1453863 - RNA, 18 nt, Pseudomonas aeruginosa PA01
aaccacuccgccacccgc

SEQ ID NO: 1453864 - RNA, 13 nt, Pseudomonas aeruginosa PA01
aaccacucggcgc

SEQ ID NO: 1453865 - RNA, 20 nt, Pseudomonas aeruginosa PA01
aaccagcagcaggucgucgg

SEQ ID NO: 1453866 - RNA, 21 nt, Pseudomonas aeruginosa PA01
aacauggcgucggcgaucacg

SEQ ID NO: 1453867 - RNA, 13 nt, Pseudomonas aeruginosa PA01
aacaugaagccgc

SEQ ID NO: 1453868 - RNA, 20 nt, Pseudomonas aeruginosa PA01
aacaguugccgcagcagcgg

SEQ ID NO: 1453869 - RNA, 17 nt, Pseudomonas aeruginosa PA01
aacaguucgaugggccg

SEQ ID NO: 1453870 - RNA, 20 nt, Pseudomonas aeruginosa PA01
aacaucagcagcgccagcag

SEQ ID NO: 1453871 - RNA, 19 nt, Pseudomonas aeruginosa PA01
aaccgaguuucccggcgcg

SEQ ID NO: 1453872 - RNA, 17 nt, Pseudomonas aeruginosa PA01
aaccgagacccuggcgc

SEQ ID NO: 1453873 - RNA, 18 nt, Pseudomonas aeruginosa PA01
aaccgagacccuggcgcu

SEQ ID NO: 1453874 - RNA, 17 nt, Pseudomonas aeruginosa PA01
aacccucaggucggcgc

SEQ ID NO: 1453875 - RNA, 20 nt, Pseudomonas aeruginosa PA01
aacccugcccagugggccac

SEQ ID NO: 1453876 - RNA, 23 nt, Pseudomonas aeruginosa PA01
aacccugcccagugggccaccgg

SEQ ID NO: 1453877 - RNA, 17 nt, Pseudomonas aeruginosa PA01
aaccgaaguagucgccc

SEQ ID NO: 1453878 - RNA, 16 nt, Pseudomonas aeruginosa PA01
aacccuuccagccgcc

SEQ ID NO: 1453879 - RNA, 20 nt, Pseudomonas aeruginosa PA01
aacccgggcccaagccgagc

SEQ ID NO: 1453880 - RNA, 13 nt, Pseudomonas aeruginosa PA01
aacccgcggcgcg

SEQ ID NO: 1453881 - RNA, 16 nt, Pseudomonas aeruginosa PA01
aacccgcggcgcgccu

SEQ ID NO: 1453882 - RNA, 15 nt, Pseudomonas aeruginosa PA01
aacccggccagcccg

SEQ ID NO: 1453883 - RNA, 16 nt, Pseudomonas aeruginosa PA01
aacccggccagcccgg

SEQ ID NO: 1453884 - RNA, 13 nt, Pseudomonas aeruginosa PA01
aacccaggcgcug

SEQ ID NO: 1453885 - RNA, 13 nt, Pseudomonas aeruginosa PA01
aacccagggcgcu

SEQ ID NO: 1453886 - RNA, 13 nt, Pseudomonas aeruginosa PA01
aacccgcccggcu

SEQ ID NO: 1453887 - RNA, 15 nt, Pseudomonas aeruginosa PA01
aaccccggccuggcg

SEQ ID NO: 1453888 - RNA, 21 nt, Pseudomonas aeruginosa PA01
aaccaggcaauggccggcggg

SEQ ID NO: 1453889 - RNA, 18 nt, Pseudomonas aeruginosa PA01
aaccaggcggugucgcgg

SEQ ID NO: 1453890 - RNA, 17 nt, Pseudomonas aeruginosa PA01
aaccagggacgcccgga

SEQ ID NO: 1453891 - RNA, 23 nt, Pseudomonas aeruginosa PA01
aaaggauuuccgcggccggcagg

SEQ ID NO: 1453892 - RNA, 22 nt, Pseudomonas aeruginosa PA01
aaagcuucgucgcgcaggcggg

SEQ ID NO: 1453893 - RNA, 22 nt, Pseudomonas aeruginosa PA01
aaaggcgcgccgguuucgaccg

SEQ ID NO: 1453894 - RNA, 17 nt, Pseudomonas aeruginosa PA01
aaaaauacuccgcgacg

SEQ ID NO: 1453895 - RNA, 20 nt, Pseudomonas aeruginosa PA01
aaacgccagcccucgcccag

SEQ ID NO: 1453896 - RNA, 15 nt, Pseudomonas aeruginosa PA01
aaacucgcgggcgcg

SEQ ID NO: 1453897 - RNA, 22 nt, Pseudomonas aeruginosa PA01
aacacuuccuucucccggcugg

SEQ ID NO: 1453898 - RNA, 20 nt, Pseudomonas aeruginosa PA01
aacagcagcggcaccagcac

SEQ ID NO: 1453899 - RNA, 15 nt, Pseudomonas aeruginosa PA01
aacagcagcucgccg

SEQ ID NO: 1453900 - RNA, 20 nt, Pseudomonas aeruginosa PA01
aacagaggaaggcgccggca

SEQ ID NO: 1453901 - RNA, 16 nt, Pseudomonas aeruginosa PA01
aacagcaacaccgcgc

SEQ ID NO: 1453902 - RNA, 22 nt, Pseudomonas aeruginosa PA01
aaaaggccgcguaagcggccuu

SEQ ID NO: 1453903 - RNA, 18 nt, Pseudomonas aeruginosa PA01
aacagcuccuccagccgc

SEQ ID NO: 1453904 - RNA, 22 nt, Pseudomonas aeruginosa PA01
aacagcuccuccagcguggcgg

SEQ ID NO: 1453905 - RNA, 14 nt, Pseudomonas aeruginosa PA01
aacagcggcccgag

SEQ ID NO: 1453906 - RNA, 17 nt, Pseudomonas aeruginosa PA01
aacagcgccaccagcau

SEQ ID NO: 1453907 - RNA, 17 nt, Pseudomonas aeruginosa PA01
aacagcgccagcggcag

SEQ ID NO: 1453908 - RNA, 13 nt, Pseudomonas aeruginosa PA01
aacagcggaaugc

SEQ ID NO: 1453909 - RNA, 16 nt, Pseudomonas aeruginosa PA01
aacagcgccgcgcgcu

SEQ ID NO: 1453910 - RNA, 12 nt, Pseudomonas aeruginosa PA01
aacagcgcgcca

SEQ ID NO: 1453911 - RNA, 22 nt, Pseudomonas aeruginosa PA01
aacagcccgucgcgcgccggag

SEQ ID NO: 1453912 - RNA, 12 nt, Pseudomonas aeruginosa PA01
aacagccgcccc

SEQ ID NO: 1453913 - RNA, 14 nt, Pseudomonas aeruginosa PA01
aacagccagcgguu

SEQ ID NO: 1453914 - RNA, 23 nt, Pseudomonas aeruginosa PA01
aacagccagcgguugagcagggc

SEQ ID NO: 1453915 - RNA, 23 nt, Pseudomonas aeruginosa PA01
aacagccagaggucgagcugggu

SEQ ID NO: 1453916 - RNA, 18 nt, Pseudomonas aeruginosa PA01
aacagguucggcaggccu

SEQ ID NO: 1453917 - RNA, 20 nt, Pseudomonas aeruginosa PA01
aacaggcuggcgucgacgcc

SEQ ID NO: 1453918 - RNA, 17 nt, Pseudomonas aeruginosa PA01
aacaggcugugcgccag

SEQ ID NO: 1453919 - RNA, 16 nt, Pseudomonas aeruginosa PA01
aacagcuugacgaucu

SEQ ID NO: 1453920 - RNA, 20 nt, Pseudomonas aeruginosa PA01
aacagcuugccgcugcgcau

SEQ ID NO: 1453921 - RNA, 20 nt, Pseudomonas aeruginosa PA01
aacaggcaaagaccgaccag

SEQ ID NO: 1453922 - RNA, 20 nt, Pseudomonas aeruginosa PA01
aaauggccgcuucaagcggc

SEQ ID NO: 1453923 - RNA, 15 nt, Pseudomonas aeruginosa PA01
uuuucgcuuugcgcg

SEQ ID NO: 1453924 - RNA, 15 nt, Pseudomonas aeruginosa PA01
uuuuucaugcgcggg

SEQ ID NO: 1453925 - RNA, 16 nt, Pseudomonas aeruginosa PA01
uuuuucauggccuggc

SEQ ID NO: 1453926 - RNA, 18 nt, Pseudomonas aeruginosa PA01
uuuuucaugggcggggug

SEQ ID NO: 1453927 - RNA, 21 nt, Pseudomonas aeruginosa PA01
uuuuucauuggcgcgucggug

SEQ ID NO: 1453928 - RNA, 19 nt, Pseudomonas aeruginosa PA01
uuuuucauuucgcgcggua

SEQ ID NO: 1453929 - RNA, 14 nt, Pseudomonas aeruginosa PA01
uuucuccggcgccg

SEQ ID NO: 1453930 - RNA, 14 nt, Pseudomonas aeruginosa PA01
uuucguuggcccag

SEQ ID NO: 1453931 - RNA, 18 nt, Pseudomonas aeruginosa PA01
uuucguuggcgcgaccgc

SEQ ID NO: 1453932 - RNA, 18 nt, Pseudomonas aeruginosa PA01
uuuccgcgcccggcuggc

SEQ ID NO: 1453933 - RNA, 18 nt, Pseudomonas aeruginosa PA01
uuuccgauccuccugggg

SEQ ID NO: 1453934 - RNA, 16 nt, Pseudomonas aeruginosa PA01
uuuccagcccggcgug

SEQ ID NO: 1453935 - RNA, 16 nt, Pseudomonas aeruginosa PA01
uuuccagggccuggcg

SEQ ID NO: 1453936 - RNA, 17 nt, Pseudomonas aeruginosa PA01
uuucagcgcuugcuggc

SEQ ID NO: 1453937 - RNA, 18 nt, Pseudomonas aeruginosa PA01
uuucagcgcuugcuggcg

SEQ ID NO: 1453938 - RNA, 17 nt, Pseudomonas aeruginosa PA01
uuucagaacgucggcgg

SEQ ID NO: 1453939 - RNA, 20 nt, Pseudomonas aeruginosa PA01
uuucaccgguaccacgggca

SEQ ID NO: 1453940 - RNA, 23 nt, Pseudomonas aeruginosa PA01
uuucaauuccgccgcggcaaugc

SEQ ID NO: 1453941 - RNA, 11 nt, Pseudomonas aeruginosa PA01
uuucacgccga

SEQ ID NO: 1453942 - RNA, 22 nt, Pseudomonas aeruginosa PA01
uugucguaugccugugcaccga

SEQ ID NO: 1453943 - RNA, 19 nt, Pseudomonas aeruginosa PA01
uugggcgccucgccgcggc

SEQ ID NO: 1453944 - RNA, 12 nt, Pseudomonas aeruginosa PA01
uugggcaucgag

SEQ ID NO: 1453945 - RNA, 16 nt, Pseudomonas aeruginosa PA01
uugggccaggcaucca

SEQ ID NO: 1453946 - RNA, 23 nt, Pseudomonas aeruginosa PA01
uuggcuggcggggucgcgccggu

SEQ ID NO: 1453947 - RNA, 14 nt, Pseudomonas aeruginosa PA01
uuggcuuccgagca

SEQ ID NO: 1453948 - RNA, 19 nt, Pseudomonas aeruginosa PA01
uuggcucaguugcugauca

SEQ ID NO: 1453949 - RNA, 23 nt, Pseudomonas aeruginosa PA01
uugggcagccacgaagccucuuc

SEQ ID NO: 1453950 - RNA, 13 nt, Pseudomonas aeruginosa PA01
uuguccggcacca

SEQ ID NO: 1453951 - RNA, 10 nt, Pseudomonas aeruginosa PA01
uuguccggcc

SEQ ID NO: 1453952 - RNA, 17 nt, Pseudomonas aeruginosa PA01
uuguccggcccggagcg

SEQ ID NO: 1453953 - RNA, 13 nt, Pseudomonas aeruginosa PA01
uugucgaccagcg

SEQ ID NO: 1453954 - RNA, 17 nt, Pseudomonas aeruginosa PA01
uugucgaugcgcccgcc

SEQ ID NO: 1453955 - RNA, 19 nt, Pseudomonas aeruginosa PA01
uugucggugaugaagaagc

SEQ ID NO: 1453956 - RNA, 16 nt, Pseudomonas aeruginosa PA01
uugucgcggcugacga

SEQ ID NO: 1453957 - RNA, 13 nt, Pseudomonas aeruginosa PA01
uugucgcguccgg

SEQ ID NO: 1453958 - RNA, 17 nt, Pseudomonas aeruginosa PA01
uugucgccgcuggacga

SEQ ID NO: 1453959 - RNA, 16 nt, Pseudomonas aeruginosa PA01
uuguccugcggccggg

SEQ ID NO: 1453960 - RNA, 12 nt, Pseudomonas aeruginosa PA01
uuguccuggcgc

SEQ ID NO: 1453961 - RNA, 17 nt, Pseudomonas aeruginosa PA01
uuggcgcgggcgaaggc

SEQ ID NO: 1453962 - RNA, 14 nt, Pseudomonas aeruginosa PA01
uuggcgcgcuggca

SEQ ID NO: 1453963 - RNA, 14 nt, Pseudomonas aeruginosa PA01
uuggcgcgaccgcc

SEQ ID NO: 1453964 - RNA, 12 nt, Pseudomonas aeruginosa PA01
uuggcgccgucc

SEQ ID NO: 1453965 - RNA, 13 nt, Pseudomonas aeruginosa PA01
uuggcggccauca

SEQ ID NO: 1453966 - RNA, 18 nt, Pseudomonas aeruginosa PA01
uuggcgucgaugcgccuc

SEQ ID NO: 1453967 - RNA, 17 nt, Pseudomonas aeruginosa PA01
uugaaaacggcgcccuc

SEQ ID NO: 1453968 - RNA, 14 nt, Pseudomonas aeruginosa PA01
uugaaaccggcgaa

SEQ ID NO: 1453969 - RNA, 12 nt, Pseudomonas aeruginosa PA01
uggcggcugaag

SEQ ID NO: 1453970 - RNA, 20 nt, Pseudomonas aeruginosa PA01
uggcgggccuugcgaccagg

SEQ ID NO: 1453971 - RNA, 13 nt, Pseudomonas aeruginosa PA01
uggcgggcggccc

SEQ ID NO: 1453972 - RNA, 21 nt, Pseudomonas aeruginosa PA01
uggcgggcguuuucguuggcg

SEQ ID NO: 1453973 - RNA, 20 nt, Pseudomonas aeruginosa PA01
uggcgggcucuaugcgcggg

SEQ ID NO: 1453974 - RNA, 13 nt, Pseudomonas aeruginosa PA01
uggcgggccagca

SEQ ID NO: 1453975 - RNA, 15 nt, Pseudomonas aeruginosa PA01
uggcgggccagcagg

SEQ ID NO: 1453976 - RNA, 23 nt, Pseudomonas aeruginosa PA01
uggcgguacagcccccaggcacc

SEQ ID NO: 1453977 - RNA, 17 nt, Pseudomonas aeruginosa PA01
uggcggggucgcgccgg

SEQ ID NO: 1453978 - RNA, 18 nt, Pseudomonas aeruginosa PA01
uggcgguagcccggcagc

SEQ ID NO: 1453979 - RNA, 20 nt, Pseudomonas aeruginosa PA01
uggcgguagcccggcagcuc

SEQ ID NO: 1453980 - RNA, 21 nt, Pseudomonas aeruginosa PA01
uggcggucggccaggcggccg

SEQ ID NO: 1453981 - RNA, 23 nt, Pseudomonas aeruginosa PA01
uggcuccuggagguagcugcgcc

SEQ ID NO: 1453982 - RNA, 24 nt, Pseudomonas aeruginosa PA01
uggcuccgggccgagggcugagac

SEQ ID NO: 1453983 - RNA, 15 nt, Pseudomonas aeruginosa PA01
uggcucgaucggcag

SEQ ID NO: 1453984 - RNA, 20 nt, Pseudomonas aeruginosa PA01
uggcucgaucggcagggcgc

SEQ ID NO: 1453985 - RNA, 15 nt, Pseudomonas aeruginosa PA01
uggcucggcggcagg

SEQ ID NO: 1453986 - RNA, 18 nt, Pseudomonas aeruginosa PA01
uggcucaucucguugagg

SEQ ID NO: 1453987 - RNA, 21 nt, Pseudomonas aeruginosa PA01
uggcuccacugcuuggccagg

SEQ ID NO: 1453988 - RNA, 18 nt, Pseudomonas aeruginosa PA01
uggcguugucggcaaccg

SEQ ID NO: 1453989 - RNA, 16 nt, Pseudomonas aeruginosa PA01
uggcuacccgcagggc

SEQ ID NO: 1453990 - RNA, 13 nt, Pseudomonas aeruginosa PA01
ugggccccggccg

SEQ ID NO: 1453991 - RNA, 14 nt, Pseudomonas aeruginosa PA01
ugggccccggccgg

SEQ ID NO: 1453992 - RNA, 21 nt, Pseudomonas aeruginosa PA01
ugggccccggccggcaggagg

SEQ ID NO: 1453993 - RNA, 18 nt, Pseudomonas aeruginosa PA01
ugggccagcgccguacgc

SEQ ID NO: 1453994 - RNA, 14 nt, Pseudomonas aeruginosa PA01
ugggccaucgccgg

SEQ ID NO: 1453995 - RNA, 23 nt, Pseudomonas aeruginosa PA01
ugggccaugaccucggccagcca

SEQ ID NO: 1453996 - RNA, 18 nt, Pseudomonas aeruginosa PA01
ugggccggcaugcucagc

SEQ ID NO: 1453997 - RNA, 23 nt, Pseudomonas aeruginosa PA01
ugggccggcaugcucagccgcgc

SEQ ID NO: 1453998 - RNA, 15 nt, Pseudomonas aeruginosa PA01
ugggccggccgacga

SEQ ID NO: 1453999 - RNA, 16 nt, Pseudomonas aeruginosa PA01
ugggccggcgccagca

SEQ ID NO: 1454000 - RNA, 21 nt, Pseudomonas aeruginosa PA01
ugggcaccaguggcgccgcca

SEQ ID NO: 1454001 - RNA, 14 nt, Pseudomonas aeruginosa PA01
ugggcacgaugcug

SEQ ID NO: 1454002 - RNA, 16 nt, Pseudomonas aeruginosa PA01
ugggcacgaugcugaa

SEQ ID NO: 1454003 - RNA, 16 nt, Pseudomonas aeruginosa PA01
ugggcacgccgguggc

SEQ ID NO: 1454004 - RNA, 19 nt, Pseudomonas aeruginosa PA01
ugggcacgccgguggccag

SEQ ID NO: 1454005 - RNA, 14 nt, Pseudomonas aeruginosa PA01
ugggcaacaggccg

SEQ ID NO: 1454006 - RNA, 15 nt, Pseudomonas aeruginosa PA01
ugggcaagcugcacg

SEQ ID NO: 1454007 - RNA, 17 nt, Pseudomonas aeruginosa PA01
ugggcaagcugcacggc

SEQ ID NO: 1454008 - RNA, 22 nt, Pseudomonas aeruginosa PA01
ugggauucagugggucgaugcc

SEQ ID NO: 1454009 - RNA, 14 nt, Pseudomonas aeruginosa PA01
ugggauggccagcc

SEQ ID NO: 1454010 - RNA, 19 nt, Pseudomonas aeruginosa PA01
ugggaucgucgaaagccuc

SEQ ID NO: 1454011 - RNA, 14 nt, Pseudomonas aeruginosa PA01
ugggaucggcgauc

SEQ ID NO: 1454012 - RNA, 13 nt, Pseudomonas aeruginosa PA01
uggcuuggcccug

SEQ ID NO: 1454013 - RNA, 14 nt, Pseudomonas aeruginosa PA01
uggcuuuccagcau

SEQ ID NO: 1454014 - RNA, 14 nt, Pseudomonas aeruginosa PA01
uggcuuuccaggcg

SEQ ID NO: 1454015 - RNA, 23 nt, Pseudomonas aeruginosa PA01
uggcuugaucgagucgccggcga

SEQ ID NO: 1454016 - RNA, 15 nt, Pseudomonas aeruginosa PA01
uggcuuccuggcgcc

SEQ ID NO: 1454017 - RNA, 17 nt, Pseudomonas aeruginosa PA01
uggcuuccuggcgccgg

SEQ ID NO: 1454018 - RNA, 17 nt, Pseudomonas aeruginosa PA01
uggcuguagcucugcug

SEQ ID NO: 1454019 - RNA, 15 nt, Pseudomonas aeruginosa PA01
uggcugucggcgccc

SEQ ID NO: 1454020 - RNA, 15 nt, Pseudomonas aeruginosa PA01
uggcucuugccgcga

SEQ ID NO: 1454021 - RNA, 12 nt, Pseudomonas aeruginosa PA01
uggcuggcgcaa

SEQ ID NO: 1454022 - RNA, 24 nt, Pseudomonas aeruginosa PA01
uggcuggcgcuaccgcgcauggcg

SEQ ID NO: 1454023 - RNA, 14 nt, Pseudomonas aeruginosa PA01
uggcugugcuggcc

SEQ ID NO: 1454024 - RNA, 14 nt, Pseudomonas aeruginosa PA01
uggcuuccagccag

SEQ ID NO: 1454025 - RNA, 17 nt, Pseudomonas aeruginosa PA01
uggggaagacggccagg

SEQ ID NO: 1454026 - RNA, 15 nt, Pseudomonas aeruginosa PA01
ugggcuugccggggu

SEQ ID NO: 1454027 - RNA, 17 nt, Pseudomonas aeruginosa PA01
uggggaccgcaccuggu

SEQ ID NO: 1454028 - RNA, 18 nt, Pseudomonas aeruginosa PA01
uggggaaucugcgccagg

SEQ ID NO: 1454029 - RNA, 19 nt, Pseudomonas aeruginosa PA01
ugggcugggucggcuggca

SEQ ID NO: 1454030 - RNA, 23 nt, Pseudomonas aeruginosa PA01
ugggcggccucguaggcggcgcg

SEQ ID NO: 1454031 - RNA, 15 nt, Pseudomonas aeruginosa PA01
ugggcguuggccagc

SEQ ID NO: 1454032 - RNA, 21 nt, Pseudomonas aeruginosa PA01
ugggcuaccgcaucgccaccg

SEQ ID NO: 1454033 - RNA, 23 nt, Pseudomonas aeruginosa PA01
ugggcuaccgcaucgccaccgcg

SEQ ID NO: 1454034 - RNA, 23 nt, Pseudomonas aeruginosa PA01
ugggcucagauuaucugcgacug

SEQ ID NO: 1454035 - RNA, 22 nt, Pseudomonas aeruginosa PA01
ugggcuccagcgggaaggucgg

SEQ ID NO: 1454036 - RNA, 23 nt, Pseudomonas aeruginosa PA01
ugggcuccagcgggaaggucggc

SEQ ID NO: 1454037 - RNA, 18 nt, Pseudomonas aeruginosa PA01
ugggcgccucgucgacgc

SEQ ID NO: 1454038 - RNA, 16 nt, Pseudomonas aeruginosa PA01
ugggcgcgcgccgggc

SEQ ID NO: 1454039 - RNA, 11 nt, Pseudomonas aeruginosa PA01
ugggcgccagc

SEQ ID NO: 1454040 - RNA, 14 nt, Pseudomonas aeruginosa PA01
ugggcgccgccagc

SEQ ID NO: 1454041 - RNA, 18 nt, Pseudomonas aeruginosa PA01
ugggcgccgccagccaga

SEQ ID NO: 1454042 - RNA, 19 nt, Pseudomonas aeruginosa PA01
ugggccgugaaaagcggcg

SEQ ID NO: 1454043 - RNA, 19 nt, Pseudomonas aeruginosa PA01
ugggccgguugcggcgccg

SEQ ID NO: 1454044 - RNA, 20 nt, Pseudomonas aeruginosa PA01
ugggccgguugcggcgccgg

SEQ ID NO: 1454045 - RNA, 16 nt, Pseudomonas aeruginosa PA01
ugggccggcgcgccgu

SEQ ID NO: 1454046 - RNA, 23 nt, Pseudomonas aeruginosa PA01
ugguaggagccgucgccggcgac

SEQ ID NO: 1454047 - RNA, 18 nt, Pseudomonas aeruginosa PA01
ugguaguccgcugcgagc

SEQ ID NO: 1454048 - RNA, 15 nt, Pseudomonas aeruginosa PA01
ugguagucgagccgg

SEQ ID NO: 1454049 - RNA, 22 nt, Pseudomonas aeruginosa PA01
ugguaggcgucgucgaccucga

SEQ ID NO: 1454050 - RNA, 14 nt, Pseudomonas aeruginosa PA01
ugguagugcuggcg

SEQ ID NO: 1454051 - RNA, 14 nt, Pseudomonas aeruginosa PA01
ugggucagcgccag

SEQ ID NO: 1454052 - RNA, 18 nt, Pseudomonas aeruginosa PA01
ugggugaacagcggcccg

SEQ ID NO: 1454053 - RNA, 23 nt, Pseudomonas aeruginosa PA01
ugggugaagaccagucggccguu

SEQ ID NO: 1454054 - RNA, 13 nt, Pseudomonas aeruginosa PA01
ugggucgcgcagg

SEQ ID NO: 1454055 - RNA, 17 nt, Pseudomonas aeruginosa PA01
uggguacgcaccggcuu

SEQ ID NO: 1454056 - RNA, 13 nt, Pseudomonas aeruginosa PA01
uggguaggccagg

SEQ ID NO: 1454057 - RNA, 16 nt, Pseudomonas aeruginosa PA01
uggguauccagcggcc

SEQ ID NO: 1454058 - RNA, 18 nt, Pseudomonas aeruginosa PA01
ugggguuucugcuggcca

SEQ ID NO: 1454059 - RNA, 21 nt, Pseudomonas aeruginosa PA01
uggggcgaauaaccauugcgc

SEQ ID NO: 1454060 - RNA, 21 nt, Pseudomonas aeruginosa PA01
uggggacggaagcauggccgg

SEQ ID NO: 1454061 - RNA, 20 nt, Pseudomonas aeruginosa PA01
uggggauggccggcgcggcg

SEQ ID NO: 1454062 - RNA, 19 nt, Pseudomonas aeruginosa PA01
uggcgacgucgccccagcc

SEQ ID NO: 1454063 - RNA, 21 nt, Pseudomonas aeruginosa PA01
uggcgacguccugcgggucau

SEQ ID NO: 1454064 - RNA, 20 nt, Pseudomonas aeruginosa PA01
uggcgagcgucgagucgcgc

SEQ ID NO: 1454065 - RNA, 22 nt, Pseudomonas aeruginosa PA01
uggcgacgacgggagcgcgagg

SEQ ID NO: 1454066 - RNA, 13 nt, Pseudomonas aeruginosa PA01
uggcgacgaugcg

SEQ ID NO: 1454067 - RNA, 13 nt, Pseudomonas aeruginosa PA01
uggcgacgcgcag

SEQ ID NO: 1454068 - RNA, 22 nt, Pseudomonas aeruginosa PA01
uggcgacgcgcaggccggugau

SEQ ID NO: 1454069 - RNA, 20 nt, Pseudomonas aeruginosa PA01
uggcgaccugguggcgccgg

SEQ ID NO: 1454070 - RNA, 19 nt, Pseudomonas aeruginosa PA01
uggcgacgaagacgcugcg

SEQ ID NO: 1454071 - RNA, 21 nt, Pseudomonas aeruginosa PA01
uggcgacgaagacgcugcgca

SEQ ID NO: 1454072 - RNA, 19 nt, Pseudomonas aeruginosa PA01
uggcgaccaggacagcacg

SEQ ID NO: 1454073 - RNA, 23 nt, Pseudomonas aeruginosa PA01
uggcgacaggcgaucgacgccuc

SEQ ID NO: 1454074 - RNA, 18 nt, Pseudomonas aeruginosa PA01
uggcgacaggcgaucgcc

SEQ ID NO: 1454075 - RNA, 20 nt, Pseudomonas aeruginosa PA01
uggcgaauagccggcgcugg

SEQ ID NO: 1454076 - RNA, 17 nt, Pseudomonas aeruginosa PA01
uggcgaauuuccugcug

SEQ ID NO: 1454077 - RNA, 20 nt, Pseudomonas aeruginosa PA01
uggcgaaguugccgccgcug

SEQ ID NO: 1454078 - RNA, 19 nt, Pseudomonas aeruginosa PA01
uggcgaaguucccgccgcu

SEQ ID NO: 1454079 - RNA, 15 nt, Pseudomonas aeruginosa PA01
uggccguccaggcug

SEQ ID NO: 1454080 - RNA, 14 nt, Pseudomonas aeruginosa PA01
uggccgucgggaua

SEQ ID NO: 1454081 - RNA, 18 nt, Pseudomonas aeruginosa PA01
uggccgucuccaggcgcg

SEQ ID NO: 1454082 - RNA, 19 nt, Pseudomonas aeruginosa PA01
uggccgucuccaggcgcgc

SEQ ID NO: 1454083 - RNA, 17 nt, Pseudomonas aeruginosa PA01
uggccguucuccagguc

SEQ ID NO: 1454084 - RNA, 17 nt, Pseudomonas aeruginosa PA01
uggccguugaccagcgc

SEQ ID NO: 1454085 - RNA, 15 nt, Pseudomonas aeruginosa PA01
uggccguugagcacc

SEQ ID NO: 1454086 - RNA, 21 nt, Pseudomonas aeruginosa PA01
uggccguugagcaccucgacc

SEQ ID NO: 1454087 - RNA, 20 nt, Pseudomonas aeruginosa PA01
uggccguggcgccccaggcg

SEQ ID NO: 1454088 - RNA, 15 nt, Pseudomonas aeruginosa PA01
uggccgugggccgcc

SEQ ID NO: 1454089 - RNA, 22 nt, Pseudomonas aeruginosa PA01
uggccgugcucgaugaucgacu

SEQ ID NO: 1454090 - RNA, 20 nt, Pseudomonas aeruginosa PA01
uggccuccggacgcugcaug

SEQ ID NO: 1454091 - RNA, 13 nt, Pseudomonas aeruginosa PA01
uggccugcagcag

SEQ ID NO: 1454092 - RNA, 23 nt, Pseudomonas aeruginosa PA01
uggccugcagcaggucgagcagu

SEQ ID NO: 1454093 - RNA, 19 nt, Pseudomonas aeruginosa PA01
uggaaaggccucggcgaug

SEQ ID NO: 1454094 - RNA, 18 nt, Pseudomonas aeruginosa PA01
uggccgcgccccacggcg

SEQ ID NO: 1454095 - RNA, 12 nt, Pseudomonas aeruginosa PA01
uggccgcgcagg

SEQ ID NO: 1454096 - RNA, 17 nt, Pseudomonas aeruginosa PA01
uggaaaccucgccgauc

SEQ ID NO: 1454097 - RNA, 22 nt, Pseudomonas aeruginosa PA01
uggaaaaguuuuucgcggcgcg

SEQ ID NO: 1454098 - RNA, 15 nt, Pseudomonas aeruginosa PA01
ugcuuuugaacacca

SEQ ID NO: 1454099 - RNA, 17 nt, Pseudomonas aeruginosa PA01
ugcuuucccugcugcgg

SEQ ID NO: 1454100 - RNA, 17 nt, Pseudomonas aeruginosa PA01
uggccgcuugaagcggc

SEQ ID NO: 1454101 - RNA, 18 nt, Pseudomonas aeruginosa PA01
uggccgcugagcagcagg

SEQ ID NO: 1454102 - RNA, 15 nt, Pseudomonas aeruginosa PA01
uggccgcuguggaag

SEQ ID NO: 1454103 - RNA, 16 nt, Pseudomonas aeruginosa PA01
uggccgcguucgccga

SEQ ID NO: 1454104 - RNA, 18 nt, Pseudomonas aeruginosa PA01
uggccgcuacgcggcggg

SEQ ID NO: 1454105 - RNA, 17 nt, Pseudomonas aeruginosa PA01
uggccgcgggaggccgc

SEQ ID NO: 1454106 - RNA, 18 nt, Pseudomonas aeruginosa PA01
uggccgcgggaggccgcc

SEQ ID NO: 1454107 - RNA, 18 nt, Pseudomonas aeruginosa PA01
uggccgcgcgaccgcggc

SEQ ID NO: 1454108 - RNA, 19 nt, Pseudomonas aeruginosa PA01
uggccgcgcgaccgcggcg

SEQ ID NO: 1454109 - RNA, 20 nt, Pseudomonas aeruginosa PA01
uggccggucguucgcccuuc

SEQ ID NO: 1454110 - RNA, 17 nt, Pseudomonas aeruginosa PA01
uggccggugccauacag

SEQ ID NO: 1454111 - RNA, 17 nt, Pseudomonas aeruginosa PA01
uggccggugccgcccug

SEQ ID NO: 1454112 - RNA, 18 nt, Pseudomonas aeruginosa PA01
uggccggugccgcccugg

SEQ ID NO: 1454113 - RNA, 18 nt, Pseudomonas aeruginosa PA01
uggccgggggucgcggcg

SEQ ID NO: 1454114 - RNA, 16 nt, Pseudomonas aeruginosa PA01
uggcggcgaucgcccc

SEQ ID NO: 1454115 - RNA, 15 nt, Pseudomonas aeruginosa PA01
uggcggcgccauagg

SEQ ID NO: 1454116 - RNA, 19 nt, Pseudomonas aeruginosa PA01
uggcggcgacgaaggucgg

SEQ ID NO: 1454117 - RNA, 16 nt, Pseudomonas aeruginosa PA01
uggcggcguggcaccg

SEQ ID NO: 1454118 - RNA, 13 nt, Pseudomonas aeruginosa PA01
uggcggcucggcu

SEQ ID NO: 1454119 - RNA, 12 nt, Pseudomonas aeruginosa PA01
uggcggcgcuca

SEQ ID NO: 1454120 - RNA, 20 nt, Pseudomonas aeruginosa PA01
uggcggcgcgcgucguccag

SEQ ID NO: 1454121 - RNA, 19 nt, Pseudomonas aeruginosa PA01
uggcgcggcugaucggccg

SEQ ID NO: 1454122 - RNA, 16 nt, Pseudomonas aeruginosa PA01
uggcgcguacgcccgc

SEQ ID NO: 1454123 - RNA, 16 nt, Pseudomonas aeruginosa PA01
uggcgcuacgcucgcc

SEQ ID NO: 1454124 - RNA, 19 nt, Pseudomonas aeruginosa PA01
uggcgcuacgcucgccgac

SEQ ID NO: 1454125 - RNA, 18 nt, Pseudomonas aeruginosa PA01
uggcgcggggccccggca

SEQ ID NO: 1454126 - RNA, 16 nt, Pseudomonas aeruginosa PA01
uggcgcgucgcugccg

SEQ ID NO: 1454127 - RNA, 21 nt, Pseudomonas aeruginosa PA01
uggcgcgucgcugccgccgcg

SEQ ID NO: 1454128 - RNA, 14 nt, Pseudomonas aeruginosa PA01
uggcgcgucggccg

SEQ ID NO: 1454129 - RNA, 13 nt, Pseudomonas aeruginosa PA01
uggcgcuccaggg

SEQ ID NO: 1454130 - RNA, 21 nt, Pseudomonas aeruginosa PA01
uggcgcucucgaacaccaggc

SEQ ID NO: 1454131 - RNA, 17 nt, Pseudomonas aeruginosa PA01
uggcgcugaacaagccc

SEQ ID NO: 1454132 - RNA, 19 nt, Pseudomonas aeruginosa PA01
uggcgcucgaagcuccagc

SEQ ID NO: 1454133 - RNA, 14 nt, Pseudomonas aeruginosa PA01
uggcgcucgccgug

SEQ ID NO: 1454134 - RNA, 15 nt, Pseudomonas aeruginosa PA01
uggcgcucgccgugg

SEQ ID NO: 1454135 - RNA, 19 nt, Pseudomonas aeruginosa PA01
uggcgcucagcgccgcuuc

SEQ ID NO: 1454136 - RNA, 23 nt, Pseudomonas aeruginosa PA01
uggcgcugaggaagagcagcgcg

SEQ ID NO: 1454137 - RNA, 13 nt, Pseudomonas aeruginosa PA01
uggcggccgccgc

SEQ ID NO: 1454138 - RNA, 16 nt, Pseudomonas aeruginosa PA01
uggcgcugccaaacgc

SEQ ID NO: 1454139 - RNA, 20 nt, Pseudomonas aeruginosa PA01
uggcggccgccggcgcccug

SEQ ID NO: 1454140 - RNA, 14 nt, Pseudomonas aeruginosa PA01
uggcgaugcugacc

SEQ ID NO: 1454141 - RNA, 23 nt, Pseudomonas aeruginosa PA01
uggcgauggaugacccgcucgcc

SEQ ID NO: 1454142 - RNA, 13 nt, Pseudomonas aeruginosa PA01
uggcgaggcgcgc

SEQ ID NO: 1454143 - RNA, 17 nt, Pseudomonas aeruginosa PA01
uggcgaucaggcagcgc

SEQ ID NO: 1454144 - RNA, 22 nt, Pseudomonas aeruginosa PA01
uggcgaucaggcagcgcgcggc

SEQ ID NO: 1454145 - RNA, 17 nt, Pseudomonas aeruginosa PA01
uggcgaucaggccaagc

SEQ ID NO: 1454146 - RNA, 15 nt, Pseudomonas aeruginosa PA01
uggcgaggacgccgg

SEQ ID NO: 1454147 - RNA, 18 nt, Pseudomonas aeruginosa PA01
uggcgaggacgccgggcu

SEQ ID NO: 1454148 - RNA, 19 nt, Pseudomonas aeruginosa PA01
uggcgaggaugaucagggc

SEQ ID NO: 1454149 - RNA, 19 nt, Pseudomonas aeruginosa PA01
uggcgaggauuuccucgcg

SEQ ID NO: 1454150 - RNA, 23 nt, Pseudomonas aeruginosa PA01
uggcgccgccgagguugcgcagg

SEQ ID NO: 1454151 - RNA, 20 nt, Pseudomonas aeruginosa PA01
uggcgccggugcaugaaggc

SEQ ID NO: 1454152 - RNA, 22 nt, Pseudomonas aeruginosa PA01
uggcgccgcgggucugcucggc

SEQ ID NO: 1454153 - RNA, 17 nt, Pseudomonas aeruginosa PA01
uggcgccgagcagcggc

SEQ ID NO: 1454154 - RNA, 16 nt, Pseudomonas aeruginosa PA01
uggcgcaacaggcgca

SEQ ID NO: 1454155 - RNA, 16 nt, Pseudomonas aeruginosa PA01
uggcgcaacgccggca

SEQ ID NO: 1454156 - RNA, 21 nt, Pseudomonas aeruginosa PA01
uggcgcaacugcacguugcug

SEQ ID NO: 1454157 - RNA, 14 nt, Pseudomonas aeruginosa PA01
uggcgccgaugcug

SEQ ID NO: 1454158 - RNA, 19 nt, Pseudomonas aeruginosa PA01
uggcgauuuccucgcugcg

SEQ ID NO: 1454159 - RNA, 16 nt, Pseudomonas aeruginosa PA01
uggcgaugcccuggcc

SEQ ID NO: 1454160 - RNA, 18 nt, Pseudomonas aeruginosa PA01
uggcgaugccgaggagga

SEQ ID NO: 1454161 - RNA, 16 nt, Pseudomonas aeruginosa PA01
uggugugauccugcug

SEQ ID NO: 1454162 - RNA, 12 nt, Pseudomonas aeruginosa PA01
uggugucggccg

SEQ ID NO: 1454163 - RNA, 12 nt, Pseudomonas aeruginosa PA01
uggugaucaccg

SEQ ID NO: 1454164 - RNA, 22 nt, Pseudomonas aeruginosa PA01
uggugcaggucgcgcggcgccu

SEQ ID NO: 1454165 - RNA, 15 nt, Pseudomonas aeruginosa PA01
uggugcccgaugccg

SEQ ID NO: 1454166 - RNA, 18 nt, Pseudomonas aeruginosa PA01
uggugcccgaugccgcgc

SEQ ID NO: 1454167 - RNA, 21 nt, Pseudomonas aeruginosa PA01
uggugccgacgcugaucaucg

SEQ ID NO: 1454168 - RNA, 14 nt, Pseudomonas aeruginosa PA01
uggugccgagcagg

SEQ ID NO: 1454169 - RNA, 19 nt, Pseudomonas aeruginosa PA01
uggugccgaucagcccguc

SEQ ID NO: 1454170 - RNA, 22 nt, Pseudomonas aeruginosa PA01
uggugccgaucagcccgucggc

SEQ ID NO: 1454171 - RNA, 14 nt, Pseudomonas aeruginosa PA01
uggugcccugggcg

SEQ ID NO: 1454172 - RNA, 23 nt, Pseudomonas aeruginosa PA01
uggugcgcucgcggaccucugcg

SEQ ID NO: 1454173 - RNA, 16 nt, Pseudomonas aeruginosa PA01
uggucguagcagcgga

SEQ ID NO: 1454174 - RNA, 23 nt, Pseudomonas aeruginosa PA01
uggucguaggcgcgggcggcggc

SEQ ID NO: 1454175 - RNA, 20 nt, Pseudomonas aeruginosa PA01
uggucgucguaguggccguc

SEQ ID NO: 1454176 - RNA, 20 nt, Pseudomonas aeruginosa PA01
uggucguucucgcgcaucgc

SEQ ID NO: 1454177 - RNA, 18 nt, Pseudomonas aeruginosa PA01
uggucguugcgcgccagc

SEQ ID NO: 1454178 - RNA, 23 nt, Pseudomonas aeruginosa PA01
uggucgggcgccgcgccuucugc

SEQ ID NO: 1454179 - RNA, 17 nt, Pseudomonas aeruginosa PA01
uggucggugacccgcac

SEQ ID NO: 1454180 - RNA, 14 nt, Pseudomonas aeruginosa PA01
uggugaacgccagg

SEQ ID NO: 1454181 - RNA, 16 nt, Pseudomonas aeruginosa PA01
uggugaacgccaggca

SEQ ID NO: 1454182 - RNA, 19 nt, Pseudomonas aeruginosa PA01
uggucuucccagaccccgg

SEQ ID NO: 1454183 - RNA, 15 nt, Pseudomonas aeruginosa PA01
uggucugcucggcga

SEQ ID NO: 1454184 - RNA, 19 nt, Pseudomonas aeruginosa PA01
uggucugcucggcgauggc

SEQ ID NO: 1454185 - RNA, 16 nt, Pseudomonas aeruginosa PA01
uggucuugccgauggc

SEQ ID NO: 1454186 - RNA, 13 nt, Pseudomonas aeruginosa PA01
uggucugcacggc

SEQ ID NO: 1454187 - RNA, 17 nt, Pseudomonas aeruginosa PA01
uggucuccgugcuggcc

SEQ ID NO: 1454188 - RNA, 18 nt, Pseudomonas aeruginosa PA01
uggugaugucgcggcagg

SEQ ID NO: 1454189 - RNA, 14 nt, Pseudomonas aeruginosa PA01
uggugaugccgcgg

SEQ ID NO: 1454190 - RNA, 15 nt, Pseudomonas aeruginosa PA01
uggugaugcgcaugc

SEQ ID NO: 1454191 - RNA, 19 nt, Pseudomonas aeruginosa PA01
uggugaucaucguccugcc

SEQ ID NO: 1454192 - RNA, 14 nt, Pseudomonas aeruginosa PA01
uggugaucgaccac

SEQ ID NO: 1454193 - RNA, 19 nt, Pseudomonas aeruginosa PA01
uggugauacguccguucag

SEQ ID NO: 1454194 - RNA, 16 nt, Pseudomonas aeruginosa PA01
uggucgcugaggccgc

SEQ ID NO: 1454195 - RNA, 13 nt, Pseudomonas aeruginosa PA01
uggucggcgcggc

SEQ ID NO: 1454196 - RNA, 17 nt, Pseudomonas aeruginosa PA01
uggucggcuuccgccgc

SEQ ID NO: 1454197 - RNA, 21 nt, Pseudomonas aeruginosa PA01
uggucggcuuccgccgccagg

SEQ ID NO: 1454198 - RNA, 15 nt, Pseudomonas aeruginosa PA01
uggucggcaccaggg

SEQ ID NO: 1454199 - RNA, 20 nt, Pseudomonas aeruginosa PA01
uggucgcgaucaccgcgucc

SEQ ID NO: 1454200 - RNA, 22 nt, Pseudomonas aeruginosa PA01
uggucgcgcaggcgguggagca

SEQ ID NO: 1454201 - RNA, 23 nt, Pseudomonas aeruginosa PA01
uggucgcgcaggcgguggagcac

SEQ ID NO: 1454202 - RNA, 13 nt, Pseudomonas aeruginosa PA01
uggucgcgcgcgg

SEQ ID NO: 1454203 - RNA, 14 nt, Pseudomonas aeruginosa PA01
uggucgcgcgcggc

SEQ ID NO: 1454204 - RNA, 16 nt, Pseudomonas aeruginosa PA01
uggucgccgcccacgc

SEQ ID NO: 1454205 - RNA, 13 nt, Pseudomonas aeruginosa PA01
uggucgccgaagu

SEQ ID NO: 1454206 - RNA, 18 nt, Pseudomonas aeruginosa PA01
ugguccgucgcgcgcccg

SEQ ID NO: 1454207 - RNA, 13 nt, Pseudomonas aeruginosa PA01
ugguccgccagca

SEQ ID NO: 1454208 - RNA, 16 nt, Pseudomonas aeruginosa PA01
ugguccgccagcaggc

SEQ ID NO: 1454209 - RNA, 21 nt, Pseudomonas aeruginosa PA01
uggucgacguaggcggcgagg

SEQ ID NO: 1454210 - RNA, 18 nt, Pseudomonas aeruginosa PA01
uggucgagaaggcugccg

SEQ ID NO: 1454211 - RNA, 18 nt, Pseudomonas aeruginosa PA01
uggucgacauagcgcagc

SEQ ID NO: 1454212 - RNA, 19 nt, Pseudomonas aeruginosa PA01
uggucgacauagcgcagca

SEQ ID NO: 1454213 - RNA, 14 nt, Pseudomonas aeruginosa PA01
uggucgaccaggcg

SEQ ID NO: 1454214 - RNA, 15 nt, Pseudomonas aeruginosa PA01
uggucgcagccgcgc

SEQ ID NO: 1454215 - RNA, 17 nt, Pseudomonas aeruginosa PA01
uggucgcagcuccagcg

SEQ ID NO: 1454216 - RNA, 17 nt, Pseudomonas aeruginosa PA01
uggucgauccgcgccug

SEQ ID NO: 1454217 - RNA, 23 nt, Pseudomonas aeruginosa PA01
uggucgaucuccuccucggcggc

SEQ ID NO: 1454218 - RNA, 22 nt, Pseudomonas aeruginosa PA01
uggucgagcuuguuggccagca

SEQ ID NO: 1454219 - RNA, 19 nt, Pseudomonas aeruginosa PA01
uggucaguucggcccagca

SEQ ID NO: 1454220 - RNA, 13 nt, Pseudomonas aeruginosa PA01
uggucaucaccuu

SEQ ID NO: 1454221 - RNA, 15 nt, Pseudomonas aeruginosa PA01
uggucaucaccuucg

SEQ ID NO: 1454222 - RNA, 21 nt, Pseudomonas aeruginosa PA01
uggucaucaccuucgccagca

SEQ ID NO: 1454223 - RNA, 18 nt, Pseudomonas aeruginosa PA01
uggucaggucgacgccgc

SEQ ID NO: 1454224 - RNA, 16 nt, Pseudomonas aeruginosa PA01
uggucaggcugcgcac

SEQ ID NO: 1454225 - RNA, 20 nt, Pseudomonas aeruginosa PA01
uggucagggugccgauggag

SEQ ID NO: 1454226 - RNA, 20 nt, Pseudomonas aeruginosa PA01
uggucaggccgaccagcgcc

SEQ ID NO: 1454227 - RNA, 14 nt, Pseudomonas aeruginosa PA01
uggucaggccggcg

SEQ ID NO: 1454228 - RNA, 23 nt, Pseudomonas aeruginosa PA01
uggucaggaucacaucgcccggc

SEQ ID NO: 1454229 - RNA, 18 nt, Pseudomonas aeruginosa PA01
ugguccagcacgcuggcg

SEQ ID NO: 1454230 - RNA, 13 nt, Pseudomonas aeruginosa PA01
ugguccaccagcc

SEQ ID NO: 1454231 - RNA, 16 nt, Pseudomonas aeruginosa PA01
uggucauggcgcagac

SEQ ID NO: 1454232 - RNA, 15 nt, Pseudomonas aeruginosa PA01
uggucaacggcgauu

SEQ ID NO: 1454233 - RNA, 16 nt, Pseudomonas aeruginosa PA01
ugguauuggucgcgau

SEQ ID NO: 1454234 - RNA, 13 nt, Pseudomonas aeruginosa PA01
ugguauccaggcg

SEQ ID NO: 1454235 - RNA, 13 nt, Pseudomonas aeruginosa PA01
ugguaucgccguc

SEQ ID NO: 1454236 - RNA, 18 nt, Pseudomonas aeruginosa PA01
ugguaucggcgcucaccg

SEQ ID NO: 1454237 - RNA, 23 nt, Pseudomonas aeruginosa PA01
uggucacgccgaggcugcgggcg

SEQ ID NO: 1454238 - RNA, 20 nt, Pseudomonas aeruginosa PA01
uggucaccacguugcgccgc

SEQ ID NO: 1454239 - RNA, 23 nt, Pseudomonas aeruginosa PA01
uggucaacaccagcgccgccagg

SEQ ID NO: 1454240 - RNA, 22 nt, Pseudomonas aeruginosa PA01
uggucagccagccgagcaacuc

SEQ ID NO: 1454241 - RNA, 16 nt, Pseudomonas aeruginosa PA01
uguauccguacuggcg

SEQ ID NO: 1454242 - RNA, 19 nt, Pseudomonas aeruginosa PA01
uguaguccagcgccgcgcu

SEQ ID NO: 1454243 - RNA, 18 nt, Pseudomonas aeruginosa PA01
uguagucgacgccggucu

SEQ ID NO: 1454244 - RNA, 14 nt, Pseudomonas aeruginosa PA01
uguaggcgcaccag

SEQ ID NO: 1454245 - RNA, 16 nt, Pseudomonas aeruginosa PA01
uguaggcgcaccaggc

SEQ ID NO: 1454246 - RNA, 21 nt, Pseudomonas aeruginosa PA01
uguaggcgcaccaggccaggc

SEQ ID NO: 1454247 - RNA, 19 nt, Pseudomonas aeruginosa PA01
uguaggguucgcugccccg

SEQ ID NO: 1454248 - RNA, 22 nt, Pseudomonas aeruginosa PA01
ugucccggacgggugcgcgcca

SEQ ID NO: 1454249 - RNA, 18 nt, Pseudomonas aeruginosa PA01
uguccccucacggcgcga

SEQ ID NO: 1454250 - RNA, 17 nt, Pseudomonas aeruginosa PA01
uguccccggccagcagc

SEQ ID NO: 1454251 - RNA, 14 nt, Pseudomonas aeruginosa PA01
uguccaggccgauc

SEQ ID NO: 1454252 - RNA, 14 nt, Pseudomonas aeruginosa PA01
uguccagucaccag

SEQ ID NO: 1454253 - RNA, 18 nt, Pseudomonas aeruginosa PA01
uguccaucagccgcgcgc

SEQ ID NO: 1454254 - RNA, 21 nt, Pseudomonas aeruginosa PA01
uguccagggucuucagugcac

SEQ ID NO: 1454255 - RNA, 18 nt, Pseudomonas aeruginosa PA01
ugucgaaguagccggaaa

SEQ ID NO: 1454256 - RNA, 16 nt, Pseudomonas aeruginosa PA01
ugucgcaccagccuuc

SEQ ID NO: 1454257 - RNA, 15 nt, Pseudomonas aeruginosa PA01
uguccugccgcaggc

SEQ ID NO: 1454258 - RNA, 22 nt, Pseudomonas aeruginosa PA01
uguccucgaacagcuugccgcu

SEQ ID NO: 1454259 - RNA, 15 nt, Pseudomonas aeruginosa PA01
uguccuacccgagac

SEQ ID NO: 1454260 - RNA, 15 nt, Pseudomonas aeruginosa PA01
uguccuccagcggcg

SEQ ID NO: 1454261 - RNA, 14 nt, Pseudomonas aeruginosa PA01
uguccugcggccgg

SEQ ID NO: 1454262 - RNA, 18 nt, Pseudomonas aeruginosa PA01
uguccuggauaagccgcg

SEQ ID NO: 1454263 - RNA, 14 nt, Pseudomonas aeruginosa PA01
uguccucggcgccg

SEQ ID NO: 1454264 - RNA, 13 nt, Pseudomonas aeruginosa PA01
ugucgaaccccau

SEQ ID NO: 1454265 - RNA, 20 nt, Pseudomonas aeruginosa PA01
ugucgaacaacccgccagca

SEQ ID NO: 1454266 - RNA, 14 nt, Pseudomonas aeruginosa PA01
uguccuuguucggc

SEQ ID NO: 1454267 - RNA, 13 nt, Pseudomonas aeruginosa PA01
ugucgggggcugc

SEQ ID NO: 1454268 - RNA, 16 nt, Pseudomonas aeruginosa PA01
ugucggcucgcgccgg

SEQ ID NO: 1454269 - RNA, 14 nt, Pseudomonas aeruginosa PA01
ugucgucggcgcgg

SEQ ID NO: 1454270 - RNA, 14 nt, Pseudomonas aeruginosa PA01
ugucguccaucgac

SEQ ID NO: 1454271 - RNA, 14 nt, Pseudomonas aeruginosa PA01
ugucggccugcagc

SEQ ID NO: 1454272 - RNA, 17 nt, Pseudomonas aeruginosa PA01
ugucggcccgcgccaug

SEQ ID NO: 1454273 - RNA, 19 nt, Pseudomonas aeruginosa PA01
ugucgcccgggcgccaccg

SEQ ID NO: 1454274 - RNA, 14 nt, Pseudomonas aeruginosa PA01
ugucgccgaucugc

SEQ ID NO: 1454275 - RNA, 19 nt, Pseudomonas aeruginosa PA01
ugucgccgcggacggccgg

SEQ ID NO: 1454276 - RNA, 15 nt, Pseudomonas aeruginosa PA01
ugucgccgcugggca

SEQ ID NO: 1454277 - RNA, 13 nt, Pseudomonas aeruginosa PA01
ugucgccggcaug

SEQ ID NO: 1454278 - RNA, 23 nt, Pseudomonas aeruginosa PA01
ugucggagagggagcgccuggcg

SEQ ID NO: 1454279 - RNA, 14 nt, Pseudomonas aeruginosa PA01
ugugccgaggccgc

SEQ ID NO: 1454280 - RNA, 17 nt, Pseudomonas aeruginosa PA01
ugugccgaggccgccgc

SEQ ID NO: 1454281 - RNA, 17 nt, Pseudomonas aeruginosa PA01
ugugcgaauguccggcg

SEQ ID NO: 1454282 - RNA, 16 nt, Pseudomonas aeruginosa PA01
ugugcgagacccccgg

SEQ ID NO: 1454283 - RNA, 22 nt, Pseudomonas aeruginosa PA01
ugucguggacauacaggcgcgc

SEQ ID NO: 1454284 - RNA, 21 nt, Pseudomonas aeruginosa PA01
ugucguggucgccguccacca

SEQ ID NO: 1454285 - RNA, 21 nt, Pseudomonas aeruginosa PA01
ugucguuguugccgcgcacca

SEQ ID NO: 1454286 - RNA, 15 nt, Pseudomonas aeruginosa PA01
ugucguugcgccccg

SEQ ID NO: 1454287 - RNA, 17 nt, Pseudomonas aeruginosa PA01
ugucguucuugcgcggu

SEQ ID NO: 1454288 - RNA, 22 nt, Pseudomonas aeruginosa PA01
ugucugcaacccuuugauggcg

SEQ ID NO: 1454289 - RNA, 14 nt, Pseudomonas aeruginosa PA01
ugucucgccagccc

SEQ ID NO: 1454290 - RNA, 17 nt, Pseudomonas aeruginosa PA01
ugucuacucgacgcugc

SEQ ID NO: 1454291 - RNA, 18 nt, Pseudomonas aeruginosa PA01
uucagccgaccguccgcc

SEQ ID NO: 1454292 - RNA, 23 nt, Pseudomonas aeruginosa PA01
uucagcccgccgugcgcuccgcc

SEQ ID NO: 1454293 - RNA, 19 nt, Pseudomonas aeruginosa PA01
uucagcgccaggccgauca

SEQ ID NO: 1454294 - RNA, 13 nt, Pseudomonas aeruginosa PA01
uucagcgccagca

SEQ ID NO: 1454295 - RNA, 18 nt, Pseudomonas aeruginosa PA01
uucagcgccagcaggcga

SEQ ID NO: 1454296 - RNA, 17 nt, Pseudomonas aeruginosa PA01
uucagcgcgccccggcg

SEQ ID NO: 1454297 - RNA, 14 nt, Pseudomonas aeruginosa PA01
uucagcgccucgac

SEQ ID NO: 1454298 - RNA, 16 nt, Pseudomonas aeruginosa PA01
uucagcgccucgagga

SEQ ID NO: 1454299 - RNA, 22 nt, Pseudomonas aeruginosa PA01
uucagcgcgaaggccacgccga

SEQ ID NO: 1454300 - RNA, 21 nt, Pseudomonas aeruginosa PA01
uucagcucggcguagcgcugg

SEQ ID NO: 1454301 - RNA, 22 nt, Pseudomonas aeruginosa PA01
uucagcgguccgcucuggauca

SEQ ID NO: 1454302 - RNA, 20 nt, Pseudomonas aeruginosa PA01
uucauggccuggcgcucagc

SEQ ID NO: 1454303 - RNA, 21 nt, Pseudomonas aeruginosa PA01
uucauggcggucagaucagcg

SEQ ID NO: 1454304 - RNA, 14 nt, Pseudomonas aeruginosa PA01
uucaugagcgcccg

SEQ ID NO: 1454305 - RNA, 19 nt, Pseudomonas aeruginosa PA01
uucaucuccugcuggacga

SEQ ID NO: 1454306 - RNA, 20 nt, Pseudomonas aeruginosa PA01
uucaucgagcggcggccguc

SEQ ID NO: 1454307 - RNA, 17 nt, Pseudomonas aeruginosa PA01
uucauccugcgcgccuc

SEQ ID NO: 1454308 - RNA, 14 nt, Pseudomonas aeruginosa PA01
uucauccugcggaa

SEQ ID NO: 1454309 - RNA, 15 nt, Pseudomonas aeruginosa PA01
uucaggccguucagg

SEQ ID NO: 1454310 - RNA, 15 nt, Pseudomonas aeruginosa PA01
uucaggccggcgccg

SEQ ID NO: 1454311 - RNA, 18 nt, Pseudomonas aeruginosa PA01
uucaggccggcgccgaug

SEQ ID NO: 1454312 - RNA, 12 nt, Pseudomonas aeruginosa PA01
uuccaggcgugc

SEQ ID NO: 1454313 - RNA, 14 nt, Pseudomonas aeruginosa PA01
uuccaggcuguagc

SEQ ID NO: 1454314 - RNA, 19 nt, Pseudomonas aeruginosa PA01
uuccaggcuguagccggcg

SEQ ID NO: 1454315 - RNA, 18 nt, Pseudomonas aeruginosa PA01
uuccaggguuuccagcag

SEQ ID NO: 1454316 - RNA, 14 nt, Pseudomonas aeruginosa PA01
uuccaggucgcugc

SEQ ID NO: 1454317 - RNA, 14 nt, Pseudomonas aeruginosa PA01
uuccagggcggcgc

SEQ ID NO: 1454318 - RNA, 13 nt, Pseudomonas aeruginosa PA01
uuccagggccugc

SEQ ID NO: 1454319 - RNA, 22 nt, Pseudomonas aeruginosa PA01
uuccagggcgaagucggcgcgc

SEQ ID NO: 1454320 - RNA, 15 nt, Pseudomonas aeruginosa PA01
uuccaguucaucgag

SEQ ID NO: 1454321 - RNA, 20 nt, Pseudomonas aeruginosa PA01
uuccaguucaucgagcaggu

SEQ ID NO: 1454322 - RNA, 20 nt, Pseudomonas aeruginosa PA01
uucauuggcgcgucgguggc

SEQ ID NO: 1454323 - RNA, 15 nt, Pseudomonas aeruginosa PA01
uuccaguucggccgc

SEQ ID NO: 1454324 - RNA, 17 nt, Pseudomonas aeruginosa PA01
uucccaggccagcgggc

SEQ ID NO: 1454325 - RNA, 17 nt, Pseudomonas aeruginosa PA01
uuccccaaggcacgccc

SEQ ID NO: 1454326 - RNA, 22 nt, Pseudomonas aeruginosa PA01
uucccagcagcaacagcgccgc

SEQ ID NO: 1454327 - RNA, 17 nt, Pseudomonas aeruginosa PA01
uucccagcagcgccucg

SEQ ID NO: 1454328 - RNA, 20 nt, Pseudomonas aeruginosa PA01
uucccagcagcgccucggca

SEQ ID NO: 1454329 - RNA, 14 nt, Pseudomonas aeruginosa PA01
uuauccgcccugcg

SEQ ID NO: 1454330 - RNA, 12 nt, Pseudomonas aeruginosa PA01
uuauccgccgau

SEQ ID NO: 1454331 - RNA, 14 nt, Pseudomonas aeruginosa PA01
uucaccgcgccgcg

SEQ ID NO: 1454332 - RNA, 15 nt, Pseudomonas aeruginosa PA01
uucaccggcacgccc

SEQ ID NO: 1454333 - RNA, 14 nt, Pseudomonas aeruginosa PA01
uucaauuccgccgc

SEQ ID NO: 1454334 - RNA, 18 nt, Pseudomonas aeruginosa PA01
uucacgacaggcggcggg

SEQ ID NO: 1454335 - RNA, 19 nt, Pseudomonas aeruginosa PA01
uucaccguggcgcuggccg

SEQ ID NO: 1454336 - RNA, 23 nt, Pseudomonas aeruginosa PA01
uucagccagaccggcagcgccgc

SEQ ID NO: 1454337 - RNA, 17 nt, Pseudomonas aeruginosa PA01
uucagccagagcccguc

SEQ ID NO: 1454338 - RNA, 22 nt, Pseudomonas aeruginosa PA01
uucagccagagcccgucgaagc

SEQ ID NO: 1454339 - RNA, 17 nt, Pseudomonas aeruginosa PA01
uucagcagcaggcgcuc

SEQ ID NO: 1454340 - RNA, 18 nt, Pseudomonas aeruginosa PA01
uucagcagcaggcgcucg

SEQ ID NO: 1454341 - RNA, 22 nt, Pseudomonas aeruginosa PA01
uucagcagcgggcguccggcga

SEQ ID NO: 1454342 - RNA, 14 nt, Pseudomonas aeruginosa PA01
uguggauaacgucc

SEQ ID NO: 1454343 - RNA, 23 nt, Pseudomonas aeruginosa PA01
uguggagccggugccggcggcgg

SEQ ID NO: 1454344 - RNA, 19 nt, Pseudomonas aeruginosa PA01
uguggccccagcgcgagcg

SEQ ID NO: 1454345 - RNA, 17 nt, Pseudomonas aeruginosa PA01
uguuggucaggcugcgc

SEQ ID NO: 1454346 - RNA, 17 nt, Pseudomonas aeruginosa PA01
uguggccugggcgcuca

SEQ ID NO: 1454347 - RNA, 11 nt, Pseudomonas aeruginosa PA01
ugugcuggcca

SEQ ID NO: 1454348 - RNA, 12 nt, Pseudomonas aeruginosa PA01
ugugcgccagcu

SEQ ID NO: 1454349 - RNA, 16 nt, Pseudomonas aeruginosa PA01
ugugcguguucggcgg

SEQ ID NO: 1454350 - RNA, 19 nt, Pseudomonas aeruginosa PA01
ugugcguguucggcggcuc

SEQ ID NO: 1454351 - RNA, 15 nt, Pseudomonas aeruginosa PA01
uguuguucgccagca

SEQ ID NO: 1454352 - RNA, 15 nt, Pseudomonas aeruginosa PA01
uuacuccgccggcgu

SEQ ID NO: 1454353 - RNA, 20 nt, Pseudomonas aeruginosa PA01
uuagccgccugcggcguagu

SEQ ID NO: 1454354 - RNA, 13 nt, Pseudomonas aeruginosa PA01
uuagccggcgauc

SEQ ID NO: 1454355 - RNA, 16 nt, Pseudomonas aeruginosa PA01
uuaccguccgcgccgc

SEQ ID NO: 1454356 - RNA, 16 nt, Pseudomonas aeruginosa PA01
uuacggagaagggcgc

SEQ ID NO: 1454357 - RNA, 18 nt, Pseudomonas aeruginosa PA01
uucugccacccggcgccc

SEQ ID NO: 1454358 - RNA, 21 nt, Pseudomonas aeruginosa PA01
uucugccacccggcgcccggc

SEQ ID NO: 1454359 - RNA, 21 nt, Pseudomonas aeruginosa PA01
uucugcaauugcuugcgcucg

SEQ ID NO: 1454360 - RNA, 22 nt, Pseudomonas aeruginosa PA01
uucugcaccuuggccacgcugc

SEQ ID NO: 1454361 - RNA, 14 nt, Pseudomonas aeruginosa PA01
uucugcgccuccuc

SEQ ID NO: 1454362 - RNA, 14 nt, Pseudomonas aeruginosa PA01
uucucggcgauggc

SEQ ID NO: 1454363 - RNA, 13 nt, Pseudomonas aeruginosa PA01
uucucggccacca

SEQ ID NO: 1454364 - RNA, 18 nt, Pseudomonas aeruginosa PA01
uucucggucgccgccagc

SEQ ID NO: 1454365 - RNA, 22 nt, Pseudomonas aeruginosa PA01
uucuccgggucgugcccgagcg

SEQ ID NO: 1454366 - RNA, 23 nt, Pseudomonas aeruginosa PA01
uucuccgccagccagccgcgcgc

SEQ ID NO: 1454367 - RNA, 24 nt, Pseudomonas aeruginosa PA01
uucuccgccgcgugcgcgcccucg

SEQ ID NO: 1454368 - RNA, 21 nt, Pseudomonas aeruginosa PA01
uucucgacgaaggcgcgcucg

SEQ ID NO: 1454369 - RNA, 20 nt, Pseudomonas aeruginosa PA01
uucugcuggccaccgcggcg

SEQ ID NO: 1454370 - RNA, 18 nt, Pseudomonas aeruginosa PA01
uucuggaugcagccgggg

SEQ ID NO: 1454371 - RNA, 23 nt, Pseudomonas aeruginosa PA01
uucuucaggcaaggucgucucag

SEQ ID NO: 1454372 - RNA, 23 nt, Pseudomonas aeruginosa PA01
uucuucagcagcgggcguccggc

SEQ ID NO: 1454373 - RNA, 21 nt, Pseudomonas aeruginosa PA01
uucuucccacuccagcgcggg

SEQ ID NO: 1454374 - RNA, 18 nt, Pseudomonas aeruginosa PA01
uucuucugcugugcgucg

SEQ ID NO: 1454375 - RNA, 19 nt, Pseudomonas aeruginosa PA01
uucuuccacuugcgccggc

SEQ ID NO: 1454376 - RNA, 23 nt, Pseudomonas aeruginosa PA01
uucuucgccuugcccuggccggc

SEQ ID NO: 1454377 - RNA, 16 nt, Pseudomonas aeruginosa PA01
uucuaccuggcgcuga

SEQ ID NO: 1454378 - RNA, 21 nt, Pseudomonas aeruginosa PA01
uucgucgagggucugcuggua

SEQ ID NO: 1454379 - RNA, 17 nt, Pseudomonas aeruginosa PA01
uucgucgccacgcccgc

SEQ ID NO: 1454380 - RNA, 12 nt, Pseudomonas aeruginosa PA01
uucgucgcgcag

SEQ ID NO: 1454381 - RNA, 14 nt, Pseudomonas aeruginosa PA01
uucgucggccacca

SEQ ID NO: 1454382 - RNA, 23 nt, Pseudomonas aeruginosa PA01
uucgguaccugguccgucucguc

SEQ ID NO: 1454383 - RNA, 19 nt, Pseudomonas aeruginosa PA01
uucgucaccggcgccaccc

SEQ ID NO: 1454384 - RNA, 14 nt, Pseudomonas aeruginosa PA01
uucguccaggccgc

SEQ ID NO: 1454385 - RNA, 20 nt, Pseudomonas aeruginosa PA01
uucguccaugcucgccaccu

SEQ ID NO: 1454386 - RNA, 21 nt, Pseudomonas aeruginosa PA01
uucgggaagggaucgaccggu

SEQ ID NO: 1454387 - RNA, 23 nt, Pseudomonas aeruginosa PA01
uucggcgcauagccaccgccgac

SEQ ID NO: 1454388 - RNA, 22 nt, Pseudomonas aeruginosa PA01
uucggcguccugcucccuggcg

SEQ ID NO: 1454389 - RNA, 11 nt, Pseudomonas aeruginosa PA01
uucggcggcgc

SEQ ID NO: 1454390 - RNA, 17 nt, Pseudomonas aeruginosa PA01
uucggcggcgccuugcg

SEQ ID NO: 1454391 - RNA, 15 nt, Pseudomonas aeruginosa PA01
uucggucgcgccccg

SEQ ID NO: 1454392 - RNA, 15 nt, Pseudomonas aeruginosa PA01
uucggugccgccggc

SEQ ID NO: 1454393 - RNA, 19 nt, Pseudomonas aeruginosa PA01
uucggggaacagcgccagc

SEQ ID NO: 1454394 - RNA, 16 nt, Pseudomonas aeruginosa PA01
uucggguagccaugca

SEQ ID NO: 1454395 - RNA, 21 nt, Pseudomonas aeruginosa PA01
uucggguccaggcgccagagc

SEQ ID NO: 1454396 - RNA, 16 nt, Pseudomonas aeruginosa PA01
uucggcgagaggucgg

SEQ ID NO: 1454397 - RNA, 21 nt, Pseudomonas aeruginosa PA01
uucggcgagaggucggcgcgc

SEQ ID NO: 1454398 - RNA, 11 nt, Pseudomonas aeruginosa PA01
uucggcgaugc

SEQ ID NO: 1454399 - RNA, 16 nt, Pseudomonas aeruginosa PA01
uucggcgaugccgcgc

SEQ ID NO: 1454400 - RNA, 12 nt, Pseudomonas aeruginosa PA01
uucggcgccagc

SEQ ID NO: 1454401 - RNA, 13 nt, Pseudomonas aeruginosa PA01
uucggcggccagc

SEQ ID NO: 1454402 - RNA, 14 nt, Pseudomonas aeruginosa PA01
uucggccagggagu

SEQ ID NO: 1454403 - RNA, 14 nt, Pseudomonas aeruginosa PA01
uucggccagccggc

SEQ ID NO: 1454404 - RNA, 15 nt, Pseudomonas aeruginosa PA01
uucggccagccggcg

SEQ ID NO: 1454405 - RNA, 17 nt, Pseudomonas aeruginosa PA01
uucggcgacagccgggc

SEQ ID NO: 1454406 - RNA, 15 nt, Pseudomonas aeruginosa PA01
uucgccgagcgccgc

SEQ ID NO: 1454407 - RNA, 13 nt, Pseudomonas aeruginosa PA01
uucgccggccagg

SEQ ID NO: 1454408 - RNA, 23 nt, Pseudomonas aeruginosa PA01
uucgccggccagguggucguagc

SEQ ID NO: 1454409 - RNA, 13 nt, Pseudomonas aeruginosa PA01
uucgccggccucc

SEQ ID NO: 1454410 - RNA, 16 nt, Pseudomonas aeruginosa PA01
uucgccggccugcgcg

SEQ ID NO: 1454411 - RNA, 14 nt, Pseudomonas aeruginosa PA01
uucgccgaucacca

SEQ ID NO: 1454412 - RNA, 18 nt, Pseudomonas aeruginosa PA01
uucgccgcccgcgccucc

SEQ ID NO: 1454413 - RNA, 19 nt, Pseudomonas aeruginosa PA01
uucgccgcccgcgccucca

SEQ ID NO: 1454414 - RNA, 14 nt, Pseudomonas aeruginosa PA01
uucgccgccgagcg

SEQ ID NO: 1454415 - RNA, 14 nt, Pseudomonas aeruginosa PA01
uucgccgccgcgcg

SEQ ID NO: 1454416 - RNA, 16 nt, Pseudomonas aeruginosa PA01
uucgccgccgcgcgcg

SEQ ID NO: 1454417 - RNA, 22 nt, Pseudomonas aeruginosa PA01
uucgcgacccucagucgccccc

SEQ ID NO: 1454418 - RNA, 17 nt, Pseudomonas aeruginosa PA01
uucgccuugcccuggcc

SEQ ID NO: 1454419 - RNA, 17 nt, Pseudomonas aeruginosa PA01
uucgcaggagucgacga

SEQ ID NO: 1454420 - RNA, 14 nt, Pseudomonas aeruginosa PA01
uucgcaggccaggc

SEQ ID NO: 1454421 - RNA, 14 nt, Pseudomonas aeruginosa PA01
uucgcaccagccgg

SEQ ID NO: 1454422 - RNA, 15 nt, Pseudomonas aeruginosa PA01
uucgccagcaccucg

SEQ ID NO: 1454423 - RNA, 20 nt, Pseudomonas aeruginosa PA01
uucgccacgcugcugccggc

SEQ ID NO: 1454424 - RNA, 14 nt, Pseudomonas aeruginosa PA01
uucgccgaccaggu

SEQ ID NO: 1454425 - RNA, 19 nt, Pseudomonas aeruginosa PA01
uucgcccucagcagcgccg

SEQ ID NO: 1454426 - RNA, 15 nt, Pseudomonas aeruginosa PA01
uucgccccgccgcca

SEQ ID NO: 1454427 - RNA, 20 nt, Pseudomonas aeruginosa PA01
uucgcccgcggcggcgacgc

SEQ ID NO: 1454428 - RNA, 18 nt, Pseudomonas aeruginosa PA01
uucgccccagcggucgau

SEQ ID NO: 1454429 - RNA, 16 nt, Pseudomonas aeruginosa PA01
uucgcccauggcacgc

SEQ ID NO: 1454430 - RNA, 22 nt, Pseudomonas aeruginosa PA01
uucgcggucggugagcacgccg

SEQ ID NO: 1454431 - RNA, 18 nt, Pseudomonas aeruginosa PA01
uucgcguagccccucgcg

SEQ ID NO: 1454432 - RNA, 21 nt, Pseudomonas aeruginosa PA01
uucgcugacgaggacgccgcc

SEQ ID NO: 1454433 - RNA, 22 nt, Pseudomonas aeruginosa PA01
uucgcugacgaggacgccgccg

SEQ ID NO: 1454434 - RNA, 21 nt, Pseudomonas aeruginosa PA01
uucgcuaaccggucgcaaugg

SEQ ID NO: 1454435 - RNA, 15 nt, Pseudomonas aeruginosa PA01
uucgcgccauggccg

SEQ ID NO: 1454436 - RNA, 22 nt, Pseudomonas aeruginosa PA01
uucgcgcggauauagcugguca

SEQ ID NO: 1454437 - RNA, 13 nt, Pseudomonas aeruginosa PA01
uucgcggaccacg

SEQ ID NO: 1454438 - RNA, 21 nt, Pseudomonas aeruginosa PA01
uucgcggacgccgaagcgggc

SEQ ID NO: 1454439 - RNA, 17 nt, Pseudomonas aeruginosa PA01
uucgcggcggcgcgucg

SEQ ID NO: 1454440 - RNA, 14 nt, Pseudomonas aeruginosa PA01
uucgcgggccaggc

SEQ ID NO: 1454441 - RNA, 20 nt, Pseudomonas aeruginosa PA01
uucgcgggccaggccgagcg

SEQ ID NO: 1454442 - RNA, 22 nt, Pseudomonas aeruginosa PA01
uucggagaacagcgagaccucg

SEQ ID NO: 1454443 - RNA, 23 nt, Pseudomonas aeruginosa PA01
uucggagaacagcgagaccucgc

SEQ ID NO: 1454444 - RNA, 15 nt, Pseudomonas aeruginosa PA01
uucggaucggcccgg

SEQ ID NO: 1454445 - RNA, 16 nt, Pseudomonas aeruginosa PA01
uucggaucggcccggc

SEQ ID NO: 1454446 - RNA, 17 nt, Pseudomonas aeruginosa PA01
uucggaucggcccggcg

SEQ ID NO: 1454447 - RNA, 19 nt, Pseudomonas aeruginosa PA01
uucggcaccccuucgagca

SEQ ID NO: 1454448 - RNA, 15 nt, Pseudomonas aeruginosa PA01
uucggcagcgccucg

SEQ ID NO: 1454449 - RNA, 19 nt, Pseudomonas aeruginosa PA01
uucggcauuacuugcccac

SEQ ID NO: 1454450 - RNA, 21 nt, Pseudomonas aeruginosa PA01
uucggcauuacuugcccacgc

SEQ ID NO: 1454451 - RNA, 14 nt, Pseudomonas aeruginosa PA01
uucgcuuugcgcgc

SEQ ID NO: 1454452 - RNA, 16 nt, Pseudomonas aeruginosa PA01
uucgcuuugcgcgcag

SEQ ID NO: 1454453 - RNA, 22 nt, Pseudomonas aeruginosa PA01
uucgcuggcgaacggcuggucg

SEQ ID NO: 1454454 - RNA, 16 nt, Pseudomonas aeruginosa PA01
uucgcuucggccacca

SEQ ID NO: 1454455 - RNA, 14 nt, Pseudomonas aeruginosa PA01
uucgcugucgagca

SEQ ID NO: 1454456 - RNA, 15 nt, Pseudomonas aeruginosa PA01
uucgcugucgagcag

SEQ ID NO: 1454457 - RNA, 20 nt, Pseudomonas aeruginosa PA01
uucgcugucgagcagggaga

SEQ ID NO: 1454458 - RNA, 22 nt, Pseudomonas aeruginosa PA01
uucgcugccgccgcgcugcagg

SEQ ID NO: 1454459 - RNA, 20 nt, Pseudomonas aeruginosa PA01
uucgcuggaccaggcggccg

SEQ ID NO: 1454460 - RNA, 14 nt, Pseudomonas aeruginosa PA01
uucccugccggcgg

SEQ ID NO: 1454461 - RNA, 14 nt, Pseudomonas aeruginosa PA01
uucccugcgccucg

SEQ ID NO: 1454462 - RNA, 20 nt, Pseudomonas aeruginosa PA01
uucccccuuuuucggcgcgg

SEQ ID NO: 1454463 - RNA, 13 nt, Pseudomonas aeruginosa PA01
uucccccguggcg

SEQ ID NO: 1454464 - RNA, 12 nt, Pseudomonas aeruginosa PA01
uuccgacccgga

SEQ ID NO: 1454465 - RNA, 20 nt, Pseudomonas aeruginosa PA01
uuccgaaucgccuaccagac

SEQ ID NO: 1454466 - RNA, 21 nt, Pseudomonas aeruginosa PA01
uuccgauuucagcuucaucgc

SEQ ID NO: 1454467 - RNA, 13 nt, Pseudomonas aeruginosa PA01
uuccucgcucgcu

SEQ ID NO: 1454468 - RNA, 14 nt, Pseudomonas aeruginosa PA01
uuccucggugaugc

SEQ ID NO: 1454469 - RNA, 21 nt, Pseudomonas aeruginosa PA01
uuccgccagaugcgcgucgcc

SEQ ID NO: 1454470 - RNA, 22 nt, Pseudomonas aeruginosa PA01
uuccugcccgaccgguuccagc

SEQ ID NO: 1454471 - RNA, 15 nt, Pseudomonas aeruginosa PA01
uuccuguucgcugcc

SEQ ID NO: 1454472 - RNA, 15 nt, Pseudomonas aeruginosa PA01
uuccugcuggcuggc

SEQ ID NO: 1454473 - RNA, 16 nt, Pseudomonas aeruginosa PA01
uuccuucuugacccgc

SEQ ID NO: 1454474 - RNA, 17 nt, Pseudomonas aeruginosa PA01
uuccuugcgcggcaggc

SEQ ID NO: 1454475 - RNA, 23 nt, Pseudomonas aeruginosa PA01
uuccugguggaacagccgcagcg

SEQ ID NO: 1454476 - RNA, 14 nt, Pseudomonas aeruginosa PA01
uuccuggcgccggu

SEQ ID NO: 1454477 - RNA, 13 nt, Pseudomonas aeruginosa PA01
uuccuggcuggag

SEQ ID NO: 1454478 - RNA, 12 nt, Pseudomonas aeruginosa PA01
uuccugggaugc

SEQ ID NO: 1454479 - RNA, 13 nt, Pseudomonas aeruginosa PA01
uuccugggcgugc

SEQ ID NO: 1454480 - RNA, 17 nt, Pseudomonas aeruginosa PA01
uucgaucuccucgcgca

SEQ ID NO: 1454481 - RNA, 17 nt, Pseudomonas aeruginosa PA01
uucgaugacgccauccu

SEQ ID NO: 1454482 - RNA, 13 nt, Pseudomonas aeruginosa PA01
uucgaugccgcgc

SEQ ID NO: 1454483 - RNA, 16 nt, Pseudomonas aeruginosa PA01
uucgaugcgccgcagg

SEQ ID NO: 1454484 - RNA, 19 nt, Pseudomonas aeruginosa PA01
uucgcaaagcgagcgcccg

SEQ ID NO: 1454485 - RNA, 20 nt, Pseudomonas aeruginosa PA01
uucgcaaagcgagcgcccgc

SEQ ID NO: 1454486 - RNA, 19 nt, Pseudomonas aeruginosa PA01
uucgaggcgggcgucggcg

SEQ ID NO: 1454487 - RNA, 19 nt, Pseudomonas aeruginosa PA01
uucgagcaggaggauacgg

SEQ ID NO: 1454488 - RNA, 13 nt, Pseudomonas aeruginosa PA01
uucgacgucgauc

SEQ ID NO: 1454489 - RNA, 22 nt, Pseudomonas aeruginosa PA01
uucgacaugggccgcgcagauc

SEQ ID NO: 1454490 - RNA, 22 nt, Pseudomonas aeruginosa PA01
uucgacagcagguggcugguca

SEQ ID NO: 1454491 - RNA, 16 nt, Pseudomonas aeruginosa PA01
uucgaccggcgcgccu

SEQ ID NO: 1454492 - RNA, 16 nt, Pseudomonas aeruginosa PA01
uucgaccuccaggccg

SEQ ID NO: 1454493 - RNA, 23 nt, Pseudomonas aeruginosa PA01
uucgacgaagggcucagcccagg

SEQ ID NO: 1454494 - RNA, 13 nt, Pseudomonas aeruginosa PA01
uucgacgcgcggc

SEQ ID NO: 1454495 - RNA, 22 nt, Pseudomonas aeruginosa PA01
uucgacgcucugcucggccagc

SEQ ID NO: 1454496 - RNA, 22 nt, Pseudomonas aeruginosa PA01
uucgaaccguggcggccgccgc

SEQ ID NO: 1454497 - RNA, 23 nt, Pseudomonas aeruginosa PA01
uucgaaguccacugucucgccga

SEQ ID NO: 1454498 - RNA, 15 nt, Pseudomonas aeruginosa PA01
uucgaagcucucgcc

SEQ ID NO: 1454499 - RNA, 22 nt, Pseudomonas aeruginosa PA01
ucgcgacacaccgacaaucgcc

SEQ ID NO: 1454500 - RNA, 14 nt, Pseudomonas aeruginosa PA01
ucgcgacaccgggc

SEQ ID NO: 1454501 - RNA, 19 nt, Pseudomonas aeruginosa PA01
ucgccguacagcaggcagg

SEQ ID NO: 1454502 - RNA, 16 nt, Pseudomonas aeruginosa PA01
ucgccgucaucgagca

SEQ ID NO: 1454503 - RNA, 19 nt, Pseudomonas aeruginosa PA01
ucgccgucgagccagccca

SEQ ID NO: 1454504 - RNA, 17 nt, Pseudomonas aeruginosa PA01
ucgccguccgcgaugcg

SEQ ID NO: 1454505 - RNA, 15 nt, Pseudomonas aeruginosa PA01
ucgccggugacgcug

SEQ ID NO: 1454506 - RNA, 18 nt, Pseudomonas aeruginosa PA01
ucgccgggaaacagggcg

SEQ ID NO: 1454507 - RNA, 22 nt, Pseudomonas aeruginosa PA01
ucgccggugcggguaucgaucu

SEQ ID NO: 1454508 - RNA, 22 nt, Pseudomonas aeruginosa PA01
ucgcgacccucagucgccccca

SEQ ID NO: 1454509 - RNA, 14 nt, Pseudomonas aeruginosa PA01
ucgcgacccuggcc

SEQ ID NO: 1454510 - RNA, 18 nt, Pseudomonas aeruginosa PA01
ucgcgacccuggccgcgc

SEQ ID NO: 1454511 - RNA, 23 nt, Pseudomonas aeruginosa PA01
ucgcgacggugaaguagaucgcc

SEQ ID NO: 1454512 - RNA, 16 nt, Pseudomonas aeruginosa PA01
ucgcgacugaccacgc

SEQ ID NO: 1454513 - RNA, 18 nt, Pseudomonas aeruginosa PA01
ucgcgacugaccacgcag

SEQ ID NO: 1454514 - RNA, 15 nt, Pseudomonas aeruginosa PA01
ucgcgacugccgucg

SEQ ID NO: 1454515 - RNA, 16 nt, Pseudomonas aeruginosa PA01
ucgcgacugccgucgg

SEQ ID NO: 1454516 - RNA, 17 nt, Pseudomonas aeruginosa PA01
ucgcgagcagggcgaug

SEQ ID NO: 1454517 - RNA, 19 nt, Pseudomonas aeruginosa PA01
ucgcgagcagggcgaugcc

SEQ ID NO: 1454518 - RNA, 13 nt, Pseudomonas aeruginosa PA01
ucgcgaucugcug

SEQ ID NO: 1454519 - RNA, 14 nt, Pseudomonas aeruginosa PA01
ucgcgauccaccgc

SEQ ID NO: 1454520 - RNA, 18 nt, Pseudomonas aeruginosa PA01
ucgcgauccaccgccagg

SEQ ID NO: 1454521 - RNA, 17 nt, Pseudomonas aeruginosa PA01
ucgcgauacucgugggc

SEQ ID NO: 1454522 - RNA, 21 nt, Pseudomonas aeruginosa PA01
ucgcgauacucgugggccggu

SEQ ID NO: 1454523 - RNA, 19 nt, Pseudomonas aeruginosa PA01
ucgcgauagacgccggcga

SEQ ID NO: 1454524 - RNA, 13 nt, Pseudomonas aeruginosa PA01
ucgcgcgcggcca

SEQ ID NO: 1454525 - RNA, 14 nt, Pseudomonas aeruginosa PA01
ucgcgcgcggccag

SEQ ID NO: 1454526 - RNA, 19 nt, Pseudomonas aeruginosa PA01
ucgcgccgacgacccggau

SEQ ID NO: 1454527 - RNA, 21 nt, Pseudomonas aeruginosa PA01
ucgcgccagccccaggcgcgg

SEQ ID NO: 1454528 - RNA, 15 nt, Pseudomonas aeruginosa PA01
ucgcgccaggcgaag

SEQ ID NO: 1454529 - RNA, 16 nt, Pseudomonas aeruginosa PA01
ucgcgccaggcgaaga

SEQ ID NO: 1454530 - RNA, 14 nt, Pseudomonas aeruginosa PA01
ucgcgcccgcugug

SEQ ID NO: 1454531 - RNA, 16 nt, Pseudomonas aeruginosa PA01
ucgcgccccgccagga

SEQ ID NO: 1454532 - RNA, 21 nt, Pseudomonas aeruginosa PA01
ucgcgccccgggaccaucacc

SEQ ID NO: 1454533 - RNA, 12 nt, Pseudomonas aeruginosa PA01
ucgcgccagcac

SEQ ID NO: 1454534 - RNA, 19 nt, Pseudomonas aeruginosa PA01
ucgcgccauggccgcugaa

SEQ ID NO: 1454535 - RNA, 23 nt, Pseudomonas aeruginosa PA01
ucgcgcaucuggcugcgcgccac

SEQ ID NO: 1454536 - RNA, 20 nt, Pseudomonas aeruginosa PA01
ucgcgcaugaccuucagcac

SEQ ID NO: 1454537 - RNA, 21 nt, Pseudomonas aeruginosa PA01
ucgcgcaugaccuucagcacc

SEQ ID NO: 1454538 - RNA, 23 nt, Pseudomonas aeruginosa PA01
ucgcgcaugaccuucagcaccug

SEQ ID NO: 1454539 - RNA, 19 nt, Pseudomonas aeruginosa PA01
ucgcgcagcgccuccagcg

SEQ ID NO: 1454540 - RNA, 21 nt, Pseudomonas aeruginosa PA01
ucgcgaugguaguccgcugcg

SEQ ID NO: 1454541 - RNA, 13 nt, Pseudomonas aeruginosa PA01
ucgcgcagcaccg

SEQ ID NO: 1454542 - RNA, 16 nt, Pseudomonas aeruginosa PA01
ucgcgcagaucgccgc

SEQ ID NO: 1454543 - RNA, 12 nt, Pseudomonas aeruginosa PA01
ucgcgcagcgcc

SEQ ID NO: 1454544 - RNA, 19 nt, Pseudomonas aeruginosa PA01
ucgcgcagccacuggcgga

SEQ ID NO: 1454545 - RNA, 20 nt, Pseudomonas aeruginosa PA01
ucgcgcagcaggauccaggu

SEQ ID NO: 1454546 - RNA, 21 nt, Pseudomonas aeruginosa PA01
ucgcgcagccaggcgaggaac

SEQ ID NO: 1454547 - RNA, 12 nt, Pseudomonas aeruginosa PA01
ucgcgcagcagg

SEQ ID NO: 1454548 - RNA, 15 nt, Pseudomonas aeruginosa PA01
ucgcgcagcaggcgg

SEQ ID NO: 1454549 - RNA, 16 nt, Pseudomonas aeruginosa PA01
ucgcgcagcaggcggc

SEQ ID NO: 1454550 - RNA, 19 nt, Pseudomonas aeruginosa PA01
ucgcgcagcaggcggccca

SEQ ID NO: 1454551 - RNA, 15 nt, Pseudomonas aeruginosa PA01
ucgcgcguggccgcc

SEQ ID NO: 1454552 - RNA, 16 nt, Pseudomonas aeruginosa PA01
ucgcgcguggccgcca

SEQ ID NO: 1454553 - RNA, 20 nt, Pseudomonas aeruginosa PA01
ucgcggaucugcuccugcag

SEQ ID NO: 1454554 - RNA, 14 nt, Pseudomonas aeruginosa PA01
ucgcggaucaacgc

SEQ ID NO: 1454555 - RNA, 16 nt, Pseudomonas aeruginosa PA01
ucgcggaucaggcugg

SEQ ID NO: 1454556 - RNA, 18 nt, Pseudomonas aeruginosa PA01
ucgcgcgccucgcggcgu

SEQ ID NO: 1454557 - RNA, 16 nt, Pseudomonas aeruginosa PA01
ucgcgcgcuggucgac

SEQ ID NO: 1454558 - RNA, 20 nt, Pseudomonas aeruginosa PA01
ucgcgcggagugcugaguuu

SEQ ID NO: 1454559 - RNA, 21 nt, Pseudomonas aeruginosa PA01
ucgcgcggauauagcugguca

SEQ ID NO: 1454560 - RNA, 13 nt, Pseudomonas aeruginosa PA01
ucgcgcggggcgc

SEQ ID NO: 1454561 - RNA, 10 nt, Pseudomonas aeruginosa PA01
ucgcgcggcu

SEQ ID NO: 1454562 - RNA, 13 nt, Pseudomonas aeruginosa PA01
ucgcgcgggucgu

SEQ ID NO: 1454563 - RNA, 13 nt, Pseudomonas aeruginosa PA01
ucgcgcgggugcg

SEQ ID NO: 1454564 - RNA, 15 nt, Pseudomonas aeruginosa PA01
ucgcgcguccagccg

SEQ ID NO: 1454565 - RNA, 20 nt, Pseudomonas aeruginosa PA01
ucgcgcguccagccgguagg

SEQ ID NO: 1454566 - RNA, 22 nt, Pseudomonas aeruginosa PA01
ucgcggcgacgaucacccccag

SEQ ID NO: 1454567 - RNA, 19 nt, Pseudomonas aeruginosa PA01
ucgcggccuucucgucgcc

SEQ ID NO: 1454568 - RNA, 22 nt, Pseudomonas aeruginosa PA01
ucgcggccuucucgucgccgcc

SEQ ID NO: 1454569 - RNA, 13 nt, Pseudomonas aeruginosa PA01
ucgcggcgaugcg

SEQ ID NO: 1454570 - RNA, 21 nt, Pseudomonas aeruginosa PA01
ucgcggcgaugcgcaugcgca

SEQ ID NO: 1454571 - RNA, 18 nt, Pseudomonas aeruginosa PA01
ucgcggcgauggccgcca

SEQ ID NO: 1454572 - RNA, 23 nt, Pseudomonas aeruginosa PA01
ucgcggcgauggccgccagcagg

SEQ ID NO: 1454573 - RNA, 12 nt, Pseudomonas aeruginosa PA01
ucgcggcgcagu

SEQ ID NO: 1454574 - RNA, 14 nt, Pseudomonas aeruginosa PA01
ucgcggcgcaguuc

SEQ ID NO: 1454575 - RNA, 12 nt, Pseudomonas aeruginosa PA01
ucgcggcgcggc

SEQ ID NO: 1454576 - RNA, 15 nt, Pseudomonas aeruginosa PA01
ucgcggcgcggcggg

SEQ ID NO: 1454577 - RNA, 15 nt, Pseudomonas aeruginosa PA01
ucgcggcgccuggcg

SEQ ID NO: 1454578 - RNA, 22 nt, Pseudomonas aeruginosa PA01
ucgcggcgcgauauccgccagg

SEQ ID NO: 1454579 - RNA, 23 nt, Pseudomonas aeruginosa PA01
ucgcggcgcgauauccgccaggg

SEQ ID NO: 1454580 - RNA, 23 nt, Pseudomonas aeruginosa PA01
ucgcggcgcaggcugucggccag

SEQ ID NO: 1454581 - RNA, 19 nt, Pseudomonas aeruginosa PA01
ucgcggccagccgcuagcg

SEQ ID NO: 1454582 - RNA, 14 nt, Pseudomonas aeruginosa PA01
ucgcggccccagca

SEQ ID NO: 1454583 - RNA, 15 nt, Pseudomonas aeruginosa PA01
ucgcggccccagcac

SEQ ID NO: 1454584 - RNA, 15 nt, Pseudomonas aeruginosa PA01
ucgcggcaucccgcc

SEQ ID NO: 1454585 - RNA, 16 nt, Pseudomonas aeruginosa PA01
ucgcggcaucccgccc

SEQ ID NO: 1454586 - RNA, 20 nt, Pseudomonas aeruginosa PA01
ucgcggggcuugcgccccca

SEQ ID NO: 1454587 - RNA, 20 nt, Pseudomonas aeruginosa PA01
ucgcgggcgugcuccagcac

SEQ ID NO: 1454588 - RNA, 23 nt, Pseudomonas aeruginosa PA01
ucgcgggcgacgaagcccucgcg

SEQ ID NO: 1454589 - RNA, 21 nt, Pseudomonas aeruginosa PA01
ucgcgggcgccguggaucgcc

SEQ ID NO: 1454590 - RNA, 21 nt, Pseudomonas aeruginosa PA01
ucgcgguccagggugaucgac

SEQ ID NO: 1454591 - RNA, 19 nt, Pseudomonas aeruginosa PA01
ucgcgggugaccuggccgc

SEQ ID NO: 1454592 - RNA, 20 nt, Pseudomonas aeruginosa PA01
ucgcggguuacuucgccgau

SEQ ID NO: 1454593 - RNA, 20 nt, Pseudomonas aeruginosa PA01
ucgcgguacagcucguccuu

SEQ ID NO: 1454594 - RNA, 14 nt, Pseudomonas aeruginosa PA01
ucgcgguaggccag

SEQ ID NO: 1454595 - RNA, 15 nt, Pseudomonas aeruginosa PA01
ucgcgguaggccagc

SEQ ID NO: 1454596 - RNA, 16 nt, Pseudomonas aeruginosa PA01
ucgcgguaggccagcu

SEQ ID NO: 1454597 - RNA, 17 nt, Pseudomonas aeruginosa PA01
ucgcgguaggccagcuc

SEQ ID NO: 1454598 - RNA, 17 nt, Pseudomonas aeruginosa PA01
ucgcggcuuucuuccag

SEQ ID NO: 1454599 - RNA, 16 nt, Pseudomonas aeruginosa PA01
ucgcgggaacggcgua

SEQ ID NO: 1454600 - RNA, 15 nt, Pseudomonas aeruginosa PA01
ucgcggcucuggcgc

SEQ ID NO: 1454601 - RNA, 18 nt, Pseudomonas aeruginosa PA01
ucgcggcucuggcgcagg

SEQ ID NO: 1454602 - RNA, 13 nt, Pseudomonas aeruginosa PA01
ucgcggcuggccg

SEQ ID NO: 1454603 - RNA, 15 nt, Pseudomonas aeruginosa PA01
ucgcggcuggccgcc

SEQ ID NO: 1454604 - RNA, 22 nt, Pseudomonas aeruginosa PA01
ucgcggcuggccgccuggccgg

SEQ ID NO: 1454605 - RNA, 21 nt, Pseudomonas aeruginosa PA01
ucgcggcguaggcgcgccaag

SEQ ID NO: 1454606 - RNA, 23 nt, Pseudomonas aeruginosa PA01
ucgcggcuaucgaucacugccug

SEQ ID NO: 1454607 - RNA, 20 nt, Pseudomonas aeruginosa PA01
ucgcgggcaugcugcucggc

SEQ ID NO: 1454608 - RNA, 12 nt, Pseudomonas aeruginosa PA01
ucgcgggccagg

SEQ ID NO: 1454609 - RNA, 15 nt, Pseudomonas aeruginosa PA01
ucgcgggccgcggcg

SEQ ID NO: 1454610 - RNA, 16 nt, Pseudomonas aeruginosa PA01
ucgcgggccgcggcga

SEQ ID NO: 1454611 - RNA, 17 nt, Pseudomonas aeruginosa PA01
ucgcgggccgcggcgac

SEQ ID NO: 1454612 - RNA, 19 nt, Pseudomonas aeruginosa PA01
ucgcgggccgcggcgacca

SEQ ID NO: 1454613 - RNA, 20 nt, Pseudomonas aeruginosa PA01
ucgccauucggcgacgggcu

SEQ ID NO: 1454614 - RNA, 13 nt, Pseudomonas aeruginosa PA01
ucgccauuggcca

SEQ ID NO: 1454615 - RNA, 15 nt, Pseudomonas aeruginosa PA01
ucgccauuggccagg

SEQ ID NO: 1454616 - RNA, 22 nt, Pseudomonas aeruginosa PA01
ucgccauuggccagggucacgc

SEQ ID NO: 1454617 - RNA, 12 nt, Pseudomonas aeruginosa PA01
ucgccauccugg

SEQ ID NO: 1454618 - RNA, 22 nt, Pseudomonas aeruginosa PA01
ucgccauggucguucagcggcg

SEQ ID NO: 1454619 - RNA, 13 nt, Pseudomonas aeruginosa PA01
ucgccauggcgga

SEQ ID NO: 1454620 - RNA, 14 nt, Pseudomonas aeruginosa PA01
ucgcccaccagguc

SEQ ID NO: 1454621 - RNA, 18 nt, Pseudomonas aeruginosa PA01
ucgcccaccuugcgggug

SEQ ID NO: 1454622 - RNA, 14 nt, Pseudomonas aeruginosa PA01
ucgcccagcaggcg

SEQ ID NO: 1454623 - RNA, 19 nt, Pseudomonas aeruginosa PA01
ucgcccagcaggcgcgccc

SEQ ID NO: 1454624 - RNA, 17 nt, Pseudomonas aeruginosa PA01
ucgacgccgaagccgcu

SEQ ID NO: 1454625 - RNA, 15 nt, Pseudomonas aeruginosa PA01
ucgacgauauccacg

SEQ ID NO: 1454626 - RNA, 19 nt, Pseudomonas aeruginosa PA01
ucgacgccuugcccggcgc

SEQ ID NO: 1454627 - RNA, 20 nt, Pseudomonas aeruginosa PA01
ucgacgccuugcccggcgcg

SEQ ID NO: 1454628 - RNA, 21 nt, Pseudomonas aeruginosa PA01
ucgacgccggucucggcgaug

SEQ ID NO: 1454629 - RNA, 13 nt, Pseudomonas aeruginosa PA01
ucgacgcgccacg

SEQ ID NO: 1454630 - RNA, 12 nt, Pseudomonas aeruginosa PA01
ucgacgccagcg

SEQ ID NO: 1454631 - RNA, 14 nt, Pseudomonas aeruginosa PA01
ucgacgccagcggc

SEQ ID NO: 1454632 - RNA, 20 nt, Pseudomonas aeruginosa PA01
ucgacgccagcucggccggc

SEQ ID NO: 1454633 - RNA, 21 nt, Pseudomonas aeruginosa PA01
ucgacgcccgcuugcgccgcc

SEQ ID NO: 1454634 - RNA, 23 nt, Pseudomonas aeruginosa PA01
ucgacgcccgcuugcgccgccuc

SEQ ID NO: 1454635 - RNA, 16 nt, Pseudomonas aeruginosa PA01
ucgacgcccucggcga

SEQ ID NO: 1454636 - RNA, 17 nt, Pseudomonas aeruginosa PA01
ucgacgcccucggcgac

SEQ ID NO: 1454637 - RNA, 19 nt, Pseudomonas aeruginosa PA01
ucgacgcccucggcgacga

SEQ ID NO: 1454638 - RNA, 18 nt, Pseudomonas aeruginosa PA01
ucgacgccgagccagccg

SEQ ID NO: 1454639 - RNA, 14 nt, Pseudomonas aeruginosa PA01
ucgacgccgagcug

SEQ ID NO: 1454640 - RNA, 19 nt, Pseudomonas aeruginosa PA01
ucgacgccgagcugaccac

SEQ ID NO: 1454641 - RNA, 22 nt, Pseudomonas aeruginosa PA01
ucgacgccgagcugaccaccag

SEQ ID NO: 1454642 - RNA, 18 nt, Pseudomonas aeruginosa PA01
ucgacgcagagcgccaug

SEQ ID NO: 1454643 - RNA, 16 nt, Pseudomonas aeruginosa PA01
ucgacgcagccgggcc

SEQ ID NO: 1454644 - RNA, 23 nt, Pseudomonas aeruginosa PA01
ucgacgcagccgggccgcagcgc

SEQ ID NO: 1454645 - RNA, 12 nt, Pseudomonas aeruginosa PA01
ucgacgcagcgc

SEQ ID NO: 1454646 - RNA, 14 nt, Pseudomonas aeruginosa PA01
ucgacgcagcgcgc

SEQ ID NO: 1454647 - RNA, 22 nt, Pseudomonas aeruginosa PA01
ucgacgcagcgcgcgucggcga

SEQ ID NO: 1454648 - RNA, 23 nt, Pseudomonas aeruginosa PA01
ucgacgcagcgcgcgucggcgaa

SEQ ID NO: 1454649 - RNA, 17 nt, Pseudomonas aeruginosa PA01
ucgacgcagggcggcgc

SEQ ID NO: 1454650 - RNA, 22 nt, Pseudomonas aeruginosa PA01
ucgacgcagggcggcgccugga

SEQ ID NO: 1454651 - RNA, 17 nt, Pseudomonas aeruginosa PA01
ucgccgaaauagcgcgc

SEQ ID NO: 1454652 - RNA, 20 nt, Pseudomonas aeruginosa PA01
ucgccgaaauagcgcgccca

SEQ ID NO: 1454653 - RNA, 15 nt, Pseudomonas aeruginosa PA01
ucgcccuucuuccag

SEQ ID NO: 1454654 - RNA, 21 nt, Pseudomonas aeruginosa PA01
ucgcccuugcugcccaguacc

SEQ ID NO: 1454655 - RNA, 19 nt, Pseudomonas aeruginosa PA01
ucgcccuugggaccgggca

SEQ ID NO: 1454656 - RNA, 23 nt, Pseudomonas aeruginosa PA01
ucgccgaaaaauucagcgcagcg

SEQ ID NO: 1454657 - RNA, 23 nt, Pseudomonas aeruginosa PA01
ucgccgaaaagaagccccgcagc

SEQ ID NO: 1454658 - RNA, 20 nt, Pseudomonas aeruginosa PA01
ucgccgaaggugcaggccgc

SEQ ID NO: 1454659 - RNA, 20 nt, Pseudomonas aeruginosa PA01
ucgccgaacuccgagcagga

SEQ ID NO: 1454660 - RNA, 16 nt, Pseudomonas aeruginosa PA01
ucgccgaacggcagcu

SEQ ID NO: 1454661 - RNA, 24 nt, Pseudomonas aeruginosa PA01
ucgccgaagauccgcuccaggcug

SEQ ID NO: 1454662 - RNA, 13 nt, Pseudomonas aeruginosa PA01
ucgcccggcgcuc

SEQ ID NO: 1454663 - RNA, 12 nt, Pseudomonas aeruginosa PA01
ucgcccuggccu

SEQ ID NO: 1454664 - RNA, 21 nt, Pseudomonas aeruginosa PA01
ucgcccugcuuggccagcgcg

SEQ ID NO: 1454665 - RNA, 13 nt, Pseudomonas aeruginosa PA01
ucgcccuggugca

SEQ ID NO: 1454666 - RNA, 17 nt, Pseudomonas aeruginosa PA01
ucgcccuggugcacggc

SEQ ID NO: 1454667 - RNA, 18 nt, Pseudomonas aeruginosa PA01
ucgcccuggugcacggcg

SEQ ID NO: 1454668 - RNA, 17 nt, Pseudomonas aeruginosa PA01
ucgcccuggcgccagcg

SEQ ID NO: 1454669 - RNA, 13 nt, Pseudomonas aeruginosa PA01
ucgcccggcagca

SEQ ID NO: 1454670 - RNA, 19 nt, Pseudomonas aeruginosa PA01
ucgcccggcagcaggccgc

SEQ ID NO: 1454671 - RNA, 20 nt, Pseudomonas aeruginosa PA01
ucgcccggcagcaggccgcc

SEQ ID NO: 1454672 - RNA, 22 nt, Pseudomonas aeruginosa PA01
ucgcccggcagcaggccgccgc

SEQ ID NO: 1454673 - RNA, 22 nt, Pseudomonas aeruginosa PA01
ucgcccgcccucgucgcaccug

SEQ ID NO: 1454674 - RNA, 21 nt, Pseudomonas aeruginosa PA01
ucgcccgcaguuccucgccgc

SEQ ID NO: 1454675 - RNA, 24 nt, Pseudomonas aeruginosa PA01
ucgcccgcaguuccucgccgcugc

SEQ ID NO: 1454676 - RNA, 13 nt, Pseudomonas aeruginosa PA01
ucgcccgccggcg

SEQ ID NO: 1454677 - RNA, 17 nt, Pseudomonas aeruginosa PA01
ucgcccgccggcgugcc

SEQ ID NO: 1454678 - RNA, 13 nt, Pseudomonas aeruginosa PA01
ucgcccgcgccuc

SEQ ID NO: 1454679 - RNA, 12 nt, Pseudomonas aeruginosa PA01
ucgcccgcggcg

SEQ ID NO: 1454680 - RNA, 22 nt, Pseudomonas aeruginosa PA01
ucgcccgcggcggcgacgcugg

SEQ ID NO: 1454681 - RNA, 23 nt, Pseudomonas aeruginosa PA01
ucgcccagggcguggucggcggc

SEQ ID NO: 1454682 - RNA, 19 nt, Pseudomonas aeruginosa PA01
ucgcccagguaggcgaugc

SEQ ID NO: 1454683 - RNA, 22 nt, Pseudomonas aeruginosa PA01
ucgcccaguaccacgcagccac

SEQ ID NO: 1454684 - RNA, 15 nt, Pseudomonas aeruginosa PA01
ucgcccaggccgcug

SEQ ID NO: 1454685 - RNA, 19 nt, Pseudomonas aeruginosa PA01
ucgcccaggccgcuggcgg

SEQ ID NO: 1454686 - RNA, 20 nt, Pseudomonas aeruginosa PA01
ucgcccaggccgcuggcggc

SEQ ID NO: 1454687 - RNA, 13 nt, Pseudomonas aeruginosa PA01
ucgcccagcggcu

SEQ ID NO: 1454688 - RNA, 20 nt, Pseudomonas aeruginosa PA01
ucgcccagcggcuggcgggc

SEQ ID NO: 1454689 - RNA, 20 nt, Pseudomonas aeruginosa PA01
ucgcccagcucgccgcucca

SEQ ID NO: 1454690 - RNA, 13 nt, Pseudomonas aeruginosa PA01
ucgccgaccaggc

SEQ ID NO: 1454691 - RNA, 14 nt, Pseudomonas aeruginosa PA01
ucgccgaccaggcg

SEQ ID NO: 1454692 - RNA, 17 nt, Pseudomonas aeruginosa PA01
ucgccgaccacuuccag

SEQ ID NO: 1454693 - RNA, 16 nt, Pseudomonas aeruginosa PA01
ucgccgacccugcacc

SEQ ID NO: 1454694 - RNA, 19 nt, Pseudomonas aeruginosa PA01
ucgccgacggcuucgacca

SEQ ID NO: 1454695 - RNA, 14 nt, Pseudomonas aeruginosa PA01
ucgccgaucaccag

SEQ ID NO: 1454696 - RNA, 16 nt, Pseudomonas aeruginosa PA01
ucgccgaucaccagga

SEQ ID NO: 1454697 - RNA, 21 nt, Pseudomonas aeruginosa PA01
ucgccgaucaccaggaucgcc

SEQ ID NO: 1454698 - RNA, 15 nt, Pseudomonas aeruginosa PA01
ucgccgaguggccgc

SEQ ID NO: 1454699 - RNA, 17 nt, Pseudomonas aeruginosa PA01
ucgccgaguggccgcug

SEQ ID NO: 1454700 - RNA, 19 nt, Pseudomonas aeruginosa PA01
ucgccgaguggccgcugag

SEQ ID NO: 1454701 - RNA, 20 nt, Pseudomonas aeruginosa PA01
ucgccgaguggccgcugagc

SEQ ID NO: 1454702 - RNA, 14 nt, Pseudomonas aeruginosa PA01
ucgccgaucugcag

SEQ ID NO: 1454703 - RNA, 18 nt, Pseudomonas aeruginosa PA01
ucgccgaucuccuccgcc

SEQ ID NO: 1454704 - RNA, 13 nt, Pseudomonas aeruginosa PA01
ucgccgccuugcg

SEQ ID NO: 1454705 - RNA, 20 nt, Pseudomonas aeruginosa PA01
ucgccgccuucggcaggacc

SEQ ID NO: 1454706 - RNA, 21 nt, Pseudomonas aeruginosa PA01
ucgccgccguccuguuucugc

SEQ ID NO: 1454707 - RNA, 12 nt, Pseudomonas aeruginosa PA01
ucgccgaugucg

SEQ ID NO: 1454708 - RNA, 17 nt, Pseudomonas aeruginosa PA01
ucgccgaugucguagcc

SEQ ID NO: 1454709 - RNA, 20 nt, Pseudomonas aeruginosa PA01
ucgccgaugucguagccgcg

SEQ ID NO: 1454710 - RNA, 22 nt, Pseudomonas aeruginosa PA01
ucgccgaugucguagccgcgcg

SEQ ID NO: 1454711 - RNA, 14 nt, Pseudomonas aeruginosa PA01
ucgccgcgaccugc

SEQ ID NO: 1454712 - RNA, 23 nt, Pseudomonas aeruginosa PA01
ucgccgcgaccugcucgucgaug

SEQ ID NO: 1454713 - RNA, 19 nt, Pseudomonas aeruginosa PA01
ucgccgcgacgcuccagcg

SEQ ID NO: 1454714 - RNA, 22 nt, Pseudomonas aeruginosa PA01
ucgccgcgacgcuccagcggca

SEQ ID NO: 1454715 - RNA, 12 nt, Pseudomonas aeruginosa PA01
ucgccgcgccgc

SEQ ID NO: 1454716 - RNA, 18 nt, Pseudomonas aeruginosa PA01
ucgccgcggacggccggc

SEQ ID NO: 1454717 - RNA, 22 nt, Pseudomonas aeruginosa PA01
ucgccgcgcggucgagcucggc

SEQ ID NO: 1454718 - RNA, 20 nt, Pseudomonas aeruginosa PA01
ucgccgcggcguaggcggug

SEQ ID NO: 1454719 - RNA, 16 nt, Pseudomonas aeruginosa PA01
ucgccgcgcucgcgca

SEQ ID NO: 1454720 - RNA, 23 nt, Pseudomonas aeruginosa PA01
ucgccgcggcgaagcguugcagc

SEQ ID NO: 1454721 - RNA, 14 nt, Pseudomonas aeruginosa PA01
ucgccgcuggacga

SEQ ID NO: 1454722 - RNA, 14 nt, Pseudomonas aeruginosa PA01
ucgccgcugaaguc

SEQ ID NO: 1454723 - RNA, 19 nt, Pseudomonas aeruginosa PA01
ucgccgcugaaguccuggc

SEQ ID NO: 1454724 - RNA, 24 nt, Pseudomonas aeruginosa PA01
ucgccgcugaaguccuggccgagc

SEQ ID NO: 1454725 - RNA, 12 nt, Pseudomonas aeruginosa PA01
ucgccgcuggcg

SEQ ID NO: 1454726 - RNA, 18 nt, Pseudomonas aeruginosa PA01
ucgccgcugggcagcacg

SEQ ID NO: 1454727 - RNA, 21 nt, Pseudomonas aeruginosa PA01
ucgccgcugggcagcacgcug

SEQ ID NO: 1454728 - RNA, 17 nt, Pseudomonas aeruginosa PA01
ucgccggcgcgcacggu

SEQ ID NO: 1454729 - RNA, 15 nt, Pseudomonas aeruginosa PA01
ucgccggcgaucucc

SEQ ID NO: 1454730 - RNA, 21 nt, Pseudomonas aeruginosa PA01
ucgccggcgaucuccgccagg

SEQ ID NO: 1454731 - RNA, 22 nt, Pseudomonas aeruginosa PA01
ucgccggcgaucuccgccaggc

SEQ ID NO: 1454732 - RNA, 22 nt, Pseudomonas aeruginosa PA01
ucgccggagccuucuagcgaag

SEQ ID NO: 1454733 - RNA, 23 nt, Pseudomonas aeruginosa PA01
ucgccggagucguagcgcgcggc

SEQ ID NO: 1454734 - RNA, 13 nt, Pseudomonas aeruginosa PA01
ucggcagucgccg

SEQ ID NO: 1454735 - RNA, 17 nt, Pseudomonas aeruginosa PA01
ucggcagucgccgcacc

SEQ ID NO: 1454736 - RNA, 17 nt, Pseudomonas aeruginosa PA01
ucggcagguugcucgcc

SEQ ID NO: 1454737 - RNA, 18 nt, Pseudomonas aeruginosa PA01
ucggcagguugcucgccu

SEQ ID NO: 1454738 - RNA, 19 nt, Pseudomonas aeruginosa PA01
ucggcagguugcucgccuu

SEQ ID NO: 1454739 - RNA, 23 nt, Pseudomonas aeruginosa PA01
ucggcaggcuggcguugacugcc

SEQ ID NO: 1454740 - RNA, 15 nt, Pseudomonas aeruginosa PA01
ucggcagggcgcccg

SEQ ID NO: 1454741 - RNA, 18 nt, Pseudomonas aeruginosa PA01
ucggcagggcgcccgccc

SEQ ID NO: 1454742 - RNA, 23 nt, Pseudomonas aeruginosa PA01
ucggcagcucuaccgagaucacc

SEQ ID NO: 1454743 - RNA, 16 nt, Pseudomonas aeruginosa PA01
ucggcagcgcuggcga

SEQ ID NO: 1454744 - RNA, 18 nt, Pseudomonas aeruginosa PA01
ucggcagcgcuggcgauc

SEQ ID NO: 1454745 - RNA, 23 nt, Pseudomonas aeruginosa PA01
ucggcagcgcuggcgaucaccag

SEQ ID NO: 1454746 - RNA, 19 nt, Pseudomonas aeruginosa PA01
ucggcagcggauccgggug

SEQ ID NO: 1454747 - RNA, 19 nt, Pseudomonas aeruginosa PA01
ucggcaggaaggccuggaa

SEQ ID NO: 1454748 - RNA, 18 nt, Pseudomonas aeruginosa PA01
ucggcaggaccucgggcg

SEQ ID NO: 1454749 - RNA, 15 nt, Pseudomonas aeruginosa PA01
ucggccaacggccgc

SEQ ID NO: 1454750 - RNA, 21 nt, Pseudomonas aeruginosa PA01
ucggccaaugcccggaccugg

SEQ ID NO: 1454751 - RNA, 18 nt, Pseudomonas aeruginosa PA01
ucggccaacugagcggcg

SEQ ID NO: 1454752 - RNA, 18 nt, Pseudomonas aeruginosa PA01
ucggccaccugcuccggc

SEQ ID NO: 1454753 - RNA, 14 nt, Pseudomonas aeruginosa PA01
ucggccaccaccac

SEQ ID NO: 1454754 - RNA, 15 nt, Pseudomonas aeruginosa PA01
ucggcaacgagcagg

SEQ ID NO: 1454755 - RNA, 13 nt, Pseudomonas aeruginosa PA01
ucggcaaccgggc

SEQ ID NO: 1454756 - RNA, 16 nt, Pseudomonas aeruginosa PA01
ucggcaagcaggccgc

SEQ ID NO: 1454757 - RNA, 15 nt, Pseudomonas aeruginosa PA01
ucggcaaggcgcagc

SEQ ID NO: 1454758 - RNA, 19 nt, Pseudomonas aeruginosa PA01
ucggcaccaucaccgacag

SEQ ID NO: 1454759 - RNA, 20 nt, Pseudomonas aeruginosa PA01
ucggcaccccuucgagcaac

SEQ ID NO: 1454760 - RNA, 19 nt, Pseudomonas aeruginosa PA01
ucggcagcaucagccgcga

SEQ ID NO: 1454761 - RNA, 22 nt, Pseudomonas aeruginosa PA01
ucggcagcaucagccgcgacga

SEQ ID NO: 1454762 - RNA, 15 nt, Pseudomonas aeruginosa PA01
ucggauagucggaac

SEQ ID NO: 1454763 - RNA, 13 nt, Pseudomonas aeruginosa PA01
ucggaucaggcgg

SEQ ID NO: 1454764 - RNA, 20 nt, Pseudomonas aeruginosa PA01
ucggaucaggcgggcuccgc

SEQ ID NO: 1454765 - RNA, 15 nt, Pseudomonas aeruginosa PA01
ucggaaucggcgauc

SEQ ID NO: 1454766 - RNA, 18 nt, Pseudomonas aeruginosa PA01
ucggaacgaccacgccug

SEQ ID NO: 1454767 - RNA, 19 nt, Pseudomonas aeruginosa PA01
ucggaacgaccgguagcca

SEQ ID NO: 1454768 - RNA, 14 nt, Pseudomonas aeruginosa PA01
ucggaugccgcaca

SEQ ID NO: 1454769 - RNA, 15 nt, Pseudomonas aeruginosa PA01
ucggaacagcgccuu

SEQ ID NO: 1454770 - RNA, 14 nt, Pseudomonas aeruginosa PA01
ucgcuuuuuccgcu

SEQ ID NO: 1454771 - RNA, 24 nt, Pseudomonas aeruginosa PA01
ucgcuuuccuggccgacccgcagc

SEQ ID NO: 1454772 - RNA, 14 nt, Pseudomonas aeruginosa PA01
ucgcuuccucggca

SEQ ID NO: 1454773 - RNA, 13 nt, Pseudomonas aeruginosa PA01
ucgcuucggccac

SEQ ID NO: 1454774 - RNA, 18 nt, Pseudomonas aeruginosa PA01
ucgcugucaaucgcgcaa

SEQ ID NO: 1454775 - RNA, 13 nt, Pseudomonas aeruginosa PA01
ucgcugucagggc

SEQ ID NO: 1454776 - RNA, 15 nt, Pseudomonas aeruginosa PA01
ucgcugucgagcagg

SEQ ID NO: 1454777 - RNA, 16 nt, Pseudomonas aeruginosa PA01
ucgcugucgagcaggg

SEQ ID NO: 1454778 - RNA, 18 nt, Pseudomonas aeruginosa PA01
ucgcugucgccgagcacc

SEQ ID NO: 1454779 - RNA, 15 nt, Pseudomonas aeruginosa PA01
ucgcugucgcucagc

SEQ ID NO: 1454780 - RNA, 17 nt, Pseudomonas aeruginosa PA01
ucgcguuggcggugccg

SEQ ID NO: 1454781 - RNA, 21 nt, Pseudomonas aeruginosa PA01
ucgcguuggcggugccgcaga

SEQ ID NO: 1454782 - RNA, 21 nt, Pseudomonas aeruginosa PA01
ucgcguuggcgugcucgcgca

SEQ ID NO: 1454783 - RNA, 12 nt, Pseudomonas aeruginosa PA01
ucgcuccagccc

SEQ ID NO: 1454784 - RNA, 20 nt, Pseudomonas aeruginosa PA01
ucgcguucaucgucggcagc

SEQ ID NO: 1454785 - RNA, 22 nt, Pseudomonas aeruginosa PA01
ucgcguuccagcaacggcuuga

SEQ ID NO: 1454786 - RNA, 14 nt, Pseudomonas aeruginosa PA01
ucgcguuccagcac

SEQ ID NO: 1454787 - RNA, 14 nt, Pseudomonas aeruginosa PA01
ucgcguuccagcuc

SEQ ID NO: 1454788 - RNA, 14 nt, Pseudomonas aeruginosa PA01
ucgcguggcccggc

SEQ ID NO: 1454789 - RNA, 15 nt, Pseudomonas aeruginosa PA01
ucgcguggcccggcg

SEQ ID NO: 1454790 - RNA, 21 nt, Pseudomonas aeruginosa PA01
ucgcguggcccggcgcggcgg

SEQ ID NO: 1454791 - RNA, 14 nt, Pseudomonas aeruginosa PA01
ucgcguucgucggc

SEQ ID NO: 1454792 - RNA, 21 nt, Pseudomonas aeruginosa PA01
ucgcguucgucggccaccagg

SEQ ID NO: 1454793 - RNA, 17 nt, Pseudomonas aeruginosa PA01
ucgcucugcgccgcggc

SEQ ID NO: 1454794 - RNA, 18 nt, Pseudomonas aeruginosa PA01
ucgcucugcgccgcggcg

SEQ ID NO: 1454795 - RNA, 19 nt, Pseudomonas aeruginosa PA01
ucgcucucgaacaccggcg

SEQ ID NO: 1454796 - RNA, 11 nt, Pseudomonas aeruginosa PA01
ucgcucgcgca

SEQ ID NO: 1454797 - RNA, 13 nt, Pseudomonas aeruginosa PA01
ucgcucgcgcagg

SEQ ID NO: 1454798 - RNA, 18 nt, Pseudomonas aeruginosa PA01
ucgcugaaauccaccagc

SEQ ID NO: 1454799 - RNA, 20 nt, Pseudomonas aeruginosa PA01
ucgcugaaauccaccagcac

SEQ ID NO: 1454800 - RNA, 21 nt, Pseudomonas aeruginosa PA01
ucgcugaaauccaccagcacg

SEQ ID NO: 1454801 - RNA, 17 nt, Pseudomonas aeruginosa PA01
ucgcugggcgccucguc

SEQ ID NO: 1454802 - RNA, 17 nt, Pseudomonas aeruginosa PA01
ucgcuguagcggcucgc

SEQ ID NO: 1454803 - RNA, 21 nt, Pseudomonas aeruginosa PA01
ucgcuguagcggcucgccgaa

SEQ ID NO: 1454804 - RNA, 23 nt, Pseudomonas aeruginosa PA01
ucgcugaccagcccggcggcggc

SEQ ID NO: 1454805 - RNA, 18 nt, Pseudomonas aeruginosa PA01
ucgcggucuuccgccgac

SEQ ID NO: 1454806 - RNA, 23 nt, Pseudomonas aeruginosa PA01
ucgcgguuauccgccgccgggcu

SEQ ID NO: 1454807 - RNA, 21 nt, Pseudomonas aeruginosa PA01
ucgcguaggacgcauaaccgc

SEQ ID NO: 1454808 - RNA, 21 nt, Pseudomonas aeruginosa PA01
ucgcguagggcgacggcgcuu

SEQ ID NO: 1454809 - RNA, 21 nt, Pseudomonas aeruginosa PA01
ucgcguagggcgcauaaccgc

SEQ ID NO: 1454810 - RNA, 21 nt, Pseudomonas aeruginosa PA01
ucgcguagggcguauaaccgc

SEQ ID NO: 1454811 - RNA, 19 nt, Pseudomonas aeruginosa PA01
ucgcguagguggcgccgcc

SEQ ID NO: 1454812 - RNA, 17 nt, Pseudomonas aeruginosa PA01
ucgcguagaccaucgcc

SEQ ID NO: 1454813 - RNA, 22 nt, Pseudomonas aeruginosa PA01
ucgcguagaccaucgccggcga

SEQ ID NO: 1454814 - RNA, 24 nt, Pseudomonas aeruginosa PA01
ucgcguagaccaucgccggcgagc

SEQ ID NO: 1454815 - RNA, 17 nt, Pseudomonas aeruginosa PA01
ucgcgguucugcuccug

SEQ ID NO: 1454816 - RNA, 16 nt, Pseudomonas aeruginosa PA01
ucgcgguugccgaagc

SEQ ID NO: 1454817 - RNA, 20 nt, Pseudomonas aeruginosa PA01
ucgcguccgcaguucgcccc

SEQ ID NO: 1454818 - RNA, 17 nt, Pseudomonas aeruginosa PA01
ucgcguccagggugcug

SEQ ID NO: 1454819 - RNA, 13 nt, Pseudomonas aeruginosa PA01
ucgcgucgccgaa

SEQ ID NO: 1454820 - RNA, 22 nt, Pseudomonas aeruginosa PA01
ucgcgucgccgaacuccgagca

SEQ ID NO: 1454821 - RNA, 18 nt, Pseudomonas aeruginosa PA01
ucgcgucggccuggcgca

SEQ ID NO: 1454822 - RNA, 20 nt, Pseudomonas aeruginosa PA01
ucgcgucggccuggcgcagc

SEQ ID NO: 1454823 - RNA, 15 nt, Pseudomonas aeruginosa PA01
ucgcgugcgcuggua

SEQ ID NO: 1454824 - RNA, 22 nt, Pseudomonas aeruginosa PA01
ucgcgugcuccgugucggcggc

SEQ ID NO: 1454825 - RNA, 14 nt, Pseudomonas aeruginosa PA01
ucgcguggcugccg

SEQ ID NO: 1454826 - RNA, 13 nt, Pseudomonas aeruginosa PA01
ucgcgugggccac

SEQ ID NO: 1454827 - RNA, 15 nt, Pseudomonas aeruginosa PA01
ucgcgugggccacca

SEQ ID NO: 1454828 - RNA, 16 nt, Pseudomonas aeruginosa PA01
ucgcgugggccaccau

SEQ ID NO: 1454829 - RNA, 17 nt, Pseudomonas aeruginosa PA01
ucgcgugggccaccauc

SEQ ID NO: 1454830 - RNA, 14 nt, Pseudomonas aeruginosa PA01
ucgcgugggccagg

SEQ ID NO: 1454831 - RNA, 15 nt, Pseudomonas aeruginosa PA01
ucggcgguggagcag

SEQ ID NO: 1454832 - RNA, 21 nt, Pseudomonas aeruginosa PA01
ucggcgguggggaagcgaucc

SEQ ID NO: 1454833 - RNA, 15 nt, Pseudomonas aeruginosa PA01
ucggcgguggggccg

SEQ ID NO: 1454834 - RNA, 22 nt, Pseudomonas aeruginosa PA01
ucggcgguggggccgccgaugc

SEQ ID NO: 1454835 - RNA, 15 nt, Pseudomonas aeruginosa PA01
ucggcgguuuccagu

SEQ ID NO: 1454836 - RNA, 18 nt, Pseudomonas aeruginosa PA01
ucggcguagccggccagg

SEQ ID NO: 1454837 - RNA, 15 nt, Pseudomonas aeruginosa PA01
ucggcguagccggcg

SEQ ID NO: 1454838 - RNA, 18 nt, Pseudomonas aeruginosa PA01
ucggcguagccggcgauc

SEQ ID NO: 1454839 - RNA, 18 nt, Pseudomonas aeruginosa PA01
ucggcggggcgcaccgcc

SEQ ID NO: 1454840 - RNA, 19 nt, Pseudomonas aeruginosa PA01
ucggcgggcugccgcggaa

SEQ ID NO: 1454841 - RNA, 21 nt, Pseudomonas aeruginosa PA01
ucggcggcuuccuccaucgcc

SEQ ID NO: 1454842 - RNA, 17 nt, Pseudomonas aeruginosa PA01
ucggcggggugaucacc

SEQ ID NO: 1454843 - RNA, 13 nt, Pseudomonas aeruginosa PA01
ucggcggguccgc

SEQ ID NO: 1454844 - RNA, 21 nt, Pseudomonas aeruginosa PA01
ucggcggguauccgccgggcc

SEQ ID NO: 1454845 - RNA, 13 nt, Pseudomonas aeruginosa PA01
ucggcggucaggc

SEQ ID NO: 1454846 - RNA, 19 nt, Pseudomonas aeruginosa PA01
ucggcggucaggccaagcu

SEQ ID NO: 1454847 - RNA, 14 nt, Pseudomonas aeruginosa PA01
ucggcgguccaggg

SEQ ID NO: 1454848 - RNA, 17 nt, Pseudomonas aeruginosa PA01
ucggcgguagcgcgaag

SEQ ID NO: 1454849 - RNA, 23 nt, Pseudomonas aeruginosa PA01
ucggcgggugugguccgcggugu

SEQ ID NO: 1454850 - RNA, 16 nt, Pseudomonas aeruginosa PA01
ucggcgguacgcccuc

SEQ ID NO: 1454851 - RNA, 17 nt, Pseudomonas aeruginosa PA01
ucggcgguacgcccucc

SEQ ID NO: 1454852 - RNA, 22 nt, Pseudomonas aeruginosa PA01
ucggcgguacgcccuccagcac

SEQ ID NO: 1454853 - RNA, 16 nt, Pseudomonas aeruginosa PA01
ucggcgggaucgacgc

SEQ ID NO: 1454854 - RNA, 16 nt, Pseudomonas aeruginosa PA01
ucggcgggacggcgca

SEQ ID NO: 1454855 - RNA, 18 nt, Pseudomonas aeruginosa PA01
ucggcgggacggcgcaua

SEQ ID NO: 1454856 - RNA, 18 nt, Pseudomonas aeruginosa PA01
ucggcgggagagggcggc

SEQ ID NO: 1454857 - RNA, 20 nt, Pseudomonas aeruginosa PA01
ucggcgggagagggcggcga

SEQ ID NO: 1454858 - RNA, 22 nt, Pseudomonas aeruginosa PA01
ucggcgggagagggcggcgacc

SEQ ID NO: 1454859 - RNA, 19 nt, Pseudomonas aeruginosa PA01
ucggcggauaacgccgcug

SEQ ID NO: 1454860 - RNA, 22 nt, Pseudomonas aeruginosa PA01
ucggcggauaacgccgcuggcg

SEQ ID NO: 1454861 - RNA, 19 nt, Pseudomonas aeruginosa PA01
ucggcggcacccucuuccg

SEQ ID NO: 1454862 - RNA, 20 nt, Pseudomonas aeruginosa PA01
ucggcggcacccucuuccgc

SEQ ID NO: 1454863 - RNA, 22 nt, Pseudomonas aeruginosa PA01
ucggcggcacccucuuccgcgc

SEQ ID NO: 1454864 - RNA, 12 nt, Pseudomonas aeruginosa PA01
ucggcggcagcu

SEQ ID NO: 1454865 - RNA, 21 nt, Pseudomonas aeruginosa PA01
ucggcggcagcugcggcggca

SEQ ID NO: 1454866 - RNA, 15 nt, Pseudomonas aeruginosa PA01
ucggcggcaggccga

SEQ ID NO: 1454867 - RNA, 22 nt, Pseudomonas aeruginosa PA01
ucggcggcaggcugcgccgcug

SEQ ID NO: 1454868 - RNA, 13 nt, Pseudomonas aeruginosa PA01
ucggcggcgagcg

SEQ ID NO: 1454869 - RNA, 21 nt, Pseudomonas aeruginosa PA01
ucggcggcgagcgccgcggcg

SEQ ID NO: 1454870 - RNA, 23 nt, Pseudomonas aeruginosa PA01
ucggcggcgagcgccgcggcgaa

SEQ ID NO: 1454871 - RNA, 13 nt, Pseudomonas aeruginosa PA01
ucggcggcgcggc

SEQ ID NO: 1454872 - RNA, 14 nt, Pseudomonas aeruginosa PA01
ucggcggcgcggcg

SEQ ID NO: 1454873 - RNA, 16 nt, Pseudomonas aeruginosa PA01
ucggcggcgcggcgua

SEQ ID NO: 1454874 - RNA, 17 nt, Pseudomonas aeruginosa PA01
ucggcggcgcggcguac

SEQ ID NO: 1454875 - RNA, 20 nt, Pseudomonas aeruginosa PA01
ucggcggcgguucgccgagc

SEQ ID NO: 1454876 - RNA, 14 nt, Pseudomonas aeruginosa PA01
ucggcggcgcgcag

SEQ ID NO: 1454877 - RNA, 19 nt, Pseudomonas aeruginosa PA01
ucggcggcgcgcagcgaac

SEQ ID NO: 1454878 - RNA, 14 nt, Pseudomonas aeruginosa PA01
ucggcggcgcgcug

SEQ ID NO: 1454879 - RNA, 15 nt, Pseudomonas aeruginosa PA01
ucggcggcgcgcugc

SEQ ID NO: 1454880 - RNA, 13 nt, Pseudomonas aeruginosa PA01
ucggcggcgccgg

SEQ ID NO: 1454881 - RNA, 15 nt, Pseudomonas aeruginosa PA01
ucggcggcgccuugc

SEQ ID NO: 1454882 - RNA, 22 nt, Pseudomonas aeruginosa PA01
ucggcggcgcgaaccagcagca

SEQ ID NO: 1454883 - RNA, 20 nt, Pseudomonas aeruginosa PA01
ucggcggcggauaacgccug

SEQ ID NO: 1454884 - RNA, 13 nt, Pseudomonas aeruginosa PA01
ucggcggcggccc

SEQ ID NO: 1454885 - RNA, 15 nt, Pseudomonas aeruginosa PA01
ucggcggcggcccgc

SEQ ID NO: 1454886 - RNA, 14 nt, Pseudomonas aeruginosa PA01
ucggcggcggccug

SEQ ID NO: 1454887 - RNA, 15 nt, Pseudomonas aeruginosa PA01
ucggcggcggccugc

SEQ ID NO: 1454888 - RNA, 14 nt, Pseudomonas aeruginosa PA01
ucggcgcccuggcc

SEQ ID NO: 1454889 - RNA, 16 nt, Pseudomonas aeruginosa PA01
ucggcgcccuggccgc

SEQ ID NO: 1454890 - RNA, 17 nt, Pseudomonas aeruginosa PA01
ucggcgcccuggccgcc

SEQ ID NO: 1454891 - RNA, 18 nt, Pseudomonas aeruginosa PA01
ucggcgcccuggccgcca

SEQ ID NO: 1454892 - RNA, 13 nt, Pseudomonas aeruginosa PA01
ucggcgcccuggg

SEQ ID NO: 1454893 - RNA, 12 nt, Pseudomonas aeruginosa PA01
ucggcgccgcgc

SEQ ID NO: 1454894 - RNA, 13 nt, Pseudomonas aeruginosa PA01
ucggcgccgcgca

SEQ ID NO: 1454895 - RNA, 15 nt, Pseudomonas aeruginosa PA01
ucggcgccgaucucc

SEQ ID NO: 1454896 - RNA, 14 nt, Pseudomonas aeruginosa PA01
ucggcgcugccggc

SEQ ID NO: 1454897 - RNA, 11 nt, Pseudomonas aeruginosa PA01
ucggcgcuggc

SEQ ID NO: 1454898 - RNA, 19 nt, Pseudomonas aeruginosa PA01
ucggcggacagcccgcgcu

SEQ ID NO: 1454899 - RNA, 20 nt, Pseudomonas aeruginosa PA01
ucggcggacagcccgcgcuc

SEQ ID NO: 1454900 - RNA, 24 nt, Pseudomonas aeruginosa PA01
ucggcggacagcccgcgcucggcc

SEQ ID NO: 1454901 - RNA, 17 nt, Pseudomonas aeruginosa PA01
ucggcgcuuucgcucug

SEQ ID NO: 1454902 - RNA, 15 nt, Pseudomonas aeruginosa PA01
ucggcgcugucgccg

SEQ ID NO: 1454903 - RNA, 14 nt, Pseudomonas aeruginosa PA01
ucggcgcuggcgcg

SEQ ID NO: 1454904 - RNA, 20 nt, Pseudomonas aeruginosa PA01
ucggccugcggguucggcga

SEQ ID NO: 1454905 - RNA, 22 nt, Pseudomonas aeruginosa PA01
ucggccugcagccuggcgucgc

SEQ ID NO: 1454906 - RNA, 14 nt, Pseudomonas aeruginosa PA01
ucggccugcaccag

SEQ ID NO: 1454907 - RNA, 15 nt, Pseudomonas aeruginosa PA01
ucggccugcaccagc

SEQ ID NO: 1454908 - RNA, 20 nt, Pseudomonas aeruginosa PA01
ucggccucggcgucgcgcag

SEQ ID NO: 1454909 - RNA, 12 nt, Pseudomonas aeruginosa PA01
ucggccucggcg

SEQ ID NO: 1454910 - RNA, 15 nt, Pseudomonas aeruginosa PA01
ucggccucgcggcgc

SEQ ID NO: 1454911 - RNA, 16 nt, Pseudomonas aeruginosa PA01
ucggcgaccagcccgc

SEQ ID NO: 1454912 - RNA, 20 nt, Pseudomonas aeruginosa PA01
ucggcgaccagcccgcgcga

SEQ ID NO: 1454913 - RNA, 23 nt, Pseudomonas aeruginosa PA01
ucggcgaccagcccgcgcgacag

SEQ ID NO: 1454914 - RNA, 23 nt, Pseudomonas aeruginosa PA01
ucggcgaccacccggcgguccgc

SEQ ID NO: 1454915 - RNA, 13 nt, Pseudomonas aeruginosa PA01
ucggcgaccaccg

SEQ ID NO: 1454916 - RNA, 17 nt, Pseudomonas aeruginosa PA01
ucggcgacauagccggc

SEQ ID NO: 1454917 - RNA, 14 nt, Pseudomonas aeruginosa PA01
ucggcgaccaacag

SEQ ID NO: 1454918 - RNA, 16 nt, Pseudomonas aeruginosa PA01
ucggcgacagccgggc

SEQ ID NO: 1454919 - RNA, 19 nt, Pseudomonas aeruginosa PA01
ucggcgacagccgggcagc

SEQ ID NO: 1454920 - RNA, 17 nt, Pseudomonas aeruginosa PA01
ucggcgaaguccaccag

SEQ ID NO: 1454921 - RNA, 16 nt, Pseudomonas aeruginosa PA01
ucggcgaagucgccgu

SEQ ID NO: 1454922 - RNA, 17 nt, Pseudomonas aeruginosa PA01
ucggcgaagucgccguc

SEQ ID NO: 1454923 - RNA, 16 nt, Pseudomonas aeruginosa PA01
ucggcgaaggcgaacc

SEQ ID NO: 1454924 - RNA, 18 nt, Pseudomonas aeruginosa PA01
ucggcgaacuccgccagc

SEQ ID NO: 1454925 - RNA, 21 nt, Pseudomonas aeruginosa PA01
ucggcgaagcggaagcgcagc

SEQ ID NO: 1454926 - RNA, 22 nt, Pseudomonas aeruginosa PA01
ucggcgaagcggaagcgcagcc

SEQ ID NO: 1454927 - RNA, 14 nt, Pseudomonas aeruginosa PA01
ucggcgagcaggcg

SEQ ID NO: 1454928 - RNA, 15 nt, Pseudomonas aeruginosa PA01
ucggcgagcaggcgg

SEQ ID NO: 1454929 - RNA, 13 nt, Pseudomonas aeruginosa PA01
ucggcgagcaggu

SEQ ID NO: 1454930 - RNA, 22 nt, Pseudomonas aeruginosa PA01
ucggcgagcagguagaccgccu

SEQ ID NO: 1454931 - RNA, 19 nt, Pseudomonas aeruginosa PA01
ucggcgagccgcagcggcu

SEQ ID NO: 1454932 - RNA, 21 nt, Pseudomonas aeruginosa PA01
ucggcgagccgcagcggcucg

SEQ ID NO: 1454933 - RNA, 13 nt, Pseudomonas aeruginosa PA01
ucggcgagccggc

SEQ ID NO: 1454934 - RNA, 16 nt, Pseudomonas aeruginosa PA01
ucggcgagccggcgca

SEQ ID NO: 1454935 - RNA, 19 nt, Pseudomonas aeruginosa PA01
ucggcgagccggcgcauca

SEQ ID NO: 1454936 - RNA, 18 nt, Pseudomonas aeruginosa PA01
ucggcgagccgccgggcg

SEQ ID NO: 1454937 - RNA, 18 nt, Pseudomonas aeruginosa PA01
ucggcgagcgaaggaucg

SEQ ID NO: 1454938 - RNA, 21 nt, Pseudomonas aeruginosa PA01
ucggcgagcgaaggaucgaca

SEQ ID NO: 1454939 - RNA, 21 nt, Pseudomonas aeruginosa PA01
ucggcgaggaacagcaccagc

SEQ ID NO: 1454940 - RNA, 19 nt, Pseudomonas aeruginosa PA01
ucggcgaggaucgccagca

SEQ ID NO: 1454941 - RNA, 20 nt, Pseudomonas aeruginosa PA01
ucggcgaggaucgccagcaa

SEQ ID NO: 1454942 - RNA, 13 nt, Pseudomonas aeruginosa PA01
ucggcgaggccgg

SEQ ID NO: 1454943 - RNA, 18 nt, Pseudomonas aeruginosa PA01
ucggcgaggccggcgauc

SEQ ID NO: 1454944 - RNA, 13 nt, Pseudomonas aeruginosa PA01
ucggcgcccgccu

SEQ ID NO: 1454945 - RNA, 18 nt, Pseudomonas aeruginosa PA01
ucggcgaguucgcgcagg

SEQ ID NO: 1454946 - RNA, 21 nt, Pseudomonas aeruginosa PA01
ucggcgaggguugcacaagcc

SEQ ID NO: 1454947 - RNA, 17 nt, Pseudomonas aeruginosa PA01
ucggccgccuggcgugc

SEQ ID NO: 1454948 - RNA, 22 nt, Pseudomonas aeruginosa PA01
ucggccgccuggcgugccgcca

SEQ ID NO: 1454949 - RNA, 13 nt, Pseudomonas aeruginosa PA01
ucggccaguucgc

SEQ ID NO: 1454950 - RNA, 18 nt, Pseudomonas aeruginosa PA01
ucggccggggucaggccg

SEQ ID NO: 1454951 - RNA, 21 nt, Pseudomonas aeruginosa PA01
ucggccggggucaggccgagg

SEQ ID NO: 1454952 - RNA, 14 nt, Pseudomonas aeruginosa PA01
ucggccggcagcuc

SEQ ID NO: 1454953 - RNA, 13 nt, Pseudomonas aeruginosa PA01
ucggccucgacga

SEQ ID NO: 1454954 - RNA, 14 nt, Pseudomonas aeruginosa PA01
ucggccagcggcag

SEQ ID NO: 1454955 - RNA, 15 nt, Pseudomonas aeruginosa PA01
ucggccagcggcaga

SEQ ID NO: 1454956 - RNA, 15 nt, Pseudomonas aeruginosa PA01
ucggccacuaucgcc

SEQ ID NO: 1454957 - RNA, 15 nt, Pseudomonas aeruginosa PA01
ucggccaggaccagg

SEQ ID NO: 1454958 - RNA, 18 nt, Pseudomonas aeruginosa PA01
ucggccaggaccagggcg

SEQ ID NO: 1454959 - RNA, 20 nt, Pseudomonas aeruginosa PA01
ucggccaggacgccaccagg

SEQ ID NO: 1454960 - RNA, 17 nt, Pseudomonas aeruginosa PA01
ucggccaccuucgcccg

SEQ ID NO: 1454961 - RNA, 18 nt, Pseudomonas aeruginosa PA01
ucggccaccuucgcccgc

SEQ ID NO: 1454962 - RNA, 13 nt, Pseudomonas aeruginosa PA01
ucggccaggucgc

SEQ ID NO: 1454963 - RNA, 18 nt, Pseudomonas aeruginosa PA01
ucggccaggucgcgacug

SEQ ID NO: 1454964 - RNA, 16 nt, Pseudomonas aeruginosa PA01
ucggccaguucgcggc

SEQ ID NO: 1454965 - RNA, 21 nt, Pseudomonas aeruginosa PA01
ucggccaguucgucgagcaug

SEQ ID NO: 1454966 - RNA, 16 nt, Pseudomonas aeruginosa PA01
ucggccauaccuccag

SEQ ID NO: 1454967 - RNA, 18 nt, Pseudomonas aeruginosa PA01
ucggccauaccuccagcc

SEQ ID NO: 1454968 - RNA, 21 nt, Pseudomonas aeruginosa PA01
ucggccauaccuccagccagc

SEQ ID NO: 1454969 - RNA, 16 nt, Pseudomonas aeruginosa PA01
ucggccagggccgcuc

SEQ ID NO: 1454970 - RNA, 22 nt, Pseudomonas aeruginosa PA01
ucggccagguacuuggccacgc

SEQ ID NO: 1454971 - RNA, 22 nt, Pseudomonas aeruginosa PA01
ucggccaggggagcgccggcgc

SEQ ID NO: 1454972 - RNA, 12 nt, Pseudomonas aeruginosa PA01
ucggccaggcgg

SEQ ID NO: 1454973 - RNA, 20 nt, Pseudomonas aeruginosa PA01
ucggccagggagucgcuggc

SEQ ID NO: 1454974 - RNA, 21 nt, Pseudomonas aeruginosa PA01
ucggccagggagucgcuggcc

SEQ ID NO: 1454975 - RNA, 22 nt, Pseudomonas aeruginosa PA01
ucggccagggagucgcuggcca

SEQ ID NO: 1454976 - RNA, 20 nt, Pseudomonas aeruginosa PA01
ucggccaggcauuccuccag

SEQ ID NO: 1454977 - RNA, 16 nt, Pseudomonas aeruginosa PA01
ucggccaggcgccagg

SEQ ID NO: 1454978 - RNA, 17 nt, Pseudomonas aeruginosa PA01
ucggccaggcgccaggg

SEQ ID NO: 1454979 - RNA, 21 nt, Pseudomonas aeruginosa PA01
ucggccaggcgccagggccgg

SEQ ID NO: 1454980 - RNA, 16 nt, Pseudomonas aeruginosa PA01
ucgucgccgccgaggc

SEQ ID NO: 1454981 - RNA, 16 nt, Pseudomonas aeruginosa PA01
ucgucggggugccgcc

SEQ ID NO: 1454982 - RNA, 18 nt, Pseudomonas aeruginosa PA01
ucgucggggugccgccag

SEQ ID NO: 1454983 - RNA, 15 nt, Pseudomonas aeruginosa PA01
ucgucgcugcacgca

SEQ ID NO: 1454984 - RNA, 23 nt, Pseudomonas aeruginosa PA01
ucgucgccguggaugucgaggaa

SEQ ID NO: 1454985 - RNA, 17 nt, Pseudomonas aeruginosa PA01
ucgucgauccgcggauc

SEQ ID NO: 1454986 - RNA, 20 nt, Pseudomonas aeruginosa PA01
ucgucgcccuucaggucgac

SEQ ID NO: 1454987 - RNA, 14 nt, Pseudomonas aeruginosa PA01
ucgucgcggcgcga

SEQ ID NO: 1454988 - RNA, 14 nt, Pseudomonas aeruginosa PA01
ucgucgccaagccc

SEQ ID NO: 1454989 - RNA, 17 nt, Pseudomonas aeruginosa PA01
ucgucgccaagcccggc

SEQ ID NO: 1454990 - RNA, 18 nt, Pseudomonas aeruginosa PA01
ucgucgccaagcccggcg

SEQ ID NO: 1454991 - RNA, 13 nt, Pseudomonas aeruginosa PA01
ucgucgccagccc

SEQ ID NO: 1454992 - RNA, 20 nt, Pseudomonas aeruginosa PA01
ucgucgcaccuguuccagca

SEQ ID NO: 1454993 - RNA, 21 nt, Pseudomonas aeruginosa PA01
ucgucgcaccuguuccagcaa

SEQ ID NO: 1454994 - RNA, 20 nt, Pseudomonas aeruginosa PA01
ucgucgaugcguccgcgcag

SEQ ID NO: 1454995 - RNA, 20 nt, Pseudomonas aeruginosa PA01
ucgucgaugcugccguagcg

SEQ ID NO: 1454996 - RNA, 17 nt, Pseudomonas aeruginosa PA01
ucgucgagcugcucggc

SEQ ID NO: 1454997 - RNA, 19 nt, Pseudomonas aeruginosa PA01
ucgucgagcugcucggcgg

SEQ ID NO: 1454998 - RNA, 19 nt, Pseudomonas aeruginosa PA01
ucgucgaggaucuucuccg

SEQ ID NO: 1454999 - RNA, 14 nt, Pseudomonas aeruginosa PA01
ucgucgagcgcagc

SEQ ID NO: 1455000 - RNA, 17 nt, Pseudomonas aeruginosa PA01
ucgucgagcgcagcgac

SEQ ID NO: 1455001 - RNA, 17 nt, Pseudomonas aeruginosa PA01
ucgucgaucucgccgaa

SEQ ID NO: 1455002 - RNA, 21 nt, Pseudomonas aeruginosa PA01
ucguccaguucagggccacgc

SEQ ID NO: 1455003 - RNA, 16 nt, Pseudomonas aeruginosa PA01
ucguccaucgccaggc

SEQ ID NO: 1455004 - RNA, 12 nt, Pseudomonas aeruginosa PA01
ucgucccgagca

SEQ ID NO: 1455005 - RNA, 19 nt, Pseudomonas aeruginosa PA01
ucgucccgagcaccggccu

SEQ ID NO: 1455006 - RNA, 23 nt, Pseudomonas aeruginosa PA01
ucguccggcgccaacugcuugcc

SEQ ID NO: 1455007 - RNA, 14 nt, Pseudomonas aeruginosa PA01
ucguccgccaccac

SEQ ID NO: 1455008 - RNA, 14 nt, Pseudomonas aeruginosa PA01
ucgucgagcagcgc

SEQ ID NO: 1455009 - RNA, 23 nt, Pseudomonas aeruginosa PA01
ucguccgggcgguacaggcgcac

SEQ ID NO: 1455010 - RNA, 12 nt, Pseudomonas aeruginosa PA01
ucguccucggcg

SEQ ID NO: 1455011 - RNA, 16 nt, Pseudomonas aeruginosa PA01
ucguccucggcguagc

SEQ ID NO: 1455012 - RNA, 15 nt, Pseudomonas aeruginosa PA01
ucguccucgcccugc

SEQ ID NO: 1455013 - RNA, 15 nt, Pseudomonas aeruginosa PA01
ucguacuggcggauc

SEQ ID NO: 1455014 - RNA, 16 nt, Pseudomonas aeruginosa PA01
ucguacaccgcgcggc

SEQ ID NO: 1455015 - RNA, 14 nt, Pseudomonas aeruginosa PA01
ucgguuugcgccga

SEQ ID NO: 1455016 - RNA, 15 nt, Pseudomonas aeruginosa PA01
ucgguuugcgccgaa

SEQ ID NO: 1455017 - RNA, 16 nt, Pseudomonas aeruginosa PA01
ucgguguccgcggugc

SEQ ID NO: 1455018 - RNA, 19 nt, Pseudomonas aeruginosa PA01
ucguaaaggacgucgacga

SEQ ID NO: 1455019 - RNA, 21 nt, Pseudomonas aeruginosa PA01
ucggugccuucccagccgagg

SEQ ID NO: 1455020 - RNA, 23 nt, Pseudomonas aeruginosa PA01
ucggugccuucccagccgaggca

SEQ ID NO: 1455021 - RNA, 14 nt, Pseudomonas aeruginosa PA01
ucggugcccucgcg

SEQ ID NO: 1455022 - RNA, 19 nt, Pseudomonas aeruginosa PA01
ucggugcccucgcggacgc

SEQ ID NO: 1455023 - RNA, 13 nt, Pseudomonas aeruginosa PA01
ucggugccgcccg

SEQ ID NO: 1455024 - RNA, 16 nt, Pseudomonas aeruginosa PA01
ucggugccgcccggcg

SEQ ID NO: 1455025 - RNA, 22 nt, Pseudomonas aeruginosa PA01
ucggugagguagaagcggccgc

SEQ ID NO: 1455026 - RNA, 14 nt, Pseudomonas aeruginosa PA01
ucggugacccgcac

SEQ ID NO: 1455027 - RNA, 17 nt, Pseudomonas aeruginosa PA01
ucggugacccgcacggc

SEQ ID NO: 1455028 - RNA, 17 nt, Pseudomonas aeruginosa PA01
ucggugaacgagcccag

SEQ ID NO: 1455029 - RNA, 17 nt, Pseudomonas aeruginosa PA01
ucggugaccaccaggcg

SEQ ID NO: 1455030 - RNA, 21 nt, Pseudomonas aeruginosa PA01
ucggucucgaucggcccgggc

SEQ ID NO: 1455031 - RNA, 16 nt, Pseudomonas aeruginosa PA01
ucggucaggcgcuggu

SEQ ID NO: 1455032 - RNA, 17 nt, Pseudomonas aeruginosa PA01
ucggucagcggcgcagc

SEQ ID NO: 1455033 - RNA, 16 nt, Pseudomonas aeruginosa PA01
ucggcguuguccaggc

SEQ ID NO: 1455034 - RNA, 21 nt, Pseudomonas aeruginosa PA01
ucggcguuuuuuuauccucgc

SEQ ID NO: 1455035 - RNA, 14 nt, Pseudomonas aeruginosa PA01
ucggcucagccgac

SEQ ID NO: 1455036 - RNA, 15 nt, Pseudomonas aeruginosa PA01
ucggcucagccgacc

SEQ ID NO: 1455037 - RNA, 16 nt, Pseudomonas aeruginosa PA01
ucggcucagccgacca

SEQ ID NO: 1455038 - RNA, 16 nt, Pseudomonas aeruginosa PA01
ucggggugcgcggcga

SEQ ID NO: 1455039 - RNA, 17 nt, Pseudomonas aeruginosa PA01
ucggggugcgcggcgaa

SEQ ID NO: 1455040 - RNA, 20 nt, Pseudomonas aeruginosa PA01
ucgggguucgacccgcacuu

SEQ ID NO: 1455041 - RNA, 18 nt, Pseudomonas aeruginosa PA01
ucggguagagcgcggcgc

SEQ ID NO: 1455042 - RNA, 18 nt, Pseudomonas aeruginosa PA01
ucggguccaggcgccaga

SEQ ID NO: 1455043 - RNA, 17 nt, Pseudomonas aeruginosa PA01
ucggguccgggcccugc

SEQ ID NO: 1455044 - RNA, 15 nt, Pseudomonas aeruginosa PA01
ucgggucgcggcuga

SEQ ID NO: 1455045 - RNA, 12 nt, Pseudomonas aeruginosa PA01
ucgggucgcccu

SEQ ID NO: 1455046 - RNA, 21 nt, Pseudomonas aeruginosa PA01
ucgguauggaagaacaucgcc

SEQ ID NO: 1455047 - RNA, 15 nt, Pseudomonas aeruginosa PA01
ucggucaccgugguc

SEQ ID NO: 1455048 - RNA, 19 nt, Pseudomonas aeruginosa PA01
ucggucaccguggucaugg

SEQ ID NO: 1455049 - RNA, 13 nt, Pseudomonas aeruginosa PA01
ucguucgucgccg

SEQ ID NO: 1455050 - RNA, 22 nt, Pseudomonas aeruginosa PA01
ucguucggcuguuucaggccgg

SEQ ID NO: 1455051 - RNA, 14 nt, Pseudomonas aeruginosa PA01
ucguucgggcgcua

SEQ ID NO: 1455052 - RNA, 22 nt, Pseudomonas aeruginosa PA01
ucguucuugcgcggucccugga

SEQ ID NO: 1455053 - RNA, 18 nt, Pseudomonas aeruginosa PA01
ucguuccggcucagccgc

SEQ ID NO: 1455054 - RNA, 17 nt, Pseudomonas aeruginosa PA01
ucguucccggccuggcg

SEQ ID NO: 1455055 - RNA, 23 nt, Pseudomonas aeruginosa PA01
ucguuaugcacguucuugaccuu

SEQ ID NO: 1455056 - RNA, 23 nt, Pseudomonas aeruginosa PA01
ucguuacacagcuugggauggcc

SEQ ID NO: 1455057 - RNA, 14 nt, Pseudomonas aeruginosa PA01
ucguggucgccguc

SEQ ID NO: 1455058 - RNA, 17 nt, Pseudomonas aeruginosa PA01
ucgucguccaucgccgc

SEQ ID NO: 1455059 - RNA, 18 nt, Pseudomonas aeruginosa PA01
ucgucguccaucgccgcg

SEQ ID NO: 1455060 - RNA, 17 nt, Pseudomonas aeruginosa PA01
ucgucggucgcgacggg

SEQ ID NO: 1455061 - RNA, 14 nt, Pseudomonas aeruginosa PA01
ucguugaagcggcc

SEQ ID NO: 1455062 - RNA, 21 nt, Pseudomonas aeruginosa PA01
ucguugaucacgaacagcuug

SEQ ID NO: 1455063 - RNA, 23 nt, Pseudomonas aeruginosa PA01
ucguugcaggcacggaagcgcug

SEQ ID NO: 1455064 - RNA, 15 nt, Pseudomonas aeruginosa PA01
ucguugcccggcuug

SEQ ID NO: 1455065 - RNA, 15 nt, Pseudomonas aeruginosa PA01
ucguugccauagccg

SEQ ID NO: 1455066 - RNA, 17 nt, Pseudomonas aeruginosa PA01
ucguugccgucgagcac

SEQ ID NO: 1455067 - RNA, 12 nt, Pseudomonas aeruginosa PA01
ucguugcgcagc

SEQ ID NO: 1455068 - RNA, 20 nt, Pseudomonas aeruginosa PA01
ucuacgccauacugggcggc

SEQ ID NO: 1455069 - RNA, 15 nt, Pseudomonas aeruginosa PA01
ucuacgccuugcggc

SEQ ID NO: 1455070 - RNA, 20 nt, Pseudomonas aeruginosa PA01
ucuacuaccgccagcgcacc

SEQ ID NO: 1455071 - RNA, 23 nt, Pseudomonas aeruginosa PA01
ucuaugggacgaccucagaccac

SEQ ID NO: 1455072 - RNA, 19 nt, Pseudomonas aeruginosa PA01
ucucgcccaguaccgccac

SEQ ID NO: 1455073 - RNA, 21 nt, Pseudomonas aeruginosa PA01
ucucgcccaguaccgccacgu

SEQ ID NO: 1455074 - RNA, 15 nt, Pseudomonas aeruginosa PA01
ucucgagcaugucgg

SEQ ID NO: 1455075 - RNA, 15 nt, Pseudomonas aeruginosa PA01
ucucgaucagcgccg

SEQ ID NO: 1455076 - RNA, 20 nt, Pseudomonas aeruginosa PA01
ucucgacguaggcggcgaag

SEQ ID NO: 1455077 - RNA, 17 nt, Pseudomonas aeruginosa PA01
ucucgacgaaggcgcgc

SEQ ID NO: 1455078 - RNA, 23 nt, Pseudomonas aeruginosa PA01
ucucgacgaaggcgcgcucgauc

SEQ ID NO: 1455079 - RNA, 15 nt, Pseudomonas aeruginosa PA01
ucucgacccgcucga

SEQ ID NO: 1455080 - RNA, 13 nt, Pseudomonas aeruginosa PA01
ucucgaagcgcgc

SEQ ID NO: 1455081 - RNA, 15 nt, Pseudomonas aeruginosa PA01
ucucgaagcgcgccu

SEQ ID NO: 1455082 - RNA, 13 nt, Pseudomonas aeruginosa PA01
ucuccugcuggac

SEQ ID NO: 1455083 - RNA, 15 nt, Pseudomonas aeruginosa PA01
ucuccugccgcggcg

SEQ ID NO: 1455084 - RNA, 16 nt, Pseudomonas aeruginosa PA01
ucuccucgauccgcug

SEQ ID NO: 1455085 - RNA, 20 nt, Pseudomonas aeruginosa PA01
ucucgaacaccaggcgccag

SEQ ID NO: 1455086 - RNA, 14 nt, Pseudomonas aeruginosa PA01
ucucgaacaccggc

SEQ ID NO: 1455087 - RNA, 16 nt, Pseudomonas aeruginosa PA01
ucucgaacaccggcga

SEQ ID NO: 1455088 - RNA, 12 nt, Pseudomonas aeruginosa PA01
ucuccgcucggg

SEQ ID NO: 1455089 - RNA, 14 nt, Pseudomonas aeruginosa PA01
ucuccgcgccacgc

SEQ ID NO: 1455090 - RNA, 20 nt, Pseudomonas aeruginosa PA01
ucuccgcgccgcggcggcgg

SEQ ID NO: 1455091 - RNA, 14 nt, Pseudomonas aeruginosa PA01
ucuccgcggagagg

SEQ ID NO: 1455092 - RNA, 12 nt, Pseudomonas aeruginosa PA01
ucuccggcgccg

SEQ ID NO: 1455093 - RNA, 15 nt, Pseudomonas aeruginosa PA01
ucuccggcgccgggc

SEQ ID NO: 1455094 - RNA, 16 nt, Pseudomonas aeruginosa PA01
ucuccgugcuggccgg

SEQ ID NO: 1455095 - RNA, 16 nt, Pseudomonas aeruginosa PA01
ucuccgucaaugcggc

SEQ ID NO: 1455096 - RNA, 15 nt, Pseudomonas aeruginosa PA01
ucuccgagacgcugc

SEQ ID NO: 1455097 - RNA, 20 nt, Pseudomonas aeruginosa PA01
ucuccgccgcuaucgccgcc

SEQ ID NO: 1455098 - RNA, 15 nt, Pseudomonas aeruginosa PA01
ucuccgccagccagc

SEQ ID NO: 1455099 - RNA, 20 nt, Pseudomonas aeruginosa PA01
ucuccgccagccagccgcgc

SEQ ID NO: 1455100 - RNA, 22 nt, Pseudomonas aeruginosa PA01
ucucagcgccguugcggcagca

SEQ ID NO: 1455101 - RNA, 18 nt, Pseudomonas aeruginosa PA01
ucucggugcucaggcggc

SEQ ID NO: 1455102 - RNA, 16 nt, Pseudomonas aeruginosa PA01
ucucgguguccaccac

SEQ ID NO: 1455103 - RNA, 19 nt, Pseudomonas aeruginosa PA01
ucucgguguccaccaccag

SEQ ID NO: 1455104 - RNA, 21 nt, Pseudomonas aeruginosa PA01
ucucgguguccaccaccagca

SEQ ID NO: 1455105 - RNA, 13 nt, Pseudomonas aeruginosa PA01
ucucggucgccgc

SEQ ID NO: 1455106 - RNA, 14 nt, Pseudomonas aeruginosa PA01
ucucggucgccgcc

SEQ ID NO: 1455107 - RNA, 13 nt, Pseudomonas aeruginosa PA01
ucucggucgggcg

SEQ ID NO: 1455108 - RNA, 24 nt, Pseudomonas aeruginosa PA01
ucucguccucggggaagcgcggcu

SEQ ID NO: 1455109 - RNA, 13 nt, Pseudomonas aeruginosa PA01
ucucgucgccgac

SEQ ID NO: 1455110 - RNA, 17 nt, Pseudomonas aeruginosa PA01
ucucgucgccgcccggc

SEQ ID NO: 1455111 - RNA, 14 nt, Pseudomonas aeruginosa PA01
ucucgugggccagc

SEQ ID NO: 1455112 - RNA, 15 nt, Pseudomonas aeruginosa PA01
ucucuacgccguagg

SEQ ID NO: 1455113 - RNA, 16 nt, Pseudomonas aeruginosa PA01
ucucugcgagacgggc

SEQ ID NO: 1455114 - RNA, 20 nt, Pseudomonas aeruginosa PA01
ucucgcagcaggcguucggc

SEQ ID NO: 1455115 - RNA, 18 nt, Pseudomonas aeruginosa PA01
ucucgccgucggcgguca

SEQ ID NO: 1455116 - RNA, 13 nt, Pseudomonas aeruginosa PA01
ucucgccgccgga

SEQ ID NO: 1455117 - RNA, 19 nt, Pseudomonas aeruginosa PA01
ucucgccgccggagagcga

SEQ ID NO: 1455118 - RNA, 14 nt, Pseudomonas aeruginosa PA01
ucucgcggcgcggc

SEQ ID NO: 1455119 - RNA, 12 nt, Pseudomonas aeruginosa PA01
ucucgcggcgga

SEQ ID NO: 1455120 - RNA, 20 nt, Pseudomonas aeruginosa PA01
ucucgcgacccuggccgcgc

SEQ ID NO: 1455121 - RNA, 14 nt, Pseudomonas aeruginosa PA01
ucucgcgcagcggc

SEQ ID NO: 1455122 - RNA, 14 nt, Pseudomonas aeruginosa PA01
ucucgccucggcgg

SEQ ID NO: 1455123 - RNA, 17 nt, Pseudomonas aeruginosa PA01
ucucggcugccgccagc

SEQ ID NO: 1455124 - RNA, 16 nt, Pseudomonas aeruginosa PA01
ucucggccaccaccac

SEQ ID NO: 1455125 - RNA, 21 nt, Pseudomonas aeruginosa PA01
ucucggccaccugcuccggcg

SEQ ID NO: 1455126 - RNA, 19 nt, Pseudomonas aeruginosa PA01
ucucgcguucaucgucggc

SEQ ID NO: 1455127 - RNA, 20 nt, Pseudomonas aeruginosa PA01
ucugagggacacggcgaccu

SEQ ID NO: 1455128 - RNA, 13 nt, Pseudomonas aeruginosa PA01
ucugcaacgcggc

SEQ ID NO: 1455129 - RNA, 15 nt, Pseudomonas aeruginosa PA01
ucugcaacgcggcgu

SEQ ID NO: 1455130 - RNA, 19 nt, Pseudomonas aeruginosa PA01
ucugcacaugcaccaccug

SEQ ID NO: 1455131 - RNA, 18 nt, Pseudomonas aeruginosa PA01
ucugcaccgugcgcgcgg

SEQ ID NO: 1455132 - RNA, 22 nt, Pseudomonas aeruginosa PA01
ucugcaccgcccuuucgaacug

SEQ ID NO: 1455133 - RNA, 19 nt, Pseudomonas aeruginosa PA01
ucugaacgaagaagccggc

SEQ ID NO: 1455134 - RNA, 23 nt, Pseudomonas aeruginosa PA01
ucugaacgaagaagccggccccu

SEQ ID NO: 1455135 - RNA, 12 nt, Pseudomonas aeruginosa PA01
ucugcaggccgu

SEQ ID NO: 1455136 - RNA, 16 nt, Pseudomonas aeruginosa PA01
ucugcagggcaucgcg

SEQ ID NO: 1455137 - RNA, 15 nt, Pseudomonas aeruginosa PA01
ucugccacccggcgc

SEQ ID NO: 1455138 - RNA, 16 nt, Pseudomonas aeruginosa PA01
ucugccacccggcgcc

SEQ ID NO: 1455139 - RNA, 20 nt, Pseudomonas aeruginosa PA01
ucugcgaauagacgccgcug

SEQ ID NO: 1455140 - RNA, 20 nt, Pseudomonas aeruginosa PA01
ucugccgguaggucaccagg

SEQ ID NO: 1455141 - RNA, 17 nt, Pseudomonas aeruginosa PA01
ucugccucgccgaggcg

SEQ ID NO: 1455142 - RNA, 13 nt, Pseudomonas aeruginosa PA01
ucugccgcgacag

SEQ ID NO: 1455143 - RNA, 14 nt, Pseudomonas aeruginosa PA01
ucugcccggccaug

SEQ ID NO: 1455144 - RNA, 13 nt, Pseudomonas aeruginosa PA01
ucugcccggcuuc

SEQ ID NO: 1455145 - RNA, 20 nt, Pseudomonas aeruginosa PA01
ucugcccggcuucgcuggug

SEQ ID NO: 1455146 - RNA, 13 nt, Pseudomonas aeruginosa PA01
ucugcccgccggc

SEQ ID NO: 1455147 - RNA, 15 nt, Pseudomonas aeruginosa PA01
ucugcccgccggcgc

SEQ ID NO: 1455148 - RNA, 14 nt, Pseudomonas aeruginosa PA01
ucugcccggcaucg

SEQ ID NO: 1455149 - RNA, 15 nt, Pseudomonas aeruginosa PA01
ucugcgccgcggcgu

SEQ ID NO: 1455150 - RNA, 19 nt, Pseudomonas aeruginosa PA01
ucugcgcaccaugcccgcu

SEQ ID NO: 1455151 - RNA, 14 nt, Pseudomonas aeruginosa PA01
ucugcgagccgcgc

SEQ ID NO: 1455152 - RNA, 20 nt, Pseudomonas aeruginosa PA01
ucugcgagacgggcgacgcc

SEQ ID NO: 1455153 - RNA, 16 nt, Pseudomonas aeruginosa PA01
ucugcgacaugccggu

SEQ ID NO: 1455154 - RNA, 21 nt, Pseudomonas aeruginosa PA01
ucuguuucgggucgcccuuga

SEQ ID NO: 1455155 - RNA, 18 nt, Pseudomonas aeruginosa PA01
ucugugccgaggccgccg

SEQ ID NO: 1455156 - RNA, 14 nt, Pseudomonas aeruginosa PA01
ucugugcggcgaug

SEQ ID NO: 1455157 - RNA, 14 nt, Pseudomonas aeruginosa PA01
ucugugcggugccg

SEQ ID NO: 1455158 - RNA, 18 nt, Pseudomonas aeruginosa PA01
ucugugcggugccgcgca

SEQ ID NO: 1455159 - RNA, 21 nt, Pseudomonas aeruginosa PA01
ucuguugguggggcgccggcu

SEQ ID NO: 1455160 - RNA, 17 nt, Pseudomonas aeruginosa PA01
ucuguguggccugggcg

SEQ ID NO: 1455161 - RNA, 21 nt, Pseudomonas aeruginosa PA01
ucuggggugaggccgagccga

SEQ ID NO: 1455162 - RNA, 16 nt, Pseudomonas aeruginosa PA01
ucuggguuucgucgcg

SEQ ID NO: 1455163 - RNA, 14 nt, Pseudomonas aeruginosa PA01
ucuggucgccgaca

SEQ ID NO: 1455164 - RNA, 15 nt, Pseudomonas aeruginosa PA01
ucuggucgccgacac

SEQ ID NO: 1455165 - RNA, 15 nt, Pseudomonas aeruginosa PA01
ucugggugaccagca

SEQ ID NO: 1455166 - RNA, 15 nt, Pseudomonas aeruginosa PA01
ucugguagccgcagu

SEQ ID NO: 1455167 - RNA, 14 nt, Pseudomonas aeruginosa PA01
ucugguagcgggcc

SEQ ID NO: 1455168 - RNA, 19 nt, Pseudomonas aeruginosa PA01
ucugguagcugcggccgag

SEQ ID NO: 1455169 - RNA, 19 nt, Pseudomonas aeruginosa PA01
ucugcuuuccggcccacgc

SEQ ID NO: 1455170 - RNA, 19 nt, Pseudomonas aeruginosa PA01
ucuggaucaguucgaucuu

SEQ ID NO: 1455171 - RNA, 22 nt, Pseudomonas aeruginosa PA01
ucuggaugaacgacuccagcuu

SEQ ID NO: 1455172 - RNA, 18 nt, Pseudomonas aeruginosa PA01
ucuggaugcagccggggc

SEQ ID NO: 1455173 - RNA, 11 nt, Pseudomonas aeruginosa PA01
ucugcucggcg

SEQ ID NO: 1455174 - RNA, 14 nt, Pseudomonas aeruginosa PA01
ucugcugcagcauc

SEQ ID NO: 1455175 - RNA, 21 nt, Pseudomonas aeruginosa PA01
ucugcuggccaccgcggcguc

SEQ ID NO: 1455176 - RNA, 12 nt, Pseudomonas aeruginosa PA01
ucugcuggccgc

SEQ ID NO: 1455177 - RNA, 14 nt, Pseudomonas aeruginosa PA01
ucugcuggccgcgc

SEQ ID NO: 1455178 - RNA, 13 nt, Pseudomonas aeruginosa PA01
ucugcuccugcag

SEQ ID NO: 1455179 - RNA, 14 nt, Pseudomonas aeruginosa PA01
ucugcucgaacauc

SEQ ID NO: 1455180 - RNA, 20 nt, Pseudomonas aeruginosa PA01
ucuggcgcauccgcccgauc

SEQ ID NO: 1455181 - RNA, 21 nt, Pseudomonas aeruginosa PA01
ucuggcugaagacccugcaca

SEQ ID NO: 1455182 - RNA, 20 nt, Pseudomonas aeruginosa PA01
ucugggccaugaccucggcc

SEQ ID NO: 1455183 - RNA, 16 nt, Pseudomonas aeruginosa PA01
ucuggccgaugccgac

SEQ ID NO: 1455184 - RNA, 19 nt, Pseudomonas aeruginosa PA01
ucuggccgaugccgaccuu

SEQ ID NO: 1455185 - RNA, 17 nt, Pseudomonas aeruginosa PA01
ucuggcccugcaacagg

SEQ ID NO: 1455186 - RNA, 16 nt, Pseudomonas aeruginosa PA01
ucuggccagaaggucg

SEQ ID NO: 1455187 - RNA, 17 nt, Pseudomonas aeruginosa PA01
ucuggccagaaggucgg

SEQ ID NO: 1455188 - RNA, 16 nt, Pseudomonas aeruginosa PA01
ucuggccauagaaacc

SEQ ID NO: 1455189 - RNA, 22 nt, Pseudomonas aeruginosa PA01
ucuggccauagaaaccgucuua

SEQ ID NO: 1455190 - RNA, 14 nt, Pseudomonas aeruginosa PA01
ucuucccggcucgg

SEQ ID NO: 1455191 - RNA, 21 nt, Pseudomonas aeruginosa PA01
ucuuccucgaaggucgcgaug

SEQ ID NO: 1455192 - RNA, 10 nt, Pseudomonas aeruginosa PA01
ucuucgacgc

SEQ ID NO: 1455193 - RNA, 15 nt, Pseudomonas aeruginosa PA01
ucuucgauggcggcc

SEQ ID NO: 1455194 - RNA, 21 nt, Pseudomonas aeruginosa PA01
ucuuccaccguggcgacgaug

SEQ ID NO: 1455195 - RNA, 23 nt, Pseudomonas aeruginosa PA01
ucuuccagcacgcggagggcggc

SEQ ID NO: 1455196 - RNA, 21 nt, Pseudomonas aeruginosa PA01
ucuucacccgcagcggcagcg

SEQ ID NO: 1455197 - RNA, 13 nt, Pseudomonas aeruginosa PA01
ucuucaguucggg

SEQ ID NO: 1455198 - RNA, 17 nt, Pseudomonas aeruginosa PA01
ucuucaggccguucagg

SEQ ID NO: 1455199 - RNA, 16 nt, Pseudomonas aeruginosa PA01
ucuucgguggcggcga

SEQ ID NO: 1455200 - RNA, 15 nt, Pseudomonas aeruginosa PA01
ucuucgccgacagau

SEQ ID NO: 1455201 - RNA, 14 nt, Pseudomonas aeruginosa PA01
ucuucucggcgauu

SEQ ID NO: 1455202 - RNA, 16 nt, Pseudomonas aeruginosa PA01
ucuucguuccaucgca

SEQ ID NO: 1455203 - RNA, 20 nt, Pseudomonas aeruginosa PA01
ucuucguuuucaggcgacgc

SEQ ID NO: 1455204 - RNA, 17 nt, Pseudomonas aeruginosa PA01
ucuucuaccuggcgcug

SEQ ID NO: 1455205 - RNA, 13 nt, Pseudomonas aeruginosa PA01
ucuucuccgccgc

SEQ ID NO: 1455206 - RNA, 21 nt, Pseudomonas aeruginosa PA01
ucuugccggaaagcaguucgc

SEQ ID NO: 1455207 - RNA, 23 nt, Pseudomonas aeruginosa PA01
ucuugcgcauuuugccggagaug

SEQ ID NO: 1455208 - RNA, 15 nt, Pseudomonas aeruginosa PA01
ucuugcgcccggcgc

SEQ ID NO: 1455209 - RNA, 14 nt, Pseudomonas aeruginosa PA01
ucuucugguaggcc

SEQ ID NO: 1455210 - RNA, 18 nt, Pseudomonas aeruginosa PA01
ucuugaccuucugcaccg

SEQ ID NO: 1455211 - RNA, 17 nt, Pseudomonas aeruginosa PA01
ucuugaucacguccagg

SEQ ID NO: 1455212 - RNA, 20 nt, Pseudomonas aeruginosa PA01
ucuugauccgcuccagcgcc

SEQ ID NO: 1455213 - RNA, 22 nt, Pseudomonas aeruginosa PA01
ucuugauccgcuccagcgccuc

SEQ ID NO: 1455214 - RNA, 14 nt, Pseudomonas aeruginosa PA01
ucuugcugccggcg

SEQ ID NO: 1455215 - RNA, 17 nt, Pseudomonas aeruginosa PA01
ucuuggucacggcgaag

SEQ ID NO: 1455216 - RNA, 14 nt, Pseudomonas aeruginosa PA01
ucuuggcggcgauc

SEQ ID NO: 1455217 - RNA, 14 nt, Pseudomonas aeruginosa PA01
ucuuggcucggcag

SEQ ID NO: 1455218 - RNA, 14 nt, Pseudomonas aeruginosa PA01
ucuugucgaccagc

SEQ ID NO: 1455219 - RNA, 13 nt, Pseudomonas aeruginosa PA01
ugaacaagcccug

SEQ ID NO: 1455220 - RNA, 15 nt, Pseudomonas aeruginosa PA01
ugaacaccagcgaag

SEQ ID NO: 1455221 - RNA, 21 nt, Pseudomonas aeruginosa PA01
ugaacaccgcuucgagcaccc

SEQ ID NO: 1455222 - RNA, 22 nt, Pseudomonas aeruginosa PA01
ugaacacauagaccagcagcga

SEQ ID NO: 1455223 - RNA, 17 nt, Pseudomonas aeruginosa PA01
ugaacacaucgaccagg

SEQ ID NO: 1455224 - RNA, 21 nt, Pseudomonas aeruginosa PA01
ugaaaaccggucccucggggc

SEQ ID NO: 1455225 - RNA, 15 nt, Pseudomonas aeruginosa PA01
ugaaaacggcgcccu

SEQ ID NO: 1455226 - RNA, 20 nt, Pseudomonas aeruginosa PA01
ugaaaaagccccgccgaagc

SEQ ID NO: 1455227 - RNA, 19 nt, Pseudomonas aeruginosa PA01
ugaaaaagcccggccgcug

SEQ ID NO: 1455228 - RNA, 15 nt, Pseudomonas aeruginosa PA01
ugaaaaaggccggug

SEQ ID NO: 1455229 - RNA, 16 nt, Pseudomonas aeruginosa PA01
ugaaaaaggccgguug

SEQ ID NO: 1455230 - RNA, 15 nt, Pseudomonas aeruginosa PA01
ugaaaaaggcgcccg

SEQ ID NO: 1455231 - RNA, 18 nt, Pseudomonas aeruginosa PA01
ugaacagguagcuggaaa

SEQ ID NO: 1455232 - RNA, 16 nt, Pseudomonas aeruginosa PA01
ugaacgcggcgagaac

SEQ ID NO: 1455233 - RNA, 12 nt, Pseudomonas aeruginosa PA01
ugaacagcggcc

SEQ ID NO: 1455234 - RNA, 17 nt, Pseudomonas aeruginosa PA01
ugaacagcgccaccagc

SEQ ID NO: 1455235 - RNA, 21 nt, Pseudomonas aeruginosa PA01
ugaugucggcgcugucgccgu

SEQ ID NO: 1455236 - RNA, 14 nt, Pseudomonas aeruginosa PA01
ugauggugccgccg

SEQ ID NO: 1455237 - RNA, 16 nt, Pseudomonas aeruginosa PA01
ugauguacucgcggcc

SEQ ID NO: 1455238 - RNA, 20 nt, Pseudomonas aeruginosa PA01
ugauguaggacgccucgucg

SEQ ID NO: 1455239 - RNA, 14 nt, Pseudomonas aeruginosa PA01
ugaugugccgcacg

SEQ ID NO: 1455240 - RNA, 22 nt, Pseudomonas aeruginosa PA01
ugauguugcgccauuucaaggc

SEQ ID NO: 1455241 - RNA, 16 nt, Pseudomonas aeruginosa PA01
ugauguugcggucgau

SEQ ID NO: 1455242 - RNA, 20 nt, Pseudomonas aeruginosa PA01
ugaugccgcggacggcacgg

SEQ ID NO: 1455243 - RNA, 13 nt, Pseudomonas aeruginosa PA01
ugaugccgaggcu

SEQ ID NO: 1455244 - RNA, 12 nt, Pseudomonas aeruginosa PA01
ugaugccgacgu

SEQ ID NO: 1455245 - RNA, 20 nt, Pseudomonas aeruginosa PA01
ugaucaccaccacgccgucg

SEQ ID NO: 1455246 - RNA, 19 nt, Pseudomonas aeruginosa PA01
ugaucaccaccggcuggcg

SEQ ID NO: 1455247 - RNA, 16 nt, Pseudomonas aeruginosa PA01
ugaucagcggccgagc

SEQ ID NO: 1455248 - RNA, 22 nt, Pseudomonas aeruginosa PA01
ugaucagcccuucgcgcucgac

SEQ ID NO: 1455249 - RNA, 14 nt, Pseudomonas aeruginosa PA01
ugaucaggccgagc

SEQ ID NO: 1455250 - RNA, 22 nt, Pseudomonas aeruginosa PA01
ugaucaggccgagcaccggcag

SEQ ID NO: 1455251 - RNA, 18 nt, Pseudomonas aeruginosa PA01
ugaucagggcaccgccga

SEQ ID NO: 1455252 - RNA, 13 nt, Pseudomonas aeruginosa PA01
ugaugaugccgcg

SEQ ID NO: 1455253 - RNA, 14 nt, Pseudomonas aeruginosa PA01
ugaugaugccgcgg

SEQ ID NO: 1455254 - RNA, 17 nt, Pseudomonas aeruginosa PA01
ugaugaugccgcggcga

SEQ ID NO: 1455255 - RNA, 23 nt, Pseudomonas aeruginosa PA01
ugaugcaauggauguugccgccg

SEQ ID NO: 1455256 - RNA, 14 nt, Pseudomonas aeruginosa PA01
ugaugcccagcggc

SEQ ID NO: 1455257 - RNA, 23 nt, Pseudomonas aeruginosa PA01
ugaugcccgggucgucggucggc

SEQ ID NO: 1455258 - RNA, 19 nt, Pseudomonas aeruginosa PA01
ugaugaccguccacggcgc

SEQ ID NO: 1455259 - RNA, 20 nt, Pseudomonas aeruginosa PA01
ugaugaccguccacggcgcg

SEQ ID NO: 1455260 - RNA, 22 nt, Pseudomonas aeruginosa PA01
ugcaacccuuugauggcgcugc

SEQ ID NO: 1455261 - RNA, 16 nt, Pseudomonas aeruginosa PA01
ugcaaccgcccugguc

SEQ ID NO: 1455262 - RNA, 21 nt, Pseudomonas aeruginosa PA01
ugcaacgccagcaggcgcagg

SEQ ID NO: 1455263 - RNA, 16 nt, Pseudomonas aeruginosa PA01
ugcaacgcccgcgagc

SEQ ID NO: 1455264 - RNA, 23 nt, Pseudomonas aeruginosa PA01
ugcaacgcccgcgagccguccug

SEQ ID NO: 1455265 - RNA, 21 nt, Pseudomonas aeruginosa PA01
ugcaacgccuggugcaggucg

SEQ ID NO: 1455266 - RNA, 15 nt, Pseudomonas aeruginosa PA01
ugcaacggcacgacc

SEQ ID NO: 1455267 - RNA, 22 nt, Pseudomonas aeruginosa PA01
ugcacagguugacgaugcggcc

SEQ ID NO: 1455268 - RNA, 17 nt, Pseudomonas aeruginosa PA01
ugcacaugcaccaccug

SEQ ID NO: 1455269 - RNA, 15 nt, Pseudomonas aeruginosa PA01
ugcaccaggcccugc

SEQ ID NO: 1455270 - RNA, 19 nt, Pseudomonas aeruginosa PA01
ugcaccaggcucgccccgg

SEQ ID NO: 1455271 - RNA, 22 nt, Pseudomonas aeruginosa PA01
ugcaccaggcucgccccggcgg

SEQ ID NO: 1455272 - RNA, 14 nt, Pseudomonas aeruginosa PA01
ugcaccagcaacug

SEQ ID NO: 1455273 - RNA, 13 nt, Pseudomonas aeruginosa PA01
ugcaccagcaggc

SEQ ID NO: 1455274 - RNA, 19 nt, Pseudomonas aeruginosa PA01
ugcaccagccaguccggca

SEQ ID NO: 1455275 - RNA, 21 nt, Pseudomonas aeruginosa PA01
ugcacgugcagcucggcacgc

SEQ ID NO: 1455276 - RNA, 15 nt, Pseudomonas aeruginosa PA01
ugcacuugcggcagu

SEQ ID NO: 1455277 - RNA, 17 nt, Pseudomonas aeruginosa PA01
ugcacuucgaccaguac

SEQ ID NO: 1455278 - RNA, 13 nt, Pseudomonas aeruginosa PA01
ugcagagcggcca

SEQ ID NO: 1455279 - RNA, 18 nt, Pseudomonas aeruginosa PA01
ugcagagcggccaggucg

SEQ ID NO: 1455280 - RNA, 19 nt, Pseudomonas aeruginosa PA01
ugcacggagugggccgcgu

SEQ ID NO: 1455281 - RNA, 17 nt, Pseudomonas aeruginosa PA01
ugcacggauaccacccg

SEQ ID NO: 1455282 - RNA, 18 nt, Pseudomonas aeruginosa PA01
ugcacggauaccacccgc

SEQ ID NO: 1455283 - RNA, 22 nt, Pseudomonas aeruginosa PA01
ugcacggauaccacccgcagcc

SEQ ID NO: 1455284 - RNA, 18 nt, Pseudomonas aeruginosa PA01
ugcacggccaggccacgg

SEQ ID NO: 1455285 - RNA, 22 nt, Pseudomonas aeruginosa PA01
ugcacggccaggccacggccgg

SEQ ID NO: 1455286 - RNA, 23 nt, Pseudomonas aeruginosa PA01
ugcacggccaggccacggccggc

SEQ ID NO: 1455287 - RNA, 14 nt, Pseudomonas aeruginosa PA01
ugcacgcugcgccg

SEQ ID NO: 1455288 - RNA, 15 nt, Pseudomonas aeruginosa PA01
ugcacgcugcgccgg

SEQ ID NO: 1455289 - RNA, 16 nt, Pseudomonas aeruginosa PA01
ugcacgcugcgccggc

SEQ ID NO: 1455290 - RNA, 17 nt, Pseudomonas aeruginosa PA01
ugcacgcugcgccggcg

SEQ ID NO: 1455291 - RNA, 16 nt, Pseudomonas aeruginosa PA01
ugcacggcgacccgcc

SEQ ID NO: 1455292 - RNA, 17 nt, Pseudomonas aeruginosa PA01
ugcacggcgacccgccg

SEQ ID NO: 1455293 - RNA, 19 nt, Pseudomonas aeruginosa PA01
ugcacggcgacccgccguu

SEQ ID NO: 1455294 - RNA, 15 nt, Pseudomonas aeruginosa PA01
ugcacggucugcucg

SEQ ID NO: 1455295 - RNA, 19 nt, Pseudomonas aeruginosa PA01
ugagauccuggccggcggc

SEQ ID NO: 1455296 - RNA, 11 nt, Pseudomonas aeruginosa PA01
ugagcaccgga

SEQ ID NO: 1455297 - RNA, 18 nt, Pseudomonas aeruginosa PA01
ugagccgcugguagcuac

SEQ ID NO: 1455298 - RNA, 19 nt, Pseudomonas aeruginosa PA01
ugagccgcugguccagcug

SEQ ID NO: 1455299 - RNA, 20 nt, Pseudomonas aeruginosa PA01
ugaagccuucgcccagguag

SEQ ID NO: 1455300 - RNA, 15 nt, Pseudomonas aeruginosa PA01
ugaagcgauccagcg

SEQ ID NO: 1455301 - RNA, 14 nt, Pseudomonas aeruginosa PA01
ugaagcggccgccg

SEQ ID NO: 1455302 - RNA, 18 nt, Pseudomonas aeruginosa PA01
ugaagcgcggcggcgcgg

SEQ ID NO: 1455303 - RNA, 13 nt, Pseudomonas aeruginosa PA01
ugacguucccguc

SEQ ID NO: 1455304 - RNA, 15 nt, Pseudomonas aeruginosa PA01
ugacguugcgccgca

SEQ ID NO: 1455305 - RNA, 11 nt, Pseudomonas aeruginosa PA01
ugaagccgccg

SEQ ID NO: 1455306 - RNA, 18 nt, Pseudomonas aeruginosa PA01
ugaagccgccgcccagca

SEQ ID NO: 1455307 - RNA, 15 nt, Pseudomonas aeruginosa PA01
ugaagccgcgcgccg

SEQ ID NO: 1455308 - RNA, 19 nt, Pseudomonas aeruginosa PA01
ugaagccccaguccucgua

SEQ ID NO: 1455309 - RNA, 16 nt, Pseudomonas aeruginosa PA01
ugaagcccgcggcauc

SEQ ID NO: 1455310 - RNA, 19 nt, Pseudomonas aeruginosa PA01
ugaagcccaccaccaccga

SEQ ID NO: 1455311 - RNA, 19 nt, Pseudomonas aeruginosa PA01
ugaagcccaggcgcucggc

SEQ ID NO: 1455312 - RNA, 23 nt, Pseudomonas aeruginosa PA01
ugaagauaucgccuuccucggcg

SEQ ID NO: 1455313 - RNA, 16 nt, Pseudomonas aeruginosa PA01
ugaacgugucgacgac

SEQ ID NO: 1455314 - RNA, 19 nt, Pseudomonas aeruginosa PA01
ugaacgugucgacgaccgg

SEQ ID NO: 1455315 - RNA, 17 nt, Pseudomonas aeruginosa PA01
ugagguuguacagguug

SEQ ID NO: 1455316 - RNA, 15 nt, Pseudomonas aeruginosa PA01
ugaggcgcgcgccga

SEQ ID NO: 1455317 - RNA, 15 nt, Pseudomonas aeruginosa PA01
ugaggaugucgcggc

SEQ ID NO: 1455318 - RNA, 14 nt, Pseudomonas aeruginosa PA01
ugaggcgcagcagc

SEQ ID NO: 1455319 - RNA, 19 nt, Pseudomonas aeruginosa PA01
ugaggaagucgaugaacgc

SEQ ID NO: 1455320 - RNA, 22 nt, Pseudomonas aeruginosa PA01
ugagccugucgauuucccccgg

SEQ ID NO: 1455321 - RNA, 22 nt, Pseudomonas aeruginosa PA01
ugauagucgacggaacaggagc

SEQ ID NO: 1455322 - RNA, 14 nt, Pseudomonas aeruginosa PA01
ugauaccgccggcg

SEQ ID NO: 1455323 - RNA, 16 nt, Pseudomonas aeruginosa PA01
ugauaccgcuggccag

SEQ ID NO: 1455324 - RNA, 17 nt, Pseudomonas aeruginosa PA01
ugccaaccgcgcucggc

SEQ ID NO: 1455325 - RNA, 18 nt, Pseudomonas aeruginosa PA01
ugccaacuggcgucccca

SEQ ID NO: 1455326 - RNA, 21 nt, Pseudomonas aeruginosa PA01
ugcagggggcuuugcggcccu

SEQ ID NO: 1455327 - RNA, 15 nt, Pseudomonas aeruginosa PA01
ugcagggucgccggg

SEQ ID NO: 1455328 - RNA, 15 nt, Pseudomonas aeruginosa PA01
ugcagggucaggucg

SEQ ID NO: 1455329 - RNA, 16 nt, Pseudomonas aeruginosa PA01
ugcagggucaggucgu

SEQ ID NO: 1455330 - RNA, 13 nt, Pseudomonas aeruginosa PA01
ugcagguacggcg

SEQ ID NO: 1455331 - RNA, 16 nt, Pseudomonas aeruginosa PA01
ugcagguacggcgccg

SEQ ID NO: 1455332 - RNA, 19 nt, Pseudomonas aeruginosa PA01
ugcagguagccgcgccggc

SEQ ID NO: 1455333 - RNA, 22 nt, Pseudomonas aeruginosa PA01
ugcagguagcgcugcgcccgcu

SEQ ID NO: 1455334 - RNA, 15 nt, Pseudomonas aeruginosa PA01
ugcagguaggcggug

SEQ ID NO: 1455335 - RNA, 17 nt, Pseudomonas aeruginosa PA01
ugcaugugccaggccug

SEQ ID NO: 1455336 - RNA, 14 nt, Pseudomonas aeruginosa PA01
ugcauguccucggc

SEQ ID NO: 1455337 - RNA, 21 nt, Pseudomonas aeruginosa PA01
ugcauguccucggcgccgucg

SEQ ID NO: 1455338 - RNA, 19 nt, Pseudomonas aeruginosa PA01
ugccaggagcacgccgugc

SEQ ID NO: 1455339 - RNA, 20 nt, Pseudomonas aeruginosa PA01
ugccaggaggauucgccagc

SEQ ID NO: 1455340 - RNA, 21 nt, Pseudomonas aeruginosa PA01
ugccaggaggauucgccagcc

SEQ ID NO: 1455341 - RNA, 21 nt, Pseudomonas aeruginosa PA01
ugccaggccugggucaccagc

SEQ ID NO: 1455342 - RNA, 22 nt, Pseudomonas aeruginosa PA01
ugccaggccugggucaccagca

SEQ ID NO: 1455343 - RNA, 15 nt, Pseudomonas aeruginosa PA01
ugccagaccguggcg

SEQ ID NO: 1455344 - RNA, 19 nt, Pseudomonas aeruginosa PA01
ugccagacgaucagcggcc

SEQ ID NO: 1455345 - RNA, 22 nt, Pseudomonas aeruginosa PA01
ugccagacgaucagcggcccga

SEQ ID NO: 1455346 - RNA, 18 nt, Pseudomonas aeruginosa PA01
ugccagaggaucggccaa

SEQ ID NO: 1455347 - RNA, 17 nt, Pseudomonas aeruginosa PA01
ugccagaguugccuguc

SEQ ID NO: 1455348 - RNA, 21 nt, Pseudomonas aeruginosa PA01
ugccagcucuggccguccugc

SEQ ID NO: 1455349 - RNA, 13 nt, Pseudomonas aeruginosa PA01
ugccacugacgcg

SEQ ID NO: 1455350 - RNA, 16 nt, Pseudomonas aeruginosa PA01
ugccacugacgcgcag

SEQ ID NO: 1455351 - RNA, 19 nt, Pseudomonas aeruginosa PA01
ugccacugacgcgcagcgc

SEQ ID NO: 1455352 - RNA, 22 nt, Pseudomonas aeruginosa PA01
ugccacugacgcgcagcgccgc

SEQ ID NO: 1455353 - RNA, 12 nt, Pseudomonas aeruginosa PA01
ugccacugcgcg

SEQ ID NO: 1455354 - RNA, 16 nt, Pseudomonas aeruginosa PA01
ugccacugcgcgccag

SEQ ID NO: 1455355 - RNA, 22 nt, Pseudomonas aeruginosa PA01
ugccacuugcgggugcgcaggc

SEQ ID NO: 1455356 - RNA, 21 nt, Pseudomonas aeruginosa PA01
ugccaggggcuagucgcgcag

SEQ ID NO: 1455357 - RNA, 17 nt, Pseudomonas aeruginosa PA01
ugccaggcgcucgcgcu

SEQ ID NO: 1455358 - RNA, 17 nt, Pseudomonas aeruginosa PA01
ugccaggcucgccgcca

SEQ ID NO: 1455359 - RNA, 20 nt, Pseudomonas aeruginosa PA01
ugccaggcucgccgccagca

SEQ ID NO: 1455360 - RNA, 22 nt, Pseudomonas aeruginosa PA01
ugccaggcucgccgccagcagg

SEQ ID NO: 1455361 - RNA, 18 nt, Pseudomonas aeruginosa PA01
ugccaguauuuggcgucg

SEQ ID NO: 1455362 - RNA, 14 nt, Pseudomonas aeruginosa PA01
ugccaggaccagcc

SEQ ID NO: 1455363 - RNA, 17 nt, Pseudomonas aeruginosa PA01
ugccagguuggcaacug

SEQ ID NO: 1455364 - RNA, 15 nt, Pseudomonas aeruginosa PA01
ugcaggacccgcgac

SEQ ID NO: 1455365 - RNA, 22 nt, Pseudomonas aeruginosa PA01
ugcaggaagcgccgggccgcau

SEQ ID NO: 1455366 - RNA, 15 nt, Pseudomonas aeruginosa PA01
ugcaggaacagccag

SEQ ID NO: 1455367 - RNA, 23 nt, Pseudomonas aeruginosa PA01
ugcagcuuggcgaauagccggcg

SEQ ID NO: 1455368 - RNA, 16 nt, Pseudomonas aeruginosa PA01
ugcagcuugugggcau

SEQ ID NO: 1455369 - RNA, 18 nt, Pseudomonas aeruginosa PA01
ugcagcuugugggcaugc

SEQ ID NO: 1455370 - RNA, 23 nt, Pseudomonas aeruginosa PA01
ugcagcuugugggcaugcucggc

SEQ ID NO: 1455371 - RNA, 19 nt, Pseudomonas aeruginosa PA01
ugcagcucggcacgcagca

SEQ ID NO: 1455372 - RNA, 18 nt, Pseudomonas aeruginosa PA01
ugcagcgucgacgccgag

SEQ ID NO: 1455373 - RNA, 13 nt, Pseudomonas aeruginosa PA01
ugcagcgucgcgc

SEQ ID NO: 1455374 - RNA, 23 nt, Pseudomonas aeruginosa PA01
ugcagcgcuuguagcagccgcag

SEQ ID NO: 1455375 - RNA, 22 nt, Pseudomonas aeruginosa PA01
ugcaggcacggaagcgcugcuc

SEQ ID NO: 1455376 - RNA, 21 nt, Pseudomonas aeruginosa PA01
ugcaggccagcgccagguugg

SEQ ID NO: 1455377 - RNA, 17 nt, Pseudomonas aeruginosa PA01
ugcaggcccggccgccu

SEQ ID NO: 1455378 - RNA, 22 nt, Pseudomonas aeruginosa PA01
ugcaggccgcgcgauggccggc

SEQ ID NO: 1455379 - RNA, 23 nt, Pseudomonas aeruginosa PA01
ugcaggccgagcugcucgaagca

SEQ ID NO: 1455380 - RNA, 14 nt, Pseudomonas aeruginosa PA01
ugcaggccgccgag

SEQ ID NO: 1455381 - RNA, 18 nt, Pseudomonas aeruginosa PA01
ugcaggccgaauccgccg

SEQ ID NO: 1455382 - RNA, 22 nt, Pseudomonas aeruginosa PA01
ugcaggccgaauccgccggcga

SEQ ID NO: 1455383 - RNA, 20 nt, Pseudomonas aeruginosa PA01
ugcaggcucacgcguucggc

SEQ ID NO: 1455384 - RNA, 20 nt, Pseudomonas aeruginosa PA01
ugcaggcucgacaggucggc

SEQ ID NO: 1455385 - RNA, 12 nt, Pseudomonas aeruginosa PA01
ugcaggccggcc

SEQ ID NO: 1455386 - RNA, 19 nt, Pseudomonas aeruginosa PA01
ugcaggccggccuccagcg

SEQ ID NO: 1455387 - RNA, 16 nt, Pseudomonas aeruginosa PA01
ugcagggccgccagcc

SEQ ID NO: 1455388 - RNA, 22 nt, Pseudomonas aeruginosa PA01
ugcagggauuccgggucgaggc

SEQ ID NO: 1455389 - RNA, 21 nt, Pseudomonas aeruginosa PA01
ugcagggccagggaggcgcug

SEQ ID NO: 1455390 - RNA, 13 nt, Pseudomonas aeruginosa PA01
ugcagggcgaucc

SEQ ID NO: 1455391 - RNA, 23 nt, Pseudomonas aeruginosa PA01
ugcagggcguagugcuccucguc

SEQ ID NO: 1455392 - RNA, 17 nt, Pseudomonas aeruginosa PA01
ugcagggcgucgccggg

SEQ ID NO: 1455393 - RNA, 23 nt, Pseudomonas aeruginosa PA01
ugcagcaggguaccgcuggcgcu

SEQ ID NO: 1455394 - RNA, 20 nt, Pseudomonas aeruginosa PA01
ugcagcagguagugcucggc

SEQ ID NO: 1455395 - RNA, 22 nt, Pseudomonas aeruginosa PA01
ugcagcagguagugcucggcca

SEQ ID NO: 1455396 - RNA, 19 nt, Pseudomonas aeruginosa PA01
ugcagcaggucgagcaguu

SEQ ID NO: 1455397 - RNA, 14 nt, Pseudomonas aeruginosa PA01
ugcagcaacccggc

SEQ ID NO: 1455398 - RNA, 18 nt, Pseudomonas aeruginosa PA01
ugcagcaacucgccgccg

SEQ ID NO: 1455399 - RNA, 17 nt, Pseudomonas aeruginosa PA01
ugcagauccagcggcag

SEQ ID NO: 1455400 - RNA, 16 nt, Pseudomonas aeruginosa PA01
ugcagcaagccgcagc

SEQ ID NO: 1455401 - RNA, 17 nt, Pseudomonas aeruginosa PA01
ugcagcaagccgcagcg

SEQ ID NO: 1455402 - RNA, 19 nt, Pseudomonas aeruginosa PA01
ugcagcaguuccaggcgug

SEQ ID NO: 1455403 - RNA, 17 nt, Pseudomonas aeruginosa PA01
ugcagccaccagccgaa

SEQ ID NO: 1455404 - RNA, 17 nt, Pseudomonas aeruginosa PA01
ugcagccacccagcagc

SEQ ID NO: 1455405 - RNA, 23 nt, Pseudomonas aeruginosa PA01
ugcagccacuguccaugaaugcc

SEQ ID NO: 1455406 - RNA, 16 nt, Pseudomonas aeruginosa PA01
ugcagccagccgucgu

SEQ ID NO: 1455407 - RNA, 15 nt, Pseudomonas aeruginosa PA01
ugcagcaucaggcgc

SEQ ID NO: 1455408 - RNA, 16 nt, Pseudomonas aeruginosa PA01
ugcagcaucaggcgcu

SEQ ID NO: 1455409 - RNA, 20 nt, Pseudomonas aeruginosa PA01
ugcagccguugccccagacc

SEQ ID NO: 1455410 - RNA, 12 nt, Pseudomonas aeruginosa PA01
ugcagccggggc

SEQ ID NO: 1455411 - RNA, 18 nt, Pseudomonas aeruginosa PA01
ugcagcgagucgccgugg

SEQ ID NO: 1455412 - RNA, 16 nt, Pseudomonas aeruginosa PA01
ugcccucgcagccggc

SEQ ID NO: 1455413 - RNA, 17 nt, Pseudomonas aeruginosa PA01
ugcccucgcagccggcg

SEQ ID NO: 1455414 - RNA, 14 nt, Pseudomonas aeruginosa PA01
ugcccucggcgccc

SEQ ID NO: 1455415 - RNA, 13 nt, Pseudomonas aeruginosa PA01
ugcccucgcggcg

SEQ ID NO: 1455416 - RNA, 16 nt, Pseudomonas aeruginosa PA01
ugcccucgcggcggca

SEQ ID NO: 1455417 - RNA, 18 nt, Pseudomonas aeruginosa PA01
ugcccuuguccggcccgg

SEQ ID NO: 1455418 - RNA, 17 nt, Pseudomonas aeruginosa PA01
ugcccuuuuccuccagg

SEQ ID NO: 1455419 - RNA, 21 nt, Pseudomonas aeruginosa PA01
ugcccuugaggucguuggcca

SEQ ID NO: 1455420 - RNA, 15 nt, Pseudomonas aeruginosa PA01
ugcccuugccgggaa

SEQ ID NO: 1455421 - RNA, 13 nt, Pseudomonas aeruginosa PA01
ugcccuugccggu

SEQ ID NO: 1455422 - RNA, 12 nt, Pseudomonas aeruginosa PA01
ugcccuggccgc

SEQ ID NO: 1455423 - RNA, 18 nt, Pseudomonas aeruginosa PA01
ugcccuggccggcacccu

SEQ ID NO: 1455424 - RNA, 19 nt, Pseudomonas aeruginosa PA01
ugcccuggcagacgcugcu

SEQ ID NO: 1455425 - RNA, 14 nt, Pseudomonas aeruginosa PA01
ugcccugggccggc

SEQ ID NO: 1455426 - RNA, 15 nt, Pseudomonas aeruginosa PA01
ugcccugggccggcg

SEQ ID NO: 1455427 - RNA, 16 nt, Pseudomonas aeruginosa PA01
ugcccugggccggcgc

SEQ ID NO: 1455428 - RNA, 13 nt, Pseudomonas aeruginosa PA01
ugcccugccggcg

SEQ ID NO: 1455429 - RNA, 15 nt, Pseudomonas aeruginosa PA01
ugcccuggaagccgg

SEQ ID NO: 1455430 - RNA, 17 nt, Pseudomonas aeruginosa PA01
ugcccuggaagccggca

SEQ ID NO: 1455431 - RNA, 20 nt, Pseudomonas aeruginosa PA01
ugcccuggaagccggcaggg

SEQ ID NO: 1455432 - RNA, 19 nt, Pseudomonas aeruginosa PA01
ugcccgggucgucggucgg

SEQ ID NO: 1455433 - RNA, 19 nt, Pseudomonas aeruginosa PA01
ugcccgguauucagccaga

SEQ ID NO: 1455434 - RNA, 18 nt, Pseudomonas aeruginosa PA01
ugcccgucuagcgcaggc

SEQ ID NO: 1455435 - RNA, 21 nt, Pseudomonas aeruginosa PA01
ugcccgucgaccaucaccagc

SEQ ID NO: 1455436 - RNA, 22 nt, Pseudomonas aeruginosa PA01
ugcccgucgaccaucaccagcg

SEQ ID NO: 1455437 - RNA, 17 nt, Pseudomonas aeruginosa PA01
ugcccguaccacgucca

SEQ ID NO: 1455438 - RNA, 15 nt, Pseudomonas aeruginosa PA01
ugcccgccucgcgca

SEQ ID NO: 1455439 - RNA, 12 nt, Pseudomonas aeruginosa PA01
ugcccgccccgc

SEQ ID NO: 1455440 - RNA, 18 nt, Pseudomonas aeruginosa PA01
ugcccgccccgcaccagc

SEQ ID NO: 1455441 - RNA, 13 nt, Pseudomonas aeruginosa PA01
ugcccgcgccucg

SEQ ID NO: 1455442 - RNA, 20 nt, Pseudomonas aeruginosa PA01
ugcccgcgccugggccgcga

SEQ ID NO: 1455443 - RNA, 22 nt, Pseudomonas aeruginosa PA01
ugcccgcgccugggccgcgagg

SEQ ID NO: 1455444 - RNA, 12 nt, Pseudomonas aeruginosa PA01
ugcccgccggcg

SEQ ID NO: 1455445 - RNA, 20 nt, Pseudomonas aeruginosa PA01
ugcccgccggcgcgcccagg

SEQ ID NO: 1455446 - RNA, 13 nt, Pseudomonas aeruginosa PA01
ugcccgcaggggc

SEQ ID NO: 1455447 - RNA, 16 nt, Pseudomonas aeruginosa PA01
ugcccgcaggggcugc

SEQ ID NO: 1455448 - RNA, 19 nt, Pseudomonas aeruginosa PA01
ugcccgaggugucgccgcg

SEQ ID NO: 1455449 - RNA, 16 nt, Pseudomonas aeruginosa PA01
ugcccgagugccggcg

SEQ ID NO: 1455450 - RNA, 17 nt, Pseudomonas aeruginosa PA01
ugcccgaugccgcgccg

SEQ ID NO: 1455451 - RNA, 21 nt, Pseudomonas aeruginosa PA01
ugccaucgaggccaggccgag

SEQ ID NO: 1455452 - RNA, 15 nt, Pseudomonas aeruginosa PA01
ugccauggaucacca

SEQ ID NO: 1455453 - RNA, 18 nt, Pseudomonas aeruginosa PA01
ugccauggaucaccaggg

SEQ ID NO: 1455454 - RNA, 12 nt, Pseudomonas aeruginosa PA01
ugccauggcggc

SEQ ID NO: 1455455 - RNA, 14 nt, Pseudomonas aeruginosa PA01
ugccauggcggcgg

SEQ ID NO: 1455456 - RNA, 14 nt, Pseudomonas aeruginosa PA01
ugccaucaucggac

SEQ ID NO: 1455457 - RNA, 14 nt, Pseudomonas aeruginosa PA01
ugccauccuccagc

SEQ ID NO: 1455458 - RNA, 17 nt, Pseudomonas aeruginosa PA01
ugccauccuccagcacu

SEQ ID NO: 1455459 - RNA, 16 nt, Pseudomonas aeruginosa PA01
ugccauacagcgccca

SEQ ID NO: 1455460 - RNA, 20 nt, Pseudomonas aeruginosa PA01
ugccgcgcagguucaucgcc

SEQ ID NO: 1455461 - RNA, 13 nt, Pseudomonas aeruginosa PA01
ugccgcgccaggc

SEQ ID NO: 1455462 - RNA, 13 nt, Pseudomonas aeruginosa PA01
ugccgcgcccggc

SEQ ID NO: 1455463 - RNA, 15 nt, Pseudomonas aeruginosa PA01
ugccgcgcccggcca

SEQ ID NO: 1455464 - RNA, 17 nt, Pseudomonas aeruginosa PA01
ugccgcgcgggccggcg

SEQ ID NO: 1455465 - RNA, 19 nt, Pseudomonas aeruginosa PA01
ugccgcgcgggccggcgau

SEQ ID NO: 1455466 - RNA, 13 nt, Pseudomonas aeruginosa PA01
ugccgcgcucgga

SEQ ID NO: 1455467 - RNA, 23 nt, Pseudomonas aeruginosa PA01
ugccgcgcucggaucaggcgggc

SEQ ID NO: 1455468 - RNA, 14 nt, Pseudomonas aeruginosa PA01
ugccgcgcaccacc

SEQ ID NO: 1455469 - RNA, 13 nt, Pseudomonas aeruginosa PA01
ugccgcgcagcuu

SEQ ID NO: 1455470 - RNA, 17 nt, Pseudomonas aeruginosa PA01
ugccgccuucgcgggcc

SEQ ID NO: 1455471 - RNA, 18 nt, Pseudomonas aeruginosa PA01
ugccgccuucgcgggcca

SEQ ID NO: 1455472 - RNA, 20 nt, Pseudomonas aeruginosa PA01
ugccgcgagccagccguggc

SEQ ID NO: 1455473 - RNA, 21 nt, Pseudomonas aeruginosa PA01
ugccgcgagcuuggcccuggc

SEQ ID NO: 1455474 - RNA, 22 nt, Pseudomonas aeruginosa PA01
ugccgcgagcuuggcccuggcc

SEQ ID NO: 1455475 - RNA, 22 nt, Pseudomonas aeruginosa PA01
ugccgccgcuggccuggccacc

SEQ ID NO: 1455476 - RNA, 11 nt, Pseudomonas aeruginosa PA01
ugccgccggca

SEQ ID NO: 1455477 - RNA, 13 nt, Pseudomonas aeruginosa PA01
ugccgccggcauc

SEQ ID NO: 1455478 - RNA, 14 nt, Pseudomonas aeruginosa PA01
ugccgccggcaucc

SEQ ID NO: 1455479 - RNA, 20 nt, Pseudomonas aeruginosa PA01
ugccgccggccaccagcagc

SEQ ID NO: 1455480 - RNA, 14 nt, Pseudomonas aeruginosa PA01
ugccgccgcgcagg

SEQ ID NO: 1455481 - RNA, 13 nt, Pseudomonas aeruginosa PA01
ugccgccgcgcug

SEQ ID NO: 1455482 - RNA, 14 nt, Pseudomonas aeruginosa PA01
ugccgccgcgcugc

SEQ ID NO: 1455483 - RNA, 16 nt, Pseudomonas aeruginosa PA01
ugccgccgcgcccggc

SEQ ID NO: 1455484 - RNA, 20 nt, Pseudomonas aeruginosa PA01
ugccgccgcgcccggcgcca

SEQ ID NO: 1455485 - RNA, 22 nt, Pseudomonas aeruginosa PA01
ugccgccgcgcccggcgccagg

SEQ ID NO: 1455486 - RNA, 17 nt, Pseudomonas aeruginosa PA01
ugccgccaucgaccagg

SEQ ID NO: 1455487 - RNA, 19 nt, Pseudomonas aeruginosa PA01
ugccgccaucgccucgccg

SEQ ID NO: 1455488 - RNA, 23 nt, Pseudomonas aeruginosa PA01
ugccgccaucgccucgccggcca

SEQ ID NO: 1455489 - RNA, 23 nt, Pseudomonas aeruginosa PA01
ugccgccagguguacaucgggau

SEQ ID NO: 1455490 - RNA, 13 nt, Pseudomonas aeruginosa PA01
ugccgccagucgg

SEQ ID NO: 1455491 - RNA, 17 nt, Pseudomonas aeruginosa PA01
ugccgccagucggccug

SEQ ID NO: 1455492 - RNA, 20 nt, Pseudomonas aeruginosa PA01
ugccgccgacgccggacgag

SEQ ID NO: 1455493 - RNA, 21 nt, Pseudomonas aeruginosa PA01
ugccgccgaccucggccgcca

SEQ ID NO: 1455494 - RNA, 20 nt, Pseudomonas aeruginosa PA01
ugccgccgaucagcgcgccu

SEQ ID NO: 1455495 - RNA, 15 nt, Pseudomonas aeruginosa PA01
ugccgccgccggagg

SEQ ID NO: 1455496 - RNA, 22 nt, Pseudomonas aeruginosa PA01
ugccgaacugcagggcgucgcc

SEQ ID NO: 1455497 - RNA, 20 nt, Pseudomonas aeruginosa PA01
ugccgaacagcagggaggcg

SEQ ID NO: 1455498 - RNA, 18 nt, Pseudomonas aeruginosa PA01
ugccgaacaggcguccca

SEQ ID NO: 1455499 - RNA, 23 nt, Pseudomonas aeruginosa PA01
ugccgaacaggcgucccauggcg

SEQ ID NO: 1455500 - RNA, 19 nt, Pseudomonas aeruginosa PA01
ugccgaaggcgucauccgc

SEQ ID NO: 1455501 - RNA, 16 nt, Pseudomonas aeruginosa PA01
ugccgaagcgcucggu

SEQ ID NO: 1455502 - RNA, 21 nt, Pseudomonas aeruginosa PA01
ugccgaagauacccagcgggc

SEQ ID NO: 1455503 - RNA, 22 nt, Pseudomonas aeruginosa PA01
ugccgaagaucgacaggccgcc

SEQ ID NO: 1455504 - RNA, 23 nt, Pseudomonas aeruginosa PA01
ugccgaagaucgacaggccgccg

SEQ ID NO: 1455505 - RNA, 14 nt, Pseudomonas aeruginosa PA01
ugccgaucgccgcg

SEQ ID NO: 1455506 - RNA, 20 nt, Pseudomonas aeruginosa PA01
ugccgaucaugcucggcggu

SEQ ID NO: 1455507 - RNA, 22 nt, Pseudomonas aeruginosa PA01
ugccgaucaggcugaagcggcc

SEQ ID NO: 1455508 - RNA, 19 nt, Pseudomonas aeruginosa PA01
ugccgacaagccuccagcg

SEQ ID NO: 1455509 - RNA, 19 nt, Pseudomonas aeruginosa PA01
ugccgaccacaugggcgac

SEQ ID NO: 1455510 - RNA, 23 nt, Pseudomonas aeruginosa PA01
ugccgaccacguaguaggcgcgg

SEQ ID NO: 1455511 - RNA, 16 nt, Pseudomonas aeruginosa PA01
ugccgaucucgcccag

SEQ ID NO: 1455512 - RNA, 17 nt, Pseudomonas aeruginosa PA01
ugccgaucucgcccagu

SEQ ID NO: 1455513 - RNA, 16 nt, Pseudomonas aeruginosa PA01
ugccgaugccggaaag

SEQ ID NO: 1455514 - RNA, 15 nt, Pseudomonas aeruginosa PA01
ugccgaugccgccga

SEQ ID NO: 1455515 - RNA, 19 nt, Pseudomonas aeruginosa PA01
ugccgauggcgccgccgag

SEQ ID NO: 1455516 - RNA, 16 nt, Pseudomonas aeruginosa PA01
ugccgaugcugaucac

SEQ ID NO: 1455517 - RNA, 16 nt, Pseudomonas aeruginosa PA01
ugccgccagcgcggcg

SEQ ID NO: 1455518 - RNA, 21 nt, Pseudomonas aeruginosa PA01
ugccgccaggccuuccagaac

SEQ ID NO: 1455519 - RNA, 13 nt, Pseudomonas aeruginosa PA01
ugccgcaggcagu

SEQ ID NO: 1455520 - RNA, 16 nt, Pseudomonas aeruginosa PA01
ugccgcaggcaguggc

SEQ ID NO: 1455521 - RNA, 17 nt, Pseudomonas aeruginosa PA01
ugccgcaggcaguggcg

SEQ ID NO: 1455522 - RNA, 19 nt, Pseudomonas aeruginosa PA01
ugccgcaggcaguggcgcc

SEQ ID NO: 1455523 - RNA, 21 nt, Pseudomonas aeruginosa PA01
ugccgcaggcaguggcgccag

SEQ ID NO: 1455524 - RNA, 23 nt, Pseudomonas aeruginosa PA01
ugccgcaggcaguggcgccagcc

SEQ ID NO: 1455525 - RNA, 16 nt, Pseudomonas aeruginosa PA01
ugccgcaggccgcggc

SEQ ID NO: 1455526 - RNA, 17 nt, Pseudomonas aeruginosa PA01
ugccgcaggccgcggcc

SEQ ID NO: 1455527 - RNA, 14 nt, Pseudomonas aeruginosa PA01
ugccgcaggcgggc

SEQ ID NO: 1455528 - RNA, 18 nt, Pseudomonas aeruginosa PA01
ugccgcaggucuugucgc

SEQ ID NO: 1455529 - RNA, 20 nt, Pseudomonas aeruginosa PA01
ugcgcgggauaaacggcgga

SEQ ID NO: 1455530 - RNA, 20 nt, Pseudomonas aeruginosa PA01
ugcgcgggauagacggcgga

SEQ ID NO: 1455531 - RNA, 17 nt, Pseudomonas aeruginosa PA01
ugcgcggccugcgccgg

SEQ ID NO: 1455532 - RNA, 19 nt, Pseudomonas aeruginosa PA01
ugcgcggcgaguugcgcga

SEQ ID NO: 1455533 - RNA, 22 nt, Pseudomonas aeruginosa PA01
ugcgcggcgaguugcgcgaggc

SEQ ID NO: 1455534 - RNA, 14 nt, Pseudomonas aeruginosa PA01
ugcgcgccggcggg

SEQ ID NO: 1455535 - RNA, 13 nt, Pseudomonas aeruginosa PA01
ugcgcgcaccagg

SEQ ID NO: 1455536 - RNA, 14 nt, Pseudomonas aeruginosa PA01
ugcgcgccgccgcc

SEQ ID NO: 1455537 - RNA, 14 nt, Pseudomonas aeruginosa PA01
ugcgcgccgccggg

SEQ ID NO: 1455538 - RNA, 20 nt, Pseudomonas aeruginosa PA01
ugcgcgccgccgggcgcccg

SEQ ID NO: 1455539 - RNA, 21 nt, Pseudomonas aeruginosa PA01
ugcgcgccgccgggcgcccgg

SEQ ID NO: 1455540 - RNA, 12 nt, Pseudomonas aeruginosa PA01
ugcgcgcccuga

SEQ ID NO: 1455541 - RNA, 12 nt, Pseudomonas aeruginosa PA01
ugcgcgccgcaa

SEQ ID NO: 1455542 - RNA, 17 nt, Pseudomonas aeruginosa PA01
ugcgcugggcgccgauu

SEQ ID NO: 1455543 - RNA, 19 nt, Pseudomonas aeruginosa PA01
ugcgcugguaccugccggc

SEQ ID NO: 1455544 - RNA, 20 nt, Pseudomonas aeruginosa PA01
ugcgcugguaccugccggca

SEQ ID NO: 1455545 - RNA, 23 nt, Pseudomonas aeruginosa PA01
ugcgcugguagcgcuccagcucc

SEQ ID NO: 1455546 - RNA, 15 nt, Pseudomonas aeruginosa PA01
ugcgcuggccggcaa

SEQ ID NO: 1455547 - RNA, 15 nt, Pseudomonas aeruginosa PA01
ugcgcuggcgcagca

SEQ ID NO: 1455548 - RNA, 16 nt, Pseudomonas aeruginosa PA01
ugcgcuggcgcagcag

SEQ ID NO: 1455549 - RNA, 17 nt, Pseudomonas aeruginosa PA01
ugcgcuggcgcagcagc

SEQ ID NO: 1455550 - RNA, 14 nt, Pseudomonas aeruginosa PA01
ugcgcuuccggcag

SEQ ID NO: 1455551 - RNA, 20 nt, Pseudomonas aeruginosa PA01
ugcgcuuaaagcaacgcgga

SEQ ID NO: 1455552 - RNA, 18 nt, Pseudomonas aeruginosa PA01
ugcgcuguuccgccgugg

SEQ ID NO: 1455553 - RNA, 17 nt, Pseudomonas aeruginosa PA01
ugcgcugcuugaacacc

SEQ ID NO: 1455554 - RNA, 23 nt, Pseudomonas aeruginosa PA01
ugcgcugcgcguacaucccgccg

SEQ ID NO: 1455555 - RNA, 15 nt, Pseudomonas aeruginosa PA01
ugcgcugccagcgcc

SEQ ID NO: 1455556 - RNA, 17 nt, Pseudomonas aeruginosa PA01
ugcgcugccagcgccgc

SEQ ID NO: 1455557 - RNA, 19 nt, Pseudomonas aeruginosa PA01
ugcgcgggcaugcaccuac

SEQ ID NO: 1455558 - RNA, 22 nt, Pseudomonas aeruginosa PA01
ugcgcgggcaugcaccuaccag

SEQ ID NO: 1455559 - RNA, 24 nt, Pseudomonas aeruginosa PA01
ugcgcgggguagggguggccaggc

SEQ ID NO: 1455560 - RNA, 14 nt, Pseudomonas aeruginosa PA01
ugcgcucuggcgca

SEQ ID NO: 1455561 - RNA, 16 nt, Pseudomonas aeruginosa PA01
ugcgccgaccgcgcgc

SEQ ID NO: 1455562 - RNA, 17 nt, Pseudomonas aeruginosa PA01
ugcgccgaccgcgcgcc

SEQ ID NO: 1455563 - RNA, 18 nt, Pseudomonas aeruginosa PA01
ugcgccgacgccaccagc

SEQ ID NO: 1455564 - RNA, 20 nt, Pseudomonas aeruginosa PA01
ugcgccgaauccaggccgac

SEQ ID NO: 1455565 - RNA, 20 nt, Pseudomonas aeruginosa PA01
ugcgcccguucgaucaauug

SEQ ID NO: 1455566 - RNA, 21 nt, Pseudomonas aeruginosa PA01
ugcgcccucaagucuccagcg

SEQ ID NO: 1455567 - RNA, 16 nt, Pseudomonas aeruginosa PA01
ugcgcccucgaacggc

SEQ ID NO: 1455568 - RNA, 13 nt, Pseudomonas aeruginosa PA01
ugcgcccggcgcg

SEQ ID NO: 1455569 - RNA, 16 nt, Pseudomonas aeruginosa PA01
ugcgcccgccgcgagc

SEQ ID NO: 1455570 - RNA, 14 nt, Pseudomonas aeruginosa PA01
ugcgcccgcucgac

SEQ ID NO: 1455571 - RNA, 14 nt, Pseudomonas aeruginosa PA01
ugcgcccgcugaag

SEQ ID NO: 1455572 - RNA, 16 nt, Pseudomonas aeruginosa PA01
ugcgccccgggucgcu

SEQ ID NO: 1455573 - RNA, 22 nt, Pseudomonas aeruginosa PA01
ugcgccccggucucgcgcagcg

SEQ ID NO: 1455574 - RNA, 17 nt, Pseudomonas aeruginosa PA01
ugcgccccagcgccugg

SEQ ID NO: 1455575 - RNA, 19 nt, Pseudomonas aeruginosa PA01
ugcgccccagcgccugggc

SEQ ID NO: 1455576 - RNA, 13 nt, Pseudomonas aeruginosa PA01
ugcgccccaggug

SEQ ID NO: 1455577 - RNA, 21 nt, Pseudomonas aeruginosa PA01
ugcgccccaggugcagcgagg

SEQ ID NO: 1455578 - RNA, 15 nt, Pseudomonas aeruginosa PA01
ugcgcccccagcgcc

SEQ ID NO: 1455579 - RNA, 18 nt, Pseudomonas aeruginosa PA01
ugcgcccccagcgcccgc

SEQ ID NO: 1455580 - RNA, 13 nt, Pseudomonas aeruginosa PA01
ugcgcgccaccag

SEQ ID NO: 1455581 - RNA, 18 nt, Pseudomonas aeruginosa PA01
ugcgcgccauuccgcggc

SEQ ID NO: 1455582 - RNA, 24 nt, Pseudomonas aeruginosa PA01
ugcgcgccauuccgcggcacuccg

SEQ ID NO: 1455583 - RNA, 14 nt, Pseudomonas aeruginosa PA01
ugcgcgccaccacc

SEQ ID NO: 1455584 - RNA, 19 nt, Pseudomonas aeruginosa PA01
ugcgcgcaguaggcgcugc

SEQ ID NO: 1455585 - RNA, 14 nt, Pseudomonas aeruginosa PA01
ugcgcgccagcgcc

SEQ ID NO: 1455586 - RNA, 13 nt, Pseudomonas aeruginosa PA01
ugcgcgagcaccg

SEQ ID NO: 1455587 - RNA, 22 nt, Pseudomonas aeruginosa PA01
ugcgcgagcgauccgcugcaug

SEQ ID NO: 1455588 - RNA, 14 nt, Pseudomonas aeruginosa PA01
ugcgcgaggagccg

SEQ ID NO: 1455589 - RNA, 22 nt, Pseudomonas aeruginosa PA01
ugcgcgaggagccguagggcgc

SEQ ID NO: 1455590 - RNA, 12 nt, Pseudomonas aeruginosa PA01
ugcgcgaggcgu

SEQ ID NO: 1455591 - RNA, 22 nt, Pseudomonas aeruginosa PA01
ugcggaacgcggcuucggucag

SEQ ID NO: 1455592 - RNA, 14 nt, Pseudomonas aeruginosa PA01
ugcgcuugcugcca

SEQ ID NO: 1455593 - RNA, 16 nt, Pseudomonas aeruginosa PA01
ugcgcuugccggccgc

SEQ ID NO: 1455594 - RNA, 17 nt, Pseudomonas aeruginosa PA01
ugcggaccacagggcaa

SEQ ID NO: 1455595 - RNA, 17 nt, Pseudomonas aeruginosa PA01
ugcggcccgagggcggc

SEQ ID NO: 1455596 - RNA, 18 nt, Pseudomonas aeruginosa PA01
ugcggcccgagggcggca

SEQ ID NO: 1455597 - RNA, 12 nt, Pseudomonas aeruginosa PA01
ugcggcccgccg

SEQ ID NO: 1455598 - RNA, 15 nt, Pseudomonas aeruginosa PA01
ugcggcccgccggcg

SEQ ID NO: 1455599 - RNA, 16 nt, Pseudomonas aeruginosa PA01
ugcggcccgccggcga

SEQ ID NO: 1455600 - RNA, 13 nt, Pseudomonas aeruginosa PA01
ugcggcccgccuc

SEQ ID NO: 1455601 - RNA, 16 nt, Pseudomonas aeruginosa PA01
ugcggcccgccucggc

SEQ ID NO: 1455602 - RNA, 20 nt, Pseudomonas aeruginosa PA01
ugcggcccgccucggcggcu

SEQ ID NO: 1455603 - RNA, 19 nt, Pseudomonas aeruginosa PA01
ugcggcccuugcucagguc

SEQ ID NO: 1455604 - RNA, 21 nt, Pseudomonas aeruginosa PA01
ugcggccugcaacgccgccaa

SEQ ID NO: 1455605 - RNA, 19 nt, Pseudomonas aeruginosa PA01
ugcggcccuuguucgcggc

SEQ ID NO: 1455606 - RNA, 18 nt, Pseudomonas aeruginosa PA01
ugcggccgcaaccagccc

SEQ ID NO: 1455607 - RNA, 21 nt, Pseudomonas aeruginosa PA01
ugcggcgauggcguccaccgc

SEQ ID NO: 1455608 - RNA, 12 nt, Pseudomonas aeruginosa PA01
ugcggcgcccgc

SEQ ID NO: 1455609 - RNA, 13 nt, Pseudomonas aeruginosa PA01
ugcggcgcccgcc

SEQ ID NO: 1455610 - RNA, 10 nt, Pseudomonas aeruginosa PA01
ugcggcgccu

SEQ ID NO: 1455611 - RNA, 12 nt, Pseudomonas aeruginosa PA01
ugcggcgccggu

SEQ ID NO: 1455612 - RNA, 20 nt, Pseudomonas aeruginosa PA01
ugcggcgccgguugcugcug

SEQ ID NO: 1455613 - RNA, 14 nt, Pseudomonas aeruginosa PA01
ugcggcgcaggcgg

SEQ ID NO: 1455614 - RNA, 15 nt, Pseudomonas aeruginosa PA01
ugcggcgcucgggau

SEQ ID NO: 1455615 - RNA, 11 nt, Pseudomonas aeruginosa PA01
ugcggcgcugc

SEQ ID NO: 1455616 - RNA, 13 nt, Pseudomonas aeruginosa PA01
ugcggcgcugcca

SEQ ID NO: 1455617 - RNA, 18 nt, Pseudomonas aeruginosa PA01
ugcggguucagucggcca

SEQ ID NO: 1455618 - RNA, 21 nt, Pseudomonas aeruginosa PA01
ugcggguucagucggccaggc

SEQ ID NO: 1455619 - RNA, 14 nt, Pseudomonas aeruginosa PA01
ugcgggucgaggcc

SEQ ID NO: 1455620 - RNA, 16 nt, Pseudomonas aeruginosa PA01
ugcggguggucgccgc

SEQ ID NO: 1455621 - RNA, 20 nt, Pseudomonas aeruginosa PA01
ugcggguggucuugcgcagg

SEQ ID NO: 1455622 - RNA, 15 nt, Pseudomonas aeruginosa PA01
ugcgguaccagcgca

SEQ ID NO: 1455623 - RNA, 14 nt, Pseudomonas aeruginosa PA01
ugcgguagcgcucg

SEQ ID NO: 1455624 - RNA, 22 nt, Pseudomonas aeruginosa PA01
ugcggcuuucgguuugcgccga

SEQ ID NO: 1455625 - RNA, 17 nt, Pseudomonas aeruginosa PA01
ugcgggaacgaugccgc

SEQ ID NO: 1455626 - RNA, 15 nt, Pseudomonas aeruginosa PA01
ugcggcuugcccugc

SEQ ID NO: 1455627 - RNA, 15 nt, Pseudomonas aeruginosa PA01
ugcggcugccggugc

SEQ ID NO: 1455628 - RNA, 18 nt, Pseudomonas aeruginosa PA01
ugcggcugcagggccagg

SEQ ID NO: 1455629 - RNA, 16 nt, Pseudomonas aeruginosa PA01
ugcggcggaaggcggc

SEQ ID NO: 1455630 - RNA, 18 nt, Pseudomonas aeruginosa PA01
ugcggcggaaggcggcgu

SEQ ID NO: 1455631 - RNA, 15 nt, Pseudomonas aeruginosa PA01
ugcggcggcaccacg

SEQ ID NO: 1455632 - RNA, 20 nt, Pseudomonas aeruginosa PA01
ugcggcgcggcccguccgcg

SEQ ID NO: 1455633 - RNA, 13 nt, Pseudomonas aeruginosa PA01
ugcgggccucguu

SEQ ID NO: 1455634 - RNA, 13 nt, Pseudomonas aeruginosa PA01
ugcgggaugcccg

SEQ ID NO: 1455635 - RNA, 16 nt, Pseudomonas aeruginosa PA01
ugcgggcaggucgaug

SEQ ID NO: 1455636 - RNA, 17 nt, Pseudomonas aeruginosa PA01
ugcgggcagacaccacc

SEQ ID NO: 1455637 - RNA, 19 nt, Pseudomonas aeruginosa PA01
ugcgggcagacaccaccag

SEQ ID NO: 1455638 - RNA, 15 nt, Pseudomonas aeruginosa PA01
ugccguagcgaugcg

SEQ ID NO: 1455639 - RNA, 15 nt, Pseudomonas aeruginosa PA01
ugccgugaucaccug

SEQ ID NO: 1455640 - RNA, 13 nt, Pseudomonas aeruginosa PA01
ugccguccagccg

SEQ ID NO: 1455641 - RNA, 16 nt, Pseudomonas aeruginosa PA01
ugccguccagccggcg

SEQ ID NO: 1455642 - RNA, 15 nt, Pseudomonas aeruginosa PA01
ugccguggaccaaca

SEQ ID NO: 1455643 - RNA, 22 nt, Pseudomonas aeruginosa PA01
ugccguggaccaacagccggcg

SEQ ID NO: 1455644 - RNA, 18 nt, Pseudomonas aeruginosa PA01
ugccgugggucgccucga

SEQ ID NO: 1455645 - RNA, 17 nt, Pseudomonas aeruginosa PA01
ugccguggcggcgcgcg

SEQ ID NO: 1455646 - RNA, 13 nt, Pseudomonas aeruginosa PA01
ugccgugccgugg

SEQ ID NO: 1455647 - RNA, 16 nt, Pseudomonas aeruginosa PA01
ugccguuccagcggca

SEQ ID NO: 1455648 - RNA, 17 nt, Pseudomonas aeruginosa PA01
ugccguuccagcggcac

SEQ ID NO: 1455649 - RNA, 17 nt, Pseudomonas aeruginosa PA01
ugccguucaggccggcg

SEQ ID NO: 1455650 - RNA, 23 nt, Pseudomonas aeruginosa PA01
ugccguucaggccggcgccgccg

SEQ ID NO: 1455651 - RNA, 17 nt, Pseudomonas aeruginosa PA01
ugccguucaggcgcgga

SEQ ID NO: 1455652 - RNA, 21 nt, Pseudomonas aeruginosa PA01
ugccguagugguugcgcacgc

SEQ ID NO: 1455653 - RNA, 15 nt, Pseudomonas aeruginosa PA01
ugccguacaggucgg

SEQ ID NO: 1455654 - RNA, 17 nt, Pseudomonas aeruginosa PA01
ugccguacaggucggcg

SEQ ID NO: 1455655 - RNA, 21 nt, Pseudomonas aeruginosa PA01
ugccguacucauggccgcagc

SEQ ID NO: 1455656 - RNA, 20 nt, Pseudomonas aeruginosa PA01
ugccguacuucagggugacg

SEQ ID NO: 1455657 - RNA, 16 nt, Pseudomonas aeruginosa PA01
ugccgcgucggcucgg

SEQ ID NO: 1455658 - RNA, 22 nt, Pseudomonas aeruginosa PA01
ugccguacagcccccgccggcc

SEQ ID NO: 1455659 - RNA, 20 nt, Pseudomonas aeruginosa PA01
ugccgcggcgauaggcgcgc

SEQ ID NO: 1455660 - RNA, 19 nt, Pseudomonas aeruginosa PA01
ugccgcggaagugcgccgg

SEQ ID NO: 1455661 - RNA, 18 nt, Pseudomonas aeruginosa PA01
ugccgcggaauggcgcgc

SEQ ID NO: 1455662 - RNA, 20 nt, Pseudomonas aeruginosa PA01
ugccgcggaauggcgcgcaa

SEQ ID NO: 1455663 - RNA, 19 nt, Pseudomonas aeruginosa PA01
ugccgcgguaggucagcgg

SEQ ID NO: 1455664 - RNA, 14 nt, Pseudomonas aeruginosa PA01
ugccuucaccggcg

SEQ ID NO: 1455665 - RNA, 15 nt, Pseudomonas aeruginosa PA01
ugccuucaccggcgg

SEQ ID NO: 1455666 - RNA, 16 nt, Pseudomonas aeruginosa PA01
ugccuucaccggcgga

SEQ ID NO: 1455667 - RNA, 18 nt, Pseudomonas aeruginosa PA01
ugccuuccagcaggucga

SEQ ID NO: 1455668 - RNA, 15 nt, Pseudomonas aeruginosa PA01
ugccguuggccgagc

SEQ ID NO: 1455669 - RNA, 21 nt, Pseudomonas aeruginosa PA01
ugccguuggccgagcgcgagu

SEQ ID NO: 1455670 - RNA, 17 nt, Pseudomonas aeruginosa PA01
ugccguugggccagggc

SEQ ID NO: 1455671 - RNA, 17 nt, Pseudomonas aeruginosa PA01
ugccguucgucaccggc

SEQ ID NO: 1455672 - RNA, 15 nt, Pseudomonas aeruginosa PA01
ugccguucgcccgcg

SEQ ID NO: 1455673 - RNA, 23 nt, Pseudomonas aeruginosa PA01
ugccguucgcccgcggcggcgac

SEQ ID NO: 1455674 - RNA, 23 nt, Pseudomonas aeruginosa PA01
ugccguugcacgaaaacgaggua

SEQ ID NO: 1455675 - RNA, 20 nt, Pseudomonas aeruginosa PA01
ugcgaaccgagacccuggcg

SEQ ID NO: 1455676 - RNA, 22 nt, Pseudomonas aeruginosa PA01
ugcgaaaacggcgacccugggg

SEQ ID NO: 1455677 - RNA, 21 nt, Pseudomonas aeruginosa PA01
ugcgaacacaccgaccgcgag

SEQ ID NO: 1455678 - RNA, 22 nt, Pseudomonas aeruginosa PA01
ugcgaacacaccgaccgcgagu

SEQ ID NO: 1455679 - RNA, 13 nt, Pseudomonas aeruginosa PA01
ugccuugcagcgc

SEQ ID NO: 1455680 - RNA, 24 nt, Pseudomonas aeruginosa PA01
ugccuucguaggugaagcccaggc

SEQ ID NO: 1455681 - RNA, 22 nt, Pseudomonas aeruginosa PA01
ugccuucgucgcuggggugcag

SEQ ID NO: 1455682 - RNA, 12 nt, Pseudomonas aeruginosa PA01
ugccuucggcgg

SEQ ID NO: 1455683 - RNA, 12 nt, Pseudomonas aeruginosa PA01
ugccuucgaagc

SEQ ID NO: 1455684 - RNA, 14 nt, Pseudomonas aeruginosa PA01
ugcgccagaccagc

SEQ ID NO: 1455685 - RNA, 18 nt, Pseudomonas aeruginosa PA01
ugcgccagagcaggcgga

SEQ ID NO: 1455686 - RNA, 20 nt, Pseudomonas aeruginosa PA01
ugcgccagagcaggcggauc

SEQ ID NO: 1455687 - RNA, 20 nt, Pseudomonas aeruginosa PA01
ugcgccagcaucgcaucggc

SEQ ID NO: 1455688 - RNA, 21 nt, Pseudomonas aeruginosa PA01
ugcgccagcaucgcaucggcg

SEQ ID NO: 1455689 - RNA, 20 nt, Pseudomonas aeruginosa PA01
ugcgcccagggacgcgccgg

SEQ ID NO: 1455690 - RNA, 21 nt, Pseudomonas aeruginosa PA01
ugcgcccagggacgcgccggc

SEQ ID NO: 1455691 - RNA, 17 nt, Pseudomonas aeruginosa PA01
ugcgcccagcagcaggc

SEQ ID NO: 1455692 - RNA, 22 nt, Pseudomonas aeruginosa PA01
ugcgccaugccguucaggccgg

SEQ ID NO: 1455693 - RNA, 18 nt, Pseudomonas aeruginosa PA01
ugcgccaugcgcccgcug

SEQ ID NO: 1455694 - RNA, 19 nt, Pseudomonas aeruginosa PA01
ugcgcacggucuccgggga

SEQ ID NO: 1455695 - RNA, 20 nt, Pseudomonas aeruginosa PA01
ugcgcacggucuccggggag

SEQ ID NO: 1455696 - RNA, 11 nt, Pseudomonas aeruginosa PA01
ugcgcagcagc

SEQ ID NO: 1455697 - RNA, 23 nt, Pseudomonas aeruginosa PA01
ugcgcagaugcggggcgaccagc

SEQ ID NO: 1455698 - RNA, 20 nt, Pseudomonas aeruginosa PA01
ugcgcagcaacgcgacgauc

SEQ ID NO: 1455699 - RNA, 22 nt, Pseudomonas aeruginosa PA01
ugcgcagcaacuggucgccgca

SEQ ID NO: 1455700 - RNA, 21 nt, Pseudomonas aeruginosa PA01
ugcgcagcaucuucucggcga

SEQ ID NO: 1455701 - RNA, 14 nt, Pseudomonas aeruginosa PA01
ugcgcagccacccg

SEQ ID NO: 1455702 - RNA, 20 nt, Pseudomonas aeruginosa PA01
ugcgcagccacccgcucgac

SEQ ID NO: 1455703 - RNA, 14 nt, Pseudomonas aeruginosa PA01
ugcgcauuguucgg

SEQ ID NO: 1455704 - RNA, 21 nt, Pseudomonas aeruginosa PA01
ugcgcauuuucauugccucga

SEQ ID NO: 1455705 - RNA, 19 nt, Pseudomonas aeruginosa PA01
ugcgcauuuugccggagau

SEQ ID NO: 1455706 - RNA, 20 nt, Pseudomonas aeruginosa PA01
ugcgcaugucguccaggcug

SEQ ID NO: 1455707 - RNA, 13 nt, Pseudomonas aeruginosa PA01
ugcgcagcgcggg

SEQ ID NO: 1455708 - RNA, 16 nt, Pseudomonas aeruginosa PA01
ugcgcagcgcgggggc

SEQ ID NO: 1455709 - RNA, 17 nt, Pseudomonas aeruginosa PA01
ugcgagccgacuuccag

SEQ ID NO: 1455710 - RNA, 22 nt, Pseudomonas aeruginosa PA01
ugcgagcgcuucauccugcgcg

SEQ ID NO: 1455711 - RNA, 23 nt, Pseudomonas aeruginosa PA01
ugcgagggauguuccaggcccgc

SEQ ID NO: 1455712 - RNA, 15 nt, Pseudomonas aeruginosa PA01
ugcgaggcggugcag

SEQ ID NO: 1455713 - RNA, 19 nt, Pseudomonas aeruginosa PA01
ugcgaggcccguauggcgg

SEQ ID NO: 1455714 - RNA, 20 nt, Pseudomonas aeruginosa PA01
ugcgagucggcgacgaugcc

SEQ ID NO: 1455715 - RNA, 20 nt, Pseudomonas aeruginosa PA01
ugcgauagaccaggaaggcc

SEQ ID NO: 1455716 - RNA, 20 nt, Pseudomonas aeruginosa PA01
ugcgaucagggccucgccac

SEQ ID NO: 1455717 - RNA, 21 nt, Pseudomonas aeruginosa PA01
ugcgcaacgggacgccaggcg

SEQ ID NO: 1455718 - RNA, 15 nt, Pseudomonas aeruginosa PA01
ugcgcaaggaacugg

SEQ ID NO: 1455719 - RNA, 15 nt, Pseudomonas aeruginosa PA01
ugcgcaccaggucgc

SEQ ID NO: 1455720 - RNA, 16 nt, Pseudomonas aeruginosa PA01
ugcgcaccucgcccuu

SEQ ID NO: 1455721 - RNA, 19 nt, Pseudomonas aeruginosa PA01
ugcgcaccucggccaggcg

SEQ ID NO: 1455722 - RNA, 15 nt, Pseudomonas aeruginosa PA01
ugcgcaccgcgccgg

SEQ ID NO: 1455723 - RNA, 17 nt, Pseudomonas aeruginosa PA01
ugcgcaccgcgccggga

SEQ ID NO: 1455724 - RNA, 22 nt, Pseudomonas aeruginosa PA01
ugcgcacgcaauagugcagcuc

SEQ ID NO: 1455725 - RNA, 14 nt, Pseudomonas aeruginosa PA01
ugcuuggccaggcg

SEQ ID NO: 1455726 - RNA, 14 nt, Pseudomonas aeruginosa PA01
ugcuuggcgaggcg

SEQ ID NO: 1455727 - RNA, 13 nt, Pseudomonas aeruginosa PA01
ugcuuggcggcgg

SEQ ID NO: 1455728 - RNA, 14 nt, Pseudomonas aeruginosa PA01
ugcuuggcggcggu

SEQ ID NO: 1455729 - RNA, 17 nt, Pseudomonas aeruginosa PA01
ugcuugcgcuggccggc

SEQ ID NO: 1455730 - RNA, 15 nt, Pseudomonas aeruginosa PA01
ugcuuguguccgccg

SEQ ID NO: 1455731 - RNA, 16 nt, Pseudomonas aeruginosa PA01
ugcuuguguccgccga

SEQ ID NO: 1455732 - RNA, 17 nt, Pseudomonas aeruginosa PA01
ugcuugcgcgcggcguc

SEQ ID NO: 1455733 - RNA, 15 nt, Pseudomonas aeruginosa PA01
ugcuugccggcgccu

SEQ ID NO: 1455734 - RNA, 15 nt, Pseudomonas aeruginosa PA01
ugcuugacgaaggcg

SEQ ID NO: 1455735 - RNA, 16 nt, Pseudomonas aeruginosa PA01
ugcuugacgaaggcgg

SEQ ID NO: 1455736 - RNA, 17 nt, Pseudomonas aeruginosa PA01
ugcuugacgaaggcggc

SEQ ID NO: 1455737 - RNA, 20 nt, Pseudomonas aeruginosa PA01
ugcuugacgaaggcggcagc

SEQ ID NO: 1455738 - RNA, 16 nt, Pseudomonas aeruginosa PA01
ugcuugaucgccagcc

SEQ ID NO: 1455739 - RNA, 12 nt, Pseudomonas aeruginosa PA01
ugcuguuguugc

SEQ ID NO: 1455740 - RNA, 14 nt, Pseudomonas aeruginosa PA01
ugcuguuccucguc

SEQ ID NO: 1455741 - RNA, 14 nt, Pseudomonas aeruginosa PA01
ugcuguguccggcg

SEQ ID NO: 1455742 - RNA, 15 nt, Pseudomonas aeruginosa PA01
ugcuguguccggcgg

SEQ ID NO: 1455743 - RNA, 21 nt, Pseudomonas aeruginosa PA01
ugcuguucagcgggugccgaa

SEQ ID NO: 1455744 - RNA, 20 nt, Pseudomonas aeruginosa PA01
ugcuuaccuugccggugcgg

SEQ ID NO: 1455745 - RNA, 18 nt, Pseudomonas aeruginosa PA01
ugcuucagcccggcacca

SEQ ID NO: 1455746 - RNA, 13 nt, Pseudomonas aeruginosa PA01
ugcuucaggcgcg

SEQ ID NO: 1455747 - RNA, 21 nt, Pseudomonas aeruginosa PA01
ugcuucgaacgugcgcgcaac

SEQ ID NO: 1455748 - RNA, 12 nt, Pseudomonas aeruginosa PA01
ugcuggcgcagc

SEQ ID NO: 1455749 - RNA, 15 nt, Pseudomonas aeruginosa PA01
ugcugguagagccgg

SEQ ID NO: 1455750 - RNA, 19 nt, Pseudomonas aeruginosa PA01
ugcugguagcugcugccgg

SEQ ID NO: 1455751 - RNA, 20 nt, Pseudomonas aeruginosa PA01
ugcugggacgccuuguucac

SEQ ID NO: 1455752 - RNA, 22 nt, Pseudomonas aeruginosa PA01
ugcuggcuguaggugcccggcg

SEQ ID NO: 1455753 - RNA, 15 nt, Pseudomonas aeruginosa PA01
ugcugggucuccgcu

SEQ ID NO: 1455754 - RNA, 13 nt, Pseudomonas aeruginosa PA01
ugcugggcggcga

SEQ ID NO: 1455755 - RNA, 20 nt, Pseudomonas aeruginosa PA01
ugcugggcggcgaggccgac

SEQ ID NO: 1455756 - RNA, 20 nt, Pseudomonas aeruginosa PA01
ugcugggcgucgaacaccgg

SEQ ID NO: 1455757 - RNA, 23 nt, Pseudomonas aeruginosa PA01
ugcuggggaacugggcgagcauc

SEQ ID NO: 1455758 - RNA, 19 nt, Pseudomonas aeruginosa PA01
ugcugguugaagccgaucg

SEQ ID NO: 1455759 - RNA, 15 nt, Pseudomonas aeruginosa PA01
ugcuggugcggccga

SEQ ID NO: 1455760 - RNA, 16 nt, Pseudomonas aeruginosa PA01
ugcuggugcggccgau

SEQ ID NO: 1455761 - RNA, 21 nt, Pseudomonas aeruginosa PA01
ugcuguaguugacgucgccga

SEQ ID NO: 1455762 - RNA, 17 nt, Pseudomonas aeruginosa PA01
ugcugguggcccugggc

SEQ ID NO: 1455763 - RNA, 17 nt, Pseudomonas aeruginosa PA01
ugcugucagcgcccggc

SEQ ID NO: 1455764 - RNA, 18 nt, Pseudomonas aeruginosa PA01
ugcugugcugcaccagca

SEQ ID NO: 1455765 - RNA, 22 nt, Pseudomonas aeruginosa PA01
ugcuggccacccuugcgcccgg

SEQ ID NO: 1455766 - RNA, 23 nt, Pseudomonas aeruginosa PA01
ugcuggccacccuugcguccugc

SEQ ID NO: 1455767 - RNA, 14 nt, Pseudomonas aeruginosa PA01
ugcuggccaccgcg

SEQ ID NO: 1455768 - RNA, 18 nt, Pseudomonas aeruginosa PA01
ugcuggccaccgcggcgu

SEQ ID NO: 1455769 - RNA, 14 nt, Pseudomonas aeruginosa PA01
ugcuggauggggcu

SEQ ID NO: 1455770 - RNA, 16 nt, Pseudomonas aeruginosa PA01
ugcuggauccucgccu

SEQ ID NO: 1455771 - RNA, 17 nt, Pseudomonas aeruginosa PA01
ugcuggccgcgcaggaa

SEQ ID NO: 1455772 - RNA, 12 nt, Pseudomonas aeruginosa PA01
ugcuggccgcgc

SEQ ID NO: 1455773 - RNA, 13 nt, Pseudomonas aeruginosa PA01
ugcuggccgcgca

SEQ ID NO: 1455774 - RNA, 23 nt, Pseudomonas aeruginosa PA01
ugcuggcgaauuuccugcuggcg

SEQ ID NO: 1455775 - RNA, 15 nt, Pseudomonas aeruginosa PA01
ugcuggcgaucaucg

SEQ ID NO: 1455776 - RNA, 17 nt, Pseudomonas aeruginosa PA01
ugcuggcgaucaucgcg

SEQ ID NO: 1455777 - RNA, 16 nt, Pseudomonas aeruginosa PA01
ugcuggcgcagccagg

SEQ ID NO: 1455778 - RNA, 14 nt, Pseudomonas aeruginosa PA01
ugcuggcgccgcug

SEQ ID NO: 1455779 - RNA, 14 nt, Pseudomonas aeruginosa PA01
ugcuggcgcgaucc

SEQ ID NO: 1455780 - RNA, 23 nt, Pseudomonas aeruginosa PA01
ugcuggcgcucucgaacaccagg

SEQ ID NO: 1455781 - RNA, 22 nt, Pseudomonas aeruginosa PA01
ugcuggcggauguaguccagcg

SEQ ID NO: 1455782 - RNA, 23 nt, Pseudomonas aeruginosa PA01
ugcugccgaugcugaucacccgc

SEQ ID NO: 1455783 - RNA, 15 nt, Pseudomonas aeruginosa PA01
ugcugccauggcggc

SEQ ID NO: 1455784 - RNA, 13 nt, Pseudomonas aeruginosa PA01
ugcugcccuggcg

SEQ ID NO: 1455785 - RNA, 18 nt, Pseudomonas aeruginosa PA01
ugcugcagguggcguugc

SEQ ID NO: 1455786 - RNA, 22 nt, Pseudomonas aeruginosa PA01
ugcugcaaccgauauggcuggc

SEQ ID NO: 1455787 - RNA, 18 nt, Pseudomonas aeruginosa PA01
ugcugcacggagugggcc

SEQ ID NO: 1455788 - RNA, 13 nt, Pseudomonas aeruginosa PA01
ugcugcaccagca

SEQ ID NO: 1455789 - RNA, 14 nt, Pseudomonas aeruginosa PA01
ugcugcaccagcag

SEQ ID NO: 1455790 - RNA, 15 nt, Pseudomonas aeruginosa PA01
ugcugcaccagcagg

SEQ ID NO: 1455791 - RNA, 14 nt, Pseudomonas aeruginosa PA01
ugcugcgcgcacca

SEQ ID NO: 1455792 - RNA, 15 nt, Pseudomonas aeruginosa PA01
ugcugcgcgcggccc

SEQ ID NO: 1455793 - RNA, 12 nt, Pseudomonas aeruginosa PA01
ugcugcggcaac

SEQ ID NO: 1455794 - RNA, 23 nt, Pseudomonas aeruginosa PA01
ugcugcgcguguacccccaccgg

SEQ ID NO: 1455795 - RNA, 17 nt, Pseudomonas aeruginosa PA01
ugcugcgggcgccgccg

SEQ ID NO: 1455796 - RNA, 15 nt, Pseudomonas aeruginosa PA01
ugcugcugcggcuuc

SEQ ID NO: 1455797 - RNA, 22 nt, Pseudomonas aeruginosa PA01
ugcugcucggcauucgacccgc

SEQ ID NO: 1455798 - RNA, 24 nt, Pseudomonas aeruginosa PA01
ugcugcuccaucaguugcgcgcgg

SEQ ID NO: 1455799 - RNA, 18 nt, Pseudomonas aeruginosa PA01
ugcugcucgaccgccugc

SEQ ID NO: 1455800 - RNA, 15 nt, Pseudomonas aeruginosa PA01
ugcugcucgcagagg

SEQ ID NO: 1455801 - RNA, 14 nt, Pseudomonas aeruginosa PA01
ugcuggacggcgga

SEQ ID NO: 1455802 - RNA, 15 nt, Pseudomonas aeruginosa PA01
ugcuggacggcggac

SEQ ID NO: 1455803 - RNA, 15 nt, Pseudomonas aeruginosa PA01
ugcuggacucgcgcc

SEQ ID NO: 1455804 - RNA, 14 nt, Pseudomonas aeruginosa PA01
ugcugcuugcgccg

SEQ ID NO: 1455805 - RNA, 14 nt, Pseudomonas aeruginosa PA01
ugcugcuugcgcgc

SEQ ID NO: 1455806 - RNA, 19 nt, Pseudomonas aeruginosa PA01
ugcucggggaacacgcgcu

SEQ ID NO: 1455807 - RNA, 16 nt, Pseudomonas aeruginosa PA01
ugcucgggcgucuccu

SEQ ID NO: 1455808 - RNA, 23 nt, Pseudomonas aeruginosa PA01
ugcucggcgaucucgcccagggc

SEQ ID NO: 1455809 - RNA, 22 nt, Pseudomonas aeruginosa PA01
ugcucggccugcugcgccggca

SEQ ID NO: 1455810 - RNA, 18 nt, Pseudomonas aeruginosa PA01
ugcucggccuuguccgcg

SEQ ID NO: 1455811 - RNA, 15 nt, Pseudomonas aeruginosa PA01
ugcucggcucgcggu

SEQ ID NO: 1455812 - RNA, 21 nt, Pseudomonas aeruginosa PA01
ugcucggggucgucgcuggcg

SEQ ID NO: 1455813 - RNA, 16 nt, Pseudomonas aeruginosa PA01
ugcucguccaggccgc

SEQ ID NO: 1455814 - RNA, 23 nt, Pseudomonas aeruginosa PA01
ugcucgugcagguagccgcgccg

SEQ ID NO: 1455815 - RNA, 18 nt, Pseudomonas aeruginosa PA01
ugcucgucgaugcugccg

SEQ ID NO: 1455816 - RNA, 16 nt, Pseudomonas aeruginosa PA01
ugcugacggcguggcg

SEQ ID NO: 1455817 - RNA, 22 nt, Pseudomonas aeruginosa PA01
ugcugaguuucacgucgagcac

SEQ ID NO: 1455818 - RNA, 17 nt, Pseudomonas aeruginosa PA01
ugcugagcagucgccug

SEQ ID NO: 1455819 - RNA, 14 nt, Pseudomonas aeruginosa PA01
ugcugacguugagg

SEQ ID NO: 1455820 - RNA, 22 nt, Pseudomonas aeruginosa PA01
ugcugaaagcgauagccggggc

SEQ ID NO: 1455821 - RNA, 20 nt, Pseudomonas aeruginosa PA01
ugcgugcguugcgcggcagg

SEQ ID NO: 1455822 - RNA, 15 nt, Pseudomonas aeruginosa PA01
ugcguggguccacgc

SEQ ID NO: 1455823 - RNA, 16 nt, Pseudomonas aeruginosa PA01
ugcguggaaccgcggc

SEQ ID NO: 1455824 - RNA, 18 nt, Pseudomonas aeruginosa PA01
ugcguggugcauccgccg

SEQ ID NO: 1455825 - RNA, 19 nt, Pseudomonas aeruginosa PA01
ugcguggugcauccgccgc

SEQ ID NO: 1455826 - RNA, 16 nt, Pseudomonas aeruginosa PA01
ugcguuccagggcgaa

SEQ ID NO: 1455827 - RNA, 16 nt, Pseudomonas aeruginosa PA01
ugcguugcucgcacca

SEQ ID NO: 1455828 - RNA, 14 nt, Pseudomonas aeruginosa PA01
ugcguuucgccggg

SEQ ID NO: 1455829 - RNA, 16 nt, Pseudomonas aeruginosa PA01
ugcguuucgccgggca

SEQ ID NO: 1455830 - RNA, 12 nt, Pseudomonas aeruginosa PA01
ugcgucgcacca

SEQ ID NO: 1455831 - RNA, 14 nt, Pseudomonas aeruginosa PA01
ugcgucgcaccagg

SEQ ID NO: 1455832 - RNA, 20 nt, Pseudomonas aeruginosa PA01
ugcgucgcauccaccagcgg

SEQ ID NO: 1455833 - RNA, 19 nt, Pseudomonas aeruginosa PA01
ugcgucuucgccgaugcgc

SEQ ID NO: 1455834 - RNA, 14 nt, Pseudomonas aeruginosa PA01
ugcgugccagcacc

SEQ ID NO: 1455835 - RNA, 23 nt, Pseudomonas aeruginosa PA01
ugcgugcgauucagaugcgguag

SEQ ID NO: 1455836 - RNA, 20 nt, Pseudomonas aeruginosa PA01
ugcgguugccggagacgaug

SEQ ID NO: 1455837 - RNA, 23 nt, Pseudomonas aeruginosa PA01
ugcgguuguugaugcccaccaac

SEQ ID NO: 1455838 - RNA, 14 nt, Pseudomonas aeruginosa PA01
ugcguaccagcgcg

SEQ ID NO: 1455839 - RNA, 17 nt, Pseudomonas aeruginosa PA01
ugcguacuuggcccggc

SEQ ID NO: 1455840 - RNA, 14 nt, Pseudomonas aeruginosa PA01
ugcgucagcgaggc

SEQ ID NO: 1455841 - RNA, 21 nt, Pseudomonas aeruginosa PA01
ugcguagggcggauaacgcca

SEQ ID NO: 1455842 - RNA, 19 nt, Pseudomonas aeruginosa PA01
ugcggucgauguccugggc

SEQ ID NO: 1455843 - RNA, 14 nt, Pseudomonas aeruginosa PA01
ugcgguccggcgaa

SEQ ID NO: 1455844 - RNA, 16 nt, Pseudomonas aeruginosa PA01
ugcgguccagcgagcg

SEQ ID NO: 1455845 - RNA, 21 nt, Pseudomonas aeruginosa PA01
ugcggucauccgccggcgcgu

SEQ ID NO: 1455846 - RNA, 22 nt, Pseudomonas aeruginosa PA01
ugcggucauccgccggcgcgua

SEQ ID NO: 1455847 - RNA, 14 nt, Pseudomonas aeruginosa PA01
ugcggucgcgcccg

SEQ ID NO: 1455848 - RNA, 23 nt, Pseudomonas aeruginosa PA01
ugcgguuauccgccgccgggcuu

SEQ ID NO: 1455849 - RNA, 15 nt, Pseudomonas aeruginosa PA01
ugcgguuccuggcug

SEQ ID NO: 1455850 - RNA, 18 nt, Pseudomonas aeruginosa PA01
ugcuccugcaggcccugc

SEQ ID NO: 1455851 - RNA, 22 nt, Pseudomonas aeruginosa PA01
ugcuccuuucggaacagcgccu

SEQ ID NO: 1455852 - RNA, 15 nt, Pseudomonas aeruginosa PA01
ugcucgaacggcgga

SEQ ID NO: 1455853 - RNA, 22 nt, Pseudomonas aeruginosa PA01
ugcucgaauaaaaaaccggcca

SEQ ID NO: 1455854 - RNA, 16 nt, Pseudomonas aeruginosa PA01
ugcucgacggcaccag

SEQ ID NO: 1455855 - RNA, 12 nt, Pseudomonas aeruginosa PA01
ugcucgacccgg

SEQ ID NO: 1455856 - RNA, 23 nt, Pseudomonas aeruginosa PA01
ugcucgaccgccugcucgcggcu

SEQ ID NO: 1455857 - RNA, 23 nt, Pseudomonas aeruginosa PA01
ugcucgaccaccucggcgucggc

SEQ ID NO: 1455858 - RNA, 21 nt, Pseudomonas aeruginosa PA01
ugcuccucgccguacagcagg

SEQ ID NO: 1455859 - RNA, 17 nt, Pseudomonas aeruginosa PA01
ugcuccugcggcuggcg

SEQ ID NO: 1455860 - RNA, 12 nt, Pseudomonas aeruginosa PA01
ugcucccgagca

SEQ ID NO: 1455861 - RNA, 14 nt, Pseudomonas aeruginosa PA01
ugcuccagggagcg

SEQ ID NO: 1455862 - RNA, 20 nt, Pseudomonas aeruginosa PA01
ugcuccucgucguacuggcg

SEQ ID NO: 1455863 - RNA, 15 nt, Pseudomonas aeruginosa PA01
ugcuccgugucggcg

SEQ ID NO: 1455864 - RNA, 16 nt, Pseudomonas aeruginosa PA01
ugcuccgugucggcgg

SEQ ID NO: 1455865 - RNA, 16 nt, Pseudomonas aeruginosa PA01
ugcuccggggcgcugu

SEQ ID NO: 1455866 - RNA, 15 nt, Pseudomonas aeruginosa PA01
ugcucgaugccaucg

SEQ ID NO: 1455867 - RNA, 12 nt, Pseudomonas aeruginosa PA01
ugcucgauggcg

SEQ ID NO: 1455868 - RNA, 13 nt, Pseudomonas aeruginosa PA01
ugcucgauggcga

SEQ ID NO: 1455869 - RNA, 21 nt, Pseudomonas aeruginosa PA01
ugcucgauggcgaagcgcuug

SEQ ID NO: 1455870 - RNA, 21 nt, Pseudomonas aeruginosa PA01
ugcucgagccguuccaggcgg

SEQ ID NO: 1455871 - RNA, 13 nt, Pseudomonas aeruginosa PA01
ugcucgcaccagg

SEQ ID NO: 1455872 - RNA, 14 nt, Pseudomonas aeruginosa PA01
ugcucgccggcgcg

SEQ ID NO: 1455873 - RNA, 16 nt, Pseudomonas aeruginosa PA01
ugcucgccggcgcggg

SEQ ID NO: 1455874 - RNA, 23 nt, Pseudomonas aeruginosa PA01
ugcucgccggcgcgggcggccuc

SEQ ID NO: 1455875 - RNA, 15 nt, Pseudomonas aeruginosa PA01
ugcucgccgcugaag

SEQ ID NO: 1455876 - RNA, 12 nt, Pseudomonas aeruginosa PA01
ugcucgccggcg

SEQ ID NO: 1455877 - RNA, 19 nt, Pseudomonas aeruginosa PA01
ugcucggaaaccucgccgg

SEQ ID NO: 1455878 - RNA, 12 nt, Pseudomonas aeruginosa PA01
ugcucgcggcgu

SEQ ID NO: 1455879 - RNA, 16 nt, Pseudomonas aeruginosa PA01
ugcucgcggcuggccg

SEQ ID NO: 1455880 - RNA, 14 nt, Pseudomonas aeruginosa PA01
ugcucggccagcgc

SEQ ID NO: 1455881 - RNA, 19 nt, Pseudomonas aeruginosa PA01
ugcucggccagcgccacgg

SEQ ID NO: 1455882 - RNA, 11 nt, Pseudomonas aeruginosa PA01
ugcucggccag

SEQ ID NO: 1455883 - RNA, 22 nt, Pseudomonas aeruginosa PA01
ugcucgcgcaugaucgccucgg

SEQ ID NO: 1455884 - RNA, 13 nt, Pseudomonas aeruginosa PA01
ugcucgcgcaccg

SEQ ID NO: 1455885 - RNA, 17 nt, Pseudomonas aeruginosa PA01
ugcucgcgcaccgcggc

SEQ ID NO: 1455886 - RNA, 18 nt, Pseudomonas aeruginosa PA01
ugcucgcgcaccgcggcc

SEQ ID NO: 1455887 - RNA, 16 nt, Pseudomonas aeruginosa PA01
ugcucgcgcagccagg

SEQ ID NO: 1455888 - RNA, 15 nt, Pseudomonas aeruginosa PA01
ugcucgccguccgcg

SEQ ID NO: 1455889 - RNA, 19 nt, Pseudomonas aeruginosa PA01
ugcucgccugguaggcggc

SEQ ID NO: 1455890 - RNA, 21 nt, Pseudomonas aeruginosa PA01
ugcucgccugguaggcggcga

SEQ ID NO: 1455891 - RNA, 18 nt, Pseudomonas aeruginosa PA01
ugcucagcacggcgacgg

SEQ ID NO: 1455892 - RNA, 19 nt, Pseudomonas aeruginosa PA01
ugcucagcacggcgacggu

SEQ ID NO: 1455893 - RNA, 20 nt, Pseudomonas aeruginosa PA01
ugcucagcacggcgacggug

SEQ ID NO: 1455894 - RNA, 15 nt, Pseudomonas aeruginosa PA01
ugcucagccgcgccg

SEQ ID NO: 1455895 - RNA, 16 nt, Pseudomonas aeruginosa PA01
ugcucagccgcgccgg

SEQ ID NO: 1455896 - RNA, 18 nt, Pseudomonas aeruginosa PA01
ugcucagccgcgccgggg

SEQ ID NO: 1455897 - RNA, 14 nt, Pseudomonas aeruginosa PA01
ugcucagcggccca

SEQ ID NO: 1455898 - RNA, 19 nt, Pseudomonas aeruginosa PA01
ugcucagcggcccagcgcc

SEQ ID NO: 1455899 - RNA, 20 nt, Pseudomonas aeruginosa PA01
ugcucaggacguccuggccg

SEQ ID NO: 1455900 - RNA, 13 nt, Pseudomonas aeruginosa PA01
ugcucagcgccgg

SEQ ID NO: 1455901 - RNA, 18 nt, Pseudomonas aeruginosa PA01
ugcucaggcgcugcuggu

SEQ ID NO: 1455902 - RNA, 13 nt, Pseudomonas aeruginosa PA01
ugcucaggcggcc

SEQ ID NO: 1455903 - RNA, 15 nt, Pseudomonas aeruginosa PA01
ugcucaggcggccga

SEQ ID NO: 1455904 - RNA, 14 nt, Pseudomonas aeruginosa PA01
ugcucagggccgcg

SEQ ID NO: 1455905 - RNA, 16 nt, Pseudomonas aeruginosa PA01
ugcucauguugcgggc

SEQ ID NO: 1455906 - RNA, 20 nt, Pseudomonas aeruginosa PA01
ugcuccagcagggccagcgc

SEQ ID NO: 1455907 - RNA, 22 nt, Pseudomonas aeruginosa PA01
ugcuccagcagggccagcgccu

SEQ ID NO: 1455908 - RNA, 18 nt, Pseudomonas aeruginosa PA01
ugcuccagcaccguggcg

SEQ ID NO: 1455909 - RNA, 23 nt, Pseudomonas aeruginosa PA01
ugcuccagcaccguggcgccauc

SEQ ID NO: 1455910 - RNA, 14 nt, Pseudomonas aeruginosa PA01
ugcuccagcccggc

SEQ ID NO: 1455911 - RNA, 14 nt, Pseudomonas aeruginosa PA01
ugcuaggcuggaag

SEQ ID NO: 1455912 - RNA, 21 nt, Pseudomonas aeruginosa PA01
ugcuaggcuggaagccgcgcu

SEQ ID NO: 1455913 - RNA, 20 nt, Pseudomonas aeruginosa PA01
ucaggacguccuggccgagc

SEQ ID NO: 1455914 - RNA, 22 nt, Pseudomonas aeruginosa PA01
ucaggagggaacgucuggccag

SEQ ID NO: 1455915 - RNA, 23 nt, Pseudomonas aeruginosa PA01
ucaggaguuucaucucggcgcag

SEQ ID NO: 1455916 - RNA, 16 nt, Pseudomonas aeruginosa PA01
ucaggauagccggcgc

SEQ ID NO: 1455917 - RNA, 18 nt, Pseudomonas aeruginosa PA01
ucaggaccuuccgccagc

SEQ ID NO: 1455918 - RNA, 21 nt, Pseudomonas aeruginosa PA01
ucaggacgcuccugcgccggc

SEQ ID NO: 1455919 - RNA, 22 nt, Pseudomonas aeruginosa PA01
ucaggacgcuccugcgccggcu

SEQ ID NO: 1455920 - RNA, 24 nt, Pseudomonas aeruginosa PA01
ucaggacgcuccugcgccggcucg

SEQ ID NO: 1455921 - RNA, 14 nt, Pseudomonas aeruginosa PA01
ucaggaucggcgcc

SEQ ID NO: 1455922 - RNA, 23 nt, Pseudomonas aeruginosa PA01
ucaggaugcgaugcugucagcgc

SEQ ID NO: 1455923 - RNA, 18 nt, Pseudomonas aeruginosa PA01
ucaggauguggccgucgc

SEQ ID NO: 1455924 - RNA, 19 nt, Pseudomonas aeruginosa PA01
ucaggauguggccgucgcg

SEQ ID NO: 1455925 - RNA, 20 nt, Pseudomonas aeruginosa PA01
ucaggauguugacgauggcc

SEQ ID NO: 1455926 - RNA, 22 nt, Pseudomonas aeruginosa PA01
ucaggauguugacgauggccca

SEQ ID NO: 1455927 - RNA, 18 nt, Pseudomonas aeruginosa PA01
ucaggaaauaaccggcgu

SEQ ID NO: 1455928 - RNA, 17 nt, Pseudomonas aeruginosa PA01
ucaggaagguccaggcc

SEQ ID NO: 1455929 - RNA, 19 nt, Pseudomonas aeruginosa PA01
ucaggaaggucucgccgcc

SEQ ID NO: 1455930 - RNA, 14 nt, Pseudomonas aeruginosa PA01
ucaggaacgcgcca

SEQ ID NO: 1455931 - RNA, 14 nt, Pseudomonas aeruginosa PA01
ucagcuucgccgcc

SEQ ID NO: 1455932 - RNA, 16 nt, Pseudomonas aeruginosa PA01
ucagcuucgccgcccu

SEQ ID NO: 1455933 - RNA, 20 nt, Pseudomonas aeruginosa PA01
ucagcuucaggguggcgcug

SEQ ID NO: 1455934 - RNA, 21 nt, Pseudomonas aeruginosa PA01
ucagcuucaggguggcgcugc

SEQ ID NO: 1455935 - RNA, 16 nt, Pseudomonas aeruginosa PA01
ucaggcagcgcgcggc

SEQ ID NO: 1455936 - RNA, 18 nt, Pseudomonas aeruginosa PA01
ucaggcagcgcgcggcca

SEQ ID NO: 1455937 - RNA, 16 nt, Pseudomonas aeruginosa PA01
ucaggaucacaucgcc

SEQ ID NO: 1455938 - RNA, 23 nt, Pseudomonas aeruginosa PA01
ucaggcaguccuugagcgccagc

SEQ ID NO: 1455939 - RNA, 18 nt, Pseudomonas aeruginosa PA01
ucaggcauccccggacca

SEQ ID NO: 1455940 - RNA, 14 nt, Pseudomonas aeruginosa PA01
ucaggcaugcgggc

SEQ ID NO: 1455941 - RNA, 16 nt, Pseudomonas aeruginosa PA01
ucaggccgagcaccgg

SEQ ID NO: 1455942 - RNA, 17 nt, Pseudomonas aeruginosa PA01
ucaggccgagcaccggc

SEQ ID NO: 1455943 - RNA, 18 nt, Pseudomonas aeruginosa PA01
ucaggccgagcaccggca

SEQ ID NO: 1455944 - RNA, 21 nt, Pseudomonas aeruginosa PA01
ucaggccgagcaccggcagga

SEQ ID NO: 1455945 - RNA, 14 nt, Pseudomonas aeruginosa PA01
ucaggccgagcagc

SEQ ID NO: 1455946 - RNA, 16 nt, Pseudomonas aeruginosa PA01
ucaggccgagcagcgc

SEQ ID NO: 1455947 - RNA, 21 nt, Pseudomonas aeruginosa PA01
ucaggccgagcagcgccagcc

SEQ ID NO: 1455948 - RNA, 17 nt, Pseudomonas aeruginosa PA01
ucaggcaccucguccag

SEQ ID NO: 1455949 - RNA, 14 nt, Pseudomonas aeruginosa PA01
ucaggccgaccagc

SEQ ID NO: 1455950 - RNA, 14 nt, Pseudomonas aeruginosa PA01
ucaggccgaggcgc

SEQ ID NO: 1455951 - RNA, 21 nt, Pseudomonas aeruginosa PA01
ucaggccgagggcugccgccc

SEQ ID NO: 1455952 - RNA, 19 nt, Pseudomonas aeruginosa PA01
ucaggccgaguccgcgcgc

SEQ ID NO: 1455953 - RNA, 15 nt, Pseudomonas aeruginosa PA01
ucagcugagucgcuu

SEQ ID NO: 1455954 - RNA, 15 nt, Pseudomonas aeruginosa PA01
ucagcucuuccaggu

SEQ ID NO: 1455955 - RNA, 13 nt, Pseudomonas aeruginosa PA01
ucagcucggcgua

SEQ ID NO: 1455956 - RNA, 19 nt, Pseudomonas aeruginosa PA01
ucagcucggcaucgucgaa

SEQ ID NO: 1455957 - RNA, 16 nt, Pseudomonas aeruginosa PA01
ucagcucggcgaugcc

SEQ ID NO: 1455958 - RNA, 19 nt, Pseudomonas aeruginosa PA01
ucagcucggcgaugccgcc

SEQ ID NO: 1455959 - RNA, 17 nt, Pseudomonas aeruginosa PA01
ucagcuggcgcgccucc

SEQ ID NO: 1455960 - RNA, 17 nt, Pseudomonas aeruginosa PA01
ucagcucgaucagcccg

SEQ ID NO: 1455961 - RNA, 18 nt, Pseudomonas aeruginosa PA01
ucagcucgaucagcccgc

SEQ ID NO: 1455962 - RNA, 19 nt, Pseudomonas aeruginosa PA01
ucagcucgcgguaggccag

SEQ ID NO: 1455963 - RNA, 21 nt, Pseudomonas aeruginosa PA01
ucagcucgcgguaggccagcu

SEQ ID NO: 1455964 - RNA, 13 nt, Pseudomonas aeruginosa PA01
ucagcuccagcag

SEQ ID NO: 1455965 - RNA, 17 nt, Pseudomonas aeruginosa PA01
ucagcuccaggccgcgg

SEQ ID NO: 1455966 - RNA, 23 nt, Pseudomonas aeruginosa PA01
ucagcgggacagcuugccgucca

SEQ ID NO: 1455967 - RNA, 15 nt, Pseudomonas aeruginosa PA01
ucagcgggcgcggua

SEQ ID NO: 1455968 - RNA, 14 nt, Pseudomonas aeruginosa PA01
ucagcgggucgagc

SEQ ID NO: 1455969 - RNA, 17 nt, Pseudomonas aeruginosa PA01
ucagcgggucgagccag

SEQ ID NO: 1455970 - RNA, 18 nt, Pseudomonas aeruginosa PA01
ucagcgggucgagccagg

SEQ ID NO: 1455971 - RNA, 20 nt, Pseudomonas aeruginosa PA01
ucagcggguucuugccgcug

SEQ ID NO: 1455972 - RNA, 22 nt, Pseudomonas aeruginosa PA01
ucagcggguaacccagggugcg

SEQ ID NO: 1455973 - RNA, 22 nt, Pseudomonas aeruginosa PA01
ucagcgguggcguugucggcaa

SEQ ID NO: 1455974 - RNA, 13 nt, Pseudomonas aeruginosa PA01
ucagccagccggc

SEQ ID NO: 1455975 - RNA, 13 nt, Pseudomonas aeruginosa PA01
ucagccagcggcg

SEQ ID NO: 1455976 - RNA, 22 nt, Pseudomonas aeruginosa PA01
ucagccagcggcgcuugcgggc

SEQ ID NO: 1455977 - RNA, 16 nt, Pseudomonas aeruginosa PA01
ucagccacugccgccu

SEQ ID NO: 1455978 - RNA, 17 nt, Pseudomonas aeruginosa PA01
ucagccacugccgccuc

SEQ ID NO: 1455979 - RNA, 18 nt, Pseudomonas aeruginosa PA01
ucagccaccugcucgcug

SEQ ID NO: 1455980 - RNA, 14 nt, Pseudomonas aeruginosa PA01
ucagccagagcccg

SEQ ID NO: 1455981 - RNA, 18 nt, Pseudomonas aeruginosa PA01
ucagccacgggcgccagc

SEQ ID NO: 1455982 - RNA, 19 nt, Pseudomonas aeruginosa PA01
ucagccacgggcgccagcg

SEQ ID NO: 1455983 - RNA, 22 nt, Pseudomonas aeruginosa PA01
ucagcaccagcggaccgucggg

SEQ ID NO: 1455984 - RNA, 20 nt, Pseudomonas aeruginosa PA01
ucagcaccaggaagccccag

SEQ ID NO: 1455985 - RNA, 17 nt, Pseudomonas aeruginosa PA01
ucagcaccagggccagg

SEQ ID NO: 1455986 - RNA, 19 nt, Pseudomonas aeruginosa PA01
ucagcaccagggccagggc

SEQ ID NO: 1455987 - RNA, 23 nt, Pseudomonas aeruginosa PA01
ucagccggcccauccgccgcagg

SEQ ID NO: 1455988 - RNA, 13 nt, Pseudomonas aeruginosa PA01
ucagccggccgau

SEQ ID NO: 1455989 - RNA, 22 nt, Pseudomonas aeruginosa PA01
ucagcgauucccgaggguggcg

SEQ ID NO: 1455990 - RNA, 14 nt, Pseudomonas aeruginosa PA01
ucagcgcaccgccc

SEQ ID NO: 1455991 - RNA, 17 nt, Pseudomonas aeruginosa PA01
ucagcgcaccgcccugc

SEQ ID NO: 1455992 - RNA, 15 nt, Pseudomonas aeruginosa PA01
ucagcccucggcccg

SEQ ID NO: 1455993 - RNA, 16 nt, Pseudomonas aeruginosa PA01
ucagcccuucgcgcuc

SEQ ID NO: 1455994 - RNA, 18 nt, Pseudomonas aeruginosa PA01
ucagccgaugcucgcgcc

SEQ ID NO: 1455995 - RNA, 13 nt, Pseudomonas aeruginosa PA01
ucagcccgucggc

SEQ ID NO: 1455996 - RNA, 14 nt, Pseudomonas aeruginosa PA01
ucagcccgucggcc

SEQ ID NO: 1455997 - RNA, 20 nt, Pseudomonas aeruginosa PA01
ucagcccguguucggccagc

SEQ ID NO: 1455998 - RNA, 14 nt, Pseudomonas aeruginosa PA01
ucagccgcgcgcug

SEQ ID NO: 1455999 - RNA, 14 nt, Pseudomonas aeruginosa PA01
ucagccgcgccggg

SEQ ID NO: 1456000 - RNA, 15 nt, Pseudomonas aeruginosa PA01
ucagccgcgccgggg

SEQ ID NO: 1456001 - RNA, 21 nt, Pseudomonas aeruginosa PA01
ucagccgcgacgacugcggca

SEQ ID NO: 1456002 - RNA, 13 nt, Pseudomonas aeruginosa PA01
ucagccgcgccgg

SEQ ID NO: 1456003 - RNA, 18 nt, Pseudomonas aeruginosa PA01
ucagccgaggucgccgcc

SEQ ID NO: 1456004 - RNA, 16 nt, Pseudomonas aeruginosa PA01
ucagcgcgccccggcg

SEQ ID NO: 1456005 - RNA, 19 nt, Pseudomonas aeruginosa PA01
ucagcgcgccccggcgagc

SEQ ID NO: 1456006 - RNA, 12 nt, Pseudomonas aeruginosa PA01
ucagcgcgccga

SEQ ID NO: 1456007 - RNA, 18 nt, Pseudomonas aeruginosa PA01
ucagcgcgccgagccagg

SEQ ID NO: 1456008 - RNA, 22 nt, Pseudomonas aeruginosa PA01
ucagcgcgccgaguucgccgcg

SEQ ID NO: 1456009 - RNA, 15 nt, Pseudomonas aeruginosa PA01
ucagcgcgccuucga

SEQ ID NO: 1456010 - RNA, 22 nt, Pseudomonas aeruginosa PA01
ucagcgcgcguagcgugccgcc

SEQ ID NO: 1456011 - RNA, 15 nt, Pseudomonas aeruginosa PA01
ucagcgcgcucgcug

SEQ ID NO: 1456012 - RNA, 19 nt, Pseudomonas aeruginosa PA01
ucagcgcggagcguccacc

SEQ ID NO: 1456013 - RNA, 14 nt, Pseudomonas aeruginosa PA01
ucagcgccagcagg

SEQ ID NO: 1456014 - RNA, 20 nt, Pseudomonas aeruginosa PA01
ucagcgccagcaggcgauac

SEQ ID NO: 1456015 - RNA, 14 nt, Pseudomonas aeruginosa PA01
ucagcgccaggccg

SEQ ID NO: 1456016 - RNA, 22 nt, Pseudomonas aeruginosa PA01
ucagcgcccggcugugcucgac

SEQ ID NO: 1456017 - RNA, 14 nt, Pseudomonas aeruginosa PA01
ucagcgcgacaggc

SEQ ID NO: 1456018 - RNA, 17 nt, Pseudomonas aeruginosa PA01
ucagcgcgacaggcugg

SEQ ID NO: 1456019 - RNA, 23 nt, Pseudomonas aeruginosa PA01
ucagcgcgaaggccacgccgacg

SEQ ID NO: 1456020 - RNA, 12 nt, Pseudomonas aeruginosa PA01
ucagcgcgacag

SEQ ID NO: 1456021 - RNA, 18 nt, Pseudomonas aeruginosa PA01
ucagcgccuugaccucga

SEQ ID NO: 1456022 - RNA, 16 nt, Pseudomonas aeruginosa PA01
ucagcgccucggcgca

SEQ ID NO: 1456023 - RNA, 17 nt, Pseudomonas aeruginosa PA01
ucagcgccucggcgcag

SEQ ID NO: 1456024 - RNA, 17 nt, Pseudomonas aeruginosa PA01
ucagcgccgccaggccc

SEQ ID NO: 1456025 - RNA, 15 nt, Pseudomonas aeruginosa PA01
ucagcgccgcucggc

SEQ ID NO: 1456026 - RNA, 16 nt, Pseudomonas aeruginosa PA01
ucagcgccgcucggcg

SEQ ID NO: 1456027 - RNA, 22 nt, Pseudomonas aeruginosa PA01
ucagcgccgcuucuucccgccc

SEQ ID NO: 1456028 - RNA, 12 nt, Pseudomonas aeruginosa PA01
ucagcgccggcc

SEQ ID NO: 1456029 - RNA, 15 nt, Pseudomonas aeruginosa PA01
ucagcgccggccagg

SEQ ID NO: 1456030 - RNA, 14 nt, Pseudomonas aeruginosa PA01
ucagcgccgggucg

SEQ ID NO: 1456031 - RNA, 19 nt, Pseudomonas aeruginosa PA01
ucagcgccguugcggcagc

SEQ ID NO: 1456032 - RNA, 16 nt, Pseudomonas aeruginosa PA01
ucagcgccuccagcac

SEQ ID NO: 1456033 - RNA, 20 nt, Pseudomonas aeruginosa PA01
ucagcgccucgaccucggcc

SEQ ID NO: 1456034 - RNA, 20 nt, Pseudomonas aeruginosa PA01
ucagcgcguucaccccgccc

SEQ ID NO: 1456035 - RNA, 15 nt, Pseudomonas aeruginosa PA01
ucagcgcuuccaggg

SEQ ID NO: 1456036 - RNA, 18 nt, Pseudomonas aeruginosa PA01
ucagcgcuuccuugcccu

SEQ ID NO: 1456037 - RNA, 17 nt, Pseudomonas aeruginosa PA01
ucagcgcuugcuggcgc

SEQ ID NO: 1456038 - RNA, 18 nt, Pseudomonas aeruginosa PA01
ucagcgcuugcuggcgcg

SEQ ID NO: 1456039 - RNA, 18 nt, Pseudomonas aeruginosa PA01
ucagcggacaaccgccgu

SEQ ID NO: 1456040 - RNA, 13 nt, Pseudomonas aeruginosa PA01
ucagcgcuuccag

SEQ ID NO: 1456041 - RNA, 14 nt, Pseudomonas aeruginosa PA01
ucagcggcggugcg

SEQ ID NO: 1456042 - RNA, 20 nt, Pseudomonas aeruginosa PA01
ucagcggcggugcgccggcg

SEQ ID NO: 1456043 - RNA, 21 nt, Pseudomonas aeruginosa PA01
ucagcggcgcgucgaccacga

SEQ ID NO: 1456044 - RNA, 18 nt, Pseudomonas aeruginosa PA01
ucagcggccgagcaggcg

SEQ ID NO: 1456045 - RNA, 21 nt, Pseudomonas aeruginosa PA01
ucagcggccgagcaggcgcgc

SEQ ID NO: 1456046 - RNA, 18 nt, Pseudomonas aeruginosa PA01
ucagcggcccgagcaggc

SEQ ID NO: 1456047 - RNA, 16 nt, Pseudomonas aeruginosa PA01
ucagcaacucuuccag

SEQ ID NO: 1456048 - RNA, 22 nt, Pseudomonas aeruginosa PA01
ucagcaacugccaaccgcgcuc

SEQ ID NO: 1456049 - RNA, 17 nt, Pseudomonas aeruginosa PA01
ucagcaauuccgcagcc

SEQ ID NO: 1456050 - RNA, 16 nt, Pseudomonas aeruginosa PA01
ucagaccacgcccugc

SEQ ID NO: 1456051 - RNA, 22 nt, Pseudomonas aeruginosa PA01
ucagaccacgcccugcgccagc

SEQ ID NO: 1456052 - RNA, 20 nt, Pseudomonas aeruginosa PA01
ucagacacgaaaaagccggc

SEQ ID NO: 1456053 - RNA, 21 nt, Pseudomonas aeruginosa PA01
ucagacacgaaaaagccggcg

SEQ ID NO: 1456054 - RNA, 17 nt, Pseudomonas aeruginosa PA01
ucacuucacgacaggcg

SEQ ID NO: 1456055 - RNA, 14 nt, Pseudomonas aeruginosa PA01
ucacugcgagcacc

SEQ ID NO: 1456056 - RNA, 13 nt, Pseudomonas aeruginosa PA01
ucacgcugcucgc

SEQ ID NO: 1456057 - RNA, 15 nt, Pseudomonas aeruginosa PA01
ucacgcccugccccu

SEQ ID NO: 1456058 - RNA, 13 nt, Pseudomonas aeruginosa PA01
ucacgcaggcuuu

SEQ ID NO: 1456059 - RNA, 22 nt, Pseudomonas aeruginosa PA01
ucacgcaggcuuuccagcccgg

SEQ ID NO: 1456060 - RNA, 16 nt, Pseudomonas aeruginosa PA01
ucacggacccgcucgg

SEQ ID NO: 1456061 - RNA, 16 nt, Pseudomonas aeruginosa PA01
ucacggcauccuggcg

SEQ ID NO: 1456062 - RNA, 12 nt, Pseudomonas aeruginosa PA01
ucacggauaggc

SEQ ID NO: 1456063 - RNA, 15 nt, Pseudomonas aeruginosa PA01
ucacguccggcgaga

SEQ ID NO: 1456064 - RNA, 20 nt, Pseudomonas aeruginosa PA01
ucacguaggagccggccagg

SEQ ID NO: 1456065 - RNA, 22 nt, Pseudomonas aeruginosa PA01
ucacguaggagccggccaggcg

SEQ ID NO: 1456066 - RNA, 20 nt, Pseudomonas aeruginosa PA01
ucacguagcccccgccgcug

SEQ ID NO: 1456067 - RNA, 18 nt, Pseudomonas aeruginosa PA01
ucacguaguugacccgcc

SEQ ID NO: 1456068 - RNA, 14 nt, Pseudomonas aeruginosa PA01
ucacguccagguug

SEQ ID NO: 1456069 - RNA, 19 nt, Pseudomonas aeruginosa PA01
ucacguccuugaccacgac

SEQ ID NO: 1456070 - RNA, 15 nt, Pseudomonas aeruginosa PA01
ucacgucgcgcaccu

SEQ ID NO: 1456071 - RNA, 16 nt, Pseudomonas aeruginosa PA01
ucacgucgcgcaccug

SEQ ID NO: 1456072 - RNA, 17 nt, Pseudomonas aeruginosa PA01
ucacgucguacucggcg

SEQ ID NO: 1456073 - RNA, 13 nt, Pseudomonas aeruginosa PA01
ucaccgcccugcg

SEQ ID NO: 1456074 - RNA, 22 nt, Pseudomonas aeruginosa PA01
ucaccgcucaagacggcccgca

SEQ ID NO: 1456075 - RNA, 15 nt, Pseudomonas aeruginosa PA01
ucaccgcucgccaga

SEQ ID NO: 1456076 - RNA, 16 nt, Pseudomonas aeruginosa PA01
ucaccgccaucagcac

SEQ ID NO: 1456077 - RNA, 15 nt, Pseudomonas aeruginosa PA01
ucaccgccaccccgc

SEQ ID NO: 1456078 - RNA, 20 nt, Pseudomonas aeruginosa PA01
ucaccgccaccccgccggcg

SEQ ID NO: 1456079 - RNA, 17 nt, Pseudomonas aeruginosa PA01
ucaccgccaaggccucg

SEQ ID NO: 1456080 - RNA, 22 nt, Pseudomonas aeruginosa PA01
ucaccgcaucgaaggcgccggc

SEQ ID NO: 1456081 - RNA, 20 nt, Pseudomonas aeruginosa PA01
ucacgcaccucgucgagcag

SEQ ID NO: 1456082 - RNA, 15 nt, Pseudomonas aeruginosa PA01
ucacgauggccggca

SEQ ID NO: 1456083 - RNA, 17 nt, Pseudomonas aeruginosa PA01
ucacgauggccggcagc

SEQ ID NO: 1456084 - RNA, 20 nt, Pseudomonas aeruginosa PA01
ucacgauggccggcagcagc

SEQ ID NO: 1456085 - RNA, 21 nt, Pseudomonas aeruginosa PA01
ucacgaagcggucgccggcgc

SEQ ID NO: 1456086 - RNA, 23 nt, Pseudomonas aeruginosa PA01
ucacgacaggcggcgggccggcg

SEQ ID NO: 1456087 - RNA, 14 nt, Pseudomonas aeruginosa PA01
ucaccuugcccucg

SEQ ID NO: 1456088 - RNA, 15 nt, Pseudomonas aeruginosa PA01
ucaccuuggugccga

SEQ ID NO: 1456089 - RNA, 21 nt, Pseudomonas aeruginosa PA01
ucaccuuguacggcagcggcg

SEQ ID NO: 1456090 - RNA, 15 nt, Pseudomonas aeruginosa PA01
ucaccuggucgccga

SEQ ID NO: 1456091 - RNA, 18 nt, Pseudomonas aeruginosa PA01
ucaccuguucggcgcuga

SEQ ID NO: 1456092 - RNA, 20 nt, Pseudomonas aeruginosa PA01
ucaccuucaccggcacgccc

SEQ ID NO: 1456093 - RNA, 13 nt, Pseudomonas aeruginosa PA01
ucaccuucgcccu

SEQ ID NO: 1456094 - RNA, 14 nt, Pseudomonas aeruginosa PA01
ucaccggcagggcg

SEQ ID NO: 1456095 - RNA, 22 nt, Pseudomonas aeruginosa PA01
ucaccggaccguggugacgguc

SEQ ID NO: 1456096 - RNA, 24 nt, Pseudomonas aeruginosa PA01
ucaccggcuggcccuccauccagu

SEQ ID NO: 1456097 - RNA, 14 nt, Pseudomonas aeruginosa PA01
ucaccggcggauga

SEQ ID NO: 1456098 - RNA, 20 nt, Pseudomonas aeruginosa PA01
ucaccggcgccacccucggc

SEQ ID NO: 1456099 - RNA, 14 nt, Pseudomonas aeruginosa PA01
ucauugcgcacggu

SEQ ID NO: 1456100 - RNA, 17 nt, Pseudomonas aeruginosa PA01
uccaaccaguaggcgug

SEQ ID NO: 1456101 - RNA, 16 nt, Pseudomonas aeruginosa PA01
uccaacccauguggcg

SEQ ID NO: 1456102 - RNA, 20 nt, Pseudomonas aeruginosa PA01
uccaacccauguggcgcagc

SEQ ID NO: 1456103 - RNA, 23 nt, Pseudomonas aeruginosa PA01
ucauugaaaucaucggcccuggg

SEQ ID NO: 1456104 - RNA, 14 nt, Pseudomonas aeruginosa PA01
ucaugggcgcgcgc

SEQ ID NO: 1456105 - RNA, 17 nt, Pseudomonas aeruginosa PA01
ucaugggcgcgcgccgg

SEQ ID NO: 1456106 - RNA, 20 nt, Pseudomonas aeruginosa PA01
ucaugggcgcgcgccgggcu

SEQ ID NO: 1456107 - RNA, 18 nt, Pseudomonas aeruginosa PA01
ucaugggucgauugcugg

SEQ ID NO: 1456108 - RNA, 19 nt, Pseudomonas aeruginosa PA01
ucauggugcccagcaggcu

SEQ ID NO: 1456109 - RNA, 15 nt, Pseudomonas aeruginosa PA01
ucauguagagcaggc

SEQ ID NO: 1456110 - RNA, 18 nt, Pseudomonas aeruginosa PA01
ucaugguccgucgcgcgc

SEQ ID NO: 1456111 - RNA, 13 nt, Pseudomonas aeruginosa PA01
ucauccacaggcg

SEQ ID NO: 1456112 - RNA, 18 nt, Pseudomonas aeruginosa PA01
ucauccacaggcggcuca

SEQ ID NO: 1456113 - RNA, 12 nt, Pseudomonas aeruginosa PA01
ucaucgcgccgc

SEQ ID NO: 1456114 - RNA, 14 nt, Pseudomonas aeruginosa PA01
ucaucggcccuggg

SEQ ID NO: 1456115 - RNA, 18 nt, Pseudomonas aeruginosa PA01
ucaucggcuggucgucgc

SEQ ID NO: 1456116 - RNA, 21 nt, Pseudomonas aeruginosa PA01
ucaugcccagcuucaccggug

SEQ ID NO: 1456117 - RNA, 14 nt, Pseudomonas aeruginosa PA01
ucaugcccaggccg

SEQ ID NO: 1456118 - RNA, 13 nt, Pseudomonas aeruginosa PA01
ucaugcaggccga

SEQ ID NO: 1456119 - RNA, 16 nt, Pseudomonas aeruginosa PA01
ucaugaccgccgcuca

SEQ ID NO: 1456120 - RNA, 18 nt, Pseudomonas aeruginosa PA01
ucaugagguucaggccgg

SEQ ID NO: 1456121 - RNA, 23 nt, Pseudomonas aeruginosa PA01
ucaugaaggaaaccggccagcgc

SEQ ID NO: 1456122 - RNA, 18 nt, Pseudomonas aeruginosa PA01
ucaugaccagagccgccg

SEQ ID NO: 1456123 - RNA, 21 nt, Pseudomonas aeruginosa PA01
ucaucgucggcagccaucgca

SEQ ID NO: 1456124 - RNA, 14 nt, Pseudomonas aeruginosa PA01
ucaucguccagcuc

SEQ ID NO: 1456125 - RNA, 17 nt, Pseudomonas aeruginosa PA01
ucaguucggugccgccg

SEQ ID NO: 1456126 - RNA, 20 nt, Pseudomonas aeruginosa PA01
ucaguucggugccgccggcg

SEQ ID NO: 1456127 - RNA, 16 nt, Pseudomonas aeruginosa PA01
ucaguuccacgcggac

SEQ ID NO: 1456128 - RNA, 17 nt, Pseudomonas aeruginosa PA01
ucaguuccaggucggcg

SEQ ID NO: 1456129 - RNA, 16 nt, Pseudomonas aeruginosa PA01
ucaguucggccagcgg

SEQ ID NO: 1456130 - RNA, 16 nt, Pseudomonas aeruginosa PA01
ucaucaggcugccgag

SEQ ID NO: 1456131 - RNA, 20 nt, Pseudomonas aeruginosa PA01
ucaucaggcugccgagcagg

SEQ ID NO: 1456132 - RNA, 16 nt, Pseudomonas aeruginosa PA01
ucaucaccaggucgcu

SEQ ID NO: 1456133 - RNA, 17 nt, Pseudomonas aeruginosa PA01
ucagguagauguccagu

SEQ ID NO: 1456134 - RNA, 14 nt, Pseudomonas aeruginosa PA01
ucagguacaggcgg

SEQ ID NO: 1456135 - RNA, 17 nt, Pseudomonas aeruginosa PA01
ucagguaaggcaccacc

SEQ ID NO: 1456136 - RNA, 13 nt, Pseudomonas aeruginosa PA01
ucaggucgacgcc

SEQ ID NO: 1456137 - RNA, 22 nt, Pseudomonas aeruginosa PA01
ucaggucgaugcccagccaggg

SEQ ID NO: 1456138 - RNA, 23 nt, Pseudomonas aeruginosa PA01
ucagguagcucaucggcgacacc

SEQ ID NO: 1456139 - RNA, 14 nt, Pseudomonas aeruginosa PA01
ucagguaggcaucg

SEQ ID NO: 1456140 - RNA, 15 nt, Pseudomonas aeruginosa PA01
ucagguaggcaucga

SEQ ID NO: 1456141 - RNA, 15 nt, Pseudomonas aeruginosa PA01
ucagguaggccggcg

SEQ ID NO: 1456142 - RNA, 17 nt, Pseudomonas aeruginosa PA01
ucagguaggcgcgggcg

SEQ ID NO: 1456143 - RNA, 23 nt, Pseudomonas aeruginosa PA01
ucagguaggcgcgggcguagccu

SEQ ID NO: 1456144 - RNA, 14 nt, Pseudomonas aeruginosa PA01
ucagguagucggcg

SEQ ID NO: 1456145 - RNA, 21 nt, Pseudomonas aeruginosa PA01
ucagguagugcaacaccuggc

SEQ ID NO: 1456146 - RNA, 22 nt, Pseudomonas aeruginosa PA01
ucagguagugcaacaccuggcg

SEQ ID NO: 1456147 - RNA, 12 nt, Pseudomonas aeruginosa PA01
ucaggccggcgc

SEQ ID NO: 1456148 - RNA, 14 nt, Pseudomonas aeruginosa PA01
ucaggccggcgccg

SEQ ID NO: 1456149 - RNA, 15 nt, Pseudomonas aeruginosa PA01
ucaggccggcgccgc

SEQ ID NO: 1456150 - RNA, 17 nt, Pseudomonas aeruginosa PA01
ucaggccggcgccgccg

SEQ ID NO: 1456151 - RNA, 17 nt, Pseudomonas aeruginosa PA01
ucaggccgggcaggccg

SEQ ID NO: 1456152 - RNA, 21 nt, Pseudomonas aeruginosa PA01
ucaggccgggcaggccgaggc

SEQ ID NO: 1456153 - RNA, 12 nt, Pseudomonas aeruginosa PA01
ucaggccgggcg

SEQ ID NO: 1456154 - RNA, 17 nt, Pseudomonas aeruginosa PA01
ucaggccuugcgcggcg

SEQ ID NO: 1456155 - RNA, 18 nt, Pseudomonas aeruginosa PA01
ucaggccuugcgcggcgc

SEQ ID NO: 1456156 - RNA, 15 nt, Pseudomonas aeruginosa PA01
ucaggcgacgccgcg

SEQ ID NO: 1456157 - RNA, 16 nt, Pseudomonas aeruginosa PA01
ucaggcgacgccgcgc

SEQ ID NO: 1456158 - RNA, 19 nt, Pseudomonas aeruginosa PA01
ucaggcgacgccgcgcugc

SEQ ID NO: 1456159 - RNA, 17 nt, Pseudomonas aeruginosa PA01
ucaggucggcgcgcacc

SEQ ID NO: 1456160 - RNA, 20 nt, Pseudomonas aeruginosa PA01
ucaggucggucuggcggccc

SEQ ID NO: 1456161 - RNA, 14 nt, Pseudomonas aeruginosa PA01
ucaggucgcgcgcc

SEQ ID NO: 1456162 - RNA, 12 nt, Pseudomonas aeruginosa PA01
ucaggucggccg

SEQ ID NO: 1456163 - RNA, 15 nt, Pseudomonas aeruginosa PA01
ucagucgucguccag

SEQ ID NO: 1456164 - RNA, 16 nt, Pseudomonas aeruginosa PA01
ucagugagccccggcg

SEQ ID NO: 1456165 - RNA, 18 nt, Pseudomonas aeruginosa PA01
ucagugcacguuccagcu

SEQ ID NO: 1456166 - RNA, 19 nt, Pseudomonas aeruginosa PA01
ucagugcacguuccagcuc

SEQ ID NO: 1456167 - RNA, 20 nt, Pseudomonas aeruginosa PA01
uccacugcguccuggucgcu

SEQ ID NO: 1456168 - RNA, 14 nt, Pseudomonas aeruginosa PA01
uccacugucucgcc

SEQ ID NO: 1456169 - RNA, 15 nt, Pseudomonas aeruginosa PA01
uccacugucucgccg

SEQ ID NO: 1456170 - RNA, 19 nt, Pseudomonas aeruginosa PA01
uccagcaccagcacgcccu

SEQ ID NO: 1456171 - RNA, 23 nt, Pseudomonas aeruginosa PA01
uccagcaaugccagcgccacgcc

SEQ ID NO: 1456172 - RNA, 17 nt, Pseudomonas aeruginosa PA01
uccagcaacgccgcccc

SEQ ID NO: 1456173 - RNA, 14 nt, Pseudomonas aeruginosa PA01
uccagcaacggcau

SEQ ID NO: 1456174 - RNA, 15 nt, Pseudomonas aeruginosa PA01
uccagaucgccguuc

SEQ ID NO: 1456175 - RNA, 20 nt, Pseudomonas aeruginosa PA01
uccagaugaaacugcccggc

SEQ ID NO: 1456176 - RNA, 20 nt, Pseudomonas aeruginosa PA01
uccagaugcuugcacaccug

SEQ ID NO: 1456177 - RNA, 17 nt, Pseudomonas aeruginosa PA01
uccacgccuucgcggcc

SEQ ID NO: 1456178 - RNA, 20 nt, Pseudomonas aeruginosa PA01
uccacgccuucgcggccgag

SEQ ID NO: 1456179 - RNA, 12 nt, Pseudomonas aeruginosa PA01
uccacgcgccga

SEQ ID NO: 1456180 - RNA, 23 nt, Pseudomonas aeruginosa PA01
uccacgcugugcggcagcaggcu

SEQ ID NO: 1456181 - RNA, 17 nt, Pseudomonas aeruginosa PA01
uccacggcgcgucggcg

SEQ ID NO: 1456182 - RNA, 13 nt, Pseudomonas aeruginosa PA01
uccacggcggccu

SEQ ID NO: 1456183 - RNA, 20 nt, Pseudomonas aeruginosa PA01
uccacgggucgcagccgagc

SEQ ID NO: 1456184 - RNA, 16 nt, Pseudomonas aeruginosa PA01
uccacgucgagcgggc

SEQ ID NO: 1456185 - RNA, 17 nt, Pseudomonas aeruginosa PA01
uccacgucgagcgggcg

SEQ ID NO: 1456186 - RNA, 16 nt, Pseudomonas aeruginosa PA01
uccacgucgccgacca

SEQ ID NO: 1456187 - RNA, 20 nt, Pseudomonas aeruginosa PA01
uccacgucgccgaccaggcg

SEQ ID NO: 1456188 - RNA, 22 nt, Pseudomonas aeruginosa PA01
uccacgucgccgaccaggcggc

SEQ ID NO: 1456189 - RNA, 14 nt, Pseudomonas aeruginosa PA01
uccacucgccgacc

SEQ ID NO: 1456190 - RNA, 20 nt, Pseudomonas aeruginosa PA01
uccacguugcaguccaggcc

SEQ ID NO: 1456191 - RNA, 20 nt, Pseudomonas aeruginosa PA01
uccaacgcgcgaagcacgcu

SEQ ID NO: 1456192 - RNA, 23 nt, Pseudomonas aeruginosa PA01
uccaccaccagggucuccaggac

SEQ ID NO: 1456193 - RNA, 17 nt, Pseudomonas aeruginosa PA01
uccacagggucggcagg

SEQ ID NO: 1456194 - RNA, 14 nt, Pseudomonas aeruginosa PA01
uccaccgcccccgg

SEQ ID NO: 1456195 - RNA, 16 nt, Pseudomonas aeruginosa PA01
uccaccgcccccggcg

SEQ ID NO: 1456196 - RNA, 21 nt, Pseudomonas aeruginosa PA01
uccaccgcccccggcgccacc

SEQ ID NO: 1456197 - RNA, 15 nt, Pseudomonas aeruginosa PA01
uccaccgccgccagc

SEQ ID NO: 1456198 - RNA, 15 nt, Pseudomonas aeruginosa PA01
uccaccgcgcuccgc

SEQ ID NO: 1456199 - RNA, 21 nt, Pseudomonas aeruginosa PA01
uccaccgcggccucgcuggcg

SEQ ID NO: 1456200 - RNA, 15 nt, Pseudomonas aeruginosa PA01
uccaccgcuccggcg

SEQ ID NO: 1456201 - RNA, 17 nt, Pseudomonas aeruginosa PA01
uccaccggaucgcccug

SEQ ID NO: 1456202 - RNA, 18 nt, Pseudomonas aeruginosa PA01
uccaccggaucgcccugg

SEQ ID NO: 1456203 - RNA, 23 nt, Pseudomonas aeruginosa PA01
uccaccgccaccugccccgggcg

SEQ ID NO: 1456204 - RNA, 18 nt, Pseudomonas aeruginosa PA01
uccaccgaguggcgcagc

SEQ ID NO: 1456205 - RNA, 19 nt, Pseudomonas aeruginosa PA01
uccaccgaguggcgcagcg

SEQ ID NO: 1456206 - RNA, 15 nt, Pseudomonas aeruginosa PA01
uccaccgauggcgcg

SEQ ID NO: 1456207 - RNA, 13 nt, Pseudomonas aeruginosa PA01
uccaccggccgcg

SEQ ID NO: 1456208 - RNA, 15 nt, Pseudomonas aeruginosa PA01
uccaccggcuggccg

SEQ ID NO: 1456209 - RNA, 18 nt, Pseudomonas aeruginosa PA01
uccaccucgacccuggcg

SEQ ID NO: 1456210 - RNA, 19 nt, Pseudomonas aeruginosa PA01
uccaccucgacccuggcgc

SEQ ID NO: 1456211 - RNA, 20 nt, Pseudomonas aeruginosa PA01
uccaccucgacccuggcgcc

SEQ ID NO: 1456212 - RNA, 13 nt, Pseudomonas aeruginosa PA01
uccacgccgggca

SEQ ID NO: 1456213 - RNA, 18 nt, Pseudomonas aeruginosa PA01
uccagcggccacggcgga

SEQ ID NO: 1456214 - RNA, 21 nt, Pseudomonas aeruginosa PA01
uccagcggccgcgagcgcggc

SEQ ID NO: 1456215 - RNA, 17 nt, Pseudomonas aeruginosa PA01
uccagcggccgcgccuu

SEQ ID NO: 1456216 - RNA, 17 nt, Pseudomonas aeruginosa PA01
uccagcccggcgugggc

SEQ ID NO: 1456217 - RNA, 16 nt, Pseudomonas aeruginosa PA01
uccagccaggcgcucu

SEQ ID NO: 1456218 - RNA, 13 nt, Pseudomonas aeruginosa PA01
uccagccaggccc

SEQ ID NO: 1456219 - RNA, 14 nt, Pseudomonas aeruginosa PA01
uccagccaggcccg

SEQ ID NO: 1456220 - RNA, 21 nt, Pseudomonas aeruginosa PA01
uccagccagacguccggcagg

SEQ ID NO: 1456221 - RNA, 17 nt, Pseudomonas aeruginosa PA01
uccagccagcagcccgg

SEQ ID NO: 1456222 - RNA, 20 nt, Pseudomonas aeruginosa PA01
uccagccagcagcccggccu

SEQ ID NO: 1456223 - RNA, 23 nt, Pseudomonas aeruginosa PA01
uccagccagccgccuugcucgac

SEQ ID NO: 1456224 - RNA, 16 nt, Pseudomonas aeruginosa PA01
uccagcaugcucgggc

SEQ ID NO: 1456225 - RNA, 19 nt, Pseudomonas aeruginosa PA01
uccagcaugcucgggcugc

SEQ ID NO: 1456226 - RNA, 15 nt, Pseudomonas aeruginosa PA01
uccagcagucgcggc

SEQ ID NO: 1456227 - RNA, 18 nt, Pseudomonas aeruginosa PA01
uccagcagucgcggcccu

SEQ ID NO: 1456228 - RNA, 18 nt, Pseudomonas aeruginosa PA01
uccagcaccgccuggcgc

SEQ ID NO: 1456229 - RNA, 20 nt, Pseudomonas aeruginosa PA01
uccagcaggucggcagcguc

SEQ ID NO: 1456230 - RNA, 21 nt, Pseudomonas aeruginosa PA01
uccagcagguucggcgguagc

SEQ ID NO: 1456231 - RNA, 17 nt, Pseudomonas aeruginosa PA01
uccagcacccgcaccgg

SEQ ID NO: 1456232 - RNA, 13 nt, Pseudomonas aeruginosa PA01
uccagcaggcgcu

SEQ ID NO: 1456233 - RNA, 20 nt, Pseudomonas aeruginosa PA01
uccagcagggccagcgccug

SEQ ID NO: 1456234 - RNA, 23 nt, Pseudomonas aeruginosa PA01
uccagcagggccagcgccuggcg

SEQ ID NO: 1456235 - RNA, 13 nt, Pseudomonas aeruginosa PA01
uccagcaccggcg

SEQ ID NO: 1456236 - RNA, 19 nt, Pseudomonas aeruginosa PA01
uccagcaccggcggcgcca

SEQ ID NO: 1456237 - RNA, 15 nt, Pseudomonas aeruginosa PA01
uccagcaccguggcg

SEQ ID NO: 1456238 - RNA, 18 nt, Pseudomonas aeruginosa PA01
uccagcaccguggcgcca

SEQ ID NO: 1456239 - RNA, 17 nt, Pseudomonas aeruginosa PA01
uccagcgguaccagcag

SEQ ID NO: 1456240 - RNA, 20 nt, Pseudomonas aeruginosa PA01
uccagcgguaccagcagcgc

SEQ ID NO: 1456241 - RNA, 20 nt, Pseudomonas aeruginosa PA01
uccagcggcuuguccuggcg

SEQ ID NO: 1456242 - RNA, 20 nt, Pseudomonas aeruginosa PA01
uccagcgggaaggucggcag

SEQ ID NO: 1456243 - RNA, 20 nt, Pseudomonas aeruginosa PA01
uccagcggggaugaccgucc

SEQ ID NO: 1456244 - RNA, 19 nt, Pseudomonas aeruginosa PA01
uccagcgggguggcgcgga

SEQ ID NO: 1456245 - RNA, 14 nt, Pseudomonas aeruginosa PA01
uccagcguguggcg

SEQ ID NO: 1456246 - RNA, 23 nt, Pseudomonas aeruginosa PA01
uccagcguggcggacaacccggc

SEQ ID NO: 1456247 - RNA, 18 nt, Pseudomonas aeruginosa PA01
uccaggccgcucaccgcc

SEQ ID NO: 1456248 - RNA, 17 nt, Pseudomonas aeruginosa PA01
uccaggcccgccgcggc

SEQ ID NO: 1456249 - RNA, 17 nt, Pseudomonas aeruginosa PA01
uccaggcccauccuggc

SEQ ID NO: 1456250 - RNA, 16 nt, Pseudomonas aeruginosa PA01
uccagcuccaccaggc

SEQ ID NO: 1456251 - RNA, 14 nt, Pseudomonas aeruginosa PA01
uccaggguuuccag

SEQ ID NO: 1456252 - RNA, 20 nt, Pseudomonas aeruginosa PA01
uccagguaaaggccaccaga

SEQ ID NO: 1456253 - RNA, 17 nt, Pseudomonas aeruginosa PA01
uccagguacagccgcag

SEQ ID NO: 1456254 - RNA, 11 nt, Pseudomonas aeruginosa PA01
uccaggucggu

SEQ ID NO: 1456255 - RNA, 18 nt, Pseudomonas aeruginosa PA01
uccaggucaugcccuggc

SEQ ID NO: 1456256 - RNA, 19 nt, Pseudomonas aeruginosa PA01
uccaggucaugcccuggcc

SEQ ID NO: 1456257 - RNA, 21 nt, Pseudomonas aeruginosa PA01
uccaggucaugcccuggccga

SEQ ID NO: 1456258 - RNA, 21 nt, Pseudomonas aeruginosa PA01
uccagguccgcaccguagcgg

SEQ ID NO: 1456259 - RNA, 15 nt, Pseudomonas aeruginosa PA01
uccagggucgagggc

SEQ ID NO: 1456260 - RNA, 23 nt, Pseudomonas aeruginosa PA01
uccagggucgcccgugccucggc

SEQ ID NO: 1456261 - RNA, 15 nt, Pseudomonas aeruginosa PA01
uccagggcugccacc

SEQ ID NO: 1456262 - RNA, 20 nt, Pseudomonas aeruginosa PA01
uccagggccggaucggccuu

SEQ ID NO: 1456263 - RNA, 23 nt, Pseudomonas aeruginosa PA01
uccagggcgaagucggcgcgcca

SEQ ID NO: 1456264 - RNA, 15 nt, Pseudomonas aeruginosa PA01
uccagggcgauggcg

SEQ ID NO: 1456265 - RNA, 13 nt, Pseudomonas aeruginosa PA01
uccagggcgcuga

SEQ ID NO: 1456266 - RNA, 19 nt, Pseudomonas aeruginosa PA01
uccagggcgcugaccaggu

SEQ ID NO: 1456267 - RNA, 18 nt, Pseudomonas aeruginosa PA01
uccagggcggcgcggagc

SEQ ID NO: 1456268 - RNA, 14 nt, Pseudomonas aeruginosa PA01
uccagggccagcuu

SEQ ID NO: 1456269 - RNA, 20 nt, Pseudomonas aeruginosa PA01
uccaggcucuucagcacgcg

SEQ ID NO: 1456270 - RNA, 16 nt, Pseudomonas aeruginosa PA01
uccaggcuuugcggca

SEQ ID NO: 1456271 - RNA, 18 nt, Pseudomonas aeruginosa PA01
uccagggagcgcucgcgc

SEQ ID NO: 1456272 - RNA, 20 nt, Pseudomonas aeruginosa PA01
uccagggagcgcucgcgcag

SEQ ID NO: 1456273 - RNA, 22 nt, Pseudomonas aeruginosa PA01
uccagggagcgcucgcgcagcc

SEQ ID NO: 1456274 - RNA, 20 nt, Pseudomonas aeruginosa PA01
uccagggcauccaucgccag

SEQ ID NO: 1456275 - RNA, 14 nt, Pseudomonas aeruginosa PA01
uccaggcgcugcuc

SEQ ID NO: 1456276 - RNA, 14 nt, Pseudomonas aeruginosa PA01
uccaggcgcgccgu

SEQ ID NO: 1456277 - RNA, 16 nt, Pseudomonas aeruginosa PA01
uccaggcgcgccgugc

SEQ ID NO: 1456278 - RNA, 15 nt, Pseudomonas aeruginosa PA01
uccaggccgccggcg

SEQ ID NO: 1456279 - RNA, 23 nt, Pseudomonas aeruginosa PA01
uccaggcgacgaaacggcucugc

SEQ ID NO: 1456280 - RNA, 18 nt, Pseudomonas aeruginosa PA01
uccaggcuguggcgcggc

SEQ ID NO: 1456281 - RNA, 22 nt, Pseudomonas aeruginosa PA01
uccaggcuuuccaccgccagca

SEQ ID NO: 1456282 - RNA, 18 nt, Pseudomonas aeruginosa PA01
uccaggcuguagccggcg

SEQ ID NO: 1456283 - RNA, 19 nt, Pseudomonas aeruginosa PA01
uccaggcuguagccggcga

SEQ ID NO: 1456284 - RNA, 21 nt, Pseudomonas aeruginosa PA01
uccaggcuguagccggcgaug

SEQ ID NO: 1456285 - RNA, 24 nt, Pseudomonas aeruginosa PA01
uccaggcgggugaacucaugcagg

SEQ ID NO: 1456286 - RNA, 17 nt, Pseudomonas aeruginosa PA01
uccaggcguccgcuggc

SEQ ID NO: 1456287 - RNA, 19 nt, Pseudomonas aeruginosa PA01
uccaggcguccgcuggccu

SEQ ID NO: 1456288 - RNA, 14 nt, Pseudomonas aeruginosa PA01
uccaucgccgcggc

SEQ ID NO: 1456289 - RNA, 21 nt, Pseudomonas aeruginosa PA01
uccaucguggggcggcgcaga

SEQ ID NO: 1456290 - RNA, 16 nt, Pseudomonas aeruginosa PA01
uccaucucgccgcgca

SEQ ID NO: 1456291 - RNA, 19 nt, Pseudomonas aeruginosa PA01
uccagguucggcgccagcu

SEQ ID NO: 1456292 - RNA, 20 nt, Pseudomonas aeruginosa PA01
uccagguucggcgccagcuc

SEQ ID NO: 1456293 - RNA, 20 nt, Pseudomonas aeruginosa PA01
uccaggugccaauccgggcg

SEQ ID NO: 1456294 - RNA, 21 nt, Pseudomonas aeruginosa PA01
uccauccagucggcgcuggag

SEQ ID NO: 1456295 - RNA, 17 nt, Pseudomonas aeruginosa PA01
uccaucgcaggcagcgc

SEQ ID NO: 1456296 - RNA, 14 nt, Pseudomonas aeruginosa PA01
uccgaaaccaggau

SEQ ID NO: 1456297 - RNA, 18 nt, Pseudomonas aeruginosa PA01
uccgagaccggcagccgg

SEQ ID NO: 1456298 - RNA, 17 nt, Pseudomonas aeruginosa PA01
uccgagacgcugcaccg

SEQ ID NO: 1456299 - RNA, 18 nt, Pseudomonas aeruginosa PA01
uccgagacgcugcaccgc

SEQ ID NO: 1456300 - RNA, 21 nt, Pseudomonas aeruginosa PA01
uccgagacgcugcaccgcggc

SEQ ID NO: 1456301 - RNA, 20 nt, Pseudomonas aeruginosa PA01
uccgaggcggauuugccgcc

SEQ ID NO: 1456302 - RNA, 22 nt, Pseudomonas aeruginosa PA01
uccgaggcggauuugccgccga

SEQ ID NO: 1456303 - RNA, 22 nt, Pseudomonas aeruginosa PA01
uccgagccguuggucaacggcg

SEQ ID NO: 1456304 - RNA, 23 nt, Pseudomonas aeruginosa PA01
uccgagggaggaggcgccgggua

SEQ ID NO: 1456305 - RNA, 18 nt, Pseudomonas aeruginosa PA01
uccgagggccgcgccgac

SEQ ID NO: 1456306 - RNA, 12 nt, Pseudomonas aeruginosa PA01
ucccuggccggc

SEQ ID NO: 1456307 - RNA, 21 nt, Pseudomonas aeruginosa PA01
ucccuuguuuuccuggcccug

SEQ ID NO: 1456308 - RNA, 13 nt, Pseudomonas aeruginosa PA01
ucccuugccgccg

SEQ ID NO: 1456309 - RNA, 21 nt, Pseudomonas aeruginosa PA01
ucccuucuuuuuuucaccgcu

SEQ ID NO: 1456310 - RNA, 22 nt, Pseudomonas aeruginosa PA01
ucccuucuuuuuuucaccgcuc

SEQ ID NO: 1456311 - RNA, 13 nt, Pseudomonas aeruginosa PA01
ucccugcgccucg

SEQ ID NO: 1456312 - RNA, 16 nt, Pseudomonas aeruginosa PA01
ucccugcccgcucggg

SEQ ID NO: 1456313 - RNA, 15 nt, Pseudomonas aeruginosa PA01
ucccugccgcccuuc

SEQ ID NO: 1456314 - RNA, 14 nt, Pseudomonas aeruginosa PA01
ucccugccggcggu

SEQ ID NO: 1456315 - RNA, 14 nt, Pseudomonas aeruginosa PA01
ucccugcugcggca

SEQ ID NO: 1456316 - RNA, 17 nt, Pseudomonas aeruginosa PA01
ucccugcuucgaccagg

SEQ ID NO: 1456317 - RNA, 16 nt, Pseudomonas aeruginosa PA01
uccgcaccguagcggc

SEQ ID NO: 1456318 - RNA, 13 nt, Pseudomonas aeruginosa PA01
uccgcacccgggc

SEQ ID NO: 1456319 - RNA, 14 nt, Pseudomonas aeruginosa PA01
uccgcacccgggca

SEQ ID NO: 1456320 - RNA, 14 nt, Pseudomonas aeruginosa PA01
uccgcagcacagcc

SEQ ID NO: 1456321 - RNA, 21 nt, Pseudomonas aeruginosa PA01
uccgcagguagcugagcaggc

SEQ ID NO: 1456322 - RNA, 17 nt, Pseudomonas aeruginosa PA01
uccgcaggcaggucgcu

SEQ ID NO: 1456323 - RNA, 20 nt, Pseudomonas aeruginosa PA01
uccgcaggaaaccccucggc

SEQ ID NO: 1456324 - RNA, 23 nt, Pseudomonas aeruginosa PA01
uccgcaggaaaccccucggcuaa

SEQ ID NO: 1456325 - RNA, 22 nt, Pseudomonas aeruginosa PA01
uccgcccuuuuucgucgccagc

SEQ ID NO: 1456326 - RNA, 17 nt, Pseudomonas aeruginosa PA01
uccgcccuacggaccgg

SEQ ID NO: 1456327 - RNA, 21 nt, Pseudomonas aeruginosa PA01
uccgcccaguucuucgccgcc

SEQ ID NO: 1456328 - RNA, 17 nt, Pseudomonas aeruginosa PA01
uccgcccauugcccggc

SEQ ID NO: 1456329 - RNA, 14 nt, Pseudomonas aeruginosa PA01
uccgcaucggccac

SEQ ID NO: 1456330 - RNA, 18 nt, Pseudomonas aeruginosa PA01
uccgcaucggccaccuuc

SEQ ID NO: 1456331 - RNA, 23 nt, Pseudomonas aeruginosa PA01
uccgcaucggccgacagagcggc

SEQ ID NO: 1456332 - RNA, 15 nt, Pseudomonas aeruginosa PA01
uccgcgacaguucgc

SEQ ID NO: 1456333 - RNA, 19 nt, Pseudomonas aeruginosa PA01
uccgcgacaguucgccgcc

SEQ ID NO: 1456334 - RNA, 19 nt, Pseudomonas aeruginosa PA01
uccgcgaugcguuccaggg

SEQ ID NO: 1456335 - RNA, 16 nt, Pseudomonas aeruginosa PA01
uccgccgcagaccagc

SEQ ID NO: 1456336 - RNA, 13 nt, Pseudomonas aeruginosa PA01
uccgccuuguccu

SEQ ID NO: 1456337 - RNA, 18 nt, Pseudomonas aeruginosa PA01
uccgccuggcggauaucg

SEQ ID NO: 1456338 - RNA, 17 nt, Pseudomonas aeruginosa PA01
uccgccugguccagcag

SEQ ID NO: 1456339 - RNA, 16 nt, Pseudomonas aeruginosa PA01
uccgccuguccaccgg

SEQ ID NO: 1456340 - RNA, 21 nt, Pseudomonas aeruginosa PA01
uccgccgaggugcugcaccgg

SEQ ID NO: 1456341 - RNA, 17 nt, Pseudomonas aeruginosa PA01
uccgccgauacagcgcg

SEQ ID NO: 1456342 - RNA, 18 nt, Pseudomonas aeruginosa PA01
uccgccgauacagcgcgc

SEQ ID NO: 1456343 - RNA, 15 nt, Pseudomonas aeruginosa PA01
uccgccgccgcggcg

SEQ ID NO: 1456344 - RNA, 17 nt, Pseudomonas aeruginosa PA01
uccgccgccgcggcgcg

SEQ ID NO: 1456345 - RNA, 14 nt, Pseudomonas aeruginosa PA01
uccgccgccgggcu

SEQ ID NO: 1456346 - RNA, 13 nt, Pseudomonas aeruginosa PA01
uccgccgccgggc

SEQ ID NO: 1456347 - RNA, 13 nt, Pseudomonas aeruginosa PA01
uccgccgccgugg

SEQ ID NO: 1456348 - RNA, 22 nt, Pseudomonas aeruginosa PA01
ucccggccuggcgcgcgcgcca

SEQ ID NO: 1456349 - RNA, 15 nt, Pseudomonas aeruginosa PA01
ucccgcgccagcgcc

SEQ ID NO: 1456350 - RNA, 20 nt, Pseudomonas aeruginosa PA01
ucccgcgccagcgccgccag

SEQ ID NO: 1456351 - RNA, 18 nt, Pseudomonas aeruginosa PA01
ucccgcgacaacggccgu

SEQ ID NO: 1456352 - RNA, 19 nt, Pseudomonas aeruginosa PA01
ucccgcgagcagccgacga

SEQ ID NO: 1456353 - RNA, 16 nt, Pseudomonas aeruginosa PA01
ucccgcgauucgccgg

SEQ ID NO: 1456354 - RNA, 23 nt, Pseudomonas aeruginosa PA01
ucccgcgcgccgagcccccggcg

SEQ ID NO: 1456355 - RNA, 14 nt, Pseudomonas aeruginosa PA01
ucccguccagcgcu

SEQ ID NO: 1456356 - RNA, 14 nt, Pseudomonas aeruginosa PA01
ucccguccgcugcg

SEQ ID NO: 1456357 - RNA, 17 nt, Pseudomonas aeruginosa PA01
ucccguccgcugcgcca

SEQ ID NO: 1456358 - RNA, 18 nt, Pseudomonas aeruginosa PA01
ucccggcugagcgccagg

SEQ ID NO: 1456359 - RNA, 19 nt, Pseudomonas aeruginosa PA01
ucccggcugagcgccaggc

SEQ ID NO: 1456360 - RNA, 15 nt, Pseudomonas aeruginosa PA01
ucccucaggauagcc

SEQ ID NO: 1456361 - RNA, 13 nt, Pseudomonas aeruginosa PA01
ucccucgccgacc

SEQ ID NO: 1456362 - RNA, 14 nt, Pseudomonas aeruginosa PA01
ucccguguaccacg

SEQ ID NO: 1456363 - RNA, 14 nt, Pseudomonas aeruginosa PA01
ucccgugccgggcc

SEQ ID NO: 1456364 - RNA, 15 nt, Pseudomonas aeruginosa PA01
ucccgugcggccuac

SEQ ID NO: 1456365 - RNA, 13 nt, Pseudomonas aeruginosa PA01
ucccguuccggcg

SEQ ID NO: 1456366 - RNA, 17 nt, Pseudomonas aeruginosa PA01
ucccguuccggcgcagc

SEQ ID NO: 1456367 - RNA, 20 nt, Pseudomonas aeruginosa PA01
ucccgcccggucucagccgg

SEQ ID NO: 1456368 - RNA, 22 nt, Pseudomonas aeruginosa PA01
ucccgcccggucucagccggcg

SEQ ID NO: 1456369 - RNA, 12 nt, Pseudomonas aeruginosa PA01
ucccgcauggcu

SEQ ID NO: 1456370 - RNA, 23 nt, Pseudomonas aeruginosa PA01
ucccgcccaucaacgagccgagc

SEQ ID NO: 1456371 - RNA, 17 nt, Pseudomonas aeruginosa PA01
ucccgcaaagcccgcuc

SEQ ID NO: 1456372 - RNA, 17 nt, Pseudomonas aeruginosa PA01
ucccgccgccgcgccuu

SEQ ID NO: 1456373 - RNA, 17 nt, Pseudomonas aeruginosa PA01
ucccgccgcgccgcuca

SEQ ID NO: 1456374 - RNA, 20 nt, Pseudomonas aeruginosa PA01
ucccgccgcgccgcucaggc

SEQ ID NO: 1456375 - RNA, 22 nt, Pseudomonas aeruginosa PA01
ucccgccgcggcguuagccgcc

SEQ ID NO: 1456376 - RNA, 15 nt, Pseudomonas aeruginosa PA01
ucccgccgcuccggc

SEQ ID NO: 1456377 - RNA, 13 nt, Pseudomonas aeruginosa PA01
ucccgccgcucug

SEQ ID NO: 1456378 - RNA, 14 nt, Pseudomonas aeruginosa PA01
ucccgccgcucugc

SEQ ID NO: 1456379 - RNA, 12 nt, Pseudomonas aeruginosa PA01
ucccgcaccggc

SEQ ID NO: 1456380 - RNA, 19 nt, Pseudomonas aeruginosa PA01
ucccgcaccggcgcgccgg

SEQ ID NO: 1456381 - RNA, 22 nt, Pseudomonas aeruginosa PA01
ucccgcaccggcgcgccggaca

SEQ ID NO: 1456382 - RNA, 19 nt, Pseudomonas aeruginosa PA01
uccauuagcgucgcgcggc

SEQ ID NO: 1456383 - RNA, 17 nt, Pseudomonas aeruginosa PA01
uccaugcucgccaccug

SEQ ID NO: 1456384 - RNA, 18 nt, Pseudomonas aeruginosa PA01
uccaugucgcuggccugc

SEQ ID NO: 1456385 - RNA, 12 nt, Pseudomonas aeruginosa PA01
uccaugggcaga

SEQ ID NO: 1456386 - RNA, 15 nt, Pseudomonas aeruginosa PA01
uccggcacgcugccg

SEQ ID NO: 1456387 - RNA, 20 nt, Pseudomonas aeruginosa PA01
uccggcagcacccgcaccag

SEQ ID NO: 1456388 - RNA, 21 nt, Pseudomonas aeruginosa PA01
uccggcagcacccgcaccagc

SEQ ID NO: 1456389 - RNA, 18 nt, Pseudomonas aeruginosa PA01
uccggcagcagggucagc

SEQ ID NO: 1456390 - RNA, 21 nt, Pseudomonas aeruginosa PA01
uccggcagcagggucagcagc

SEQ ID NO: 1456391 - RNA, 13 nt, Pseudomonas aeruginosa PA01
uccggcagccagc

SEQ ID NO: 1456392 - RNA, 14 nt, Pseudomonas aeruginosa PA01
uccggcagccagcc

SEQ ID NO: 1456393 - RNA, 22 nt, Pseudomonas aeruginosa PA01
uccggcagccagccgccgaagg

SEQ ID NO: 1456394 - RNA, 15 nt, Pseudomonas aeruginosa PA01
uccggcaggcgcucc

SEQ ID NO: 1456395 - RNA, 15 nt, Pseudomonas aeruginosa PA01
uccggcaggcucagc

SEQ ID NO: 1456396 - RNA, 21 nt, Pseudomonas aeruginosa PA01
uccggcagggccucgggcggg

SEQ ID NO: 1456397 - RNA, 19 nt, Pseudomonas aeruginosa PA01
uccggcaccaccaccggac

SEQ ID NO: 1456398 - RNA, 18 nt, Pseudomonas aeruginosa PA01
uccggcaccaccagcgcg

SEQ ID NO: 1456399 - RNA, 21 nt, Pseudomonas aeruginosa PA01
uccggcaccaccagcgcgcgc

SEQ ID NO: 1456400 - RNA, 16 nt, Pseudomonas aeruginosa PA01
uccggcaugcuugcca

SEQ ID NO: 1456401 - RNA, 22 nt, Pseudomonas aeruginosa PA01
uccggcccacgcucagugcgcc

SEQ ID NO: 1456402 - RNA, 11 nt, Pseudomonas aeruginosa PA01
uccggccaugu

SEQ ID NO: 1456403 - RNA, 17 nt, Pseudomonas aeruginosa PA01
uccggccagccuggcca

SEQ ID NO: 1456404 - RNA, 19 nt, Pseudomonas aeruginosa PA01
uccggccagccuggccagc

SEQ ID NO: 1456405 - RNA, 16 nt, Pseudomonas aeruginosa PA01
uccgcgauguccccgg

SEQ ID NO: 1456406 - RNA, 21 nt, Pseudomonas aeruginosa PA01
uccgcgauguccccggccagc

SEQ ID NO: 1456407 - RNA, 15 nt, Pseudomonas aeruginosa PA01
uccgcugcgagcagg

SEQ ID NO: 1456408 - RNA, 21 nt, Pseudomonas aeruginosa PA01
uccgccuuuuuugugcccggc

SEQ ID NO: 1456409 - RNA, 16 nt, Pseudomonas aeruginosa PA01
uccgcuguccgccgcc

SEQ ID NO: 1456410 - RNA, 17 nt, Pseudomonas aeruginosa PA01
uccgcugguagcccagg

SEQ ID NO: 1456411 - RNA, 23 nt, Pseudomonas aeruginosa PA01
uccgcugcaugaaaaagcccggc

SEQ ID NO: 1456412 - RNA, 15 nt, Pseudomonas aeruginosa PA01
uccgcuggccugcag

SEQ ID NO: 1456413 - RNA, 19 nt, Pseudomonas aeruginosa PA01
uccgcuucagcgcgccgag

SEQ ID NO: 1456414 - RNA, 21 nt, Pseudomonas aeruginosa PA01
uccgcuucagcgcgccgagcc

SEQ ID NO: 1456415 - RNA, 15 nt, Pseudomonas aeruginosa PA01
uccggcccggccagg

SEQ ID NO: 1456416 - RNA, 19 nt, Pseudomonas aeruginosa PA01
uccggcccggccagguagg

SEQ ID NO: 1456417 - RNA, 16 nt, Pseudomonas aeruginosa PA01
uccggcgccaggccgg

SEQ ID NO: 1456418 - RNA, 13 nt, Pseudomonas aeruginosa PA01
uccggcgcagcgg

SEQ ID NO: 1456419 - RNA, 12 nt, Pseudomonas aeruginosa PA01
uccggccgcccg

SEQ ID NO: 1456420 - RNA, 14 nt, Pseudomonas aeruginosa PA01
uccggccaggcgcg

SEQ ID NO: 1456421 - RNA, 12 nt, Pseudomonas aeruginosa PA01
uccggcgccgag

SEQ ID NO: 1456422 - RNA, 17 nt, Pseudomonas aeruginosa PA01
uccggcgcugagcgaga

SEQ ID NO: 1456423 - RNA, 13 nt, Pseudomonas aeruginosa PA01
uccggcgcggccu

SEQ ID NO: 1456424 - RNA, 19 nt, Pseudomonas aeruginosa PA01
uccggcgcggccugcagcg

SEQ ID NO: 1456425 - RNA, 12 nt, Pseudomonas aeruginosa PA01
uccgggcccagg

SEQ ID NO: 1456426 - RNA, 13 nt, Pseudomonas aeruginosa PA01
uccgggcccaggc

SEQ ID NO: 1456427 - RNA, 17 nt, Pseudomonas aeruginosa PA01
uccgggcccgugcggca

SEQ ID NO: 1456428 - RNA, 16 nt, Pseudomonas aeruginosa PA01
uccggcucgcugacgc

SEQ ID NO: 1456429 - RNA, 16 nt, Pseudomonas aeruginosa PA01
uccgguaggagcgaga

SEQ ID NO: 1456430 - RNA, 14 nt, Pseudomonas aeruginosa PA01
uccgggcagcggcg

SEQ ID NO: 1456431 - RNA, 20 nt, Pseudomonas aeruginosa PA01
uccgggaagcggucguagcc

SEQ ID NO: 1456432 - RNA, 21 nt, Pseudomonas aeruginosa PA01
uccgggaaugcucagcacggc

SEQ ID NO: 1456433 - RNA, 14 nt, Pseudomonas aeruginosa PA01
uccggcucgccgcg

SEQ ID NO: 1456434 - RNA, 16 nt, Pseudomonas aeruginosa PA01
uccggcucgccgcgcu

SEQ ID NO: 1456435 - RNA, 18 nt, Pseudomonas aeruginosa PA01
uccggcuugaccgccgcc

SEQ ID NO: 1456436 - RNA, 23 nt, Pseudomonas aeruginosa PA01
uccggcuugccgaugucgccggc

SEQ ID NO: 1456437 - RNA, 20 nt, Pseudomonas aeruginosa PA01
uccgugcggaaaccgcggcc

SEQ ID NO: 1456438 - RNA, 23 nt, Pseudomonas aeruginosa PA01
uccgugcggaaaccgcggccggc

SEQ ID NO: 1456439 - RNA, 15 nt, Pseudomonas aeruginosa PA01
uccgugugcagcagg

SEQ ID NO: 1456440 - RNA, 17 nt, Pseudomonas aeruginosa PA01
uccucagaggcgaccag

SEQ ID NO: 1456441 - RNA, 15 nt, Pseudomonas aeruginosa PA01
uccucacggcgcagc

SEQ ID NO: 1456442 - RNA, 18 nt, Pseudomonas aeruginosa PA01
uccucacggcgcagccgc

SEQ ID NO: 1456443 - RNA, 22 nt, Pseudomonas aeruginosa PA01
uccucagugcgggcaguccugg

SEQ ID NO: 1456444 - RNA, 18 nt, Pseudomonas aeruginosa PA01
uccucagccucacccugc

SEQ ID NO: 1456445 - RNA, 22 nt, Pseudomonas aeruginosa PA01
uccucauagugcugcggcaggu

SEQ ID NO: 1456446 - RNA, 21 nt, Pseudomonas aeruginosa PA01
uccuccagcaggaccuggccg

SEQ ID NO: 1456447 - RNA, 22 nt, Pseudomonas aeruginosa PA01
uccuccagcaggaccuggccgu

SEQ ID NO: 1456448 - RNA, 14 nt, Pseudomonas aeruginosa PA01
uccuccagccggcg

SEQ ID NO: 1456449 - RNA, 14 nt, Pseudomonas aeruginosa PA01
uccuccagcgccgc

SEQ ID NO: 1456450 - RNA, 13 nt, Pseudomonas aeruginosa PA01
uccuccagcggcg

SEQ ID NO: 1456451 - RNA, 13 nt, Pseudomonas aeruginosa PA01
uccuccaggccgc

SEQ ID NO: 1456452 - RNA, 20 nt, Pseudomonas aeruginosa PA01
uccuccaggccgccggcgac

SEQ ID NO: 1456453 - RNA, 23 nt, Pseudomonas aeruginosa PA01
uccuccaguagcggaagcacggc

SEQ ID NO: 1456454 - RNA, 20 nt, Pseudomonas aeruginosa PA01
uccuccgggcgugccaggag

SEQ ID NO: 1456455 - RNA, 20 nt, Pseudomonas aeruginosa PA01
uccucccagugcgagucggc

SEQ ID NO: 1456456 - RNA, 23 nt, Pseudomonas aeruginosa PA01
uccuccacccccgcaaccgcugc

SEQ ID NO: 1456457 - RNA, 21 nt, Pseudomonas aeruginosa PA01
uccuccaccguuccgacccgg

SEQ ID NO: 1456458 - RNA, 17 nt, Pseudomonas aeruginosa PA01
uccuccaaagccuggag

SEQ ID NO: 1456459 - RNA, 19 nt, Pseudomonas aeruginosa PA01
uccucgacccacuggcgga

SEQ ID NO: 1456460 - RNA, 21 nt, Pseudomonas aeruginosa PA01
uccucgacgaaauaaugcggc

SEQ ID NO: 1456461 - RNA, 14 nt, Pseudomonas aeruginosa PA01
uccucgaaagccgc

SEQ ID NO: 1456462 - RNA, 13 nt, Pseudomonas aeruginosa PA01
uccuccucggcgg

SEQ ID NO: 1456463 - RNA, 20 nt, Pseudomonas aeruginosa PA01
uccuccuggauacgcucggc

SEQ ID NO: 1456464 - RNA, 19 nt, Pseudomonas aeruginosa PA01
uccguaaaauggcgcgccu

SEQ ID NO: 1456465 - RNA, 19 nt, Pseudomonas aeruginosa PA01
uccguccagcgcgcccggc

SEQ ID NO: 1456466 - RNA, 20 nt, Pseudomonas aeruginosa PA01
uccguccagcgcgcccggcg

SEQ ID NO: 1456467 - RNA, 17 nt, Pseudomonas aeruginosa PA01
uccgucagggcguaagc

SEQ ID NO: 1456468 - RNA, 15 nt, Pseudomonas aeruginosa PA01
uccgugacgucggcg

SEQ ID NO: 1456469 - RNA, 14 nt, Pseudomonas aeruginosa PA01
uccgucuguucggc

SEQ ID NO: 1456470 - RNA, 18 nt, Pseudomonas aeruginosa PA01
uccgucucaggcgccagg

SEQ ID NO: 1456471 - RNA, 21 nt, Pseudomonas aeruginosa PA01
uccggucggacuccgcccagu

SEQ ID NO: 1456472 - RNA, 16 nt, Pseudomonas aeruginosa PA01
uccggucaaggcagaa

SEQ ID NO: 1456473 - RNA, 20 nt, Pseudomonas aeruginosa PA01
uccggucacgcaggcgcugg

SEQ ID NO: 1456474 - RNA, 13 nt, Pseudomonas aeruginosa PA01
uccggugcaccug

SEQ ID NO: 1456475 - RNA, 14 nt, Pseudomonas aeruginosa PA01
uccggugcaccugg

SEQ ID NO: 1456476 - RNA, 20 nt, Pseudomonas aeruginosa PA01
uccggugucaggccgagguu

SEQ ID NO: 1456477 - RNA, 19 nt, Pseudomonas aeruginosa PA01
uccgguucggcaaggcgca

SEQ ID NO: 1456478 - RNA, 21 nt, Pseudomonas aeruginosa PA01
ucgaccugcggguuggucggc

SEQ ID NO: 1456479 - RNA, 16 nt, Pseudomonas aeruginosa PA01
ucgaccuggccacgcc

SEQ ID NO: 1456480 - RNA, 17 nt, Pseudomonas aeruginosa PA01
ucgaccuggcuccacug

SEQ ID NO: 1456481 - RNA, 18 nt, Pseudomonas aeruginosa PA01
ucgaccuggguaccgacg

SEQ ID NO: 1456482 - RNA, 21 nt, Pseudomonas aeruginosa PA01
ucgaccuggguaccgacgguc

SEQ ID NO: 1456483 - RNA, 17 nt, Pseudomonas aeruginosa PA01
ucgaccugguagccgaa

SEQ ID NO: 1456484 - RNA, 14 nt, Pseudomonas aeruginosa PA01
ucgaccuccaggcc

SEQ ID NO: 1456485 - RNA, 16 nt, Pseudomonas aeruginosa PA01
ucgaccuccaggccga

SEQ ID NO: 1456486 - RNA, 17 nt, Pseudomonas aeruginosa PA01
ucgaccuccaggccgaa

SEQ ID NO: 1456487 - RNA, 17 nt, Pseudomonas aeruginosa PA01
ucgaccucgauggcgau

SEQ ID NO: 1456488 - RNA, 15 nt, Pseudomonas aeruginosa PA01
ucgaccucgcgggcg

SEQ ID NO: 1456489 - RNA, 16 nt, Pseudomonas aeruginosa PA01
ucgaccggcgcgccuu

SEQ ID NO: 1456490 - RNA, 22 nt, Pseudomonas aeruginosa PA01
ucgaccggaaucacgucgaucu

SEQ ID NO: 1456491 - RNA, 18 nt, Pseudomonas aeruginosa PA01
ucgaccgcgccggcgaua

SEQ ID NO: 1456492 - RNA, 23 nt, Pseudomonas aeruginosa PA01
ucgacgaaggcgcgcucgaucag

SEQ ID NO: 1456493 - RNA, 17 nt, Pseudomonas aeruginosa PA01
ucgacgaagggcucagc

SEQ ID NO: 1456494 - RNA, 21 nt, Pseudomonas aeruginosa PA01
ucgacgaacucgacgcgccag

SEQ ID NO: 1456495 - RNA, 22 nt, Pseudomonas aeruginosa PA01
ucgacgaacucgacgcgccagg

SEQ ID NO: 1456496 - RNA, 18 nt, Pseudomonas aeruginosa PA01
ucgaccuugcccucggcg

SEQ ID NO: 1456497 - RNA, 20 nt, Pseudomonas aeruginosa PA01
ucgaccuugccgacgccgcg

SEQ ID NO: 1456498 - RNA, 23 nt, Pseudomonas aeruginosa PA01
ucgaccuugccgagcgcgaucag

SEQ ID NO: 1456499 - RNA, 19 nt, Pseudomonas aeruginosa PA01
ucgacgacgaaaggccgcg

SEQ ID NO: 1456500 - RNA, 20 nt, Pseudomonas aeruginosa PA01
ucgacgacgaaaggccgcgc

SEQ ID NO: 1456501 - RNA, 23 nt, Pseudomonas aeruginosa PA01
ucgacgacgaaaggccgcgccgg

SEQ ID NO: 1456502 - RNA, 19 nt, Pseudomonas aeruginosa PA01
ucgacgaugcugaacuguu

SEQ ID NO: 1456503 - RNA, 20 nt, Pseudomonas aeruginosa PA01
ucgacccgcccgccguccuc

SEQ ID NO: 1456504 - RNA, 22 nt, Pseudomonas aeruginosa PA01
ucgacccgccgaccagcacggc

SEQ ID NO: 1456505 - RNA, 23 nt, Pseudomonas aeruginosa PA01
ucgacccgccgaccagcacggcg

SEQ ID NO: 1456506 - RNA, 20 nt, Pseudomonas aeruginosa PA01
ucgacccgguuaccggcgac

SEQ ID NO: 1456507 - RNA, 16 nt, Pseudomonas aeruginosa PA01
ucgacccuggcgccga

SEQ ID NO: 1456508 - RNA, 17 nt, Pseudomonas aeruginosa PA01
ucgacccuggcgccgac

SEQ ID NO: 1456509 - RNA, 16 nt, Pseudomonas aeruginosa PA01
ucgaccccgccggggc

SEQ ID NO: 1456510 - RNA, 23 nt, Pseudomonas aeruginosa PA01
ucgaccccgccggggcgugcagg

SEQ ID NO: 1456511 - RNA, 18 nt, Pseudomonas aeruginosa PA01
ucgacccagccgcacgcc

SEQ ID NO: 1456512 - RNA, 15 nt, Pseudomonas aeruginosa PA01
ucgacccaggcccag

SEQ ID NO: 1456513 - RNA, 18 nt, Pseudomonas aeruginosa PA01
ucgaccaucggcggcggc

SEQ ID NO: 1456514 - RNA, 20 nt, Pseudomonas aeruginosa PA01
ucgaccaugguguuggcggc

SEQ ID NO: 1456515 - RNA, 18 nt, Pseudomonas aeruginosa PA01
ucgaccaggucgccaugc

SEQ ID NO: 1456516 - RNA, 18 nt, Pseudomonas aeruginosa PA01
ucgacaugcaccaggccg

SEQ ID NO: 1456517 - RNA, 15 nt, Pseudomonas aeruginosa PA01
ucgaccagggccggg

SEQ ID NO: 1456518 - RNA, 22 nt, Pseudomonas aeruginosa PA01
ucgaccaggcguuccaccaggc

SEQ ID NO: 1456519 - RNA, 15 nt, Pseudomonas aeruginosa PA01
ucgaccagcagcggc

SEQ ID NO: 1456520 - RNA, 13 nt, Pseudomonas aeruginosa PA01
ucgaccagcggcg

SEQ ID NO: 1456521 - RNA, 16 nt, Pseudomonas aeruginosa PA01
ucgaccagcggcggua

SEQ ID NO: 1456522 - RNA, 23 nt, Pseudomonas aeruginosa PA01
ucgaccagcggcgguagcuccag

SEQ ID NO: 1456523 - RNA, 23 nt, Pseudomonas aeruginosa PA01
ucgaccaggaauuccuggccggu

SEQ ID NO: 1456524 - RNA, 20 nt, Pseudomonas aeruginosa PA01
ucgacaucgucucgcgacac

SEQ ID NO: 1456525 - RNA, 16 nt, Pseudomonas aeruginosa PA01
ucgacaugggccgcgc

SEQ ID NO: 1456526 - RNA, 18 nt, Pseudomonas aeruginosa PA01
ucgacaugggccgcgcag

SEQ ID NO: 1456527 - RNA, 19 nt, Pseudomonas aeruginosa PA01
ucgacaucgauaacaccag

SEQ ID NO: 1456528 - RNA, 15 nt, Pseudomonas aeruginosa PA01
ucgacauugcugccg

SEQ ID NO: 1456529 - RNA, 17 nt, Pseudomonas aeruginosa PA01
ucgacauugcugccgag

SEQ ID NO: 1456530 - RNA, 14 nt, Pseudomonas aeruginosa PA01
ucgaccaccgcgug

SEQ ID NO: 1456531 - RNA, 17 nt, Pseudomonas aeruginosa PA01
ucgaaggguuggccgca

SEQ ID NO: 1456532 - RNA, 16 nt, Pseudomonas aeruginosa PA01
ucgaagguagcggucg

SEQ ID NO: 1456533 - RNA, 21 nt, Pseudomonas aeruginosa PA01
ucgaaggucugcccguggcgc

SEQ ID NO: 1456534 - RNA, 18 nt, Pseudomonas aeruginosa PA01
ucgaaguacaccuuggcg

SEQ ID NO: 1456535 - RNA, 22 nt, Pseudomonas aeruginosa PA01
ucgaaguacaccuuggcgcgac

SEQ ID NO: 1456536 - RNA, 15 nt, Pseudomonas aeruginosa PA01
ucgaaggcgcggcgg

SEQ ID NO: 1456537 - RNA, 16 nt, Pseudomonas aeruginosa PA01
ucgaaggcggcgcggc

SEQ ID NO: 1456538 - RNA, 18 nt, Pseudomonas aeruginosa PA01
ucgaaggcggcgcggcgg

SEQ ID NO: 1456539 - RNA, 20 nt, Pseudomonas aeruginosa PA01
ucgaagcggaucucgucgcc

SEQ ID NO: 1456540 - RNA, 17 nt, Pseudomonas aeruginosa PA01
ucgaagcucucgccgcg

SEQ ID NO: 1456541 - RNA, 14 nt, Pseudomonas aeruginosa PA01
ucgaagcuggccag

SEQ ID NO: 1456542 - RNA, 14 nt, Pseudomonas aeruginosa PA01
ucgaagcugucggc

SEQ ID NO: 1456543 - RNA, 17 nt, Pseudomonas aeruginosa PA01
ucgaagcugucggcccg

SEQ ID NO: 1456544 - RNA, 24 nt, Pseudomonas aeruginosa PA01
ucgaagcugucggcccgcgccaug

SEQ ID NO: 1456545 - RNA, 13 nt, Pseudomonas aeruginosa PA01
ucgaaggccagcu

SEQ ID NO: 1456546 - RNA, 14 nt, Pseudomonas aeruginosa PA01
ucgaaggccagcuc

SEQ ID NO: 1456547 - RNA, 17 nt, Pseudomonas aeruginosa PA01
ucgaaggccucggucag

SEQ ID NO: 1456548 - RNA, 14 nt, Pseudomonas aeruginosa PA01
ucgaaggccucguc

SEQ ID NO: 1456549 - RNA, 17 nt, Pseudomonas aeruginosa PA01
ucgaaggccucgucgcc

SEQ ID NO: 1456550 - RNA, 15 nt, Pseudomonas aeruginosa PA01
ucgaagcgcaguacc

SEQ ID NO: 1456551 - RNA, 20 nt, Pseudomonas aeruginosa PA01
ucgaagcgcaguacccggcc

SEQ ID NO: 1456552 - RNA, 13 nt, Pseudomonas aeruginosa PA01
ucgaagcgccagg

SEQ ID NO: 1456553 - RNA, 14 nt, Pseudomonas aeruginosa PA01
ucgaagcgccaggc

SEQ ID NO: 1456554 - RNA, 14 nt, Pseudomonas aeruginosa PA01
ucgaagcgcgccug

SEQ ID NO: 1456555 - RNA, 13 nt, Pseudomonas aeruginosa PA01
ucgaagcccagcg

SEQ ID NO: 1456556 - RNA, 17 nt, Pseudomonas aeruginosa PA01
ucgaagcccagcgccug

SEQ ID NO: 1456557 - RNA, 23 nt, Pseudomonas aeruginosa PA01
ucgaacgcuucuuguuccucguc

SEQ ID NO: 1456558 - RNA, 16 nt, Pseudomonas aeruginosa PA01
ucgaacgccaggcagg

SEQ ID NO: 1456559 - RNA, 12 nt, Pseudomonas aeruginosa PA01
ucgaacuggcca

SEQ ID NO: 1456560 - RNA, 15 nt, Pseudomonas aeruginosa PA01
ucgaacugaccacca

SEQ ID NO: 1456561 - RNA, 16 nt, Pseudomonas aeruginosa PA01
ucgaacugaccaccag

SEQ ID NO: 1456562 - RNA, 23 nt, Pseudomonas aeruginosa PA01
ucgaacugcacccgccgaccgga

SEQ ID NO: 1456563 - RNA, 20 nt, Pseudomonas aeruginosa PA01
ucgaagagcuggcggccgcg

SEQ ID NO: 1456564 - RNA, 17 nt, Pseudomonas aeruginosa PA01
ucgaagaccaggguggg

SEQ ID NO: 1456565 - RNA, 19 nt, Pseudomonas aeruginosa PA01
ucgaagacccccugccgcc

SEQ ID NO: 1456566 - RNA, 20 nt, Pseudomonas aeruginosa PA01
ucgaagacccccugccgccc

SEQ ID NO: 1456567 - RNA, 21 nt, Pseudomonas aeruginosa PA01
ucgaagacccccugccgcccu

SEQ ID NO: 1456568 - RNA, 16 nt, Pseudomonas aeruginosa PA01
ucgaagucgaucaccg

SEQ ID NO: 1456569 - RNA, 17 nt, Pseudomonas aeruginosa PA01
ucgaaguucuccagcaa

SEQ ID NO: 1456570 - RNA, 24 nt, Pseudomonas aeruginosa PA01
ucgaaguuggaaggaucgagccag

SEQ ID NO: 1456571 - RNA, 14 nt, Pseudomonas aeruginosa PA01
ucgaauggcgccgg

SEQ ID NO: 1456572 - RNA, 15 nt, Pseudomonas aeruginosa PA01
ucgaauggcgccggc

SEQ ID NO: 1456573 - RNA, 17 nt, Pseudomonas aeruginosa PA01
ucgaauuggacagcagg

SEQ ID NO: 1456574 - RNA, 19 nt, Pseudomonas aeruginosa PA01
ucgaauuggacagcaggcu

SEQ ID NO: 1456575 - RNA, 21 nt, Pseudomonas aeruginosa PA01
ucgacacugauauccgcucug

SEQ ID NO: 1456576 - RNA, 20 nt, Pseudomonas aeruginosa PA01
ucgacaccccggucaggccg

SEQ ID NO: 1456577 - RNA, 14 nt, Pseudomonas aeruginosa PA01
ucgacaccgaucac

SEQ ID NO: 1456578 - RNA, 15 nt, Pseudomonas aeruginosa PA01
ucgacaccgaucacc

SEQ ID NO: 1456579 - RNA, 16 nt, Pseudomonas aeruginosa PA01
ucgacaccgaucaccu

SEQ ID NO: 1456580 - RNA, 22 nt, Pseudomonas aeruginosa PA01
ucgacaccgaucaccuggccgg

SEQ ID NO: 1456581 - RNA, 16 nt, Pseudomonas aeruginosa PA01
ucgacaggucggcgaa

SEQ ID NO: 1456582 - RNA, 21 nt, Pseudomonas aeruginosa PA01
ucgacaggucggcgaaauccu

SEQ ID NO: 1456583 - RNA, 15 nt, Pseudomonas aeruginosa PA01
ucgacagcgcggauc

SEQ ID NO: 1456584 - RNA, 13 nt, Pseudomonas aeruginosa PA01
ucgacagcagcgc

SEQ ID NO: 1456585 - RNA, 14 nt, Pseudomonas aeruginosa PA01
ucgacagcagcgcc

SEQ ID NO: 1456586 - RNA, 17 nt, Pseudomonas aeruginosa PA01
ucgacagcagcgccagg

SEQ ID NO: 1456587 - RNA, 17 nt, Pseudomonas aeruginosa PA01
ucgacagcagguggcug

SEQ ID NO: 1456588 - RNA, 16 nt, Pseudomonas aeruginosa PA01
ucgacauacuccgccg

SEQ ID NO: 1456589 - RNA, 17 nt, Pseudomonas aeruginosa PA01
ucgacauagcgcagcac

SEQ ID NO: 1456590 - RNA, 19 nt, Pseudomonas aeruginosa PA01
uccugcaacugacggcgga

SEQ ID NO: 1456591 - RNA, 16 nt, Pseudomonas aeruginosa PA01
uccugcaacugcucga

SEQ ID NO: 1456592 - RNA, 20 nt, Pseudomonas aeruginosa PA01
uccugcaacuggaaggccgc

SEQ ID NO: 1456593 - RNA, 17 nt, Pseudomonas aeruginosa PA01
uccugaccguccuggcc

SEQ ID NO: 1456594 - RNA, 17 nt, Pseudomonas aeruginosa PA01
uccugauagggggcugc

SEQ ID NO: 1456595 - RNA, 19 nt, Pseudomonas aeruginosa PA01
uccugcaggcccugccagu

SEQ ID NO: 1456596 - RNA, 15 nt, Pseudomonas aeruginosa PA01
uccugcaggcucagc

SEQ ID NO: 1456597 - RNA, 22 nt, Pseudomonas aeruginosa PA01
uccugcagauaaagcuggacca

SEQ ID NO: 1456598 - RNA, 15 nt, Pseudomonas aeruginosa PA01
uccugccgcaggcgg

SEQ ID NO: 1456599 - RNA, 16 nt, Pseudomonas aeruginosa PA01
uccugccgcaggcggg

SEQ ID NO: 1456600 - RNA, 22 nt, Pseudomonas aeruginosa PA01
uccugcccgaccgguuccagcg

SEQ ID NO: 1456601 - RNA, 14 nt, Pseudomonas aeruginosa PA01
uccugccgcggcga

SEQ ID NO: 1456602 - RNA, 14 nt, Pseudomonas aeruginosa PA01
uccugcggaaacgg

SEQ ID NO: 1456603 - RNA, 14 nt, Pseudomonas aeruginosa PA01
uccugcgcggcgac

SEQ ID NO: 1456604 - RNA, 15 nt, Pseudomonas aeruginosa PA01
uccugcgcggcgacg

SEQ ID NO: 1456605 - RNA, 21 nt, Pseudomonas aeruginosa PA01
uccugcggauucaucggcggc

SEQ ID NO: 1456606 - RNA, 18 nt, Pseudomonas aeruginosa PA01
uccugcggccgcaaccag

SEQ ID NO: 1456607 - RNA, 13 nt, Pseudomonas aeruginosa PA01
uccugcggccggg

SEQ ID NO: 1456608 - RNA, 17 nt, Pseudomonas aeruginosa PA01
uccugcggcuggcgaac

SEQ ID NO: 1456609 - RNA, 16 nt, Pseudomonas aeruginosa PA01
uccugcggcuugccca

SEQ ID NO: 1456610 - RNA, 20 nt, Pseudomonas aeruginosa PA01
uccugcugggcgucgaacac

SEQ ID NO: 1456611 - RNA, 14 nt, Pseudomonas aeruginosa PA01
uccugcugcgacag

SEQ ID NO: 1456612 - RNA, 23 nt, Pseudomonas aeruginosa PA01
uccugcugcuggccuucgucggc

SEQ ID NO: 1456613 - RNA, 19 nt, Pseudomonas aeruginosa PA01
uccugcucagcggcccagc

SEQ ID NO: 1456614 - RNA, 17 nt, Pseudomonas aeruginosa PA01
uccugcuccuccgacgc

SEQ ID NO: 1456615 - RNA, 13 nt, Pseudomonas aeruginosa PA01
uccugcucgagau

SEQ ID NO: 1456616 - RNA, 13 nt, Pseudomonas aeruginosa PA01
uccucugccugcg

SEQ ID NO: 1456617 - RNA, 17 nt, Pseudomonas aeruginosa PA01
uccucggugcgcacgca

SEQ ID NO: 1456618 - RNA, 13 nt, Pseudomonas aeruginosa PA01
uccucgucgaggu

SEQ ID NO: 1456619 - RNA, 20 nt, Pseudomonas aeruginosa PA01
uccucgucgauccgcggauc

SEQ ID NO: 1456620 - RNA, 14 nt, Pseudomonas aeruginosa PA01
uccucgggcaccag

SEQ ID NO: 1456621 - RNA, 16 nt, Pseudomonas aeruginosa PA01
uccucgggcaccagca

SEQ ID NO: 1456622 - RNA, 21 nt, Pseudomonas aeruginosa PA01
uccucgggcaccagcacggug

SEQ ID NO: 1456623 - RNA, 24 nt, Pseudomonas aeruginosa PA01
uccucgggcggaucgagcagcggc

SEQ ID NO: 1456624 - RNA, 16 nt, Pseudomonas aeruginosa PA01
uccucguccgacagca

SEQ ID NO: 1456625 - RNA, 17 nt, Pseudomonas aeruginosa PA01
uccucgucguacuggcg

SEQ ID NO: 1456626 - RNA, 15 nt, Pseudomonas aeruginosa PA01
uccucgaucacccgc

SEQ ID NO: 1456627 - RNA, 13 nt, Pseudomonas aeruginosa PA01
uccucgccccgcc

SEQ ID NO: 1456628 - RNA, 14 nt, Pseudomonas aeruginosa PA01
uccucgccgccgac

SEQ ID NO: 1456629 - RNA, 15 nt, Pseudomonas aeruginosa PA01
uccucgccgcugcug

SEQ ID NO: 1456630 - RNA, 16 nt, Pseudomonas aeruginosa PA01
uccucgccgcuggcgc

SEQ ID NO: 1456631 - RNA, 16 nt, Pseudomonas aeruginosa PA01
uccucggcagcgcugg

SEQ ID NO: 1456632 - RNA, 17 nt, Pseudomonas aeruginosa PA01
uccucggcagcgcuggc

SEQ ID NO: 1456633 - RNA, 13 nt, Pseudomonas aeruginosa PA01
uccucggcaucca

SEQ ID NO: 1456634 - RNA, 18 nt, Pseudomonas aeruginosa PA01
uccucggccaacggccgc

SEQ ID NO: 1456635 - RNA, 22 nt, Pseudomonas aeruginosa PA01
uccucgcgcugcccggcgcgac

SEQ ID NO: 1456636 - RNA, 16 nt, Pseudomonas aeruginosa PA01
uccucgcggaagucgg

SEQ ID NO: 1456637 - RNA, 15 nt, Pseudomonas aeruginosa PA01
uccucgcgcagcggc

SEQ ID NO: 1456638 - RNA, 14 nt, Pseudomonas aeruginosa PA01
uccucgccucgcgc

SEQ ID NO: 1456639 - RNA, 19 nt, Pseudomonas aeruginosa PA01
uccucggccaugccggcca

SEQ ID NO: 1456640 - RNA, 12 nt, Pseudomonas aeruginosa PA01
uccucggccgac

SEQ ID NO: 1456641 - RNA, 13 nt, Pseudomonas aeruginosa PA01
uccucggccgaca

SEQ ID NO: 1456642 - RNA, 14 nt, Pseudomonas aeruginosa PA01
uccucggccgccag

SEQ ID NO: 1456643 - RNA, 14 nt, Pseudomonas aeruginosa PA01
uccucggccuugcu

SEQ ID NO: 1456644 - RNA, 21 nt, Pseudomonas aeruginosa PA01
uccucggccuugcuggcgaca

SEQ ID NO: 1456645 - RNA, 21 nt, Pseudomonas aeruginosa PA01
uccucggcgaacuccgccagc

SEQ ID NO: 1456646 - RNA, 17 nt, Pseudomonas aeruginosa PA01
uccucggcguagccggc

SEQ ID NO: 1456647 - RNA, 15 nt, Pseudomonas aeruginosa PA01
ucgaaaugccgcacc

SEQ ID NO: 1456648 - RNA, 18 nt, Pseudomonas aeruginosa PA01
ucgaaaugcucgugcagg

SEQ ID NO: 1456649 - RNA, 17 nt, Pseudomonas aeruginosa PA01
ucgaacacuugaccguc

SEQ ID NO: 1456650 - RNA, 19 nt, Pseudomonas aeruginosa PA01
ucgaacagcaccgagcagg

SEQ ID NO: 1456651 - RNA, 22 nt, Pseudomonas aeruginosa PA01
ucgaacaaucccagcucgccga

SEQ ID NO: 1456652 - RNA, 17 nt, Pseudomonas aeruginosa PA01
ucgaacaccaggcgcca

SEQ ID NO: 1456653 - RNA, 21 nt, Pseudomonas aeruginosa PA01
ucgaaagccgccgccgcgccg

SEQ ID NO: 1456654 - RNA, 15 nt, Pseudomonas aeruginosa PA01
ucgaaagccugccgg

SEQ ID NO: 1456655 - RNA, 21 nt, Pseudomonas aeruginosa PA01
ucgaaagcuucgucgcgcagg

SEQ ID NO: 1456656 - RNA, 22 nt, Pseudomonas aeruginosa PA01
ucgaacagcagcaagccgauga

SEQ ID NO: 1456657 - RNA, 20 nt, Pseudomonas aeruginosa PA01
ucgaacagcagcucgccgcu

SEQ ID NO: 1456658 - RNA, 15 nt, Pseudomonas aeruginosa PA01
ucgaacaucagcagc

SEQ ID NO: 1456659 - RNA, 18 nt, Pseudomonas aeruginosa PA01
ucgaaccccuggcgcucg

SEQ ID NO: 1456660 - RNA, 20 nt, Pseudomonas aeruginosa PA01
ucgaaccguggcggccgccg

SEQ ID NO: 1456661 - RNA, 20 nt, Pseudomonas aeruginosa PA01
ucgaaacgcuggcggccgag

SEQ ID NO: 1456662 - RNA, 22 nt, Pseudomonas aeruginosa PA01
ucgaaacgggcgcucuggccgc

SEQ ID NO: 1456663 - RNA, 20 nt, Pseudomonas aeruginosa PA01
ucgaaaaaaggcgccuucgg

SEQ ID NO: 1456664 - RNA, 19 nt, Pseudomonas aeruginosa PA01
uccugugcgaggcuggccu

SEQ ID NO: 1456665 - RNA, 19 nt, Pseudomonas aeruginosa PA01
uccugucgaggccucgucg

SEQ ID NO: 1456666 - RNA, 13 nt, Pseudomonas aeruginosa PA01
uccuguucgucgc

SEQ ID NO: 1456667 - RNA, 23 nt, Pseudomonas aeruginosa PA01
uccuuccaggguuuccagcagca

SEQ ID NO: 1456668 - RNA, 24 nt, Pseudomonas aeruginosa PA01
uccuucgcggcggcgcgucggugc

SEQ ID NO: 1456669 - RNA, 16 nt, Pseudomonas aeruginosa PA01
uccuucggccgcacca

SEQ ID NO: 1456670 - RNA, 17 nt, Pseudomonas aeruginosa PA01
uccuucggccgcaccag

SEQ ID NO: 1456671 - RNA, 15 nt, Pseudomonas aeruginosa PA01
uccuucucgaagccg

SEQ ID NO: 1456672 - RNA, 16 nt, Pseudomonas aeruginosa PA01
uccuugagcgccagca

SEQ ID NO: 1456673 - RNA, 14 nt, Pseudomonas aeruginosa PA01
uccuugcccggcgc

SEQ ID NO: 1456674 - RNA, 19 nt, Pseudomonas aeruginosa PA01
uccuugauccacucgcccu

SEQ ID NO: 1456675 - RNA, 14 nt, Pseudomonas aeruginosa PA01
uccugggccgacgc

SEQ ID NO: 1456676 - RNA, 19 nt, Pseudomonas aeruginosa PA01
uccuggguauagaccagca

SEQ ID NO: 1456677 - RNA, 22 nt, Pseudomonas aeruginosa PA01
uccuggguauagaccagcaccg

SEQ ID NO: 1456678 - RNA, 21 nt, Pseudomonas aeruginosa PA01
uccugggcgauuuccaccggc

SEQ ID NO: 1456679 - RNA, 22 nt, Pseudomonas aeruginosa PA01
uccugggcgauuuccaccggca

SEQ ID NO: 1456680 - RNA, 15 nt, Pseudomonas aeruginosa PA01
uccugggcgccagcc

SEQ ID NO: 1456681 - RNA, 15 nt, Pseudomonas aeruginosa PA01
uccugggcggcaacu

SEQ ID NO: 1456682 - RNA, 19 nt, Pseudomonas aeruginosa PA01
uccugggcggucucggcgg

SEQ ID NO: 1456683 - RNA, 19 nt, Pseudomonas aeruginosa PA01
uccugggcgugcuuggcga

SEQ ID NO: 1456684 - RNA, 16 nt, Pseudomonas aeruginosa PA01
uccugggcuucguccg

SEQ ID NO: 1456685 - RNA, 22 nt, Pseudomonas aeruginosa PA01
uccuggguagauuuacaagccc

SEQ ID NO: 1456686 - RNA, 12 nt, Pseudomonas aeruginosa PA01
uccugggugccg

SEQ ID NO: 1456687 - RNA, 15 nt, Pseudomonas aeruginosa PA01
uccugguccagccag

SEQ ID NO: 1456688 - RNA, 19 nt, Pseudomonas aeruginosa PA01
uccugguacucguccuccc

SEQ ID NO: 1456689 - RNA, 21 nt, Pseudomonas aeruginosa PA01
uccuggugaucaucguccugc

SEQ ID NO: 1456690 - RNA, 17 nt, Pseudomonas aeruginosa PA01
uccuggugcggcaccag

SEQ ID NO: 1456691 - RNA, 20 nt, Pseudomonas aeruginosa PA01
uccuggucgagcuuguuggc

SEQ ID NO: 1456692 - RNA, 20 nt, Pseudomonas aeruginosa PA01
uccuggacccguugccgacc

SEQ ID NO: 1456693 - RNA, 16 nt, Pseudomonas aeruginosa PA01
uccuggaaagaccggc

SEQ ID NO: 1456694 - RNA, 17 nt, Pseudomonas aeruginosa PA01
uccuggaaagaccggcg

SEQ ID NO: 1456695 - RNA, 19 nt, Pseudomonas aeruginosa PA01
uccuggaagaacaggcgcu

SEQ ID NO: 1456696 - RNA, 21 nt, Pseudomonas aeruginosa PA01
uccuggauaagccgcgccauc

SEQ ID NO: 1456697 - RNA, 19 nt, Pseudomonas aeruginosa PA01
uccuggauacgcucggcca

SEQ ID NO: 1456698 - RNA, 22 nt, Pseudomonas aeruginosa PA01
uccuggccgggggucgcggcga

SEQ ID NO: 1456699 - RNA, 18 nt, Pseudomonas aeruginosa PA01
uccuggcgguagcccggc

SEQ ID NO: 1456700 - RNA, 20 nt, Pseudomonas aeruginosa PA01
uccuggccgacccgcagcgg

SEQ ID NO: 1456701 - RNA, 13 nt, Pseudomonas aeruginosa PA01
uccuggccgagcc

SEQ ID NO: 1456702 - RNA, 12 nt, Pseudomonas aeruginosa PA01
uccuggcgcgag

SEQ ID NO: 1456703 - RNA, 23 nt, Pseudomonas aeruginosa PA01
uccuggcgcgagaagccagccag

SEQ ID NO: 1456704 - RNA, 13 nt, Pseudomonas aeruginosa PA01
uccuggcgcgcgg

SEQ ID NO: 1456705 - RNA, 19 nt, Pseudomonas aeruginosa PA01
uccuggcgcguacgcccgc

SEQ ID NO: 1456706 - RNA, 21 nt, Pseudomonas aeruginosa PA01
uccuggcgcgucaugccgccg

SEQ ID NO: 1456707 - RNA, 22 nt, Pseudomonas aeruginosa PA01
uccuggcgcgucaugccgccgu

SEQ ID NO: 1456708 - RNA, 17 nt, Pseudomonas aeruginosa PA01
uccuggcgcgucggccg

SEQ ID NO: 1456709 - RNA, 21 nt, Pseudomonas aeruginosa PA01
uaccucgaagcccagcgccug

SEQ ID NO: 1456710 - RNA, 20 nt, Pseudomonas aeruginosa PA01
uaccucgugggugccggggg

SEQ ID NO: 1456711 - RNA, 14 nt, Pseudomonas aeruginosa PA01
uaccucuggcugaa

SEQ ID NO: 1456712 - RNA, 16 nt, Pseudomonas aeruginosa PA01
uaccugcaaggcggug

SEQ ID NO: 1456713 - RNA, 20 nt, Pseudomonas aeruginosa PA01
uaccuggguugccgcgccga

SEQ ID NO: 1456714 - RNA, 16 nt, Pseudomonas aeruginosa PA01
uaccuucgagcaggag

SEQ ID NO: 1456715 - RNA, 14 nt, Pseudomonas aeruginosa PA01
uaccuugagcaggg

SEQ ID NO: 1456716 - RNA, 19 nt, Pseudomonas aeruginosa PA01
uacgaaaaaaaggcgcugc

SEQ ID NO: 1456717 - RNA, 23 nt, Pseudomonas aeruginosa PA01
uacgaaaaagccccugcgccuca

SEQ ID NO: 1456718 - RNA, 15 nt, Pseudomonas aeruginosa PA01
uacggcaccaccacc

SEQ ID NO: 1456719 - RNA, 16 nt, Pseudomonas aeruginosa PA01
uacggcaucaccggcg

SEQ ID NO: 1456720 - RNA, 12 nt, Pseudomonas aeruginosa PA01
uacgcuuggcca

SEQ ID NO: 1456721 - RNA, 21 nt, Pseudomonas aeruginosa PA01
uacgcuuggccaggucgucgc

SEQ ID NO: 1456722 - RNA, 15 nt, Pseudomonas aeruginosa PA01
uacggaagcggccga

SEQ ID NO: 1456723 - RNA, 14 nt, Pseudomonas aeruginosa PA01
uacggaaggucgcc

SEQ ID NO: 1456724 - RNA, 19 nt, Pseudomonas aeruginosa PA01
uacgcugcauguccgcagg

SEQ ID NO: 1456725 - RNA, 12 nt, Pseudomonas aeruginosa PA01
uacgcucggcgu

SEQ ID NO: 1456726 - RNA, 20 nt, Pseudomonas aeruginosa PA01
uacgcuccggugccagggcg

SEQ ID NO: 1456727 - RNA, 21 nt, Pseudomonas aeruginosa PA01
uacgcuccguagggcgacgcc

SEQ ID NO: 1456728 - RNA, 17 nt, Pseudomonas aeruginosa PA01
uacgcggcaccgcuuuc

SEQ ID NO: 1456729 - RNA, 13 nt, Pseudomonas aeruginosa PA01
uacgacuucggcg

SEQ ID NO: 1456730 - RNA, 20 nt, Pseudomonas aeruginosa PA01
uacgcguacgacuucggcga

SEQ ID NO: 1456731 - RNA, 17 nt, Pseudomonas aeruginosa PA01
uacgccuugcggcgccg

SEQ ID NO: 1456732 - RNA, 19 nt, Pseudomonas aeruginosa PA01
uacggguggcaugggccag

SEQ ID NO: 1456733 - RNA, 23 nt, Pseudomonas aeruginosa PA01
uacggucaugccgaacuucuccg

SEQ ID NO: 1456734 - RNA, 13 nt, Pseudomonas aeruginosa PA01
uacggcgcagcag

SEQ ID NO: 1456735 - RNA, 17 nt, Pseudomonas aeruginosa PA01
uacggcgcagcagggcg

SEQ ID NO: 1456736 - RNA, 17 nt, Pseudomonas aeruginosa PA01
uacggcuccggcuccgc

SEQ ID NO: 1456737 - RNA, 15 nt, Pseudomonas aeruginosa PA01
uacucaugaccgccg

SEQ ID NO: 1456738 - RNA, 15 nt, Pseudomonas aeruginosa PA01
uacgugauccguggc

SEQ ID NO: 1456739 - RNA, 19 nt, Pseudomonas aeruginosa PA01
uacgugauccguggcgagc

SEQ ID NO: 1456740 - RNA, 14 nt, Pseudomonas aeruginosa PA01
uacguacucgucgc

SEQ ID NO: 1456741 - RNA, 23 nt, Pseudomonas aeruginosa PA01
uacgucuucgauggcggccgcca

SEQ ID NO: 1456742 - RNA, 14 nt, Pseudomonas aeruginosa PA01
uagaaacgcgccuc

SEQ ID NO: 1456743 - RNA, 15 nt, Pseudomonas aeruginosa PA01
uagaacggcggcaac

SEQ ID NO: 1456744 - RNA, 15 nt, Pseudomonas aeruginosa PA01
uacucggcuacgaac

SEQ ID NO: 1456745 - RNA, 18 nt, Pseudomonas aeruginosa PA01
uacucggcuacgaaccga

SEQ ID NO: 1456746 - RNA, 20 nt, Pseudomonas aeruginosa PA01
uacucggcccgggccuggug

SEQ ID NO: 1456747 - RNA, 15 nt, Pseudomonas aeruginosa PA01
uaggacaccgcccuu

SEQ ID NO: 1456748 - RNA, 13 nt, Pseudomonas aeruginosa PA01
uaggacaggccga

SEQ ID NO: 1456749 - RNA, 15 nt, Pseudomonas aeruginosa PA01
uaggacagggccagg

SEQ ID NO: 1456750 - RNA, 19 nt, Pseudomonas aeruginosa PA01
uaggacgaacaaccgcuug

SEQ ID NO: 1456751 - RNA, 18 nt, Pseudomonas aeruginosa PA01
uaggacgccucgucggag

SEQ ID NO: 1456752 - RNA, 22 nt, Pseudomonas aeruginosa PA01
uaggaucgcuauccaccgucgc

SEQ ID NO: 1456753 - RNA, 16 nt, Pseudomonas aeruginosa PA01
uaggccagcaccucga

SEQ ID NO: 1456754 - RNA, 18 nt, Pseudomonas aeruginosa PA01
uaggccagcaccucgacg

SEQ ID NO: 1456755 - RNA, 13 nt, Pseudomonas aeruginosa PA01
uaggccagcggcu

SEQ ID NO: 1456756 - RNA, 23 nt, Pseudomonas aeruginosa PA01
uaggccagcggcuccucggccug

SEQ ID NO: 1456757 - RNA, 15 nt, Pseudomonas aeruginosa PA01
uaggccaugaucauc

SEQ ID NO: 1456758 - RNA, 22 nt, Pseudomonas aeruginosa PA01
uaggcacaggacccuuccagcg

SEQ ID NO: 1456759 - RNA, 21 nt, Pseudomonas aeruginosa PA01
uaggcaucgacgccagcggcg

SEQ ID NO: 1456760 - RNA, 13 nt, Pseudomonas aeruginosa PA01
uagcuggcgcagg

SEQ ID NO: 1456761 - RNA, 17 nt, Pseudomonas aeruginosa PA01
uagcugaucucggcgac

SEQ ID NO: 1456762 - RNA, 13 nt, Pseudomonas aeruginosa PA01
uagcugcgcgccu

SEQ ID NO: 1456763 - RNA, 16 nt, Pseudomonas aeruginosa PA01
uagcugaggccguagc

SEQ ID NO: 1456764 - RNA, 15 nt, Pseudomonas aeruginosa PA01
uaggcgacgaucagc

SEQ ID NO: 1456765 - RNA, 16 nt, Pseudomonas aeruginosa PA01
uaggcgacgaucagcc

SEQ ID NO: 1456766 - RNA, 17 nt, Pseudomonas aeruginosa PA01
uaggcgcaccaggccag

SEQ ID NO: 1456767 - RNA, 18 nt, Pseudomonas aeruginosa PA01
uaggccucgaugaucgcc

SEQ ID NO: 1456768 - RNA, 16 nt, Pseudomonas aeruginosa PA01
uaggccugguagaucu

SEQ ID NO: 1456769 - RNA, 16 nt, Pseudomonas aeruginosa PA01
uaggccuuggcgaucu

SEQ ID NO: 1456770 - RNA, 21 nt, Pseudomonas aeruginosa PA01
uaggccgcuuccggcccggcc

SEQ ID NO: 1456771 - RNA, 12 nt, Pseudomonas aeruginosa PA01
uaggccaggcaa

SEQ ID NO: 1456772 - RNA, 22 nt, Pseudomonas aeruginosa PA01
uaggccaggcagaccagcgcaa

SEQ ID NO: 1456773 - RNA, 23 nt, Pseudomonas aeruginosa PA01
uagggcgcauaacgccaacggcg

SEQ ID NO: 1456774 - RNA, 14 nt, Pseudomonas aeruginosa PA01
uagggcgacgcccg

SEQ ID NO: 1456775 - RNA, 19 nt, Pseudomonas aeruginosa PA01
uagggcgaauaaccgcauc

SEQ ID NO: 1456776 - RNA, 22 nt, Pseudomonas aeruginosa PA01
uagggcgaauaaccgcaucgcg

SEQ ID NO: 1456777 - RNA, 21 nt, Pseudomonas aeruginosa PA01
uagggcgaauagcgccgcagg

SEQ ID NO: 1456778 - RNA, 18 nt, Pseudomonas aeruginosa PA01
uagggcaucgccgacagg

SEQ ID NO: 1456779 - RNA, 21 nt, Pseudomonas aeruginosa PA01
uaggcgcugcaaucgcugccg

SEQ ID NO: 1456780 - RNA, 22 nt, Pseudomonas aeruginosa PA01
uaggcgcugcgguaccagcgca

SEQ ID NO: 1456781 - RNA, 14 nt, Pseudomonas aeruginosa PA01
uaggcgcuggugcu

SEQ ID NO: 1456782 - RNA, 19 nt, Pseudomonas aeruginosa PA01
uaggcggauaacgccagga

SEQ ID NO: 1456783 - RNA, 22 nt, Pseudomonas aeruginosa PA01
uaggcgcgcaacgcuuccagca

SEQ ID NO: 1456784 - RNA, 17 nt, Pseudomonas aeruginosa PA01
uaggcgcgggcggcggc

SEQ ID NO: 1456785 - RNA, 18 nt, Pseudomonas aeruginosa PA01
uaggcgcgggcggcggcg

SEQ ID NO: 1456786 - RNA, 13 nt, Pseudomonas aeruginosa PA01
uaggcgccagccu

SEQ ID NO: 1456787 - RNA, 14 nt, Pseudomonas aeruginosa PA01
uaggcguccuggcg

SEQ ID NO: 1456788 - RNA, 15 nt, Pseudomonas aeruginosa PA01
uaggcgguggcgauc

SEQ ID NO: 1456789 - RNA, 19 nt, Pseudomonas aeruginosa PA01
uagggacggugcaggccga

SEQ ID NO: 1456790 - RNA, 13 nt, Pseudomonas aeruginosa PA01
uagcgcuccucgc

SEQ ID NO: 1456791 - RNA, 19 nt, Pseudomonas aeruginosa PA01
uagcgcgcuguagccggcg

SEQ ID NO: 1456792 - RNA, 20 nt, Pseudomonas aeruginosa PA01
uagcgcgcuguagccggcgc

SEQ ID NO: 1456793 - RNA, 17 nt, Pseudomonas aeruginosa PA01
uagccugcggccagcgc

SEQ ID NO: 1456794 - RNA, 19 nt, Pseudomonas aeruginosa PA01
uagcgccccggccgcgcca

SEQ ID NO: 1456795 - RNA, 21 nt, Pseudomonas aeruginosa PA01
uagcgccccggccgcgccagc

SEQ ID NO: 1456796 - RNA, 22 nt, Pseudomonas aeruginosa PA01
uagcgccccggccgcgccagcc

SEQ ID NO: 1456797 - RNA, 13 nt, Pseudomonas aeruginosa PA01
uagcguccagcuc

SEQ ID NO: 1456798 - RNA, 12 nt, Pseudomonas aeruginosa PA01
uagcgugccgcc

SEQ ID NO: 1456799 - RNA, 15 nt, Pseudomonas aeruginosa PA01
uagcguugcgccaga

SEQ ID NO: 1456800 - RNA, 22 nt, Pseudomonas aeruginosa PA01
uagcguugcgccagaccagccc

SEQ ID NO: 1456801 - RNA, 23 nt, Pseudomonas aeruginosa PA01
uagcggaagcacggcucggcgag

SEQ ID NO: 1456802 - RNA, 16 nt, Pseudomonas aeruginosa PA01
uagcggucgugcagca

SEQ ID NO: 1456803 - RNA, 17 nt, Pseudomonas aeruginosa PA01
uagcggucgugcagcag

SEQ ID NO: 1456804 - RNA, 19 nt, Pseudomonas aeruginosa PA01
uagcggucgugcagcagcg

SEQ ID NO: 1456805 - RNA, 20 nt, Pseudomonas aeruginosa PA01
uagcgcuucccgcggcucca

SEQ ID NO: 1456806 - RNA, 14 nt, Pseudomonas aeruginosa PA01
uagccgcgccggcc

SEQ ID NO: 1456807 - RNA, 18 nt, Pseudomonas aeruginosa PA01
uagccgcgccggccgucc

SEQ ID NO: 1456808 - RNA, 15 nt, Pseudomonas aeruginosa PA01
uagccgcgcgccagc

SEQ ID NO: 1456809 - RNA, 22 nt, Pseudomonas aeruginosa PA01
uagaucgcccgcaguuccucgc

SEQ ID NO: 1456810 - RNA, 23 nt, Pseudomonas aeruginosa PA01
uagaugccacugacgcgcagcgc

SEQ ID NO: 1456811 - RNA, 18 nt, Pseudomonas aeruginosa PA01
uagaugccggccucgacg

SEQ ID NO: 1456812 - RNA, 20 nt, Pseudomonas aeruginosa PA01
uagccggccaaccaccggcg

SEQ ID NO: 1456813 - RNA, 18 nt, Pseudomonas aeruginosa PA01
uagccggcgaaccaggcg

SEQ ID NO: 1456814 - RNA, 19 nt, Pseudomonas aeruginosa PA01
uagccggcgaaccaggcgg

SEQ ID NO: 1456815 - RNA, 17 nt, Pseudomonas aeruginosa PA01
uagccggacuccgacgc

SEQ ID NO: 1456816 - RNA, 19 nt, Pseudomonas aeruginosa PA01
uagccggaaaacagcgagc

SEQ ID NO: 1456817 - RNA, 17 nt, Pseudomonas aeruginosa PA01
uagccggcgauccgcug

SEQ ID NO: 1456818 - RNA, 12 nt, Pseudomonas aeruginosa PA01
uagccggcgaug

SEQ ID NO: 1456819 - RNA, 14 nt, Pseudomonas aeruginosa PA01
uagccggcgaugcc

SEQ ID NO: 1456820 - RNA, 17 nt, Pseudomonas aeruginosa PA01
uagccggcgaugccgcc

SEQ ID NO: 1456821 - RNA, 16 nt, Pseudomonas aeruginosa PA01
uagccggcgaugugcg

SEQ ID NO: 1456822 - RNA, 12 nt, Pseudomonas aeruginosa PA01
uagccggcgcgg

SEQ ID NO: 1456823 - RNA, 15 nt, Pseudomonas aeruginosa PA01
uagccggcgcggcgc

SEQ ID NO: 1456824 - RNA, 16 nt, Pseudomonas aeruginosa PA01
uagccggcuuccucgc

SEQ ID NO: 1456825 - RNA, 20 nt, Pseudomonas aeruginosa PA01
uagccggcuuccucgcccuc

SEQ ID NO: 1456826 - RNA, 15 nt, Pseudomonas aeruginosa PA01
uagccggggccguuc

SEQ ID NO: 1456827 - RNA, 17 nt, Pseudomonas aeruginosa PA01
uagccguugaggccguc

SEQ ID NO: 1456828 - RNA, 16 nt, Pseudomonas aeruginosa PA01
uagccguugucgguga

SEQ ID NO: 1456829 - RNA, 19 nt, Pseudomonas aeruginosa PA01
uagccgucgaacagcagcu

SEQ ID NO: 1456830 - RNA, 19 nt, Pseudomonas aeruginosa PA01
uagccgucguagcgcagcg

SEQ ID NO: 1456831 - RNA, 22 nt, Pseudomonas aeruginosa PA01
uagccgucguagcgcagcggca

SEQ ID NO: 1456832 - RNA, 14 nt, Pseudomonas aeruginosa PA01
uagccguucgacgc

SEQ ID NO: 1456833 - RNA, 19 nt, Pseudomonas aeruginosa PA01
uagccguucgacgcugcua

SEQ ID NO: 1456834 - RNA, 14 nt, Pseudomonas aeruginosa PA01
uagccucaguaccu

SEQ ID NO: 1456835 - RNA, 22 nt, Pseudomonas aeruginosa PA01
uauuggucaccacguugcgccg

SEQ ID NO: 1456836 - RNA, 20 nt, Pseudomonas aeruginosa PA01
uauggccgacccgugcgccg

SEQ ID NO: 1456837 - RNA, 20 nt, Pseudomonas aeruginosa PA01
uauggcgggccuugcgacca

SEQ ID NO: 1456838 - RNA, 15 nt, Pseudomonas aeruginosa PA01
uauggcugcugugcg

SEQ ID NO: 1456839 - RNA, 22 nt, Pseudomonas aeruginosa PA01
uauccaccgucgcggucaucgc

SEQ ID NO: 1456840 - RNA, 14 nt, Pseudomonas aeruginosa PA01
uauccacgccgucg

SEQ ID NO: 1456841 - RNA, 13 nt, Pseudomonas aeruginosa PA01
uauccgggcccag

SEQ ID NO: 1456842 - RNA, 12 nt, Pseudomonas aeruginosa PA01
uauccgccgccg

SEQ ID NO: 1456843 - RNA, 13 nt, Pseudomonas aeruginosa PA01
uauccgccgccga

SEQ ID NO: 1456844 - RNA, 21 nt, Pseudomonas aeruginosa PA01
uauccgccgccgacgucacgg

SEQ ID NO: 1456845 - RNA, 13 nt, Pseudomonas aeruginosa PA01
uauccgccgccgg

SEQ ID NO: 1456846 - RNA, 12 nt, Pseudomonas aeruginosa PA01
uauccgccggcc

SEQ ID NO: 1456847 - RNA, 14 nt, Pseudomonas aeruginosa PA01
uauccgccggccgg

SEQ ID NO: 1456848 - RNA, 13 nt, Pseudomonas aeruginosa PA01
uauccgccgucgg

SEQ ID NO: 1456849 - RNA, 20 nt, Pseudomonas aeruginosa PA01
uaucccagcgcgugcaggcg

SEQ ID NO: 1456850 - RNA, 15 nt, Pseudomonas aeruginosa PA01
uaucgggccgaucga

SEQ ID NO: 1456851 - RNA, 14 nt, Pseudomonas aeruginosa PA01
uauacccggcgccc

SEQ ID NO: 1456852 - RNA, 15 nt, Pseudomonas aeruginosa PA01
uauagguggugcugg

SEQ ID NO: 1456853 - RNA, 15 nt, Pseudomonas aeruginosa PA01
uagugggcgaggcgc

SEQ ID NO: 1456854 - RNA, 21 nt, Pseudomonas aeruginosa PA01
uagugcaacaccuggcgcucg

SEQ ID NO: 1456855 - RNA, 15 nt, Pseudomonas aeruginosa PA01
uagugcggccaggcg

SEQ ID NO: 1456856 - RNA, 14 nt, Pseudomonas aeruginosa PA01
uagugcucggccag

SEQ ID NO: 1456857 - RNA, 12 nt, Pseudomonas aeruginosa PA01
uagugcuggaau

SEQ ID NO: 1456858 - RNA, 14 nt, Pseudomonas aeruginosa PA01
uagugcuggaaucg

SEQ ID NO: 1456859 - RNA, 19 nt, Pseudomonas aeruginosa PA01
uagucggugaccuccucga

SEQ ID NO: 1456860 - RNA, 14 nt, Pseudomonas aeruginosa PA01
uaguccaucaccgc

SEQ ID NO: 1456861 - RNA, 14 nt, Pseudomonas aeruginosa PA01
uagucgcgcagcgc

SEQ ID NO: 1456862 - RNA, 15 nt, Pseudomonas aeruginosa PA01
uagucgcggggcgga

SEQ ID NO: 1456863 - RNA, 15 nt, Pseudomonas aeruginosa PA01
uagucgcccagcgcc

SEQ ID NO: 1456864 - RNA, 14 nt, Pseudomonas aeruginosa PA01
uaggguucgccgac

SEQ ID NO: 1456865 - RNA, 15 nt, Pseudomonas aeruginosa PA01
uaggguucgccgacg

SEQ ID NO: 1456866 - RNA, 16 nt, Pseudomonas aeruginosa PA01
uagguauccgccggcc

SEQ ID NO: 1456867 - RNA, 23 nt, Pseudomonas aeruginosa PA01
uagguauccgccggccggggcgc

SEQ ID NO: 1456868 - RNA, 11 nt, Pseudomonas aeruginosa PA01
uaggucaccgc

SEQ ID NO: 1456869 - RNA, 14 nt, Pseudomonas aeruginosa PA01
uaggucaugcccag

SEQ ID NO: 1456870 - RNA, 17 nt, Pseudomonas aeruginosa PA01
uagguggcgccgccggc

SEQ ID NO: 1456871 - RNA, 14 nt, Pseudomonas aeruginosa PA01
uagguggugcuggu

SEQ ID NO: 1456872 - RNA, 15 nt, Pseudomonas aeruginosa PA01
uaguccagcgccgcg

SEQ ID NO: 1456873 - RNA, 22 nt, Pseudomonas aeruginosa PA01
uaguccagcgguaccagcagcg

SEQ ID NO: 1456874 - RNA, 16 nt, Pseudomonas aeruginosa PA01
uaguaggguucgccga

SEQ ID NO: 1456875 - RNA, 16 nt, Pseudomonas aeruginosa PA01
uaguagugccccuuga

SEQ ID NO: 1456876 - RNA, 21 nt, Pseudomonas aeruginosa PA01
uaguacaugacgaagcgcacc

SEQ ID NO: 1456877 - RNA, 18 nt, Pseudomonas aeruginosa PA01
guugaaacgcucggcguc

SEQ ID NO: 1456878 - RNA, 18 nt, Pseudomonas aeruginosa PA01
guucugccgcagcgccuc

SEQ ID NO: 1456879 - RNA, 21 nt, Pseudomonas aeruginosa PA01
guucugccgcagcgccucccg

SEQ ID NO: 1456880 - RNA, 21 nt, Pseudomonas aeruginosa PA01
guucugccagagcgcugccug

SEQ ID NO: 1456881 - RNA, 17 nt, Pseudomonas aeruginosa PA01
guugaacucggcgccca

SEQ ID NO: 1456882 - RNA, 15 nt, Pseudomonas aeruginosa PA01
guugaagcggccgua

SEQ ID NO: 1456883 - RNA, 17 nt, Pseudomonas aeruginosa PA01
guugagcuggccgagcg

SEQ ID NO: 1456884 - RNA, 18 nt, Pseudomonas aeruginosa PA01
guugagcuggccgagcga

SEQ ID NO: 1456885 - RNA, 17 nt, Pseudomonas aeruginosa PA01
guugagcaccucgaccu

SEQ ID NO: 1456886 - RNA, 17 nt, Pseudomonas aeruginosa PA01
guugagauccuggccgg

SEQ ID NO: 1456887 - RNA, 20 nt, Pseudomonas aeruginosa PA01
guugagauccuggccggcgg

SEQ ID NO: 1456888 - RNA, 18 nt, Pseudomonas aeruginosa PA01
guugacgucgccgaugcg

SEQ ID NO: 1456889 - RNA, 19 nt, Pseudomonas aeruginosa PA01
guugacguucugcccgccg

SEQ ID NO: 1456890 - RNA, 20 nt, Pseudomonas aeruginosa PA01
guugacguucugcccgccgg

SEQ ID NO: 1456891 - RNA, 23 nt, Pseudomonas aeruginosa PA01
guugacguucugcccgccggcgc

SEQ ID NO: 1456892 - RNA, 21 nt, Pseudomonas aeruginosa PA01
guugagcaccggaaaggcguc

SEQ ID NO: 1456893 - RNA, 15 nt, Pseudomonas aeruginosa PA01
guggugaucagcggc

SEQ ID NO: 1456894 - RNA, 16 nt, Pseudomonas aeruginosa PA01
guucgucaaccagcac

SEQ ID NO: 1456895 - RNA, 18 nt, Pseudomonas aeruginosa PA01
guucgucaccggcgccac

SEQ ID NO: 1456896 - RNA, 19 nt, Pseudomonas aeruginosa PA01
guucguccaucgccaggcc

SEQ ID NO: 1456897 - RNA, 20 nt, Pseudomonas aeruginosa PA01
guucguccaucgccaggcca

SEQ ID NO: 1456898 - RNA, 15 nt, Pseudomonas aeruginosa PA01
guucgucccgagcac

SEQ ID NO: 1456899 - RNA, 17 nt, Pseudomonas aeruginosa PA01
guucgucccgagcaccg

SEQ ID NO: 1456900 - RNA, 21 nt, Pseudomonas aeruginosa PA01
guucgucgcgucgcacccggc

SEQ ID NO: 1456901 - RNA, 23 nt, Pseudomonas aeruginosa PA01
guucgucgaucagguccuggccg

SEQ ID NO: 1456902 - RNA, 23 nt, Pseudomonas aeruginosa PA01
guggucuuccucggugucggcca

SEQ ID NO: 1456903 - RNA, 19 nt, Pseudomonas aeruginosa PA01
guucguucuguucgucccg

SEQ ID NO: 1456904 - RNA, 21 nt, Pseudomonas aeruginosa PA01
guucguguaggguucgcugcc

SEQ ID NO: 1456905 - RNA, 14 nt, Pseudomonas aeruginosa PA01
guucgucuggcgcc

SEQ ID NO: 1456906 - RNA, 17 nt, Pseudomonas aeruginosa PA01
guucgucuggcgccugg

SEQ ID NO: 1456907 - RNA, 18 nt, Pseudomonas aeruginosa PA01
guucucgaucaucgccag

SEQ ID NO: 1456908 - RNA, 18 nt, Pseudomonas aeruginosa PA01
guucucgcagcaggcguu

SEQ ID NO: 1456909 - RNA, 13 nt, Pseudomonas aeruginosa PA01
guucucgacccgc

SEQ ID NO: 1456910 - RNA, 19 nt, Pseudomonas aeruginosa PA01
guucucguguugcagcaga

SEQ ID NO: 1456911 - RNA, 15 nt, Pseudomonas aeruginosa PA01
guucuccucccgccc

SEQ ID NO: 1456912 - RNA, 18 nt, Pseudomonas aeruginosa PA01
guucucauugcgccgccg

SEQ ID NO: 1456913 - RNA, 22 nt, Pseudomonas aeruginosa PA01
guucuccgggucgugcccgagc

SEQ ID NO: 1456914 - RNA, 20 nt, Pseudomonas aeruginosa PA01
guucuccaccgccaccugcc

SEQ ID NO: 1456915 - RNA, 17 nt, Pseudomonas aeruginosa PA01
guucucccgcgcgcugu

SEQ ID NO: 1456916 - RNA, 16 nt, Pseudomonas aeruginosa PA01
guuggaucaccggggu

SEQ ID NO: 1456917 - RNA, 15 nt, Pseudomonas aeruginosa PA01
guuggcaaagcccgc

SEQ ID NO: 1456918 - RNA, 13 nt, Pseudomonas aeruginosa PA01
guuggacgcggcc

SEQ ID NO: 1456919 - RNA, 20 nt, Pseudomonas aeruginosa PA01
guugcggcccagcggcaggu

SEQ ID NO: 1456920 - RNA, 17 nt, Pseudomonas aeruginosa PA01
guugcugcugcggggcc

SEQ ID NO: 1456921 - RNA, 17 nt, Pseudomonas aeruginosa PA01
guugcugaucaggccga

SEQ ID NO: 1456922 - RNA, 22 nt, Pseudomonas aeruginosa PA01
guugcugcccuggcgcgcgccc

SEQ ID NO: 1456923 - RNA, 12 nt, Pseudomonas aeruginosa PA01
guugcggcgggu

SEQ ID NO: 1456924 - RNA, 20 nt, Pseudomonas aeruginosa PA01
guugcggcgggucacgccga

SEQ ID NO: 1456925 - RNA, 23 nt, Pseudomonas aeruginosa PA01
guugcggcgggucacgccgaggg

SEQ ID NO: 1456926 - RNA, 16 nt, Pseudomonas aeruginosa PA01
guugcgggcaggucga

SEQ ID NO: 1456927 - RNA, 13 nt, Pseudomonas aeruginosa PA01
guugcggcgccgg

SEQ ID NO: 1456928 - RNA, 14 nt, Pseudomonas aeruginosa PA01
guugcggcgccggu

SEQ ID NO: 1456929 - RNA, 23 nt, Pseudomonas aeruginosa PA01
guugcgcggcgaguugcgcgagg

SEQ ID NO: 1456930 - RNA, 14 nt, Pseudomonas aeruginosa PA01
guugccuguccagc

SEQ ID NO: 1456931 - RNA, 20 nt, Pseudomonas aeruginosa PA01
guugcggaacggcucgcggg

SEQ ID NO: 1456932 - RNA, 15 nt, Pseudomonas aeruginosa PA01
guugcggaaagcgac

SEQ ID NO: 1456933 - RNA, 20 nt, Pseudomonas aeruginosa PA01
guugcgcuccauccagucgg

SEQ ID NO: 1456934 - RNA, 14 nt, Pseudomonas aeruginosa PA01
guugcgcuggcgca

SEQ ID NO: 1456935 - RNA, 15 nt, Pseudomonas aeruginosa PA01
guugcgcuggcgcag

SEQ ID NO: 1456936 - RNA, 18 nt, Pseudomonas aeruginosa PA01
guugcgcuggcgcagcag

SEQ ID NO: 1456937 - RNA, 20 nt, Pseudomonas aeruginosa PA01
guugcgcuggcgcagcagca

SEQ ID NO: 1456938 - RNA, 19 nt, Pseudomonas aeruginosa PA01
guugccggucuugccggcu

SEQ ID NO: 1456939 - RNA, 20 nt, Pseudomonas aeruginosa PA01
guugccggucuugccggcug

SEQ ID NO: 1456940 - RNA, 17 nt, Pseudomonas aeruginosa PA01
guugccgucgagcacca

SEQ ID NO: 1456941 - RNA, 19 nt, Pseudomonas aeruginosa PA01
guugccgucgagcaccagc

SEQ ID NO: 1456942 - RNA, 23 nt, Pseudomonas aeruginosa PA01
guugccgucgagcaccagcaggu

SEQ ID NO: 1456943 - RNA, 15 nt, Pseudomonas aeruginosa PA01
guugccagacgauca

SEQ ID NO: 1456944 - RNA, 16 nt, Pseudomonas aeruginosa PA01
guugccguggcggcgc

SEQ ID NO: 1456945 - RNA, 17 nt, Pseudomonas aeruginosa PA01
guugccguggcggcgcg

SEQ ID NO: 1456946 - RNA, 23 nt, Pseudomonas aeruginosa PA01
guugagguagagcacgccgucgc

SEQ ID NO: 1456947 - RNA, 15 nt, Pseudomonas aeruginosa PA01
guugcagagcggcca

SEQ ID NO: 1456948 - RNA, 17 nt, Pseudomonas aeruginosa PA01
guugcagagcggccagg

SEQ ID NO: 1456949 - RNA, 21 nt, Pseudomonas aeruginosa PA01
guugcagagcggccaggucga

SEQ ID NO: 1456950 - RNA, 22 nt, Pseudomonas aeruginosa PA01
guugcagagcggccaggucgag

SEQ ID NO: 1456951 - RNA, 14 nt, Pseudomonas aeruginosa PA01
guugaggccgucga

SEQ ID NO: 1456952 - RNA, 14 nt, Pseudomonas aeruginosa PA01
guugaggcgcucgu

SEQ ID NO: 1456953 - RNA, 14 nt, Pseudomonas aeruginosa PA01
guugaggcguucga

SEQ ID NO: 1456954 - RNA, 14 nt, Pseudomonas aeruginosa PA01
guugagggccgcgc

SEQ ID NO: 1456955 - RNA, 16 nt, Pseudomonas aeruginosa PA01
guugagucgcgcgcgc

SEQ ID NO: 1456956 - RNA, 20 nt, Pseudomonas aeruginosa PA01
guugaguucgaagcgccagg

SEQ ID NO: 1456957 - RNA, 20 nt, Pseudomonas aeruginosa PA01
guugaguugcaggccggcga

SEQ ID NO: 1456958 - RNA, 20 nt, Pseudomonas aeruginosa PA01
guugccaggaggauucgcca

SEQ ID NO: 1456959 - RNA, 15 nt, Pseudomonas aeruginosa PA01
guugccaggccggcg

SEQ ID NO: 1456960 - RNA, 16 nt, Pseudomonas aeruginosa PA01
guugccaggccggcgc

SEQ ID NO: 1456961 - RNA, 20 nt, Pseudomonas aeruginosa PA01
guugccagguauuccgccca

SEQ ID NO: 1456962 - RNA, 22 nt, Pseudomonas aeruginosa PA01
guugccagggauacucaugcag

SEQ ID NO: 1456963 - RNA, 15 nt, Pseudomonas aeruginosa PA01
guugccagcagcgcu

SEQ ID NO: 1456964 - RNA, 16 nt, Pseudomonas aeruginosa PA01
guugcaguccaggccg

SEQ ID NO: 1456965 - RNA, 12 nt, Pseudomonas aeruginosa PA01
guugcaggucga

SEQ ID NO: 1456966 - RNA, 16 nt, Pseudomonas aeruginosa PA01
guugcagugcgccgca

SEQ ID NO: 1456967 - RNA, 22 nt, Pseudomonas aeruginosa PA01
guugcagcacccccagcaggcc

SEQ ID NO: 1456968 - RNA, 13 nt, Pseudomonas aeruginosa PA01
guugcaggcccag

SEQ ID NO: 1456969 - RNA, 15 nt, Pseudomonas aeruginosa PA01
guugcaggcccagcu

SEQ ID NO: 1456970 - RNA, 16 nt, Pseudomonas aeruginosa PA01
guugcaggccggcgag

SEQ ID NO: 1456971 - RNA, 22 nt, Pseudomonas aeruginosa PA01
guugcagggauuccgggucgag

SEQ ID NO: 1456972 - RNA, 19 nt, Pseudomonas aeruginosa PA01
guugcaggcacggaagcgc

SEQ ID NO: 1456973 - RNA, 19 nt, Pseudomonas aeruginosa PA01
guugcaggcagucccagaa

SEQ ID NO: 1456974 - RNA, 22 nt, Pseudomonas aeruginosa PA01
guuuccgcuguccgccgccgcg

SEQ ID NO: 1456975 - RNA, 14 nt, Pseudomonas aeruginosa PA01
guuuccgugcgcug

SEQ ID NO: 1456976 - RNA, 21 nt, Pseudomonas aeruginosa PA01
guuuccgugcgcugcgcguac

SEQ ID NO: 1456977 - RNA, 22 nt, Pseudomonas aeruginosa PA01
guuuccgugcggaaaccgcggc

SEQ ID NO: 1456978 - RNA, 16 nt, Pseudomonas aeruginosa PA01
guuuccggcagcacgu

SEQ ID NO: 1456979 - RNA, 19 nt, Pseudomonas aeruginosa PA01
guuuccggcaugcuugcca

SEQ ID NO: 1456980 - RNA, 21 nt, Pseudomonas aeruginosa PA01
guuuccccguggcgccgcagg

SEQ ID NO: 1456981 - RNA, 19 nt, Pseudomonas aeruginosa PA01
guuucccggcgcggcuacc

SEQ ID NO: 1456982 - RNA, 22 nt, Pseudomonas aeruginosa PA01
guuuccaggcucaccucgaagg

SEQ ID NO: 1456983 - RNA, 12 nt, Pseudomonas aeruginosa PA01
guuuccgcgagg

SEQ ID NO: 1456984 - RNA, 14 nt, Pseudomonas aeruginosa PA01
guuuccgacccgga

SEQ ID NO: 1456985 - RNA, 22 nt, Pseudomonas aeruginosa PA01
guuuccgacccggaucauggua

SEQ ID NO: 1456986 - RNA, 17 nt, Pseudomonas aeruginosa PA01
guuucgaugagcuucgc

SEQ ID NO: 1456987 - RNA, 16 nt, Pseudomonas aeruginosa PA01
guuucgaccggcgcgc

SEQ ID NO: 1456988 - RNA, 15 nt, Pseudomonas aeruginosa PA01
guuucggccgcugcc

SEQ ID NO: 1456989 - RNA, 16 nt, Pseudomonas aeruginosa PA01
guuucggccgcugccg

SEQ ID NO: 1456990 - RNA, 15 nt, Pseudomonas aeruginosa PA01
guuucgccgccggcc

SEQ ID NO: 1456991 - RNA, 16 nt, Pseudomonas aeruginosa PA01
guuucgccgccggcca

SEQ ID NO: 1456992 - RNA, 15 nt, Pseudomonas aeruginosa PA01
guugucggccagcag

SEQ ID NO: 1456993 - RNA, 18 nt, Pseudomonas aeruginosa PA01
guuuaccaggaccagcgc

SEQ ID NO: 1456994 - RNA, 20 nt, Pseudomonas aeruginosa PA01
guugucgcggcugacgaagu

SEQ ID NO: 1456995 - RNA, 14 nt, Pseudomonas aeruginosa PA01
guuggccaccugca

SEQ ID NO: 1456996 - RNA, 16 nt, Pseudomonas aeruginosa PA01
guuggccagcaggcgc

SEQ ID NO: 1456997 - RNA, 18 nt, Pseudomonas aeruginosa PA01
guuggccagcaggcgccg

SEQ ID NO: 1456998 - RNA, 19 nt, Pseudomonas aeruginosa PA01
guuggccagcaggcgccgc

SEQ ID NO: 1456999 - RNA, 23 nt, Pseudomonas aeruginosa PA01
guuggccaggaccaucggcacca

SEQ ID NO: 1457000 - RNA, 14 nt, Pseudomonas aeruginosa PA01
guuggccaggcgcg

SEQ ID NO: 1457001 - RNA, 15 nt, Pseudomonas aeruginosa PA01
guuggccaggcgcga

SEQ ID NO: 1457002 - RNA, 13 nt, Pseudomonas aeruginosa PA01
guuggccagcgcc

SEQ ID NO: 1457003 - RNA, 14 nt, Pseudomonas aeruginosa PA01
guuggccagcgcca

SEQ ID NO: 1457004 - RNA, 21 nt, Pseudomonas aeruginosa PA01
guuggccagcgccaccagcag

SEQ ID NO: 1457005 - RNA, 14 nt, Pseudomonas aeruginosa PA01
guuggcccgcgccg

SEQ ID NO: 1457006 - RNA, 14 nt, Pseudomonas aeruginosa PA01
guuggcccagaccu

SEQ ID NO: 1457007 - RNA, 15 nt, Pseudomonas aeruginosa PA01
guuggccccgccgag

SEQ ID NO: 1457008 - RNA, 16 nt, Pseudomonas aeruginosa PA01
guuggccgagcgcgag

SEQ ID NO: 1457009 - RNA, 21 nt, Pseudomonas aeruginosa PA01
guuggucuguugguggggcgc

SEQ ID NO: 1457010 - RNA, 17 nt, Pseudomonas aeruginosa PA01
guugguggggcgccggc

SEQ ID NO: 1457011 - RNA, 15 nt, Pseudomonas aeruginosa PA01
guugguggccgcgcc

SEQ ID NO: 1457012 - RNA, 16 nt, Pseudomonas aeruginosa PA01
guuggugcacgcgccg

SEQ ID NO: 1457013 - RNA, 18 nt, Pseudomonas aeruginosa PA01
guuguccaggcgaugguu

SEQ ID NO: 1457014 - RNA, 22 nt, Pseudomonas aeruginosa PA01
guuguccaggcuguggcgcggc

SEQ ID NO: 1457015 - RNA, 14 nt, Pseudomonas aeruginosa PA01
guuguccagggcau

SEQ ID NO: 1457016 - RNA, 19 nt, Pseudomonas aeruginosa PA01
guuguagcguucggcgacc

SEQ ID NO: 1457017 - RNA, 19 nt, Pseudomonas aeruginosa PA01
guuguagaaacgguccagg

SEQ ID NO: 1457018 - RNA, 14 nt, Pseudomonas aeruginosa PA01
guuguagcccuggg

SEQ ID NO: 1457019 - RNA, 22 nt, Pseudomonas aeruginosa PA01
guuguacagcgaggcccgcgcc

SEQ ID NO: 1457020 - RNA, 22 nt, Pseudomonas aeruginosa PA01
guuguacucgaucugucgcagc

SEQ ID NO: 1457021 - RNA, 14 nt, Pseudomonas aeruginosa PA01
guuguacuggccga

SEQ ID NO: 1457022 - RNA, 16 nt, Pseudomonas aeruginosa PA01
guuguacuggccgaaa

SEQ ID NO: 1457023 - RNA, 17 nt, Pseudomonas aeruginosa PA01
guuucucggucgccgcc

SEQ ID NO: 1457024 - RNA, 21 nt, Pseudomonas aeruginosa PA01
guuucuucccacuccagcgcg

SEQ ID NO: 1457025 - RNA, 20 nt, Pseudomonas aeruginosa PA01
guuucuuuuuauccggcgga

SEQ ID NO: 1457026 - RNA, 22 nt, Pseudomonas aeruginosa PA01
guuugcgccgaauccaggccga

SEQ ID NO: 1457027 - RNA, 15 nt, Pseudomonas aeruginosa PA01
guuugccgucggcgc

SEQ ID NO: 1457028 - RNA, 15 nt, Pseudomonas aeruginosa PA01
guuugcccagcgccg

SEQ ID NO: 1457029 - RNA, 18 nt, Pseudomonas aeruginosa PA01
guuugcggcgcaggcgga

SEQ ID NO: 1457030 - RNA, 19 nt, Pseudomonas aeruginosa PA01
guuuucaggcgacgccgcg

SEQ ID NO: 1457031 - RNA, 18 nt, Pseudomonas aeruginosa PA01
guuuuccgcuuccacgcu

SEQ ID NO: 1457032 - RNA, 20 nt, Pseudomonas aeruginosa PA01
guuuucuuuuugcgccaggu

SEQ ID NO: 1457033 - RNA, 18 nt, Pseudomonas aeruginosa PA01
guuuucguuggcgcgacc

SEQ ID NO: 1457034 - RNA, 18 nt, Pseudomonas aeruginosa PA01
uacaacggcaucggccac

SEQ ID NO: 1457035 - RNA, 19 nt, Pseudomonas aeruginosa PA01
uacaccugcaacucggcgu

SEQ ID NO: 1457036 - RNA, 16 nt, Pseudomonas aeruginosa PA01
uacagcgggccgggga

SEQ ID NO: 1457037 - RNA, 14 nt, Pseudomonas aeruginosa PA01
uacagcucguccuu

SEQ ID NO: 1457038 - RNA, 13 nt, Pseudomonas aeruginosa PA01
uacagcucgcgca

SEQ ID NO: 1457039 - RNA, 18 nt, Pseudomonas aeruginosa PA01
uacaggccccaggcgauc

SEQ ID NO: 1457040 - RNA, 17 nt, Pseudomonas aeruginosa PA01
uacaggcgcaccuggcg

SEQ ID NO: 1457041 - RNA, 13 nt, Pseudomonas aeruginosa PA01
uacaggcgcagca

SEQ ID NO: 1457042 - RNA, 14 nt, Pseudomonas aeruginosa PA01
uacaggcgcgccug

SEQ ID NO: 1457043 - RNA, 22 nt, Pseudomonas aeruginosa PA01
uacaggcgcgccuggcccuggc

SEQ ID NO: 1457044 - RNA, 22 nt, Pseudomonas aeruginosa PA01
uacaaagcauuucuucaccacc

SEQ ID NO: 1457045 - RNA, 14 nt, Pseudomonas aeruginosa PA01
uaaugcggcgcgau

SEQ ID NO: 1457046 - RNA, 22 nt, Pseudomonas aeruginosa PA01
uaaggcaccaccgccgccagca

SEQ ID NO: 1457047 - RNA, 19 nt, Pseudomonas aeruginosa PA01
uaaggcaugcccaggcucg

SEQ ID NO: 1457048 - RNA, 18 nt, Pseudomonas aeruginosa PA01
uaaggaaaaacccggccc

SEQ ID NO: 1457049 - RNA, 22 nt, Pseudomonas aeruginosa PA01
uaacguuacgcagauagaggcg

SEQ ID NO: 1457050 - RNA, 11 nt, Pseudomonas aeruginosa PA01
uaaccgcucgc

SEQ ID NO: 1457051 - RNA, 14 nt, Pseudomonas aeruginosa PA01
uaaccgcaucgcgg

SEQ ID NO: 1457052 - RNA, 21 nt, Pseudomonas aeruginosa PA01
uaaacggcaugcacgcccugg

SEQ ID NO: 1457053 - RNA, 16 nt, Pseudomonas aeruginosa PA01
uaaaauggcgcgccuc

SEQ ID NO: 1457054 - RNA, 15 nt, Pseudomonas aeruginosa PA01
gucgacggcggccgc

SEQ ID NO: 1457055 - RNA, 16 nt, Pseudomonas aeruginosa PA01
gucgacggcggccgcc

SEQ ID NO: 1457056 - RNA, 13 nt, Pseudomonas aeruginosa PA01
gucgacggcggcc

SEQ ID NO: 1457057 - RNA, 18 nt, Pseudomonas aeruginosa PA01
gucgacggaacaggagcc

SEQ ID NO: 1457058 - RNA, 15 nt, Pseudomonas aeruginosa PA01
gucgacguaggcggc

SEQ ID NO: 1457059 - RNA, 17 nt, Pseudomonas aeruginosa PA01
gucgacguaggcggcga

SEQ ID NO: 1457060 - RNA, 13 nt, Pseudomonas aeruginosa PA01
guccgccagcagg

SEQ ID NO: 1457061 - RNA, 14 nt, Pseudomonas aeruginosa PA01
guccgccagcaggc

SEQ ID NO: 1457062 - RNA, 22 nt, Pseudomonas aeruginosa PA01
guccgcaguucgccccgccgcc

SEQ ID NO: 1457063 - RNA, 17 nt, Pseudomonas aeruginosa PA01
guccgcaggcaggucgc

SEQ ID NO: 1457064 - RNA, 20 nt, Pseudomonas aeruginosa PA01
guccgcaccguagcggcugc

SEQ ID NO: 1457065 - RNA, 17 nt, Pseudomonas aeruginosa PA01
guccgaugucguugcgc

SEQ ID NO: 1457066 - RNA, 19 nt, Pseudomonas aeruginosa PA01
guccgauucuuggcucggc

SEQ ID NO: 1457067 - RNA, 22 nt, Pseudomonas aeruginosa PA01
guccgauucuuggcucggcagc

SEQ ID NO: 1457068 - RNA, 15 nt, Pseudomonas aeruginosa PA01
gucgagcacgccguc

SEQ ID NO: 1457069 - RNA, 13 nt, Pseudomonas aeruginosa PA01
gucgagcacggcg

SEQ ID NO: 1457070 - RNA, 20 nt, Pseudomonas aeruginosa PA01
gucgagcaguuccggcacga

SEQ ID NO: 1457071 - RNA, 16 nt, Pseudomonas aeruginosa PA01
gucgagcaucugccgg

SEQ ID NO: 1457072 - RNA, 20 nt, Pseudomonas aeruginosa PA01
gucgagcaucugccgggcgc

SEQ ID NO: 1457073 - RNA, 23 nt, Pseudomonas aeruginosa PA01
gucgagcaugacgauaucggcgc

SEQ ID NO: 1457074 - RNA, 15 nt, Pseudomonas aeruginosa PA01
gucgagcagcgccgc

SEQ ID NO: 1457075 - RNA, 13 nt, Pseudomonas aeruginosa PA01
gucgagcagcgcg

SEQ ID NO: 1457076 - RNA, 16 nt, Pseudomonas aeruginosa PA01
gucgagcagcgcgcgg

SEQ ID NO: 1457077 - RNA, 17 nt, Pseudomonas aeruginosa PA01
gucgagcagcgcgcggc

SEQ ID NO: 1457078 - RNA, 18 nt, Pseudomonas aeruginosa PA01
gucgagcagcgcgcggcu

SEQ ID NO: 1457079 - RNA, 21 nt, Pseudomonas aeruginosa PA01
gucgagcagggagaaccaggc

SEQ ID NO: 1457080 - RNA, 19 nt, Pseudomonas aeruginosa PA01
gucgagcuuguuggccagc

SEQ ID NO: 1457081 - RNA, 21 nt, Pseudomonas aeruginosa PA01
gucgagcuuguuggccagcag

SEQ ID NO: 1457082 - RNA, 16 nt, Pseudomonas aeruginosa PA01
gucgagcgggcggucg

SEQ ID NO: 1457083 - RNA, 13 nt, Pseudomonas aeruginosa PA01
gucgagcugcucg

SEQ ID NO: 1457084 - RNA, 15 nt, Pseudomonas aeruginosa PA01
gucgagcugcucggc

SEQ ID NO: 1457085 - RNA, 17 nt, Pseudomonas aeruginosa PA01
gucgagcuggcgcaggc

SEQ ID NO: 1457086 - RNA, 19 nt, Pseudomonas aeruginosa PA01
gucgagcuggcgcaggccu

SEQ ID NO: 1457087 - RNA, 21 nt, Pseudomonas aeruginosa PA01
gucgagcugggucacuccgcu

SEQ ID NO: 1457088 - RNA, 13 nt, Pseudomonas aeruginosa PA01
gucgagcucggcc

SEQ ID NO: 1457089 - RNA, 14 nt, Pseudomonas aeruginosa PA01
gucgagcucggcca

SEQ ID NO: 1457090 - RNA, 16 nt, Pseudomonas aeruginosa PA01
gucgagcucggccagg

SEQ ID NO: 1457091 - RNA, 17 nt, Pseudomonas aeruginosa PA01
gucgagcucggccaggc

SEQ ID NO: 1457092 - RNA, 18 nt, Pseudomonas aeruginosa PA01
gucgagcucggccaggca

SEQ ID NO: 1457093 - RNA, 19 nt, Pseudomonas aeruginosa PA01
gucgagcucggccaggcac

SEQ ID NO: 1457094 - RNA, 20 nt, Pseudomonas aeruginosa PA01
gucgagccagcccagcggcg

SEQ ID NO: 1457095 - RNA, 15 nt, Pseudomonas aeruginosa PA01
gucgcccaccuugcg

SEQ ID NO: 1457096 - RNA, 16 nt, Pseudomonas aeruginosa PA01
gucgcccaccuugcgg

SEQ ID NO: 1457097 - RNA, 15 nt, Pseudomonas aeruginosa PA01
gucgccauucggcga

SEQ ID NO: 1457098 - RNA, 20 nt, Pseudomonas aeruginosa PA01
gucgccaugcccgucgacca

SEQ ID NO: 1457099 - RNA, 16 nt, Pseudomonas aeruginosa PA01
gucgccauccuggucg

SEQ ID NO: 1457100 - RNA, 17 nt, Pseudomonas aeruginosa PA01
gucgccauccuggucgc

SEQ ID NO: 1457101 - RNA, 12 nt, Pseudomonas aeruginosa PA01
gucgccaggccg

SEQ ID NO: 1457102 - RNA, 13 nt, Pseudomonas aeruginosa PA01
gucgccaggccgu

SEQ ID NO: 1457103 - RNA, 22 nt, Pseudomonas aeruginosa PA01
gucgccaggccguagaccacca

SEQ ID NO: 1457104 - RNA, 19 nt, Pseudomonas aeruginosa PA01
gucgcagagacgcagcgcu

SEQ ID NO: 1457105 - RNA, 13 nt, Pseudomonas aeruginosa PA01
gucgcagcaggcc

SEQ ID NO: 1457106 - RNA, 16 nt, Pseudomonas aeruginosa PA01
gucgcagcaggccgcu

SEQ ID NO: 1457107 - RNA, 17 nt, Pseudomonas aeruginosa PA01
gucgcagcaggccgcug

SEQ ID NO: 1457108 - RNA, 18 nt, Pseudomonas aeruginosa PA01
gucgcagcaggccgcugg

SEQ ID NO: 1457109 - RNA, 13 nt, Pseudomonas aeruginosa PA01
gucgcagccgggg

SEQ ID NO: 1457110 - RNA, 14 nt, Pseudomonas aeruginosa PA01
gucgcagcggccgu

SEQ ID NO: 1457111 - RNA, 17 nt, Pseudomonas aeruginosa PA01
gucgcagcguuccagcg

SEQ ID NO: 1457112 - RNA, 19 nt, Pseudomonas aeruginosa PA01
gucgcagcguuccagcgcu

SEQ ID NO: 1457113 - RNA, 23 nt, Pseudomonas aeruginosa PA01
gucgcagcguuccagcgcuggca

SEQ ID NO: 1457114 - RNA, 15 nt, Pseudomonas aeruginosa PA01
gucgcagcuccagcg

SEQ ID NO: 1457115 - RNA, 22 nt, Pseudomonas aeruginosa PA01
gucgcaagccauuccaacuggc

SEQ ID NO: 1457116 - RNA, 21 nt, Pseudomonas aeruginosa PA01
gucgcaccgggaggcgccgcg

SEQ ID NO: 1457117 - RNA, 19 nt, Pseudomonas aeruginosa PA01
gucgcaccuguuccagcaa

SEQ ID NO: 1457118 - RNA, 19 nt, Pseudomonas aeruginosa PA01
gucgcacgcagcgccgcgu

SEQ ID NO: 1457119 - RNA, 12 nt, Pseudomonas aeruginosa PA01
gucgcacugguc

SEQ ID NO: 1457120 - RNA, 15 nt, Pseudomonas aeruginosa PA01
gucgcacuggucggc

SEQ ID NO: 1457121 - RNA, 15 nt, Pseudomonas aeruginosa PA01
gucgcaccgccagca

SEQ ID NO: 1457122 - RNA, 16 nt, Pseudomonas aeruginosa PA01
gucgcaccgccagcag

SEQ ID NO: 1457123 - RNA, 17 nt, Pseudomonas aeruginosa PA01
gucgcaccgccagcagu

SEQ ID NO: 1457124 - RNA, 14 nt, Pseudomonas aeruginosa PA01
gucgcacccggccc

SEQ ID NO: 1457125 - RNA, 18 nt, Pseudomonas aeruginosa PA01
gucgcacccggcccaugg

SEQ ID NO: 1457126 - RNA, 23 nt, Pseudomonas aeruginosa PA01
gucgaugaucgguucccgcccgc

SEQ ID NO: 1457127 - RNA, 20 nt, Pseudomonas aeruginosa PA01
gucgaugaucugcauggcgc

SEQ ID NO: 1457128 - RNA, 20 nt, Pseudomonas aeruginosa PA01
gucgaugacgaggcccgccc

SEQ ID NO: 1457129 - RNA, 16 nt, Pseudomonas aeruginosa PA01
gucgaugaacgcgcgg

SEQ ID NO: 1457130 - RNA, 15 nt, Pseudomonas aeruginosa PA01
gucgaugccgcccgg

SEQ ID NO: 1457131 - RNA, 18 nt, Pseudomonas aeruginosa PA01
gucgaugaggucgcagcg

SEQ ID NO: 1457132 - RNA, 19 nt, Pseudomonas aeruginosa PA01
gucgaugcccucgcggcgg

SEQ ID NO: 1457133 - RNA, 20 nt, Pseudomonas aeruginosa PA01
gucgaugcccucgcggcggc

SEQ ID NO: 1457134 - RNA, 16 nt, Pseudomonas aeruginosa PA01
gucgaugccuucggcg

SEQ ID NO: 1457135 - RNA, 22 nt, Pseudomonas aeruginosa PA01
gucgauccugaccccggccugg

SEQ ID NO: 1457136 - RNA, 17 nt, Pseudomonas aeruginosa PA01
gucgauccgcggaucgu

SEQ ID NO: 1457137 - RNA, 15 nt, Pseudomonas aeruginosa PA01
gucgaggcugccgaa

SEQ ID NO: 1457138 - RNA, 23 nt, Pseudomonas aeruginosa PA01
gucgaggcugccgaagccuucgu

SEQ ID NO: 1457139 - RNA, 13 nt, Pseudomonas aeruginosa PA01
gucgaggccucgu

SEQ ID NO: 1457140 - RNA, 21 nt, Pseudomonas aeruginosa PA01
gucgaggcggagaagccgcug

SEQ ID NO: 1457141 - RNA, 22 nt, Pseudomonas aeruginosa PA01
gucgaggcggagaagccgcuga

SEQ ID NO: 1457142 - RNA, 16 nt, Pseudomonas aeruginosa PA01
gucgaggcccucggcg

SEQ ID NO: 1457143 - RNA, 20 nt, Pseudomonas aeruginosa PA01
gucgaggcccucggcggcga

SEQ ID NO: 1457144 - RNA, 22 nt, Pseudomonas aeruginosa PA01
gucgaggcccucggcggcgagc

SEQ ID NO: 1457145 - RNA, 18 nt, Pseudomonas aeruginosa PA01
gucgaggaucuucuccga

SEQ ID NO: 1457146 - RNA, 19 nt, Pseudomonas aeruginosa PA01
gucgaggcaaucugcccgg

SEQ ID NO: 1457147 - RNA, 21 nt, Pseudomonas aeruginosa PA01
gucgaggcaaucugcccggca

SEQ ID NO: 1457148 - RNA, 13 nt, Pseudomonas aeruginosa PA01
gucgaggaacagg

SEQ ID NO: 1457149 - RNA, 20 nt, Pseudomonas aeruginosa PA01
gucgaggaacaggucgacgc

SEQ ID NO: 1457150 - RNA, 14 nt, Pseudomonas aeruginosa PA01
gucgaggaaggcca

SEQ ID NO: 1457151 - RNA, 19 nt, Pseudomonas aeruginosa PA01
gucgaggaaggccagcagg

SEQ ID NO: 1457152 - RNA, 17 nt, Pseudomonas aeruginosa PA01
gucgaucucgagcaugu

SEQ ID NO: 1457153 - RNA, 18 nt, Pseudomonas aeruginosa PA01
gucgaucugcucguccag

SEQ ID NO: 1457154 - RNA, 17 nt, Pseudomonas aeruginosa PA01
gucgaucuccuccucgg

SEQ ID NO: 1457155 - RNA, 21 nt, Pseudomonas aeruginosa PA01
gucgaucuccuccucggcggc

SEQ ID NO: 1457156 - RNA, 22 nt, Pseudomonas aeruginosa PA01
gucgaucuccuccucggcggcu

SEQ ID NO: 1457157 - RNA, 21 nt, Pseudomonas aeruginosa PA01
gucggaagcgucagccgcggc

SEQ ID NO: 1457158 - RNA, 15 nt, Pseudomonas aeruginosa PA01
gucggaacgaccacg

SEQ ID NO: 1457159 - RNA, 21 nt, Pseudomonas aeruginosa PA01
gucggaacgaccacgccugcc

SEQ ID NO: 1457160 - RNA, 14 nt, Pseudomonas aeruginosa PA01
gucgcuuucgcgca

SEQ ID NO: 1457161 - RNA, 20 nt, Pseudomonas aeruginosa PA01
gucgcuuuuuccgcugccgu

SEQ ID NO: 1457162 - RNA, 22 nt, Pseudomonas aeruginosa PA01
gucggaucggauagccgugcag

SEQ ID NO: 1457163 - RNA, 14 nt, Pseudomonas aeruginosa PA01
gucggaugcagcgc

SEQ ID NO: 1457164 - RNA, 15 nt, Pseudomonas aeruginosa PA01
gucggaugccacucg

SEQ ID NO: 1457165 - RNA, 15 nt, Pseudomonas aeruginosa PA01
gucggcaaagccgcu

SEQ ID NO: 1457166 - RNA, 17 nt, Pseudomonas aeruginosa PA01
gucgcuguagcggcucg

SEQ ID NO: 1457167 - RNA, 14 nt, Pseudomonas aeruginosa PA01
gucgcugccgccgc

SEQ ID NO: 1457168 - RNA, 16 nt, Pseudomonas aeruginosa PA01
gucgcuguccuccagc

SEQ ID NO: 1457169 - RNA, 21 nt, Pseudomonas aeruginosa PA01
gucgcuguccuccagcggcgg

SEQ ID NO: 1457170 - RNA, 13 nt, Pseudomonas aeruginosa PA01
gucgcugccgccg

SEQ ID NO: 1457171 - RNA, 21 nt, Pseudomonas aeruginosa PA01
gucgcuucacucauccucgcc

SEQ ID NO: 1457172 - RNA, 13 nt, Pseudomonas aeruginosa PA01
gucgcuucgcccg

SEQ ID NO: 1457173 - RNA, 17 nt, Pseudomonas aeruginosa PA01
gucgcuucgcccgccgc

SEQ ID NO: 1457174 - RNA, 23 nt, Pseudomonas aeruginosa PA01
gucgcuucgcccgccgccuggug

SEQ ID NO: 1457175 - RNA, 15 nt, Pseudomonas aeruginosa PA01
gucggcaccgaucgc

SEQ ID NO: 1457176 - RNA, 13 nt, Pseudomonas aeruginosa PA01
gucggcaccugca

SEQ ID NO: 1457177 - RNA, 15 nt, Pseudomonas aeruginosa PA01
gucggcaccugcaga

SEQ ID NO: 1457178 - RNA, 20 nt, Pseudomonas aeruginosa PA01
gucggcaccagggcuucgcg

SEQ ID NO: 1457179 - RNA, 22 nt, Pseudomonas aeruginosa PA01
gucggcaccagggcuucgcgca

SEQ ID NO: 1457180 - RNA, 17 nt, Pseudomonas aeruginosa PA01
gucggcaagcaggccgc

SEQ ID NO: 1457181 - RNA, 23 nt, Pseudomonas aeruginosa PA01
gucggcaacgauaccgccgccgg

SEQ ID NO: 1457182 - RNA, 19 nt, Pseudomonas aeruginosa PA01
gucggccaggacgccacca

SEQ ID NO: 1457183 - RNA, 16 nt, Pseudomonas aeruginosa PA01
gucggcacgaugucga

SEQ ID NO: 1457184 - RNA, 21 nt, Pseudomonas aeruginosa PA01
gucgcugcacgcacgcgccug

SEQ ID NO: 1457185 - RNA, 19 nt, Pseudomonas aeruginosa PA01
gucgcugcccaucgccucc

SEQ ID NO: 1457186 - RNA, 19 nt, Pseudomonas aeruginosa PA01
gucgcugcccucgaccagg

SEQ ID NO: 1457187 - RNA, 14 nt, Pseudomonas aeruginosa PA01
gucgcugccgagcu

SEQ ID NO: 1457188 - RNA, 15 nt, Pseudomonas aeruginosa PA01
gucgcugagcggcug

SEQ ID NO: 1457189 - RNA, 14 nt, Pseudomonas aeruginosa PA01
gucgcugaggccgc

SEQ ID NO: 1457190 - RNA, 14 nt, Pseudomonas aeruginosa PA01
gucgcugaccaccc

SEQ ID NO: 1457191 - RNA, 19 nt, Pseudomonas aeruginosa PA01
gucgcugaccacccggugc

SEQ ID NO: 1457192 - RNA, 19 nt, Pseudomonas aeruginosa PA01
gucgcugaccagcccggcg

SEQ ID NO: 1457193 - RNA, 20 nt, Pseudomonas aeruginosa PA01
gucgcguccggccagccugg

SEQ ID NO: 1457194 - RNA, 15 nt, Pseudomonas aeruginosa PA01
gucgcgucggccugg

SEQ ID NO: 1457195 - RNA, 20 nt, Pseudomonas aeruginosa PA01
gucgcgucggccuggcgcag

SEQ ID NO: 1457196 - RNA, 21 nt, Pseudomonas aeruginosa PA01
gucgcgucggccuggcgcagc

SEQ ID NO: 1457197 - RNA, 16 nt, Pseudomonas aeruginosa PA01
gucgcgucgcacccgg

SEQ ID NO: 1457198 - RNA, 18 nt, Pseudomonas aeruginosa PA01
gucgcgucgcacccggcc

SEQ ID NO: 1457199 - RNA, 23 nt, Pseudomonas aeruginosa PA01
gucgcgucgcacccggcccaugg

SEQ ID NO: 1457200 - RNA, 14 nt, Pseudomonas aeruginosa PA01
gucgcguuccagcu

SEQ ID NO: 1457201 - RNA, 14 nt, Pseudomonas aeruginosa PA01
gucgcggcccuggu

SEQ ID NO: 1457202 - RNA, 17 nt, Pseudomonas aeruginosa PA01
gucgcgguugccgaagc

SEQ ID NO: 1457203 - RNA, 16 nt, Pseudomonas aeruginosa PA01
gucgcguagaccaucg

SEQ ID NO: 1457204 - RNA, 19 nt, Pseudomonas aeruginosa PA01
gucgcguacagcgggccgg

SEQ ID NO: 1457205 - RNA, 15 nt, Pseudomonas aeruginosa PA01
gucgcggccccagca

SEQ ID NO: 1457206 - RNA, 20 nt, Pseudomonas aeruginosa PA01
gucgcggauguucaccaggu

SEQ ID NO: 1457207 - RNA, 15 nt, Pseudomonas aeruginosa PA01
gucgcggcaggcggc

SEQ ID NO: 1457208 - RNA, 19 nt, Pseudomonas aeruginosa PA01
gucgcggcaggcggcggcg

SEQ ID NO: 1457209 - RNA, 19 nt, Pseudomonas aeruginosa PA01
gucgcggagaauccgcucg

SEQ ID NO: 1457210 - RNA, 18 nt, Pseudomonas aeruginosa PA01
gucgcggacuccggaggc

SEQ ID NO: 1457211 - RNA, 17 nt, Pseudomonas aeruginosa PA01
gucgcggaccuccagcc

SEQ ID NO: 1457212 - RNA, 18 nt, Pseudomonas aeruginosa PA01
gucgcggaccuccagccg

SEQ ID NO: 1457213 - RNA, 23 nt, Pseudomonas aeruginosa PA01
gucgcggaucaacgggcccugcc

SEQ ID NO: 1457214 - RNA, 15 nt, Pseudomonas aeruginosa PA01
gucgccgaucugcag

SEQ ID NO: 1457215 - RNA, 17 nt, Pseudomonas aeruginosa PA01
gucgccgaucugcaggu

SEQ ID NO: 1457216 - RNA, 21 nt, Pseudomonas aeruginosa PA01
gucgccgcacaccgcgcgcgc

SEQ ID NO: 1457217 - RNA, 14 nt, Pseudomonas aeruginosa PA01
gucgccgcaccggc

SEQ ID NO: 1457218 - RNA, 19 nt, Pseudomonas aeruginosa PA01
gucgccgcaccggcgaugg

SEQ ID NO: 1457219 - RNA, 22 nt, Pseudomonas aeruginosa PA01
gucgccgcaccggcgauggccg

SEQ ID NO: 1457220 - RNA, 23 nt, Pseudomonas aeruginosa PA01
gucgccgauuucgcagaacgcgg

SEQ ID NO: 1457221 - RNA, 18 nt, Pseudomonas aeruginosa PA01
gucgccggaggggcggcc

SEQ ID NO: 1457222 - RNA, 20 nt, Pseudomonas aeruginosa PA01
gucgccggaggggcggccgc

SEQ ID NO: 1457223 - RNA, 23 nt, Pseudomonas aeruginosa PA01
gucgccggagucguagcgcgcgg

SEQ ID NO: 1457224 - RNA, 21 nt, Pseudomonas aeruginosa PA01
gucgccgcucauccgcuggua

SEQ ID NO: 1457225 - RNA, 22 nt, Pseudomonas aeruginosa PA01
gucgccgcugaugcgcuggucg

SEQ ID NO: 1457226 - RNA, 15 nt, Pseudomonas aeruginosa PA01
gucgccgcuggacga

SEQ ID NO: 1457227 - RNA, 15 nt, Pseudomonas aeruginosa PA01
gucgccgcgaccucg

SEQ ID NO: 1457228 - RNA, 15 nt, Pseudomonas aeruginosa PA01
gucgccgcggacggc

SEQ ID NO: 1457229 - RNA, 16 nt, Pseudomonas aeruginosa PA01
gucgccgcggacggcc

SEQ ID NO: 1457230 - RNA, 19 nt, Pseudomonas aeruginosa PA01
gucgccgcggacggccggc

SEQ ID NO: 1457231 - RNA, 20 nt, Pseudomonas aeruginosa PA01
gucgccgcggacggccggcu

SEQ ID NO: 1457232 - RNA, 13 nt, Pseudomonas aeruginosa PA01
gucgccgacugcg

SEQ ID NO: 1457233 - RNA, 17 nt, Pseudomonas aeruginosa PA01
gucgccgacuucggcaa

SEQ ID NO: 1457234 - RNA, 19 nt, Pseudomonas aeruginosa PA01
gucgccgacuucggcaagc

SEQ ID NO: 1457235 - RNA, 18 nt, Pseudomonas aeruginosa PA01
gucgcccgugccucggcg

SEQ ID NO: 1457236 - RNA, 17 nt, Pseudomonas aeruginosa PA01
gucgcccgggcgccacc

SEQ ID NO: 1457237 - RNA, 16 nt, Pseudomonas aeruginosa PA01
gucgcccgcuucgcca

SEQ ID NO: 1457238 - RNA, 13 nt, Pseudomonas aeruginosa PA01
gucgcccgccggc

SEQ ID NO: 1457239 - RNA, 15 nt, Pseudomonas aeruginosa PA01
gucgcccgccggcgu

SEQ ID NO: 1457240 - RNA, 18 nt, Pseudomonas aeruginosa PA01
gucgccccacagcggugg

SEQ ID NO: 1457241 - RNA, 15 nt, Pseudomonas aeruginosa PA01
gucgcccaucucggu

SEQ ID NO: 1457242 - RNA, 23 nt, Pseudomonas aeruginosa PA01
gucgcccaucucgguguccacca

SEQ ID NO: 1457243 - RNA, 15 nt, Pseudomonas aeruginosa PA01
gucgcccagcgccug

SEQ ID NO: 1457244 - RNA, 14 nt, Pseudomonas aeruginosa PA01
gucgcccaggccgc

SEQ ID NO: 1457245 - RNA, 17 nt, Pseudomonas aeruginosa PA01
gucgcccaggccgcugg

SEQ ID NO: 1457246 - RNA, 20 nt, Pseudomonas aeruginosa PA01
gucgcccaggccgcuggcgg

SEQ ID NO: 1457247 - RNA, 21 nt, Pseudomonas aeruginosa PA01
gucgcccaggccgcuggcggc

SEQ ID NO: 1457248 - RNA, 19 nt, Pseudomonas aeruginosa PA01
gucgccccgguuggcgccc

SEQ ID NO: 1457249 - RNA, 21 nt, Pseudomonas aeruginosa PA01
gucgccccgguuggcgcccca

SEQ ID NO: 1457250 - RNA, 24 nt, Pseudomonas aeruginosa PA01
gucgccguagaacagcacgucgau

SEQ ID NO: 1457251 - RNA, 17 nt, Pseudomonas aeruginosa PA01
gucgccguccaccaagc

SEQ ID NO: 1457252 - RNA, 19 nt, Pseudomonas aeruginosa PA01
gucgccggucaggcugcgg

SEQ ID NO: 1457253 - RNA, 17 nt, Pseudomonas aeruginosa PA01
gucgccguggaugucga

SEQ ID NO: 1457254 - RNA, 20 nt, Pseudomonas aeruginosa PA01
gucgcgcagcuccucggcgu

SEQ ID NO: 1457255 - RNA, 22 nt, Pseudomonas aeruginosa PA01
gucgccucgaacauggccaccg

SEQ ID NO: 1457256 - RNA, 16 nt, Pseudomonas aeruginosa PA01
gucgcgcagggccagg

SEQ ID NO: 1457257 - RNA, 14 nt, Pseudomonas aeruginosa PA01
gucgccgugguggc

SEQ ID NO: 1457258 - RNA, 19 nt, Pseudomonas aeruginosa PA01
gucgccgugguggccgugg

SEQ ID NO: 1457259 - RNA, 17 nt, Pseudomonas aeruginosa PA01
gucgccguucagguuca

SEQ ID NO: 1457260 - RNA, 17 nt, Pseudomonas aeruginosa PA01
gucgccguuggccuuca

SEQ ID NO: 1457261 - RNA, 13 nt, Pseudomonas aeruginosa PA01
gucgcgcagcgcc

SEQ ID NO: 1457262 - RNA, 12 nt, Pseudomonas aeruginosa PA01
gucgcgccaggc

SEQ ID NO: 1457263 - RNA, 13 nt, Pseudomonas aeruginosa PA01
gucgcgccagcac

SEQ ID NO: 1457264 - RNA, 14 nt, Pseudomonas aeruginosa PA01
gucgcgccagcacc

SEQ ID NO: 1457265 - RNA, 13 nt, Pseudomonas aeruginosa PA01
gucgcgcccgcug

SEQ ID NO: 1457266 - RNA, 18 nt, Pseudomonas aeruginosa PA01
gucgcgcccgcugugcgg

SEQ ID NO: 1457267 - RNA, 15 nt, Pseudomonas aeruginosa PA01
gucgcgcgugccccg

SEQ ID NO: 1457268 - RNA, 16 nt, Pseudomonas aeruginosa PA01
gucgcgcgugccccgu

SEQ ID NO: 1457269 - RNA, 17 nt, Pseudomonas aeruginosa PA01
gucgcgcgugccccgug

SEQ ID NO: 1457270 - RNA, 20 nt, Pseudomonas aeruginosa PA01
gucgcgcgugccccguggcg

SEQ ID NO: 1457271 - RNA, 16 nt, Pseudomonas aeruginosa PA01
gucgcgcucaggcgca

SEQ ID NO: 1457272 - RNA, 17 nt, Pseudomonas aeruginosa PA01
gucgcgcucaggcgcag

SEQ ID NO: 1457273 - RNA, 18 nt, Pseudomonas aeruginosa PA01
gucgcgcucaggcgcagc

SEQ ID NO: 1457274 - RNA, 19 nt, Pseudomonas aeruginosa PA01
gucgcgcucaggcgcagcg

SEQ ID NO: 1457275 - RNA, 19 nt, Pseudomonas aeruginosa PA01
gucgcgcuguugccgcgcu

SEQ ID NO: 1457276 - RNA, 12 nt, Pseudomonas aeruginosa PA01
gucgcgcuggac

SEQ ID NO: 1457277 - RNA, 14 nt, Pseudomonas aeruginosa PA01
gucgcggacccgcg

SEQ ID NO: 1457278 - RNA, 16 nt, Pseudomonas aeruginosa PA01
gucgcggacccgcgcc

SEQ ID NO: 1457279 - RNA, 19 nt, Pseudomonas aeruginosa PA01
gucgcggacccgcgccggc

SEQ ID NO: 1457280 - RNA, 17 nt, Pseudomonas aeruginosa PA01
gucgcgccccgccagga

SEQ ID NO: 1457281 - RNA, 15 nt, Pseudomonas aeruginosa PA01
gucgcggaacucgau

SEQ ID NO: 1457282 - RNA, 23 nt, Pseudomonas aeruginosa PA01
gucgcggaacucgaugaaaccgg

SEQ ID NO: 1457283 - RNA, 12 nt, Pseudomonas aeruginosa PA01
gucgcgcuucag

SEQ ID NO: 1457284 - RNA, 13 nt, Pseudomonas aeruginosa PA01
gucgcgcuugccu

SEQ ID NO: 1457285 - RNA, 23 nt, Pseudomonas aeruginosa PA01
gucgcgcuugccuuccugggcgu

SEQ ID NO: 1457286 - RNA, 23 nt, Pseudomonas aeruginosa PA01
gucgcgcuuguugaucaccaccg

SEQ ID NO: 1457287 - RNA, 17 nt, Pseudomonas aeruginosa PA01
gucggcgacgaugccgc

SEQ ID NO: 1457288 - RNA, 19 nt, Pseudomonas aeruginosa PA01
gucggcgacgaugccgccg

SEQ ID NO: 1457289 - RNA, 20 nt, Pseudomonas aeruginosa PA01
gucggcgacgaugccgccgc

SEQ ID NO: 1457290 - RNA, 13 nt, Pseudomonas aeruginosa PA01
gucggcgagccgg

SEQ ID NO: 1457291 - RNA, 15 nt, Pseudomonas aeruginosa PA01
gucggcgagccggcg

SEQ ID NO: 1457292 - RNA, 15 nt, Pseudomonas aeruginosa PA01
gucggcgaucacguc

SEQ ID NO: 1457293 - RNA, 23 nt, Pseudomonas aeruginosa PA01
gucggcgaucacguccuugacca

SEQ ID NO: 1457294 - RNA, 15 nt, Pseudomonas aeruginosa PA01
gucggcgaucgccag

SEQ ID NO: 1457295 - RNA, 17 nt, Pseudomonas aeruginosa PA01
gucggcgaucaggccga

SEQ ID NO: 1457296 - RNA, 20 nt, Pseudomonas aeruginosa PA01
gucggcgaucaggccgaugc

SEQ ID NO: 1457297 - RNA, 19 nt, Pseudomonas aeruginosa PA01
gucggcgaaguccaccagg

SEQ ID NO: 1457298 - RNA, 20 nt, Pseudomonas aeruginosa PA01
gucggcgaaguccaccaggc

SEQ ID NO: 1457299 - RNA, 23 nt, Pseudomonas aeruginosa PA01
gucggcgaaguccaccaggcgcc

SEQ ID NO: 1457300 - RNA, 22 nt, Pseudomonas aeruginosa PA01
gucggcgaacccggcgcggcgc

SEQ ID NO: 1457301 - RNA, 19 nt, Pseudomonas aeruginosa PA01
gucggcgaacuggccaccg

SEQ ID NO: 1457302 - RNA, 15 nt, Pseudomonas aeruginosa PA01
gucggcgaagccugc

SEQ ID NO: 1457303 - RNA, 18 nt, Pseudomonas aeruginosa PA01
gucggcgaagccugcggc

SEQ ID NO: 1457304 - RNA, 20 nt, Pseudomonas aeruginosa PA01
gucggcgaucugugcgagcg

SEQ ID NO: 1457305 - RNA, 16 nt, Pseudomonas aeruginosa PA01
gucggcgaugcgcugg

SEQ ID NO: 1457306 - RNA, 17 nt, Pseudomonas aeruginosa PA01
gucggcgaugcgcugga

SEQ ID NO: 1457307 - RNA, 13 nt, Pseudomonas aeruginosa PA01
gucggcgcgacgg

SEQ ID NO: 1457308 - RNA, 15 nt, Pseudomonas aeruginosa PA01
gucggcgcgacggcc

SEQ ID NO: 1457309 - RNA, 21 nt, Pseudomonas aeruginosa PA01
gucggccggcagcuccggcgg

SEQ ID NO: 1457310 - RNA, 14 nt, Pseudomonas aeruginosa PA01
gucggccgcccagc

SEQ ID NO: 1457311 - RNA, 17 nt, Pseudomonas aeruginosa PA01
gucggccgcccagcgga

SEQ ID NO: 1457312 - RNA, 21 nt, Pseudomonas aeruginosa PA01
gucggccgcccagcggaugcg

SEQ ID NO: 1457313 - RNA, 14 nt, Pseudomonas aeruginosa PA01
gucggccucggcga

SEQ ID NO: 1457314 - RNA, 16 nt, Pseudomonas aeruginosa PA01
gucggccucggcgagg

SEQ ID NO: 1457315 - RNA, 18 nt, Pseudomonas aeruginosa PA01
gucggccguugcgggcga

SEQ ID NO: 1457316 - RNA, 14 nt, Pseudomonas aeruginosa PA01
gucggccucgacga

SEQ ID NO: 1457317 - RNA, 21 nt, Pseudomonas aeruginosa PA01
gucggccucgagcaucuccgg

SEQ ID NO: 1457318 - RNA, 19 nt, Pseudomonas aeruginosa PA01
gucggccggggucaggccg

SEQ ID NO: 1457319 - RNA, 20 nt, Pseudomonas aeruginosa PA01
gucggccggggucaggccga

SEQ ID NO: 1457320 - RNA, 13 nt, Pseudomonas aeruginosa PA01
gucggccucggcg

SEQ ID NO: 1457321 - RNA, 17 nt, Pseudomonas aeruginosa PA01
gucggccuguucgccca

SEQ ID NO: 1457322 - RNA, 18 nt, Pseudomonas aeruginosa PA01
gucggccuguucgcccaa

SEQ ID NO: 1457323 - RNA, 17 nt, Pseudomonas aeruginosa PA01
gucggccuugaacacgg

SEQ ID NO: 1457324 - RNA, 15 nt, Pseudomonas aeruginosa PA01
gucggccuggcgcag

SEQ ID NO: 1457325 - RNA, 16 nt, Pseudomonas aeruginosa PA01
gucggccuggcgcagc

SEQ ID NO: 1457326 - RNA, 12 nt, Pseudomonas aeruginosa PA01
gucggccugggu

SEQ ID NO: 1457327 - RNA, 22 nt, Pseudomonas aeruginosa PA01
gucggccuggguacgcaccggc

SEQ ID NO: 1457328 - RNA, 21 nt, Pseudomonas aeruginosa PA01
gucggccugcaacacccaggc

SEQ ID NO: 1457329 - RNA, 13 nt, Pseudomonas aeruginosa PA01
gucggccugcacc

SEQ ID NO: 1457330 - RNA, 16 nt, Pseudomonas aeruginosa PA01
gucggccugcaccagc

SEQ ID NO: 1457331 - RNA, 14 nt, Pseudomonas aeruginosa PA01
gucggccugcucga

SEQ ID NO: 1457332 - RNA, 19 nt, Pseudomonas aeruginosa PA01
gucggccugcagccuggcg

SEQ ID NO: 1457333 - RNA, 14 nt, Pseudomonas aeruginosa PA01
gucggccugcugcu

SEQ ID NO: 1457334 - RNA, 15 nt, Pseudomonas aeruginosa PA01
gucggccugcugcuc

SEQ ID NO: 1457335 - RNA, 14 nt, Pseudomonas aeruginosa PA01
gucggccaucgccg

SEQ ID NO: 1457336 - RNA, 15 nt, Pseudomonas aeruginosa PA01
gucggccaucgccgu

SEQ ID NO: 1457337 - RNA, 19 nt, Pseudomonas aeruginosa PA01
gucggccaucgccgucucg

SEQ ID NO: 1457338 - RNA, 22 nt, Pseudomonas aeruginosa PA01
gucggccaucuggcugccgagg

SEQ ID NO: 1457339 - RNA, 19 nt, Pseudomonas aeruginosa PA01
gucggccaggcggccgacg

SEQ ID NO: 1457340 - RNA, 22 nt, Pseudomonas aeruginosa PA01
gucggccaggggagcgccggcg

SEQ ID NO: 1457341 - RNA, 23 nt, Pseudomonas aeruginosa PA01
gucggccaggggagcgccggcgc

SEQ ID NO: 1457342 - RNA, 14 nt, Pseudomonas aeruginosa PA01
gucggccaggucgc

SEQ ID NO: 1457343 - RNA, 20 nt, Pseudomonas aeruginosa PA01
gucggcccuccccuggcccu

SEQ ID NO: 1457344 - RNA, 12 nt, Pseudomonas aeruginosa PA01
gucggccgacgg

SEQ ID NO: 1457345 - RNA, 22 nt, Pseudomonas aeruginosa PA01
gucggcccggagaccgugccgc

SEQ ID NO: 1457346 - RNA, 19 nt, Pseudomonas aeruginosa PA01
gucggugaagcgcggcggc

SEQ ID NO: 1457347 - RNA, 14 nt, Pseudomonas aeruginosa PA01
gucgggcuucagcg

SEQ ID NO: 1457348 - RNA, 16 nt, Pseudomonas aeruginosa PA01
gucgggcuucagcgcc

SEQ ID NO: 1457349 - RNA, 21 nt, Pseudomonas aeruginosa PA01
gucgguccagcuccuugcgcu

SEQ ID NO: 1457350 - RNA, 17 nt, Pseudomonas aeruginosa PA01
gucgguccgccgaugcg

SEQ ID NO: 1457351 - RNA, 23 nt, Pseudomonas aeruginosa PA01
gucggucgaacugaccaccagga

SEQ ID NO: 1457352 - RNA, 13 nt, Pseudomonas aeruginosa PA01
gucggucggcguc

SEQ ID NO: 1457353 - RNA, 20 nt, Pseudomonas aeruginosa PA01
gucgggcgaaacggcaggcc

SEQ ID NO: 1457354 - RNA, 12 nt, Pseudomonas aeruginosa PA01
gucgggccgcgc

SEQ ID NO: 1457355 - RNA, 16 nt, Pseudomonas aeruginosa PA01
gucgggccgcgcucgg

SEQ ID NO: 1457356 - RNA, 16 nt, Pseudomonas aeruginosa PA01
gucgggcucagaaguc

SEQ ID NO: 1457357 - RNA, 21 nt, Pseudomonas aeruginosa PA01
gucgggcucaugggcgaugcg

SEQ ID NO: 1457358 - RNA, 15 nt, Pseudomonas aeruginosa PA01
gucgggcgccgcgcc

SEQ ID NO: 1457359 - RNA, 21 nt, Pseudomonas aeruginosa PA01
gucgggcagauguccaggcag

SEQ ID NO: 1457360 - RNA, 17 nt, Pseudomonas aeruginosa PA01
gucgggcaguuccgcca

SEQ ID NO: 1457361 - RNA, 20 nt, Pseudomonas aeruginosa PA01
gucgggcaguuccgccagau

SEQ ID NO: 1457362 - RNA, 21 nt, Pseudomonas aeruginosa PA01
gucgggcaguuccgccagaug

SEQ ID NO: 1457363 - RNA, 11 nt, Pseudomonas aeruginosa PA01
gucggcgcggg

SEQ ID NO: 1457364 - RNA, 15 nt, Pseudomonas aeruginosa PA01
gucggcgcggccggc

SEQ ID NO: 1457365 - RNA, 13 nt, Pseudomonas aeruginosa PA01
gucggcgcggccg

SEQ ID NO: 1457366 - RNA, 24 nt, Pseudomonas aeruginosa PA01
gucggcgcgcgacacauggucggc

SEQ ID NO: 1457367 - RNA, 13 nt, Pseudomonas aeruginosa PA01
gucggcgcgcccg

SEQ ID NO: 1457368 - RNA, 17 nt, Pseudomonas aeruginosa PA01
gucggcgcgcccggcgc

SEQ ID NO: 1457369 - RNA, 12 nt, Pseudomonas aeruginosa PA01
gucggcgcugga

SEQ ID NO: 1457370 - RNA, 23 nt, Pseudomonas aeruginosa PA01
gucggcgcggggcccggcuccag

SEQ ID NO: 1457371 - RNA, 22 nt, Pseudomonas aeruginosa PA01
gucggcggcacccucuuccgcg

SEQ ID NO: 1457372 - RNA, 13 nt, Pseudomonas aeruginosa PA01
gucggcggcacgc

SEQ ID NO: 1457373 - RNA, 19 nt, Pseudomonas aeruginosa PA01
gucggcggcagcugcggcg

SEQ ID NO: 1457374 - RNA, 21 nt, Pseudomonas aeruginosa PA01
gucggcggcagcugcggcggc

SEQ ID NO: 1457375 - RNA, 16 nt, Pseudomonas aeruginosa PA01
gucggcgcgggcgccg

SEQ ID NO: 1457376 - RNA, 13 nt, Pseudomonas aeruginosa PA01
gucggcgcugucg

SEQ ID NO: 1457377 - RNA, 16 nt, Pseudomonas aeruginosa PA01
gucggcgcugucgccg

SEQ ID NO: 1457378 - RNA, 11 nt, Pseudomonas aeruginosa PA01
gucggcggccu

SEQ ID NO: 1457379 - RNA, 16 nt, Pseudomonas aeruginosa PA01
gucggcggccucggcc

SEQ ID NO: 1457380 - RNA, 17 nt, Pseudomonas aeruginosa PA01
gucggcggccgccuuga

SEQ ID NO: 1457381 - RNA, 19 nt, Pseudomonas aeruginosa PA01
gucggcggcgccuucgccg

SEQ ID NO: 1457382 - RNA, 22 nt, Pseudomonas aeruginosa PA01
gucggcggcgccuucgccggaa

SEQ ID NO: 1457383 - RNA, 20 nt, Pseudomonas aeruginosa PA01
gucggcgugguugccugcug

SEQ ID NO: 1457384 - RNA, 14 nt, Pseudomonas aeruginosa PA01
gucgggaucgagca

SEQ ID NO: 1457385 - RNA, 16 nt, Pseudomonas aeruginosa PA01
gucgggcaacggcugg

SEQ ID NO: 1457386 - RNA, 20 nt, Pseudomonas aeruginosa PA01
gucggcgucuugucgaagcc

SEQ ID NO: 1457387 - RNA, 15 nt, Pseudomonas aeruginosa PA01
gucggcgggaagggu

SEQ ID NO: 1457388 - RNA, 16 nt, Pseudomonas aeruginosa PA01
gucggcguccauggcg

SEQ ID NO: 1457389 - RNA, 20 nt, Pseudomonas aeruginosa PA01
gucggcguccauggcggcga

SEQ ID NO: 1457390 - RNA, 13 nt, Pseudomonas aeruginosa PA01
gucggcguccgcc

SEQ ID NO: 1457391 - RNA, 14 nt, Pseudomonas aeruginosa PA01
gucggcguccgccu

SEQ ID NO: 1457392 - RNA, 15 nt, Pseudomonas aeruginosa PA01
gucucaggcgccagg

SEQ ID NO: 1457393 - RNA, 16 nt, Pseudomonas aeruginosa PA01
gucucaggcgccaggc

SEQ ID NO: 1457394 - RNA, 20 nt, Pseudomonas aeruginosa PA01
gucucaggggccgacgcgcu

SEQ ID NO: 1457395 - RNA, 20 nt, Pseudomonas aeruginosa PA01
gucuaucccgugccgggcca

SEQ ID NO: 1457396 - RNA, 13 nt, Pseudomonas aeruginosa PA01
gucuagcgccccg

SEQ ID NO: 1457397 - RNA, 18 nt, Pseudomonas aeruginosa PA01
gucuagcgccccggccgc

SEQ ID NO: 1457398 - RNA, 22 nt, Pseudomonas aeruginosa PA01
gucuagcgccccggccgcgcca

SEQ ID NO: 1457399 - RNA, 23 nt, Pseudomonas aeruginosa PA01
gucuagcgccccggccgcgccag

SEQ ID NO: 1457400 - RNA, 18 nt, Pseudomonas aeruginosa PA01
gucguuuuguccggcggc

SEQ ID NO: 1457401 - RNA, 15 nt, Pseudomonas aeruginosa PA01
gucgugcgccggccu

SEQ ID NO: 1457402 - RNA, 16 nt, Pseudomonas aeruginosa PA01
gucgugcgccggccuc

SEQ ID NO: 1457403 - RNA, 19 nt, Pseudomonas aeruginosa PA01
gucgugcccgagcgacugg

SEQ ID NO: 1457404 - RNA, 14 nt, Pseudomonas aeruginosa PA01
gucgugcagcagcg

SEQ ID NO: 1457405 - RNA, 21 nt, Pseudomonas aeruginosa PA01
gucguggccauagagccgcug

SEQ ID NO: 1457406 - RNA, 21 nt, Pseudomonas aeruginosa PA01
gucguggacauacaggcgcgc

SEQ ID NO: 1457407 - RNA, 15 nt, Pseudomonas aeruginosa PA01
gucguuggccggcug

SEQ ID NO: 1457408 - RNA, 22 nt, Pseudomonas aeruginosa PA01
gucguuggccaggcgcgacagc

SEQ ID NO: 1457409 - RNA, 13 nt, Pseudomonas aeruginosa PA01
gucguccggcgcc

SEQ ID NO: 1457410 - RNA, 20 nt, Pseudomonas aeruginosa PA01
gucguccggguucaugucgg

SEQ ID NO: 1457411 - RNA, 20 nt, Pseudomonas aeruginosa PA01
gucguccugcgcggcgacga

SEQ ID NO: 1457412 - RNA, 16 nt, Pseudomonas aeruginosa PA01
gucguccaucgccgcg

SEQ ID NO: 1457413 - RNA, 17 nt, Pseudomonas aeruginosa PA01
gucguccagggcgcuuu

SEQ ID NO: 1457414 - RNA, 20 nt, Pseudomonas aeruginosa PA01
gucguccaucgacagggucg

SEQ ID NO: 1457415 - RNA, 20 nt, Pseudomonas aeruginosa PA01
gucgucgccaucgcucaccg

SEQ ID NO: 1457416 - RNA, 17 nt, Pseudomonas aeruginosa PA01
gucgucgcccuggccga

SEQ ID NO: 1457417 - RNA, 18 nt, Pseudomonas aeruginosa PA01
gucgucgcccuggccgau

SEQ ID NO: 1457418 - RNA, 16 nt, Pseudomonas aeruginosa PA01
gucgucgaagcgcagc

SEQ ID NO: 1457419 - RNA, 19 nt, Pseudomonas aeruginosa PA01
gucgucgaagcgcagcagg

SEQ ID NO: 1457420 - RNA, 23 nt, Pseudomonas aeruginosa PA01
gucgucgaagcgcagcaggucuu

SEQ ID NO: 1457421 - RNA, 22 nt, Pseudomonas aeruginosa PA01
gucgucgaaguuuuccacgaag

SEQ ID NO: 1457422 - RNA, 16 nt, Pseudomonas aeruginosa PA01
gucgugcagguguucg

SEQ ID NO: 1457423 - RNA, 13 nt, Pseudomonas aeruginosa PA01
gucgucgcggcgc

SEQ ID NO: 1457424 - RNA, 18 nt, Pseudomonas aeruginosa PA01
gucgucgcgguacagccg

SEQ ID NO: 1457425 - RNA, 14 nt, Pseudomonas aeruginosa PA01
gucgucgcugcgcg

SEQ ID NO: 1457426 - RNA, 14 nt, Pseudomonas aeruginosa PA01
gucgucgcuggcgg

SEQ ID NO: 1457427 - RNA, 17 nt, Pseudomonas aeruginosa PA01
gucuccgugcuggccgg

SEQ ID NO: 1457428 - RNA, 19 nt, Pseudomonas aeruginosa PA01
gucuccgugcuggccggca

SEQ ID NO: 1457429 - RNA, 23 nt, Pseudomonas aeruginosa PA01
gucuccggggagauguccaucag

SEQ ID NO: 1457430 - RNA, 14 nt, Pseudomonas aeruginosa PA01
gucucuuccagcau

SEQ ID NO: 1457431 - RNA, 15 nt, Pseudomonas aeruginosa PA01
gucuccaggaccagu

SEQ ID NO: 1457432 - RNA, 22 nt, Pseudomonas aeruginosa PA01
gucugcaacccuuugauggcgc

SEQ ID NO: 1457433 - RNA, 22 nt, Pseudomonas aeruginosa PA01
gucugcaccucaugcugcgcgg

SEQ ID NO: 1457434 - RNA, 19 nt, Pseudomonas aeruginosa PA01
gucugccagcucuggccgu

SEQ ID NO: 1457435 - RNA, 18 nt, Pseudomonas aeruginosa PA01
gucugcccguggcgcgga

SEQ ID NO: 1457436 - RNA, 14 nt, Pseudomonas aeruginosa PA01
gucugcccguucug

SEQ ID NO: 1457437 - RNA, 20 nt, Pseudomonas aeruginosa PA01
gucugccgcucguuggcggc

SEQ ID NO: 1457438 - RNA, 22 nt, Pseudomonas aeruginosa PA01
gucugccgcucguuggcggcca

SEQ ID NO: 1457439 - RNA, 14 nt, Pseudomonas aeruginosa PA01
gucugccgcuggcg

SEQ ID NO: 1457440 - RNA, 17 nt, Pseudomonas aeruginosa PA01
gucugccgcuggcggcc

SEQ ID NO: 1457441 - RNA, 14 nt, Pseudomonas aeruginosa PA01
gucugccucgccga

SEQ ID NO: 1457442 - RNA, 21 nt, Pseudomonas aeruginosa PA01
gucugcgaguugaucggcgug

SEQ ID NO: 1457443 - RNA, 15 nt, Pseudomonas aeruginosa PA01
gucuugucgaagccc

SEQ ID NO: 1457444 - RNA, 24 nt, Pseudomonas aeruginosa PA01
gucuuuggucuaauggcaccugga

SEQ ID NO: 1457445 - RNA, 14 nt, Pseudomonas aeruginosa PA01
gugaaaagcggcgu

SEQ ID NO: 1457446 - RNA, 14 nt, Pseudomonas aeruginosa PA01
gugaaacgccagaa

SEQ ID NO: 1457447 - RNA, 22 nt, Pseudomonas aeruginosa PA01
gugaaaccgauauaggcgacga

SEQ ID NO: 1457448 - RNA, 15 nt, Pseudomonas aeruginosa PA01
gugaaaccggcaagc

SEQ ID NO: 1457449 - RNA, 17 nt, Pseudomonas aeruginosa PA01
gucugugccgaggccgc

SEQ ID NO: 1457450 - RNA, 23 nt, Pseudomonas aeruginosa PA01
gucuucaggccgaguccgcgcgc

SEQ ID NO: 1457451 - RNA, 16 nt, Pseudomonas aeruginosa PA01
gucuucaggcgcuccu

SEQ ID NO: 1457452 - RNA, 21 nt, Pseudomonas aeruginosa PA01
gucuucaguaggccagcggcu

SEQ ID NO: 1457453 - RNA, 15 nt, Pseudomonas aeruginosa PA01
gucuguucggccagg

SEQ ID NO: 1457454 - RNA, 22 nt, Pseudomonas aeruginosa PA01
gucuguugguggggcgccggcu

SEQ ID NO: 1457455 - RNA, 20 nt, Pseudomonas aeruginosa PA01
gucuuccucggugucggcca

SEQ ID NO: 1457456 - RNA, 20 nt, Pseudomonas aeruginosa PA01
gucuuccugcacgcugcgcc

SEQ ID NO: 1457457 - RNA, 15 nt, Pseudomonas aeruginosa PA01
gucuuccagggcggc

SEQ ID NO: 1457458 - RNA, 18 nt, Pseudomonas aeruginosa PA01
gucuuccagggcggcgcg

SEQ ID NO: 1457459 - RNA, 20 nt, Pseudomonas aeruginosa PA01
gucuuccagggcggcgcgga

SEQ ID NO: 1457460 - RNA, 20 nt, Pseudomonas aeruginosa PA01
gucuugcgcuugccggccgc

SEQ ID NO: 1457461 - RNA, 17 nt, Pseudomonas aeruginosa PA01
gucuuccggcucgccgc

SEQ ID NO: 1457462 - RNA, 15 nt, Pseudomonas aeruginosa PA01
guggagucaggcgcc

SEQ ID NO: 1457463 - RNA, 17 nt, Pseudomonas aeruginosa PA01
guggagucaggcgccgg

SEQ ID NO: 1457464 - RNA, 13 nt, Pseudomonas aeruginosa PA01
guggaggcggcgg

SEQ ID NO: 1457465 - RNA, 14 nt, Pseudomonas aeruginosa PA01
guggaggcggcggu

SEQ ID NO: 1457466 - RNA, 22 nt, Pseudomonas aeruginosa PA01
guggaugccgguggcgcccagc

SEQ ID NO: 1457467 - RNA, 17 nt, Pseudomonas aeruginosa PA01
guggaucgcccgaacgc

SEQ ID NO: 1457468 - RNA, 18 nt, Pseudomonas aeruginosa PA01
guggaucgcccgaacgcc

SEQ ID NO: 1457469 - RNA, 13 nt, Pseudomonas aeruginosa PA01
guggaucgcccgg

SEQ ID NO: 1457470 - RNA, 17 nt, Pseudomonas aeruginosa PA01
guggaucgcccggcugc

SEQ ID NO: 1457471 - RNA, 22 nt, Pseudomonas aeruginosa PA01
guggaucgcggcguaggcgcgc

SEQ ID NO: 1457472 - RNA, 19 nt, Pseudomonas aeruginosa PA01
guggcaacugccgcccgcu

SEQ ID NO: 1457473 - RNA, 20 nt, Pseudomonas aeruginosa PA01
guggauguucgccgccacca

SEQ ID NO: 1457474 - RNA, 15 nt, Pseudomonas aeruginosa PA01
guggauugcagcguc

SEQ ID NO: 1457475 - RNA, 15 nt, Pseudomonas aeruginosa PA01
guggcacccaggcca

SEQ ID NO: 1457476 - RNA, 21 nt, Pseudomonas aeruginosa PA01
guggcacccaggccacgccca

SEQ ID NO: 1457477 - RNA, 14 nt, Pseudomonas aeruginosa PA01
guggcaccaggucg

SEQ ID NO: 1457478 - RNA, 14 nt, Pseudomonas aeruginosa PA01
guggaccagcgccg

SEQ ID NO: 1457479 - RNA, 18 nt, Pseudomonas aeruginosa PA01
guggacauacaggcgcgc

SEQ ID NO: 1457480 - RNA, 23 nt, Pseudomonas aeruginosa PA01
guggacgaaacgguagcccgcgg

SEQ ID NO: 1457481 - RNA, 20 nt, Pseudomonas aeruginosa PA01
guggacugguugaccugcag

SEQ ID NO: 1457482 - RNA, 18 nt, Pseudomonas aeruginosa PA01
guggagccggugccggcg

SEQ ID NO: 1457483 - RNA, 14 nt, Pseudomonas aeruginosa PA01
guggacgucggcgu

SEQ ID NO: 1457484 - RNA, 19 nt, Pseudomonas aeruginosa PA01
guggacggucucgccgccg

SEQ ID NO: 1457485 - RNA, 14 nt, Pseudomonas aeruginosa PA01
guggagaggucgcc

SEQ ID NO: 1457486 - RNA, 15 nt, Pseudomonas aeruginosa PA01
guggagaggucgccg

SEQ ID NO: 1457487 - RNA, 18 nt, Pseudomonas aeruginosa PA01
gugcuugacgaaggcggc

SEQ ID NO: 1457488 - RNA, 20 nt, Pseudomonas aeruginosa PA01
gugcuuggugucggccgcca

SEQ ID NO: 1457489 - RNA, 19 nt, Pseudomonas aeruginosa PA01
gugcuuguccaccaccgac

SEQ ID NO: 1457490 - RNA, 17 nt, Pseudomonas aeruginosa PA01
guggaaaccucgccgau

SEQ ID NO: 1457491 - RNA, 21 nt, Pseudomonas aeruginosa PA01
gugcuuugcccgucuagcgca

SEQ ID NO: 1457492 - RNA, 16 nt, Pseudomonas aeruginosa PA01
guggaagccguggcgg

SEQ ID NO: 1457493 - RNA, 22 nt, Pseudomonas aeruginosa PA01
guggaacgaggcgacccggguc

SEQ ID NO: 1457494 - RNA, 18 nt, Pseudomonas aeruginosa PA01
guggaacccauggcgcga

SEQ ID NO: 1457495 - RNA, 22 nt, Pseudomonas aeruginosa PA01
guggaacccauggcgcgaugcu

SEQ ID NO: 1457496 - RNA, 16 nt, Pseudomonas aeruginosa PA01
guggaaccgcggcgcc

SEQ ID NO: 1457497 - RNA, 18 nt, Pseudomonas aeruginosa PA01
guggaaguacggcgcggu

SEQ ID NO: 1457498 - RNA, 17 nt, Pseudomonas aeruginosa PA01
guggaauccagggccga

SEQ ID NO: 1457499 - RNA, 20 nt, Pseudomonas aeruginosa PA01
guggaauccagggccgagca

SEQ ID NO: 1457500 - RNA, 15 nt, Pseudomonas aeruginosa PA01
guggaaguggacggg

SEQ ID NO: 1457501 - RNA, 14 nt, Pseudomonas aeruginosa PA01
gugcuggcgcaaca

SEQ ID NO: 1457502 - RNA, 14 nt, Pseudomonas aeruginosa PA01
gugcugggcgaccu

SEQ ID NO: 1457503 - RNA, 22 nt, Pseudomonas aeruginosa PA01
gugcugggcgaccuucagcggg

SEQ ID NO: 1457504 - RNA, 18 nt, Pseudomonas aeruginosa PA01
gugcugggucacguggcc

SEQ ID NO: 1457505 - RNA, 20 nt, Pseudomonas aeruginosa PA01
gugcugggucacguggccgc

SEQ ID NO: 1457506 - RNA, 21 nt, Pseudomonas aeruginosa PA01
gugcuggguggaggcccagau

SEQ ID NO: 1457507 - RNA, 11 nt, Pseudomonas aeruginosa PA01
gugcuggcgga

SEQ ID NO: 1457508 - RNA, 22 nt, Pseudomonas aeruginosa PA01
gugcuggcuauucgcccagugg

SEQ ID NO: 1457509 - RNA, 17 nt, Pseudomonas aeruginosa PA01
gugcuggccggcagcag

SEQ ID NO: 1457510 - RNA, 22 nt, Pseudomonas aeruginosa PA01
gugcuggccacccuugcguccu

SEQ ID NO: 1457511 - RNA, 16 nt, Pseudomonas aeruginosa PA01
gugcuggugcggccga

SEQ ID NO: 1457512 - RNA, 16 nt, Pseudomonas aeruginosa PA01
gugcugguggcccugg

SEQ ID NO: 1457513 - RNA, 22 nt, Pseudomonas aeruginosa PA01
gugcuuacggagaagggcgcgc

SEQ ID NO: 1457514 - RNA, 16 nt, Pseudomonas aeruginosa PA01
gugcuguuguugccgg

SEQ ID NO: 1457515 - RNA, 16 nt, Pseudomonas aeruginosa PA01
gugcuguucagcgggu

SEQ ID NO: 1457516 - RNA, 17 nt, Pseudomonas aeruginosa PA01
guggccggcgaccagcu

SEQ ID NO: 1457517 - RNA, 21 nt, Pseudomonas aeruginosa PA01
guggccgucgaagggcacgcc

SEQ ID NO: 1457518 - RNA, 23 nt, Pseudomonas aeruginosa PA01
guggccgucgaagggcacgccgc

SEQ ID NO: 1457519 - RNA, 19 nt, Pseudomonas aeruginosa PA01
guggccggugugcgacugg

SEQ ID NO: 1457520 - RNA, 16 nt, Pseudomonas aeruginosa PA01
guggccgugcagcccu

SEQ ID NO: 1457521 - RNA, 17 nt, Pseudomonas aeruginosa PA01
guggccgugcagcccuc

SEQ ID NO: 1457522 - RNA, 23 nt, Pseudomonas aeruginosa PA01
guggccgcgccccacggcgcggc

SEQ ID NO: 1457523 - RNA, 13 nt, Pseudomonas aeruginosa PA01
guggccgcgccgc

SEQ ID NO: 1457524 - RNA, 19 nt, Pseudomonas aeruginosa PA01
guggccgcgccgcccuggc

SEQ ID NO: 1457525 - RNA, 22 nt, Pseudomonas aeruginosa PA01
guggccgcgccgcccuggccgc

SEQ ID NO: 1457526 - RNA, 12 nt, Pseudomonas aeruginosa PA01
guggccgccagg

SEQ ID NO: 1457527 - RNA, 14 nt, Pseudomonas aeruginosa PA01
guggccgccagggu

SEQ ID NO: 1457528 - RNA, 17 nt, Pseudomonas aeruginosa PA01
guggcccugggcggcga

SEQ ID NO: 1457529 - RNA, 17 nt, Pseudomonas aeruginosa PA01
guggcgaacgcccggcu

SEQ ID NO: 1457530 - RNA, 17 nt, Pseudomonas aeruginosa PA01
guggcgaagccagcacg

SEQ ID NO: 1457531 - RNA, 17 nt, Pseudomonas aeruginosa PA01
guggcgaaacuccagca

SEQ ID NO: 1457532 - RNA, 15 nt, Pseudomonas aeruginosa PA01
guggcgaacagcacc

SEQ ID NO: 1457533 - RNA, 22 nt, Pseudomonas aeruginosa PA01
guggcgaacagcaccuuggcca

SEQ ID NO: 1457534 - RNA, 14 nt, Pseudomonas aeruginosa PA01
guggcgaaccacga

SEQ ID NO: 1457535 - RNA, 14 nt, Pseudomonas aeruginosa PA01
guggcgacgccggu

SEQ ID NO: 1457536 - RNA, 16 nt, Pseudomonas aeruginosa PA01
guggcgacgcgcaggc

SEQ ID NO: 1457537 - RNA, 20 nt, Pseudomonas aeruginosa PA01
guggcgacgcgcaggccggu

SEQ ID NO: 1457538 - RNA, 21 nt, Pseudomonas aeruginosa PA01
guggccuccugcaacgccugg

SEQ ID NO: 1457539 - RNA, 14 nt, Pseudomonas aeruginosa PA01
guggccguggcgcc

SEQ ID NO: 1457540 - RNA, 21 nt, Pseudomonas aeruginosa PA01
guggccguugagcaccucgac

SEQ ID NO: 1457541 - RNA, 15 nt, Pseudomonas aeruginosa PA01
guggcccggcgcggc

SEQ ID NO: 1457542 - RNA, 16 nt, Pseudomonas aeruginosa PA01
guggccccagcgcgag

SEQ ID NO: 1457543 - RNA, 17 nt, Pseudomonas aeruginosa PA01
guggccccagcgcgagc

SEQ ID NO: 1457544 - RNA, 18 nt, Pseudomonas aeruginosa PA01
guggccccagcgcgagcg

SEQ ID NO: 1457545 - RNA, 19 nt, Pseudomonas aeruginosa PA01
guggccagcgaacccaggc

SEQ ID NO: 1457546 - RNA, 16 nt, Pseudomonas aeruginosa PA01
guggccagcgcccagg

SEQ ID NO: 1457547 - RNA, 17 nt, Pseudomonas aeruginosa PA01
guggccagcgcccaggc

SEQ ID NO: 1457548 - RNA, 20 nt, Pseudomonas aeruginosa PA01
guggccaggacgcuggcgau

SEQ ID NO: 1457549 - RNA, 18 nt, Pseudomonas aeruginosa PA01
guggccaggcgcaccagc

SEQ ID NO: 1457550 - RNA, 20 nt, Pseudomonas aeruginosa PA01
guggccaggcgcaccagcag

SEQ ID NO: 1457551 - RNA, 14 nt, Pseudomonas aeruginosa PA01
guggcaugggccag

SEQ ID NO: 1457552 - RNA, 22 nt, Pseudomonas aeruginosa PA01
guggcaugguguccggcggcga

SEQ ID NO: 1457553 - RNA, 20 nt, Pseudomonas aeruginosa PA01
guggcauucgucgccgcugg

SEQ ID NO: 1457554 - RNA, 20 nt, Pseudomonas aeruginosa PA01
guggcacguacguccagggc

SEQ ID NO: 1457555 - RNA, 20 nt, Pseudomonas aeruginosa PA01
guggcaggaaaugccuggcu

SEQ ID NO: 1457556 - RNA, 14 nt, Pseudomonas aeruginosa PA01
guggcaggcgcccg

SEQ ID NO: 1457557 - RNA, 16 nt, Pseudomonas aeruginosa PA01
guggcaggcgcccggu

SEQ ID NO: 1457558 - RNA, 23 nt, Pseudomonas aeruginosa PA01
gugggacaggaagagcaggcgga

SEQ ID NO: 1457559 - RNA, 23 nt, Pseudomonas aeruginosa PA01
gugggaagagcaucucgccggca

SEQ ID NO: 1457560 - RNA, 17 nt, Pseudomonas aeruginosa PA01
guggcguuuucccaggu

SEQ ID NO: 1457561 - RNA, 20 nt, Pseudomonas aeruginosa PA01
guggcuggccucggcgaucg

SEQ ID NO: 1457562 - RNA, 11 nt, Pseudomonas aeruginosa PA01
guggcugcgcu

SEQ ID NO: 1457563 - RNA, 21 nt, Pseudomonas aeruginosa PA01
guggcuuggcccugcgcgcgc

SEQ ID NO: 1457564 - RNA, 18 nt, Pseudomonas aeruginosa PA01
guggcucgaucagccggc

SEQ ID NO: 1457565 - RNA, 20 nt, Pseudomonas aeruginosa PA01
guggcucgaucagccggcgc

SEQ ID NO: 1457566 - RNA, 22 nt, Pseudomonas aeruginosa PA01
guggcucgaucagccggcgcgc

SEQ ID NO: 1457567 - RNA, 22 nt, Pseudomonas aeruginosa PA01
guggcucgauugcugaggggug

SEQ ID NO: 1457568 - RNA, 22 nt, Pseudomonas aeruginosa PA01
guggcuccgcgcguucagccac

SEQ ID NO: 1457569 - RNA, 16 nt, Pseudomonas aeruginosa PA01
guggcguuauccgccc

SEQ ID NO: 1457570 - RNA, 15 nt, Pseudomonas aeruginosa PA01
guggcguuccaggcg

SEQ ID NO: 1457571 - RNA, 18 nt, Pseudomonas aeruginosa PA01
guggcguuccaggcggcg

SEQ ID NO: 1457572 - RNA, 23 nt, Pseudomonas aeruginosa PA01
guggcguuccaggcggcggacga

SEQ ID NO: 1457573 - RNA, 21 nt, Pseudomonas aeruginosa PA01
guggcuauccuccaggccgcc

SEQ ID NO: 1457574 - RNA, 23 nt, Pseudomonas aeruginosa PA01
guggcuauccuccaggccgccgg

SEQ ID NO: 1457575 - RNA, 14 nt, Pseudomonas aeruginosa PA01
guggcgugcucggc

SEQ ID NO: 1457576 - RNA, 14 nt, Pseudomonas aeruginosa PA01
guggcgggcggccc

SEQ ID NO: 1457577 - RNA, 13 nt, Pseudomonas aeruginosa PA01
guggcgggccagc

SEQ ID NO: 1457578 - RNA, 14 nt, Pseudomonas aeruginosa PA01
guggcgggccagca

SEQ ID NO: 1457579 - RNA, 15 nt, Pseudomonas aeruginosa PA01
guggcgggccagcag

SEQ ID NO: 1457580 - RNA, 20 nt, Pseudomonas aeruginosa PA01
guggcgggccagcaggcgcu

SEQ ID NO: 1457581 - RNA, 14 nt, Pseudomonas aeruginosa PA01
guggcgggucggcg

SEQ ID NO: 1457582 - RNA, 20 nt, Pseudomonas aeruginosa PA01
guggcgcuacgcucgccgac

SEQ ID NO: 1457583 - RNA, 12 nt, Pseudomonas aeruginosa PA01
guggcgcggcug

SEQ ID NO: 1457584 - RNA, 21 nt, Pseudomonas aeruginosa PA01
guggcgcggcugaucggccgc

SEQ ID NO: 1457585 - RNA, 23 nt, Pseudomonas aeruginosa PA01
guggcgcggcugaucggccgcca

SEQ ID NO: 1457586 - RNA, 17 nt, Pseudomonas aeruginosa PA01
guggcgcugucgccggu

SEQ ID NO: 1457587 - RNA, 23 nt, Pseudomonas aeruginosa PA01
guggcgcugucgccggucaggcu

SEQ ID NO: 1457588 - RNA, 19 nt, Pseudomonas aeruginosa PA01
guggcggacaacccggcgc

SEQ ID NO: 1457589 - RNA, 21 nt, Pseudomonas aeruginosa PA01
guggcggacaacccggcgcug

SEQ ID NO: 1457590 - RNA, 14 nt, Pseudomonas aeruginosa PA01
guggcggccgccgc

SEQ ID NO: 1457591 - RNA, 15 nt, Pseudomonas aeruginosa PA01
guggcggccgccggc

SEQ ID NO: 1457592 - RNA, 19 nt, Pseudomonas aeruginosa PA01
guggcggccgccggcgccc

SEQ ID NO: 1457593 - RNA, 20 nt, Pseudomonas aeruginosa PA01
guggcgcuucguugcgaugg

SEQ ID NO: 1457594 - RNA, 19 nt, Pseudomonas aeruginosa PA01
guggcgcuugagcagccag

SEQ ID NO: 1457595 - RNA, 20 nt, Pseudomonas aeruginosa PA01
guggcgcuugagcagccagg

SEQ ID NO: 1457596 - RNA, 21 nt, Pseudomonas aeruginosa PA01
guggcgcuugagcagccaggc

SEQ ID NO: 1457597 - RNA, 14 nt, Pseudomonas aeruginosa PA01
guggcggcgcucag

SEQ ID NO: 1457598 - RNA, 17 nt, Pseudomonas aeruginosa PA01
guggcgcgcaccaccug

SEQ ID NO: 1457599 - RNA, 14 nt, Pseudomonas aeruginosa PA01
guggcgccggcuga

SEQ ID NO: 1457600 - RNA, 18 nt, Pseudomonas aeruginosa PA01
guggcgccggcugacgcu

SEQ ID NO: 1457601 - RNA, 16 nt, Pseudomonas aeruginosa PA01
guggcgccgccggcga

SEQ ID NO: 1457602 - RNA, 19 nt, Pseudomonas aeruginosa PA01
guggcgccgagcagcggcg

SEQ ID NO: 1457603 - RNA, 13 nt, Pseudomonas aeruginosa PA01
guggcgccgcagg

SEQ ID NO: 1457604 - RNA, 16 nt, Pseudomonas aeruginosa PA01
guggcgccgcagggcc

SEQ ID NO: 1457605 - RNA, 16 nt, Pseudomonas aeruginosa PA01
guggcgaugcccuggc

SEQ ID NO: 1457606 - RNA, 22 nt, Pseudomonas aeruginosa PA01
guggcgaucacgucguacucgg

SEQ ID NO: 1457607 - RNA, 19 nt, Pseudomonas aeruginosa PA01
guggcgaucaggcagcgcg

SEQ ID NO: 1457608 - RNA, 13 nt, Pseudomonas aeruginosa PA01
guggcgccagcca

SEQ ID NO: 1457609 - RNA, 14 nt, Pseudomonas aeruginosa PA01
guggcgccagccag

SEQ ID NO: 1457610 - RNA, 15 nt, Pseudomonas aeruginosa PA01
guggcgccagccagc

SEQ ID NO: 1457611 - RNA, 19 nt, Pseudomonas aeruginosa PA01
guggcgccauccuccagcg

SEQ ID NO: 1457612 - RNA, 21 nt, Pseudomonas aeruginosa PA01
guggcgccauccuccagcgcc

SEQ ID NO: 1457613 - RNA, 14 nt, Pseudomonas aeruginosa PA01
guggcgcccagcca

SEQ ID NO: 1457614 - RNA, 16 nt, Pseudomonas aeruginosa PA01
guggcgcccagccaga

SEQ ID NO: 1457615 - RNA, 15 nt, Pseudomonas aeruginosa PA01
guggcgcccaugccg

SEQ ID NO: 1457616 - RNA, 17 nt, Pseudomonas aeruginosa PA01
guggcgcccaugccgcc

SEQ ID NO: 1457617 - RNA, 22 nt, Pseudomonas aeruginosa PA01
guggcgcccaugccgcccggcc

SEQ ID NO: 1457618 - RNA, 17 nt, Pseudomonas aeruginosa PA01
guggggaugcgcgaggu

SEQ ID NO: 1457619 - RNA, 18 nt, Pseudomonas aeruginosa PA01
guggggaagacggccagg

SEQ ID NO: 1457620 - RNA, 13 nt, Pseudomonas aeruginosa PA01
gugggcuucgccg

SEQ ID NO: 1457621 - RNA, 23 nt, Pseudomonas aeruginosa PA01
gugggcuucgccgccgcgcgcgc

SEQ ID NO: 1457622 - RNA, 12 nt, Pseudomonas aeruginosa PA01
guggggcgccgg

SEQ ID NO: 1457623 - RNA, 16 nt, Pseudomonas aeruginosa PA01
guggggcgccggcucg

SEQ ID NO: 1457624 - RNA, 22 nt, Pseudomonas aeruginosa PA01
guggggcgccggcucgcccagc

SEQ ID NO: 1457625 - RNA, 12 nt, Pseudomonas aeruginosa PA01
guggggccagaa

SEQ ID NO: 1457626 - RNA, 22 nt, Pseudomonas aeruginosa PA01
guggggccgccgaugccgacgu

SEQ ID NO: 1457627 - RNA, 13 nt, Pseudomonas aeruginosa PA01
gugggcggccggc

SEQ ID NO: 1457628 - RNA, 20 nt, Pseudomonas aeruginosa PA01
gugggcggucggcgagggca

SEQ ID NO: 1457629 - RNA, 17 nt, Pseudomonas aeruginosa PA01
gugggcgaggcgcucga

SEQ ID NO: 1457630 - RNA, 16 nt, Pseudomonas aeruginosa PA01
gugggcgagggcgcgc

SEQ ID NO: 1457631 - RNA, 13 nt, Pseudomonas aeruginosa PA01
gugggcguagagc

SEQ ID NO: 1457632 - RNA, 23 nt, Pseudomonas aeruginosa PA01
gugggcucuaugcaauggggcgc

SEQ ID NO: 1457633 - RNA, 15 nt, Pseudomonas aeruginosa PA01
gugggcuccagcggg

SEQ ID NO: 1457634 - RNA, 17 nt, Pseudomonas aeruginosa PA01
gugggccagcaggccga

SEQ ID NO: 1457635 - RNA, 13 nt, Pseudomonas aeruginosa PA01
gugggccagccca

SEQ ID NO: 1457636 - RNA, 13 nt, Pseudomonas aeruginosa PA01
gugggccgccgaa

SEQ ID NO: 1457637 - RNA, 23 nt, Pseudomonas aeruginosa PA01
gugggccggcaugcucagccgcg

SEQ ID NO: 1457638 - RNA, 12 nt, Pseudomonas aeruginosa PA01
gugggccggcgc

SEQ ID NO: 1457639 - RNA, 16 nt, Pseudomonas aeruginosa PA01
gugggccggcgcgccg

SEQ ID NO: 1457640 - RNA, 14 nt, Pseudomonas aeruginosa PA01
gugggcgccgccgg

SEQ ID NO: 1457641 - RNA, 15 nt, Pseudomonas aeruginosa PA01
gugggcgccgccggu

SEQ ID NO: 1457642 - RNA, 14 nt, Pseudomonas aeruginosa PA01
gugggcgccggcgc

SEQ ID NO: 1457643 - RNA, 14 nt, Pseudomonas aeruginosa PA01
gugggccaccggcu

SEQ ID NO: 1457644 - RNA, 16 nt, Pseudomonas aeruginosa PA01
gugggcaacaggccga

SEQ ID NO: 1457645 - RNA, 14 nt, Pseudomonas aeruginosa PA01
gugguagagcggca

SEQ ID NO: 1457646 - RNA, 18 nt, Pseudomonas aeruginosa PA01
guggguaagcucgaucac

SEQ ID NO: 1457647 - RNA, 15 nt, Pseudomonas aeruginosa PA01
guggguaggccaggc

SEQ ID NO: 1457648 - RNA, 16 nt, Pseudomonas aeruginosa PA01
guggguaggccaggca

SEQ ID NO: 1457649 - RNA, 17 nt, Pseudomonas aeruginosa PA01
gugggucgaugcccucg

SEQ ID NO: 1457650 - RNA, 17 nt, Pseudomonas aeruginosa PA01
gugguccagcucgguca

SEQ ID NO: 1457651 - RNA, 20 nt, Pseudomonas aeruginosa PA01
guggucgcagcuccagcgga

SEQ ID NO: 1457652 - RNA, 16 nt, Pseudomonas aeruginosa PA01
guggucguugcgcgcc

SEQ ID NO: 1457653 - RNA, 19 nt, Pseudomonas aeruginosa PA01
guggucguugcgcgccagc

SEQ ID NO: 1457654 - RNA, 16 nt, Pseudomonas aeruginosa PA01
guggucaggcgccagg

SEQ ID NO: 1457655 - RNA, 22 nt, Pseudomonas aeruginosa PA01
guggucaccgccagcgggacga

SEQ ID NO: 1457656 - RNA, 22 nt, Pseudomonas aeruginosa PA01
guggucagcaccagggccaggg

SEQ ID NO: 1457657 - RNA, 16 nt, Pseudomonas aeruginosa PA01
guggucagccagccga

SEQ ID NO: 1457658 - RNA, 21 nt, Pseudomonas aeruginosa PA01
guggucgaggguggucagcca

SEQ ID NO: 1457659 - RNA, 12 nt, Pseudomonas aeruginosa PA01
gugguccgccag

SEQ ID NO: 1457660 - RNA, 13 nt, Pseudomonas aeruginosa PA01
gugguccgccagc

SEQ ID NO: 1457661 - RNA, 14 nt, Pseudomonas aeruginosa PA01
gugguccgccagca

SEQ ID NO: 1457662 - RNA, 15 nt, Pseudomonas aeruginosa PA01
gugguccgccagcag

SEQ ID NO: 1457663 - RNA, 13 nt, Pseudomonas aeruginosa PA01
gugccgcgcagcu

SEQ ID NO: 1457664 - RNA, 19 nt, Pseudomonas aeruginosa PA01
gugccgcggaauggcgcgc

SEQ ID NO: 1457665 - RNA, 15 nt, Pseudomonas aeruginosa PA01
gugccgccggcgccg

SEQ ID NO: 1457666 - RNA, 16 nt, Pseudomonas aeruginosa PA01
gugccgccggcgccgc

SEQ ID NO: 1457667 - RNA, 19 nt, Pseudomonas aeruginosa PA01
gugccgccggggcgcaggu

SEQ ID NO: 1457668 - RNA, 14 nt, Pseudomonas aeruginosa PA01
gugcccgccggcgc

SEQ ID NO: 1457669 - RNA, 19 nt, Pseudomonas aeruginosa PA01
gugcccgccggcgcgccca

SEQ ID NO: 1457670 - RNA, 18 nt, Pseudomonas aeruginosa PA01
gugccucugaccgcgccc

SEQ ID NO: 1457671 - RNA, 16 nt, Pseudomonas aeruginosa PA01
gugccugcaccacgca

SEQ ID NO: 1457672 - RNA, 22 nt, Pseudomonas aeruginosa PA01
gugccugcaccacgcaggcgcg

SEQ ID NO: 1457673 - RNA, 23 nt, Pseudomonas aeruginosa PA01
gugccucgcgcguggccgccagg

SEQ ID NO: 1457674 - RNA, 12 nt, Pseudomonas aeruginosa PA01
gugccucggcgg

SEQ ID NO: 1457675 - RNA, 17 nt, Pseudomonas aeruginosa PA01
gugccggagaacgccgc

SEQ ID NO: 1457676 - RNA, 13 nt, Pseudomonas aeruginosa PA01
gugccgcuggccg

SEQ ID NO: 1457677 - RNA, 15 nt, Pseudomonas aeruginosa PA01
gugccgcuggccgac

SEQ ID NO: 1457678 - RNA, 16 nt, Pseudomonas aeruginosa PA01
gugccgcuggccgacc

SEQ ID NO: 1457679 - RNA, 19 nt, Pseudomonas aeruginosa PA01
gugccgcuguaggacaggu

SEQ ID NO: 1457680 - RNA, 15 nt, Pseudomonas aeruginosa PA01
gugcgcaggcgcucg

SEQ ID NO: 1457681 - RNA, 16 nt, Pseudomonas aeruginosa PA01
gugcgagggcggcggc

SEQ ID NO: 1457682 - RNA, 17 nt, Pseudomonas aeruginosa PA01
gugcgagggcggcggcu

SEQ ID NO: 1457683 - RNA, 14 nt, Pseudomonas aeruginosa PA01
gugcgccaggccgg

SEQ ID NO: 1457684 - RNA, 14 nt, Pseudomonas aeruginosa PA01
gugcgcccagcagc

SEQ ID NO: 1457685 - RNA, 15 nt, Pseudomonas aeruginosa PA01
gugcgcccagcagca

SEQ ID NO: 1457686 - RNA, 20 nt, Pseudomonas aeruginosa PA01
gugcgcccagcagcaggccg

SEQ ID NO: 1457687 - RNA, 21 nt, Pseudomonas aeruginosa PA01
gugcgcccagcagcaggccgg

SEQ ID NO: 1457688 - RNA, 13 nt, Pseudomonas aeruginosa PA01
gugcgccagcucg

SEQ ID NO: 1457689 - RNA, 15 nt, Pseudomonas aeruginosa PA01
gugcgacgcagcaga

SEQ ID NO: 1457690 - RNA, 18 nt, Pseudomonas aeruginosa PA01
gugcgaauguccggcgac

SEQ ID NO: 1457691 - RNA, 20 nt, Pseudomonas aeruginosa PA01
gugcgaauguccggcgacca

SEQ ID NO: 1457692 - RNA, 22 nt, Pseudomonas aeruginosa PA01
gugccuucggcggcgccuugcg

SEQ ID NO: 1457693 - RNA, 16 nt, Pseudomonas aeruginosa PA01
gugccuucccagccga

SEQ ID NO: 1457694 - RNA, 19 nt, Pseudomonas aeruginosa PA01
gugccuuccgcgcccaggc

SEQ ID NO: 1457695 - RNA, 23 nt, Pseudomonas aeruginosa PA01
gugccuuccgcgcccaggcugcc

SEQ ID NO: 1457696 - RNA, 15 nt, Pseudomonas aeruginosa PA01
gugcgguggcuggcg

SEQ ID NO: 1457697 - RNA, 15 nt, Pseudomonas aeruginosa PA01
gugcggugggcgagg

SEQ ID NO: 1457698 - RNA, 19 nt, Pseudomonas aeruginosa PA01
gugcggugggcgagggcgc

SEQ ID NO: 1457699 - RNA, 15 nt, Pseudomonas aeruginosa PA01
gugcggugccgcgca

SEQ ID NO: 1457700 - RNA, 22 nt, Pseudomonas aeruginosa PA01
gugcguacggucaugccgaacu

SEQ ID NO: 1457701 - RNA, 18 nt, Pseudomonas aeruginosa PA01
gugcgguuguucgcccaa

SEQ ID NO: 1457702 - RNA, 13 nt, Pseudomonas aeruginosa PA01
gugcgggugccga

SEQ ID NO: 1457703 - RNA, 23 nt, Pseudomonas aeruginosa PA01
gugcggggaaagcuccucggccu

SEQ ID NO: 1457704 - RNA, 12 nt, Pseudomonas aeruginosa PA01
gugcggggugcg

SEQ ID NO: 1457705 - RNA, 18 nt, Pseudomonas aeruginosa PA01
gugcggggcgcucgcccu

SEQ ID NO: 1457706 - RNA, 18 nt, Pseudomonas aeruginosa PA01
gugcggcguucgccgcgg

SEQ ID NO: 1457707 - RNA, 23 nt, Pseudomonas aeruginosa PA01
gugcggcugggugucgaccuccg

SEQ ID NO: 1457708 - RNA, 14 nt, Pseudomonas aeruginosa PA01
gugcggcuggcgcg

SEQ ID NO: 1457709 - RNA, 21 nt, Pseudomonas aeruginosa PA01
gugcggcuggcgcgcgcgcug

SEQ ID NO: 1457710 - RNA, 16 nt, Pseudomonas aeruginosa PA01
gugcggcgggcgcccg

SEQ ID NO: 1457711 - RNA, 14 nt, Pseudomonas aeruginosa PA01
gugcggcguggcga

SEQ ID NO: 1457712 - RNA, 20 nt, Pseudomonas aeruginosa PA01
gugcgccgguugcugcuugc

SEQ ID NO: 1457713 - RNA, 13 nt, Pseudomonas aeruginosa PA01
gugcgggccgucg

SEQ ID NO: 1457714 - RNA, 13 nt, Pseudomonas aeruginosa PA01
gugcgggcgacgc

SEQ ID NO: 1457715 - RNA, 12 nt, Pseudomonas aeruginosa PA01
gugcgcccguuc

SEQ ID NO: 1457716 - RNA, 15 nt, Pseudomonas aeruginosa PA01
gugcgccgcggguca

SEQ ID NO: 1457717 - RNA, 20 nt, Pseudomonas aeruginosa PA01
gugcgccgcgggucaccagc

SEQ ID NO: 1457718 - RNA, 22 nt, Pseudomonas aeruginosa PA01
gugcgccgcucgcgcacggcga

SEQ ID NO: 1457719 - RNA, 13 nt, Pseudomonas aeruginosa PA01
gugcgccgcagcg

SEQ ID NO: 1457720 - RNA, 15 nt, Pseudomonas aeruginosa PA01
gugcgccccagcuca

SEQ ID NO: 1457721 - RNA, 21 nt, Pseudomonas aeruginosa PA01
gugcgccggggaucaggucgc

SEQ ID NO: 1457722 - RNA, 13 nt, Pseudomonas aeruginosa PA01
gugcgccggcggg

SEQ ID NO: 1457723 - RNA, 20 nt, Pseudomonas aeruginosa PA01
gugcgccggcggccggcgca

SEQ ID NO: 1457724 - RNA, 23 nt, Pseudomonas aeruginosa PA01
gugcucgauggcgaagcgcuugc

SEQ ID NO: 1457725 - RNA, 13 nt, Pseudomonas aeruginosa PA01
gugcucgaucagg

SEQ ID NO: 1457726 - RNA, 12 nt, Pseudomonas aeruginosa PA01
gugcuccaccuc

SEQ ID NO: 1457727 - RNA, 17 nt, Pseudomonas aeruginosa PA01
gugcuccgugucggcgg

SEQ ID NO: 1457728 - RNA, 21 nt, Pseudomonas aeruginosa PA01
gugcuccgugucggcggcgcc

SEQ ID NO: 1457729 - RNA, 18 nt, Pseudomonas aeruginosa PA01
gugcuccguugaacucgg

SEQ ID NO: 1457730 - RNA, 23 nt, Pseudomonas aeruginosa PA01
gugcuccguugaacucggcgccc

SEQ ID NO: 1457731 - RNA, 22 nt, Pseudomonas aeruginosa PA01
gugcuccucgucguacuggcgg

SEQ ID NO: 1457732 - RNA, 21 nt, Pseudomonas aeruginosa PA01
gugcucaggacguccuggccg

SEQ ID NO: 1457733 - RNA, 22 nt, Pseudomonas aeruginosa PA01
gugcucaggacguccuggccga

SEQ ID NO: 1457734 - RNA, 20 nt, Pseudomonas aeruginosa PA01
gugcugcaccagcaggucga

SEQ ID NO: 1457735 - RNA, 21 nt, Pseudomonas aeruginosa PA01
gugcugcaccagcaggucgag

SEQ ID NO: 1457736 - RNA, 19 nt, Pseudomonas aeruginosa PA01
gugcugaagauaucgccuu

SEQ ID NO: 1457737 - RNA, 22 nt, Pseudomonas aeruginosa PA01
gugcugccgaugcugaucaccc

SEQ ID NO: 1457738 - RNA, 24 nt, Pseudomonas aeruginosa PA01
gugcuggacuucggucucguccgg

SEQ ID NO: 1457739 - RNA, 21 nt, Pseudomonas aeruginosa PA01
gugcucgcgcaugaucgccuc

SEQ ID NO: 1457740 - RNA, 20 nt, Pseudomonas aeruginosa PA01
gugcucggggaacacgcgcu

SEQ ID NO: 1457741 - RNA, 22 nt, Pseudomonas aeruginosa PA01
gugcucuuuucccgcaccggcg

SEQ ID NO: 1457742 - RNA, 16 nt, Pseudomonas aeruginosa PA01
gugcugaacaucaggu

SEQ ID NO: 1457743 - RNA, 18 nt, Pseudomonas aeruginosa PA01
gugauggaagagcgccgc

SEQ ID NO: 1457744 - RNA, 15 nt, Pseudomonas aeruginosa PA01
gugaugcgucgcacc

SEQ ID NO: 1457745 - RNA, 23 nt, Pseudomonas aeruginosa PA01
gugaugcccagcggcgccagcuc

SEQ ID NO: 1457746 - RNA, 15 nt, Pseudomonas aeruginosa PA01
gugaucgagccgccg

SEQ ID NO: 1457747 - RNA, 14 nt, Pseudomonas aeruginosa PA01
gugaucgagacgcc

SEQ ID NO: 1457748 - RNA, 18 nt, Pseudomonas aeruginosa PA01
gugaucaucguccugccg

SEQ ID NO: 1457749 - RNA, 22 nt, Pseudomonas aeruginosa PA01
gugauccauguagaaggcgucc

SEQ ID NO: 1457750 - RNA, 14 nt, Pseudomonas aeruginosa PA01
gugauccguggcga

SEQ ID NO: 1457751 - RNA, 17 nt, Pseudomonas aeruginosa PA01
gugauccguggcgagcg

SEQ ID NO: 1457752 - RNA, 22 nt, Pseudomonas aeruginosa PA01
gugaucaccuggaucgccaggc

SEQ ID NO: 1457753 - RNA, 13 nt, Pseudomonas aeruginosa PA01
gugauccagcugg

SEQ ID NO: 1457754 - RNA, 16 nt, Pseudomonas aeruginosa PA01
gugauccagcuggcgc

SEQ ID NO: 1457755 - RNA, 14 nt, Pseudomonas aeruginosa PA01
gugauccaggcguc

SEQ ID NO: 1457756 - RNA, 14 nt, Pseudomonas aeruginosa PA01
gugauccaggucga

SEQ ID NO: 1457757 - RNA, 13 nt, Pseudomonas aeruginosa PA01
gugaacucaugca

SEQ ID NO: 1457758 - RNA, 19 nt, Pseudomonas aeruginosa PA01
gugaacucaugcaggccga

SEQ ID NO: 1457759 - RNA, 20 nt, Pseudomonas aeruginosa PA01
gugagccccggcgucggcgc

SEQ ID NO: 1457760 - RNA, 16 nt, Pseudomonas aeruginosa PA01
gugagcagggugacgg

SEQ ID NO: 1457761 - RNA, 15 nt, Pseudomonas aeruginosa PA01
gugagcaggcgccgg

SEQ ID NO: 1457762 - RNA, 15 nt, Pseudomonas aeruginosa PA01
gugaacuggccgucg

SEQ ID NO: 1457763 - RNA, 17 nt, Pseudomonas aeruginosa PA01
gugagcgacccgcugaa

SEQ ID NO: 1457764 - RNA, 22 nt, Pseudomonas aeruginosa PA01
gugcagcggaagcccugcuggc

SEQ ID NO: 1457765 - RNA, 14 nt, Pseudomonas aeruginosa PA01
gugcagcggcagcg

SEQ ID NO: 1457766 - RNA, 15 nt, Pseudomonas aeruginosa PA01
gugcagcggcagcgu

SEQ ID NO: 1457767 - RNA, 24 nt, Pseudomonas aeruginosa PA01
gugcagcggcagcgucucggcugc

SEQ ID NO: 1457768 - RNA, 16 nt, Pseudomonas aeruginosa PA01
gugcagcccggucacg

SEQ ID NO: 1457769 - RNA, 22 nt, Pseudomonas aeruginosa PA01
gugcagcaggguaccgcuggcg

SEQ ID NO: 1457770 - RNA, 23 nt, Pseudomonas aeruginosa PA01
gugcaccgccggguacagcgcca

SEQ ID NO: 1457771 - RNA, 14 nt, Pseudomonas aeruginosa PA01
gugcaccagcaacu

SEQ ID NO: 1457772 - RNA, 16 nt, Pseudomonas aeruginosa PA01
gugcaccgaggcgcgc

SEQ ID NO: 1457773 - RNA, 22 nt, Pseudomonas aeruginosa PA01
gugcaggaagcgccgggccgca

SEQ ID NO: 1457774 - RNA, 20 nt, Pseudomonas aeruginosa PA01
gugcaguucgaccuccaggc

SEQ ID NO: 1457775 - RNA, 21 nt, Pseudomonas aeruginosa PA01
gugcagcgagucgccgugggc

SEQ ID NO: 1457776 - RNA, 20 nt, Pseudomonas aeruginosa PA01
gugcagcucggcacgcagca

SEQ ID NO: 1457777 - RNA, 19 nt, Pseudomonas aeruginosa PA01
gugcagcuccaccgauggc

SEQ ID NO: 1457778 - RNA, 21 nt, Pseudomonas aeruginosa PA01
gugcagcuccaccgauggcgc

SEQ ID NO: 1457779 - RNA, 22 nt, Pseudomonas aeruginosa PA01
gugcauccgccgcagaccagcg

SEQ ID NO: 1457780 - RNA, 17 nt, Pseudomonas aeruginosa PA01
gugcaucggccgccagg

SEQ ID NO: 1457781 - RNA, 17 nt, Pseudomonas aeruginosa PA01
gugcauggccgggccga

SEQ ID NO: 1457782 - RNA, 13 nt, Pseudomonas aeruginosa PA01
gugcaugccgggg

SEQ ID NO: 1457783 - RNA, 14 nt, Pseudomonas aeruginosa PA01
gugccccguggcgg

SEQ ID NO: 1457784 - RNA, 16 nt, Pseudomonas aeruginosa PA01
gugccccguggcgggc

SEQ ID NO: 1457785 - RNA, 18 nt, Pseudomonas aeruginosa PA01
gugcccgaugccgcgccg

SEQ ID NO: 1457786 - RNA, 20 nt, Pseudomonas aeruginosa PA01
gugcccgaugccgcgccgga

SEQ ID NO: 1457787 - RNA, 13 nt, Pseudomonas aeruginosa PA01
gugcccagcaggc

SEQ ID NO: 1457788 - RNA, 14 nt, Pseudomonas aeruginosa PA01
gugcccagcaggcu

SEQ ID NO: 1457789 - RNA, 19 nt, Pseudomonas aeruginosa PA01
gugcccagcaggcugcugc

SEQ ID NO: 1457790 - RNA, 19 nt, Pseudomonas aeruginosa PA01
gugccauugcuugagcagu

SEQ ID NO: 1457791 - RNA, 17 nt, Pseudomonas aeruginosa PA01
gugcccagcggcgccuc

SEQ ID NO: 1457792 - RNA, 13 nt, Pseudomonas aeruginosa PA01
gugcccaggcgcu

SEQ ID NO: 1457793 - RNA, 17 nt, Pseudomonas aeruginosa PA01
gugcccaggcgcuggcg

SEQ ID NO: 1457794 - RNA, 21 nt, Pseudomonas aeruginosa PA01
gugcccaggcgcuggcgccga

SEQ ID NO: 1457795 - RNA, 20 nt, Pseudomonas aeruginosa PA01
gugccccaggccgaacucac

SEQ ID NO: 1457796 - RNA, 13 nt, Pseudomonas aeruginosa PA01
gugccccaggcga

SEQ ID NO: 1457797 - RNA, 13 nt, Pseudomonas aeruginosa PA01
gugcccagggcgg

SEQ ID NO: 1457798 - RNA, 19 nt, Pseudomonas aeruginosa PA01
gugcccauccgcucggcga

SEQ ID NO: 1457799 - RNA, 19 nt, Pseudomonas aeruginosa PA01
gugccauggaucaccaggg

SEQ ID NO: 1457800 - RNA, 23 nt, Pseudomonas aeruginosa PA01
gugccauggaucaccagggucgg

SEQ ID NO: 1457801 - RNA, 16 nt, Pseudomonas aeruginosa PA01
gugccauacagcgccc

SEQ ID NO: 1457802 - RNA, 15 nt, Pseudomonas aeruginosa PA01
gugccaucaggccgc

SEQ ID NO: 1457803 - RNA, 18 nt, Pseudomonas aeruginosa PA01
gugccaucaggccgcggc

SEQ ID NO: 1457804 - RNA, 20 nt, Pseudomonas aeruginosa PA01
gugccaucaggccgcggccc

SEQ ID NO: 1457805 - RNA, 21 nt, Pseudomonas aeruginosa PA01
gugccaucaggccgcggcccu

SEQ ID NO: 1457806 - RNA, 21 nt, Pseudomonas aeruginosa PA01
gugccagggcuucccaggcca

SEQ ID NO: 1457807 - RNA, 15 nt, Pseudomonas aeruginosa PA01
gugccaggaccagcc

SEQ ID NO: 1457808 - RNA, 14 nt, Pseudomonas aeruginosa PA01
gugccaggccuggg

SEQ ID NO: 1457809 - RNA, 22 nt, Pseudomonas aeruginosa PA01
gugccaggccugggucaccagc

SEQ ID NO: 1457810 - RNA, 19 nt, Pseudomonas aeruginosa PA01
gugccaggcgcucgcgcug

SEQ ID NO: 1457811 - RNA, 20 nt, Pseudomonas aeruginosa PA01
gugccaggcgcucgcgcugc

SEQ ID NO: 1457812 - RNA, 12 nt, Pseudomonas aeruginosa PA01
gugccaggcggc

SEQ ID NO: 1457813 - RNA, 18 nt, Pseudomonas aeruginosa PA01
gugccaggcggcagccgc

SEQ ID NO: 1457814 - RNA, 19 nt, Pseudomonas aeruginosa PA01
gugccaggcucgccgccag

SEQ ID NO: 1457815 - RNA, 16 nt, Pseudomonas aeruginosa PA01
gugcauguagcgcucc

SEQ ID NO: 1457816 - RNA, 15 nt, Pseudomonas aeruginosa PA01
gucaucaccggcagg

SEQ ID NO: 1457817 - RNA, 18 nt, Pseudomonas aeruginosa PA01
gucaucaggcucaggccg

SEQ ID NO: 1457818 - RNA, 19 nt, Pseudomonas aeruginosa PA01
gucaucaccuucgccagca

SEQ ID NO: 1457819 - RNA, 21 nt, Pseudomonas aeruginosa PA01
gucauagcagcgccgcgccug

SEQ ID NO: 1457820 - RNA, 17 nt, Pseudomonas aeruginosa PA01
gucaguuccaggucggc

SEQ ID NO: 1457821 - RNA, 20 nt, Pseudomonas aeruginosa PA01
gucaguuccaggucggcggc

SEQ ID NO: 1457822 - RNA, 14 nt, Pseudomonas aeruginosa PA01
gucaguucggugcc

SEQ ID NO: 1457823 - RNA, 19 nt, Pseudomonas aeruginosa PA01
gucaguucggugccgccgg

SEQ ID NO: 1457824 - RNA, 17 nt, Pseudomonas aeruginosa PA01
gucaucgccggcgccga

SEQ ID NO: 1457825 - RNA, 14 nt, Pseudomonas aeruginosa PA01
gucauccuggcccu

SEQ ID NO: 1457826 - RNA, 13 nt, Pseudomonas aeruginosa PA01
gucaucgaggcca

SEQ ID NO: 1457827 - RNA, 21 nt, Pseudomonas aeruginosa PA01
gucauuggcgaaauugccucc

SEQ ID NO: 1457828 - RNA, 15 nt, Pseudomonas aeruginosa PA01
gucauuggcgaaguu

SEQ ID NO: 1457829 - RNA, 21 nt, Pseudomonas aeruginosa PA01
gucauuggcgaaguugccgcc

SEQ ID NO: 1457830 - RNA, 14 nt, Pseudomonas aeruginosa PA01
gucauguccggggc

SEQ ID NO: 1457831 - RNA, 15 nt, Pseudomonas aeruginosa PA01
gucauggugccgagc

SEQ ID NO: 1457832 - RNA, 14 nt, Pseudomonas aeruginosa PA01
gucauggcgggcgu

SEQ ID NO: 1457833 - RNA, 13 nt, Pseudomonas aeruginosa PA01
gucaugccgccgu

SEQ ID NO: 1457834 - RNA, 14 nt, Pseudomonas aeruginosa PA01
gucaugccgccguc

SEQ ID NO: 1457835 - RNA, 20 nt, Pseudomonas aeruginosa PA01
gucaugccgccgucgcggcc

SEQ ID NO: 1457836 - RNA, 20 nt, Pseudomonas aeruginosa PA01
gucaugcgcccuacgccacc

SEQ ID NO: 1457837 - RNA, 18 nt, Pseudomonas aeruginosa PA01
gucaugcccuggccgacg

SEQ ID NO: 1457838 - RNA, 22 nt, Pseudomonas aeruginosa PA01
gucaugcccuggccgacgcuga

SEQ ID NO: 1457839 - RNA, 19 nt, Pseudomonas aeruginosa PA01
gucaugcccuugucgcccu

SEQ ID NO: 1457840 - RNA, 18 nt, Pseudomonas aeruginosa PA01
gucaugagguucaggccg

SEQ ID NO: 1457841 - RNA, 17 nt, Pseudomonas aeruginosa PA01
gucauggcgcacgccgc

SEQ ID NO: 1457842 - RNA, 19 nt, Pseudomonas aeruginosa PA01
gucauggccagcucgaccu

SEQ ID NO: 1457843 - RNA, 17 nt, Pseudomonas aeruginosa PA01
gucaugaccagagccgc

SEQ ID NO: 1457844 - RNA, 19 nt, Pseudomonas aeruginosa PA01
gucaugaccagagccgccg

SEQ ID NO: 1457845 - RNA, 20 nt, Pseudomonas aeruginosa PA01
gucaugaccagagccgccga

SEQ ID NO: 1457846 - RNA, 22 nt, Pseudomonas aeruginosa PA01
gucaugaaggaaaccggccagc

SEQ ID NO: 1457847 - RNA, 16 nt, Pseudomonas aeruginosa PA01
gucaucggcccgacgc

SEQ ID NO: 1457848 - RNA, 13 nt, Pseudomonas aeruginosa PA01
gucaucgcgccgc

SEQ ID NO: 1457849 - RNA, 15 nt, Pseudomonas aeruginosa PA01
gucaucgcgccgccg

SEQ ID NO: 1457850 - RNA, 16 nt, Pseudomonas aeruginosa PA01
gucaucgcgccgccga

SEQ ID NO: 1457851 - RNA, 19 nt, Pseudomonas aeruginosa PA01
gucaucgcgccgccgaagc

SEQ ID NO: 1457852 - RNA, 23 nt, Pseudomonas aeruginosa PA01
gucaucgcgccgccgaagccgac

SEQ ID NO: 1457853 - RNA, 14 nt, Pseudomonas aeruginosa PA01
gucagcggcgcagc

SEQ ID NO: 1457854 - RNA, 20 nt, Pseudomonas aeruginosa PA01
gucagcggcgcagccucgcg

SEQ ID NO: 1457855 - RNA, 21 nt, Pseudomonas aeruginosa PA01
gucagcggcgcagccucgcgc

SEQ ID NO: 1457856 - RNA, 19 nt, Pseudomonas aeruginosa PA01
gucagcgguaugccgcagg

SEQ ID NO: 1457857 - RNA, 22 nt, Pseudomonas aeruginosa PA01
gucagcggugaaaauuucguga

SEQ ID NO: 1457858 - RNA, 18 nt, Pseudomonas aeruginosa PA01
gucagcgccuugaccucg

SEQ ID NO: 1457859 - RNA, 22 nt, Pseudomonas aeruginosa PA01
gucagcgccuugaccucgacgc

SEQ ID NO: 1457860 - RNA, 14 nt, Pseudomonas aeruginosa PA01
gucagcgcccggcu

SEQ ID NO: 1457861 - RNA, 15 nt, Pseudomonas aeruginosa PA01
gucagcgcgccagca

SEQ ID NO: 1457862 - RNA, 14 nt, Pseudomonas aeruginosa PA01
gucagcgccagcaa

SEQ ID NO: 1457863 - RNA, 18 nt, Pseudomonas aeruginosa PA01
gucagcgccagcaacccg

SEQ ID NO: 1457864 - RNA, 19 nt, Pseudomonas aeruginosa PA01
gucagcggacaaccgccgu

SEQ ID NO: 1457865 - RNA, 14 nt, Pseudomonas aeruginosa PA01
gucagcuucgccgc

SEQ ID NO: 1457866 - RNA, 16 nt, Pseudomonas aeruginosa PA01
gucagcuucgccgccc

SEQ ID NO: 1457867 - RNA, 17 nt, Pseudomonas aeruginosa PA01
gucagcuucgccgcccu

SEQ ID NO: 1457868 - RNA, 20 nt, Pseudomonas aeruginosa PA01
gucagcuucgccgcccugga

SEQ ID NO: 1457869 - RNA, 13 nt, Pseudomonas aeruginosa PA01
gucagcuugcccu

SEQ ID NO: 1457870 - RNA, 15 nt, Pseudomonas aeruginosa PA01
gucagcuugcccuca

SEQ ID NO: 1457871 - RNA, 14 nt, Pseudomonas aeruginosa PA01
gucaggaucggcgc

SEQ ID NO: 1457872 - RNA, 18 nt, Pseudomonas aeruginosa PA01
gucaggaucggcgcccag

SEQ ID NO: 1457873 - RNA, 19 nt, Pseudomonas aeruginosa PA01
gucaggaucggcgcccagc

SEQ ID NO: 1457874 - RNA, 17 nt, Pseudomonas aeruginosa PA01
gucaggaucacaucgcc

SEQ ID NO: 1457875 - RNA, 19 nt, Pseudomonas aeruginosa PA01
gucaggcaccucguccagc

SEQ ID NO: 1457876 - RNA, 16 nt, Pseudomonas aeruginosa PA01
gucaggacagcgugcg

SEQ ID NO: 1457877 - RNA, 19 nt, Pseudomonas aeruginosa PA01
gucaggacagcgugcggcc

SEQ ID NO: 1457878 - RNA, 14 nt, Pseudomonas aeruginosa PA01
gucagggugccgau

SEQ ID NO: 1457879 - RNA, 19 nt, Pseudomonas aeruginosa PA01
gucagggcuugcgcgccac

SEQ ID NO: 1457880 - RNA, 18 nt, Pseudomonas aeruginosa PA01
gucaggcucagcucggcg

SEQ ID NO: 1457881 - RNA, 22 nt, Pseudomonas aeruginosa PA01
gucaggcucagcucggcgaugc

SEQ ID NO: 1457882 - RNA, 19 nt, Pseudomonas aeruginosa PA01
gucaggcugacgucgacgc

SEQ ID NO: 1457883 - RNA, 17 nt, Pseudomonas aeruginosa PA01
gucaggcugaucggcgc

SEQ ID NO: 1457884 - RNA, 21 nt, Pseudomonas aeruginosa PA01
gucaggcugaucuugccgcug

SEQ ID NO: 1457885 - RNA, 15 nt, Pseudomonas aeruginosa PA01
gucaggcugcgcacc

SEQ ID NO: 1457886 - RNA, 21 nt, Pseudomonas aeruginosa PA01
gucaggcugcgcaccucggcc

SEQ ID NO: 1457887 - RNA, 14 nt, Pseudomonas aeruginosa PA01
gucaggcugcggcg

SEQ ID NO: 1457888 - RNA, 15 nt, Pseudomonas aeruginosa PA01
gucaggcugcggcgg

SEQ ID NO: 1457889 - RNA, 23 nt, Pseudomonas aeruginosa PA01
gucaggcuguagccucccgccgc

SEQ ID NO: 1457890 - RNA, 15 nt, Pseudomonas aeruginosa PA01
gucaggccgaccagc

SEQ ID NO: 1457891 - RNA, 16 nt, Pseudomonas aeruginosa PA01
gucaggccgaccagcg

SEQ ID NO: 1457892 - RNA, 22 nt, Pseudomonas aeruginosa PA01
gucaggccgaccagcgccgacu

SEQ ID NO: 1457893 - RNA, 15 nt, Pseudomonas aeruginosa PA01
gucaggccggcgcga

SEQ ID NO: 1457894 - RNA, 13 nt, Pseudomonas aeruginosa PA01
gucaggcgccagg

SEQ ID NO: 1457895 - RNA, 12 nt, Pseudomonas aeruginosa PA01
gucaggcgcccg

SEQ ID NO: 1457896 - RNA, 15 nt, Pseudomonas aeruginosa PA01
gucaggcgccggccu

SEQ ID NO: 1457897 - RNA, 12 nt, Pseudomonas aeruginosa PA01
gucaggccuuga

SEQ ID NO: 1457898 - RNA, 18 nt, Pseudomonas aeruginosa PA01
gucaggccuugacgcggg

SEQ ID NO: 1457899 - RNA, 18 nt, Pseudomonas aeruginosa PA01
gucaggccuugcgcggcg

SEQ ID NO: 1457900 - RNA, 19 nt, Pseudomonas aeruginosa PA01
gucaggccuugcgcggcgc

SEQ ID NO: 1457901 - RNA, 20 nt, Pseudomonas aeruginosa PA01
gucaggccuugcgcggcgcc

SEQ ID NO: 1457902 - RNA, 23 nt, Pseudomonas aeruginosa PA01
gucagguugccggugaugucggc

SEQ ID NO: 1457903 - RNA, 16 nt, Pseudomonas aeruginosa PA01
gucagguuggacaggu

SEQ ID NO: 1457904 - RNA, 23 nt, Pseudomonas aeruginosa PA01
gucaggucguacacguuggccgu

SEQ ID NO: 1457905 - RNA, 23 nt, Pseudomonas aeruginosa PA01
gucagguaggcaucgacgccagc

SEQ ID NO: 1457906 - RNA, 21 nt, Pseudomonas aeruginosa PA01
gucagguauucgccggccagg

SEQ ID NO: 1457907 - RNA, 22 nt, Pseudomonas aeruginosa PA01
gucagguauucgccggccaggu

SEQ ID NO: 1457908 - RNA, 13 nt, Pseudomonas aeruginosa PA01
gucagguccuugu

SEQ ID NO: 1457909 - RNA, 17 nt, Pseudomonas aeruginosa PA01
gucagguccuuguuccu

SEQ ID NO: 1457910 - RNA, 23 nt, Pseudomonas aeruginosa PA01
gucagguccuuguuccugggcgg

SEQ ID NO: 1457911 - RNA, 17 nt, Pseudomonas aeruginosa PA01
gucaggucgacgccgcc

SEQ ID NO: 1457912 - RNA, 18 nt, Pseudomonas aeruginosa PA01
gucaggucgacgccgccg

SEQ ID NO: 1457913 - RNA, 19 nt, Pseudomonas aeruginosa PA01
gucaggucgacgccgccga

SEQ ID NO: 1457914 - RNA, 21 nt, Pseudomonas aeruginosa PA01
gucaggucgacgccgccgagc

SEQ ID NO: 1457915 - RNA, 19 nt, Pseudomonas aeruginosa PA01
guccaaccgggcaucgccg

SEQ ID NO: 1457916 - RNA, 16 nt, Pseudomonas aeruginosa PA01
guccaccaccagcagg

SEQ ID NO: 1457917 - RNA, 16 nt, Pseudomonas aeruginosa PA01
guccaccagcgcccgu

SEQ ID NO: 1457918 - RNA, 13 nt, Pseudomonas aeruginosa PA01
guccaccaccgac

SEQ ID NO: 1457919 - RNA, 19 nt, Pseudomonas aeruginosa PA01
guccaccaccgacgggucg

SEQ ID NO: 1457920 - RNA, 19 nt, Pseudomonas aeruginosa PA01
guccaccgaguggcgcagc

SEQ ID NO: 1457921 - RNA, 16 nt, Pseudomonas aeruginosa PA01
guccaccgccgccagc

SEQ ID NO: 1457922 - RNA, 19 nt, Pseudomonas aeruginosa PA01
guccaccgccgccagcaac

SEQ ID NO: 1457923 - RNA, 21 nt, Pseudomonas aeruginosa PA01
guccaccgccgccagcaacag

SEQ ID NO: 1457924 - RNA, 22 nt, Pseudomonas aeruginosa PA01
guccacgccgaagucggcgagc

SEQ ID NO: 1457925 - RNA, 19 nt, Pseudomonas aeruginosa PA01
guccaccgguggcgacgcg

SEQ ID NO: 1457926 - RNA, 20 nt, Pseudomonas aeruginosa PA01
guccaccgguggcgacgcgc

SEQ ID NO: 1457927 - RNA, 16 nt, Pseudomonas aeruginosa PA01
guccagcagguggcgc

SEQ ID NO: 1457928 - RNA, 20 nt, Pseudomonas aeruginosa PA01
guccagcacggugaaccagg

SEQ ID NO: 1457929 - RNA, 12 nt, Pseudomonas aeruginosa PA01
guccagcacgcu

SEQ ID NO: 1457930 - RNA, 23 nt, Pseudomonas aeruginosa PA01
guccagcgagaacuugccggcgc

SEQ ID NO: 1457931 - RNA, 16 nt, Pseudomonas aeruginosa PA01
guccagcgagcgggcg

SEQ ID NO: 1457932 - RNA, 17 nt, Pseudomonas aeruginosa PA01
guccagcgaggcgugga

SEQ ID NO: 1457933 - RNA, 21 nt, Pseudomonas aeruginosa PA01
guccagcgaggcguggaaggg

SEQ ID NO: 1457934 - RNA, 19 nt, Pseudomonas aeruginosa PA01
guccagccggcgcuucugc

SEQ ID NO: 1457935 - RNA, 13 nt, Pseudomonas aeruginosa PA01
guccagccgccgc

SEQ ID NO: 1457936 - RNA, 14 nt, Pseudomonas aeruginosa PA01
guccagccgccgcu

SEQ ID NO: 1457937 - RNA, 15 nt, Pseudomonas aeruginosa PA01
guccagccgccgcug

SEQ ID NO: 1457938 - RNA, 16 nt, Pseudomonas aeruginosa PA01
guccagccgccgcugc

SEQ ID NO: 1457939 - RNA, 17 nt, Pseudomonas aeruginosa PA01
guccagccgccgcugca

SEQ ID NO: 1457940 - RNA, 23 nt, Pseudomonas aeruginosa PA01
guccagaucgccaccccgccgcu

SEQ ID NO: 1457941 - RNA, 19 nt, Pseudomonas aeruginosa PA01
guccagcaaggugcgggcg

SEQ ID NO: 1457942 - RNA, 20 nt, Pseudomonas aeruginosa PA01
guccagcaaggugcgggcga

SEQ ID NO: 1457943 - RNA, 22 nt, Pseudomonas aeruginosa PA01
guccacggagaagcguccgagg

SEQ ID NO: 1457944 - RNA, 18 nt, Pseudomonas aeruginosa PA01
guccacgucguaggccga

SEQ ID NO: 1457945 - RNA, 22 nt, Pseudomonas aeruginosa PA01
guccacgucguaggccgagccc

SEQ ID NO: 1457946 - RNA, 15 nt, Pseudomonas aeruginosa PA01
guccacuccggcagc

SEQ ID NO: 1457947 - RNA, 22 nt, Pseudomonas aeruginosa PA01
guccacuccggcagcacccgca

SEQ ID NO: 1457948 - RNA, 19 nt, Pseudomonas aeruginosa PA01
guccacugucucgccgaug

SEQ ID NO: 1457949 - RNA, 24 nt, Pseudomonas aeruginosa PA01
gucccagaaguaguacugguccgg

SEQ ID NO: 1457950 - RNA, 20 nt, Pseudomonas aeruginosa PA01
gucccagguagcgcugcgcc

SEQ ID NO: 1457951 - RNA, 20 nt, Pseudomonas aeruginosa PA01
gucccggccauuccuuccag

SEQ ID NO: 1457952 - RNA, 17 nt, Pseudomonas aeruginosa PA01
gucccggaguuccagcg

SEQ ID NO: 1457953 - RNA, 13 nt, Pseudomonas aeruginosa PA01
gucccaucagcag

SEQ ID NO: 1457954 - RNA, 18 nt, Pseudomonas aeruginosa PA01
gucccgggaaaccaccag

SEQ ID NO: 1457955 - RNA, 15 nt, Pseudomonas aeruginosa PA01
gucccguccgcugcg

SEQ ID NO: 1457956 - RNA, 21 nt, Pseudomonas aeruginosa PA01
gucccguuccgcucaccaggc

SEQ ID NO: 1457957 - RNA, 15 nt, Pseudomonas aeruginosa PA01
guccgaccauuuccc

SEQ ID NO: 1457958 - RNA, 16 nt, Pseudomonas aeruginosa PA01
guccgagaccggcagc

SEQ ID NO: 1457959 - RNA, 22 nt, Pseudomonas aeruginosa PA01
guccgaggcggauuugccgccg

SEQ ID NO: 1457960 - RNA, 23 nt, Pseudomonas aeruginosa PA01
guccgaggcggauuugccgccga

SEQ ID NO: 1457961 - RNA, 14 nt, Pseudomonas aeruginosa PA01
guccauguugcggc

SEQ ID NO: 1457962 - RNA, 20 nt, Pseudomonas aeruginosa PA01
guccaugccguacaggucgg

SEQ ID NO: 1457963 - RNA, 14 nt, Pseudomonas aeruginosa PA01
guccauggcggcga

SEQ ID NO: 1457964 - RNA, 16 nt, Pseudomonas aeruginosa PA01
guccagguacaccagg

SEQ ID NO: 1457965 - RNA, 17 nt, Pseudomonas aeruginosa PA01
guccagguacaccaggg

SEQ ID NO: 1457966 - RNA, 20 nt, Pseudomonas aeruginosa PA01
guccagguacaccagggugg

SEQ ID NO: 1457967 - RNA, 23 nt, Pseudomonas aeruginosa PA01
guccagguacaccaggguggcgc

SEQ ID NO: 1457968 - RNA, 16 nt, Pseudomonas aeruginosa PA01
guccaggugcggcugg

SEQ ID NO: 1457969 - RNA, 21 nt, Pseudomonas aeruginosa PA01
guccaggucaugcccuggccg

SEQ ID NO: 1457970 - RNA, 15 nt, Pseudomonas aeruginosa PA01
guccagguccgcacc

SEQ ID NO: 1457971 - RNA, 16 nt, Pseudomonas aeruginosa PA01
guccaggucgcggagc

SEQ ID NO: 1457972 - RNA, 19 nt, Pseudomonas aeruginosa PA01
guccaucuguaccaccgcc

SEQ ID NO: 1457973 - RNA, 14 nt, Pseudomonas aeruginosa PA01
guccaucucgccgc

SEQ ID NO: 1457974 - RNA, 17 nt, Pseudomonas aeruginosa PA01
guccaucucgccgcgca

SEQ ID NO: 1457975 - RNA, 18 nt, Pseudomonas aeruginosa PA01
guccaucguucaguugcc

SEQ ID NO: 1457976 - RNA, 14 nt, Pseudomonas aeruginosa PA01
guccagcgcgcccg

SEQ ID NO: 1457977 - RNA, 18 nt, Pseudomonas aeruginosa PA01
guccagcgcgcccggcgc

SEQ ID NO: 1457978 - RNA, 16 nt, Pseudomonas aeruginosa PA01
guccagcgcgccgcgc

SEQ ID NO: 1457979 - RNA, 15 nt, Pseudomonas aeruginosa PA01
guccagcggccgcgc

SEQ ID NO: 1457980 - RNA, 18 nt, Pseudomonas aeruginosa PA01
guccagcggccgcgccuu

SEQ ID NO: 1457981 - RNA, 14 nt, Pseudomonas aeruginosa PA01
guccagcgggccca

SEQ ID NO: 1457982 - RNA, 20 nt, Pseudomonas aeruginosa PA01
guccagcgcuccuugcgcca

SEQ ID NO: 1457983 - RNA, 22 nt, Pseudomonas aeruginosa PA01
guccagcgcuccuugcgccagg

SEQ ID NO: 1457984 - RNA, 21 nt, Pseudomonas aeruginosa PA01
guccagcgcuugaacgcgcgc

SEQ ID NO: 1457985 - RNA, 23 nt, Pseudomonas aeruginosa PA01
guccagcgcuugaacgcgcgccu

SEQ ID NO: 1457986 - RNA, 16 nt, Pseudomonas aeruginosa PA01
guccaggcugccgccu

SEQ ID NO: 1457987 - RNA, 15 nt, Pseudomonas aeruginosa PA01
guccaggcgggccag

SEQ ID NO: 1457988 - RNA, 16 nt, Pseudomonas aeruginosa PA01
guccaggcgucggcgc

SEQ ID NO: 1457989 - RNA, 14 nt, Pseudomonas aeruginosa PA01
guccaggggccgau

SEQ ID NO: 1457990 - RNA, 19 nt, Pseudomonas aeruginosa PA01
guccaggcuguggcgcggc

SEQ ID NO: 1457991 - RNA, 20 nt, Pseudomonas aeruginosa PA01
guccaggcuguggcgcggcu

SEQ ID NO: 1457992 - RNA, 20 nt, Pseudomonas aeruginosa PA01
guccagggccggaucggccu

SEQ ID NO: 1457993 - RNA, 18 nt, Pseudomonas aeruginosa PA01
guccagcgguaccagcag

SEQ ID NO: 1457994 - RNA, 21 nt, Pseudomonas aeruginosa PA01
guccagcgguaccagcagcgc

SEQ ID NO: 1457995 - RNA, 21 nt, Pseudomonas aeruginosa PA01
guccaggcgccagagcgcgcu

SEQ ID NO: 1457996 - RNA, 13 nt, Pseudomonas aeruginosa PA01
guccaggcgcugc

SEQ ID NO: 1457997 - RNA, 17 nt, Pseudomonas aeruginosa PA01
guccaggcgcugcucga

SEQ ID NO: 1457998 - RNA, 20 nt, Pseudomonas aeruginosa PA01
guaucggcguuuagcgcccg

SEQ ID NO: 1457999 - RNA, 23 nt, Pseudomonas aeruginosa PA01
guaucggcguuuagcgcccgacg

SEQ ID NO: 1458000 - RNA, 19 nt, Pseudomonas aeruginosa PA01
guaucggcuugccggcggc

SEQ ID NO: 1458001 - RNA, 20 nt, Pseudomonas aeruginosa PA01
guaucggcuugccggcggcg

SEQ ID NO: 1458002 - RNA, 22 nt, Pseudomonas aeruginosa PA01
guauucaucggcggcaggcgca

SEQ ID NO: 1458003 - RNA, 17 nt, Pseudomonas aeruginosa PA01
guauuccacgucgccga

SEQ ID NO: 1458004 - RNA, 11 nt, Pseudomonas aeruginosa PA01
guaucgcgcuu

SEQ ID NO: 1458005 - RNA, 15 nt, Pseudomonas aeruginosa PA01
guaggugauguugcg

SEQ ID NO: 1458006 - RNA, 17 nt, Pseudomonas aeruginosa PA01
guaggugcccggcggga

SEQ ID NO: 1458007 - RNA, 16 nt, Pseudomonas aeruginosa PA01
guagguggcgccgccg

SEQ ID NO: 1458008 - RNA, 14 nt, Pseudomonas aeruginosa PA01
guaggucaccgcgc

SEQ ID NO: 1458009 - RNA, 17 nt, Pseudomonas aeruginosa PA01
guaggucaccgcgccgg

SEQ ID NO: 1458010 - RNA, 18 nt, Pseudomonas aeruginosa PA01
guaggucaccgcgccggu

SEQ ID NO: 1458011 - RNA, 19 nt, Pseudomonas aeruginosa PA01
guaggggucguugccgucg

SEQ ID NO: 1458012 - RNA, 13 nt, Pseudomonas aeruginosa PA01
guagguccaggcg

SEQ ID NO: 1458013 - RNA, 14 nt, Pseudomonas aeruginosa PA01
guagguccaggcga

SEQ ID NO: 1458014 - RNA, 14 nt, Pseudomonas aeruginosa PA01
guaggguucgccga

SEQ ID NO: 1458015 - RNA, 21 nt, Pseudomonas aeruginosa PA01
guaggguucgccgacguccuc

SEQ ID NO: 1458016 - RNA, 19 nt, Pseudomonas aeruginosa PA01
guagguagcguugcgccag

SEQ ID NO: 1458017 - RNA, 15 nt, Pseudomonas aeruginosa PA01
guagguauccgccgg

SEQ ID NO: 1458018 - RNA, 16 nt, Pseudomonas aeruginosa PA01
guagguauccgccggc

SEQ ID NO: 1458019 - RNA, 17 nt, Pseudomonas aeruginosa PA01
guagguauccgccggcc

SEQ ID NO: 1458020 - RNA, 14 nt, Pseudomonas aeruginosa PA01
guaggggaccaccc

SEQ ID NO: 1458021 - RNA, 19 nt, Pseudomonas aeruginosa PA01
guauucggcgaccagcccg

SEQ ID NO: 1458022 - RNA, 22 nt, Pseudomonas aeruginosa PA01
guauucggcgaccagcccgcgc

SEQ ID NO: 1458023 - RNA, 17 nt, Pseudomonas aeruginosa PA01
guauucgccggccaggu

SEQ ID NO: 1458024 - RNA, 20 nt, Pseudomonas aeruginosa PA01
guauucgccggccagguagc

SEQ ID NO: 1458025 - RNA, 16 nt, Pseudomonas aeruginosa PA01
guauucgaacagcuug

SEQ ID NO: 1458026 - RNA, 15 nt, Pseudomonas aeruginosa PA01
guauuguggccccag

SEQ ID NO: 1458027 - RNA, 21 nt, Pseudomonas aeruginosa PA01
gucaacgccuggccacgccau

SEQ ID NO: 1458028 - RNA, 17 nt, Pseudomonas aeruginosa PA01
gucaccagggucacgcc

SEQ ID NO: 1458029 - RNA, 19 nt, Pseudomonas aeruginosa PA01
gucaccaggucgcggauca

SEQ ID NO: 1458030 - RNA, 17 nt, Pseudomonas aeruginosa PA01
gucaccaugaucaucgg

SEQ ID NO: 1458031 - RNA, 22 nt, Pseudomonas aeruginosa PA01
gucaccaugaucaucggcuggc

SEQ ID NO: 1458032 - RNA, 18 nt, Pseudomonas aeruginosa PA01
gucaccguggagaggucg

SEQ ID NO: 1458033 - RNA, 21 nt, Pseudomonas aeruginosa PA01
gucaccguggagaggucgccg

SEQ ID NO: 1458034 - RNA, 16 nt, Pseudomonas aeruginosa PA01
gucaccguggucaugg

SEQ ID NO: 1458035 - RNA, 16 nt, Pseudomonas aeruginosa PA01
gucaccccgaccagcg

SEQ ID NO: 1458036 - RNA, 18 nt, Pseudomonas aeruginosa PA01
gucaccccgaccagcgcg

SEQ ID NO: 1458037 - RNA, 20 nt, Pseudomonas aeruginosa PA01
gucacccauucgaugccgcg

SEQ ID NO: 1458038 - RNA, 21 nt, Pseudomonas aeruginosa PA01
gucacccauucgaugccgcgc

SEQ ID NO: 1458039 - RNA, 22 nt, Pseudomonas aeruginosa PA01
gucacccauucgaugccgcgcg

SEQ ID NO: 1458040 - RNA, 16 nt, Pseudomonas aeruginosa PA01
gucacgaaggcgauca

SEQ ID NO: 1458041 - RNA, 18 nt, Pseudomonas aeruginosa PA01
gucacgaaggcgaucacg

SEQ ID NO: 1458042 - RNA, 15 nt, Pseudomonas aeruginosa PA01
gucaccucggcgcca

SEQ ID NO: 1458043 - RNA, 16 nt, Pseudomonas aeruginosa PA01
gucagcacgccuucca

SEQ ID NO: 1458044 - RNA, 18 nt, Pseudomonas aeruginosa PA01
gucagcagcaccgcgagc

SEQ ID NO: 1458045 - RNA, 19 nt, Pseudomonas aeruginosa PA01
gucagcaggcccgagccgg

SEQ ID NO: 1458046 - RNA, 19 nt, Pseudomonas aeruginosa PA01
gucagaacacacgaauggc

SEQ ID NO: 1458047 - RNA, 14 nt, Pseudomonas aeruginosa PA01
gucacuuccuugcg

SEQ ID NO: 1458048 - RNA, 13 nt, Pseudomonas aeruginosa PA01
gucacuggcgagg

SEQ ID NO: 1458049 - RNA, 21 nt, Pseudomonas aeruginosa PA01
gucacuggaacagcgcgucac

SEQ ID NO: 1458050 - RNA, 15 nt, Pseudomonas aeruginosa PA01
gucagccagccgagc

SEQ ID NO: 1458051 - RNA, 16 nt, Pseudomonas aeruginosa PA01
gucagccagccgagca

SEQ ID NO: 1458052 - RNA, 23 nt, Pseudomonas aeruginosa PA01
gucagccagccgagcaacucggc

SEQ ID NO: 1458053 - RNA, 16 nt, Pseudomonas aeruginosa PA01
gucagccgcaggccgu

SEQ ID NO: 1458054 - RNA, 22 nt, Pseudomonas aeruginosa PA01
gucagccgaugcucgcgccagc

SEQ ID NO: 1458055 - RNA, 23 nt, Pseudomonas aeruginosa PA01
gucagccgaugcucgcgccagcc

SEQ ID NO: 1458056 - RNA, 23 nt, Pseudomonas aeruginosa PA01
gucagcccguguucggccagccg

SEQ ID NO: 1458057 - RNA, 14 nt, Pseudomonas aeruginosa PA01
gucagccaggcugg

SEQ ID NO: 1458058 - RNA, 16 nt, Pseudomonas aeruginosa PA01
gucagcgacuggcccu

SEQ ID NO: 1458059 - RNA, 16 nt, Pseudomonas aeruginosa PA01
gucagcgaggcgggcg

SEQ ID NO: 1458060 - RNA, 20 nt, Pseudomonas aeruginosa PA01
gucagcgaggcgggcgcgga

SEQ ID NO: 1458061 - RNA, 15 nt, Pseudomonas aeruginosa PA01
gucagccgcggccgg

SEQ ID NO: 1458062 - RNA, 18 nt, Pseudomonas aeruginosa PA01
gucagccgcggccgggga

SEQ ID NO: 1458063 - RNA, 17 nt, Pseudomonas aeruginosa PA01
guagcguuaucgccggu

SEQ ID NO: 1458064 - RNA, 16 nt, Pseudomonas aeruginosa PA01
guagcguuccuggcgc

SEQ ID NO: 1458065 - RNA, 18 nt, Pseudomonas aeruginosa PA01
guagccgcccaccgcggg

SEQ ID NO: 1458066 - RNA, 13 nt, Pseudomonas aeruginosa PA01
guagccgccggga

SEQ ID NO: 1458067 - RNA, 15 nt, Pseudomonas aeruginosa PA01
guaggcaucgaucuu

SEQ ID NO: 1458068 - RNA, 20 nt, Pseudomonas aeruginosa PA01
guaggaggaaauacagcacc

SEQ ID NO: 1458069 - RNA, 15 nt, Pseudomonas aeruginosa PA01
guagcugagcaggcc

SEQ ID NO: 1458070 - RNA, 14 nt, Pseudomonas aeruginosa PA01
guagcuccaggccg

SEQ ID NO: 1458071 - RNA, 14 nt, Pseudomonas aeruginosa PA01
guagcucaucggcg

SEQ ID NO: 1458072 - RNA, 15 nt, Pseudomonas aeruginosa PA01
guagcucaucggcga

SEQ ID NO: 1458073 - RNA, 16 nt, Pseudomonas aeruginosa PA01
guagccgaagucggcg

SEQ ID NO: 1458074 - RNA, 17 nt, Pseudomonas aeruginosa PA01
guagccgaggcggccga

SEQ ID NO: 1458075 - RNA, 18 nt, Pseudomonas aeruginosa PA01
guagccgaggcggccgag

SEQ ID NO: 1458076 - RNA, 21 nt, Pseudomonas aeruginosa PA01
guagccgaucaacgcggccag

SEQ ID NO: 1458077 - RNA, 22 nt, Pseudomonas aeruginosa PA01
guagccgaucaacgcggccagc

SEQ ID NO: 1458078 - RNA, 11 nt, Pseudomonas aeruginosa PA01
guagccgagca

SEQ ID NO: 1458079 - RNA, 21 nt, Pseudomonas aeruginosa PA01
guagccgccuuguuccaggcg

SEQ ID NO: 1458080 - RNA, 11 nt, Pseudomonas aeruginosa PA01
guagccgcgcc

SEQ ID NO: 1458081 - RNA, 14 nt, Pseudomonas aeruginosa PA01
guagcgguccucgg

SEQ ID NO: 1458082 - RNA, 21 nt, Pseudomonas aeruginosa PA01
guagcgguccucgggcaccag

SEQ ID NO: 1458083 - RNA, 22 nt, Pseudomonas aeruginosa PA01
guagcgguccucgggcaccagc

SEQ ID NO: 1458084 - RNA, 17 nt, Pseudomonas aeruginosa PA01
guagaucggcagcauca

SEQ ID NO: 1458085 - RNA, 23 nt, Pseudomonas aeruginosa PA01
guagaucugugcggugccgcgca

SEQ ID NO: 1458086 - RNA, 13 nt, Pseudomonas aeruginosa PA01
guagaucgacagc

SEQ ID NO: 1458087 - RNA, 17 nt, Pseudomonas aeruginosa PA01
guagaucccuucguccu

SEQ ID NO: 1458088 - RNA, 16 nt, Pseudomonas aeruginosa PA01
guagaugccgcgucgg

SEQ ID NO: 1458089 - RNA, 14 nt, Pseudomonas aeruginosa PA01
guagaugccggugc

SEQ ID NO: 1458090 - RNA, 19 nt, Pseudomonas aeruginosa PA01
guagauggacgguucccag

SEQ ID NO: 1458091 - RNA, 13 nt, Pseudomonas aeruginosa PA01
guagcccggcagc

SEQ ID NO: 1458092 - RNA, 18 nt, Pseudomonas aeruginosa PA01
guagcccuucuccgccag

SEQ ID NO: 1458093 - RNA, 20 nt, Pseudomonas aeruginosa PA01
guaggcgcgccaaggccgcc

SEQ ID NO: 1458094 - RNA, 17 nt, Pseudomonas aeruginosa PA01
guaggcgcgggcggcgg

SEQ ID NO: 1458095 - RNA, 14 nt, Pseudomonas aeruginosa PA01
guaggcgccgccgu

SEQ ID NO: 1458096 - RNA, 15 nt, Pseudomonas aeruginosa PA01
guaggcgcucuggaa

SEQ ID NO: 1458097 - RNA, 17 nt, Pseudomonas aeruginosa PA01
guagggcaucgccgaca

SEQ ID NO: 1458098 - RNA, 23 nt, Pseudomonas aeruginosa PA01
guagggcaucgccgacaggucgg

SEQ ID NO: 1458099 - RNA, 21 nt, Pseudomonas aeruginosa PA01
guagggcgucaguuccacgcg

SEQ ID NO: 1458100 - RNA, 19 nt, Pseudomonas aeruginosa PA01
guagggcgaauaucgcggc

SEQ ID NO: 1458101 - RNA, 17 nt, Pseudomonas aeruginosa PA01
guaggcgguggcgauca

SEQ ID NO: 1458102 - RNA, 15 nt, Pseudomonas aeruginosa PA01
guaggcguccuggcg

SEQ ID NO: 1458103 - RNA, 19 nt, Pseudomonas aeruginosa PA01
guaggcucccccgcgccgc

SEQ ID NO: 1458104 - RNA, 21 nt, Pseudomonas aeruginosa PA01
guaggcucccccgcgccgccg

SEQ ID NO: 1458105 - RNA, 18 nt, Pseudomonas aeruginosa PA01
guaggcuuggucgggcgc

SEQ ID NO: 1458106 - RNA, 12 nt, Pseudomonas aeruginosa PA01
guaggcgaugcg

SEQ ID NO: 1458107 - RNA, 20 nt, Pseudomonas aeruginosa PA01
guaggcgauggccuggucgg

SEQ ID NO: 1458108 - RNA, 15 nt, Pseudomonas aeruginosa PA01
guaggcgcaccaggc

SEQ ID NO: 1458109 - RNA, 17 nt, Pseudomonas aeruginosa PA01
guaggcgcaccaggcca

SEQ ID NO: 1458110 - RNA, 22 nt, Pseudomonas aeruginosa PA01
guaggcgcaccaggccaggcug

SEQ ID NO: 1458111 - RNA, 23 nt, Pseudomonas aeruginosa PA01
guaggcgagcagcggcacgcucu

SEQ ID NO: 1458112 - RNA, 16 nt, Pseudomonas aeruginosa PA01
guaggccuggccgccc

SEQ ID NO: 1458113 - RNA, 19 nt, Pseudomonas aeruginosa PA01
guaggcgaagcccagcgag

SEQ ID NO: 1458114 - RNA, 16 nt, Pseudomonas aeruginosa PA01
guaggcgaaggcgaug

SEQ ID NO: 1458115 - RNA, 15 nt, Pseudomonas aeruginosa PA01
guaggccgcuuccgg

SEQ ID NO: 1458116 - RNA, 12 nt, Pseudomonas aeruginosa PA01
guaggccaggca

SEQ ID NO: 1458117 - RNA, 13 nt, Pseudomonas aeruginosa PA01
guaggccaugauc

SEQ ID NO: 1458118 - RNA, 14 nt, Pseudomonas aeruginosa PA01
guaggccaugauca

SEQ ID NO: 1458119 - RNA, 17 nt, Pseudomonas aeruginosa PA01
guacgcucaccaccacc

SEQ ID NO: 1458120 - RNA, 23 nt, Pseudomonas aeruginosa PA01
guacgcugcauguccgcaggcag

SEQ ID NO: 1458121 - RNA, 12 nt, Pseudomonas aeruginosa PA01
guacggcgcggu

SEQ ID NO: 1458122 - RNA, 23 nt, Pseudomonas aeruginosa PA01
guacggaucgguccccuccaggu

SEQ ID NO: 1458123 - RNA, 15 nt, Pseudomonas aeruginosa PA01
guacggcaccaccac

SEQ ID NO: 1458124 - RNA, 15 nt, Pseudomonas aeruginosa PA01
guacggcgccgcugc

SEQ ID NO: 1458125 - RNA, 16 nt, Pseudomonas aeruginosa PA01
guaaucaccuuccucg

SEQ ID NO: 1458126 - RNA, 22 nt, Pseudomonas aeruginosa PA01
guaauaggcgaagcggcucggc

SEQ ID NO: 1458127 - RNA, 13 nt, Pseudomonas aeruginosa PA01
guagagcacgccg

SEQ ID NO: 1458128 - RNA, 15 nt, Pseudomonas aeruginosa PA01
guagagacggcggcg

SEQ ID NO: 1458129 - RNA, 17 nt, Pseudomonas aeruginosa PA01
guagagaugcaccggcc

SEQ ID NO: 1458130 - RNA, 18 nt, Pseudomonas aeruginosa PA01
guagagaugcaccggcca

SEQ ID NO: 1458131 - RNA, 19 nt, Pseudomonas aeruginosa PA01
guagagaugcaccggccac

SEQ ID NO: 1458132 - RNA, 21 nt, Pseudomonas aeruginosa PA01
guagagaugcagcagguagaa

SEQ ID NO: 1458133 - RNA, 19 nt, Pseudomonas aeruginosa PA01
guagagauucuuccggugc

SEQ ID NO: 1458134 - RNA, 20 nt, Pseudomonas aeruginosa PA01
guagaggcucaacugguccu

SEQ ID NO: 1458135 - RNA, 15 nt, Pseudomonas aeruginosa PA01
guagaggcucggcgg

SEQ ID NO: 1458136 - RNA, 14 nt, Pseudomonas aeruginosa PA01
guagagcgcggcgc

SEQ ID NO: 1458137 - RNA, 15 nt, Pseudomonas aeruginosa PA01
guagaguucgcugcg

SEQ ID NO: 1458138 - RNA, 20 nt, Pseudomonas aeruginosa PA01
guagaccggcuccagggcga

SEQ ID NO: 1458139 - RNA, 14 nt, Pseudomonas aeruginosa PA01
guagaccuguucgc

SEQ ID NO: 1458140 - RNA, 17 nt, Pseudomonas aeruginosa PA01
guagaccuucucguccu

SEQ ID NO: 1458141 - RNA, 20 nt, Pseudomonas aeruginosa PA01
guagacgaaacucaucaggc

SEQ ID NO: 1458142 - RNA, 16 nt, Pseudomonas aeruginosa PA01
guagaccaucgccggc

SEQ ID NO: 1458143 - RNA, 18 nt, Pseudomonas aeruginosa PA01
guagaccaucgccggcga

SEQ ID NO: 1458144 - RNA, 22 nt, Pseudomonas aeruginosa PA01
guacugguccggguuggcgcag

SEQ ID NO: 1458145 - RNA, 14 nt, Pseudomonas aeruginosa PA01
guacugcgccaguu

SEQ ID NO: 1458146 - RNA, 23 nt, Pseudomonas aeruginosa PA01
guacugcucgguauggcugcugu

SEQ ID NO: 1458147 - RNA, 16 nt, Pseudomonas aeruginosa PA01
guacucggcccgggcc

SEQ ID NO: 1458148 - RNA, 16 nt, Pseudomonas aeruginosa PA01
guacgguuggccagcg

SEQ ID NO: 1458149 - RNA, 18 nt, Pseudomonas aeruginosa PA01
guacgguuggccagcgaa

SEQ ID NO: 1458150 - RNA, 14 nt, Pseudomonas aeruginosa PA01
guacucgccgggcg

SEQ ID NO: 1458151 - RNA, 13 nt, Pseudomonas aeruginosa PA01
guacucgccggug

SEQ ID NO: 1458152 - RNA, 20 nt, Pseudomonas aeruginosa PA01
guacggucuugcgcuugccg

SEQ ID NO: 1458153 - RNA, 14 nt, Pseudomonas aeruginosa PA01
guacucggcggggc

SEQ ID NO: 1458154 - RNA, 16 nt, Pseudomonas aeruginosa PA01
guacucggcggggcgc

SEQ ID NO: 1458155 - RNA, 18 nt, Pseudomonas aeruginosa PA01
guacucggcggggcgcag

SEQ ID NO: 1458156 - RNA, 19 nt, Pseudomonas aeruginosa PA01
guacucggcuacgaaccga

SEQ ID NO: 1458157 - RNA, 20 nt, Pseudomonas aeruginosa PA01
guacucggcuacgaaccgag

SEQ ID NO: 1458158 - RNA, 16 nt, Pseudomonas aeruginosa PA01
guacucguccucccag

SEQ ID NO: 1458159 - RNA, 18 nt, Pseudomonas aeruginosa PA01
guacucguguuccggcag

SEQ ID NO: 1458160 - RNA, 20 nt, Pseudomonas aeruginosa PA01
ggugcggauggcgaucgagc

SEQ ID NO: 1458161 - RNA, 14 nt, Pseudomonas aeruginosa PA01
ggugcgcucgcgga

SEQ ID NO: 1458162 - RNA, 16 nt, Pseudomonas aeruginosa PA01
ggugcgcuggaacggc

SEQ ID NO: 1458163 - RNA, 12 nt, Pseudomonas aeruginosa PA01
ggugcgcggcga

SEQ ID NO: 1458164 - RNA, 22 nt, Pseudomonas aeruginosa PA01
ggugcgggccuugaccaccgcc

SEQ ID NO: 1458165 - RNA, 14 nt, Pseudomonas aeruginosa PA01
ggugcgggcgcggg

SEQ ID NO: 1458166 - RNA, 17 nt, Pseudomonas aeruginosa PA01
ggugcggguggucgccg

SEQ ID NO: 1458167 - RNA, 19 nt, Pseudomonas aeruginosa PA01
ggugcggguggucgccgcc

SEQ ID NO: 1458168 - RNA, 21 nt, Pseudomonas aeruginosa PA01
ggugcggguggucgccgccca

SEQ ID NO: 1458169 - RNA, 14 nt, Pseudomonas aeruginosa PA01
ggugcggcugcuca

SEQ ID NO: 1458170 - RNA, 13 nt, Pseudomonas aeruginosa PA01
ggugcggcuggcg

SEQ ID NO: 1458171 - RNA, 15 nt, Pseudomonas aeruginosa PA01
ggugcggcuggcgcg

SEQ ID NO: 1458172 - RNA, 15 nt, Pseudomonas aeruginosa PA01
gguggaauccagggc

SEQ ID NO: 1458173 - RNA, 17 nt, Pseudomonas aeruginosa PA01
gguggaauaccgcugcg

SEQ ID NO: 1458174 - RNA, 17 nt, Pseudomonas aeruginosa PA01
gguggaacgaggcgacc

SEQ ID NO: 1458175 - RNA, 19 nt, Pseudomonas aeruginosa PA01
ggugcuuuccugcuccagc

SEQ ID NO: 1458176 - RNA, 17 nt, Pseudomonas aeruginosa PA01
ggugcuuugcauggccu

SEQ ID NO: 1458177 - RNA, 13 nt, Pseudomonas aeruginosa PA01
gguggaacagcau

SEQ ID NO: 1458178 - RNA, 15 nt, Pseudomonas aeruginosa PA01
gguggaacagcauca

SEQ ID NO: 1458179 - RNA, 14 nt, Pseudomonas aeruginosa PA01
gguggaacagccgc

SEQ ID NO: 1458180 - RNA, 20 nt, Pseudomonas aeruginosa PA01
gguggccacgucgccccagg

SEQ ID NO: 1458181 - RNA, 19 nt, Pseudomonas aeruginosa PA01
gguggccaggacgcuggcg

SEQ ID NO: 1458182 - RNA, 20 nt, Pseudomonas aeruginosa PA01
gguggccaggacgcuggcga

SEQ ID NO: 1458183 - RNA, 14 nt, Pseudomonas aeruginosa PA01
gguggccaggcgca

SEQ ID NO: 1458184 - RNA, 19 nt, Pseudomonas aeruginosa PA01
gguggccaggcgcaccagc

SEQ ID NO: 1458185 - RNA, 15 nt, Pseudomonas aeruginosa PA01
gguggcccugggcgg

SEQ ID NO: 1458186 - RNA, 15 nt, Pseudomonas aeruginosa PA01
gguggccgcgccgcc

SEQ ID NO: 1458187 - RNA, 13 nt, Pseudomonas aeruginosa PA01
gguggccguggcg

SEQ ID NO: 1458188 - RNA, 14 nt, Pseudomonas aeruginosa PA01
gguggccguugagc

SEQ ID NO: 1458189 - RNA, 16 nt, Pseudomonas aeruginosa PA01
gguggcgaccaggaca

SEQ ID NO: 1458190 - RNA, 13 nt, Pseudomonas aeruginosa PA01
gguggcgaccgcc

SEQ ID NO: 1458191 - RNA, 19 nt, Pseudomonas aeruginosa PA01
gguggcgacgcgcaggccg

SEQ ID NO: 1458192 - RNA, 20 nt, Pseudomonas aeruginosa PA01
gguggcgacgcgcaggccgg

SEQ ID NO: 1458193 - RNA, 17 nt, Pseudomonas aeruginosa PA01
gguggcgcccaugccgc

SEQ ID NO: 1458194 - RNA, 23 nt, Pseudomonas aeruginosa PA01
gguggcgcccaugccgcccggcc

SEQ ID NO: 1458195 - RNA, 13 nt, Pseudomonas aeruginosa PA01
ggugggcuugccg

SEQ ID NO: 1458196 - RNA, 13 nt, Pseudomonas aeruginosa PA01
ggugggcuccagc

SEQ ID NO: 1458197 - RNA, 14 nt, Pseudomonas aeruginosa PA01
gguggggccgccga

SEQ ID NO: 1458198 - RNA, 21 nt, Pseudomonas aeruginosa PA01
ggugguaagcgagcagacuga

SEQ ID NO: 1458199 - RNA, 19 nt, Pseudomonas aeruginosa PA01
ggugguacggcugagaccu

SEQ ID NO: 1458200 - RNA, 15 nt, Pseudomonas aeruginosa PA01
ggugguagagcggca

SEQ ID NO: 1458201 - RNA, 18 nt, Pseudomonas aeruginosa PA01
ggugguagagcggcaccu

SEQ ID NO: 1458202 - RNA, 13 nt, Pseudomonas aeruginosa PA01
gguggucaccgcc

SEQ ID NO: 1458203 - RNA, 15 nt, Pseudomonas aeruginosa PA01
gguggucaccgccag

SEQ ID NO: 1458204 - RNA, 15 nt, Pseudomonas aeruginosa PA01
ggugcgcaggcgcuc

SEQ ID NO: 1458205 - RNA, 18 nt, Pseudomonas aeruginosa PA01
ggugcgcaggcgcucgcg

SEQ ID NO: 1458206 - RNA, 23 nt, Pseudomonas aeruginosa PA01
ggugcgaaaaauacuccgcgacg

SEQ ID NO: 1458207 - RNA, 18 nt, Pseudomonas aeruginosa PA01
ggugccuucggcggcgcc

SEQ ID NO: 1458208 - RNA, 19 nt, Pseudomonas aeruginosa PA01
ggugccuucggcggcgccu

SEQ ID NO: 1458209 - RNA, 19 nt, Pseudomonas aeruginosa PA01
ggugcgagucaccccgacc

SEQ ID NO: 1458210 - RNA, 14 nt, Pseudomonas aeruginosa PA01
ggugcgcaggcugc

SEQ ID NO: 1458211 - RNA, 14 nt, Pseudomonas aeruginosa PA01
ggugccggcggcgg

SEQ ID NO: 1458212 - RNA, 16 nt, Pseudomonas aeruginosa PA01
ggugccgggggcggcg

SEQ ID NO: 1458213 - RNA, 17 nt, Pseudomonas aeruginosa PA01
ggugccguugcuaccgg

SEQ ID NO: 1458214 - RNA, 18 nt, Pseudomonas aeruginosa PA01
ggugccguugcuaccggc

SEQ ID NO: 1458215 - RNA, 21 nt, Pseudomonas aeruginosa PA01
ggugccguugcuaccggcgga

SEQ ID NO: 1458216 - RNA, 21 nt, Pseudomonas aeruginosa PA01
ggugccgucaugcacuucgac

SEQ ID NO: 1458217 - RNA, 17 nt, Pseudomonas aeruginosa PA01
ggugcccagcggcgccu

SEQ ID NO: 1458218 - RNA, 17 nt, Pseudomonas aeruginosa PA01
ggugcccaucaggcuca

SEQ ID NO: 1458219 - RNA, 18 nt, Pseudomonas aeruginosa PA01
ggugcccgaugccgcgcc

SEQ ID NO: 1458220 - RNA, 16 nt, Pseudomonas aeruginosa PA01
ggugccccgcuggccc

SEQ ID NO: 1458221 - RNA, 20 nt, Pseudomonas aeruginosa PA01
ggugccccgcuggcccaaca

SEQ ID NO: 1458222 - RNA, 17 nt, Pseudomonas aeruginosa PA01
ggugccagggcggucgg

SEQ ID NO: 1458223 - RNA, 18 nt, Pseudomonas aeruginosa PA01
ggugccagggcggucggc

SEQ ID NO: 1458224 - RNA, 15 nt, Pseudomonas aeruginosa PA01
ggugccauacagcgc

SEQ ID NO: 1458225 - RNA, 17 nt, Pseudomonas aeruginosa PA01
ggugccauacagcgccc

SEQ ID NO: 1458226 - RNA, 19 nt, Pseudomonas aeruginosa PA01
ggugccauacucggacggc

SEQ ID NO: 1458227 - RNA, 23 nt, Pseudomonas aeruginosa PA01
ggugccauccgcagucuucucgg

SEQ ID NO: 1458228 - RNA, 17 nt, Pseudomonas aeruginosa PA01
ggugccauggaucacca

SEQ ID NO: 1458229 - RNA, 19 nt, Pseudomonas aeruginosa PA01
ggugccauucggugcgcuc

SEQ ID NO: 1458230 - RNA, 13 nt, Pseudomonas aeruginosa PA01
ggugcccagcagg

SEQ ID NO: 1458231 - RNA, 15 nt, Pseudomonas aeruginosa PA01
ggugccgaucagccc

SEQ ID NO: 1458232 - RNA, 19 nt, Pseudomonas aeruginosa PA01
ggugccgcagacaucgccg

SEQ ID NO: 1458233 - RNA, 14 nt, Pseudomonas aeruginosa PA01
ggugccgccggcca

SEQ ID NO: 1458234 - RNA, 13 nt, Pseudomonas aeruginosa PA01
ggugccgccaguc

SEQ ID NO: 1458235 - RNA, 13 nt, Pseudomonas aeruginosa PA01
ggugccgccggcg

SEQ ID NO: 1458236 - RNA, 14 nt, Pseudomonas aeruginosa PA01
ggugccgcccuggg

SEQ ID NO: 1458237 - RNA, 17 nt, Pseudomonas aeruginosa PA01
ggugccgcgcagguuca

SEQ ID NO: 1458238 - RNA, 19 nt, Pseudomonas aeruginosa PA01
ggugccggagaacgccgcc

SEQ ID NO: 1458239 - RNA, 18 nt, Pseudomonas aeruginosa PA01
gguuucgcgccauggccg

SEQ ID NO: 1458240 - RNA, 18 nt, Pseudomonas aeruginosa PA01
gguuucuuuuuauccggc

SEQ ID NO: 1458241 - RNA, 12 nt, Pseudomonas aeruginosa PA01
gguuucgucgcg

SEQ ID NO: 1458242 - RNA, 17 nt, Pseudomonas aeruginosa PA01
gguuucgaccggcgcgc

SEQ ID NO: 1458243 - RNA, 14 nt, Pseudomonas aeruginosa PA01
gguuucgcagcgcu

SEQ ID NO: 1458244 - RNA, 14 nt, Pseudomonas aeruginosa PA01
gguuuccaggcuca

SEQ ID NO: 1458245 - RNA, 15 nt, Pseudomonas aeruginosa PA01
gguuuccaggcucac

SEQ ID NO: 1458246 - RNA, 13 nt, Pseudomonas aeruginosa PA01
gguuucaggccuu

SEQ ID NO: 1458247 - RNA, 20 nt, Pseudomonas aeruginosa PA01
gguugcggccugaucaugua

SEQ ID NO: 1458248 - RNA, 15 nt, Pseudomonas aeruginosa PA01
gguugcggcgcccgc

SEQ ID NO: 1458249 - RNA, 23 nt, Pseudomonas aeruginosa PA01
gguugcgggagcacugggaaucg

SEQ ID NO: 1458250 - RNA, 13 nt, Pseudomonas aeruginosa PA01
gguugcgcggcag

SEQ ID NO: 1458251 - RNA, 13 nt, Pseudomonas aeruginosa PA01
gguugcgcuggcg

SEQ ID NO: 1458252 - RNA, 13 nt, Pseudomonas aeruginosa PA01
gguugccgcugcg

SEQ ID NO: 1458253 - RNA, 14 nt, Pseudomonas aeruginosa PA01
gguugccgcuggcc

SEQ ID NO: 1458254 - RNA, 15 nt, Pseudomonas aeruginosa PA01
gguugccgcuggccu

SEQ ID NO: 1458255 - RNA, 20 nt, Pseudomonas aeruginosa PA01
gguugccggagacgauggcg

SEQ ID NO: 1458256 - RNA, 16 nt, Pseudomonas aeruginosa PA01
gguugcgccauugccg

SEQ ID NO: 1458257 - RNA, 20 nt, Pseudomonas aeruginosa PA01
gguugcgccauugccgccag

SEQ ID NO: 1458258 - RNA, 15 nt, Pseudomonas aeruginosa PA01
gguugcccagcaggc

SEQ ID NO: 1458259 - RNA, 15 nt, Pseudomonas aeruginosa PA01
gguugccgccgauca

SEQ ID NO: 1458260 - RNA, 20 nt, Pseudomonas aeruginosa PA01
guaaacgcgaaugcccggca

SEQ ID NO: 1458261 - RNA, 23 nt, Pseudomonas aeruginosa PA01
gguucaauccuuccgucgucacc

SEQ ID NO: 1458262 - RNA, 18 nt, Pseudomonas aeruginosa PA01
gguuaucgaggcgucggc

SEQ ID NO: 1458263 - RNA, 19 nt, Pseudomonas aeruginosa PA01
gguuaucgaggcgucggcg

SEQ ID NO: 1458264 - RNA, 11 nt, Pseudomonas aeruginosa PA01
gguucagcggg

SEQ ID NO: 1458265 - RNA, 20 nt, Pseudomonas aeruginosa PA01
gguucaggguggcgaucacg

SEQ ID NO: 1458266 - RNA, 21 nt, Pseudomonas aeruginosa PA01
gguucagucggccaggcgcca

SEQ ID NO: 1458267 - RNA, 16 nt, Pseudomonas aeruginosa PA01
gguucagcccgccgug

SEQ ID NO: 1458268 - RNA, 23 nt, Pseudomonas aeruginosa PA01
gguucagcccgccgugcgcuccg

SEQ ID NO: 1458269 - RNA, 13 nt, Pseudomonas aeruginosa PA01
gguucaggccggg

SEQ ID NO: 1458270 - RNA, 19 nt, Pseudomonas aeruginosa PA01
gguucgcaggccaggcgca

SEQ ID NO: 1458271 - RNA, 19 nt, Pseudomonas aeruginosa PA01
gguucgagucccguccgcu

SEQ ID NO: 1458272 - RNA, 21 nt, Pseudomonas aeruginosa PA01
gguucgccgagcgccgccagg

SEQ ID NO: 1458273 - RNA, 15 nt, Pseudomonas aeruginosa PA01
gguucgcccaguacc

SEQ ID NO: 1458274 - RNA, 15 nt, Pseudomonas aeruginosa PA01
gguguugaaagccuu

SEQ ID NO: 1458275 - RNA, 12 nt, Pseudomonas aeruginosa PA01
gguguucggccc

SEQ ID NO: 1458276 - RNA, 14 nt, Pseudomonas aeruginosa PA01
gguguucggccccg

SEQ ID NO: 1458277 - RNA, 14 nt, Pseudomonas aeruginosa PA01
gguguagaccacca

SEQ ID NO: 1458278 - RNA, 17 nt, Pseudomonas aeruginosa PA01
gguguagaggaucuccg

SEQ ID NO: 1458279 - RNA, 20 nt, Pseudomonas aeruginosa PA01
gguucggcgguagcgcgaag

SEQ ID NO: 1458280 - RNA, 15 nt, Pseudomonas aeruginosa PA01
gguucgcguggcccg

SEQ ID NO: 1458281 - RNA, 17 nt, Pseudomonas aeruginosa PA01
gguucgcgcgcuggucg

SEQ ID NO: 1458282 - RNA, 13 nt, Pseudomonas aeruginosa PA01
gguucgcggcgca

SEQ ID NO: 1458283 - RNA, 19 nt, Pseudomonas aeruginosa PA01
gguucggggaacagcgcca

SEQ ID NO: 1458284 - RNA, 23 nt, Pseudomonas aeruginosa PA01
gguucggggaacagcgccagcgg

SEQ ID NO: 1458285 - RNA, 14 nt, Pseudomonas aeruginosa PA01
gguucggcaggccu

SEQ ID NO: 1458286 - RNA, 22 nt, Pseudomonas aeruginosa PA01
gguucggcgaggaucgccagca

SEQ ID NO: 1458287 - RNA, 17 nt, Pseudomonas aeruginosa PA01
gguucgugccaggcggc

SEQ ID NO: 1458288 - RNA, 20 nt, Pseudomonas aeruginosa PA01
gguucuugaugucagcguag

SEQ ID NO: 1458289 - RNA, 14 nt, Pseudomonas aeruginosa PA01
gguucuugcccagc

SEQ ID NO: 1458290 - RNA, 21 nt, Pseudomonas aeruginosa PA01
gguucugguccaccagcccgc

SEQ ID NO: 1458291 - RNA, 14 nt, Pseudomonas aeruginosa PA01
gguucugcuccgga

SEQ ID NO: 1458292 - RNA, 20 nt, Pseudomonas aeruginosa PA01
gguucugcuccggacugccg

SEQ ID NO: 1458293 - RNA, 22 nt, Pseudomonas aeruginosa PA01
gguucguugaccguccacaccg

SEQ ID NO: 1458294 - RNA, 13 nt, Pseudomonas aeruginosa PA01
gguucucgacccg

SEQ ID NO: 1458295 - RNA, 12 nt, Pseudomonas aeruginosa PA01
gguucucggcca

SEQ ID NO: 1458296 - RNA, 13 nt, Pseudomonas aeruginosa PA01
gguucucggccac

SEQ ID NO: 1458297 - RNA, 17 nt, Pseudomonas aeruginosa PA01
gguucucggccaccacc

SEQ ID NO: 1458298 - RNA, 15 nt, Pseudomonas aeruginosa PA01
gguucucggucgggc

SEQ ID NO: 1458299 - RNA, 19 nt, Pseudomonas aeruginosa PA01
gguucucggucgggcgggc

SEQ ID NO: 1458300 - RNA, 16 nt, Pseudomonas aeruginosa PA01
gguugagauccuggcc

SEQ ID NO: 1458301 - RNA, 22 nt, Pseudomonas aeruginosa PA01
gguugauccugggcgccagccg

SEQ ID NO: 1458302 - RNA, 20 nt, Pseudomonas aeruginosa PA01
gguugaucagguucggcagc

SEQ ID NO: 1458303 - RNA, 23 nt, Pseudomonas aeruginosa PA01
gguugaugugcaguucgaccucc

SEQ ID NO: 1458304 - RNA, 17 nt, Pseudomonas aeruginosa PA01
gguucuucguuccugau

SEQ ID NO: 1458305 - RNA, 21 nt, Pseudomonas aeruginosa PA01
gguugaaacugcgcaggcugg

SEQ ID NO: 1458306 - RNA, 15 nt, Pseudomonas aeruginosa PA01
gguugaagagcagca

SEQ ID NO: 1458307 - RNA, 19 nt, Pseudomonas aeruginosa PA01
gguugaccccgaggucggc

SEQ ID NO: 1458308 - RNA, 18 nt, Pseudomonas aeruginosa PA01
gguugaccccgcggccga

SEQ ID NO: 1458309 - RNA, 21 nt, Pseudomonas aeruginosa PA01
gguugaccccgcggccgagga

SEQ ID NO: 1458310 - RNA, 19 nt, Pseudomonas aeruginosa PA01
gguugaccugcagcgccuc

SEQ ID NO: 1458311 - RNA, 23 nt, Pseudomonas aeruginosa PA01
gguugaccuuguccuggccggcg

SEQ ID NO: 1458312 - RNA, 14 nt, Pseudomonas aeruginosa PA01
ggucucgaucagcg

SEQ ID NO: 1458313 - RNA, 18 nt, Pseudomonas aeruginosa PA01
ggucucgaucagcgccgg

SEQ ID NO: 1458314 - RNA, 13 nt, Pseudomonas aeruginosa PA01
ggucucgauggca

SEQ ID NO: 1458315 - RNA, 11 nt, Pseudomonas aeruginosa PA01
ggucucgacgc

SEQ ID NO: 1458316 - RNA, 16 nt, Pseudomonas aeruginosa PA01
ggucucgccaccccgc

SEQ ID NO: 1458317 - RNA, 22 nt, Pseudomonas aeruginosa PA01
ggucucgccgccgagcaggccc

SEQ ID NO: 1458318 - RNA, 16 nt, Pseudomonas aeruginosa PA01
ggucucgcgggcgacg

SEQ ID NO: 1458319 - RNA, 20 nt, Pseudomonas aeruginosa PA01
ggucucgcugacccaggcuu

SEQ ID NO: 1458320 - RNA, 20 nt, Pseudomonas aeruginosa PA01
ggucucguagcagccacggg

SEQ ID NO: 1458321 - RNA, 23 nt, Pseudomonas aeruginosa PA01
ggucucuuccagcaugcucgggc

SEQ ID NO: 1458322 - RNA, 13 nt, Pseudomonas aeruginosa PA01
ggucucuucgucg

SEQ ID NO: 1458323 - RNA, 19 nt, Pseudomonas aeruginosa PA01
ggucugcgccucgcuggcg

SEQ ID NO: 1458324 - RNA, 19 nt, Pseudomonas aeruginosa PA01
ggucugcgguauaggccuu

SEQ ID NO: 1458325 - RNA, 23 nt, Pseudomonas aeruginosa PA01
ggucugccucgccgaggcggaag

SEQ ID NO: 1458326 - RNA, 15 nt, Pseudomonas aeruginosa PA01
ggucugcccguggcg

SEQ ID NO: 1458327 - RNA, 17 nt, Pseudomonas aeruginosa PA01
ggucugcccguggcgcg

SEQ ID NO: 1458328 - RNA, 19 nt, Pseudomonas aeruginosa PA01
ggucugcccguggcgcgga

SEQ ID NO: 1458329 - RNA, 22 nt, Pseudomonas aeruginosa PA01
ggucguagcagguccgcgccuc

SEQ ID NO: 1458330 - RNA, 14 nt, Pseudomonas aeruginosa PA01
ggucgguucgucga

SEQ ID NO: 1458331 - RNA, 16 nt, Pseudomonas aeruginosa PA01
ggucgguucgucgagg

SEQ ID NO: 1458332 - RNA, 15 nt, Pseudomonas aeruginosa PA01
ggucguacaccgcgc

SEQ ID NO: 1458333 - RNA, 21 nt, Pseudomonas aeruginosa PA01
ggucguacaccgcgcggcaca

SEQ ID NO: 1458334 - RNA, 18 nt, Pseudomonas aeruginosa PA01
ggucguacacguuggccg

SEQ ID NO: 1458335 - RNA, 17 nt, Pseudomonas aeruginosa PA01
ggucguagggcgucagu

SEQ ID NO: 1458336 - RNA, 17 nt, Pseudomonas aeruginosa PA01
ggucucgaacgccaggc

SEQ ID NO: 1458337 - RNA, 20 nt, Pseudomonas aeruginosa PA01
ggucucaguauuucucgacu

SEQ ID NO: 1458338 - RNA, 14 nt, Pseudomonas aeruginosa PA01
ggucuccaggacca

SEQ ID NO: 1458339 - RNA, 16 nt, Pseudomonas aeruginosa PA01
ggucgcggaucaggcu

SEQ ID NO: 1458340 - RNA, 19 nt, Pseudomonas aeruginosa PA01
ggucgcggcgaccucuucg

SEQ ID NO: 1458341 - RNA, 17 nt, Pseudomonas aeruginosa PA01
ggucgcggcugcgcgcc

SEQ ID NO: 1458342 - RNA, 19 nt, Pseudomonas aeruginosa PA01
ggucgcggcugcgcgccgg

SEQ ID NO: 1458343 - RNA, 15 nt, Pseudomonas aeruginosa PA01
ggucggaugcagcgc

SEQ ID NO: 1458344 - RNA, 17 nt, Pseudomonas aeruginosa PA01
ggucggaugcagcgcuu

SEQ ID NO: 1458345 - RNA, 13 nt, Pseudomonas aeruginosa PA01
ggucgcgcuggac

SEQ ID NO: 1458346 - RNA, 20 nt, Pseudomonas aeruginosa PA01
ggucgcgcuggaccuggccg

SEQ ID NO: 1458347 - RNA, 12 nt, Pseudomonas aeruginosa PA01
ggucgcgcuggg

SEQ ID NO: 1458348 - RNA, 20 nt, Pseudomonas aeruginosa PA01
ggucgcggaacucgaugaaa

SEQ ID NO: 1458349 - RNA, 12 nt, Pseudomonas aeruginosa PA01
ggucgcgcggcg

SEQ ID NO: 1458350 - RNA, 14 nt, Pseudomonas aeruginosa PA01
ggucgcgcggcgcc

SEQ ID NO: 1458351 - RNA, 20 nt, Pseudomonas aeruginosa PA01
ggucgcgcgggugcggcugg

SEQ ID NO: 1458352 - RNA, 22 nt, Pseudomonas aeruginosa PA01
ggucgcgcgggugcggcuggcg

SEQ ID NO: 1458353 - RNA, 17 nt, Pseudomonas aeruginosa PA01
ggucgcgcucaggcgca

SEQ ID NO: 1458354 - RNA, 20 nt, Pseudomonas aeruginosa PA01
ggucgcgcucuggcccagcu

SEQ ID NO: 1458355 - RNA, 14 nt, Pseudomonas aeruginosa PA01
ggucggcaggaccg

SEQ ID NO: 1458356 - RNA, 15 nt, Pseudomonas aeruginosa PA01
ggucggcauccggca

SEQ ID NO: 1458357 - RNA, 17 nt, Pseudomonas aeruginosa PA01
ggucggcauccggcagg

SEQ ID NO: 1458358 - RNA, 19 nt, Pseudomonas aeruginosa PA01
ggucggcagaccgacccuc

SEQ ID NO: 1458359 - RNA, 21 nt, Pseudomonas aeruginosa PA01
ggucggcagcagcuugccggc

SEQ ID NO: 1458360 - RNA, 22 nt, Pseudomonas aeruginosa PA01
ggucggcagcgucgagcuggcg

SEQ ID NO: 1458361 - RNA, 24 nt, Pseudomonas aeruginosa PA01
ggucggcagcgucgagcuggcgca

SEQ ID NO: 1458362 - RNA, 15 nt, Pseudomonas aeruginosa PA01
ggucggccaggcggc

SEQ ID NO: 1458363 - RNA, 18 nt, Pseudomonas aeruginosa PA01
ggucggccaggcggccga

SEQ ID NO: 1458364 - RNA, 19 nt, Pseudomonas aeruginosa PA01
ggucggccaggacgccacc

SEQ ID NO: 1458365 - RNA, 14 nt, Pseudomonas aeruginosa PA01
ggucgggcagcuuc

SEQ ID NO: 1458366 - RNA, 13 nt, Pseudomonas aeruginosa PA01
ggucgggcaacgg

SEQ ID NO: 1458367 - RNA, 17 nt, Pseudomonas aeruginosa PA01
ggucgggcagaugucca

SEQ ID NO: 1458368 - RNA, 19 nt, Pseudomonas aeruginosa PA01
ggucggcuuccgccgccag

SEQ ID NO: 1458369 - RNA, 21 nt, Pseudomonas aeruginosa PA01
ggucggcuuccgccgccaggu

SEQ ID NO: 1458370 - RNA, 13 nt, Pseudomonas aeruginosa PA01
ggucggcuggcag

SEQ ID NO: 1458371 - RNA, 20 nt, Pseudomonas aeruginosa PA01
ggucggcggucucgaacgcc

SEQ ID NO: 1458372 - RNA, 21 nt, Pseudomonas aeruginosa PA01
ggucggcggucucgaacgcca

SEQ ID NO: 1458373 - RNA, 17 nt, Pseudomonas aeruginosa PA01
ggucggccgccucgguc

SEQ ID NO: 1458374 - RNA, 13 nt, Pseudomonas aeruginosa PA01
ggucggcgggcac

SEQ ID NO: 1458375 - RNA, 17 nt, Pseudomonas aeruginosa PA01
ggucggcgggcaccgcc

SEQ ID NO: 1458376 - RNA, 13 nt, Pseudomonas aeruginosa PA01
ggucggcggccuu

SEQ ID NO: 1458377 - RNA, 14 nt, Pseudomonas aeruginosa PA01
ggucggcggccuug

SEQ ID NO: 1458378 - RNA, 19 nt, Pseudomonas aeruginosa PA01
ggugagcauggcguugagg

SEQ ID NO: 1458379 - RNA, 19 nt, Pseudomonas aeruginosa PA01
ggugagcaggcgccggacc

SEQ ID NO: 1458380 - RNA, 14 nt, Pseudomonas aeruginosa PA01
ggugagcugaucgc

SEQ ID NO: 1458381 - RNA, 19 nt, Pseudomonas aeruginosa PA01
ggugacccacuccggcagg

SEQ ID NO: 1458382 - RNA, 21 nt, Pseudomonas aeruginosa PA01
ggugacccacuccggcaggcg

SEQ ID NO: 1458383 - RNA, 23 nt, Pseudomonas aeruginosa PA01
ggugacccacuccggcaggcgcu

SEQ ID NO: 1458384 - RNA, 16 nt, Pseudomonas aeruginosa PA01
ggugagcacgccgcga

SEQ ID NO: 1458385 - RNA, 18 nt, Pseudomonas aeruginosa PA01
ggugagcacgccgcgacc

SEQ ID NO: 1458386 - RNA, 22 nt, Pseudomonas aeruginosa PA01
ggugaaccugaccaucgucgcu

SEQ ID NO: 1458387 - RNA, 13 nt, Pseudomonas aeruginosa PA01
ggugacacccugc

SEQ ID NO: 1458388 - RNA, 21 nt, Pseudomonas aeruginosa PA01
ggugacacccugccgcgccgg

SEQ ID NO: 1458389 - RNA, 14 nt, Pseudomonas aeruginosa PA01
ggugaaaagcgcug

SEQ ID NO: 1458390 - RNA, 21 nt, Pseudomonas aeruginosa PA01
ggugaaaccggcaagcuccgc

SEQ ID NO: 1458391 - RNA, 20 nt, Pseudomonas aeruginosa PA01
ggucuugcgcagggcggcga

SEQ ID NO: 1458392 - RNA, 13 nt, Pseudomonas aeruginosa PA01
ggucuugucgaag

SEQ ID NO: 1458393 - RNA, 18 nt, Pseudomonas aeruginosa PA01
ggugauuucuucagccug

SEQ ID NO: 1458394 - RNA, 21 nt, Pseudomonas aeruginosa PA01
ggugauuucuucagccugggg

SEQ ID NO: 1458395 - RNA, 22 nt, Pseudomonas aeruginosa PA01
ggugaucuggaaauucagcgcu

SEQ ID NO: 1458396 - RNA, 16 nt, Pseudomonas aeruginosa PA01
ggugagggcgacggcg

SEQ ID NO: 1458397 - RNA, 14 nt, Pseudomonas aeruginosa PA01
ggugaggaccuggc

SEQ ID NO: 1458398 - RNA, 21 nt, Pseudomonas aeruginosa PA01
ggugaggcgcagcagcgccag

SEQ ID NO: 1458399 - RNA, 18 nt, Pseudomonas aeruginosa PA01
ggugaucgccgcgaggug

SEQ ID NO: 1458400 - RNA, 15 nt, Pseudomonas aeruginosa PA01
ggugaucucgcggcg

SEQ ID NO: 1458401 - RNA, 20 nt, Pseudomonas aeruginosa PA01
ggugaucucgcggcgcggcg

SEQ ID NO: 1458402 - RNA, 15 nt, Pseudomonas aeruginosa PA01
ggugcaccaggcgau

SEQ ID NO: 1458403 - RNA, 21 nt, Pseudomonas aeruginosa PA01
ggugcaccaggcgaugcgccg

SEQ ID NO: 1458404 - RNA, 12 nt, Pseudomonas aeruginosa PA01
ggugcaccgcgc

SEQ ID NO: 1458405 - RNA, 13 nt, Pseudomonas aeruginosa PA01
ggugcaccuggcg

SEQ ID NO: 1458406 - RNA, 14 nt, Pseudomonas aeruginosa PA01
ggugcaccuggcga

SEQ ID NO: 1458407 - RNA, 17 nt, Pseudomonas aeruginosa PA01
ggugcacgccgauggcg

SEQ ID NO: 1458408 - RNA, 17 nt, Pseudomonas aeruginosa PA01
ggugcagguucaccgcc

SEQ ID NO: 1458409 - RNA, 15 nt, Pseudomonas aeruginosa PA01
gggugaacagcggcc

SEQ ID NO: 1458410 - RNA, 15 nt, Pseudomonas aeruginosa PA01
gggucuucaggccga

SEQ ID NO: 1458411 - RNA, 17 nt, Pseudomonas aeruginosa PA01
gggucuucaggcgccgu

SEQ ID NO: 1458412 - RNA, 21 nt, Pseudomonas aeruginosa PA01
gggugaacucaugcaggccga

SEQ ID NO: 1458413 - RNA, 23 nt, Pseudomonas aeruginosa PA01
gggugaacucaugcaggccgaag

SEQ ID NO: 1458414 - RNA, 15 nt, Pseudomonas aeruginosa PA01
gggugaacuggccgu

SEQ ID NO: 1458415 - RNA, 19 nt, Pseudomonas aeruginosa PA01
gggugaagaccagucggcc

SEQ ID NO: 1458416 - RNA, 21 nt, Pseudomonas aeruginosa PA01
gggugaagcgcaggcggcugg

SEQ ID NO: 1458417 - RNA, 14 nt, Pseudomonas aeruginosa PA01
gggugaccgugcgg

SEQ ID NO: 1458418 - RNA, 14 nt, Pseudomonas aeruginosa PA01
ggucagcggcgcag

SEQ ID NO: 1458419 - RNA, 15 nt, Pseudomonas aeruginosa PA01
ggucagcggcgcagc

SEQ ID NO: 1458420 - RNA, 16 nt, Pseudomonas aeruginosa PA01
ggucagcggcgcagcc

SEQ ID NO: 1458421 - RNA, 22 nt, Pseudomonas aeruginosa PA01
ggucagcuucgccgcccuggau

SEQ ID NO: 1458422 - RNA, 13 nt, Pseudomonas aeruginosa PA01
ggucaggaucaca

SEQ ID NO: 1458423 - RNA, 16 nt, Pseudomonas aeruginosa PA01
ggucaggccggcgcga

SEQ ID NO: 1458424 - RNA, 20 nt, Pseudomonas aeruginosa PA01
ggucaggccuugacgcggga

SEQ ID NO: 1458425 - RNA, 15 nt, Pseudomonas aeruginosa PA01
ggucaggcgccagga

SEQ ID NO: 1458426 - RNA, 15 nt, Pseudomonas aeruginosa PA01
ggucaggcgcccggu

SEQ ID NO: 1458427 - RNA, 21 nt, Pseudomonas aeruginosa PA01
ggucaggcugacgucgacgca

SEQ ID NO: 1458428 - RNA, 17 nt, Pseudomonas aeruginosa PA01
ggucaggcugcgcaccu

SEQ ID NO: 1458429 - RNA, 17 nt, Pseudomonas aeruginosa PA01
ggucaggcugcggcgga

SEQ ID NO: 1458430 - RNA, 14 nt, Pseudomonas aeruginosa PA01
ggucaggcuggccc

SEQ ID NO: 1458431 - RNA, 22 nt, Pseudomonas aeruginosa PA01
ggucagggcauauucauagccg

SEQ ID NO: 1458432 - RNA, 14 nt, Pseudomonas aeruginosa PA01
ggucaggccaagcu

SEQ ID NO: 1458433 - RNA, 12 nt, Pseudomonas aeruginosa PA01
ggucaggccgac

SEQ ID NO: 1458434 - RNA, 15 nt, Pseudomonas aeruginosa PA01
ggucaggccgaccag

SEQ ID NO: 1458435 - RNA, 21 nt, Pseudomonas aeruginosa PA01
ggucaggccgaccagcgccga

SEQ ID NO: 1458436 - RNA, 14 nt, Pseudomonas aeruginosa PA01
ggucagcuugccgc

SEQ ID NO: 1458437 - RNA, 15 nt, Pseudomonas aeruginosa PA01
ggucagcuugccgca

SEQ ID NO: 1458438 - RNA, 14 nt, Pseudomonas aeruginosa PA01
ggucaugcccaggc

SEQ ID NO: 1458439 - RNA, 16 nt, Pseudomonas aeruginosa PA01
ggucaugcccaggccg

SEQ ID NO: 1458440 - RNA, 23 nt, Pseudomonas aeruginosa PA01
ggucaugcucgggguuuccucga

SEQ ID NO: 1458441 - RNA, 13 nt, Pseudomonas aeruginosa PA01
ggucauggccagc

SEQ ID NO: 1458442 - RNA, 16 nt, Pseudomonas aeruginosa PA01
ggucauggccagcucg

SEQ ID NO: 1458443 - RNA, 15 nt, Pseudomonas aeruginosa PA01
ggucaucgcgccgcc

SEQ ID NO: 1458444 - RNA, 17 nt, Pseudomonas aeruginosa PA01
ggucaucgcgccgccga

SEQ ID NO: 1458445 - RNA, 16 nt, Pseudomonas aeruginosa PA01
ggucaucggcccgacg

SEQ ID NO: 1458446 - RNA, 16 nt, Pseudomonas aeruginosa PA01
ggucagguacaggcgg

SEQ ID NO: 1458447 - RNA, 23 nt, Pseudomonas aeruginosa PA01
ggucagguauucgccggccaggu

SEQ ID NO: 1458448 - RNA, 14 nt, Pseudomonas aeruginosa PA01
ggucauggcgcaga

SEQ ID NO: 1458449 - RNA, 16 nt, Pseudomonas aeruginosa PA01
ggucauggcgcagacg

SEQ ID NO: 1458450 - RNA, 21 nt, Pseudomonas aeruginosa PA01
ggucauggugccgagcaggau

SEQ ID NO: 1458451 - RNA, 23 nt, Pseudomonas aeruginosa PA01
gguccagccagacguccggcagg

SEQ ID NO: 1458452 - RNA, 17 nt, Pseudomonas aeruginosa PA01
gguccagccagccgccu

SEQ ID NO: 1458453 - RNA, 17 nt, Pseudomonas aeruginosa PA01
gguccagcagguucucg

SEQ ID NO: 1458454 - RNA, 20 nt, Pseudomonas aeruginosa PA01
gguccagcacgcuggcgagg

SEQ ID NO: 1458455 - RNA, 21 nt, Pseudomonas aeruginosa PA01
gguccagcacgcuggcgagga

SEQ ID NO: 1458456 - RNA, 13 nt, Pseudomonas aeruginosa PA01
gguccaggcgacg

SEQ ID NO: 1458457 - RNA, 12 nt, Pseudomonas aeruginosa PA01
gguccaggcgcc

SEQ ID NO: 1458458 - RNA, 16 nt, Pseudomonas aeruginosa PA01
gguccaucccuucgug

SEQ ID NO: 1458459 - RNA, 23 nt, Pseudomonas aeruginosa PA01
gguccaucugcaacgcggcguca

SEQ ID NO: 1458460 - RNA, 19 nt, Pseudomonas aeruginosa PA01
gguccaggcgucggcgccu

SEQ ID NO: 1458461 - RNA, 15 nt, Pseudomonas aeruginosa PA01
gguccagggugaucg

SEQ ID NO: 1458462 - RNA, 23 nt, Pseudomonas aeruginosa PA01
gguccaggucaugcccuggccga

SEQ ID NO: 1458463 - RNA, 23 nt, Pseudomonas aeruginosa PA01
gguccagcucggucagcggcgca

SEQ ID NO: 1458464 - RNA, 19 nt, Pseudomonas aeruginosa PA01
ggucccaucagcaguccgc

SEQ ID NO: 1458465 - RNA, 21 nt, Pseudomonas aeruginosa PA01
ggucgaucagcagcagcgcca

SEQ ID NO: 1458466 - RNA, 13 nt, Pseudomonas aeruginosa PA01
ggucgagacccgc

SEQ ID NO: 1458467 - RNA, 18 nt, Pseudomonas aeruginosa PA01
ggucgaucuccuccucgg

SEQ ID NO: 1458468 - RNA, 13 nt, Pseudomonas aeruginosa PA01
ggucgaucucguc

SEQ ID NO: 1458469 - RNA, 22 nt, Pseudomonas aeruginosa PA01
ggucgaugcccucgcggcggca

SEQ ID NO: 1458470 - RNA, 13 nt, Pseudomonas aeruginosa PA01
ggucgaugaucuu

SEQ ID NO: 1458471 - RNA, 16 nt, Pseudomonas aeruginosa PA01
ggucgaugggcgagcg

SEQ ID NO: 1458472 - RNA, 20 nt, Pseudomonas aeruginosa PA01
ggucgauuccugucuccgca

SEQ ID NO: 1458473 - RNA, 22 nt, Pseudomonas aeruginosa PA01
ggucgauuccugucuccgcacc

SEQ ID NO: 1458474 - RNA, 14 nt, Pseudomonas aeruginosa PA01
ggucgcccucggcc

SEQ ID NO: 1458475 - RNA, 19 nt, Pseudomonas aeruginosa PA01
ggucgcccucggccaggca

SEQ ID NO: 1458476 - RNA, 20 nt, Pseudomonas aeruginosa PA01
ggucgcccucggccaggcau

SEQ ID NO: 1458477 - RNA, 22 nt, Pseudomonas aeruginosa PA01
ggucgcccucggccaggcauuc

SEQ ID NO: 1458478 - RNA, 23 nt, Pseudomonas aeruginosa PA01
ggucgcccugcagcgcgcgcugg

SEQ ID NO: 1458479 - RNA, 14 nt, Pseudomonas aeruginosa PA01
ggucgccauggucg

SEQ ID NO: 1458480 - RNA, 20 nt, Pseudomonas aeruginosa PA01
ggucgccgaaguacucgugu

SEQ ID NO: 1458481 - RNA, 17 nt, Pseudomonas aeruginosa PA01
ggucgccgaacagccgc

SEQ ID NO: 1458482 - RNA, 18 nt, Pseudomonas aeruginosa PA01
ggucgccgaacagccgcc

SEQ ID NO: 1458483 - RNA, 11 nt, Pseudomonas aeruginosa PA01
ggucgccgaca

SEQ ID NO: 1458484 - RNA, 22 nt, Pseudomonas aeruginosa PA01
ggucgccgccggcgaacagcca

SEQ ID NO: 1458485 - RNA, 12 nt, Pseudomonas aeruginosa PA01
ggucgccgcaca

SEQ ID NO: 1458486 - RNA, 14 nt, Pseudomonas aeruginosa PA01
ggucgccgccagca

SEQ ID NO: 1458487 - RNA, 19 nt, Pseudomonas aeruginosa PA01
ggucgccgccagcauggcg

SEQ ID NO: 1458488 - RNA, 13 nt, Pseudomonas aeruginosa PA01
ggucgccgcgacc

SEQ ID NO: 1458489 - RNA, 14 nt, Pseudomonas aeruginosa PA01
ggucgccgcgaccu

SEQ ID NO: 1458490 - RNA, 15 nt, Pseudomonas aeruginosa PA01
ggucgcgcaggcggu

SEQ ID NO: 1458491 - RNA, 16 nt, Pseudomonas aeruginosa PA01
ggucgcgcagggccag

SEQ ID NO: 1458492 - RNA, 22 nt, Pseudomonas aeruginosa PA01
ggucgcgcagggccagggcggc

SEQ ID NO: 1458493 - RNA, 15 nt, Pseudomonas aeruginosa PA01
ggucgcgcagcggcu

SEQ ID NO: 1458494 - RNA, 14 nt, Pseudomonas aeruginosa PA01
ggucgcgccggugg

SEQ ID NO: 1458495 - RNA, 16 nt, Pseudomonas aeruginosa PA01
ggucgcgccgguggcg

SEQ ID NO: 1458496 - RNA, 20 nt, Pseudomonas aeruginosa PA01
ggucgcgccguccaucaggc

SEQ ID NO: 1458497 - RNA, 15 nt, Pseudomonas aeruginosa PA01
ggucgcgcgcggcca

SEQ ID NO: 1458498 - RNA, 20 nt, Pseudomonas aeruginosa PA01
ggucgcgcgcggccagcucg

SEQ ID NO: 1458499 - RNA, 13 nt, Pseudomonas aeruginosa PA01
ggucgcgccccgc

SEQ ID NO: 1458500 - RNA, 20 nt, Pseudomonas aeruginosa PA01
ggucgaccuugccgacgccg

SEQ ID NO: 1458501 - RNA, 18 nt, Pseudomonas aeruginosa PA01
ggucgacgcagggcggcg

SEQ ID NO: 1458502 - RNA, 20 nt, Pseudomonas aeruginosa PA01
ggucgacgcagggcggcgcc

SEQ ID NO: 1458503 - RNA, 18 nt, Pseudomonas aeruginosa PA01
ggucgacgccauggcgcu

SEQ ID NO: 1458504 - RNA, 21 nt, Pseudomonas aeruginosa PA01
ggucgacgccauggcgcuuca

SEQ ID NO: 1458505 - RNA, 19 nt, Pseudomonas aeruginosa PA01
ggucgagaaggcugccggg

SEQ ID NO: 1458506 - RNA, 21 nt, Pseudomonas aeruginosa PA01
ggucgagaaggcugccgggcu

SEQ ID NO: 1458507 - RNA, 16 nt, Pseudomonas aeruginosa PA01
ggucgacuucgcacca

SEQ ID NO: 1458508 - RNA, 20 nt, Pseudomonas aeruginosa PA01
ggucgacuucgcaccagccg

SEQ ID NO: 1458509 - RNA, 17 nt, Pseudomonas aeruginosa PA01
ggucgacugcuggguac

SEQ ID NO: 1458510 - RNA, 14 nt, Pseudomonas aeruginosa PA01
ggucgacgccgccg

SEQ ID NO: 1458511 - RNA, 13 nt, Pseudomonas aeruginosa PA01
ggucgacggcggc

SEQ ID NO: 1458512 - RNA, 17 nt, Pseudomonas aeruginosa PA01
ggucgacggcggccgcc

SEQ ID NO: 1458513 - RNA, 19 nt, Pseudomonas aeruginosa PA01
ggucgacggcggccgccau

SEQ ID NO: 1458514 - RNA, 16 nt, Pseudomonas aeruginosa PA01
ggucgacguaggcggc

SEQ ID NO: 1458515 - RNA, 17 nt, Pseudomonas aeruginosa PA01
ggucgacguaggcggcg

SEQ ID NO: 1458516 - RNA, 18 nt, Pseudomonas aeruginosa PA01
ggucgacguaggcggcga

SEQ ID NO: 1458517 - RNA, 21 nt, Pseudomonas aeruginosa PA01
gguccggguuggcgcaggccg

SEQ ID NO: 1458518 - RNA, 22 nt, Pseudomonas aeruginosa PA01
gguccggguuggcgcaggccgg

SEQ ID NO: 1458519 - RNA, 14 nt, Pseudomonas aeruginosa PA01
ggucgaccagccag

SEQ ID NO: 1458520 - RNA, 23 nt, Pseudomonas aeruginosa PA01
ggucgacaucgauaacaccagga

SEQ ID NO: 1458521 - RNA, 22 nt, Pseudomonas aeruginosa PA01
ggucgacaugcaccaggccgcc

SEQ ID NO: 1458522 - RNA, 22 nt, Pseudomonas aeruginosa PA01
ggucgacauagcgcagcaccgg

SEQ ID NO: 1458523 - RNA, 18 nt, Pseudomonas aeruginosa PA01
gguccggcugucgacgca

SEQ ID NO: 1458524 - RNA, 17 nt, Pseudomonas aeruginosa PA01
gguccggagggcccggg

SEQ ID NO: 1458525 - RNA, 22 nt, Pseudomonas aeruginosa PA01
gguccgcuucagcgcgccgagc

SEQ ID NO: 1458526 - RNA, 19 nt, Pseudomonas aeruginosa PA01
ggcgagcauuccucagcgc

SEQ ID NO: 1458527 - RNA, 22 nt, Pseudomonas aeruginosa PA01
ggcgagcauuccucagcgccgg

SEQ ID NO: 1458528 - RNA, 13 nt, Pseudomonas aeruginosa PA01
ggcgagcaggguc

SEQ ID NO: 1458529 - RNA, 19 nt, Pseudomonas aeruginosa PA01
ggcgagcagguagaccgcc

SEQ ID NO: 1458530 - RNA, 17 nt, Pseudomonas aeruginosa PA01
ggcgagcaucucggcca

SEQ ID NO: 1458531 - RNA, 23 nt, Pseudomonas aeruginosa PA01
ggcgagcaucucggccaggcccu

SEQ ID NO: 1458532 - RNA, 23 nt, Pseudomonas aeruginosa PA01
ggcgagcaggcgaacagggccau

SEQ ID NO: 1458533 - RNA, 15 nt, Pseudomonas aeruginosa PA01
ggcgagcagggcgcu

SEQ ID NO: 1458534 - RNA, 20 nt, Pseudomonas aeruginosa PA01
ggcgagcagggcgcugagcg

SEQ ID NO: 1458535 - RNA, 15 nt, Pseudomonas aeruginosa PA01
ggcgagcagcggcac

SEQ ID NO: 1458536 - RNA, 22 nt, Pseudomonas aeruginosa PA01
ggcgagcagcggcacgcucugg

SEQ ID NO: 1458537 - RNA, 14 nt, Pseudomonas aeruginosa PA01
ggcgagcagcggcg

SEQ ID NO: 1458538 - RNA, 16 nt, Pseudomonas aeruginosa PA01
ggcgagcagcggcgcu

SEQ ID NO: 1458539 - RNA, 14 nt, Pseudomonas aeruginosa PA01
ggcgagagcguccg

SEQ ID NO: 1458540 - RNA, 17 nt, Pseudomonas aeruginosa PA01
ggcgagagcguccggca

SEQ ID NO: 1458541 - RNA, 23 nt, Pseudomonas aeruginosa PA01
ggcgagagcguccggcagggccu

SEQ ID NO: 1458542 - RNA, 12 nt, Pseudomonas aeruginosa PA01
ggcgagaggucg

SEQ ID NO: 1458543 - RNA, 15 nt, Pseudomonas aeruginosa PA01
ggcgagaggucggcg

SEQ ID NO: 1458544 - RNA, 21 nt, Pseudomonas aeruginosa PA01
ggcgagaggucggcgcgcccg

SEQ ID NO: 1458545 - RNA, 22 nt, Pseudomonas aeruginosa PA01
ggcgagaggucggcgcgcccgg

SEQ ID NO: 1458546 - RNA, 13 nt, Pseudomonas aeruginosa PA01
ggcgagagcgccg

SEQ ID NO: 1458547 - RNA, 14 nt, Pseudomonas aeruginosa PA01
ggcgagagcgccga

SEQ ID NO: 1458548 - RNA, 17 nt, Pseudomonas aeruginosa PA01
ggcgagcacggcgaaca

SEQ ID NO: 1458549 - RNA, 18 nt, Pseudomonas aeruginosa PA01
ggcgagcacggcgaacac

SEQ ID NO: 1458550 - RNA, 22 nt, Pseudomonas aeruginosa PA01
ggcgagcaaugaaaaaggcgau

SEQ ID NO: 1458551 - RNA, 20 nt, Pseudomonas aeruginosa PA01
ggcgacguucugcucgcugc

SEQ ID NO: 1458552 - RNA, 17 nt, Pseudomonas aeruginosa PA01
ggcgacgugggccugcu

SEQ ID NO: 1458553 - RNA, 19 nt, Pseudomonas aeruginosa PA01
ggcgacgugggccugcucc

SEQ ID NO: 1458554 - RNA, 23 nt, Pseudomonas aeruginosa PA01
ggcgacgugggccugcuccucgg

SEQ ID NO: 1458555 - RNA, 23 nt, Pseudomonas aeruginosa PA01
ggcgacuaccagguucugccaga

SEQ ID NO: 1458556 - RNA, 20 nt, Pseudomonas aeruginosa PA01
ggcgacuucgcauuccaccu

SEQ ID NO: 1458557 - RNA, 19 nt, Pseudomonas aeruginosa PA01
ggcgagaacucguccgguc

SEQ ID NO: 1458558 - RNA, 20 nt, Pseudomonas aeruginosa PA01
ggcgagaccggggaucagcu

SEQ ID NO: 1458559 - RNA, 21 nt, Pseudomonas aeruginosa PA01
ggcgagaaagucgaucagcgc

SEQ ID NO: 1458560 - RNA, 19 nt, Pseudomonas aeruginosa PA01
ggcgagaaucgccgaggcg

SEQ ID NO: 1458561 - RNA, 12 nt, Pseudomonas aeruginosa PA01
ggcgacgacggg

SEQ ID NO: 1458562 - RNA, 11 nt, Pseudomonas aeruginosa PA01
ggcgacgagga

SEQ ID NO: 1458563 - RNA, 16 nt, Pseudomonas aeruginosa PA01
ggcgacgaugccgccg

SEQ ID NO: 1458564 - RNA, 16 nt, Pseudomonas aeruginosa PA01
ggcgacgaugcgcccc

SEQ ID NO: 1458565 - RNA, 22 nt, Pseudomonas aeruginosa PA01
ggcgacgaugcgccccagcgcc

SEQ ID NO: 1458566 - RNA, 20 nt, Pseudomonas aeruginosa PA01
ggcgacgaaggucggcggca

SEQ ID NO: 1458567 - RNA, 19 nt, Pseudomonas aeruginosa PA01
ggcgacgaucacccccagc

SEQ ID NO: 1458568 - RNA, 14 nt, Pseudomonas aeruginosa PA01
ggcgacgaucagcc

SEQ ID NO: 1458569 - RNA, 17 nt, Pseudomonas aeruginosa PA01
ggcgacgaucagcccgc

SEQ ID NO: 1458570 - RNA, 17 nt, Pseudomonas aeruginosa PA01
ggcgacgauguucucca

SEQ ID NO: 1458571 - RNA, 17 nt, Pseudomonas aeruginosa PA01
ggcgacgcagcacggcg

SEQ ID NO: 1458572 - RNA, 17 nt, Pseudomonas aeruginosa PA01
ggcgacgcaggacgucg

SEQ ID NO: 1458573 - RNA, 14 nt, Pseudomonas aeruginosa PA01
ggcgacgccgcgcu

SEQ ID NO: 1458574 - RNA, 14 nt, Pseudomonas aeruginosa PA01
ggcgacgcauggau

SEQ ID NO: 1458575 - RNA, 16 nt, Pseudomonas aeruginosa PA01
ggcgacgccacccgca

SEQ ID NO: 1458576 - RNA, 12 nt, Pseudomonas aeruginosa PA01
ggcgacgcccga

SEQ ID NO: 1458577 - RNA, 16 nt, Pseudomonas aeruginosa PA01
ggcgacgcccgaggcg

SEQ ID NO: 1458578 - RNA, 12 nt, Pseudomonas aeruginosa PA01
ggcgacgcccug

SEQ ID NO: 1458579 - RNA, 17 nt, Pseudomonas aeruginosa PA01
ggcgacgcccuguucgg

SEQ ID NO: 1458580 - RNA, 13 nt, Pseudomonas aeruginosa PA01
ggcgacgcgcagg

SEQ ID NO: 1458581 - RNA, 13 nt, Pseudomonas aeruginosa PA01
ggcgacgccgguc

SEQ ID NO: 1458582 - RNA, 19 nt, Pseudomonas aeruginosa PA01
ggcgacgccggucgggcac

SEQ ID NO: 1458583 - RNA, 14 nt, Pseudomonas aeruginosa PA01
ggcgacgccguccc

SEQ ID NO: 1458584 - RNA, 15 nt, Pseudomonas aeruginosa PA01
ggcgacgccguccca

SEQ ID NO: 1458585 - RNA, 22 nt, Pseudomonas aeruginosa PA01
ggcgacggaaacgacaggcugg

SEQ ID NO: 1458586 - RNA, 23 nt, Pseudomonas aeruginosa PA01
ggcgacgcugaugaugccgcggc

SEQ ID NO: 1458587 - RNA, 17 nt, Pseudomonas aeruginosa PA01
ggcgacggcggugcgca

SEQ ID NO: 1458588 - RNA, 14 nt, Pseudomonas aeruginosa PA01
ggcgacgucgcccc

SEQ ID NO: 1458589 - RNA, 21 nt, Pseudomonas aeruginosa PA01
ggcgacgucgccccagccuug

SEQ ID NO: 1458590 - RNA, 16 nt, Pseudomonas aeruginosa PA01
ggcgacggugccgguc

SEQ ID NO: 1458591 - RNA, 20 nt, Pseudomonas aeruginosa PA01
ggcgacggucaggccgagca

SEQ ID NO: 1458592 - RNA, 17 nt, Pseudomonas aeruginosa PA01
ggcgacccaggccgaca

SEQ ID NO: 1458593 - RNA, 17 nt, Pseudomonas aeruginosa PA01
ggcgacccgaaggucgc

SEQ ID NO: 1458594 - RNA, 18 nt, Pseudomonas aeruginosa PA01
ggcgaccaggacagcacg

SEQ ID NO: 1458595 - RNA, 16 nt, Pseudomonas aeruginosa PA01
ggcgaccauccagccu

SEQ ID NO: 1458596 - RNA, 22 nt, Pseudomonas aeruginosa PA01
ggcgacccagaccugccgcccg

SEQ ID NO: 1458597 - RNA, 14 nt, Pseudomonas aeruginosa PA01
ggcgacccagcgcu

SEQ ID NO: 1458598 - RNA, 15 nt, Pseudomonas aeruginosa PA01
ggcgaccagcccgcg

SEQ ID NO: 1458599 - RNA, 13 nt, Pseudomonas aeruginosa PA01
ggcgaccagccgg

SEQ ID NO: 1458600 - RNA, 12 nt, Pseudomonas aeruginosa PA01
ggcgaccagcgc

SEQ ID NO: 1458601 - RNA, 13 nt, Pseudomonas aeruginosa PA01
ggcgaccagcgcg

SEQ ID NO: 1458602 - RNA, 16 nt, Pseudomonas aeruginosa PA01
ggcgaccagcgcgguc

SEQ ID NO: 1458603 - RNA, 22 nt, Pseudomonas aeruginosa PA01
ggcgaccagcgcggucucuucg

SEQ ID NO: 1458604 - RNA, 12 nt, Pseudomonas aeruginosa PA01
ggcgaccagcgu

SEQ ID NO: 1458605 - RNA, 14 nt, Pseudomonas aeruginosa PA01
ggcgaccagcgucg

SEQ ID NO: 1458606 - RNA, 15 nt, Pseudomonas aeruginosa PA01
ggcgaccagcgucgc

SEQ ID NO: 1458607 - RNA, 23 nt, Pseudomonas aeruginosa PA01
ggcgaccagcucgaagccgccgu

SEQ ID NO: 1458608 - RNA, 17 nt, Pseudomonas aeruginosa PA01
ggcgacccgccguucgc

SEQ ID NO: 1458609 - RNA, 21 nt, Pseudomonas aeruginosa PA01
ggcgacccgccguucgcccgc

SEQ ID NO: 1458610 - RNA, 22 nt, Pseudomonas aeruginosa PA01
ggcgacccgccguucgcccgcc

SEQ ID NO: 1458611 - RNA, 13 nt, Pseudomonas aeruginosa PA01
ggcgaccgccagg

SEQ ID NO: 1458612 - RNA, 15 nt, Pseudomonas aeruginosa PA01
ggcgaccgccaggcg

SEQ ID NO: 1458613 - RNA, 15 nt, Pseudomonas aeruginosa PA01
ggcgaccgaacagcg

SEQ ID NO: 1458614 - RNA, 16 nt, Pseudomonas aeruginosa PA01
ggcgaccgaacagcgc

SEQ ID NO: 1458615 - RNA, 19 nt, Pseudomonas aeruginosa PA01
ggcgaccgaacagcgcgcc

SEQ ID NO: 1458616 - RNA, 20 nt, Pseudomonas aeruginosa PA01
ggcgaccgaacagcgcgcca

SEQ ID NO: 1458617 - RNA, 12 nt, Pseudomonas aeruginosa PA01
ggcgaccgcugg

SEQ ID NO: 1458618 - RNA, 14 nt, Pseudomonas aeruginosa PA01
ggcgaccgcuggac

SEQ ID NO: 1458619 - RNA, 16 nt, Pseudomonas aeruginosa PA01
ggcgaccgcuggacca

SEQ ID NO: 1458620 - RNA, 14 nt, Pseudomonas aeruginosa PA01
ggcgaccugcggca

SEQ ID NO: 1458621 - RNA, 18 nt, Pseudomonas aeruginosa PA01
ggcgaccucagucgugca

SEQ ID NO: 1458622 - RNA, 22 nt, Pseudomonas aeruginosa PA01
ggcgaccucagucgugcaggug

SEQ ID NO: 1458623 - RNA, 13 nt, Pseudomonas aeruginosa PA01
ggcgaccugcucg

SEQ ID NO: 1458624 - RNA, 14 nt, Pseudomonas aeruginosa PA01
ggcgaccugcucga

SEQ ID NO: 1458625 - RNA, 17 nt, Pseudomonas aeruginosa PA01
ggcgaccugcucgcgca

SEQ ID NO: 1458626 - RNA, 19 nt, Pseudomonas aeruginosa PA01
ggcgaccugcucgcgcacc

SEQ ID NO: 1458627 - RNA, 21 nt, Pseudomonas aeruginosa PA01
ggcgaccugcucgcgcaccgc

SEQ ID NO: 1458628 - RNA, 11 nt, Pseudomonas aeruginosa PA01
ggcgaccugcu

SEQ ID NO: 1458629 - RNA, 20 nt, Pseudomonas aeruginosa PA01
ggcgacgaagacgcugcgca

SEQ ID NO: 1458630 - RNA, 17 nt, Pseudomonas aeruginosa PA01
ggcgacgaagcccaggc

SEQ ID NO: 1458631 - RNA, 16 nt, Pseudomonas aeruginosa PA01
ggcgacgaaggccugg

SEQ ID NO: 1458632 - RNA, 20 nt, Pseudomonas aeruginosa PA01
ggcgacgaaggccuggucga

SEQ ID NO: 1458633 - RNA, 20 nt, Pseudomonas aeruginosa PA01
ggcgaccuuguccaggcgcu

SEQ ID NO: 1458634 - RNA, 23 nt, Pseudomonas aeruginosa PA01
ggcgaccuuguccaggcgcugcu

SEQ ID NO: 1458635 - RNA, 14 nt, Pseudomonas aeruginosa PA01
ggcgaccuugucga

SEQ ID NO: 1458636 - RNA, 22 nt, Pseudomonas aeruginosa PA01
ggcgaccuugacgaagccggcg

SEQ ID NO: 1458637 - RNA, 23 nt, Pseudomonas aeruginosa PA01
ggcgaccuugacgaagccggcga

SEQ ID NO: 1458638 - RNA, 24 nt, Pseudomonas aeruginosa PA01
ggcgaccuugacgaagccggcgau

SEQ ID NO: 1458639 - RNA, 19 nt, Pseudomonas aeruginosa PA01
ggcgaccuugcgcaccagg

SEQ ID NO: 1458640 - RNA, 14 nt, Pseudomonas aeruginosa PA01
ggcgaccuguucga

SEQ ID NO: 1458641 - RNA, 18 nt, Pseudomonas aeruginosa PA01
ggcgacagcuuccagugc

SEQ ID NO: 1458642 - RNA, 17 nt, Pseudomonas aeruginosa PA01
ggcgacaggcgaucgac

SEQ ID NO: 1458643 - RNA, 16 nt, Pseudomonas aeruginosa PA01
ggcgacauagccggcg

SEQ ID NO: 1458644 - RNA, 16 nt, Pseudomonas aeruginosa PA01
ggcgacauagcggcug

SEQ ID NO: 1458645 - RNA, 16 nt, Pseudomonas aeruginosa PA01
ggcgaccaacagggcg

SEQ ID NO: 1458646 - RNA, 23 nt, Pseudomonas aeruginosa PA01
ggcgaccaccgcgaauccgcggc

SEQ ID NO: 1458647 - RNA, 14 nt, Pseudomonas aeruginosa PA01
ggcgaccacccggc

SEQ ID NO: 1458648 - RNA, 16 nt, Pseudomonas aeruginosa PA01
ggcgaccacccggcgg

SEQ ID NO: 1458649 - RNA, 17 nt, Pseudomonas aeruginosa PA01
ggcgaccacccggcggu

SEQ ID NO: 1458650 - RNA, 21 nt, Pseudomonas aeruginosa PA01
ggcgaccacccggcgguccgc

SEQ ID NO: 1458651 - RNA, 20 nt, Pseudomonas aeruginosa PA01
ggcgaccaccacgucgaugc

SEQ ID NO: 1458652 - RNA, 12 nt, Pseudomonas aeruginosa PA01
ggcgaacagcac

SEQ ID NO: 1458653 - RNA, 13 nt, Pseudomonas aeruginosa PA01
ggcgaacagcacc

SEQ ID NO: 1458654 - RNA, 14 nt, Pseudomonas aeruginosa PA01
ggcgaacagcaccu

SEQ ID NO: 1458655 - RNA, 19 nt, Pseudomonas aeruginosa PA01
ggcgaacagcaccuuggcc

SEQ ID NO: 1458656 - RNA, 22 nt, Pseudomonas aeruginosa PA01
ggcgaacagcaccuuggccaug

SEQ ID NO: 1458657 - RNA, 23 nt, Pseudomonas aeruginosa PA01
ggcgaaauggguucccagcagca

SEQ ID NO: 1458658 - RNA, 18 nt, Pseudomonas aeruginosa PA01
ggcgaacaccgggccgcc

SEQ ID NO: 1458659 - RNA, 17 nt, Pseudomonas aeruginosa PA01
ggcgaacaacgccgccg

SEQ ID NO: 1458660 - RNA, 17 nt, Pseudomonas aeruginosa PA01
ggcgaaaugcaggccgg

SEQ ID NO: 1458661 - RNA, 17 nt, Pseudomonas aeruginosa PA01
ggcgaaauccucgcgca

SEQ ID NO: 1458662 - RNA, 22 nt, Pseudomonas aeruginosa PA01
ggcgaaauccucgcgcaccgcc

SEQ ID NO: 1458663 - RNA, 23 nt, Pseudomonas aeruginosa PA01
ggcgaaauccucgcgcaccgccu

SEQ ID NO: 1458664 - RNA, 14 nt, Pseudomonas aeruginosa PA01
ggccuuggccaugc

SEQ ID NO: 1458665 - RNA, 16 nt, Pseudomonas aeruginosa PA01
ggccuuggccaugccc

SEQ ID NO: 1458666 - RNA, 14 nt, Pseudomonas aeruginosa PA01
ggccuuggcccggu

SEQ ID NO: 1458667 - RNA, 22 nt, Pseudomonas aeruginosa PA01
ggcgacagcaccacgccgcugg

SEQ ID NO: 1458668 - RNA, 16 nt, Pseudomonas aeruginosa PA01
ggcgacagccgggcag

SEQ ID NO: 1458669 - RNA, 12 nt, Pseudomonas aeruginosa PA01
ggcgacaccgcc

SEQ ID NO: 1458670 - RNA, 14 nt, Pseudomonas aeruginosa PA01
ggcgacaccgccag

SEQ ID NO: 1458671 - RNA, 19 nt, Pseudomonas aeruginosa PA01
ggcgacaccgccagcaccu

SEQ ID NO: 1458672 - RNA, 14 nt, Pseudomonas aeruginosa PA01
ggcgaacagccagc

SEQ ID NO: 1458673 - RNA, 15 nt, Pseudomonas aeruginosa PA01
ggcgaacagccagcg

SEQ ID NO: 1458674 - RNA, 17 nt, Pseudomonas aeruginosa PA01
ggcgaacagccagcggu

SEQ ID NO: 1458675 - RNA, 14 nt, Pseudomonas aeruginosa PA01
ggcgaacagcgccg

SEQ ID NO: 1458676 - RNA, 15 nt, Pseudomonas aeruginosa PA01
ggcgaacagcgccgc

SEQ ID NO: 1458677 - RNA, 16 nt, Pseudomonas aeruginosa PA01
ggcgaacagcgccgcg

SEQ ID NO: 1458678 - RNA, 17 nt, Pseudomonas aeruginosa PA01
ggcgaacagcgccgcgg

SEQ ID NO: 1458679 - RNA, 22 nt, Pseudomonas aeruginosa PA01
ggcgaacagcgccgcggcuggc

SEQ ID NO: 1458680 - RNA, 17 nt, Pseudomonas aeruginosa PA01
ggcgaacagcgcuuccu

SEQ ID NO: 1458681 - RNA, 22 nt, Pseudomonas aeruginosa PA01
ggcgaacagggccaucagggcg

SEQ ID NO: 1458682 - RNA, 14 nt, Pseudomonas aeruginosa PA01
ggcgaacagcagcg

SEQ ID NO: 1458683 - RNA, 15 nt, Pseudomonas aeruginosa PA01
ggcgaacaggcagcg

SEQ ID NO: 1458684 - RNA, 17 nt, Pseudomonas aeruginosa PA01
ggcgaacaggcagcggg

SEQ ID NO: 1458685 - RNA, 22 nt, Pseudomonas aeruginosa PA01
ggcgaacaggcagcgggccagg

SEQ ID NO: 1458686 - RNA, 16 nt, Pseudomonas aeruginosa PA01
ggcgagcuggaucggc

SEQ ID NO: 1458687 - RNA, 21 nt, Pseudomonas aeruginosa PA01
ggcgagcugccccucguggcg

SEQ ID NO: 1458688 - RNA, 22 nt, Pseudomonas aeruginosa PA01
ggcgagcguucggaucggcccg

SEQ ID NO: 1458689 - RNA, 12 nt, Pseudomonas aeruginosa PA01
ggcgagcgucga

SEQ ID NO: 1458690 - RNA, 20 nt, Pseudomonas aeruginosa PA01
ggcgagcgucgagucgcgca

SEQ ID NO: 1458691 - RNA, 17 nt, Pseudomonas aeruginosa PA01
ggcgagccgcagcggcu

SEQ ID NO: 1458692 - RNA, 19 nt, Pseudomonas aeruginosa PA01
ggcgagccgcagcggcucg

SEQ ID NO: 1458693 - RNA, 23 nt, Pseudomonas aeruginosa PA01
ggcgagccagguuuccggcagca

SEQ ID NO: 1458694 - RNA, 13 nt, Pseudomonas aeruginosa PA01
ggcgagccgcugg

SEQ ID NO: 1458695 - RNA, 19 nt, Pseudomonas aeruginosa PA01
ggcgagccgccgggcggcg

SEQ ID NO: 1458696 - RNA, 17 nt, Pseudomonas aeruginosa PA01
ggcgagccgcgacggcu

SEQ ID NO: 1458697 - RNA, 21 nt, Pseudomonas aeruginosa PA01
ggcgagccggcgcaucagcgc

SEQ ID NO: 1458698 - RNA, 23 nt, Pseudomonas aeruginosa PA01
ggcgagccggcgcaucagcgccg

SEQ ID NO: 1458699 - RNA, 24 nt, Pseudomonas aeruginosa PA01
ggcgagccggcgcaucagcgccgg

SEQ ID NO: 1458700 - RNA, 12 nt, Pseudomonas aeruginosa PA01
ggcgagcgcgau

SEQ ID NO: 1458701 - RNA, 13 nt, Pseudomonas aeruginosa PA01
ggcgagcgcgauc

SEQ ID NO: 1458702 - RNA, 13 nt, Pseudomonas aeruginosa PA01
ggcgagcgccugg

SEQ ID NO: 1458703 - RNA, 15 nt, Pseudomonas aeruginosa PA01
ggcgagcgccgcggc

SEQ ID NO: 1458704 - RNA, 16 nt, Pseudomonas aeruginosa PA01
ggcgagcgccgcggcg

SEQ ID NO: 1458705 - RNA, 13 nt, Pseudomonas aeruginosa PA01
ggcgagggcgcgc

SEQ ID NO: 1458706 - RNA, 13 nt, Pseudomonas aeruginosa PA01
ggcgagggcggcg

SEQ ID NO: 1458707 - RNA, 15 nt, Pseudomonas aeruginosa PA01
ggcgagggcggcgac

SEQ ID NO: 1458708 - RNA, 18 nt, Pseudomonas aeruginosa PA01
ggcgagggcggcgaccug

SEQ ID NO: 1458709 - RNA, 19 nt, Pseudomonas aeruginosa PA01
ggcgagggcggcgaccugg

SEQ ID NO: 1458710 - RNA, 17 nt, Pseudomonas aeruginosa PA01
ggcgagggcggcgcggg

SEQ ID NO: 1458711 - RNA, 12 nt, Pseudomonas aeruginosa PA01
ggcgaggcgcgc

SEQ ID NO: 1458712 - RNA, 15 nt, Pseudomonas aeruginosa PA01
ggcgaggcgcgccug

SEQ ID NO: 1458713 - RNA, 16 nt, Pseudomonas aeruginosa PA01
ggcgaggcgcgccugg

SEQ ID NO: 1458714 - RNA, 15 nt, Pseudomonas aeruginosa PA01
ggcgaggcgcucgac

SEQ ID NO: 1458715 - RNA, 22 nt, Pseudomonas aeruginosa PA01
ggcgagggugaacuggccgucg

SEQ ID NO: 1458716 - RNA, 12 nt, Pseudomonas aeruginosa PA01
ggcgaggguggc

SEQ ID NO: 1458717 - RNA, 14 nt, Pseudomonas aeruginosa PA01
ggcgaggucgccgg

SEQ ID NO: 1458718 - RNA, 14 nt, Pseudomonas aeruginosa PA01
ggcgaggucgcgga

SEQ ID NO: 1458719 - RNA, 20 nt, Pseudomonas aeruginosa PA01
ggcgagguguucccggauca

SEQ ID NO: 1458720 - RNA, 22 nt, Pseudomonas aeruginosa PA01
ggcgagguguucccggaucagc

SEQ ID NO: 1458721 - RNA, 13 nt, Pseudomonas aeruginosa PA01
ggcgaggccgacc

SEQ ID NO: 1458722 - RNA, 14 nt, Pseudomonas aeruginosa PA01
ggcgaggccgcucu

SEQ ID NO: 1458723 - RNA, 12 nt, Pseudomonas aeruginosa PA01
ggcgaggccggc

SEQ ID NO: 1458724 - RNA, 19 nt, Pseudomonas aeruginosa PA01
ggcgaggauuuccggcuug

SEQ ID NO: 1458725 - RNA, 16 nt, Pseudomonas aeruginosa PA01
ggcgaggauuuccucg

SEQ ID NO: 1458726 - RNA, 23 nt, Pseudomonas aeruginosa PA01
ggcgaggagguuggucugcucgg

SEQ ID NO: 1458727 - RNA, 18 nt, Pseudomonas aeruginosa PA01
ggcgaggaucacgcagca

SEQ ID NO: 1458728 - RNA, 20 nt, Pseudomonas aeruginosa PA01
ggcgaggaucacgcagcagg

SEQ ID NO: 1458729 - RNA, 14 nt, Pseudomonas aeruginosa PA01
ggcgaggaucgcca

SEQ ID NO: 1458730 - RNA, 15 nt, Pseudomonas aeruginosa PA01
ggcgaggaucgccag

SEQ ID NO: 1458731 - RNA, 14 nt, Pseudomonas aeruginosa PA01
ggcgaggaucgcgc

SEQ ID NO: 1458732 - RNA, 20 nt, Pseudomonas aeruginosa PA01
ggcgaggaucgcgcuggcca

SEQ ID NO: 1458733 - RNA, 21 nt, Pseudomonas aeruginosa PA01
ggcgaggaucgcucccaggcu

SEQ ID NO: 1458734 - RNA, 19 nt, Pseudomonas aeruginosa PA01
ggcgaggaaaaggaucgcc

SEQ ID NO: 1458735 - RNA, 22 nt, Pseudomonas aeruginosa PA01
ggcgaggaaaaggaucgccgcg

SEQ ID NO: 1458736 - RNA, 20 nt, Pseudomonas aeruginosa PA01
ggcgaggaacagcaccagca

SEQ ID NO: 1458737 - RNA, 15 nt, Pseudomonas aeruginosa PA01
ggcgaggaacagcga

SEQ ID NO: 1458738 - RNA, 14 nt, Pseudomonas aeruginosa PA01
ggcgaggacgccgg

SEQ ID NO: 1458739 - RNA, 18 nt, Pseudomonas aeruginosa PA01
ggcgaucaccagggugcg

SEQ ID NO: 1458740 - RNA, 19 nt, Pseudomonas aeruginosa PA01
ggcgaucaccagggugcgc

SEQ ID NO: 1458741 - RNA, 20 nt, Pseudomonas aeruginosa PA01
ggcgaucaccagggugcgcu

SEQ ID NO: 1458742 - RNA, 22 nt, Pseudomonas aeruginosa PA01
ggcgaucaccagggugcgcucg

SEQ ID NO: 1458743 - RNA, 15 nt, Pseudomonas aeruginosa PA01
ggcgauauggccgau

SEQ ID NO: 1458744 - RNA, 17 nt, Pseudomonas aeruginosa PA01
ggcgauaucccgccgcc

SEQ ID NO: 1458745 - RNA, 19 nt, Pseudomonas aeruginosa PA01
ggcgauaucccgccgccgc

SEQ ID NO: 1458746 - RNA, 12 nt, Pseudomonas aeruginosa PA01
ggcgaucacccg

SEQ ID NO: 1458747 - RNA, 17 nt, Pseudomonas aeruginosa PA01
ggcgaucacgccgcgca

SEQ ID NO: 1458748 - RNA, 17 nt, Pseudomonas aeruginosa PA01
ggcgaucacggcgcccc

SEQ ID NO: 1458749 - RNA, 17 nt, Pseudomonas aeruginosa PA01
ggcgaucagaacgaugc

SEQ ID NO: 1458750 - RNA, 12 nt, Pseudomonas aeruginosa PA01
ggcgaucagcgg

SEQ ID NO: 1458751 - RNA, 16 nt, Pseudomonas aeruginosa PA01
ggcgaucagcgggcgg

SEQ ID NO: 1458752 - RNA, 23 nt, Pseudomonas aeruginosa PA01
ggcgaucagcgggcgguagaucu

SEQ ID NO: 1458753 - RNA, 15 nt, Pseudomonas aeruginosa PA01
ggcgaucauccagcc

SEQ ID NO: 1458754 - RNA, 15 nt, Pseudomonas aeruginosa PA01
ggcgaucaggcagcg

SEQ ID NO: 1458755 - RNA, 16 nt, Pseudomonas aeruginosa PA01
ggcgaucaggcagcgc

SEQ ID NO: 1458756 - RNA, 20 nt, Pseudomonas aeruginosa PA01
ggcgaucaggcagcgcgcgg

SEQ ID NO: 1458757 - RNA, 23 nt, Pseudomonas aeruginosa PA01
ggcgaucaggcagcgcgcggcca

SEQ ID NO: 1458758 - RNA, 13 nt, Pseudomonas aeruginosa PA01
ggcgaucaggcca

SEQ ID NO: 1458759 - RNA, 15 nt, Pseudomonas aeruginosa PA01
ggcgaucaggccaag

SEQ ID NO: 1458760 - RNA, 17 nt, Pseudomonas aeruginosa PA01
ggcgaucaggccaagcu

SEQ ID NO: 1458761 - RNA, 16 nt, Pseudomonas aeruginosa PA01
ggcgaucaggccgaug

SEQ ID NO: 1458762 - RNA, 17 nt, Pseudomonas aeruginosa PA01
ggcgaucaggccgaugc

SEQ ID NO: 1458763 - RNA, 17 nt, Pseudomonas aeruginosa PA01
ggcgaguucggcgagca

SEQ ID NO: 1458764 - RNA, 22 nt, Pseudomonas aeruginosa PA01
ggcgaguaaccaccgcucucga

SEQ ID NO: 1458765 - RNA, 23 nt, Pseudomonas aeruginosa PA01
ggcgagucgaucaggucgccgcc

SEQ ID NO: 1458766 - RNA, 21 nt, Pseudomonas aeruginosa PA01
ggcgagguugcccacggccag

SEQ ID NO: 1458767 - RNA, 22 nt, Pseudomonas aeruginosa PA01
ggcgaguaccaccgugcccgcc

SEQ ID NO: 1458768 - RNA, 23 nt, Pseudomonas aeruginosa PA01
ggcgaguaccaccgugcccgccg

SEQ ID NO: 1458769 - RNA, 14 nt, Pseudomonas aeruginosa PA01
ggcgauacaccgca

SEQ ID NO: 1458770 - RNA, 15 nt, Pseudomonas aeruginosa PA01
ggcgauacgcggccc

SEQ ID NO: 1458771 - RNA, 15 nt, Pseudomonas aeruginosa PA01
ggcgauaggcgcgca

SEQ ID NO: 1458772 - RNA, 13 nt, Pseudomonas aeruginosa PA01
ggcgauagccgac

SEQ ID NO: 1458773 - RNA, 20 nt, Pseudomonas aeruginosa PA01
ggcgaguuuguugcgcgagg

SEQ ID NO: 1458774 - RNA, 14 nt, Pseudomonas aeruginosa PA01
ggcgaguucggcgu

SEQ ID NO: 1458775 - RNA, 16 nt, Pseudomonas aeruginosa PA01
ggcgaguugcgcgagg

SEQ ID NO: 1458776 - RNA, 16 nt, Pseudomonas aeruginosa PA01
ggcgaucuccgccagg

SEQ ID NO: 1458777 - RNA, 20 nt, Pseudomonas aeruginosa PA01
ggcgaucuccgccaggcggc

SEQ ID NO: 1458778 - RNA, 22 nt, Pseudomonas aeruginosa PA01
ggcgaucuccgccaggcggccg

SEQ ID NO: 1458779 - RNA, 23 nt, Pseudomonas aeruginosa PA01
ggcgaucuccgccaggcggccga

SEQ ID NO: 1458780 - RNA, 22 nt, Pseudomonas aeruginosa PA01
ggcgaucgucgagaugcugcgg

SEQ ID NO: 1458781 - RNA, 13 nt, Pseudomonas aeruginosa PA01
ggcgaucucgcgg

SEQ ID NO: 1458782 - RNA, 15 nt, Pseudomonas aeruginosa PA01
ggcgaucucggcgcg

SEQ ID NO: 1458783 - RNA, 17 nt, Pseudomonas aeruginosa PA01
ggcgaucucggcgcggg

SEQ ID NO: 1458784 - RNA, 19 nt, Pseudomonas aeruginosa PA01
ggcgaucucggcgcgggca

SEQ ID NO: 1458785 - RNA, 12 nt, Pseudomonas aeruginosa PA01
ggcgaugaccag

SEQ ID NO: 1458786 - RNA, 17 nt, Pseudomonas aeruginosa PA01
ggcgaugaccagcucgg

SEQ ID NO: 1458787 - RNA, 22 nt, Pseudomonas aeruginosa PA01
ggcgaugaccagcucggcggga

SEQ ID NO: 1458788 - RNA, 22 nt, Pseudomonas aeruginosa PA01
ggcgaugaccaggguggcggcg

SEQ ID NO: 1458789 - RNA, 13 nt, Pseudomonas aeruginosa PA01
ggcgaucuggcga

SEQ ID NO: 1458790 - RNA, 23 nt, Pseudomonas aeruginosa PA01
ggcgaucuucagguaggcgcggg

SEQ ID NO: 1458791 - RNA, 17 nt, Pseudomonas aeruginosa PA01
ggcgaucuucuccgccg

SEQ ID NO: 1458792 - RNA, 21 nt, Pseudomonas aeruginosa PA01
ggcgaucuugaucgccagcgg

SEQ ID NO: 1458793 - RNA, 22 nt, Pseudomonas aeruginosa PA01
ggcgaucuugaucgccagcggu

SEQ ID NO: 1458794 - RNA, 21 nt, Pseudomonas aeruginosa PA01
ggcgaucggguagagcgcggc

SEQ ID NO: 1458795 - RNA, 13 nt, Pseudomonas aeruginosa PA01
ggcgaucgccugg

SEQ ID NO: 1458796 - RNA, 18 nt, Pseudomonas aeruginosa PA01
ggcgaucgaaggaucgcc

SEQ ID NO: 1458797 - RNA, 19 nt, Pseudomonas aeruginosa PA01
ggcgaucgaaggaucgccu

SEQ ID NO: 1458798 - RNA, 15 nt, Pseudomonas aeruginosa PA01
ggcgaucgagcuguc

SEQ ID NO: 1458799 - RNA, 13 nt, Pseudomonas aeruginosa PA01
ggcgaucgccagg

SEQ ID NO: 1458800 - RNA, 15 nt, Pseudomonas aeruginosa PA01
ggcgaucgccaggug

SEQ ID NO: 1458801 - RNA, 22 nt, Pseudomonas aeruginosa PA01
ggcgaucgccagguggaagcgc

SEQ ID NO: 1458802 - RNA, 14 nt, Pseudomonas aeruginosa PA01
ggcgaucgccaguu

SEQ ID NO: 1458803 - RNA, 15 nt, Pseudomonas aeruginosa PA01
ggcgaucgccgcggc

SEQ ID NO: 1458804 - RNA, 16 nt, Pseudomonas aeruginosa PA01
ggcgaucgccgcggcg

SEQ ID NO: 1458805 - RNA, 13 nt, Pseudomonas aeruginosa PA01
ggcgauccgcccg

SEQ ID NO: 1458806 - RNA, 20 nt, Pseudomonas aeruginosa PA01
ggcgauccgcccgcaugcca

SEQ ID NO: 1458807 - RNA, 13 nt, Pseudomonas aeruginosa PA01
ggcgauccgcgcu

SEQ ID NO: 1458808 - RNA, 12 nt, Pseudomonas aeruginosa PA01
ggcgauccgcug

SEQ ID NO: 1458809 - RNA, 13 nt, Pseudomonas aeruginosa PA01
ggcgauccgcugc

SEQ ID NO: 1458810 - RNA, 14 nt, Pseudomonas aeruginosa PA01
ggcgauccgcugca

SEQ ID NO: 1458811 - RNA, 20 nt, Pseudomonas aeruginosa PA01
ggcgaucccguagaccggcu

SEQ ID NO: 1458812 - RNA, 22 nt, Pseudomonas aeruginosa PA01
ggcgaucccguagaccggcucc

SEQ ID NO: 1458813 - RNA, 15 nt, Pseudomonas aeruginosa PA01
ggcgaucaucgcgca

SEQ ID NO: 1458814 - RNA, 17 nt, Pseudomonas aeruginosa PA01
ggcgaucaucgccaccg

SEQ ID NO: 1458815 - RNA, 20 nt, Pseudomonas aeruginosa PA01
ggcgaucaucgccaccggua

SEQ ID NO: 1458816 - RNA, 16 nt, Pseudomonas aeruginosa PA01
ggcgaucaugccuucg

SEQ ID NO: 1458817 - RNA, 22 nt, Pseudomonas aeruginosa PA01
ggcgaucaugccuucgaucuca

SEQ ID NO: 1458818 - RNA, 22 nt, Pseudomonas aeruginosa PA01
ggcgauccacagcagguugcug

SEQ ID NO: 1458819 - RNA, 19 nt, Pseudomonas aeruginosa PA01
ggcgauccagaagaucagc

SEQ ID NO: 1458820 - RNA, 20 nt, Pseudomonas aeruginosa PA01
ggcgauccagaagaucagcg

SEQ ID NO: 1458821 - RNA, 13 nt, Pseudomonas aeruginosa PA01
ggcgauccagcgg

SEQ ID NO: 1458822 - RNA, 24 nt, Pseudomonas aeruginosa PA01
ggcgaugaggcuguccagcaggcg

SEQ ID NO: 1458823 - RNA, 14 nt, Pseudomonas aeruginosa PA01
ggcgaugaucagcc

SEQ ID NO: 1458824 - RNA, 19 nt, Pseudomonas aeruginosa PA01
ggcgaugaccgccccggca

SEQ ID NO: 1458825 - RNA, 23 nt, Pseudomonas aeruginosa PA01
ggcgaugaucggcagccguccgc

SEQ ID NO: 1458826 - RNA, 16 nt, Pseudomonas aeruginosa PA01
ggcgaugaucuggcca

SEQ ID NO: 1458827 - RNA, 17 nt, Pseudomonas aeruginosa PA01
ggcgaugaucuggccac

SEQ ID NO: 1458828 - RNA, 13 nt, Pseudomonas aeruginosa PA01
ggcgaugcccagg

SEQ ID NO: 1458829 - RNA, 19 nt, Pseudomonas aeruginosa PA01
ggcgaugcccaggccgccg

SEQ ID NO: 1458830 - RNA, 16 nt, Pseudomonas aeruginosa PA01
ggcgaugccgcgccag

SEQ ID NO: 1458831 - RNA, 13 nt, Pseudomonas aeruginosa PA01
ggcgaugccgccg

SEQ ID NO: 1458832 - RNA, 20 nt, Pseudomonas aeruginosa PA01
ggcgauucuccugggcgguc

SEQ ID NO: 1458833 - RNA, 13 nt, Pseudomonas aeruginosa PA01
ggcgaugccgacg

SEQ ID NO: 1458834 - RNA, 12 nt, Pseudomonas aeruginosa PA01
ggcgaugccgag

SEQ ID NO: 1458835 - RNA, 19 nt, Pseudomonas aeruginosa PA01
ggcgaugccgauggcgccg

SEQ ID NO: 1458836 - RNA, 20 nt, Pseudomonas aeruginosa PA01
ggcgaugccgauggcgccgc

SEQ ID NO: 1458837 - RNA, 12 nt, Pseudomonas aeruginosa PA01
ggcgaugccgcc

SEQ ID NO: 1458838 - RNA, 19 nt, Pseudomonas aeruginosa PA01
ggcgaugccgcccagcacc

SEQ ID NO: 1458839 - RNA, 14 nt, Pseudomonas aeruginosa PA01
ggcgaugcccuggc

SEQ ID NO: 1458840 - RNA, 20 nt, Pseudomonas aeruginosa PA01
ggcgaugcccuggccgcugc

SEQ ID NO: 1458841 - RNA, 22 nt, Pseudomonas aeruginosa PA01
ggcgaugcccuggccgcugccg

SEQ ID NO: 1458842 - RNA, 23 nt, Pseudomonas aeruginosa PA01
ggcgaugcccuggccgcugccgc

SEQ ID NO: 1458843 - RNA, 17 nt, Pseudomonas aeruginosa PA01
ggcgaugcccuuggcca

SEQ ID NO: 1458844 - RNA, 22 nt, Pseudomonas aeruginosa PA01
ggcgaugcccuuggccagcgcg

SEQ ID NO: 1458845 - RNA, 15 nt, Pseudomonas aeruginosa PA01
ggcgcacaucacccg

SEQ ID NO: 1458846 - RNA, 12 nt, Pseudomonas aeruginosa PA01
ggcgcaccaggc

SEQ ID NO: 1458847 - RNA, 16 nt, Pseudomonas aeruginosa PA01
ggcgcaccaggccagg

SEQ ID NO: 1458848 - RNA, 17 nt, Pseudomonas aeruginosa PA01
ggcgcaccaggccaggc

SEQ ID NO: 1458849 - RNA, 18 nt, Pseudomonas aeruginosa PA01
ggcgcaccaggccaggcu

SEQ ID NO: 1458850 - RNA, 21 nt, Pseudomonas aeruginosa PA01
ggcgcaccaggccaggcugcg

SEQ ID NO: 1458851 - RNA, 22 nt, Pseudomonas aeruginosa PA01
ggcgcaccaggccaggcugcgc

SEQ ID NO: 1458852 - RNA, 20 nt, Pseudomonas aeruginosa PA01
ggcgaugccggagagcagca

SEQ ID NO: 1458853 - RNA, 20 nt, Pseudomonas aeruginosa PA01
ggccgcgcuccaacaggcau

SEQ ID NO: 1458854 - RNA, 19 nt, Pseudomonas aeruginosa PA01
ggccgcgcucgacggucag

SEQ ID NO: 1458855 - RNA, 17 nt, Pseudomonas aeruginosa PA01
ggccgcgcugcugccau

SEQ ID NO: 1458856 - RNA, 16 nt, Pseudomonas aeruginosa PA01
ggccgcggagcaccgc

SEQ ID NO: 1458857 - RNA, 20 nt, Pseudomonas aeruginosa PA01
ggccgcggagcaccgcgccu

SEQ ID NO: 1458858 - RNA, 20 nt, Pseudomonas aeruginosa PA01
ggccgcgggucuugcgcagg

SEQ ID NO: 1458859 - RNA, 20 nt, Pseudomonas aeruginosa PA01
ggccgcgggaggccgccucg

SEQ ID NO: 1458860 - RNA, 18 nt, Pseudomonas aeruginosa PA01
ggccgcguaagcggccuu

SEQ ID NO: 1458861 - RNA, 14 nt, Pseudomonas aeruginosa PA01
ggccgcgucgccca

SEQ ID NO: 1458862 - RNA, 16 nt, Pseudomonas aeruginosa PA01
ggccgcgucgcccagg

SEQ ID NO: 1458863 - RNA, 20 nt, Pseudomonas aeruginosa PA01
ggccgcgucgcccaggccgc

SEQ ID NO: 1458864 - RNA, 22 nt, Pseudomonas aeruginosa PA01
ggccgcgucgcccaggccgcug

SEQ ID NO: 1458865 - RNA, 18 nt, Pseudomonas aeruginosa PA01
ggccgaucaccagcgcca

SEQ ID NO: 1458866 - RNA, 14 nt, Pseudomonas aeruginosa PA01
ggccgaucaccacc

SEQ ID NO: 1458867 - RNA, 16 nt, Pseudomonas aeruginosa PA01
ggccgaucaccaccag

SEQ ID NO: 1458868 - RNA, 21 nt, Pseudomonas aeruginosa PA01
ggccgaucaccaccagcgccg

SEQ ID NO: 1458869 - RNA, 22 nt, Pseudomonas aeruginosa PA01
ggccgaucaccaccagcgccgc

SEQ ID NO: 1458870 - RNA, 23 nt, Pseudomonas aeruginosa PA01
ggccgaucaccaccagcgccgcc

SEQ ID NO: 1458871 - RNA, 19 nt, Pseudomonas aeruginosa PA01
ggccgaucaccaccuggau

SEQ ID NO: 1458872 - RNA, 23 nt, Pseudomonas aeruginosa PA01
ggccgagguggagaucagcggac

SEQ ID NO: 1458873 - RNA, 14 nt, Pseudomonas aeruginosa PA01
ggccgagguuucca

SEQ ID NO: 1458874 - RNA, 19 nt, Pseudomonas aeruginosa PA01
ggccgaguggccgaaggcg

SEQ ID NO: 1458875 - RNA, 14 nt, Pseudomonas aeruginosa PA01
ggccgaguucgcgc

SEQ ID NO: 1458876 - RNA, 16 nt, Pseudomonas aeruginosa PA01
ggccgaguucgcgcag

SEQ ID NO: 1458877 - RNA, 24 nt, Pseudomonas aeruginosa PA01
ggccgaguucgcgcaggcgcuggc

SEQ ID NO: 1458878 - RNA, 17 nt, Pseudomonas aeruginosa PA01
ggccgaucagcggcggu

SEQ ID NO: 1458879 - RNA, 15 nt, Pseudomonas aeruginosa PA01
ggccgaucagcggcg

SEQ ID NO: 1458880 - RNA, 13 nt, Pseudomonas aeruginosa PA01
ggccgaucagcgc

SEQ ID NO: 1458881 - RNA, 15 nt, Pseudomonas aeruginosa PA01
ggccgaucaccuggc

SEQ ID NO: 1458882 - RNA, 17 nt, Pseudomonas aeruginosa PA01
ggccgaucaccuggcca

SEQ ID NO: 1458883 - RNA, 22 nt, Pseudomonas aeruginosa PA01
ggccgaucaccuucaccggcac

SEQ ID NO: 1458884 - RNA, 21 nt, Pseudomonas aeruginosa PA01
ggccgcgcagucccgcgcggc

SEQ ID NO: 1458885 - RNA, 20 nt, Pseudomonas aeruginosa PA01
ggccgcgcgaccgcggcgcu

SEQ ID NO: 1458886 - RNA, 15 nt, Pseudomonas aeruginosa PA01
ggccgcgcgauggcc

SEQ ID NO: 1458887 - RNA, 16 nt, Pseudomonas aeruginosa PA01
ggccgcgcgauggccg

SEQ ID NO: 1458888 - RNA, 17 nt, Pseudomonas aeruginosa PA01
ggccgcgcgauggccgg

SEQ ID NO: 1458889 - RNA, 18 nt, Pseudomonas aeruginosa PA01
ggccgcgcggcuugccgg

SEQ ID NO: 1458890 - RNA, 22 nt, Pseudomonas aeruginosa PA01
ggccgcgccccacggcgcggcc

SEQ ID NO: 1458891 - RNA, 12 nt, Pseudomonas aeruginosa PA01
ggccgcgccgca

SEQ ID NO: 1458892 - RNA, 21 nt, Pseudomonas aeruginosa PA01
ggccgcgccgcaagggcgucg

SEQ ID NO: 1458893 - RNA, 15 nt, Pseudomonas aeruginosa PA01
ggccgcgccagccac

SEQ ID NO: 1458894 - RNA, 12 nt, Pseudomonas aeruginosa PA01
ggccgcgccgac

SEQ ID NO: 1458895 - RNA, 23 nt, Pseudomonas aeruginosa PA01
ggccgcgccgacccagagcgcgc

SEQ ID NO: 1458896 - RNA, 13 nt, Pseudomonas aeruginosa PA01
ggccgcgccgagc

SEQ ID NO: 1458897 - RNA, 17 nt, Pseudomonas aeruginosa PA01
ggccgcgccuucagcgc

SEQ ID NO: 1458898 - RNA, 14 nt, Pseudomonas aeruginosa PA01
ggccggcgauggcc

SEQ ID NO: 1458899 - RNA, 15 nt, Pseudomonas aeruginosa PA01
ggccggcgauggccg

SEQ ID NO: 1458900 - RNA, 16 nt, Pseudomonas aeruginosa PA01
ggccggcgauggccgc

SEQ ID NO: 1458901 - RNA, 13 nt, Pseudomonas aeruginosa PA01
ggccggcgauggc

SEQ ID NO: 1458902 - RNA, 12 nt, Pseudomonas aeruginosa PA01
ggccggcgccgc

SEQ ID NO: 1458903 - RNA, 17 nt, Pseudomonas aeruginosa PA01
ggccggcgccagcaggc

SEQ ID NO: 1458904 - RNA, 11 nt, Pseudomonas aeruginosa PA01
ggccggcgccg

SEQ ID NO: 1458905 - RNA, 13 nt, Pseudomonas aeruginosa PA01
ggccggcgccgcc

SEQ ID NO: 1458906 - RNA, 12 nt, Pseudomonas aeruginosa PA01
ggccggcgccuu

SEQ ID NO: 1458907 - RNA, 17 nt, Pseudomonas aeruginosa PA01
ggccggcgccuugcgcc

SEQ ID NO: 1458908 - RNA, 21 nt, Pseudomonas aeruginosa PA01
ggccggcgccuugcgccaggc

SEQ ID NO: 1458909 - RNA, 19 nt, Pseudomonas aeruginosa PA01
ggccggcgugcccauccgc

SEQ ID NO: 1458910 - RNA, 22 nt, Pseudomonas aeruginosa PA01
ggccggcgugcccuuuuccucc

SEQ ID NO: 1458911 - RNA, 15 nt, Pseudomonas aeruginosa PA01
ggccggcucagcgcu

SEQ ID NO: 1458912 - RNA, 16 nt, Pseudomonas aeruginosa PA01
ggccggcucagcgcuu

SEQ ID NO: 1458913 - RNA, 20 nt, Pseudomonas aeruginosa PA01
ggccggcugcuccgggcggc

SEQ ID NO: 1458914 - RNA, 13 nt, Pseudomonas aeruginosa PA01
ggccggggccggc

SEQ ID NO: 1458915 - RNA, 16 nt, Pseudomonas aeruginosa PA01
ggccggggccggcacc

SEQ ID NO: 1458916 - RNA, 18 nt, Pseudomonas aeruginosa PA01
ggccgggauauccagguu

SEQ ID NO: 1458917 - RNA, 16 nt, Pseudomonas aeruginosa PA01
ggccggggaucggcau

SEQ ID NO: 1458918 - RNA, 19 nt, Pseudomonas aeruginosa PA01
ggccgggauacagcagcca

SEQ ID NO: 1458919 - RNA, 15 nt, Pseudomonas aeruginosa PA01
ggccgggaaccagca

SEQ ID NO: 1458920 - RNA, 16 nt, Pseudomonas aeruginosa PA01
ggccgggggucgcggc

SEQ ID NO: 1458921 - RNA, 17 nt, Pseudomonas aeruginosa PA01
ggccggggucaggccga

SEQ ID NO: 1458922 - RNA, 21 nt, Pseudomonas aeruginosa PA01
ggccggggucaggccgaggcg

SEQ ID NO: 1458923 - RNA, 23 nt, Pseudomonas aeruginosa PA01
ggccggggucaggccgaggcgcu

SEQ ID NO: 1458924 - RNA, 14 nt, Pseudomonas aeruginosa PA01
ggccgggggcggcg

SEQ ID NO: 1458925 - RNA, 16 nt, Pseudomonas aeruginosa PA01
ggccgggggcggcgcc

SEQ ID NO: 1458926 - RNA, 17 nt, Pseudomonas aeruginosa PA01
ggccgggggcggcgccu

SEQ ID NO: 1458927 - RNA, 14 nt, Pseudomonas aeruginosa PA01
ggccggggcgcgcc

SEQ ID NO: 1458928 - RNA, 16 nt, Pseudomonas aeruginosa PA01
ggccggggcgcgcccg

SEQ ID NO: 1458929 - RNA, 17 nt, Pseudomonas aeruginosa PA01
ggccggggcgcgcccgc

SEQ ID NO: 1458930 - RNA, 21 nt, Pseudomonas aeruginosa PA01
ggccggggcggauucaggcgc

SEQ ID NO: 1458931 - RNA, 16 nt, Pseudomonas aeruginosa PA01
ggccggcuucagcaac

SEQ ID NO: 1458932 - RNA, 17 nt, Pseudomonas aeruginosa PA01
ggccgggucaucaccgg

SEQ ID NO: 1458933 - RNA, 18 nt, Pseudomonas aeruginosa PA01
ggccgggucaucaccggc

SEQ ID NO: 1458934 - RNA, 19 nt, Pseudomonas aeruginosa PA01
ggccgggucguacaccaga

SEQ ID NO: 1458935 - RNA, 17 nt, Pseudomonas aeruginosa PA01
ggccgcguucgccgagg

SEQ ID NO: 1458936 - RNA, 19 nt, Pseudomonas aeruginosa PA01
ggccgcguucgccgaggcg

SEQ ID NO: 1458937 - RNA, 22 nt, Pseudomonas aeruginosa PA01
ggccgcguucgccgaggcggcg

SEQ ID NO: 1458938 - RNA, 17 nt, Pseudomonas aeruginosa PA01
ggccgcucgagggcgac

SEQ ID NO: 1458939 - RNA, 20 nt, Pseudomonas aeruginosa PA01
ggccgcucgagggcgaccgc

SEQ ID NO: 1458940 - RNA, 21 nt, Pseudomonas aeruginosa PA01
ggccgcucgagggcgaccgcc

SEQ ID NO: 1458941 - RNA, 16 nt, Pseudomonas aeruginosa PA01
ggccgcucccaccgcu

SEQ ID NO: 1458942 - RNA, 14 nt, Pseudomonas aeruginosa PA01
ggccgcucgcgcgg

SEQ ID NO: 1458943 - RNA, 14 nt, Pseudomonas aeruginosa PA01
ggccggagcaggcc

SEQ ID NO: 1458944 - RNA, 15 nt, Pseudomonas aeruginosa PA01
ggccggagcaggcca

SEQ ID NO: 1458945 - RNA, 17 nt, Pseudomonas aeruginosa PA01
ggccggagcaggccaug

SEQ ID NO: 1458946 - RNA, 14 nt, Pseudomonas aeruginosa PA01
ggccggccuccagc

SEQ ID NO: 1458947 - RNA, 18 nt, Pseudomonas aeruginosa PA01
ggccggccuccagcgccu

SEQ ID NO: 1458948 - RNA, 20 nt, Pseudomonas aeruginosa PA01
ggccggccucggcggcgcga

SEQ ID NO: 1458949 - RNA, 12 nt, Pseudomonas aeruginosa PA01
ggccggccuggg

SEQ ID NO: 1458950 - RNA, 12 nt, Pseudomonas aeruginosa PA01
ggccggcgaacc

SEQ ID NO: 1458951 - RNA, 12 nt, Pseudomonas aeruginosa PA01
ggccggcgauca

SEQ ID NO: 1458952 - RNA, 14 nt, Pseudomonas aeruginosa PA01
ggccggcgaucagc

SEQ ID NO: 1458953 - RNA, 19 nt, Pseudomonas aeruginosa PA01
ggccggcgaccagcgucgc

SEQ ID NO: 1458954 - RNA, 16 nt, Pseudomonas aeruginosa PA01
ggccggcgagccaggu

SEQ ID NO: 1458955 - RNA, 13 nt, Pseudomonas aeruginosa PA01
ggccugagccggc

SEQ ID NO: 1458956 - RNA, 18 nt, Pseudomonas aeruginosa PA01
ggccugagccggccggag

SEQ ID NO: 1458957 - RNA, 23 nt, Pseudomonas aeruginosa PA01
ggccucguugaucggcaacgagc

SEQ ID NO: 1458958 - RNA, 18 nt, Pseudomonas aeruginosa PA01
ggccucuccgagacgcug

SEQ ID NO: 1458959 - RNA, 20 nt, Pseudomonas aeruginosa PA01
ggccucgaggucggccuggc

SEQ ID NO: 1458960 - RNA, 21 nt, Pseudomonas aeruginosa PA01
ggccucgaggucggccuggcu

SEQ ID NO: 1458961 - RNA, 19 nt, Pseudomonas aeruginosa PA01
ggccucgacgcagagcgcc

SEQ ID NO: 1458962 - RNA, 20 nt, Pseudomonas aeruginosa PA01
ggccucgacgcagagcgcca

SEQ ID NO: 1458963 - RNA, 13 nt, Pseudomonas aeruginosa PA01
ggccuccuggcgg

SEQ ID NO: 1458964 - RNA, 20 nt, Pseudomonas aeruginosa PA01
ggccugcaacacccaggccu

SEQ ID NO: 1458965 - RNA, 15 nt, Pseudomonas aeruginosa PA01
ggccugcaacgccgc

SEQ ID NO: 1458966 - RNA, 16 nt, Pseudomonas aeruginosa PA01
ggccugcucagcgucc

SEQ ID NO: 1458967 - RNA, 14 nt, Pseudomonas aeruginosa PA01
ggccugcuccagcg

SEQ ID NO: 1458968 - RNA, 13 nt, Pseudomonas aeruginosa PA01
ggccugcuccucg

SEQ ID NO: 1458969 - RNA, 19 nt, Pseudomonas aeruginosa PA01
ggccugcuccucggcagcg

SEQ ID NO: 1458970 - RNA, 15 nt, Pseudomonas aeruginosa PA01
ggccugcucgcgcag

SEQ ID NO: 1458971 - RNA, 15 nt, Pseudomonas aeruginosa PA01
ggccugcucggcucg

SEQ ID NO: 1458972 - RNA, 18 nt, Pseudomonas aeruginosa PA01
ggccugcucggcucgcgg

SEQ ID NO: 1458973 - RNA, 18 nt, Pseudomonas aeruginosa PA01
ggccugcugcgccggcac

SEQ ID NO: 1458974 - RNA, 22 nt, Pseudomonas aeruginosa PA01
ggccugcugcucgaccgccugc

SEQ ID NO: 1458975 - RNA, 14 nt, Pseudomonas aeruginosa PA01
ggccuggaucgccu

SEQ ID NO: 1458976 - RNA, 18 nt, Pseudomonas aeruginosa PA01
ggccuggaucgccuugcg

SEQ ID NO: 1458977 - RNA, 21 nt, Pseudomonas aeruginosa PA01
ggccuggaucgccuugcgcgu

SEQ ID NO: 1458978 - RNA, 20 nt, Pseudomonas aeruginosa PA01
ggccuggaacaccaggccgc

SEQ ID NO: 1458979 - RNA, 14 nt, Pseudomonas aeruginosa PA01
ggccuggagcgccu

SEQ ID NO: 1458980 - RNA, 15 nt, Pseudomonas aeruginosa PA01
ggccuggagcgccuc

SEQ ID NO: 1458981 - RNA, 13 nt, Pseudomonas aeruginosa PA01
ggccuggcccggc

SEQ ID NO: 1458982 - RNA, 18 nt, Pseudomonas aeruginosa PA01
ggccuggcccuggcgcag

SEQ ID NO: 1458983 - RNA, 21 nt, Pseudomonas aeruginosa PA01
ggccuggcccuggcgcaggcg

SEQ ID NO: 1458984 - RNA, 23 nt, Pseudomonas aeruginosa PA01
ggccuggcccuggcgcaggcggc

SEQ ID NO: 1458985 - RNA, 11 nt, Pseudomonas aeruginosa PA01
ggccuggccgc

SEQ ID NO: 1458986 - RNA, 12 nt, Pseudomonas aeruginosa PA01
ggccuggccgcc

SEQ ID NO: 1458987 - RNA, 23 nt, Pseudomonas aeruginosa PA01
ggccuggccacccuuguggccga

SEQ ID NO: 1458988 - RNA, 21 nt, Pseudomonas aeruginosa PA01
ggccuucgccuucggcgugca

SEQ ID NO: 1458989 - RNA, 16 nt, Pseudomonas aeruginosa PA01
ggccuucggcgccgga

SEQ ID NO: 1458990 - RNA, 12 nt, Pseudomonas aeruginosa PA01
ggccuucgucgg

SEQ ID NO: 1458991 - RNA, 14 nt, Pseudomonas aeruginosa PA01
ggccuucgucggcu

SEQ ID NO: 1458992 - RNA, 17 nt, Pseudomonas aeruginosa PA01
ggccuucucgucgccgc

SEQ ID NO: 1458993 - RNA, 18 nt, Pseudomonas aeruginosa PA01
ggccuucucgucgccgcc

SEQ ID NO: 1458994 - RNA, 20 nt, Pseudomonas aeruginosa PA01
ggccuucucgucgccgcccg

SEQ ID NO: 1458995 - RNA, 19 nt, Pseudomonas aeruginosa PA01
ggccuucuugcugccggcg

SEQ ID NO: 1458996 - RNA, 12 nt, Pseudomonas aeruginosa PA01
ggccuugagcag

SEQ ID NO: 1458997 - RNA, 19 nt, Pseudomonas aeruginosa PA01
ggccuugagcaggcggccg

SEQ ID NO: 1458998 - RNA, 14 nt, Pseudomonas aeruginosa PA01
ggccuugagcgccg

SEQ ID NO: 1458999 - RNA, 15 nt, Pseudomonas aeruginosa PA01
ggccuugagcgccga

SEQ ID NO: 1459000 - RNA, 20 nt, Pseudomonas aeruginosa PA01
ggccuugagcgccgaaggcg

SEQ ID NO: 1459001 - RNA, 22 nt, Pseudomonas aeruginosa PA01
ggccuugagcgccgaaggcguc

SEQ ID NO: 1459002 - RNA, 15 nt, Pseudomonas aeruginosa PA01
ggccuugaggcgggc

SEQ ID NO: 1459003 - RNA, 16 nt, Pseudomonas aeruginosa PA01
ggccuugaucaccacc

SEQ ID NO: 1459004 - RNA, 20 nt, Pseudomonas aeruginosa PA01
ggccuugaucaccaccacgc

SEQ ID NO: 1459005 - RNA, 22 nt, Pseudomonas aeruginosa PA01
ggccuugaucaccaccacgccg

SEQ ID NO: 1459006 - RNA, 16 nt, Pseudomonas aeruginosa PA01
ggccuugaccaccgcc

SEQ ID NO: 1459007 - RNA, 17 nt, Pseudomonas aeruginosa PA01
ggccuugaccaccgcca

SEQ ID NO: 1459008 - RNA, 23 nt, Pseudomonas aeruginosa PA01
ggccuugaccaccgccaggcugg

SEQ ID NO: 1459009 - RNA, 24 nt, Pseudomonas aeruginosa PA01
ggccuugcagcaacucgccgccga

SEQ ID NO: 1459010 - RNA, 21 nt, Pseudomonas aeruginosa PA01
ggccuugcagggccgccagcc

SEQ ID NO: 1459011 - RNA, 13 nt, Pseudomonas aeruginosa PA01
ggccuugccuucg

SEQ ID NO: 1459012 - RNA, 16 nt, Pseudomonas aeruginosa PA01
ggccuugcgcggcgcc

SEQ ID NO: 1459013 - RNA, 13 nt, Pseudomonas aeruginosa PA01
ggccuugcuggcg

SEQ ID NO: 1459014 - RNA, 15 nt, Pseudomonas aeruginosa PA01
ggccuucaggcgcuc

SEQ ID NO: 1459015 - RNA, 17 nt, Pseudomonas aeruginosa PA01
ggccuucaggcgcuccu

SEQ ID NO: 1459016 - RNA, 14 nt, Pseudomonas aeruginosa PA01
ggccuucaggcugc

SEQ ID NO: 1459017 - RNA, 15 nt, Pseudomonas aeruginosa PA01
ggccuucaggcugcg

SEQ ID NO: 1459018 - RNA, 16 nt, Pseudomonas aeruginosa PA01
ggccuucaggcugcgc

SEQ ID NO: 1459019 - RNA, 15 nt, Pseudomonas aeruginosa PA01
ggccuucaccgcgcc

SEQ ID NO: 1459020 - RNA, 16 nt, Pseudomonas aeruginosa PA01
ggccuucgacgaugcg

SEQ ID NO: 1459021 - RNA, 19 nt, Pseudomonas aeruginosa PA01
ggccuucgacgguucgcga

SEQ ID NO: 1459022 - RNA, 18 nt, Pseudomonas aeruginosa PA01
ggccuucgccagcggcca

SEQ ID NO: 1459023 - RNA, 20 nt, Pseudomonas aeruginosa PA01
ggccuuccagaacgccgcgc

SEQ ID NO: 1459024 - RNA, 16 nt, Pseudomonas aeruginosa PA01
ggccugggcgaagucg

SEQ ID NO: 1459025 - RNA, 14 nt, Pseudomonas aeruginosa PA01
ggccugggcgccgc

SEQ ID NO: 1459026 - RNA, 18 nt, Pseudomonas aeruginosa PA01
ggccugggguagccggcc

SEQ ID NO: 1459027 - RNA, 19 nt, Pseudomonas aeruginosa PA01
ggccugggucaccagcacc

SEQ ID NO: 1459028 - RNA, 22 nt, Pseudomonas aeruginosa PA01
ggccuggccguugcgcaggcgg

SEQ ID NO: 1459029 - RNA, 17 nt, Pseudomonas aeruginosa PA01
ggccuggcgcgcgcgcc

SEQ ID NO: 1459030 - RNA, 20 nt, Pseudomonas aeruginosa PA01
ggccuggcgcaacaggcgca

SEQ ID NO: 1459031 - RNA, 15 nt, Pseudomonas aeruginosa PA01
ggccuggcgcacggc

SEQ ID NO: 1459032 - RNA, 17 nt, Pseudomonas aeruginosa PA01
ggccuggcgcagcggca

SEQ ID NO: 1459033 - RNA, 20 nt, Pseudomonas aeruginosa PA01
ggccugggccgaaggccagg

SEQ ID NO: 1459034 - RNA, 22 nt, Pseudomonas aeruginosa PA01
ggccugggccgaaggccaggcc

SEQ ID NO: 1459035 - RNA, 17 nt, Pseudomonas aeruginosa PA01
ggccugggacggcgugg

SEQ ID NO: 1459036 - RNA, 21 nt, Pseudomonas aeruginosa PA01
ggccugggacggcguggucga

SEQ ID NO: 1459037 - RNA, 22 nt, Pseudomonas aeruginosa PA01
ggccugggcaagcugcacggcg

SEQ ID NO: 1459038 - RNA, 14 nt, Pseudomonas aeruginosa PA01
ggccuggcucaugu

SEQ ID NO: 1459039 - RNA, 19 nt, Pseudomonas aeruginosa PA01
ggccuggcucgaucggcag

SEQ ID NO: 1459040 - RNA, 17 nt, Pseudomonas aeruginosa PA01
ggccuggcugccgagca

SEQ ID NO: 1459041 - RNA, 13 nt, Pseudomonas aeruginosa PA01
ggccuggcuggcc

SEQ ID NO: 1459042 - RNA, 17 nt, Pseudomonas aeruginosa PA01
ggccuggcgcucagcgc

SEQ ID NO: 1459043 - RNA, 22 nt, Pseudomonas aeruginosa PA01
ggccuggcgcucagcgccgcuu

SEQ ID NO: 1459044 - RNA, 19 nt, Pseudomonas aeruginosa PA01
ggccggugaucucgcggcg

SEQ ID NO: 1459045 - RNA, 21 nt, Pseudomonas aeruginosa PA01
ggccggugaucucgcggcgcg

SEQ ID NO: 1459046 - RNA, 15 nt, Pseudomonas aeruginosa PA01
ggccgucgggcaugg

SEQ ID NO: 1459047 - RNA, 19 nt, Pseudomonas aeruginosa PA01
ggccgucgggcauggcgau

SEQ ID NO: 1459048 - RNA, 17 nt, Pseudomonas aeruginosa PA01
ggccgguagucggggca

SEQ ID NO: 1459049 - RNA, 14 nt, Pseudomonas aeruginosa PA01
ggccgugagcacga

SEQ ID NO: 1459050 - RNA, 19 nt, Pseudomonas aeruginosa PA01
ggccgucuuccagggcggc

SEQ ID NO: 1459051 - RNA, 19 nt, Pseudomonas aeruginosa PA01
ggccgucguuuuguccggc

SEQ ID NO: 1459052 - RNA, 22 nt, Pseudomonas aeruginosa PA01
ggccgucguuuuguccggcggc

SEQ ID NO: 1459053 - RNA, 15 nt, Pseudomonas aeruginosa PA01
ggccgucuccaggcg

SEQ ID NO: 1459054 - RNA, 16 nt, Pseudomonas aeruginosa PA01
ggccgucuccaggcgc

SEQ ID NO: 1459055 - RNA, 18 nt, Pseudomonas aeruginosa PA01
ggccgucuccaggcgcgc

SEQ ID NO: 1459056 - RNA, 18 nt, Pseudomonas aeruginosa PA01
ggccgugugccugagcug

SEQ ID NO: 1459057 - RNA, 14 nt, Pseudomonas aeruginosa PA01
ggccgugggccgcc

SEQ ID NO: 1459058 - RNA, 14 nt, Pseudomonas aeruginosa PA01
ggccgugggccggc

SEQ ID NO: 1459059 - RNA, 15 nt, Pseudomonas aeruginosa PA01
ggccgugggccggcg

SEQ ID NO: 1459060 - RNA, 16 nt, Pseudomonas aeruginosa PA01
ggccgugggccggcgc

SEQ ID NO: 1459061 - RNA, 15 nt, Pseudomonas aeruginosa PA01
ggccguucaggcggg

SEQ ID NO: 1459062 - RNA, 15 nt, Pseudomonas aeruginosa PA01
ggccguugcgggcga

SEQ ID NO: 1459063 - RNA, 17 nt, Pseudomonas aeruginosa PA01
ggccguugaccagcgcg

SEQ ID NO: 1459064 - RNA, 19 nt, Pseudomonas aeruginosa PA01
ggccguugaccagcgcguc

SEQ ID NO: 1459065 - RNA, 14 nt, Pseudomonas aeruginosa PA01
ggccguuggcgaac

SEQ ID NO: 1459066 - RNA, 22 nt, Pseudomonas aeruginosa PA01
ggccguuggcgaacuucaggcc

SEQ ID NO: 1459067 - RNA, 14 nt, Pseudomonas aeruginosa PA01
ggccuaggacaccg

SEQ ID NO: 1459068 - RNA, 18 nt, Pseudomonas aeruginosa PA01
ggccuacugcuggacggc

SEQ ID NO: 1459069 - RNA, 19 nt, Pseudomonas aeruginosa PA01
ggccuacugcuggacggcg

SEQ ID NO: 1459070 - RNA, 22 nt, Pseudomonas aeruginosa PA01
ggccuacuucucgacgaaggcg

SEQ ID NO: 1459071 - RNA, 19 nt, Pseudomonas aeruginosa PA01
ggccuacuugaucagccgc

SEQ ID NO: 1459072 - RNA, 13 nt, Pseudomonas aeruginosa PA01
ggccuacccgcgc

SEQ ID NO: 1459073 - RNA, 20 nt, Pseudomonas aeruginosa PA01
ggccuacccgcgcuucuucg

SEQ ID NO: 1459074 - RNA, 14 nt, Pseudomonas aeruginosa PA01
ggccuccgguggcg

SEQ ID NO: 1459075 - RNA, 15 nt, Pseudomonas aeruginosa PA01
ggcagacgcugcucg

SEQ ID NO: 1459076 - RNA, 18 nt, Pseudomonas aeruginosa PA01
ggcagacgcugcucgacg

SEQ ID NO: 1459077 - RNA, 13 nt, Pseudomonas aeruginosa PA01
ggcagacgugcug

SEQ ID NO: 1459078 - RNA, 16 nt, Pseudomonas aeruginosa PA01
ggcagaguggcgcggc

SEQ ID NO: 1459079 - RNA, 20 nt, Pseudomonas aeruginosa PA01
ggcagaguggcgcggcugau

SEQ ID NO: 1459080 - RNA, 17 nt, Pseudomonas aeruginosa PA01
ggcagaccugcagcagg

SEQ ID NO: 1459081 - RNA, 21 nt, Pseudomonas aeruginosa PA01
ggcagaccugcagcaggauca

SEQ ID NO: 1459082 - RNA, 18 nt, Pseudomonas aeruginosa PA01
ggcagaccuggugggcgg

SEQ ID NO: 1459083 - RNA, 20 nt, Pseudomonas aeruginosa PA01
ggcagaccuggugggcggcg

SEQ ID NO: 1459084 - RNA, 20 nt, Pseudomonas aeruginosa PA01
ggcagacgaucuggcagucg

SEQ ID NO: 1459085 - RNA, 16 nt, Pseudomonas aeruginosa PA01
ggaugugcucagcgau

SEQ ID NO: 1459086 - RNA, 15 nt, Pseudomonas aeruginosa PA01
ggaugugcaccagca

SEQ ID NO: 1459087 - RNA, 19 nt, Pseudomonas aeruginosa PA01
ggauguaguccagcgccgc

SEQ ID NO: 1459088 - RNA, 13 nt, Pseudomonas aeruginosa PA01
ggcagcacgcugg

SEQ ID NO: 1459089 - RNA, 16 nt, Pseudomonas aeruginosa PA01
ggcagcacccgcacca

SEQ ID NO: 1459090 - RNA, 19 nt, Pseudomonas aeruginosa PA01
ggcagcacccgcaccagcc

SEQ ID NO: 1459091 - RNA, 18 nt, Pseudomonas aeruginosa PA01
ggcagcaccaggccaucg

SEQ ID NO: 1459092 - RNA, 15 nt, Pseudomonas aeruginosa PA01
ggcagauguccaggc

SEQ ID NO: 1459093 - RNA, 17 nt, Pseudomonas aeruginosa PA01
ggcagaucgcgccgagc

SEQ ID NO: 1459094 - RNA, 15 nt, Pseudomonas aeruginosa PA01
ggcagauccgccgug

SEQ ID NO: 1459095 - RNA, 23 nt, Pseudomonas aeruginosa PA01
ggcagauccgccgugaggcgcgc

SEQ ID NO: 1459096 - RNA, 22 nt, Pseudomonas aeruginosa PA01
ggcagccaucgcauagccggcg

SEQ ID NO: 1459097 - RNA, 23 nt, Pseudomonas aeruginosa PA01
ggcagccaucgcauagccggcgc

SEQ ID NO: 1459098 - RNA, 16 nt, Pseudomonas aeruginosa PA01
ggcagccacucggcca

SEQ ID NO: 1459099 - RNA, 22 nt, Pseudomonas aeruginosa PA01
ggcagccacucggccaggcgcc

SEQ ID NO: 1459100 - RNA, 24 nt, Pseudomonas aeruginosa PA01
ggcagccacucggccaggcgccag

SEQ ID NO: 1459101 - RNA, 20 nt, Pseudomonas aeruginosa PA01
ggcagcacgucuugcaggcu

SEQ ID NO: 1459102 - RNA, 21 nt, Pseudomonas aeruginosa PA01
ggcagcacgucuugcaggcuc

SEQ ID NO: 1459103 - RNA, 12 nt, Pseudomonas aeruginosa PA01
ggcagcagagcg

SEQ ID NO: 1459104 - RNA, 16 nt, Pseudomonas aeruginosa PA01
ggcagcagagcgccac

SEQ ID NO: 1459105 - RNA, 17 nt, Pseudomonas aeruginosa PA01
ggcagcagcggaucggc

SEQ ID NO: 1459106 - RNA, 18 nt, Pseudomonas aeruginosa PA01
ggcagcagcuugccggca

SEQ ID NO: 1459107 - RNA, 18 nt, Pseudomonas aeruginosa PA01
ggcagcagcgaacgccgc

SEQ ID NO: 1459108 - RNA, 18 nt, Pseudomonas aeruginosa PA01
ggcagcaucucggucgca

SEQ ID NO: 1459109 - RNA, 15 nt, Pseudomonas aeruginosa PA01
ggcagcaggucgcgc

SEQ ID NO: 1459110 - RNA, 18 nt, Pseudomonas aeruginosa PA01
ggcagcagucgcagcucg

SEQ ID NO: 1459111 - RNA, 12 nt, Pseudomonas aeruginosa PA01
ggcagcaggccg

SEQ ID NO: 1459112 - RNA, 13 nt, Pseudomonas aeruginosa PA01
ggcagcaggccgc

SEQ ID NO: 1459113 - RNA, 16 nt, Pseudomonas aeruginosa PA01
ggcagcaggccgccgc

SEQ ID NO: 1459114 - RNA, 18 nt, Pseudomonas aeruginosa PA01
ggcagcagggucagcagc

SEQ ID NO: 1459115 - RNA, 19 nt, Pseudomonas aeruginosa PA01
ggcagcagggucagcagcg

SEQ ID NO: 1459116 - RNA, 22 nt, Pseudomonas aeruginosa PA01
ggcagcagggucagcagcgcca

SEQ ID NO: 1459117 - RNA, 15 nt, Pseudomonas aeruginosa PA01
ggcagcaggcgggcg

SEQ ID NO: 1459118 - RNA, 16 nt, Pseudomonas aeruginosa PA01
ggcagcaggcgggcga

SEQ ID NO: 1459119 - RNA, 19 nt, Pseudomonas aeruginosa PA01
ggcagcaggcgggcgaagu

SEQ ID NO: 1459120 - RNA, 21 nt, Pseudomonas aeruginosa PA01
ggcagcaggcuguacagcagg

SEQ ID NO: 1459121 - RNA, 12 nt, Pseudomonas aeruginosa PA01
ggcaggccagcu

SEQ ID NO: 1459122 - RNA, 23 nt, Pseudomonas aeruginosa PA01
ggcaggccagcuuccaggcgcgc

SEQ ID NO: 1459123 - RNA, 15 nt, Pseudomonas aeruginosa PA01
ggcaggccacggccg

SEQ ID NO: 1459124 - RNA, 16 nt, Pseudomonas aeruginosa PA01
ggcaggccacggccgc

SEQ ID NO: 1459125 - RNA, 20 nt, Pseudomonas aeruginosa PA01
ggcaggccacggccgcugcg

SEQ ID NO: 1459126 - RNA, 15 nt, Pseudomonas aeruginosa PA01
ggcaggccagcaggu

SEQ ID NO: 1459127 - RNA, 14 nt, Pseudomonas aeruginosa PA01
ggcaggcagugccg

SEQ ID NO: 1459128 - RNA, 20 nt, Pseudomonas aeruginosa PA01
ggcaggcaugcggccccggc

SEQ ID NO: 1459129 - RNA, 23 nt, Pseudomonas aeruginosa PA01
ggcaggacgaugaucaccaggac

SEQ ID NO: 1459130 - RNA, 13 nt, Pseudomonas aeruginosa PA01
ggcaggaucaggc

SEQ ID NO: 1459131 - RNA, 14 nt, Pseudomonas aeruginosa PA01
ggcaggaucaggcu

SEQ ID NO: 1459132 - RNA, 21 nt, Pseudomonas aeruginosa PA01
ggcaggaucaggcucgagccg

SEQ ID NO: 1459133 - RNA, 14 nt, Pseudomonas aeruginosa PA01
ggcaggaucggcgc

SEQ ID NO: 1459134 - RNA, 20 nt, Pseudomonas aeruginosa PA01
ggcaggaucggcgcggucgg

SEQ ID NO: 1459135 - RNA, 19 nt, Pseudomonas aeruginosa PA01
ggcaggucguuacgugucg

SEQ ID NO: 1459136 - RNA, 18 nt, Pseudomonas aeruginosa PA01
ggcagugcucgaucaggc

SEQ ID NO: 1459137 - RNA, 20 nt, Pseudomonas aeruginosa PA01
ggcagugcucgaucaggcug

SEQ ID NO: 1459138 - RNA, 24 nt, Pseudomonas aeruginosa PA01
ggcagugcucgaucaggcugugca

SEQ ID NO: 1459139 - RNA, 16 nt, Pseudomonas aeruginosa PA01
ggcaguggcgccagcc

SEQ ID NO: 1459140 - RNA, 19 nt, Pseudomonas aeruginosa PA01
ggcaguggugauccgcacc

SEQ ID NO: 1459141 - RNA, 23 nt, Pseudomonas aeruginosa PA01
ggcaguugcaguaccugcucacg

SEQ ID NO: 1459142 - RNA, 21 nt, Pseudomonas aeruginosa PA01
ggcauaaccggaagcgaucuc

SEQ ID NO: 1459143 - RNA, 15 nt, Pseudomonas aeruginosa PA01
ggcaggugccgcucg

SEQ ID NO: 1459144 - RNA, 15 nt, Pseudomonas aeruginosa PA01
ggcagguggcuggcc

SEQ ID NO: 1459145 - RNA, 12 nt, Pseudomonas aeruginosa PA01
ggcagguggucg

SEQ ID NO: 1459146 - RNA, 15 nt, Pseudomonas aeruginosa PA01
ggcagguggcgcagc

SEQ ID NO: 1459147 - RNA, 16 nt, Pseudomonas aeruginosa PA01
ggcagguuucgcgaua

SEQ ID NO: 1459148 - RNA, 16 nt, Pseudomonas aeruginosa PA01
ggcagguucagcaggu

SEQ ID NO: 1459149 - RNA, 22 nt, Pseudomonas aeruginosa PA01
ggcagguugaugugcaguucga

SEQ ID NO: 1459150 - RNA, 20 nt, Pseudomonas aeruginosa PA01
ggcagguugcacggccggua

SEQ ID NO: 1459151 - RNA, 17 nt, Pseudomonas aeruginosa PA01
ggcagguugcgggagca

SEQ ID NO: 1459152 - RNA, 23 nt, Pseudomonas aeruginosa PA01
ggcagguugugguugggcaggcg

SEQ ID NO: 1459153 - RNA, 16 nt, Pseudomonas aeruginosa PA01
ggcagccgcguugucc

SEQ ID NO: 1459154 - RNA, 15 nt, Pseudomonas aeruginosa PA01
ggcagccgucgguga

SEQ ID NO: 1459155 - RNA, 13 nt, Pseudomonas aeruginosa PA01
ggcagcgaccacc

SEQ ID NO: 1459156 - RNA, 17 nt, Pseudomonas aeruginosa PA01
ggcagcgaccaccacca

SEQ ID NO: 1459157 - RNA, 16 nt, Pseudomonas aeruginosa PA01
ggcagcgagcggguca

SEQ ID NO: 1459158 - RNA, 18 nt, Pseudomonas aeruginosa PA01
ggcagcgagcgggucagc

SEQ ID NO: 1459159 - RNA, 13 nt, Pseudomonas aeruginosa PA01
ggcagccuuggcc

SEQ ID NO: 1459160 - RNA, 16 nt, Pseudomonas aeruginosa PA01
ggcagccuuggccacg

SEQ ID NO: 1459161 - RNA, 17 nt, Pseudomonas aeruginosa PA01
ggcagccuuggccacgg

SEQ ID NO: 1459162 - RNA, 22 nt, Pseudomonas aeruginosa PA01
ggcagccggccaugcuggcgcu

SEQ ID NO: 1459163 - RNA, 14 nt, Pseudomonas aeruginosa PA01
ggcagccguccgcc

SEQ ID NO: 1459164 - RNA, 16 nt, Pseudomonas aeruginosa PA01
ggcagcgccaucaggc

SEQ ID NO: 1459165 - RNA, 19 nt, Pseudomonas aeruginosa PA01
ggcagcgccaucaggcccu

SEQ ID NO: 1459166 - RNA, 18 nt, Pseudomonas aeruginosa PA01
ggcagcgaugccuccggc

SEQ ID NO: 1459167 - RNA, 22 nt, Pseudomonas aeruginosa PA01
ggcagcgauaaccgcguugcgg

SEQ ID NO: 1459168 - RNA, 13 nt, Pseudomonas aeruginosa PA01
ggcagcgaucgcc

SEQ ID NO: 1459169 - RNA, 12 nt, Pseudomonas aeruginosa PA01
ggcagcgccgag

SEQ ID NO: 1459170 - RNA, 14 nt, Pseudomonas aeruginosa PA01
ggcagcgccgaggu

SEQ ID NO: 1459171 - RNA, 18 nt, Pseudomonas aeruginosa PA01
ggcagcgccgaggucuug

SEQ ID NO: 1459172 - RNA, 12 nt, Pseudomonas aeruginosa PA01
ggcagcgccgcc

SEQ ID NO: 1459173 - RNA, 15 nt, Pseudomonas aeruginosa PA01
ggcagcgccgccagc

SEQ ID NO: 1459174 - RNA, 13 nt, Pseudomonas aeruginosa PA01
ggcagcgccgccc

SEQ ID NO: 1459175 - RNA, 14 nt, Pseudomonas aeruginosa PA01
ggcagcgccgccca

SEQ ID NO: 1459176 - RNA, 15 nt, Pseudomonas aeruginosa PA01
ggcagcgccgcccac

SEQ ID NO: 1459177 - RNA, 14 nt, Pseudomonas aeruginosa PA01
ggcagcgccgccgg

SEQ ID NO: 1459178 - RNA, 18 nt, Pseudomonas aeruginosa PA01
ggcagcgccgccgggcgu

SEQ ID NO: 1459179 - RNA, 19 nt, Pseudomonas aeruginosa PA01
ggcagcgccgccgggcgua

SEQ ID NO: 1459180 - RNA, 21 nt, Pseudomonas aeruginosa PA01
ggcaggaaccagacguugcgc

SEQ ID NO: 1459181 - RNA, 18 nt, Pseudomonas aeruginosa PA01
ggcagcuuggcgacgucc

SEQ ID NO: 1459182 - RNA, 20 nt, Pseudomonas aeruginosa PA01
ggcagcucccuugccgccgg

SEQ ID NO: 1459183 - RNA, 21 nt, Pseudomonas aeruginosa PA01
ggcagcgucucggcugccgcc

SEQ ID NO: 1459184 - RNA, 17 nt, Pseudomonas aeruginosa PA01
ggcagcgugcaccagca

SEQ ID NO: 1459185 - RNA, 19 nt, Pseudomonas aeruginosa PA01
ggcagcgugcaccagcagg

SEQ ID NO: 1459186 - RNA, 21 nt, Pseudomonas aeruginosa PA01
ggcagcgugcaccagcaggcg

SEQ ID NO: 1459187 - RNA, 18 nt, Pseudomonas aeruginosa PA01
ggcagcgugcucacggca

SEQ ID NO: 1459188 - RNA, 21 nt, Pseudomonas aeruginosa PA01
ggcagcucgcuaugcagcagg

SEQ ID NO: 1459189 - RNA, 15 nt, Pseudomonas aeruginosa PA01
ggcagcucggccgag

SEQ ID NO: 1459190 - RNA, 21 nt, Pseudomonas aeruginosa PA01
ggcagcucggcgacauagccg

SEQ ID NO: 1459191 - RNA, 20 nt, Pseudomonas aeruginosa PA01
ggcagcucguugcacagcgc

SEQ ID NO: 1459192 - RNA, 22 nt, Pseudomonas aeruginosa PA01
ggcagcucguugcacagcgccc

SEQ ID NO: 1459193 - RNA, 23 nt, Pseudomonas aeruginosa PA01
ggcauucucgcgacccuggccgc

SEQ ID NO: 1459194 - RNA, 20 nt, Pseudomonas aeruginosa PA01
ggcauuggccaucagcgccg

SEQ ID NO: 1459195 - RNA, 21 nt, Pseudomonas aeruginosa PA01
ggcauuggccaucagcgccgc

SEQ ID NO: 1459196 - RNA, 23 nt, Pseudomonas aeruginosa PA01
ggccaacgguagcggaucagccg

SEQ ID NO: 1459197 - RNA, 16 nt, Pseudomonas aeruginosa PA01
ggccaacugagcggcg

SEQ ID NO: 1459198 - RNA, 18 nt, Pseudomonas aeruginosa PA01
ggccaagcuuguugcgca

SEQ ID NO: 1459199 - RNA, 21 nt, Pseudomonas aeruginosa PA01
ggccaagcuuguugcgcaggc

SEQ ID NO: 1459200 - RNA, 22 nt, Pseudomonas aeruginosa PA01
ggccaagcuuguugcgcaggcg

SEQ ID NO: 1459201 - RNA, 16 nt, Pseudomonas aeruginosa PA01
ggccaauugcuccggu

SEQ ID NO: 1459202 - RNA, 15 nt, Pseudomonas aeruginosa PA01
ggcaucagccccucg

SEQ ID NO: 1459203 - RNA, 14 nt, Pseudomonas aeruginosa PA01
ggcauggccgcucc

SEQ ID NO: 1459204 - RNA, 16 nt, Pseudomonas aeruginosa PA01
ggcaucaugccgagca

SEQ ID NO: 1459205 - RNA, 22 nt, Pseudomonas aeruginosa PA01
ggcaucaugccgagcaucagcg

SEQ ID NO: 1459206 - RNA, 13 nt, Pseudomonas aeruginosa PA01
ggcauaccgcccg

SEQ ID NO: 1459207 - RNA, 16 nt, Pseudomonas aeruginosa PA01
ggcauagcgcagccgc

SEQ ID NO: 1459208 - RNA, 17 nt, Pseudomonas aeruginosa PA01
ggcauagcgcagccgcu

SEQ ID NO: 1459209 - RNA, 15 nt, Pseudomonas aeruginosa PA01
ggcauaggcgccagc

SEQ ID NO: 1459210 - RNA, 16 nt, Pseudomonas aeruginosa PA01
ggcauagaugccggcc

SEQ ID NO: 1459211 - RNA, 22 nt, Pseudomonas aeruginosa PA01
ggcauauggaucggccucgcgg

SEQ ID NO: 1459212 - RNA, 21 nt, Pseudomonas aeruginosa PA01
ggcauuccagaaacggcugcc

SEQ ID NO: 1459213 - RNA, 18 nt, Pseudomonas aeruginosa PA01
ggcauuccgggcgaaagc

SEQ ID NO: 1459214 - RNA, 20 nt, Pseudomonas aeruginosa PA01
ggcauuccuccagggucgcc

SEQ ID NO: 1459215 - RNA, 14 nt, Pseudomonas aeruginosa PA01
ggcauuccuggucc

SEQ ID NO: 1459216 - RNA, 17 nt, Pseudomonas aeruginosa PA01
ggcauucgucgccgcug

SEQ ID NO: 1459217 - RNA, 20 nt, Pseudomonas aeruginosa PA01
ggcauucgacccgccgacca

SEQ ID NO: 1459218 - RNA, 16 nt, Pseudomonas aeruginosa PA01
ggcauucgcagcggcc

SEQ ID NO: 1459219 - RNA, 13 nt, Pseudomonas aeruginosa PA01
ggcauucguccag

SEQ ID NO: 1459220 - RNA, 19 nt, Pseudomonas aeruginosa PA01
ggcauucguccagccgccg

SEQ ID NO: 1459221 - RNA, 20 nt, Pseudomonas aeruginosa PA01
ggcauucguccagccgccgc

SEQ ID NO: 1459222 - RNA, 19 nt, Pseudomonas aeruginosa PA01
ggcauucaccagcgacgac

SEQ ID NO: 1459223 - RNA, 22 nt, Pseudomonas aeruginosa PA01
ggcauggcgaucuccgggagca

SEQ ID NO: 1459224 - RNA, 20 nt, Pseudomonas aeruginosa PA01
ggcauggcuuuccaggcgcc

SEQ ID NO: 1459225 - RNA, 21 nt, Pseudomonas aeruginosa PA01
ggcauggcuuuccaggcgccg

SEQ ID NO: 1459226 - RNA, 22 nt, Pseudomonas aeruginosa PA01
ggcauggcuuuccaggcgccgc

SEQ ID NO: 1459227 - RNA, 16 nt, Pseudomonas aeruginosa PA01
ggcauguagcgcgccg

SEQ ID NO: 1459228 - RNA, 13 nt, Pseudomonas aeruginosa PA01
ggcaugggccagu

SEQ ID NO: 1459229 - RNA, 15 nt, Pseudomonas aeruginosa PA01
ggcauguccaccgcc

SEQ ID NO: 1459230 - RNA, 17 nt, Pseudomonas aeruginosa PA01
ggcauguccaccgccgc

SEQ ID NO: 1459231 - RNA, 19 nt, Pseudomonas aeruginosa PA01
ggcauguccaccgccgcca

SEQ ID NO: 1459232 - RNA, 21 nt, Pseudomonas aeruginosa PA01
ggcauguccaccgccgccagc

SEQ ID NO: 1459233 - RNA, 22 nt, Pseudomonas aeruginosa PA01
ggcauguccaccgccgccagca

SEQ ID NO: 1459234 - RNA, 14 nt, Pseudomonas aeruginosa PA01
ggccaccagcagca

SEQ ID NO: 1459235 - RNA, 18 nt, Pseudomonas aeruginosa PA01
ggccaccagagccagccg

SEQ ID NO: 1459236 - RNA, 20 nt, Pseudomonas aeruginosa PA01
ggccaccagagccagccgcg

SEQ ID NO: 1459237 - RNA, 21 nt, Pseudomonas aeruginosa PA01
ggccaccaggcuuacccgcga

SEQ ID NO: 1459238 - RNA, 22 nt, Pseudomonas aeruginosa PA01
ggccaccaucacgucgcgcacc

SEQ ID NO: 1459239 - RNA, 17 nt, Pseudomonas aeruginosa PA01
ggccaccaucagguaga

SEQ ID NO: 1459240 - RNA, 17 nt, Pseudomonas aeruginosa PA01
ggccaccaucgcggcga

SEQ ID NO: 1459241 - RNA, 18 nt, Pseudomonas aeruginosa PA01
ggccaccaucgcggcgau

SEQ ID NO: 1459242 - RNA, 20 nt, Pseudomonas aeruginosa PA01
ggccaccaucgcggcgaugg

SEQ ID NO: 1459243 - RNA, 23 nt, Pseudomonas aeruginosa PA01
ggccaccaucgcggcgauggccg

SEQ ID NO: 1459244 - RNA, 15 nt, Pseudomonas aeruginosa PA01
ggccaccagggugcg

SEQ ID NO: 1459245 - RNA, 13 nt, Pseudomonas aeruginosa PA01
ggccacgccgccg

SEQ ID NO: 1459246 - RNA, 13 nt, Pseudomonas aeruginosa PA01
ggccacgccuucg

SEQ ID NO: 1459247 - RNA, 22 nt, Pseudomonas aeruginosa PA01
ggccacgccuucgggcgaugcg

SEQ ID NO: 1459248 - RNA, 20 nt, Pseudomonas aeruginosa PA01
ggccacgaacugcauggccu

SEQ ID NO: 1459249 - RNA, 21 nt, Pseudomonas aeruginosa PA01
ggccacgacccugcuggccgg

SEQ ID NO: 1459250 - RNA, 17 nt, Pseudomonas aeruginosa PA01
ggccacccgccucgucg

SEQ ID NO: 1459251 - RNA, 16 nt, Pseudomonas aeruginosa PA01
ggccagccccugcgga

SEQ ID NO: 1459252 - RNA, 17 nt, Pseudomonas aeruginosa PA01
ggccagccccugcggac

SEQ ID NO: 1459253 - RNA, 16 nt, Pseudomonas aeruginosa PA01
ggccagcagguagccu

SEQ ID NO: 1459254 - RNA, 14 nt, Pseudomonas aeruginosa PA01
ggccagcagggccg

SEQ ID NO: 1459255 - RNA, 15 nt, Pseudomonas aeruginosa PA01
ggccagcagggccgc

SEQ ID NO: 1459256 - RNA, 23 nt, Pseudomonas aeruginosa PA01
ggccagcaggguggccagggucc

SEQ ID NO: 1459257 - RNA, 19 nt, Pseudomonas aeruginosa PA01
ggccagcaggcuggcggca

SEQ ID NO: 1459258 - RNA, 20 nt, Pseudomonas aeruginosa PA01
ggccagcaggcuggcggcau

SEQ ID NO: 1459259 - RNA, 14 nt, Pseudomonas aeruginosa PA01
ggccagcagcuccg

SEQ ID NO: 1459260 - RNA, 16 nt, Pseudomonas aeruginosa PA01
ggccagcagcuccggg

SEQ ID NO: 1459261 - RNA, 14 nt, Pseudomonas aeruginosa PA01
ggccagcaggccga

SEQ ID NO: 1459262 - RNA, 15 nt, Pseudomonas aeruginosa PA01
ggccagcaggccgag

SEQ ID NO: 1459263 - RNA, 16 nt, Pseudomonas aeruginosa PA01
ggccagcaggccgauc

SEQ ID NO: 1459264 - RNA, 17 nt, Pseudomonas aeruginosa PA01
ggccagcaggccgauca

SEQ ID NO: 1459265 - RNA, 21 nt, Pseudomonas aeruginosa PA01
ggccagcaggccgaucagcgg

SEQ ID NO: 1459266 - RNA, 16 nt, Pseudomonas aeruginosa PA01
ggccagcaggccgugg

SEQ ID NO: 1459267 - RNA, 15 nt, Pseudomonas aeruginosa PA01
ggccagcaggcgccg

SEQ ID NO: 1459268 - RNA, 16 nt, Pseudomonas aeruginosa PA01
ggccagcaggcgccgc

SEQ ID NO: 1459269 - RNA, 18 nt, Pseudomonas aeruginosa PA01
ggccagcaggcgccgcgc

SEQ ID NO: 1459270 - RNA, 16 nt, Pseudomonas aeruginosa PA01
ggccagcaggcgcucg

SEQ ID NO: 1459271 - RNA, 19 nt, Pseudomonas aeruginosa PA01
ggccagcaggcgcucggcg

SEQ ID NO: 1459272 - RNA, 15 nt, Pseudomonas aeruginosa PA01
ggccagccgcuagcg

SEQ ID NO: 1459273 - RNA, 20 nt, Pseudomonas aeruginosa PA01
ggccagccgcgccagugccu

SEQ ID NO: 1459274 - RNA, 17 nt, Pseudomonas aeruginosa PA01
ggccagccgcgcggcau

SEQ ID NO: 1459275 - RNA, 16 nt, Pseudomonas aeruginosa PA01
ggccagcccggagccg

SEQ ID NO: 1459276 - RNA, 13 nt, Pseudomonas aeruginosa PA01
ggccagcccggcc

SEQ ID NO: 1459277 - RNA, 16 nt, Pseudomonas aeruginosa PA01
ggccagcccggccucg

SEQ ID NO: 1459278 - RNA, 16 nt, Pseudomonas aeruginosa PA01
ggccagccggcgccgc

SEQ ID NO: 1459279 - RNA, 14 nt, Pseudomonas aeruginosa PA01
ggccagccguucgc

SEQ ID NO: 1459280 - RNA, 17 nt, Pseudomonas aeruginosa PA01
ggccagcagcggcggcg

SEQ ID NO: 1459281 - RNA, 19 nt, Pseudomonas aeruginosa PA01
ggccagcagcggcggcgcc

SEQ ID NO: 1459282 - RNA, 16 nt, Pseudomonas aeruginosa PA01
ggccagcagcgccucc

SEQ ID NO: 1459283 - RNA, 22 nt, Pseudomonas aeruginosa PA01
ggccacuucguccggccgcccg

SEQ ID NO: 1459284 - RNA, 18 nt, Pseudomonas aeruginosa PA01
ggccagagcuucugcugg

SEQ ID NO: 1459285 - RNA, 16 nt, Pseudomonas aeruginosa PA01
ggccauggcagagcug

SEQ ID NO: 1459286 - RNA, 13 nt, Pseudomonas aeruginosa PA01
ggccaugcgcucg

SEQ ID NO: 1459287 - RNA, 23 nt, Pseudomonas aeruginosa PA01
ggccauggguaucguugaucggc

SEQ ID NO: 1459288 - RNA, 14 nt, Pseudomonas aeruginosa PA01
ggccaugggugucg

SEQ ID NO: 1459289 - RNA, 19 nt, Pseudomonas aeruginosa PA01
ggccaugagguuggccacg

SEQ ID NO: 1459290 - RNA, 17 nt, Pseudomonas aeruginosa PA01
ggccaugaugugcgcag

SEQ ID NO: 1459291 - RNA, 19 nt, Pseudomonas aeruginosa PA01
ggccaugccgccgacgccg

SEQ ID NO: 1459292 - RNA, 14 nt, Pseudomonas aeruginosa PA01
ggccaugcaggcca

SEQ ID NO: 1459293 - RNA, 18 nt, Pseudomonas aeruginosa PA01
ggccaugaccucggccag

SEQ ID NO: 1459294 - RNA, 15 nt, Pseudomonas aeruginosa PA01
ggccaugaucaucgc

SEQ ID NO: 1459295 - RNA, 19 nt, Pseudomonas aeruginosa PA01
ggccaugaucaucgccugc

SEQ ID NO: 1459296 - RNA, 22 nt, Pseudomonas aeruginosa PA01
ggccaugaucaucgccugcugg

SEQ ID NO: 1459297 - RNA, 23 nt, Pseudomonas aeruginosa PA01
ggccaugauccggugcaggccga

SEQ ID NO: 1459298 - RNA, 17 nt, Pseudomonas aeruginosa PA01
ggccaucggcgaagcgg

SEQ ID NO: 1459299 - RNA, 18 nt, Pseudomonas aeruginosa PA01
ggccaucuucucgaagcg

SEQ ID NO: 1459300 - RNA, 22 nt, Pseudomonas aeruginosa PA01
ggccaucuucucgaagcgcgcc

SEQ ID NO: 1459301 - RNA, 18 nt, Pseudomonas aeruginosa PA01
ggccauccccgaggcgac

SEQ ID NO: 1459302 - RNA, 15 nt, Pseudomonas aeruginosa PA01
ggccauccuggccgg

SEQ ID NO: 1459303 - RNA, 18 nt, Pseudomonas aeruginosa PA01
ggccauccuggccggucg

SEQ ID NO: 1459304 - RNA, 18 nt, Pseudomonas aeruginosa PA01
ggccaucgaaaucgccca

SEQ ID NO: 1459305 - RNA, 21 nt, Pseudomonas aeruginosa PA01
ggccaucgaaaucgcccacca

SEQ ID NO: 1459306 - RNA, 24 nt, Pseudomonas aeruginosa PA01
ggccaucgaaaucgcccaccaggu

SEQ ID NO: 1459307 - RNA, 12 nt, Pseudomonas aeruginosa PA01
ggccaucgccgg

SEQ ID NO: 1459308 - RNA, 21 nt, Pseudomonas aeruginosa PA01
ggccaucgccggcccgcgcgg

SEQ ID NO: 1459309 - RNA, 16 nt, Pseudomonas aeruginosa PA01
ggccaucgccgucucg

SEQ ID NO: 1459310 - RNA, 15 nt, Pseudomonas aeruginosa PA01
ggcccacagugccag

SEQ ID NO: 1459311 - RNA, 21 nt, Pseudomonas aeruginosa PA01
ggcccacagugccaggcucgc

SEQ ID NO: 1459312 - RNA, 18 nt, Pseudomonas aeruginosa PA01
ggcccacgcccaucggcg

SEQ ID NO: 1459313 - RNA, 18 nt, Pseudomonas aeruginosa PA01
ggcccacgggcggccgac

SEQ ID NO: 1459314 - RNA, 14 nt, Pseudomonas aeruginosa PA01
ggcccacggcgccu

SEQ ID NO: 1459315 - RNA, 20 nt, Pseudomonas aeruginosa PA01
ggcccagaugaucaggccga

SEQ ID NO: 1459316 - RNA, 22 nt, Pseudomonas aeruginosa PA01
ggcccagaugaucaggccgagc

SEQ ID NO: 1459317 - RNA, 16 nt, Pseudomonas aeruginosa PA01
ggcccagagcagcacc

SEQ ID NO: 1459318 - RNA, 21 nt, Pseudomonas aeruginosa PA01
ggcccagauauccagggccag

SEQ ID NO: 1459319 - RNA, 13 nt, Pseudomonas aeruginosa PA01
ggcccaagccgag

SEQ ID NO: 1459320 - RNA, 15 nt, Pseudomonas aeruginosa PA01
ggcccaagccgagcg

SEQ ID NO: 1459321 - RNA, 14 nt, Pseudomonas aeruginosa PA01
ggcccaauccgcgc

SEQ ID NO: 1459322 - RNA, 21 nt, Pseudomonas aeruginosa PA01
ggcccaccagaggcugaccuu

SEQ ID NO: 1459323 - RNA, 16 nt, Pseudomonas aeruginosa PA01
ggccaugucccgggug

SEQ ID NO: 1459324 - RNA, 16 nt, Pseudomonas aeruginosa PA01
ggccauuacgccgagc

SEQ ID NO: 1459325 - RNA, 17 nt, Pseudomonas aeruginosa PA01
ggccauucggccuggca

SEQ ID NO: 1459326 - RNA, 13 nt, Pseudomonas aeruginosa PA01
ggccauucuucuc

SEQ ID NO: 1459327 - RNA, 22 nt, Pseudomonas aeruginosa PA01
ggccauugcccgguggccuccu

SEQ ID NO: 1459328 - RNA, 15 nt, Pseudomonas aeruginosa PA01
ggccauugccgccag

SEQ ID NO: 1459329 - RNA, 13 nt, Pseudomonas aeruginosa PA01
ggccaggucgcga

SEQ ID NO: 1459330 - RNA, 21 nt, Pseudomonas aeruginosa PA01
ggccagguagcggaccccggc

SEQ ID NO: 1459331 - RNA, 16 nt, Pseudomonas aeruginosa PA01
ggccagguagcggcgu

SEQ ID NO: 1459332 - RNA, 15 nt, Pseudomonas aeruginosa PA01
ggccagguaggcgac

SEQ ID NO: 1459333 - RNA, 22 nt, Pseudomonas aeruginosa PA01
ggccaggucgguccgccgaugc

SEQ ID NO: 1459334 - RNA, 15 nt, Pseudomonas aeruginosa PA01
ggccagguugaccag

SEQ ID NO: 1459335 - RNA, 20 nt, Pseudomonas aeruginosa PA01
ggccaggucguugcgccggc

SEQ ID NO: 1459336 - RNA, 15 nt, Pseudomonas aeruginosa PA01
ggccauagcgcgccg

SEQ ID NO: 1459337 - RNA, 17 nt, Pseudomonas aeruginosa PA01
ggccauagcgcgccggg

SEQ ID NO: 1459338 - RNA, 23 nt, Pseudomonas aeruginosa PA01
ggccaguuggugcacgcgccggg

SEQ ID NO: 1459339 - RNA, 16 nt, Pseudomonas aeruginosa PA01
ggccauaauggccgcu

SEQ ID NO: 1459340 - RNA, 16 nt, Pseudomonas aeruginosa PA01
ggccauagagccgcug

SEQ ID NO: 1459341 - RNA, 12 nt, Pseudomonas aeruginosa PA01
ggccaucagcgc

SEQ ID NO: 1459342 - RNA, 13 nt, Pseudomonas aeruginosa PA01
ggccaucagcgcc

SEQ ID NO: 1459343 - RNA, 14 nt, Pseudomonas aeruginosa PA01
ggccaucagcgcca

SEQ ID NO: 1459344 - RNA, 17 nt, Pseudomonas aeruginosa PA01
ggccaucagcgccgccu

SEQ ID NO: 1459345 - RNA, 19 nt, Pseudomonas aeruginosa PA01
ggccaucagcgccgccucg

SEQ ID NO: 1459346 - RNA, 18 nt, Pseudomonas aeruginosa PA01
ggccaucagggucggccc

SEQ ID NO: 1459347 - RNA, 12 nt, Pseudomonas aeruginosa PA01
ggccaucagcac

SEQ ID NO: 1459348 - RNA, 16 nt, Pseudomonas aeruginosa PA01
ggccaucagcaccagg

SEQ ID NO: 1459349 - RNA, 17 nt, Pseudomonas aeruginosa PA01
ggccaucagcaccagga

SEQ ID NO: 1459350 - RNA, 19 nt, Pseudomonas aeruginosa PA01
ggccaucagugccugcacg

SEQ ID NO: 1459351 - RNA, 19 nt, Pseudomonas aeruginosa PA01
ggccauccagccaggcgcu

SEQ ID NO: 1459352 - RNA, 21 nt, Pseudomonas aeruginosa PA01
ggccauccagccaggcgcucu

SEQ ID NO: 1459353 - RNA, 14 nt, Pseudomonas aeruginosa PA01
ggccaguucgucga

SEQ ID NO: 1459354 - RNA, 16 nt, Pseudomonas aeruginosa PA01
ggccaguucgucgagc

SEQ ID NO: 1459355 - RNA, 18 nt, Pseudomonas aeruginosa PA01
ggccaguucgcggcgcag

SEQ ID NO: 1459356 - RNA, 16 nt, Pseudomonas aeruginosa PA01
ggccaguucggggucg

SEQ ID NO: 1459357 - RNA, 21 nt, Pseudomonas aeruginosa PA01
ggccaguucggggucggccug

SEQ ID NO: 1459358 - RNA, 21 nt, Pseudomonas aeruginosa PA01
ggccagcgcaucgaggccggc

SEQ ID NO: 1459359 - RNA, 19 nt, Pseudomonas aeruginosa PA01
ggccagcgaacccaggccg

SEQ ID NO: 1459360 - RNA, 20 nt, Pseudomonas aeruginosa PA01
ggccagcgaacccaggccgc

SEQ ID NO: 1459361 - RNA, 13 nt, Pseudomonas aeruginosa PA01
ggccagcgccagg

SEQ ID NO: 1459362 - RNA, 14 nt, Pseudomonas aeruginosa PA01
ggccagcgccaggu

SEQ ID NO: 1459363 - RNA, 19 nt, Pseudomonas aeruginosa PA01
ggccagccuggccagcgcu

SEQ ID NO: 1459364 - RNA, 11 nt, Pseudomonas aeruginosa PA01
ggccagcgcca

SEQ ID NO: 1459365 - RNA, 19 nt, Pseudomonas aeruginosa PA01
ggccagcgccaccagcagg

SEQ ID NO: 1459366 - RNA, 20 nt, Pseudomonas aeruginosa PA01
ggccagcgccaccagcaggg

SEQ ID NO: 1459367 - RNA, 21 nt, Pseudomonas aeruginosa PA01
ggccaggcucgguucugcgca

SEQ ID NO: 1459368 - RNA, 21 nt, Pseudomonas aeruginosa PA01
ggccagggaaaagcccaggug

SEQ ID NO: 1459369 - RNA, 22 nt, Pseudomonas aeruginosa PA01
ggccagggaaaagcccaggugg

SEQ ID NO: 1459370 - RNA, 13 nt, Pseudomonas aeruginosa PA01
ggccagggaggcg

SEQ ID NO: 1459371 - RNA, 13 nt, Pseudomonas aeruginosa PA01
ggccagcgccgcc

SEQ ID NO: 1459372 - RNA, 20 nt, Pseudomonas aeruginosa PA01
ggccagguauucgcgcucgg

SEQ ID NO: 1459373 - RNA, 14 nt, Pseudomonas aeruginosa PA01
ggccagguccgaac

SEQ ID NO: 1459374 - RNA, 17 nt, Pseudomonas aeruginosa PA01
ggccagguaccggccag

SEQ ID NO: 1459375 - RNA, 23 nt, Pseudomonas aeruginosa PA01
ggccagguacuuggccacgccuu

SEQ ID NO: 1459376 - RNA, 17 nt, Pseudomonas aeruginosa PA01
ggccaggggagcgccgg

SEQ ID NO: 1459377 - RNA, 23 nt, Pseudomonas aeruginosa PA01
ggccaggguccgcuucagcgcgc

SEQ ID NO: 1459378 - RNA, 16 nt, Pseudomonas aeruginosa PA01
ggccagggucgccagc

SEQ ID NO: 1459379 - RNA, 17 nt, Pseudomonas aeruginosa PA01
ggccagggucgccagca

SEQ ID NO: 1459380 - RNA, 22 nt, Pseudomonas aeruginosa PA01
ggccaggggcugaacagcgcca

SEQ ID NO: 1459381 - RNA, 17 nt, Pseudomonas aeruginosa PA01
ggccagggggccuggcu

SEQ ID NO: 1459382 - RNA, 23 nt, Pseudomonas aeruginosa PA01
ggccagggcaugggucagcgcca

SEQ ID NO: 1459383 - RNA, 14 nt, Pseudomonas aeruginosa PA01
ggccagggcgcggu

SEQ ID NO: 1459384 - RNA, 12 nt, Pseudomonas aeruginosa PA01
ggccagggcggc

SEQ ID NO: 1459385 - RNA, 16 nt, Pseudomonas aeruginosa PA01
ggccagggcggcgccg

SEQ ID NO: 1459386 - RNA, 17 nt, Pseudomonas aeruginosa PA01
ggccagggcggcgccga

SEQ ID NO: 1459387 - RNA, 20 nt, Pseudomonas aeruginosa PA01
ggccagggaggcgcuggcca

SEQ ID NO: 1459388 - RNA, 23 nt, Pseudomonas aeruginosa PA01
ggccagggaggcgcuggccagcg

SEQ ID NO: 1459389 - RNA, 23 nt, Pseudomonas aeruginosa PA01
ggccagggagucgcuggccaucu

SEQ ID NO: 1459390 - RNA, 22 nt, Pseudomonas aeruginosa PA01
ggccagggccgcucgagggcga

SEQ ID NO: 1459391 - RNA, 19 nt, Pseudomonas aeruginosa PA01
ggccagggcgaggaucacg

SEQ ID NO: 1459392 - RNA, 24 nt, Pseudomonas aeruginosa PA01
ggccagggcgaggaucacgcagca

SEQ ID NO: 1459393 - RNA, 14 nt, Pseudomonas aeruginosa PA01
ggccagggcgaggc

SEQ ID NO: 1459394 - RNA, 23 nt, Pseudomonas aeruginosa PA01
ggcccgcaugaacgccucgccaa

SEQ ID NO: 1459395 - RNA, 19 nt, Pseudomonas aeruginosa PA01
ggcccgccacagaucgcca

SEQ ID NO: 1459396 - RNA, 12 nt, Pseudomonas aeruginosa PA01
ggcccgccgcgg

SEQ ID NO: 1459397 - RNA, 13 nt, Pseudomonas aeruginosa PA01
ggcccgccgcggc

SEQ ID NO: 1459398 - RNA, 21 nt, Pseudomonas aeruginosa PA01
ggcccgccggucaaccgcggg

SEQ ID NO: 1459399 - RNA, 14 nt, Pseudomonas aeruginosa PA01
ggcccgcgagccgc

SEQ ID NO: 1459400 - RNA, 16 nt, Pseudomonas aeruginosa PA01
ggcccgcgagccgcgc

SEQ ID NO: 1459401 - RNA, 15 nt, Pseudomonas aeruginosa PA01
ggcccgccucggcgg

SEQ ID NO: 1459402 - RNA, 14 nt, Pseudomonas aeruginosa PA01
ggcccggcgcggcg

SEQ ID NO: 1459403 - RNA, 19 nt, Pseudomonas aeruginosa PA01
ggcccggcgcggcggccgc

SEQ ID NO: 1459404 - RNA, 16 nt, Pseudomonas aeruginosa PA01
ggcccggcgcugcccg

SEQ ID NO: 1459405 - RNA, 22 nt, Pseudomonas aeruginosa PA01
ggcccggcgcugcuucuugucg

SEQ ID NO: 1459406 - RNA, 13 nt, Pseudomonas aeruginosa PA01
ggcccggcgcggc

SEQ ID NO: 1459407 - RNA, 16 nt, Pseudomonas aeruginosa PA01
ggcccgguuggccagg

SEQ ID NO: 1459408 - RNA, 22 nt, Pseudomonas aeruginosa PA01
ggcccgguggaauaccgcugcg

SEQ ID NO: 1459409 - RNA, 14 nt, Pseudomonas aeruginosa PA01
ggcccggccaggcg

SEQ ID NO: 1459410 - RNA, 16 nt, Pseudomonas aeruginosa PA01
ggcccggccaggcgau

SEQ ID NO: 1459411 - RNA, 16 nt, Pseudomonas aeruginosa PA01
ggcccggccagguagg

SEQ ID NO: 1459412 - RNA, 21 nt, Pseudomonas aeruginosa PA01
ggcccggccagguaggcgacg

SEQ ID NO: 1459413 - RNA, 14 nt, Pseudomonas aeruginosa PA01
ggcccggcaggcag

SEQ ID NO: 1459414 - RNA, 14 nt, Pseudomonas aeruginosa PA01
ggcccggcaggcgc

SEQ ID NO: 1459415 - RNA, 15 nt, Pseudomonas aeruginosa PA01
ggcccggcaggcgca

SEQ ID NO: 1459416 - RNA, 17 nt, Pseudomonas aeruginosa PA01
ggcccggagaccgugcc

SEQ ID NO: 1459417 - RNA, 18 nt, Pseudomonas aeruginosa PA01
ggcccggagaucgccgcg

SEQ ID NO: 1459418 - RNA, 20 nt, Pseudomonas aeruginosa PA01
ggcccggagccaacgcccgg

SEQ ID NO: 1459419 - RNA, 17 nt, Pseudomonas aeruginosa PA01
ggcccgcgccgccggua

SEQ ID NO: 1459420 - RNA, 22 nt, Pseudomonas aeruginosa PA01
ggcccgcgccgccucgauggcg

SEQ ID NO: 1459421 - RNA, 14 nt, Pseudomonas aeruginosa PA01
ggcccagcagcgcu

SEQ ID NO: 1459422 - RNA, 16 nt, Pseudomonas aeruginosa PA01
ggcccagcagcgcuca

SEQ ID NO: 1459423 - RNA, 17 nt, Pseudomonas aeruginosa PA01
ggcccagcaggccggcc

SEQ ID NO: 1459424 - RNA, 15 nt, Pseudomonas aeruginosa PA01
ggcccagccgcggcg

SEQ ID NO: 1459425 - RNA, 17 nt, Pseudomonas aeruginosa PA01
ggcccagccgcggcgcc

SEQ ID NO: 1459426 - RNA, 17 nt, Pseudomonas aeruginosa PA01
ggccccagcacuggugg

SEQ ID NO: 1459427 - RNA, 18 nt, Pseudomonas aeruginosa PA01
ggcccagccauugcgcca

SEQ ID NO: 1459428 - RNA, 17 nt, Pseudomonas aeruginosa PA01
ggccccagggccggcgc

SEQ ID NO: 1459429 - RNA, 12 nt, Pseudomonas aeruginosa PA01
ggccccagcgcg

SEQ ID NO: 1459430 - RNA, 18 nt, Pseudomonas aeruginosa PA01
ggcccccacggaggccuu

SEQ ID NO: 1459431 - RNA, 14 nt, Pseudomonas aeruginosa PA01
ggccccaggccgcc

SEQ ID NO: 1459432 - RNA, 21 nt, Pseudomonas aeruginosa PA01
ggcccgacccacuugaacacc

SEQ ID NO: 1459433 - RNA, 12 nt, Pseudomonas aeruginosa PA01
ggcccgaaggcc

SEQ ID NO: 1459434 - RNA, 19 nt, Pseudomonas aeruginosa PA01
ggccccggcgauccgcgca

SEQ ID NO: 1459435 - RNA, 15 nt, Pseudomonas aeruginosa PA01
ggccccggcgcucgc

SEQ ID NO: 1459436 - RNA, 13 nt, Pseudomonas aeruginosa PA01
ggccccuccaccu

SEQ ID NO: 1459437 - RNA, 19 nt, Pseudomonas aeruginosa PA01
ggcccguauggcgggccuu

SEQ ID NO: 1459438 - RNA, 12 nt, Pseudomonas aeruginosa PA01
ggcccguccgcg

SEQ ID NO: 1459439 - RNA, 15 nt, Pseudomonas aeruginosa PA01
ggcccguccgcgcca

SEQ ID NO: 1459440 - RNA, 14 nt, Pseudomonas aeruginosa PA01
ggcccgugcggcac

SEQ ID NO: 1459441 - RNA, 19 nt, Pseudomonas aeruginosa PA01
ggcccgugcggcacgcugc

SEQ ID NO: 1459442 - RNA, 19 nt, Pseudomonas aeruginosa PA01
ggcccguuccaccgccugg

SEQ ID NO: 1459443 - RNA, 13 nt, Pseudomonas aeruginosa PA01
ggcccuccaggcg

SEQ ID NO: 1459444 - RNA, 15 nt, Pseudomonas aeruginosa PA01
ggcccuccaggcgaa

SEQ ID NO: 1459445 - RNA, 14 nt, Pseudomonas aeruginosa PA01
ggcccuccauccag

SEQ ID NO: 1459446 - RNA, 20 nt, Pseudomonas aeruginosa PA01
ggcccuccauccagucuucg

SEQ ID NO: 1459447 - RNA, 21 nt, Pseudomonas aeruginosa PA01
ggcccuccauccagucuucgc

SEQ ID NO: 1459448 - RNA, 23 nt, Pseudomonas aeruginosa PA01
ggcccuccauccagucuucgccg

SEQ ID NO: 1459449 - RNA, 19 nt, Pseudomonas aeruginosa PA01
ggcccucagcggcggugcg

SEQ ID NO: 1459450 - RNA, 16 nt, Pseudomonas aeruginosa PA01
ggccgacaccucgauc

SEQ ID NO: 1459451 - RNA, 14 nt, Pseudomonas aeruginosa PA01
ggcccucggcgacc

SEQ ID NO: 1459452 - RNA, 16 nt, Pseudomonas aeruginosa PA01
ggcccucggcgccgag

SEQ ID NO: 1459453 - RNA, 14 nt, Pseudomonas aeruginosa PA01
ggcccucggcggcg

SEQ ID NO: 1459454 - RNA, 13 nt, Pseudomonas aeruginosa PA01
ggccgacagcggc

SEQ ID NO: 1459455 - RNA, 15 nt, Pseudomonas aeruginosa PA01
ggccgacagcggcug

SEQ ID NO: 1459456 - RNA, 18 nt, Pseudomonas aeruginosa PA01
ggccgacagcggcuggcg

SEQ ID NO: 1459457 - RNA, 16 nt, Pseudomonas aeruginosa PA01
ggccgaccagcgccga

SEQ ID NO: 1459458 - RNA, 17 nt, Pseudomonas aeruginosa PA01
ggccgaccagcgccgac

SEQ ID NO: 1459459 - RNA, 19 nt, Pseudomonas aeruginosa PA01
ggccgaccagcgccgacuu

SEQ ID NO: 1459460 - RNA, 13 nt, Pseudomonas aeruginosa PA01
ggccgaccaggcc

SEQ ID NO: 1459461 - RNA, 15 nt, Pseudomonas aeruginosa PA01
ggccgaccaggccgu

SEQ ID NO: 1459462 - RNA, 20 nt, Pseudomonas aeruginosa PA01
ggccgaccaggugcuggucg

SEQ ID NO: 1459463 - RNA, 12 nt, Pseudomonas aeruginosa PA01
ggccgaccagca

SEQ ID NO: 1459464 - RNA, 20 nt, Pseudomonas aeruginosa PA01
ggccgacagagcggccggcg

SEQ ID NO: 1459465 - RNA, 15 nt, Pseudomonas aeruginosa PA01
ggccgagcaucagca

SEQ ID NO: 1459466 - RNA, 20 nt, Pseudomonas aeruginosa PA01
ggccgagcccagcggcaggg

SEQ ID NO: 1459467 - RNA, 14 nt, Pseudomonas aeruginosa PA01
ggccgagccccggu

SEQ ID NO: 1459468 - RNA, 13 nt, Pseudomonas aeruginosa PA01
ggccgagcagcgc

SEQ ID NO: 1459469 - RNA, 14 nt, Pseudomonas aeruginosa PA01
ggccgagcagcgcc

SEQ ID NO: 1459470 - RNA, 16 nt, Pseudomonas aeruginosa PA01
ggccgagcagcgccag

SEQ ID NO: 1459471 - RNA, 17 nt, Pseudomonas aeruginosa PA01
ggccgagcagcgccagc

SEQ ID NO: 1459472 - RNA, 18 nt, Pseudomonas aeruginosa PA01
ggccgagcagcgccagcc

SEQ ID NO: 1459473 - RNA, 19 nt, Pseudomonas aeruginosa PA01
ggccgagcagcgccagcca

SEQ ID NO: 1459474 - RNA, 15 nt, Pseudomonas aeruginosa PA01
ggccgagcaggcgcg

SEQ ID NO: 1459475 - RNA, 16 nt, Pseudomonas aeruginosa PA01
ggccgagcaggcgcgc

SEQ ID NO: 1459476 - RNA, 17 nt, Pseudomonas aeruginosa PA01
ggccgagcaggcgcgcc

SEQ ID NO: 1459477 - RNA, 18 nt, Pseudomonas aeruginosa PA01
ggccgagcaggcgcgcca

SEQ ID NO: 1459478 - RNA, 21 nt, Pseudomonas aeruginosa PA01
ggccgagcaggcgcgccaggc

SEQ ID NO: 1459479 - RNA, 18 nt, Pseudomonas aeruginosa PA01
ggccgacgugcacccgcu

SEQ ID NO: 1459480 - RNA, 16 nt, Pseudomonas aeruginosa PA01
ggccgacggcccuccg

SEQ ID NO: 1459481 - RNA, 13 nt, Pseudomonas aeruginosa PA01
ggccgacucgcga

SEQ ID NO: 1459482 - RNA, 17 nt, Pseudomonas aeruginosa PA01
ggccgacguccaucagc

SEQ ID NO: 1459483 - RNA, 14 nt, Pseudomonas aeruginosa PA01
ggccgacggcgcgc

SEQ ID NO: 1459484 - RNA, 18 nt, Pseudomonas aeruginosa PA01
ggccgaccagcagggcca

SEQ ID NO: 1459485 - RNA, 20 nt, Pseudomonas aeruginosa PA01
ggccgaccagcagggccagc

SEQ ID NO: 1459486 - RNA, 23 nt, Pseudomonas aeruginosa PA01
ggccgagaagguucucggccacc

SEQ ID NO: 1459487 - RNA, 19 nt, Pseudomonas aeruginosa PA01
ggccgagaccgcagcccag

SEQ ID NO: 1459488 - RNA, 20 nt, Pseudomonas aeruginosa PA01
ggccgagaccgcagcccagu

SEQ ID NO: 1459489 - RNA, 18 nt, Pseudomonas aeruginosa PA01
ggccgagauccugcagca

SEQ ID NO: 1459490 - RNA, 21 nt, Pseudomonas aeruginosa PA01
ggccgagauccugcagcaguu

SEQ ID NO: 1459491 - RNA, 18 nt, Pseudomonas aeruginosa PA01
ggccgagcaauccggcgc

SEQ ID NO: 1459492 - RNA, 23 nt, Pseudomonas aeruginosa PA01
ggccgagcaauccggcgcugccg

SEQ ID NO: 1459493 - RNA, 17 nt, Pseudomonas aeruginosa PA01
ggccgagcaccacgcgc

SEQ ID NO: 1459494 - RNA, 15 nt, Pseudomonas aeruginosa PA01
ggccgagcaccggca

SEQ ID NO: 1459495 - RNA, 22 nt, Pseudomonas aeruginosa PA01
ggccgagcaccggcaggacgau

SEQ ID NO: 1459496 - RNA, 15 nt, Pseudomonas aeruginosa PA01
ggccgagcugccgca

SEQ ID NO: 1459497 - RNA, 21 nt, Pseudomonas aeruginosa PA01
ggccgagcugccgcaccgccu

SEQ ID NO: 1459498 - RNA, 14 nt, Pseudomonas aeruginosa PA01
ggccgagcugcucg

SEQ ID NO: 1459499 - RNA, 18 nt, Pseudomonas aeruginosa PA01
ggccgagcugcucgaagc

SEQ ID NO: 1459500 - RNA, 22 nt, Pseudomonas aeruginosa PA01
ggccgagcgugcgcaugcccgc

SEQ ID NO: 1459501 - RNA, 16 nt, Pseudomonas aeruginosa PA01
ggccgagcgcgccgcc

SEQ ID NO: 1459502 - RNA, 15 nt, Pseudomonas aeruginosa PA01
ggccgagcgcgccgc

SEQ ID NO: 1459503 - RNA, 13 nt, Pseudomonas aeruginosa PA01
ggccgagcgccag

SEQ ID NO: 1459504 - RNA, 15 nt, Pseudomonas aeruginosa PA01
ggccgagcgccgccu

SEQ ID NO: 1459505 - RNA, 12 nt, Pseudomonas aeruginosa PA01
ggccgagcgcgc

SEQ ID NO: 1459506 - RNA, 22 nt, Pseudomonas aeruginosa PA01
ggccgagcgcagcgccaccagg

SEQ ID NO: 1459507 - RNA, 14 nt, Pseudomonas aeruginosa PA01
ggccgagccggcau

SEQ ID NO: 1459508 - RNA, 13 nt, Pseudomonas aeruginosa PA01
ggccgaggucgag

SEQ ID NO: 1459509 - RNA, 14 nt, Pseudomonas aeruginosa PA01
ggccgaggucgagg

SEQ ID NO: 1459510 - RNA, 15 nt, Pseudomonas aeruginosa PA01
ggccgaggucggcgg

SEQ ID NO: 1459511 - RNA, 17 nt, Pseudomonas aeruginosa PA01
ggccgaggucggcggcg

SEQ ID NO: 1459512 - RNA, 18 nt, Pseudomonas aeruginosa PA01
ggccgaggucggcggcgg

SEQ ID NO: 1459513 - RNA, 21 nt, Pseudomonas aeruginosa PA01
ggccgaggucggcggcgggga

SEQ ID NO: 1459514 - RNA, 14 nt, Pseudomonas aeruginosa PA01
ggccgaggcuuccu

SEQ ID NO: 1459515 - RNA, 22 nt, Pseudomonas aeruginosa PA01
ggccgagggcgaguucggcgag

SEQ ID NO: 1459516 - RNA, 15 nt, Pseudomonas aeruginosa PA01
ggccgagggcgcgca

SEQ ID NO: 1459517 - RNA, 16 nt, Pseudomonas aeruginosa PA01
ggccgagggcgcgcag

SEQ ID NO: 1459518 - RNA, 13 nt, Pseudomonas aeruginosa PA01
ggccgagggcugc

SEQ ID NO: 1459519 - RNA, 17 nt, Pseudomonas aeruginosa PA01
ggccgagggcugccgcc

SEQ ID NO: 1459520 - RNA, 23 nt, Pseudomonas aeruginosa PA01
ggccgagggugaucagccgaggu

SEQ ID NO: 1459521 - RNA, 22 nt, Pseudomonas aeruginosa PA01
ggccgaggaaggcgcuggcgcu

SEQ ID NO: 1459522 - RNA, 13 nt, Pseudomonas aeruginosa PA01
ggccgagcgggaa

SEQ ID NO: 1459523 - RNA, 15 nt, Pseudomonas aeruginosa PA01
ggccgaggacccggc

SEQ ID NO: 1459524 - RNA, 18 nt, Pseudomonas aeruginosa PA01
ggccgaggacccggcgga

SEQ ID NO: 1459525 - RNA, 15 nt, Pseudomonas aeruginosa PA01
ggccgaggccggcga

SEQ ID NO: 1459526 - RNA, 17 nt, Pseudomonas aeruginosa PA01
ggccgaggccggcgaag

SEQ ID NO: 1459527 - RNA, 18 nt, Pseudomonas aeruginosa PA01
ggccgaggccggcgaagu

SEQ ID NO: 1459528 - RNA, 16 nt, Pseudomonas aeruginosa PA01
ggccgaggaggccagc

SEQ ID NO: 1459529 - RNA, 21 nt, Pseudomonas aeruginosa PA01
ggccgaggaggccagcagcag

SEQ ID NO: 1459530 - RNA, 19 nt, Pseudomonas aeruginosa PA01
ggccgaggaugcucgccug

SEQ ID NO: 1459531 - RNA, 22 nt, Pseudomonas aeruginosa PA01
ggcggcgguucgccgagcgccg

SEQ ID NO: 1459532 - RNA, 16 nt, Pseudomonas aeruginosa PA01
ggcggcggccugcucg

SEQ ID NO: 1459533 - RNA, 18 nt, Pseudomonas aeruginosa PA01
ggcggcggggaaggcguc

SEQ ID NO: 1459534 - RNA, 17 nt, Pseudomonas aeruginosa PA01
ggcggcggucaucgcgc

SEQ ID NO: 1459535 - RNA, 18 nt, Pseudomonas aeruginosa PA01
ggcggcgucccggcgccg

SEQ ID NO: 1459536 - RNA, 16 nt, Pseudomonas aeruginosa PA01
ggcggcgugcaggccg

SEQ ID NO: 1459537 - RNA, 20 nt, Pseudomonas aeruginosa PA01
ggcggcguggcucgaucagc

SEQ ID NO: 1459538 - RNA, 21 nt, Pseudomonas aeruginosa PA01
ggcggcguggcucgaucagcc

SEQ ID NO: 1459539 - RNA, 14 nt, Pseudomonas aeruginosa PA01
ggcggcguuggccg

SEQ ID NO: 1459540 - RNA, 16 nt, Pseudomonas aeruginosa PA01
ggcggcguuggccgag

SEQ ID NO: 1459541 - RNA, 15 nt, Pseudomonas aeruginosa PA01
ggcggcucaggccgc

SEQ ID NO: 1459542 - RNA, 16 nt, Pseudomonas aeruginosa PA01
ggcggcucaggccgcc

SEQ ID NO: 1459543 - RNA, 17 nt, Pseudomonas aeruginosa PA01
ggcggcucaggccgccg

SEQ ID NO: 1459544 - RNA, 16 nt, Pseudomonas aeruginosa PA01
ggcggcuaccagcgcu

SEQ ID NO: 1459545 - RNA, 17 nt, Pseudomonas aeruginosa PA01
ggcggcucaacgggacc

SEQ ID NO: 1459546 - RNA, 16 nt, Pseudomonas aeruginosa PA01
ggcggcuccggcgcca

SEQ ID NO: 1459547 - RNA, 17 nt, Pseudomonas aeruginosa PA01
ggcggcuccggcgccag

SEQ ID NO: 1459548 - RNA, 20 nt, Pseudomonas aeruginosa PA01
ggcgggagagggcggcgacc

SEQ ID NO: 1459549 - RNA, 22 nt, Pseudomonas aeruginosa PA01
ggcgggagagggcggcgaccgg

SEQ ID NO: 1459550 - RNA, 12 nt, Pseudomonas aeruginosa PA01
ggcggcgccgaa

SEQ ID NO: 1459551 - RNA, 14 nt, Pseudomonas aeruginosa PA01
ggcggcgccgaaca

SEQ ID NO: 1459552 - RNA, 23 nt, Pseudomonas aeruginosa PA01
ggcggcgccaccgcgacgcgcug

SEQ ID NO: 1459553 - RNA, 16 nt, Pseudomonas aeruginosa PA01
ggcggcgccaggccgg

SEQ ID NO: 1459554 - RNA, 16 nt, Pseudomonas aeruginosa PA01
ggcggcgacgcuggcg

SEQ ID NO: 1459555 - RNA, 13 nt, Pseudomonas aeruginosa PA01
ggcggcgaaggcc

SEQ ID NO: 1459556 - RNA, 15 nt, Pseudomonas aeruginosa PA01
ggcggcgaaggccgc

SEQ ID NO: 1459557 - RNA, 19 nt, Pseudomonas aeruginosa PA01
ggcggcgaccugcggcaag

SEQ ID NO: 1459558 - RNA, 19 nt, Pseudomonas aeruginosa PA01
ggcggcgacccagaccugc

SEQ ID NO: 1459559 - RNA, 21 nt, Pseudomonas aeruginosa PA01
ggcggccuuuucggcggccag

SEQ ID NO: 1459560 - RNA, 16 nt, Pseudomonas aeruginosa PA01
ggcggcgaaagccauc

SEQ ID NO: 1459561 - RNA, 17 nt, Pseudomonas aeruginosa PA01
ggcggcgaacggaccga

SEQ ID NO: 1459562 - RNA, 22 nt, Pseudomonas aeruginosa PA01
ggcggcgccggugaggcgcagc

SEQ ID NO: 1459563 - RNA, 14 nt, Pseudomonas aeruginosa PA01
ggcggcgccggcag

SEQ ID NO: 1459564 - RNA, 15 nt, Pseudomonas aeruginosa PA01
ggcggcgccggcagg

SEQ ID NO: 1459565 - RNA, 18 nt, Pseudomonas aeruginosa PA01
ggcggcggauaacgccug

SEQ ID NO: 1459566 - RNA, 17 nt, Pseudomonas aeruginosa PA01
ggcggcgccuucgccgg

SEQ ID NO: 1459567 - RNA, 20 nt, Pseudomonas aeruginosa PA01
ggcggcgccuugcgguccag

SEQ ID NO: 1459568 - RNA, 14 nt, Pseudomonas aeruginosa PA01
ggcggcggccgcau

SEQ ID NO: 1459569 - RNA, 11 nt, Pseudomonas aeruginosa PA01
ggcggcggccc

SEQ ID NO: 1459570 - RNA, 18 nt, Pseudomonas aeruginosa PA01
ggcggcggcccgcacagg

SEQ ID NO: 1459571 - RNA, 14 nt, Pseudomonas aeruginosa PA01
ggcggcgggccggc

SEQ ID NO: 1459572 - RNA, 20 nt, Pseudomonas aeruginosa PA01
ggcggcgggccggcguccag

SEQ ID NO: 1459573 - RNA, 21 nt, Pseudomonas aeruginosa PA01
ggcggcgggccggcguccagg

SEQ ID NO: 1459574 - RNA, 16 nt, Pseudomonas aeruginosa PA01
ggcggcggcguuggcc

SEQ ID NO: 1459575 - RNA, 18 nt, Pseudomonas aeruginosa PA01
ggcggcggcucaggccgc

SEQ ID NO: 1459576 - RNA, 18 nt, Pseudomonas aeruginosa PA01
ggcggacaacccggcgcu

SEQ ID NO: 1459577 - RNA, 22 nt, Pseudomonas aeruginosa PA01
ggcggacaacccggcgcuggcc

SEQ ID NO: 1459578 - RNA, 24 nt, Pseudomonas aeruginosa PA01
ggcggacaacccggcgcuggccgc

SEQ ID NO: 1459579 - RNA, 18 nt, Pseudomonas aeruginosa PA01
ggcggaacuugucgccgc

SEQ ID NO: 1459580 - RNA, 19 nt, Pseudomonas aeruginosa PA01
ggcggaacuugucgccgcu

SEQ ID NO: 1459581 - RNA, 17 nt, Pseudomonas aeruginosa PA01
ggcgcuguaggcgagca

SEQ ID NO: 1459582 - RNA, 22 nt, Pseudomonas aeruginosa PA01
ggcgcuuuuuucuugccgccag

SEQ ID NO: 1459583 - RNA, 20 nt, Pseudomonas aeruginosa PA01
ggcggaaauacggcuccggc

SEQ ID NO: 1459584 - RNA, 19 nt, Pseudomonas aeruginosa PA01
ggcggaaauacuccgcgug

SEQ ID NO: 1459585 - RNA, 23 nt, Pseudomonas aeruginosa PA01
ggcggcacgaccacaucggccag

SEQ ID NO: 1459586 - RNA, 16 nt, Pseudomonas aeruginosa PA01
ggcggcacccucuucc

SEQ ID NO: 1459587 - RNA, 23 nt, Pseudomonas aeruginosa PA01
ggcggcacgcuccagaucgccgu

SEQ ID NO: 1459588 - RNA, 17 nt, Pseudomonas aeruginosa PA01
ggcggcacuccaggaac

SEQ ID NO: 1459589 - RNA, 14 nt, Pseudomonas aeruginosa PA01
ggcggcacucggcg

SEQ ID NO: 1459590 - RNA, 15 nt, Pseudomonas aeruginosa PA01
ggcggcacucggcga

SEQ ID NO: 1459591 - RNA, 17 nt, Pseudomonas aeruginosa PA01
ggcggcacucggcgacc

SEQ ID NO: 1459592 - RNA, 18 nt, Pseudomonas aeruginosa PA01
ggcggcacucggcgacca

SEQ ID NO: 1459593 - RNA, 13 nt, Pseudomonas aeruginosa PA01
ggcggcagccgcg

SEQ ID NO: 1459594 - RNA, 14 nt, Pseudomonas aeruginosa PA01
ggcggcagccgcgg

SEQ ID NO: 1459595 - RNA, 15 nt, Pseudomonas aeruginosa PA01
ggcggcagccgcggc

SEQ ID NO: 1459596 - RNA, 12 nt, Pseudomonas aeruginosa PA01
ggcggcaggcca

SEQ ID NO: 1459597 - RNA, 14 nt, Pseudomonas aeruginosa PA01
ggcggcaggccagc

SEQ ID NO: 1459598 - RNA, 13 nt, Pseudomonas aeruginosa PA01
ggcggcaggccga

SEQ ID NO: 1459599 - RNA, 20 nt, Pseudomonas aeruginosa PA01
ggcggcagcugcggcggcac

SEQ ID NO: 1459600 - RNA, 14 nt, Pseudomonas aeruginosa PA01
ggcggcaucgcgua

SEQ ID NO: 1459601 - RNA, 14 nt, Pseudomonas aeruginosa PA01
ggcggcaucggcgc

SEQ ID NO: 1459602 - RNA, 15 nt, Pseudomonas aeruginosa PA01
ggcggcaucggcgcc

SEQ ID NO: 1459603 - RNA, 17 nt, Pseudomonas aeruginosa PA01
ggcggcaucggcgccgc

SEQ ID NO: 1459604 - RNA, 12 nt, Pseudomonas aeruginosa PA01
ggcggcaggcgc

SEQ ID NO: 1459605 - RNA, 16 nt, Pseudomonas aeruginosa PA01
ggcggcaggcgccggc

SEQ ID NO: 1459606 - RNA, 16 nt, Pseudomonas aeruginosa PA01
ggcggcaucaguagcg

SEQ ID NO: 1459607 - RNA, 12 nt, Pseudomonas aeruginosa PA01
ggcggcaggcug

SEQ ID NO: 1459608 - RNA, 13 nt, Pseudomonas aeruginosa PA01
ggcggcaggcugc

SEQ ID NO: 1459609 - RNA, 14 nt, Pseudomonas aeruginosa PA01
ggcggcaggcugcg

SEQ ID NO: 1459610 - RNA, 15 nt, Pseudomonas aeruginosa PA01
ggcggcaggcugcgc

SEQ ID NO: 1459611 - RNA, 16 nt, Pseudomonas aeruginosa PA01
ggcggccagccuuccu

SEQ ID NO: 1459612 - RNA, 13 nt, Pseudomonas aeruginosa PA01
ggcggccaggcgg

SEQ ID NO: 1459613 - RNA, 14 nt, Pseudomonas aeruginosa PA01
ggcggccaggcggc

SEQ ID NO: 1459614 - RNA, 20 nt, Pseudomonas aeruginosa PA01
ggcggccgacgugcacccgc

SEQ ID NO: 1459615 - RNA, 21 nt, Pseudomonas aeruginosa PA01
ggcggccgacgugcacccgcu

SEQ ID NO: 1459616 - RNA, 23 nt, Pseudomonas aeruginosa PA01
ggcggcccugguugcggaacggc

SEQ ID NO: 1459617 - RNA, 23 nt, Pseudomonas aeruginosa PA01
ggcggccgaacuggaugauggua

SEQ ID NO: 1459618 - RNA, 21 nt, Pseudomonas aeruginosa PA01
ggcggccgaagaacaccacgc

SEQ ID NO: 1459619 - RNA, 20 nt, Pseudomonas aeruginosa PA01
ggcggccgaauccuccagcc

SEQ ID NO: 1459620 - RNA, 14 nt, Pseudomonas aeruginosa PA01
ggcggccgccauuc

SEQ ID NO: 1459621 - RNA, 15 nt, Pseudomonas aeruginosa PA01
ggcggccgccgagca

SEQ ID NO: 1459622 - RNA, 13 nt, Pseudomonas aeruginosa PA01
ggcggccgccauc

SEQ ID NO: 1459623 - RNA, 20 nt, Pseudomonas aeruginosa PA01
ggcggccgccggcgcccugc

SEQ ID NO: 1459624 - RNA, 12 nt, Pseudomonas aeruginosa PA01
ggcggccuggua

SEQ ID NO: 1459625 - RNA, 22 nt, Pseudomonas aeruginosa PA01
ggcggccugguagucgccgguc

SEQ ID NO: 1459626 - RNA, 12 nt, Pseudomonas aeruginosa PA01
ggcggccagcgg

SEQ ID NO: 1459627 - RNA, 21 nt, Pseudomonas aeruginosa PA01
ggcggccagcggaugcuggcg

SEQ ID NO: 1459628 - RNA, 20 nt, Pseudomonas aeruginosa PA01
ggcggccagcagcacggcga

SEQ ID NO: 1459629 - RNA, 22 nt, Pseudomonas aeruginosa PA01
ggcggccagcagcacggcgacg

SEQ ID NO: 1459630 - RNA, 15 nt, Pseudomonas aeruginosa PA01
ggcggccagcagcac

SEQ ID NO: 1459631 - RNA, 13 nt, Pseudomonas aeruginosa PA01
ggcggccacccga

SEQ ID NO: 1459632 - RNA, 15 nt, Pseudomonas aeruginosa PA01
ggcggccacccgaag

SEQ ID NO: 1459633 - RNA, 15 nt, Pseudomonas aeruginosa PA01
ggcggcaugccguug

SEQ ID NO: 1459634 - RNA, 21 nt, Pseudomonas aeruginosa PA01
ggcggcaugccguugggccag

SEQ ID NO: 1459635 - RNA, 19 nt, Pseudomonas aeruginosa PA01
ggcggcauugagcgccagc

SEQ ID NO: 1459636 - RNA, 17 nt, Pseudomonas aeruginosa PA01
ggcggccaaccucuccc

SEQ ID NO: 1459637 - RNA, 12 nt, Pseudomonas aeruginosa PA01
ggcggccaccac

SEQ ID NO: 1459638 - RNA, 16 nt, Pseudomonas aeruginosa PA01
ggcgcuuuccacucgg

SEQ ID NO: 1459639 - RNA, 22 nt, Pseudomonas aeruginosa PA01
ggcgcuuuccacucggggucgu

SEQ ID NO: 1459640 - RNA, 22 nt, Pseudomonas aeruginosa PA01
ggcgcuuucgagaaagcgcagg

SEQ ID NO: 1459641 - RNA, 23 nt, Pseudomonas aeruginosa PA01
ggcgcuuucgcucuggucgaaca

SEQ ID NO: 1459642 - RNA, 17 nt, Pseudomonas aeruginosa PA01
ggcgcuguccuguggcg

SEQ ID NO: 1459643 - RNA, 13 nt, Pseudomonas aeruginosa PA01
ggcgcugucgccc

SEQ ID NO: 1459644 - RNA, 20 nt, Pseudomonas aeruginosa PA01
ggcgcugucgcccgggcgcc

SEQ ID NO: 1459645 - RNA, 15 nt, Pseudomonas aeruginosa PA01
ggcgcugucgccggu

SEQ ID NO: 1459646 - RNA, 16 nt, Pseudomonas aeruginosa PA01
ggcgcugucgccgguc

SEQ ID NO: 1459647 - RNA, 21 nt, Pseudomonas aeruginosa PA01
ggcgcugucgccggucaggcu

SEQ ID NO: 1459648 - RNA, 19 nt, Pseudomonas aeruginosa PA01
ggcgcugucgccguuggcc

SEQ ID NO: 1459649 - RNA, 22 nt, Pseudomonas aeruginosa PA01
ggcgcugucucgccagcccggc

SEQ ID NO: 1459650 - RNA, 23 nt, Pseudomonas aeruginosa PA01
ggcgcugucucgccagcccggca

SEQ ID NO: 1459651 - RNA, 19 nt, Pseudomonas aeruginosa PA01
ggcgcuuucaucaggcgcu

SEQ ID NO: 1459652 - RNA, 20 nt, Pseudomonas aeruginosa PA01
ggcgcuuucaucaggcgcuu

SEQ ID NO: 1459653 - RNA, 13 nt, Pseudomonas aeruginosa PA01
ggcgcuggcgccg

SEQ ID NO: 1459654 - RNA, 12 nt, Pseudomonas aeruginosa PA01
ggcgcuggcgcg

SEQ ID NO: 1459655 - RNA, 14 nt, Pseudomonas aeruginosa PA01
ggcgcuggcgggcg

SEQ ID NO: 1459656 - RNA, 17 nt, Pseudomonas aeruginosa PA01
ggcgcugggcggcuggc

SEQ ID NO: 1459657 - RNA, 19 nt, Pseudomonas aeruginosa PA01
ggcgcugggcggcuggccg

SEQ ID NO: 1459658 - RNA, 18 nt, Pseudomonas aeruginosa PA01
ggcgcugguccuucagcu

SEQ ID NO: 1459659 - RNA, 20 nt, Pseudomonas aeruginosa PA01
ggcgcugguccuucagcugg

SEQ ID NO: 1459660 - RNA, 20 nt, Pseudomonas aeruginosa PA01
ggcgcugguccuugaucgga

SEQ ID NO: 1459661 - RNA, 22 nt, Pseudomonas aeruginosa PA01
ggcgcugcaugggcucgcgcgg

SEQ ID NO: 1459662 - RNA, 19 nt, Pseudomonas aeruginosa PA01
ggcgcugccaaacgccguc

SEQ ID NO: 1459663 - RNA, 14 nt, Pseudomonas aeruginosa PA01
ggcgcugccgaaca

SEQ ID NO: 1459664 - RNA, 17 nt, Pseudomonas aeruginosa PA01
ggcgcugccgaacagca

SEQ ID NO: 1459665 - RNA, 19 nt, Pseudomonas aeruginosa PA01
ggcgcugccgaacagcagg

SEQ ID NO: 1459666 - RNA, 16 nt, Pseudomonas aeruginosa PA01
ggcgcugccgaucagc

SEQ ID NO: 1459667 - RNA, 18 nt, Pseudomonas aeruginosa PA01
ggcgcugccgaucagcca

SEQ ID NO: 1459668 - RNA, 23 nt, Pseudomonas aeruginosa PA01
ggcgcugccguagaggucgccgu

SEQ ID NO: 1459669 - RNA, 21 nt, Pseudomonas aeruginosa PA01
ggcgcugcgccguuucgacga

SEQ ID NO: 1459670 - RNA, 14 nt, Pseudomonas aeruginosa PA01
ggcgcugcgcggcc

SEQ ID NO: 1459671 - RNA, 15 nt, Pseudomonas aeruginosa PA01
ggcgcugcgcggccu

SEQ ID NO: 1459672 - RNA, 16 nt, Pseudomonas aeruginosa PA01
ggcgcugcgcggccug

SEQ ID NO: 1459673 - RNA, 17 nt, Pseudomonas aeruginosa PA01
ggcgcugcgcggccugc

SEQ ID NO: 1459674 - RNA, 23 nt, Pseudomonas aeruginosa PA01
ggcgcucggggauguccgccgcc

SEQ ID NO: 1459675 - RNA, 12 nt, Pseudomonas aeruginosa PA01
ggcgcucgucga

SEQ ID NO: 1459676 - RNA, 17 nt, Pseudomonas aeruginosa PA01
ggcgcugaccaggucgu

SEQ ID NO: 1459677 - RNA, 21 nt, Pseudomonas aeruginosa PA01
ggcgcugaccucgauggcgug

SEQ ID NO: 1459678 - RNA, 18 nt, Pseudomonas aeruginosa PA01
ggcgcucguugcgccgcu

SEQ ID NO: 1459679 - RNA, 20 nt, Pseudomonas aeruginosa PA01
ggcgcucguugcgccgcucc

SEQ ID NO: 1459680 - RNA, 15 nt, Pseudomonas aeruginosa PA01
ggcgcucucgccgcc

SEQ ID NO: 1459681 - RNA, 15 nt, Pseudomonas aeruginosa PA01
ggcgcucuggccgcg

SEQ ID NO: 1459682 - RNA, 17 nt, Pseudomonas aeruginosa PA01
ggcgcucuggccgcgcu

SEQ ID NO: 1459683 - RNA, 18 nt, Pseudomonas aeruginosa PA01
ggcgcucuucaccgucga

SEQ ID NO: 1459684 - RNA, 20 nt, Pseudomonas aeruginosa PA01
ggcgcugaacagcuggcgcg

SEQ ID NO: 1459685 - RNA, 20 nt, Pseudomonas aeruginosa PA01
ggcgcugcaaucgcugccgg

SEQ ID NO: 1459686 - RNA, 20 nt, Pseudomonas aeruginosa PA01
ggcgcugaggaagagcagcg

SEQ ID NO: 1459687 - RNA, 16 nt, Pseudomonas aeruginosa PA01
ggcgcugagcgagacc

SEQ ID NO: 1459688 - RNA, 17 nt, Pseudomonas aeruginosa PA01
ggcgcugagcgcgguca

SEQ ID NO: 1459689 - RNA, 20 nt, Pseudomonas aeruginosa PA01
ggcgcguugcuuccaggcac

SEQ ID NO: 1459690 - RNA, 19 nt, Pseudomonas aeruginosa PA01
ggcgcguugugccgccacc

SEQ ID NO: 1459691 - RNA, 20 nt, Pseudomonas aeruginosa PA01
ggcgcuacgaaggcgugccg

SEQ ID NO: 1459692 - RNA, 15 nt, Pseudomonas aeruginosa PA01
ggcgcuacgccaauc

SEQ ID NO: 1459693 - RNA, 21 nt, Pseudomonas aeruginosa PA01
ggcgcuacgccaauccaugau

SEQ ID NO: 1459694 - RNA, 18 nt, Pseudomonas aeruginosa PA01
ggcgcuacgcucgccgac

SEQ ID NO: 1459695 - RNA, 23 nt, Pseudomonas aeruginosa PA01
ggcgcuacgcucgccgacggcuu

SEQ ID NO: 1459696 - RNA, 15 nt, Pseudomonas aeruginosa PA01
ggcgcucggcggcgc

SEQ ID NO: 1459697 - RNA, 17 nt, Pseudomonas aeruginosa PA01
ggcgcucggcggcgcgc

SEQ ID NO: 1459698 - RNA, 18 nt, Pseudomonas aeruginosa PA01
ggcgcucggcggcgcgca

SEQ ID NO: 1459699 - RNA, 17 nt, Pseudomonas aeruginosa PA01
ggcgcucggcuccagcc

SEQ ID NO: 1459700 - RNA, 14 nt, Pseudomonas aeruginosa PA01
ggcgcucggccagg

SEQ ID NO: 1459701 - RNA, 18 nt, Pseudomonas aeruginosa PA01
ggcgcucggccaggucgc

SEQ ID NO: 1459702 - RNA, 14 nt, Pseudomonas aeruginosa PA01
ggcgcucggcgacg

SEQ ID NO: 1459703 - RNA, 16 nt, Pseudomonas aeruginosa PA01
ggcgcucggcgacgcg

SEQ ID NO: 1459704 - RNA, 14 nt, Pseudomonas aeruginosa PA01
ggcgcucaacgccu

SEQ ID NO: 1459705 - RNA, 13 nt, Pseudomonas aeruginosa PA01
ggcgcucgcugcg

SEQ ID NO: 1459706 - RNA, 17 nt, Pseudomonas aeruginosa PA01
ggcgcucgcugcgugcg

SEQ ID NO: 1459707 - RNA, 12 nt, Pseudomonas aeruginosa PA01
ggcgcucggcca

SEQ ID NO: 1459708 - RNA, 20 nt, Pseudomonas aeruginosa PA01
ggcgcucgcccuugcgccgc

SEQ ID NO: 1459709 - RNA, 12 nt, Pseudomonas aeruginosa PA01
ggcgcucgcgcu

SEQ ID NO: 1459710 - RNA, 15 nt, Pseudomonas aeruginosa PA01
ggcgcucgcgcugca

SEQ ID NO: 1459711 - RNA, 13 nt, Pseudomonas aeruginosa PA01
ggcgcuauccgcc

SEQ ID NO: 1459712 - RNA, 18 nt, Pseudomonas aeruginosa PA01
ggcgcucgaagcuccagc

SEQ ID NO: 1459713 - RNA, 20 nt, Pseudomonas aeruginosa PA01
ggcgcucgaagcuccagcgu

SEQ ID NO: 1459714 - RNA, 15 nt, Pseudomonas aeruginosa PA01
ggcgcuaugcgccgu

SEQ ID NO: 1459715 - RNA, 22 nt, Pseudomonas aeruginosa PA01
ggcgcuaugcgccguuacgccg

SEQ ID NO: 1459716 - RNA, 22 nt, Pseudomonas aeruginosa PA01
ggcgcggcguaccagccgcggu

SEQ ID NO: 1459717 - RNA, 13 nt, Pseudomonas aeruginosa PA01
ggcgcggcgucgg

SEQ ID NO: 1459718 - RNA, 17 nt, Pseudomonas aeruginosa PA01
ggcgcggcgucgggcga

SEQ ID NO: 1459719 - RNA, 22 nt, Pseudomonas aeruginosa PA01
ggcgcguucacuccacgaggau

SEQ ID NO: 1459720 - RNA, 11 nt, Pseudomonas aeruginosa PA01
ggcgcggcugg

SEQ ID NO: 1459721 - RNA, 15 nt, Pseudomonas aeruginosa PA01
ggcgcggccugcagc

SEQ ID NO: 1459722 - RNA, 18 nt, Pseudomonas aeruginosa PA01
ggcgcggccugcagcgac

SEQ ID NO: 1459723 - RNA, 20 nt, Pseudomonas aeruginosa PA01
ggcgcggagagucggaagcu

SEQ ID NO: 1459724 - RNA, 18 nt, Pseudomonas aeruginosa PA01
ggcgcggcgcaaucaggg

SEQ ID NO: 1459725 - RNA, 20 nt, Pseudomonas aeruginosa PA01
ggcgcggcgcaaucagggcu

SEQ ID NO: 1459726 - RNA, 22 nt, Pseudomonas aeruginosa PA01
ggcgcggcgcaaucagggcugg

SEQ ID NO: 1459727 - RNA, 14 nt, Pseudomonas aeruginosa PA01
ggcgcgcuggcaga

SEQ ID NO: 1459728 - RNA, 17 nt, Pseudomonas aeruginosa PA01
ggcgcggacauggcgcu

SEQ ID NO: 1459729 - RNA, 17 nt, Pseudomonas aeruginosa PA01
ggcgcggacgggccgcg

SEQ ID NO: 1459730 - RNA, 22 nt, Pseudomonas aeruginosa PA01
ggcgcggacgggccgcgccgca

SEQ ID NO: 1459731 - RNA, 14 nt, Pseudomonas aeruginosa PA01
ggcgcggcggccgc

SEQ ID NO: 1459732 - RNA, 15 nt, Pseudomonas aeruginosa PA01
ggcgcggcggccgcc

SEQ ID NO: 1459733 - RNA, 17 nt, Pseudomonas aeruginosa PA01
ggcgcggcgcagcggcg

SEQ ID NO: 1459734 - RNA, 18 nt, Pseudomonas aeruginosa PA01
ggcgcggcgccagcgccc

SEQ ID NO: 1459735 - RNA, 21 nt, Pseudomonas aeruginosa PA01
ggcgcggcgccagcgccccac

SEQ ID NO: 1459736 - RNA, 17 nt, Pseudomonas aeruginosa PA01
ggcgcgcccaggcccag

SEQ ID NO: 1459737 - RNA, 21 nt, Pseudomonas aeruginosa PA01
ggcgcgcccaggcccagcgcg

SEQ ID NO: 1459738 - RNA, 12 nt, Pseudomonas aeruginosa PA01
ggcgcgccaggc

SEQ ID NO: 1459739 - RNA, 18 nt, Pseudomonas aeruginosa PA01
ggcgcgccagaagcggcc

SEQ ID NO: 1459740 - RNA, 19 nt, Pseudomonas aeruginosa PA01
ggcgcgccagaagcggccg

SEQ ID NO: 1459741 - RNA, 23 nt, Pseudomonas aeruginosa PA01
ggcgcgccagaagcggccgacca

SEQ ID NO: 1459742 - RNA, 15 nt, Pseudomonas aeruginosa PA01
ggcgcgccaaggccg

SEQ ID NO: 1459743 - RNA, 20 nt, Pseudomonas aeruginosa PA01
ggcgcgccaaggccgccagg

SEQ ID NO: 1459744 - RNA, 21 nt, Pseudomonas aeruginosa PA01
ggcgcgccaaggccgccaggc

SEQ ID NO: 1459745 - RNA, 23 nt, Pseudomonas aeruginosa PA01
ggcgcgccggacaggccacccgc

SEQ ID NO: 1459746 - RNA, 17 nt, Pseudomonas aeruginosa PA01
ggcgcgccgacagcacg

SEQ ID NO: 1459747 - RNA, 18 nt, Pseudomonas aeruginosa PA01
ggcgcgccgacagcacga

SEQ ID NO: 1459748 - RNA, 21 nt, Pseudomonas aeruginosa PA01
ggcgcgccccgucccuaccag

SEQ ID NO: 1459749 - RNA, 17 nt, Pseudomonas aeruginosa PA01
ggcgcgcccgccagguc

SEQ ID NO: 1459750 - RNA, 15 nt, Pseudomonas aeruginosa PA01
ggcgcgcccggcgca

SEQ ID NO: 1459751 - RNA, 15 nt, Pseudomonas aeruginosa PA01
ggcgcgcccggcgcc

SEQ ID NO: 1459752 - RNA, 21 nt, Pseudomonas aeruginosa PA01
ggcgcggaagcgccugcggug

SEQ ID NO: 1459753 - RNA, 22 nt, Pseudomonas aeruginosa PA01
ggcgcggaauacguacucgucg

SEQ ID NO: 1459754 - RNA, 14 nt, Pseudomonas aeruginosa PA01
ggcgcggacaagcc

SEQ ID NO: 1459755 - RNA, 18 nt, Pseudomonas aeruginosa PA01
ggcgcggacaagcccagc

SEQ ID NO: 1459756 - RNA, 17 nt, Pseudomonas aeruginosa PA01
ggcgcgcuuccuccagu

SEQ ID NO: 1459757 - RNA, 21 nt, Pseudomonas aeruginosa PA01
ggcgcgcuuccuccaguagcg

SEQ ID NO: 1459758 - RNA, 23 nt, Pseudomonas aeruginosa PA01
ggcgcgcuuuccggcgcggccug

SEQ ID NO: 1459759 - RNA, 13 nt, Pseudomonas aeruginosa PA01
ggcgcgcuggucg

SEQ ID NO: 1459760 - RNA, 14 nt, Pseudomonas aeruginosa PA01
ggcgcgcuggucgu

SEQ ID NO: 1459761 - RNA, 13 nt, Pseudomonas aeruginosa PA01
ggcgcgcugcggc

SEQ ID NO: 1459762 - RNA, 15 nt, Pseudomonas aeruginosa PA01
ggcgcgcugcggcag

SEQ ID NO: 1459763 - RNA, 19 nt, Pseudomonas aeruginosa PA01
ggcgcgcugcgggucauug

SEQ ID NO: 1459764 - RNA, 19 nt, Pseudomonas aeruginosa PA01
ggcgcgcugcgugcgccgc

SEQ ID NO: 1459765 - RNA, 13 nt, Pseudomonas aeruginosa PA01
ggcgcgcuccggc

SEQ ID NO: 1459766 - RNA, 13 nt, Pseudomonas aeruginosa PA01
ggcgcgccuggcc

SEQ ID NO: 1459767 - RNA, 15 nt, Pseudomonas aeruginosa PA01
ggcgcgcucagcgcu

SEQ ID NO: 1459768 - RNA, 20 nt, Pseudomonas aeruginosa PA01
ggcgcgccuucagcgccucc

SEQ ID NO: 1459769 - RNA, 20 nt, Pseudomonas aeruginosa PA01
ggcgcgcgacacauggucgg

SEQ ID NO: 1459770 - RNA, 19 nt, Pseudomonas aeruginosa PA01
ggcgcgccugagcuggccc

SEQ ID NO: 1459771 - RNA, 14 nt, Pseudomonas aeruginosa PA01
ggcgcgccgugcgg

SEQ ID NO: 1459772 - RNA, 13 nt, Pseudomonas aeruginosa PA01
ggcgcgcaccagc

SEQ ID NO: 1459773 - RNA, 13 nt, Pseudomonas aeruginosa PA01
ggcgcgcacuucc

SEQ ID NO: 1459774 - RNA, 21 nt, Pseudomonas aeruginosa PA01
ggcgcgcacuuccucggcgac

SEQ ID NO: 1459775 - RNA, 17 nt, Pseudomonas aeruginosa PA01
ggcgcgcagcagguagu

SEQ ID NO: 1459776 - RNA, 14 nt, Pseudomonas aeruginosa PA01
ggcgcgcagcgaac

SEQ ID NO: 1459777 - RNA, 13 nt, Pseudomonas aeruginosa PA01
ggcgcgcagggca

SEQ ID NO: 1459778 - RNA, 14 nt, Pseudomonas aeruginosa PA01
ggcgcgcagggcau

SEQ ID NO: 1459779 - RNA, 15 nt, Pseudomonas aeruginosa PA01
ggcgcgcagggccag

SEQ ID NO: 1459780 - RNA, 16 nt, Pseudomonas aeruginosa PA01
ggcgcgcagggccagc

SEQ ID NO: 1459781 - RNA, 17 nt, Pseudomonas aeruginosa PA01
ggcgcgcagggccagca

SEQ ID NO: 1459782 - RNA, 14 nt, Pseudomonas aeruginosa PA01
ggcgcgcagggccg

SEQ ID NO: 1459783 - RNA, 16 nt, Pseudomonas aeruginosa PA01
ggcgcgcagggccgcg

SEQ ID NO: 1459784 - RNA, 19 nt, Pseudomonas aeruginosa PA01
ggcgcgcagggccgcggcg

SEQ ID NO: 1459785 - RNA, 17 nt, Pseudomonas aeruginosa PA01
ggcgcgaggcgcccgcc

SEQ ID NO: 1459786 - RNA, 16 nt, Pseudomonas aeruginosa PA01
ggcgcaccgccucgac

SEQ ID NO: 1459787 - RNA, 14 nt, Pseudomonas aeruginosa PA01
ggcgcaccgacgcc

SEQ ID NO: 1459788 - RNA, 15 nt, Pseudomonas aeruginosa PA01
ggcgcaccgacgccg

SEQ ID NO: 1459789 - RNA, 16 nt, Pseudomonas aeruginosa PA01
ggcgcaccgacgccgc

SEQ ID NO: 1459790 - RNA, 17 nt, Pseudomonas aeruginosa PA01
ggcgcaccgacgccgcc

SEQ ID NO: 1459791 - RNA, 14 nt, Pseudomonas aeruginosa PA01
ggcgcgcaccaccu

SEQ ID NO: 1459792 - RNA, 18 nt, Pseudomonas aeruginosa PA01
ggcgcgcaccaccuggca

SEQ ID NO: 1459793 - RNA, 23 nt, Pseudomonas aeruginosa PA01
ggcgcgcaccaccuggcagguau

SEQ ID NO: 1459794 - RNA, 22 nt, Pseudomonas aeruginosa PA01
ggcgcgcaacgcuuccagcacc

SEQ ID NO: 1459795 - RNA, 23 nt, Pseudomonas aeruginosa PA01
ggcgcgcaacgcuuccagcaccu

SEQ ID NO: 1459796 - RNA, 21 nt, Pseudomonas aeruginosa PA01
ggcgcgauggaguaggcgucg

SEQ ID NO: 1459797 - RNA, 23 nt, Pseudomonas aeruginosa PA01
ggcgcgaucgcguuccagcaacg

SEQ ID NO: 1459798 - RNA, 19 nt, Pseudomonas aeruginosa PA01
ggcgcgauccuccgccagc

SEQ ID NO: 1459799 - RNA, 15 nt, Pseudomonas aeruginosa PA01
ggcgcgaucggggca

SEQ ID NO: 1459800 - RNA, 20 nt, Pseudomonas aeruginosa PA01
ggcgcgaucggggcagaaca

SEQ ID NO: 1459801 - RNA, 20 nt, Pseudomonas aeruginosa PA01
ggcguugcccaugaucgcca

SEQ ID NO: 1459802 - RNA, 14 nt, Pseudomonas aeruginosa PA01
ggcguugccggcau

SEQ ID NO: 1459803 - RNA, 22 nt, Pseudomonas aeruginosa PA01
ggcuaaccgccuucgcguucgc

SEQ ID NO: 1459804 - RNA, 17 nt, Pseudomonas aeruginosa PA01
ggcuaaccgcgaagcgg

SEQ ID NO: 1459805 - RNA, 16 nt, Pseudomonas aeruginosa PA01
ggcguuggccagcgcc

SEQ ID NO: 1459806 - RNA, 17 nt, Pseudomonas aeruginosa PA01
ggcguuggccagcgcca

SEQ ID NO: 1459807 - RNA, 19 nt, Pseudomonas aeruginosa PA01
ggcuacaucgucugcgcgg

SEQ ID NO: 1459808 - RNA, 16 nt, Pseudomonas aeruginosa PA01
ggcguggucggcggcc

SEQ ID NO: 1459809 - RNA, 18 nt, Pseudomonas aeruginosa PA01
ggcguggucggcggccuc

SEQ ID NO: 1459810 - RNA, 13 nt, Pseudomonas aeruginosa PA01
ggcguguucgucg

SEQ ID NO: 1459811 - RNA, 13 nt, Pseudomonas aeruginosa PA01
ggcgugucgaggg

SEQ ID NO: 1459812 - RNA, 13 nt, Pseudomonas aeruginosa PA01
ggcguuauccgcc

SEQ ID NO: 1459813 - RNA, 20 nt, Pseudomonas aeruginosa PA01
ggcguuauccgccgccgacg

SEQ ID NO: 1459814 - RNA, 15 nt, Pseudomonas aeruginosa PA01
ggcguuauucgcccu

SEQ ID NO: 1459815 - RNA, 21 nt, Pseudomonas aeruginosa PA01
ggcguugcagggugcguacgg

SEQ ID NO: 1459816 - RNA, 18 nt, Pseudomonas aeruginosa PA01
ggcguugcagugcgccgc

SEQ ID NO: 1459817 - RNA, 19 nt, Pseudomonas aeruginosa PA01
ggcguugcagugcgccgca

SEQ ID NO: 1459818 - RNA, 20 nt, Pseudomonas aeruginosa PA01
ggcgugcuuggcgaggcgcg

SEQ ID NO: 1459819 - RNA, 23 nt, Pseudomonas aeruginosa PA01
ggcgugcccauccgcucggcgag

SEQ ID NO: 1459820 - RNA, 14 nt, Pseudomonas aeruginosa PA01
ggcguggccggcga

SEQ ID NO: 1459821 - RNA, 19 nt, Pseudomonas aeruginosa PA01
ggcguggccggcgaccagc

SEQ ID NO: 1459822 - RNA, 19 nt, Pseudomonas aeruginosa PA01
ggcguggcucgaucagccg

SEQ ID NO: 1459823 - RNA, 16 nt, Pseudomonas aeruginosa PA01
ggcgugggcgccggcg

SEQ ID NO: 1459824 - RNA, 18 nt, Pseudomonas aeruginosa PA01
ggcgugggcggucggcga

SEQ ID NO: 1459825 - RNA, 15 nt, Pseudomonas aeruginosa PA01
ggcgugggcugacau

SEQ ID NO: 1459826 - RNA, 20 nt, Pseudomonas aeruginosa PA01
ggcguggggaagacggccag

SEQ ID NO: 1459827 - RNA, 24 nt, Pseudomonas aeruginosa PA01
ggcguggggaagacggccaggaug

SEQ ID NO: 1459828 - RNA, 23 nt, Pseudomonas aeruginosa PA01
ggcguggcgaucaggcagcgcgc

SEQ ID NO: 1459829 - RNA, 14 nt, Pseudomonas aeruginosa PA01
ggcguggcggccgc

SEQ ID NO: 1459830 - RNA, 17 nt, Pseudomonas aeruginosa PA01
ggcguggcggccgccgg

SEQ ID NO: 1459831 - RNA, 16 nt, Pseudomonas aeruginosa PA01
ggcgucgaugccgaau

SEQ ID NO: 1459832 - RNA, 17 nt, Pseudomonas aeruginosa PA01
ggcgucgcccucggcgc

SEQ ID NO: 1459833 - RNA, 16 nt, Pseudomonas aeruginosa PA01
ggcgugagcagggccg

SEQ ID NO: 1459834 - RNA, 20 nt, Pseudomonas aeruginosa PA01
ggcgugagggucgcgccgac

SEQ ID NO: 1459835 - RNA, 19 nt, Pseudomonas aeruginosa PA01
ggcgugcagaccgucgauc

SEQ ID NO: 1459836 - RNA, 16 nt, Pseudomonas aeruginosa PA01
ggcgugcauggccggg

SEQ ID NO: 1459837 - RNA, 19 nt, Pseudomonas aeruginosa PA01
ggcgugcagguagcagccg

SEQ ID NO: 1459838 - RNA, 19 nt, Pseudomonas aeruginosa PA01
ggcgugcaucaccuugucg

SEQ ID NO: 1459839 - RNA, 15 nt, Pseudomonas aeruginosa PA01
ggcgugcaggccgcc

SEQ ID NO: 1459840 - RNA, 19 nt, Pseudomonas aeruginosa PA01
ggcuccggguacuggcgcu

SEQ ID NO: 1459841 - RNA, 17 nt, Pseudomonas aeruginosa PA01
ggcuccggcuccgcgca

SEQ ID NO: 1459842 - RNA, 13 nt, Pseudomonas aeruginosa PA01
ggcuccggcugcg

SEQ ID NO: 1459843 - RNA, 13 nt, Pseudomonas aeruginosa PA01
ggcuccagcggga

SEQ ID NO: 1459844 - RNA, 19 nt, Pseudomonas aeruginosa PA01
ggcuccagcuugucgucgg

SEQ ID NO: 1459845 - RNA, 15 nt, Pseudomonas aeruginosa PA01
ggcuccaggaccggc

SEQ ID NO: 1459846 - RNA, 23 nt, Pseudomonas aeruginosa PA01
ggcuccaggaccggcaggucggg

SEQ ID NO: 1459847 - RNA, 16 nt, Pseudomonas aeruginosa PA01
ggcuccagcaccagca

SEQ ID NO: 1459848 - RNA, 22 nt, Pseudomonas aeruginosa PA01
ggcuccagcaccagcacgcccu

SEQ ID NO: 1459849 - RNA, 13 nt, Pseudomonas aeruginosa PA01
ggcuccagccagg

SEQ ID NO: 1459850 - RNA, 13 nt, Pseudomonas aeruginosa PA01
ggcuccagccgcu

SEQ ID NO: 1459851 - RNA, 23 nt, Pseudomonas aeruginosa PA01
ggcuccagccgcugcagggcggc

SEQ ID NO: 1459852 - RNA, 21 nt, Pseudomonas aeruginosa PA01
ggcuccaauucgacgccgaaa

SEQ ID NO: 1459853 - RNA, 18 nt, Pseudomonas aeruginosa PA01
ggcucaguucggccagcg

SEQ ID NO: 1459854 - RNA, 21 nt, Pseudomonas aeruginosa PA01
ggcucaguucggccagcggca

SEQ ID NO: 1459855 - RNA, 22 nt, Pseudomonas aeruginosa PA01
ggcucaguucggccagcggcag

SEQ ID NO: 1459856 - RNA, 13 nt, Pseudomonas aeruginosa PA01
ggcucaguugcug

SEQ ID NO: 1459857 - RNA, 23 nt, Pseudomonas aeruginosa PA01
ggcucaguugcugaucaggccga

SEQ ID NO: 1459858 - RNA, 14 nt, Pseudomonas aeruginosa PA01
ggcucaucgcccgc

SEQ ID NO: 1459859 - RNA, 15 nt, Pseudomonas aeruginosa PA01
ggcucaugcccagcu

SEQ ID NO: 1459860 - RNA, 13 nt, Pseudomonas aeruginosa PA01
ggcucagccgcug

SEQ ID NO: 1459861 - RNA, 14 nt, Pseudomonas aeruginosa PA01
ggcucaggccgccg

SEQ ID NO: 1459862 - RNA, 15 nt, Pseudomonas aeruginosa PA01
ggcucagcucggcga

SEQ ID NO: 1459863 - RNA, 17 nt, Pseudomonas aeruginosa PA01
ggcucagggucucgcgg

SEQ ID NO: 1459864 - RNA, 15 nt, Pseudomonas aeruginosa PA01
ggcucaggcucuuug

SEQ ID NO: 1459865 - RNA, 22 nt, Pseudomonas aeruginosa PA01
ggcucaggcucuuugcgacuga

SEQ ID NO: 1459866 - RNA, 16 nt, Pseudomonas aeruginosa PA01
ggcucagccgaccacc

SEQ ID NO: 1459867 - RNA, 17 nt, Pseudomonas aeruginosa PA01
ggcucagcccaggcgcc

SEQ ID NO: 1459868 - RNA, 21 nt, Pseudomonas aeruginosa PA01
ggcucacucccguccagcgcu

SEQ ID NO: 1459869 - RNA, 16 nt, Pseudomonas aeruginosa PA01
ggcucagaagucccag

SEQ ID NO: 1459870 - RNA, 22 nt, Pseudomonas aeruginosa PA01
ggcuaccaggaagcucggcagc

SEQ ID NO: 1459871 - RNA, 16 nt, Pseudomonas aeruginosa PA01
ggcucggccagggccg

SEQ ID NO: 1459872 - RNA, 17 nt, Pseudomonas aeruginosa PA01
ggcucggccagggccgc

SEQ ID NO: 1459873 - RNA, 20 nt, Pseudomonas aeruginosa PA01
ggcucggcgagcgaaggauc

SEQ ID NO: 1459874 - RNA, 12 nt, Pseudomonas aeruginosa PA01
ggcucggcgagg

SEQ ID NO: 1459875 - RNA, 20 nt, Pseudomonas aeruginosa PA01
ggcucggccuguaccgcuuc

SEQ ID NO: 1459876 - RNA, 16 nt, Pseudomonas aeruginosa PA01
ggcucggcgggcugcc

SEQ ID NO: 1459877 - RNA, 11 nt, Pseudomonas aeruginosa PA01
ggcucggcggc

SEQ ID NO: 1459878 - RNA, 13 nt, Pseudomonas aeruginosa PA01
ggcucggcggcca

SEQ ID NO: 1459879 - RNA, 16 nt, Pseudomonas aeruginosa PA01
ggcucgcgcagcggcg

SEQ ID NO: 1459880 - RNA, 17 nt, Pseudomonas aeruginosa PA01
ggcucgcgcagcggcgc

SEQ ID NO: 1459881 - RNA, 14 nt, Pseudomonas aeruginosa PA01
ggcucgcgccggcg

SEQ ID NO: 1459882 - RNA, 22 nt, Pseudomonas aeruginosa PA01
ggcucgccggguuguccaggcg

SEQ ID NO: 1459883 - RNA, 12 nt, Pseudomonas aeruginosa PA01
ggcucgcucucg

SEQ ID NO: 1459884 - RNA, 23 nt, Pseudomonas aeruginosa PA01
ggcucgcucucgaacaccggcga

SEQ ID NO: 1459885 - RNA, 22 nt, Pseudomonas aeruginosa PA01
ggcucgcugaaauccaccagca

SEQ ID NO: 1459886 - RNA, 13 nt, Pseudomonas aeruginosa PA01
ggcucgcggcgcu

SEQ ID NO: 1459887 - RNA, 15 nt, Pseudomonas aeruginosa PA01
ggcucgcggcgcucg

SEQ ID NO: 1459888 - RNA, 16 nt, Pseudomonas aeruginosa PA01
ggcuccucggccuggg

SEQ ID NO: 1459889 - RNA, 13 nt, Pseudomonas aeruginosa PA01
ggcuccgggccga

SEQ ID NO: 1459890 - RNA, 17 nt, Pseudomonas aeruginosa PA01
ggcuccuugaaggcuuc

SEQ ID NO: 1459891 - RNA, 14 nt, Pseudomonas aeruginosa PA01
ggcucgaggccgag

SEQ ID NO: 1459892 - RNA, 15 nt, Pseudomonas aeruginosa PA01
ggcucgagccgaacu

SEQ ID NO: 1459893 - RNA, 17 nt, Pseudomonas aeruginosa PA01
ggcucgaucggcagggc

SEQ ID NO: 1459894 - RNA, 21 nt, Pseudomonas aeruginosa PA01
ggcucgaucggcagggcgccg

SEQ ID NO: 1459895 - RNA, 18 nt, Pseudomonas aeruginosa PA01
ggcucgcccagcaggcgc

SEQ ID NO: 1459896 - RNA, 17 nt, Pseudomonas aeruginosa PA01
ggcucgcccaucugcgc

SEQ ID NO: 1459897 - RNA, 19 nt, Pseudomonas aeruginosa PA01
ggcucgcccaugcgcggcg

SEQ ID NO: 1459898 - RNA, 20 nt, Pseudomonas aeruginosa PA01
ggcucgcccaugcgcggcga

SEQ ID NO: 1459899 - RNA, 14 nt, Pseudomonas aeruginosa PA01
ggcucgccccggcg

SEQ ID NO: 1459900 - RNA, 18 nt, Pseudomonas aeruginosa PA01
ggcucgccccggcggcga

SEQ ID NO: 1459901 - RNA, 19 nt, Pseudomonas aeruginosa PA01
ggcucgccccggcggcgau

SEQ ID NO: 1459902 - RNA, 12 nt, Pseudomonas aeruginosa PA01
ggcucgccgacu

SEQ ID NO: 1459903 - RNA, 21 nt, Pseudomonas aeruginosa PA01
ggcucgccgacuuccaggcgc

SEQ ID NO: 1459904 - RNA, 13 nt, Pseudomonas aeruginosa PA01
ggcucgccgcgcu

SEQ ID NO: 1459905 - RNA, 15 nt, Pseudomonas aeruginosa PA01
ggcucgccgccagca

SEQ ID NO: 1459906 - RNA, 12 nt, Pseudomonas aeruginosa PA01
ggcucgccgccg

SEQ ID NO: 1459907 - RNA, 18 nt, Pseudomonas aeruginosa PA01
ggcucgccgccgggcgcg

SEQ ID NO: 1459908 - RNA, 18 nt, Pseudomonas aeruginosa PA01
ggcguaacggcucgccgg

SEQ ID NO: 1459909 - RNA, 15 nt, Pseudomonas aeruginosa PA01
ggcgguucgccgagc

SEQ ID NO: 1459910 - RNA, 20 nt, Pseudomonas aeruginosa PA01
ggcgguucgccgagcgccgc

SEQ ID NO: 1459911 - RNA, 17 nt, Pseudomonas aeruginosa PA01
ggcgguucucgucgaug

SEQ ID NO: 1459912 - RNA, 17 nt, Pseudomonas aeruginosa PA01
ggcgguugaugccgacg

SEQ ID NO: 1459913 - RNA, 14 nt, Pseudomonas aeruginosa PA01
ggcgguuucgccga

SEQ ID NO: 1459914 - RNA, 19 nt, Pseudomonas aeruginosa PA01
ggcgguuguucagcgggcg

SEQ ID NO: 1459915 - RNA, 21 nt, Pseudomonas aeruginosa PA01
ggcgguuguucagcgggcgcu

SEQ ID NO: 1459916 - RNA, 22 nt, Pseudomonas aeruginosa PA01
ggcgguguagaccaccagcagg

SEQ ID NO: 1459917 - RNA, 19 nt, Pseudomonas aeruginosa PA01
ggcgguuauuccgcgggac

SEQ ID NO: 1459918 - RNA, 20 nt, Pseudomonas aeruginosa PA01
ggcguagaggcucggcggcc

SEQ ID NO: 1459919 - RNA, 15 nt, Pseudomonas aeruginosa PA01
ggcguacuucggcgc

SEQ ID NO: 1459920 - RNA, 17 nt, Pseudomonas aeruginosa PA01
ggcguagaaacgcgccu

SEQ ID NO: 1459921 - RNA, 23 nt, Pseudomonas aeruginosa PA01
ggcguagaaacgcgccuccggca

SEQ ID NO: 1459922 - RNA, 19 nt, Pseudomonas aeruginosa PA01
ggcguagaccuugcggccg

SEQ ID NO: 1459923 - RNA, 20 nt, Pseudomonas aeruginosa PA01
ggcguagaccuugcggccgu

SEQ ID NO: 1459924 - RNA, 13 nt, Pseudomonas aeruginosa PA01
ggcguaggagucg

SEQ ID NO: 1459925 - RNA, 21 nt, Pseudomonas aeruginosa PA01
ggcguaggccgucgcugccga

SEQ ID NO: 1459926 - RNA, 12 nt, Pseudomonas aeruginosa PA01
ggcguaggccuc

SEQ ID NO: 1459927 - RNA, 13 nt, Pseudomonas aeruginosa PA01
ggcguaggcgucg

SEQ ID NO: 1459928 - RNA, 14 nt, Pseudomonas aeruginosa PA01
ggcguagccggcca

SEQ ID NO: 1459929 - RNA, 16 nt, Pseudomonas aeruginosa PA01
ggcguagccggcgauc

SEQ ID NO: 1459930 - RNA, 14 nt, Pseudomonas aeruginosa PA01
ggcguagccuuccu

SEQ ID NO: 1459931 - RNA, 23 nt, Pseudomonas aeruginosa PA01
ggcguagccuuccuucucgaagc

SEQ ID NO: 1459932 - RNA, 16 nt, Pseudomonas aeruginosa PA01
ggcguagcgcaggguc

SEQ ID NO: 1459933 - RNA, 20 nt, Pseudomonas aeruginosa PA01
ggcguacgucgauauugccg

SEQ ID NO: 1459934 - RNA, 16 nt, Pseudomonas aeruginosa PA01
ggcguaccuucgagca

SEQ ID NO: 1459935 - RNA, 21 nt, Pseudomonas aeruginosa PA01
ggcguacgaaccccgggccgc

SEQ ID NO: 1459936 - RNA, 13 nt, Pseudomonas aeruginosa PA01
ggcguaccagccg

SEQ ID NO: 1459937 - RNA, 18 nt, Pseudomonas aeruginosa PA01
ggcguaccagccgcgguc

SEQ ID NO: 1459938 - RNA, 23 nt, Pseudomonas aeruginosa PA01
ggcguaagcuggguaggaucgcu

SEQ ID NO: 1459939 - RNA, 17 nt, Pseudomonas aeruginosa PA01
ggcguacaggccccagg

SEQ ID NO: 1459940 - RNA, 15 nt, Pseudomonas aeruginosa PA01
ggcgggagcggccug

SEQ ID NO: 1459941 - RNA, 14 nt, Pseudomonas aeruginosa PA01
ggcgggaucgacgc

SEQ ID NO: 1459942 - RNA, 19 nt, Pseudomonas aeruginosa PA01
ggcgggaucgacgccgcug

SEQ ID NO: 1459943 - RNA, 22 nt, Pseudomonas aeruginosa PA01
ggcgggaucgacgccgcuggcg

SEQ ID NO: 1459944 - RNA, 21 nt, Pseudomonas aeruginosa PA01
ggcgggaucuucuaccuggcg

SEQ ID NO: 1459945 - RNA, 23 nt, Pseudomonas aeruginosa PA01
ggcgggaucuucuaccuggcgcu

SEQ ID NO: 1459946 - RNA, 15 nt, Pseudomonas aeruginosa PA01
ggcgggcaccgccag

SEQ ID NO: 1459947 - RNA, 16 nt, Pseudomonas aeruginosa PA01
ggcgggcaccgccagc

SEQ ID NO: 1459948 - RNA, 20 nt, Pseudomonas aeruginosa PA01
ggcgggcaccgccagcccgc

SEQ ID NO: 1459949 - RNA, 13 nt, Pseudomonas aeruginosa PA01
ggcgggcugccgc

SEQ ID NO: 1459950 - RNA, 14 nt, Pseudomonas aeruginosa PA01
ggcgggcugccgcg

SEQ ID NO: 1459951 - RNA, 16 nt, Pseudomonas aeruginosa PA01
ggcgggcugccgcgga

SEQ ID NO: 1459952 - RNA, 19 nt, Pseudomonas aeruginosa PA01
ggcgggcuggaaaacgcca

SEQ ID NO: 1459953 - RNA, 14 nt, Pseudomonas aeruginosa PA01
ggcgggcgucggcg

SEQ ID NO: 1459954 - RNA, 20 nt, Pseudomonas aeruginosa PA01
ggcgggcguuuucguuggcg

SEQ ID NO: 1459955 - RNA, 17 nt, Pseudomonas aeruginosa PA01
ggcgggcuccgccgccg

SEQ ID NO: 1459956 - RNA, 23 nt, Pseudomonas aeruginosa PA01
ggcgggcuccgccgccgugaucu

SEQ ID NO: 1459957 - RNA, 21 nt, Pseudomonas aeruginosa PA01
ggcgggcucgcaaucagcgcg

SEQ ID NO: 1459958 - RNA, 13 nt, Pseudomonas aeruginosa PA01
ggcgggcucgccc

SEQ ID NO: 1459959 - RNA, 14 nt, Pseudomonas aeruginosa PA01
ggcgggcucgccca

SEQ ID NO: 1459960 - RNA, 15 nt, Pseudomonas aeruginosa PA01
ggcgggcucgcccau

SEQ ID NO: 1459961 - RNA, 12 nt, Pseudomonas aeruginosa PA01
ggcgggcggccc

SEQ ID NO: 1459962 - RNA, 15 nt, Pseudomonas aeruginosa PA01
ggcgggcggcgucga

SEQ ID NO: 1459963 - RNA, 19 nt, Pseudomonas aeruginosa PA01
ggcgggcgguagcgggcca

SEQ ID NO: 1459964 - RNA, 13 nt, Pseudomonas aeruginosa PA01
ggcgguggccacg

SEQ ID NO: 1459965 - RNA, 18 nt, Pseudomonas aeruginosa PA01
ggcggugcggucggcgcc

SEQ ID NO: 1459966 - RNA, 13 nt, Pseudomonas aeruginosa PA01
ggcggugcgcaug

SEQ ID NO: 1459967 - RNA, 14 nt, Pseudomonas aeruginosa PA01
ggcggugcgccggc

SEQ ID NO: 1459968 - RNA, 15 nt, Pseudomonas aeruginosa PA01
ggcggugcgccggcg

SEQ ID NO: 1459969 - RNA, 13 nt, Pseudomonas aeruginosa PA01
ggcggggaacagc

SEQ ID NO: 1459970 - RNA, 14 nt, Pseudomonas aeruginosa PA01
ggcggggaacagca

SEQ ID NO: 1459971 - RNA, 23 nt, Pseudomonas aeruginosa PA01
ggcggggaagccuucgcccggcu

SEQ ID NO: 1459972 - RNA, 17 nt, Pseudomonas aeruginosa PA01
ggcggugccauggauca

SEQ ID NO: 1459973 - RNA, 20 nt, Pseudomonas aeruginosa PA01
ggcggugccauggaucacca

SEQ ID NO: 1459974 - RNA, 15 nt, Pseudomonas aeruginosa PA01
ggcguccaccgcuuc

SEQ ID NO: 1459975 - RNA, 18 nt, Pseudomonas aeruginosa PA01
ggcguccaccgcuucgcg

SEQ ID NO: 1459976 - RNA, 12 nt, Pseudomonas aeruginosa PA01
ggcguccaccgg

SEQ ID NO: 1459977 - RNA, 14 nt, Pseudomonas aeruginosa PA01
ggcguccaccggcg

SEQ ID NO: 1459978 - RNA, 19 nt, Pseudomonas aeruginosa PA01
ggcguccaccggcgcccac

SEQ ID NO: 1459979 - RNA, 13 nt, Pseudomonas aeruginosa PA01
ggcguccagggcu

SEQ ID NO: 1459980 - RNA, 19 nt, Pseudomonas aeruginosa PA01
ggcgucauagcagcgccgc

SEQ ID NO: 1459981 - RNA, 13 nt, Pseudomonas aeruginosa PA01
ggcgucaguuccg

SEQ ID NO: 1459982 - RNA, 23 nt, Pseudomonas aeruginosa PA01
ggcgucacgccgaucccggcggc

SEQ ID NO: 1459983 - RNA, 17 nt, Pseudomonas aeruginosa PA01
ggcguagugcaucagcc

SEQ ID NO: 1459984 - RNA, 20 nt, Pseudomonas aeruginosa PA01
ggcguagugcuccucgucgu

SEQ ID NO: 1459985 - RNA, 20 nt, Pseudomonas aeruginosa PA01
ggcguaguagggacggugca

SEQ ID NO: 1459986 - RNA, 16 nt, Pseudomonas aeruginosa PA01
ggcguauccucggcca

SEQ ID NO: 1459987 - RNA, 14 nt, Pseudomonas aeruginosa PA01
ggcguauucggcga

SEQ ID NO: 1459988 - RNA, 17 nt, Pseudomonas aeruginosa PA01
ggcguauucggcgacca

SEQ ID NO: 1459989 - RNA, 23 nt, Pseudomonas aeruginosa PA01
ggcgucccgcaguagcucgccga

SEQ ID NO: 1459990 - RNA, 16 nt, Pseudomonas aeruginosa PA01
ggcgucccgcuccagc

SEQ ID NO: 1459991 - RNA, 14 nt, Pseudomonas aeruginosa PA01
ggcgucccgcugcg

SEQ ID NO: 1459992 - RNA, 15 nt, Pseudomonas aeruginosa PA01
ggcgucccuggagca

SEQ ID NO: 1459993 - RNA, 16 nt, Pseudomonas aeruginosa PA01
ggcgucccuggagcag

SEQ ID NO: 1459994 - RNA, 17 nt, Pseudomonas aeruginosa PA01
ggcgucccuggagcagg

SEQ ID NO: 1459995 - RNA, 14 nt, Pseudomonas aeruginosa PA01
ggcgucccauggcg

SEQ ID NO: 1459996 - RNA, 18 nt, Pseudomonas aeruginosa PA01
ggcguccccaugcccggc

SEQ ID NO: 1459997 - RNA, 22 nt, Pseudomonas aeruginosa PA01
ggcguccccaugcccggccugg

SEQ ID NO: 1459998 - RNA, 24 nt, Pseudomonas aeruginosa PA01
ggcguccccaugcccggccuggcg

SEQ ID NO: 1459999 - RNA, 19 nt, Pseudomonas aeruginosa PA01
ggcguccaguagcgccugg

SEQ ID NO: 1460000 - RNA, 23 nt, Pseudomonas aeruginosa PA01
ggcguccagcagguacagcgacu

SEQ ID NO: 1460001 - RNA, 14 nt, Pseudomonas aeruginosa PA01
ggcguccgcuggcc

SEQ ID NO: 1460002 - RNA, 14 nt, Pseudomonas aeruginosa PA01
ggcguccggcgagc

SEQ ID NO: 1460003 - RNA, 20 nt, Pseudomonas aeruginosa PA01
ggcguccggcgagcacggcg

SEQ ID NO: 1460004 - RNA, 15 nt, Pseudomonas aeruginosa PA01
ggcguccgggugccc

SEQ ID NO: 1460005 - RNA, 19 nt, Pseudomonas aeruginosa PA01
ggcguccgggugccccagg

SEQ ID NO: 1460006 - RNA, 22 nt, Pseudomonas aeruginosa PA01
ggcguccgguugcuggcacagg

SEQ ID NO: 1460007 - RNA, 17 nt, Pseudomonas aeruginosa PA01
ggcguccgccucgcuga

SEQ ID NO: 1460008 - RNA, 16 nt, Pseudomonas aeruginosa PA01
ggcguccgcggccugc

SEQ ID NO: 1460009 - RNA, 16 nt, Pseudomonas aeruginosa PA01
ggcguccuugccgagg

SEQ ID NO: 1460010 - RNA, 16 nt, Pseudomonas aeruginosa PA01
ggcgucccggcgccgc

SEQ ID NO: 1460011 - RNA, 20 nt, Pseudomonas aeruginosa PA01
ggcguccuggcgaguggcga

SEQ ID NO: 1460012 - RNA, 21 nt, Pseudomonas aeruginosa PA01
ggcguccugcucccuggcgga

SEQ ID NO: 1460013 - RNA, 20 nt, Pseudomonas aeruginosa PA01
ggcgucgaggugcggcugcc

SEQ ID NO: 1460014 - RNA, 20 nt, Pseudomonas aeruginosa PA01
ggcgucgaucccgaucgcca

SEQ ID NO: 1460015 - RNA, 14 nt, Pseudomonas aeruginosa PA01
ggcgucgaacaccg

SEQ ID NO: 1460016 - RNA, 20 nt, Pseudomonas aeruginosa PA01
ggcgucgaaacgggcgcucu

SEQ ID NO: 1460017 - RNA, 22 nt, Pseudomonas aeruginosa PA01
ggcgucgaaacgggcgcucugg

SEQ ID NO: 1460018 - RNA, 15 nt, Pseudomonas aeruginosa PA01
ggcgucgaacagcga

SEQ ID NO: 1460019 - RNA, 20 nt, Pseudomonas aeruginosa PA01
ggcgucgaaggccucgucgc

SEQ ID NO: 1460020 - RNA, 15 nt, Pseudomonas aeruginosa PA01
ggcgucgaaggcggc

SEQ ID NO: 1460021 - RNA, 15 nt, Pseudomonas aeruginosa PA01
ggcgucgaccgccug

SEQ ID NO: 1460022 - RNA, 17 nt, Pseudomonas aeruginosa PA01
ggcgucgaaggcggcgc

SEQ ID NO: 1460023 - RNA, 19 nt, Pseudomonas aeruginosa PA01
ggcgucgaaggcggcgcgg

SEQ ID NO: 1460024 - RNA, 20 nt, Pseudomonas aeruginosa PA01
ggcgucgaaggcggcgcggc

SEQ ID NO: 1460025 - RNA, 21 nt, Pseudomonas aeruginosa PA01
ggcgucgaaggcggcgcggcg

SEQ ID NO: 1460026 - RNA, 15 nt, Pseudomonas aeruginosa PA01
ggggauuuccucguc

SEQ ID NO: 1460027 - RNA, 20 nt, Pseudomonas aeruginosa PA01
ggggauuuccucgucgccgu

SEQ ID NO: 1460028 - RNA, 22 nt, Pseudomonas aeruginosa PA01
ggggcagaccuggugggcggcg

SEQ ID NO: 1460029 - RNA, 14 nt, Pseudomonas aeruginosa PA01
ggggcaggcgcagg

SEQ ID NO: 1460030 - RNA, 16 nt, Pseudomonas aeruginosa PA01
ggggcaggcgcaggcg

SEQ ID NO: 1460031 - RNA, 14 nt, Pseudomonas aeruginosa PA01
ggggcaucggccau

SEQ ID NO: 1460032 - RNA, 16 nt, Pseudomonas aeruginosa PA01
ggggcauguccaccgc

SEQ ID NO: 1460033 - RNA, 21 nt, Pseudomonas aeruginosa PA01
ggggcauucguccagccgccg

SEQ ID NO: 1460034 - RNA, 13 nt, Pseudomonas aeruginosa PA01
ggggcgaccagca

SEQ ID NO: 1460035 - RNA, 12 nt, Pseudomonas aeruginosa PA01
ggggcgaggucg

SEQ ID NO: 1460036 - RNA, 12 nt, Pseudomonas aeruginosa PA01
ggggccguccgc

SEQ ID NO: 1460037 - RNA, 14 nt, Pseudomonas aeruginosa PA01
ggggccucggccag

SEQ ID NO: 1460038 - RNA, 18 nt, Pseudomonas aeruginosa PA01
ggggccucggccagcgcc

SEQ ID NO: 1460039 - RNA, 17 nt, Pseudomonas aeruginosa PA01
ggggcgcagcaggaucu

SEQ ID NO: 1460040 - RNA, 13 nt, Pseudomonas aeruginosa PA01
ggggcgcgccggc

SEQ ID NO: 1460041 - RNA, 11 nt, Pseudomonas aeruginosa PA01
ggggcgccggc

SEQ ID NO: 1460042 - RNA, 14 nt, Pseudomonas aeruginosa PA01
ggggcgcucguugc

SEQ ID NO: 1460043 - RNA, 14 nt, Pseudomonas aeruginosa PA01
ggggcgcuguuggc

SEQ ID NO: 1460044 - RNA, 18 nt, Pseudomonas aeruginosa PA01
ggggcggccucaggccug

SEQ ID NO: 1460045 - RNA, 20 nt, Pseudomonas aeruginosa PA01
ggggaaaccguggucgccgc

SEQ ID NO: 1460046 - RNA, 14 nt, Pseudomonas aeruginosa PA01
ggggaacagcgcca

SEQ ID NO: 1460047 - RNA, 22 nt, Pseudomonas aeruginosa PA01
ggggaacagcgccagcggcagc

SEQ ID NO: 1460048 - RNA, 21 nt, Pseudomonas aeruginosa PA01
gggcuuuuuucguggccgcga

SEQ ID NO: 1460049 - RNA, 21 nt, Pseudomonas aeruginosa PA01
gggcuuuuucauggcuggccc

SEQ ID NO: 1460050 - RNA, 22 nt, Pseudomonas aeruginosa PA01
gggcuuuuucaugggcgcgcgc

SEQ ID NO: 1460051 - RNA, 19 nt, Pseudomonas aeruginosa PA01
gggcuuuuucguuggccag

SEQ ID NO: 1460052 - RNA, 20 nt, Pseudomonas aeruginosa PA01
gggcuuuuucguuggccagg

SEQ ID NO: 1460053 - RNA, 23 nt, Pseudomonas aeruginosa PA01
gggcuuuucauuaccggcgaccu

SEQ ID NO: 1460054 - RNA, 16 nt, Pseudomonas aeruginosa PA01
gggcugggcagcgccg

SEQ ID NO: 1460055 - RNA, 14 nt, Pseudomonas aeruginosa PA01
gggcuugcaauccg

SEQ ID NO: 1460056 - RNA, 11 nt, Pseudomonas aeruginosa PA01
gggcuugccgg

SEQ ID NO: 1460057 - RNA, 14 nt, Pseudomonas aeruginosa PA01
gggcuugcgcgcca

SEQ ID NO: 1460058 - RNA, 18 nt, Pseudomonas aeruginosa PA01
gggcuuucuucgccuggc

SEQ ID NO: 1460059 - RNA, 18 nt, Pseudomonas aeruginosa PA01
ggggaucagcuucagcuc

SEQ ID NO: 1460060 - RNA, 16 nt, Pseudomonas aeruginosa PA01
ggggaucacucgccgc

SEQ ID NO: 1460061 - RNA, 15 nt, Pseudomonas aeruginosa PA01
ggggagcgccggcgc

SEQ ID NO: 1460062 - RNA, 18 nt, Pseudomonas aeruginosa PA01
ggggauggccggcgcggc

SEQ ID NO: 1460063 - RNA, 12 nt, Pseudomonas aeruginosa PA01
ggggaugcgccg

SEQ ID NO: 1460064 - RNA, 22 nt, Pseudomonas aeruginosa PA01
ggggaccugucggcucgcgccg

SEQ ID NO: 1460065 - RNA, 14 nt, Pseudomonas aeruginosa PA01
ggggaauuucacgc

SEQ ID NO: 1460066 - RNA, 15 nt, Pseudomonas aeruginosa PA01
ggggaauuucacgcc

SEQ ID NO: 1460067 - RNA, 15 nt, Pseudomonas aeruginosa PA01
ggggaauuuccggca

SEQ ID NO: 1460068 - RNA, 13 nt, Pseudomonas aeruginosa PA01
ggggaaucgccgu

SEQ ID NO: 1460069 - RNA, 18 nt, Pseudomonas aeruginosa PA01
ggggaaucugcgccaggu

SEQ ID NO: 1460070 - RNA, 14 nt, Pseudomonas aeruginosa PA01
ggggagccgaggcu

SEQ ID NO: 1460071 - RNA, 15 nt, Pseudomonas aeruginosa PA01
gggcugguucagcgg

SEQ ID NO: 1460072 - RNA, 21 nt, Pseudomonas aeruginosa PA01
gggcuguagugcuccggggcg

SEQ ID NO: 1460073 - RNA, 23 nt, Pseudomonas aeruginosa PA01
gggcuguagugcuccggggcgcu

SEQ ID NO: 1460074 - RNA, 15 nt, Pseudomonas aeruginosa PA01
gggcuucccaggcca

SEQ ID NO: 1460075 - RNA, 14 nt, Pseudomonas aeruginosa PA01
gggcuucagcgccg

SEQ ID NO: 1460076 - RNA, 15 nt, Pseudomonas aeruginosa PA01
gggcuucagcgccgg

SEQ ID NO: 1460077 - RNA, 15 nt, Pseudomonas aeruginosa PA01
gggcuucgccgccgc

SEQ ID NO: 1460078 - RNA, 15 nt, Pseudomonas aeruginosa PA01
gggcuucgcgcagau

SEQ ID NO: 1460079 - RNA, 20 nt, Pseudomonas aeruginosa PA01
gggcuucgcgguggaugccg

SEQ ID NO: 1460080 - RNA, 20 nt, Pseudomonas aeruginosa PA01
gggcuucgcugaugccggcg

SEQ ID NO: 1460081 - RNA, 17 nt, Pseudomonas aeruginosa PA01
gggcuucgguguaucgg

SEQ ID NO: 1460082 - RNA, 20 nt, Pseudomonas aeruginosa PA01
gggcuucuucaccaggccga

SEQ ID NO: 1460083 - RNA, 23 nt, Pseudomonas aeruginosa PA01
gggcuucuucaccaggccgaacg

SEQ ID NO: 1460084 - RNA, 19 nt, Pseudomonas aeruginosa PA01
gggcuggccgucgaggucg

SEQ ID NO: 1460085 - RNA, 16 nt, Pseudomonas aeruginosa PA01
gggcuggccaccagca

SEQ ID NO: 1460086 - RNA, 17 nt, Pseudomonas aeruginosa PA01
gggcuggccaccgccag

SEQ ID NO: 1460087 - RNA, 21 nt, Pseudomonas aeruginosa PA01
gggcuggccaccgggaucagc

SEQ ID NO: 1460088 - RNA, 18 nt, Pseudomonas aeruginosa PA01
gggcugcgcaucgccugg

SEQ ID NO: 1460089 - RNA, 16 nt, Pseudomonas aeruginosa PA01
gggcugcgugccagca

SEQ ID NO: 1460090 - RNA, 17 nt, Pseudomonas aeruginosa PA01
gggcugcccaccaccag

SEQ ID NO: 1460091 - RNA, 23 nt, Pseudomonas aeruginosa PA01
gggcugcccaccaccaggaccau

SEQ ID NO: 1460092 - RNA, 17 nt, Pseudomonas aeruginosa PA01
gggcugagacgcugccg

SEQ ID NO: 1460093 - RNA, 13 nt, Pseudomonas aeruginosa PA01
gggcucugccggu

SEQ ID NO: 1460094 - RNA, 19 nt, Pseudomonas aeruginosa PA01
gggcucgugcccucgcuac

SEQ ID NO: 1460095 - RNA, 22 nt, Pseudomonas aeruginosa PA01
gggcucuuucguuucagcgcca

SEQ ID NO: 1460096 - RNA, 24 nt, Pseudomonas aeruginosa PA01
gggcucuuucguuucagcgccagc

SEQ ID NO: 1460097 - RNA, 13 nt, Pseudomonas aeruginosa PA01
gggcugaacagcg

SEQ ID NO: 1460098 - RNA, 16 nt, Pseudomonas aeruginosa PA01
gggcugaacagcgcca

SEQ ID NO: 1460099 - RNA, 17 nt, Pseudomonas aeruginosa PA01
gggcugaacagcgccac

SEQ ID NO: 1460100 - RNA, 22 nt, Pseudomonas aeruginosa PA01
gggcugaacagcgccaccagca

SEQ ID NO: 1460101 - RNA, 15 nt, Pseudomonas aeruginosa PA01
gggcucgggcgcgga

SEQ ID NO: 1460102 - RNA, 17 nt, Pseudomonas aeruginosa PA01
gggcucgcgcggggcgc

SEQ ID NO: 1460103 - RNA, 24 nt, Pseudomonas aeruginosa PA01
gggcucgcgcggggcgcgcugcga

SEQ ID NO: 1460104 - RNA, 21 nt, Pseudomonas aeruginosa PA01
gggcgcgagguuucgcuuucc

SEQ ID NO: 1460105 - RNA, 18 nt, Pseudomonas aeruginosa PA01
gggcgcgcacuuccucgg

SEQ ID NO: 1460106 - RNA, 12 nt, Pseudomonas aeruginosa PA01
gggcgcgcccgc

SEQ ID NO: 1460107 - RNA, 21 nt, Pseudomonas aeruginosa PA01
gggcgccuuuuucauggccug

SEQ ID NO: 1460108 - RNA, 19 nt, Pseudomonas aeruginosa PA01
gggcgccucgccgcggcag

SEQ ID NO: 1460109 - RNA, 21 nt, Pseudomonas aeruginosa PA01
gggcgccguggaucgcccggc

SEQ ID NO: 1460110 - RNA, 22 nt, Pseudomonas aeruginosa PA01
gggcgccuccagcgggccuucg

SEQ ID NO: 1460111 - RNA, 15 nt, Pseudomonas aeruginosa PA01
gggcgugcaggccgc

SEQ ID NO: 1460112 - RNA, 14 nt, Pseudomonas aeruginosa PA01
gggcguggcggccg

SEQ ID NO: 1460113 - RNA, 15 nt, Pseudomonas aeruginosa PA01
gggcguggcggccgc

SEQ ID NO: 1460114 - RNA, 19 nt, Pseudomonas aeruginosa PA01
gggcgucuccugccgccga

SEQ ID NO: 1460115 - RNA, 22 nt, Pseudomonas aeruginosa PA01
gggcgucuccugccgccgauag

SEQ ID NO: 1460116 - RNA, 20 nt, Pseudomonas aeruginosa PA01
gggcguuuucguuggcgcga

SEQ ID NO: 1460117 - RNA, 21 nt, Pseudomonas aeruginosa PA01
gggcguuuucguuggcggcca

SEQ ID NO: 1460118 - RNA, 22 nt, Pseudomonas aeruginosa PA01
gggcguuuucguuggcggccau

SEQ ID NO: 1460119 - RNA, 23 nt, Pseudomonas aeruginosa PA01
gggcguuuucguuggcggccauc

SEQ ID NO: 1460120 - RNA, 19 nt, Pseudomonas aeruginosa PA01
gggcguuuuucauggcggc

SEQ ID NO: 1460121 - RNA, 13 nt, Pseudomonas aeruginosa PA01
gggcguuggccag

SEQ ID NO: 1460122 - RNA, 14 nt, Pseudomonas aeruginosa PA01
gggcguuggccagc

SEQ ID NO: 1460123 - RNA, 18 nt, Pseudomonas aeruginosa PA01
gggcguuggccagcgcca

SEQ ID NO: 1460124 - RNA, 19 nt, Pseudomonas aeruginosa PA01
gggcguuggccagcgccac

SEQ ID NO: 1460125 - RNA, 18 nt, Pseudomonas aeruginosa PA01
gggcguggucggcggccu

SEQ ID NO: 1460126 - RNA, 17 nt, Pseudomonas aeruginosa PA01
gggcguucuuggccgcg

SEQ ID NO: 1460127 - RNA, 22 nt, Pseudomonas aeruginosa PA01
gggcguucuuggccgcgccgaa

SEQ ID NO: 1460128 - RNA, 21 nt, Pseudomonas aeruginosa PA01
gggcuagucgcgcagcgccuc

SEQ ID NO: 1460129 - RNA, 18 nt, Pseudomonas aeruginosa PA01
gggcuauucccgccgcuc

SEQ ID NO: 1460130 - RNA, 22 nt, Pseudomonas aeruginosa PA01
gggcucacauuaauugcgagcg

SEQ ID NO: 1460131 - RNA, 17 nt, Pseudomonas aeruginosa PA01
gggcucagcccaggcgc

SEQ ID NO: 1460132 - RNA, 20 nt, Pseudomonas aeruginosa PA01
gggcucagcccaggcgccgc

SEQ ID NO: 1460133 - RNA, 13 nt, Pseudomonas aeruginosa PA01
gggcucagcgcgc

SEQ ID NO: 1460134 - RNA, 13 nt, Pseudomonas aeruginosa PA01
gggcucaggccuu

SEQ ID NO: 1460135 - RNA, 14 nt, Pseudomonas aeruginosa PA01
gggcuccgccgcga

SEQ ID NO: 1460136 - RNA, 21 nt, Pseudomonas aeruginosa PA01
gggguuuucuuuuugcgccag

SEQ ID NO: 1460137 - RNA, 23 nt, Pseudomonas aeruginosa PA01
gggguuuucuuuuugcgccaggu

SEQ ID NO: 1460138 - RNA, 20 nt, Pseudomonas aeruginosa PA01
gggguuucuuuuuauccggc

SEQ ID NO: 1460139 - RNA, 18 nt, Pseudomonas aeruginosa PA01
gggguucuugucgaccag

SEQ ID NO: 1460140 - RNA, 22 nt, Pseudomonas aeruginosa PA01
ggggugcgcuggaacggccagg

SEQ ID NO: 1460141 - RNA, 19 nt, Pseudomonas aeruginosa PA01
gggguggaguaccaggcca

SEQ ID NO: 1460142 - RNA, 19 nt, Pseudomonas aeruginosa PA01
ggggugccgccagucggcc

SEQ ID NO: 1460143 - RNA, 19 nt, Pseudomonas aeruginosa PA01
ggggugaggccgagccgac

SEQ ID NO: 1460144 - RNA, 22 nt, Pseudomonas aeruginosa PA01
ggggugaucagucgucguccag

SEQ ID NO: 1460145 - RNA, 14 nt, Pseudomonas aeruginosa PA01
ggguaagcucgauc

SEQ ID NO: 1460146 - RNA, 19 nt, Pseudomonas aeruginosa PA01
ggguaaggcaugcccaggc

SEQ ID NO: 1460147 - RNA, 17 nt, Pseudomonas aeruginosa PA01
ggguaauaccccgcccc

SEQ ID NO: 1460148 - RNA, 12 nt, Pseudomonas aeruginosa PA01
ggguagcugcug

SEQ ID NO: 1460149 - RNA, 22 nt, Pseudomonas aeruginosa PA01
ggguaggaggaaauacagcacc

SEQ ID NO: 1460150 - RNA, 13 nt, Pseudomonas aeruginosa PA01
ggguagccgccca

SEQ ID NO: 1460151 - RNA, 18 nt, Pseudomonas aeruginosa PA01
ggguaccgaaacagggcg

SEQ ID NO: 1460152 - RNA, 14 nt, Pseudomonas aeruginosa PA01
ggguacgcaccggc

SEQ ID NO: 1460153 - RNA, 15 nt, Pseudomonas aeruginosa PA01
ggguacgcaccggcu

SEQ ID NO: 1460154 - RNA, 16 nt, Pseudomonas aeruginosa PA01
ggguaccgcuggcgcu

SEQ ID NO: 1460155 - RNA, 24 nt, Pseudomonas aeruginosa PA01
ggguaccguugcgcaggcguuccu

SEQ ID NO: 1460156 - RNA, 17 nt, Pseudomonas aeruginosa PA01
ggguacuccuggcaugg

SEQ ID NO: 1460157 - RNA, 16 nt, Pseudomonas aeruginosa PA01
gggggccagcagggcc

SEQ ID NO: 1460158 - RNA, 17 nt, Pseudomonas aeruginosa PA01
gggggccagcagggccg

SEQ ID NO: 1460159 - RNA, 23 nt, Pseudomonas aeruginosa PA01
gggggccagcagggccgccgagg

SEQ ID NO: 1460160 - RNA, 19 nt, Pseudomonas aeruginosa PA01
gggggccucggccagcgcc

SEQ ID NO: 1460161 - RNA, 19 nt, Pseudomonas aeruginosa PA01
gggggucucguagcagcca

SEQ ID NO: 1460162 - RNA, 22 nt, Pseudomonas aeruginosa PA01
gggguaggaggaaauacagcac

SEQ ID NO: 1460163 - RNA, 13 nt, Pseudomonas aeruginosa PA01
gggguagggucag

SEQ ID NO: 1460164 - RNA, 13 nt, Pseudomonas aeruginosa PA01
ggggucagcgccu

SEQ ID NO: 1460165 - RNA, 21 nt, Pseudomonas aeruginosa PA01
ggggucgacgcagggcggcgc

SEQ ID NO: 1460166 - RNA, 12 nt, Pseudomonas aeruginosa PA01
gggguccgccgg

SEQ ID NO: 1460167 - RNA, 17 nt, Pseudomonas aeruginosa PA01
gggguaaggcaugccca

SEQ ID NO: 1460168 - RNA, 13 nt, Pseudomonas aeruginosa PA01
gggguagccgaga

SEQ ID NO: 1460169 - RNA, 23 nt, Pseudomonas aeruginosa PA01
ggggcuuuuucguuuccggcagg

SEQ ID NO: 1460170 - RNA, 18 nt, Pseudomonas aeruginosa PA01
ggggcuuucuucgccugg

SEQ ID NO: 1460171 - RNA, 20 nt, Pseudomonas aeruginosa PA01
ggggcuuucuucgccuggcg

SEQ ID NO: 1460172 - RNA, 23 nt, Pseudomonas aeruginosa PA01
ggggcuucuuuuaucgaaucggc

SEQ ID NO: 1460173 - RNA, 19 nt, Pseudomonas aeruginosa PA01
ggggcuuuuuuucgccugc

SEQ ID NO: 1460174 - RNA, 19 nt, Pseudomonas aeruginosa PA01
ggggcguuuuuucuuucca

SEQ ID NO: 1460175 - RNA, 18 nt, Pseudomonas aeruginosa PA01
ggggcgugucgagggcug

SEQ ID NO: 1460176 - RNA, 15 nt, Pseudomonas aeruginosa PA01
ggggcgugcaggccg

SEQ ID NO: 1460177 - RNA, 18 nt, Pseudomonas aeruginosa PA01
ggggcgugcaggccgccg

SEQ ID NO: 1460178 - RNA, 12 nt, Pseudomonas aeruginosa PA01
ggggcucggcga

SEQ ID NO: 1460179 - RNA, 15 nt, Pseudomonas aeruginosa PA01
ggggcucugccggug

SEQ ID NO: 1460180 - RNA, 13 nt, Pseudomonas aeruginosa PA01
ggguccgccgguc

SEQ ID NO: 1460181 - RNA, 13 nt, Pseudomonas aeruginosa PA01
ggguccagcggcc

SEQ ID NO: 1460182 - RNA, 14 nt, Pseudomonas aeruginosa PA01
ggguccagcggccg

SEQ ID NO: 1460183 - RNA, 16 nt, Pseudomonas aeruginosa PA01
gggucaucaccggcag

SEQ ID NO: 1460184 - RNA, 13 nt, Pseudomonas aeruginosa PA01
gggucaugcucgg

SEQ ID NO: 1460185 - RNA, 13 nt, Pseudomonas aeruginosa PA01
gggucaggccgag

SEQ ID NO: 1460186 - RNA, 14 nt, Pseudomonas aeruginosa PA01
gggucaggccgagg

SEQ ID NO: 1460187 - RNA, 20 nt, Pseudomonas aeruginosa PA01
gggucaggccgagggcugcc

SEQ ID NO: 1460188 - RNA, 21 nt, Pseudomonas aeruginosa PA01
gggucagcggguuggcuucca

SEQ ID NO: 1460189 - RNA, 22 nt, Pseudomonas aeruginosa PA01
gggucagccgaugcucgcgcca

SEQ ID NO: 1460190 - RNA, 12 nt, Pseudomonas aeruginosa PA01
gggucagcgcca

SEQ ID NO: 1460191 - RNA, 16 nt, Pseudomonas aeruginosa PA01
gggucagcaggcugcc

SEQ ID NO: 1460192 - RNA, 23 nt, Pseudomonas aeruginosa PA01
gggucagcagugcggggcgcucg

SEQ ID NO: 1460193 - RNA, 15 nt, Pseudomonas aeruginosa PA01
gggucacgccgauca

SEQ ID NO: 1460194 - RNA, 18 nt, Pseudomonas aeruginosa PA01
gggucacggugaggaccu

SEQ ID NO: 1460195 - RNA, 22 nt, Pseudomonas aeruginosa PA01
gggucacggucagcucggcauc

SEQ ID NO: 1460196 - RNA, 17 nt, Pseudomonas aeruginosa PA01
gggucagcagcgccagu

SEQ ID NO: 1460197 - RNA, 20 nt, Pseudomonas aeruginosa PA01
gggucagaccagcccuggcg

SEQ ID NO: 1460198 - RNA, 22 nt, Pseudomonas aeruginosa PA01
gggucagaccagcccuggcgcg

SEQ ID NO: 1460199 - RNA, 19 nt, Pseudomonas aeruginosa PA01
ggguagggguggccaggcg

SEQ ID NO: 1460200 - RNA, 13 nt, Pseudomonas aeruginosa PA01
ggguaggccaggc

SEQ ID NO: 1460201 - RNA, 16 nt, Pseudomonas aeruginosa PA01
gggucaccagcgccgg

SEQ ID NO: 1460202 - RNA, 21 nt, Pseudomonas aeruginosa PA01
ggguaugugacgucuguugcg

SEQ ID NO: 1460203 - RNA, 15 nt, Pseudomonas aeruginosa PA01
gggucugcucgcgcu

SEQ ID NO: 1460204 - RNA, 18 nt, Pseudomonas aeruginosa PA01
gggucugcucgcgcuucu

SEQ ID NO: 1460205 - RNA, 19 nt, Pseudomonas aeruginosa PA01
gggucugcgaguugaucgg

SEQ ID NO: 1460206 - RNA, 23 nt, Pseudomonas aeruginosa PA01
gggucuggggaaauucgcgcugg

SEQ ID NO: 1460207 - RNA, 19 nt, Pseudomonas aeruginosa PA01
gggucuggccggcgaucag

SEQ ID NO: 1460208 - RNA, 23 nt, Pseudomonas aeruginosa PA01
gggucuggcgauucuccugggcg

SEQ ID NO: 1460209 - RNA, 18 nt, Pseudomonas aeruginosa PA01
gggucugcuugcgcuggc

SEQ ID NO: 1460210 - RNA, 17 nt, Pseudomonas aeruginosa PA01
gggucgucgcuggcgga

SEQ ID NO: 1460211 - RNA, 18 nt, Pseudomonas aeruginosa PA01
gggucgucgaagcgcagc

SEQ ID NO: 1460212 - RNA, 18 nt, Pseudomonas aeruginosa PA01
gggucugcgccucgcugg

SEQ ID NO: 1460213 - RNA, 12 nt, Pseudomonas aeruginosa PA01
gggucucgcggg

SEQ ID NO: 1460214 - RNA, 23 nt, Pseudomonas aeruginosa PA01
gggucguacaccgcgcggcacag

SEQ ID NO: 1460215 - RNA, 19 nt, Pseudomonas aeruginosa PA01
gggucgucgcccuggccga

SEQ ID NO: 1460216 - RNA, 19 nt, Pseudomonas aeruginosa PA01
gggucgggcucaugggcga

SEQ ID NO: 1460217 - RNA, 18 nt, Pseudomonas aeruginosa PA01
gggucgguucgcggcgca

SEQ ID NO: 1460218 - RNA, 12 nt, Pseudomonas aeruginosa PA01
gggucgacugcu

SEQ ID NO: 1460219 - RNA, 23 nt, Pseudomonas aeruginosa PA01
gggucgacuucgcaccagccggc

SEQ ID NO: 1460220 - RNA, 15 nt, Pseudomonas aeruginosa PA01
gggucgaggccgaaa

SEQ ID NO: 1460221 - RNA, 16 nt, Pseudomonas aeruginosa PA01
gggucgaccuugccga

SEQ ID NO: 1460222 - RNA, 15 nt, Pseudomonas aeruginosa PA01
ggguccuggugauca

SEQ ID NO: 1460223 - RNA, 14 nt, Pseudomonas aeruginosa PA01
gggucgauugcugg

SEQ ID NO: 1460224 - RNA, 19 nt, Pseudomonas aeruginosa PA01
gggucgauugcugggugcg

SEQ ID NO: 1460225 - RNA, 21 nt, Pseudomonas aeruginosa PA01
gggucgaugcccucgcggcgg

SEQ ID NO: 1460226 - RNA, 12 nt, Pseudomonas aeruginosa PA01
gggucgccuggg

SEQ ID NO: 1460227 - RNA, 21 nt, Pseudomonas aeruginosa PA01
gggucgcgcagggcagcgcga

SEQ ID NO: 1460228 - RNA, 12 nt, Pseudomonas aeruginosa PA01
gggucgcgccgg

SEQ ID NO: 1460229 - RNA, 20 nt, Pseudomonas aeruginosa PA01
gggucggcccggagaccgug

SEQ ID NO: 1460230 - RNA, 15 nt, Pseudomonas aeruginosa PA01
gggucggcaccgagc

SEQ ID NO: 1460231 - RNA, 14 nt, Pseudomonas aeruginosa PA01
gggucggcaccugc

SEQ ID NO: 1460232 - RNA, 15 nt, Pseudomonas aeruginosa PA01
gggucgcuuccucgg

SEQ ID NO: 1460233 - RNA, 13 nt, Pseudomonas aeruginosa PA01
gggucggccugcg

SEQ ID NO: 1460234 - RNA, 13 nt, Pseudomonas aeruginosa PA01
gggucgcagcagg

SEQ ID NO: 1460235 - RNA, 20 nt, Pseudomonas aeruginosa PA01
gggucgcugcucagggccgc

SEQ ID NO: 1460236 - RNA, 21 nt, Pseudomonas aeruginosa PA01
gggucgcugcucagggccgcg

SEQ ID NO: 1460237 - RNA, 17 nt, Pseudomonas aeruginosa PA01
gggucgcggcuggccgc

SEQ ID NO: 1460238 - RNA, 22 nt, Pseudomonas aeruginosa PA01
gggucgcggcuggccgccuggc

SEQ ID NO: 1460239 - RNA, 17 nt, Pseudomonas aeruginosa PA01
gggaugcgcgaggucug

SEQ ID NO: 1460240 - RNA, 22 nt, Pseudomonas aeruginosa PA01
gggauggucgagagaauccgcc

SEQ ID NO: 1460241 - RNA, 13 nt, Pseudomonas aeruginosa PA01
gggauggucgagg

SEQ ID NO: 1460242 - RNA, 15 nt, Pseudomonas aeruginosa PA01
gggauggccggcgcg

SEQ ID NO: 1460243 - RNA, 13 nt, Pseudomonas aeruginosa PA01
gggauggcgcggu

SEQ ID NO: 1460244 - RNA, 14 nt, Pseudomonas aeruginosa PA01
gggaugccggcggc

SEQ ID NO: 1460245 - RNA, 16 nt, Pseudomonas aeruginosa PA01
gggaugccgggccgag

SEQ ID NO: 1460246 - RNA, 12 nt, Pseudomonas aeruginosa PA01
gggaugccgccg

SEQ ID NO: 1460247 - RNA, 20 nt, Pseudomonas aeruginosa PA01
gggaucguaggcgcgcaccu

SEQ ID NO: 1460248 - RNA, 15 nt, Pseudomonas aeruginosa PA01
gggaugcccggccgc

SEQ ID NO: 1460249 - RNA, 17 nt, Pseudomonas aeruginosa PA01
gggaugcccggccgcag

SEQ ID NO: 1460250 - RNA, 14 nt, Pseudomonas aeruginosa PA01
gggauacagcagcc

SEQ ID NO: 1460251 - RNA, 17 nt, Pseudomonas aeruginosa PA01
gggaucuccgcgccacg

SEQ ID NO: 1460252 - RNA, 18 nt, Pseudomonas aeruginosa PA01
gggaucuccucgacggcg

SEQ ID NO: 1460253 - RNA, 12 nt, Pseudomonas aeruginosa PA01
gggagccaggcg

SEQ ID NO: 1460254 - RNA, 14 nt, Pseudomonas aeruginosa PA01
gggagccaggcggc

SEQ ID NO: 1460255 - RNA, 23 nt, Pseudomonas aeruginosa PA01
gggagauguccaucagccgcgcg

SEQ ID NO: 1460256 - RNA, 12 nt, Pseudomonas aeruginosa PA01
gggagcacggca

SEQ ID NO: 1460257 - RNA, 14 nt, Pseudomonas aeruginosa PA01
gggagcgccuggcg

SEQ ID NO: 1460258 - RNA, 14 nt, Pseudomonas aeruginosa PA01
gggagcgcucgcgc

SEQ ID NO: 1460259 - RNA, 15 nt, Pseudomonas aeruginosa PA01
gggagcgcucgcgca

SEQ ID NO: 1460260 - RNA, 22 nt, Pseudomonas aeruginosa PA01
gggagccuaccauuagaggaac

SEQ ID NO: 1460261 - RNA, 23 nt, Pseudomonas aeruginosa PA01
gggaggaauaaagaaaaggccgc

SEQ ID NO: 1460262 - RNA, 15 nt, Pseudomonas aeruginosa PA01
gggaggcgcuggcca

SEQ ID NO: 1460263 - RNA, 17 nt, Pseudomonas aeruginosa PA01
gggaggcgcuggccagc

SEQ ID NO: 1460264 - RNA, 11 nt, Pseudomonas aeruginosa PA01
gggagcggccg

SEQ ID NO: 1460265 - RNA, 16 nt, Pseudomonas aeruginosa PA01
gggauagacggcggau

SEQ ID NO: 1460266 - RNA, 16 nt, Pseudomonas aeruginosa PA01
gggauaaacggcggau

SEQ ID NO: 1460267 - RNA, 14 nt, Pseudomonas aeruginosa PA01
gggaguuccgcgca

SEQ ID NO: 1460268 - RNA, 15 nt, Pseudomonas aeruginosa PA01
gggaacugggcgagc

SEQ ID NO: 1460269 - RNA, 22 nt, Pseudomonas aeruginosa PA01
gggaacgccgggcaacgccagg

SEQ ID NO: 1460270 - RNA, 22 nt, Pseudomonas aeruginosa PA01
gggaacgaguugggcgaccugc

SEQ ID NO: 1460271 - RNA, 17 nt, Pseudomonas aeruginosa PA01
gggaacccgcggcgcgc

SEQ ID NO: 1460272 - RNA, 20 nt, Pseudomonas aeruginosa PA01
gggaacccgcggcgcgccuu

SEQ ID NO: 1460273 - RNA, 23 nt, Pseudomonas aeruginosa PA01
gggaacgaaacgcuugcguuccu

SEQ ID NO: 1460274 - RNA, 18 nt, Pseudomonas aeruginosa PA01
gggaacauugccaccacc

SEQ ID NO: 1460275 - RNA, 15 nt, Pseudomonas aeruginosa PA01
gggaaccacaccugc

SEQ ID NO: 1460276 - RNA, 13 nt, Pseudomonas aeruginosa PA01
gggaacagcgcca

SEQ ID NO: 1460277 - RNA, 15 nt, Pseudomonas aeruginosa PA01
gggaacagcgccagc

SEQ ID NO: 1460278 - RNA, 17 nt, Pseudomonas aeruginosa PA01
gggaacagcgccagcgg

SEQ ID NO: 1460279 - RNA, 19 nt, Pseudomonas aeruginosa PA01
gggaacagcgccagcggca

SEQ ID NO: 1460280 - RNA, 22 nt, Pseudomonas aeruginosa PA01
gggaacagcgccagcggcagcg

SEQ ID NO: 1460281 - RNA, 18 nt, Pseudomonas aeruginosa PA01
ggcuugcgcgccaccagc

SEQ ID NO: 1460282 - RNA, 19 nt, Pseudomonas aeruginosa PA01
ggcuugcgcgccaccagcg

SEQ ID NO: 1460283 - RNA, 14 nt, Pseudomonas aeruginosa PA01
ggcuugcugcaggu

SEQ ID NO: 1460284 - RNA, 14 nt, Pseudomonas aeruginosa PA01
gggaacacgcgcug

SEQ ID NO: 1460285 - RNA, 18 nt, Pseudomonas aeruginosa PA01
gggaaaucaccgccaccu

SEQ ID NO: 1460286 - RNA, 17 nt, Pseudomonas aeruginosa PA01
gggacgaccucagacca

SEQ ID NO: 1460287 - RNA, 15 nt, Pseudomonas aeruginosa PA01
gggaccgcaccuggu

SEQ ID NO: 1460288 - RNA, 23 nt, Pseudomonas aeruginosa PA01
gggaccugucggcucgcgccggc

SEQ ID NO: 1460289 - RNA, 16 nt, Pseudomonas aeruginosa PA01
gggagaaccaggcggu

SEQ ID NO: 1460290 - RNA, 20 nt, Pseudomonas aeruginosa PA01
gggagaaccaggcggugucg

SEQ ID NO: 1460291 - RNA, 14 nt, Pseudomonas aeruginosa PA01
gggacaugucgagg

SEQ ID NO: 1460292 - RNA, 18 nt, Pseudomonas aeruginosa PA01
gggacaugucgagggccg

SEQ ID NO: 1460293 - RNA, 19 nt, Pseudomonas aeruginosa PA01
gggaccaccccggucaugg

SEQ ID NO: 1460294 - RNA, 17 nt, Pseudomonas aeruginosa PA01
gggacagggcggcagcg

SEQ ID NO: 1460295 - RNA, 20 nt, Pseudomonas aeruginosa PA01
gggacagggcggcagcgugc

SEQ ID NO: 1460296 - RNA, 15 nt, Pseudomonas aeruginosa PA01
ggcuucagagcugga

SEQ ID NO: 1460297 - RNA, 14 nt, Pseudomonas aeruginosa PA01
ggcuucagcaacuc

SEQ ID NO: 1460298 - RNA, 23 nt, Pseudomonas aeruginosa PA01
ggcuuccagccagcccucgggga

SEQ ID NO: 1460299 - RNA, 23 nt, Pseudomonas aeruginosa PA01
ggcuucagccagaccggcagcgc

SEQ ID NO: 1460300 - RNA, 21 nt, Pseudomonas aeruginosa PA01
ggcuuccuccaucgccucgcg

SEQ ID NO: 1460301 - RNA, 13 nt, Pseudomonas aeruginosa PA01
ggcuuccggcucc

SEQ ID NO: 1460302 - RNA, 21 nt, Pseudomonas aeruginosa PA01
ggcuuccagguacggcccgcg

SEQ ID NO: 1460303 - RNA, 16 nt, Pseudomonas aeruginosa PA01
ggcuucccaggccagc

SEQ ID NO: 1460304 - RNA, 15 nt, Pseudomonas aeruginosa PA01
ggcuguugcugggcu

SEQ ID NO: 1460305 - RNA, 14 nt, Pseudomonas aeruginosa PA01
ggcuguuucaggcc

SEQ ID NO: 1460306 - RNA, 16 nt, Pseudomonas aeruginosa PA01
ggcuguuucaggccgg

SEQ ID NO: 1460307 - RNA, 18 nt, Pseudomonas aeruginosa PA01
ggcuguuucaggccggcg

SEQ ID NO: 1460308 - RNA, 12 nt, Pseudomonas aeruginosa PA01
ggcuguugccgg

SEQ ID NO: 1460309 - RNA, 23 nt, Pseudomonas aeruginosa PA01
ggcuucgcuggugcucaugccuu

SEQ ID NO: 1460310 - RNA, 16 nt, Pseudomonas aeruginosa PA01
ggcuugcccugcucgu

SEQ ID NO: 1460311 - RNA, 13 nt, Pseudomonas aeruginosa PA01
ggcuugccggcgc

SEQ ID NO: 1460312 - RNA, 15 nt, Pseudomonas aeruginosa PA01
ggcuugccggggucg

SEQ ID NO: 1460313 - RNA, 14 nt, Pseudomonas aeruginosa PA01
ggcuugcgccgaag

SEQ ID NO: 1460314 - RNA, 13 nt, Pseudomonas aeruginosa PA01
ggcuucgagcugc

SEQ ID NO: 1460315 - RNA, 16 nt, Pseudomonas aeruginosa PA01
ggcuuccuggaagcga

SEQ ID NO: 1460316 - RNA, 15 nt, Pseudomonas aeruginosa PA01
ggcuuccugggcgaa

SEQ ID NO: 1460317 - RNA, 13 nt, Pseudomonas aeruginosa PA01
ggcuuccuggugg

SEQ ID NO: 1460318 - RNA, 18 nt, Pseudomonas aeruginosa PA01
ggcuucgcccuacgcggc

SEQ ID NO: 1460319 - RNA, 13 nt, Pseudomonas aeruginosa PA01
ggcuucgccgccg

SEQ ID NO: 1460320 - RNA, 15 nt, Pseudomonas aeruginosa PA01
ggcuucgccgccgcg

SEQ ID NO: 1460321 - RNA, 19 nt, Pseudomonas aeruginosa PA01
ggcuucgcgcuccaggccc

SEQ ID NO: 1460322 - RNA, 17 nt, Pseudomonas aeruginosa PA01
ggcuucgcgcagauagu

SEQ ID NO: 1460323 - RNA, 16 nt, Pseudomonas aeruginosa PA01
ggcugucgucgagggu

SEQ ID NO: 1460324 - RNA, 14 nt, Pseudomonas aeruginosa PA01
ggcugucgacgcag

SEQ ID NO: 1460325 - RNA, 17 nt, Pseudomonas aeruginosa PA01
ggcugucgacgcagccg

SEQ ID NO: 1460326 - RNA, 23 nt, Pseudomonas aeruginosa PA01
ggcugucgacgcagccgggccgc

SEQ ID NO: 1460327 - RNA, 18 nt, Pseudomonas aeruginosa PA01
ggcugucgccgaucugca

SEQ ID NO: 1460328 - RNA, 16 nt, Pseudomonas aeruginosa PA01
ggcugucgcggacccg

SEQ ID NO: 1460329 - RNA, 22 nt, Pseudomonas aeruginosa PA01
ggcugucgcggacccgcgccgg

SEQ ID NO: 1460330 - RNA, 13 nt, Pseudomonas aeruginosa PA01
ggcugucggccag

SEQ ID NO: 1460331 - RNA, 17 nt, Pseudomonas aeruginosa PA01
ggcugucggccagcccc

SEQ ID NO: 1460332 - RNA, 19 nt, Pseudomonas aeruginosa PA01
ggcugucggccagccccug

SEQ ID NO: 1460333 - RNA, 13 nt, Pseudomonas aeruginosa PA01
ggcugucggccau

SEQ ID NO: 1460334 - RNA, 18 nt, Pseudomonas aeruginosa PA01
ggcugucggccaucgccg

SEQ ID NO: 1460335 - RNA, 18 nt, Pseudomonas aeruginosa PA01
ggcugugggucgggucgg

SEQ ID NO: 1460336 - RNA, 15 nt, Pseudomonas aeruginosa PA01
ggcugugcgccaggc

SEQ ID NO: 1460337 - RNA, 18 nt, Pseudomonas aeruginosa PA01
ggcugugcgccaggccgg

SEQ ID NO: 1460338 - RNA, 15 nt, Pseudomonas aeruginosa PA01
ggcugugcucgagga

SEQ ID NO: 1460339 - RNA, 14 nt, Pseudomonas aeruginosa PA01
ggcugugcuggcca

SEQ ID NO: 1460340 - RNA, 15 nt, Pseudomonas aeruginosa PA01
ggcugugcuggccac

SEQ ID NO: 1460341 - RNA, 19 nt, Pseudomonas aeruginosa PA01
ggcugugcaggaaggcgac

SEQ ID NO: 1460342 - RNA, 17 nt, Pseudomonas aeruginosa PA01
ggcugugccccaggcac

SEQ ID NO: 1460343 - RNA, 18 nt, Pseudomonas aeruginosa PA01
ggcucggcuuccaucacc

SEQ ID NO: 1460344 - RNA, 16 nt, Pseudomonas aeruginosa PA01
ggcucgggcgcggaca

SEQ ID NO: 1460345 - RNA, 16 nt, Pseudomonas aeruginosa PA01
ggcucgguuccagcuc

SEQ ID NO: 1460346 - RNA, 21 nt, Pseudomonas aeruginosa PA01
ggcucgguuccagcucgucga

SEQ ID NO: 1460347 - RNA, 20 nt, Pseudomonas aeruginosa PA01
ggcucgucggcguugcugau

SEQ ID NO: 1460348 - RNA, 22 nt, Pseudomonas aeruginosa PA01
ggcucgugccaucaggccgcgg

SEQ ID NO: 1460349 - RNA, 18 nt, Pseudomonas aeruginosa PA01
ggcuguccagcaggcguu

SEQ ID NO: 1460350 - RNA, 21 nt, Pseudomonas aeruginosa PA01
ggcuguccagcaggcguuccu

SEQ ID NO: 1460351 - RNA, 15 nt, Pseudomonas aeruginosa PA01
ggcuguagccggcga

SEQ ID NO: 1460352 - RNA, 19 nt, Pseudomonas aeruginosa PA01
ggcuguagccucccgccgc

SEQ ID NO: 1460353 - RNA, 23 nt, Pseudomonas aeruginosa PA01
ggcuguagccucccgccgcggcg

SEQ ID NO: 1460354 - RNA, 14 nt, Pseudomonas aeruginosa PA01
ggcuguagcgcucc

SEQ ID NO: 1460355 - RNA, 18 nt, Pseudomonas aeruginosa PA01
ggcuguaggugcccggcg

SEQ ID NO: 1460356 - RNA, 21 nt, Pseudomonas aeruginosa PA01
gggccacguucugcaggacga

SEQ ID NO: 1460357 - RNA, 21 nt, Pseudomonas aeruginosa PA01
gggccaccuggcucuguuccu

SEQ ID NO: 1460358 - RNA, 18 nt, Pseudomonas aeruginosa PA01
gggcauucguccagccgc

SEQ ID NO: 1460359 - RNA, 20 nt, Pseudomonas aeruginosa PA01
gggcauucguccagccgccg

SEQ ID NO: 1460360 - RNA, 21 nt, Pseudomonas aeruginosa PA01
gggcauucguccagccgccgc

SEQ ID NO: 1460361 - RNA, 22 nt, Pseudomonas aeruginosa PA01
gggcauuggccaucagcgccgc

SEQ ID NO: 1460362 - RNA, 15 nt, Pseudomonas aeruginosa PA01
gggcauccaucgcca

SEQ ID NO: 1460363 - RNA, 20 nt, Pseudomonas aeruginosa PA01
gggcaucgaccagacgcagc

SEQ ID NO: 1460364 - RNA, 14 nt, Pseudomonas aeruginosa PA01
gggcaucgaugacc

SEQ ID NO: 1460365 - RNA, 14 nt, Pseudomonas aeruginosa PA01
gggcaucgccgaca

SEQ ID NO: 1460366 - RNA, 15 nt, Pseudomonas aeruginosa PA01
gggcaucgccgacca

SEQ ID NO: 1460367 - RNA, 16 nt, Pseudomonas aeruginosa PA01
gggcaugcucggccag

SEQ ID NO: 1460368 - RNA, 18 nt, Pseudomonas aeruginosa PA01
gggcaugcucggccaggu

SEQ ID NO: 1460369 - RNA, 15 nt, Pseudomonas aeruginosa PA01
gggcaugcugcucgg

SEQ ID NO: 1460370 - RNA, 16 nt, Pseudomonas aeruginosa PA01
gggcauggcuggcgcu

SEQ ID NO: 1460371 - RNA, 16 nt, Pseudomonas aeruginosa PA01
gggcaugggucagcgc

SEQ ID NO: 1460372 - RNA, 21 nt, Pseudomonas aeruginosa PA01
gggcaugggucagcgccagca

SEQ ID NO: 1460373 - RNA, 22 nt, Pseudomonas aeruginosa PA01
gggcaugaccgauggcgccgcg

SEQ ID NO: 1460374 - RNA, 21 nt, Pseudomonas aeruginosa PA01
gggcaagcucgacgagccgcg

SEQ ID NO: 1460375 - RNA, 18 nt, Pseudomonas aeruginosa PA01
gggccaucgccggcccgc

SEQ ID NO: 1460376 - RNA, 14 nt, Pseudomonas aeruginosa PA01
gggccaugaccucg

SEQ ID NO: 1460377 - RNA, 16 nt, Pseudomonas aeruginosa PA01
gggccaugaccucggc

SEQ ID NO: 1460378 - RNA, 20 nt, Pseudomonas aeruginosa PA01
gggccaugaccucggccagc

SEQ ID NO: 1460379 - RNA, 15 nt, Pseudomonas aeruginosa PA01
gggcccacagugcca

SEQ ID NO: 1460380 - RNA, 18 nt, Pseudomonas aeruginosa PA01
gggcccaagccgagcggc

SEQ ID NO: 1460381 - RNA, 19 nt, Pseudomonas aeruginosa PA01
gggcccaagccgagcggca

SEQ ID NO: 1460382 - RNA, 21 nt, Pseudomonas aeruginosa PA01
gggccccucgccgugacgagg

SEQ ID NO: 1460383 - RNA, 17 nt, Pseudomonas aeruginosa PA01
gggcccaggcuggcggc

SEQ ID NO: 1460384 - RNA, 21 nt, Pseudomonas aeruginosa PA01
gggcccaggcuggcggccagg

SEQ ID NO: 1460385 - RNA, 17 nt, Pseudomonas aeruginosa PA01
gggcccauuccacgugc

SEQ ID NO: 1460386 - RNA, 20 nt, Pseudomonas aeruginosa PA01
gggcccagagcagcaccagc

SEQ ID NO: 1460387 - RNA, 22 nt, Pseudomonas aeruginosa PA01
gggcccagagcagcaccagcac

SEQ ID NO: 1460388 - RNA, 12 nt, Pseudomonas aeruginosa PA01
gggccagcgccg

SEQ ID NO: 1460389 - RNA, 21 nt, Pseudomonas aeruginosa PA01
gggccaggaugaccaggcuga

SEQ ID NO: 1460390 - RNA, 21 nt, Pseudomonas aeruginosa PA01
gggccaggaaaucgagcgcca

SEQ ID NO: 1460391 - RNA, 22 nt, Pseudomonas aeruginosa PA01
gggccaggagcaucggcgcggc

SEQ ID NO: 1460392 - RNA, 15 nt, Pseudomonas aeruginosa PA01
gggccaggccgagca

SEQ ID NO: 1460393 - RNA, 15 nt, Pseudomonas aeruginosa PA01
gggccaggccgagcg

SEQ ID NO: 1460394 - RNA, 15 nt, Pseudomonas aeruginosa PA01
gggccagggcgagga

SEQ ID NO: 1460395 - RNA, 13 nt, Pseudomonas aeruginosa PA01
gggccagggcggc

SEQ ID NO: 1460396 - RNA, 16 nt, Pseudomonas aeruginosa PA01
gggccagcagcgcugc

SEQ ID NO: 1460397 - RNA, 15 nt, Pseudomonas aeruginosa PA01
gggccagcaggcgcu

SEQ ID NO: 1460398 - RNA, 16 nt, Pseudomonas aeruginosa PA01
gggccagcagggccgc

SEQ ID NO: 1460399 - RNA, 21 nt, Pseudomonas aeruginosa PA01
gggccagcagggccgccgagg

SEQ ID NO: 1460400 - RNA, 22 nt, Pseudomonas aeruginosa PA01
gggccagcaggguggccagggu

SEQ ID NO: 1460401 - RNA, 16 nt, Pseudomonas aeruginosa PA01
gggccagcaacaggca

SEQ ID NO: 1460402 - RNA, 16 nt, Pseudomonas aeruginosa PA01
gggccagccagagcca

SEQ ID NO: 1460403 - RNA, 12 nt, Pseudomonas aeruginosa PA01
gggccagcggaa

SEQ ID NO: 1460404 - RNA, 15 nt, Pseudomonas aeruginosa PA01
gggcgaugcggcgga

SEQ ID NO: 1460405 - RNA, 14 nt, Pseudomonas aeruginosa PA01
gggcgcaccgccuc

SEQ ID NO: 1460406 - RNA, 21 nt, Pseudomonas aeruginosa PA01
gggcgcacuccgggcagacca

SEQ ID NO: 1460407 - RNA, 14 nt, Pseudomonas aeruginosa PA01
gggcgauggccagc

SEQ ID NO: 1460408 - RNA, 22 nt, Pseudomonas aeruginosa PA01
gggcgauguugaacagcgccgg

SEQ ID NO: 1460409 - RNA, 13 nt, Pseudomonas aeruginosa PA01
gggcgaugccgau

SEQ ID NO: 1460410 - RNA, 14 nt, Pseudomonas aeruginosa PA01
gggcgaugccgaug

SEQ ID NO: 1460411 - RNA, 21 nt, Pseudomonas aeruginosa PA01
gggcgaaguugaaacggcgga

SEQ ID NO: 1460412 - RNA, 13 nt, Pseudomonas aeruginosa PA01
gggcgaauaccag

SEQ ID NO: 1460413 - RNA, 20 nt, Pseudomonas aeruginosa PA01
gggcgaauaccagugccgcg

SEQ ID NO: 1460414 - RNA, 21 nt, Pseudomonas aeruginosa PA01
gggcgaauaccagugccgcgg

SEQ ID NO: 1460415 - RNA, 13 nt, Pseudomonas aeruginosa PA01
gggcgaaggccac

SEQ ID NO: 1460416 - RNA, 16 nt, Pseudomonas aeruginosa PA01
gggcgaaggccucguc

SEQ ID NO: 1460417 - RNA, 19 nt, Pseudomonas aeruginosa PA01
gggcgaagucggcgcgcca

SEQ ID NO: 1460418 - RNA, 14 nt, Pseudomonas aeruginosa PA01
gggcgaagcgcagc

SEQ ID NO: 1460419 - RNA, 20 nt, Pseudomonas aeruginosa PA01
gggcgaagccggcggcgcgg

SEQ ID NO: 1460420 - RNA, 14 nt, Pseudomonas aeruginosa PA01
gggcgccgaccagc

SEQ ID NO: 1460421 - RNA, 15 nt, Pseudomonas aeruginosa PA01
gggcgccgaccagcu

SEQ ID NO: 1460422 - RNA, 13 nt, Pseudomonas aeruginosa PA01
gggcgccgccagc

SEQ ID NO: 1460423 - RNA, 13 nt, Pseudomonas aeruginosa PA01
gggcgccgccggu

SEQ ID NO: 1460424 - RNA, 14 nt, Pseudomonas aeruginosa PA01
gggcgccagccgcc

SEQ ID NO: 1460425 - RNA, 17 nt, Pseudomonas aeruginosa PA01
gggcgccagccgccauc

SEQ ID NO: 1460426 - RNA, 15 nt, Pseudomonas aeruginosa PA01
gggcgccggcgcgca

SEQ ID NO: 1460427 - RNA, 14 nt, Pseudomonas aeruginosa PA01
gggcgccggcucgc

SEQ ID NO: 1460428 - RNA, 23 nt, Pseudomonas aeruginosa PA01
gggcgccggcaggccuucggcgc

SEQ ID NO: 1460429 - RNA, 13 nt, Pseudomonas aeruginosa PA01
gggcgcaggccga

SEQ ID NO: 1460430 - RNA, 18 nt, Pseudomonas aeruginosa PA01
gggcgcaggggcgcgccg

SEQ ID NO: 1460431 - RNA, 19 nt, Pseudomonas aeruginosa PA01
gggcgcaggggcgcgccgg

SEQ ID NO: 1460432 - RNA, 12 nt, Pseudomonas aeruginosa PA01
gggcgccaccgc

SEQ ID NO: 1460433 - RNA, 13 nt, Pseudomonas aeruginosa PA01
gggcgcccgcccg

SEQ ID NO: 1460434 - RNA, 23 nt, Pseudomonas aeruginosa PA01
gggcgcccgcccggaaccaccgg

SEQ ID NO: 1460435 - RNA, 19 nt, Pseudomonas aeruginosa PA01
gggcgcccgcccggcacca

SEQ ID NO: 1460436 - RNA, 23 nt, Pseudomonas aeruginosa PA01
gggcgcccgcccggcaccaccgg

SEQ ID NO: 1460437 - RNA, 23 nt, Pseudomonas aeruginosa PA01
gggcgccaucgcuuuccuggccg

SEQ ID NO: 1460438 - RNA, 14 nt, Pseudomonas aeruginosa PA01
gggccgaccugccc

SEQ ID NO: 1460439 - RNA, 16 nt, Pseudomonas aeruginosa PA01
gggccgaccugcccgc

SEQ ID NO: 1460440 - RNA, 18 nt, Pseudomonas aeruginosa PA01
gggccgagcgcagcgcca

SEQ ID NO: 1460441 - RNA, 23 nt, Pseudomonas aeruginosa PA01
gggccgagcgcagcgccaccagg

SEQ ID NO: 1460442 - RNA, 23 nt, Pseudomonas aeruginosa PA01
gggccgagggugaucagccgagg

SEQ ID NO: 1460443 - RNA, 14 nt, Pseudomonas aeruginosa PA01
gggccgaggucgcg

SEQ ID NO: 1460444 - RNA, 20 nt, Pseudomonas aeruginosa PA01
gggccgaggucgcgggccag

SEQ ID NO: 1460445 - RNA, 13 nt, Pseudomonas aeruginosa PA01
gggccgauccgcg

SEQ ID NO: 1460446 - RNA, 19 nt, Pseudomonas aeruginosa PA01
gggccgaucgagcggcccg

SEQ ID NO: 1460447 - RNA, 21 nt, Pseudomonas aeruginosa PA01
gggccgaugccgggcaacgcg

SEQ ID NO: 1460448 - RNA, 16 nt, Pseudomonas aeruginosa PA01
gggccgccagccgcca

SEQ ID NO: 1460449 - RNA, 19 nt, Pseudomonas aeruginosa PA01
gggccgcagguuggccccg

SEQ ID NO: 1460450 - RNA, 18 nt, Pseudomonas aeruginosa PA01
gggcgaaacggcaggcca

SEQ ID NO: 1460451 - RNA, 20 nt, Pseudomonas aeruginosa PA01
gggcgaaacggcaggccagc

SEQ ID NO: 1460452 - RNA, 19 nt, Pseudomonas aeruginosa PA01
gggcgaacaacgccgccgg

SEQ ID NO: 1460453 - RNA, 14 nt, Pseudomonas aeruginosa PA01
gggcgaacagcagc

SEQ ID NO: 1460454 - RNA, 22 nt, Pseudomonas aeruginosa PA01
gggcgaacagcgccgcggcugg

SEQ ID NO: 1460455 - RNA, 14 nt, Pseudomonas aeruginosa PA01
gggccuucgccagc

SEQ ID NO: 1460456 - RNA, 15 nt, Pseudomonas aeruginosa PA01
gggccuucaggcgcu

SEQ ID NO: 1460457 - RNA, 17 nt, Pseudomonas aeruginosa PA01
gggccuucaggcgcucc

SEQ ID NO: 1460458 - RNA, 15 nt, Pseudomonas aeruginosa PA01
gggccuugagcaggc

SEQ ID NO: 1460459 - RNA, 18 nt, Pseudomonas aeruginosa PA01
gggccuugagcaggcguu

SEQ ID NO: 1460460 - RNA, 22 nt, Pseudomonas aeruginosa PA01
gggccuuuuccguuguggcggc

SEQ ID NO: 1460461 - RNA, 21 nt, Pseudomonas aeruginosa PA01
gggccuuuucuuuggcgacga

SEQ ID NO: 1460462 - RNA, 17 nt, Pseudomonas aeruginosa PA01
gccguguugaugccgau

SEQ ID NO: 1460463 - RNA, 15 nt, Pseudomonas aeruginosa PA01
gccguuacgccgggu

SEQ ID NO: 1460464 - RNA, 14 nt, Pseudomonas aeruginosa PA01
gccguggucgcgca

SEQ ID NO: 1460465 - RNA, 15 nt, Pseudomonas aeruginosa PA01
gccguggucgcgcag

SEQ ID NO: 1460466 - RNA, 17 nt, Pseudomonas aeruginosa PA01
gccguggucgcgcaggc

SEQ ID NO: 1460467 - RNA, 16 nt, Pseudomonas aeruginosa PA01
gccgugggucgccucg

SEQ ID NO: 1460468 - RNA, 22 nt, Pseudomonas aeruginosa PA01
gccguggcucggcggcaggcug

SEQ ID NO: 1460469 - RNA, 20 nt, Pseudomonas aeruginosa PA01
gccguggcugugcuggccac

SEQ ID NO: 1460470 - RNA, 14 nt, Pseudomonas aeruginosa PA01
gccgugggccgccg

SEQ ID NO: 1460471 - RNA, 20 nt, Pseudomonas aeruginosa PA01
gccgugggccggcgcgccgu

SEQ ID NO: 1460472 - RNA, 16 nt, Pseudomonas aeruginosa PA01
gccgugggcgccgccg

SEQ ID NO: 1460473 - RNA, 15 nt, Pseudomonas aeruginosa PA01
gccgugggcguagag

SEQ ID NO: 1460474 - RNA, 21 nt, Pseudomonas aeruginosa PA01
gccgugggcguagagccugga

SEQ ID NO: 1460475 - RNA, 15 nt, Pseudomonas aeruginosa PA01
gccguggcaggcgcc

SEQ ID NO: 1460476 - RNA, 16 nt, Pseudomonas aeruginosa PA01
gccguggcggcgcgcg

SEQ ID NO: 1460477 - RNA, 16 nt, Pseudomonas aeruginosa PA01
gccguggcgccccagg

SEQ ID NO: 1460478 - RNA, 20 nt, Pseudomonas aeruginosa PA01
gccguggcgccccaggcggg

SEQ ID NO: 1460479 - RNA, 21 nt, Pseudomonas aeruginosa PA01
gccguggcgccccaggcgggc

SEQ ID NO: 1460480 - RNA, 19 nt, Pseudomonas aeruginosa PA01
gccgucgggcauggcgauc

SEQ ID NO: 1460481 - RNA, 20 nt, Pseudomonas aeruginosa PA01
gccgucgggcuucgguguau

SEQ ID NO: 1460482 - RNA, 23 nt, Pseudomonas aeruginosa PA01
gccgucggugaucgagacgccgu

SEQ ID NO: 1460483 - RNA, 15 nt, Pseudomonas aeruginosa PA01
gccgucggcuccgcu

SEQ ID NO: 1460484 - RNA, 17 nt, Pseudomonas aeruginosa PA01
gccgugcagggucaggu

SEQ ID NO: 1460485 - RNA, 18 nt, Pseudomonas aeruginosa PA01
gccgugcagggucagguc

SEQ ID NO: 1460486 - RNA, 12 nt, Pseudomonas aeruginosa PA01
gccgugcagcag

SEQ ID NO: 1460487 - RNA, 13 nt, Pseudomonas aeruginosa PA01
gccgugcagcagc

SEQ ID NO: 1460488 - RNA, 14 nt, Pseudomonas aeruginosa PA01
gccgugcagcagcg

SEQ ID NO: 1460489 - RNA, 18 nt, Pseudomonas aeruginosa PA01
gccgugcagcagcgaccu

SEQ ID NO: 1460490 - RNA, 13 nt, Pseudomonas aeruginosa PA01
gccgugcagcccu

SEQ ID NO: 1460491 - RNA, 21 nt, Pseudomonas aeruginosa PA01
gccguggaccaacagccggcg

SEQ ID NO: 1460492 - RNA, 20 nt, Pseudomonas aeruginosa PA01
gccguggaccaggaucaccu

SEQ ID NO: 1460493 - RNA, 14 nt, Pseudomonas aeruginosa PA01
gccguggaacgcag

SEQ ID NO: 1460494 - RNA, 15 nt, Pseudomonas aeruginosa PA01
gccguggcaccaggu

SEQ ID NO: 1460495 - RNA, 15 nt, Pseudomonas aeruginosa PA01
gccguggcacccagg

SEQ ID NO: 1460496 - RNA, 13 nt, Pseudomonas aeruginosa PA01
gccguggaucgcc

SEQ ID NO: 1460497 - RNA, 17 nt, Pseudomonas aeruginosa PA01
gccguggaucgcccggc

SEQ ID NO: 1460498 - RNA, 17 nt, Pseudomonas aeruginosa PA01
gccgugcaugccgacga

SEQ ID NO: 1460499 - RNA, 15 nt, Pseudomonas aeruginosa PA01
gccgugcaucaccgg

SEQ ID NO: 1460500 - RNA, 20 nt, Pseudomonas aeruginosa PA01
gccgugcaucaccggcagca

SEQ ID NO: 1460501 - RNA, 21 nt, Pseudomonas aeruginosa PA01
gccgugcaucaccggcagcag

SEQ ID NO: 1460502 - RNA, 23 nt, Pseudomonas aeruginosa PA01
gccgugcaucaccggcagcagcg

SEQ ID NO: 1460503 - RNA, 19 nt, Pseudomonas aeruginosa PA01
gccguuuuuuaugccgagg

SEQ ID NO: 1460504 - RNA, 21 nt, Pseudomonas aeruginosa PA01
gccguuuuuuaugccgaggcg

SEQ ID NO: 1460505 - RNA, 22 nt, Pseudomonas aeruginosa PA01
gccguuuuuuaugccgaggcgu

SEQ ID NO: 1460506 - RNA, 17 nt, Pseudomonas aeruginosa PA01
gccguuuuacucgucgc

SEQ ID NO: 1460507 - RNA, 19 nt, Pseudomonas aeruginosa PA01
gccguucgucaccggcgcc

SEQ ID NO: 1460508 - RNA, 20 nt, Pseudomonas aeruginosa PA01
gccguucgucaccggcgcca

SEQ ID NO: 1460509 - RNA, 21 nt, Pseudomonas aeruginosa PA01
gccguuucguuuccguugucu

SEQ ID NO: 1460510 - RNA, 19 nt, Pseudomonas aeruginosa PA01
gccguucucauugcgccgc

SEQ ID NO: 1460511 - RNA, 13 nt, Pseudomonas aeruginosa PA01
gccguucucccgc

SEQ ID NO: 1460512 - RNA, 18 nt, Pseudomonas aeruginosa PA01
gccguucagcucccaggc

SEQ ID NO: 1460513 - RNA, 19 nt, Pseudomonas aeruginosa PA01
gccguucagcucccaggcg

SEQ ID NO: 1460514 - RNA, 13 nt, Pseudomonas aeruginosa PA01
gccguucaggccg

SEQ ID NO: 1460515 - RNA, 16 nt, Pseudomonas aeruginosa PA01
gccguucaggccggcg

SEQ ID NO: 1460516 - RNA, 17 nt, Pseudomonas aeruginosa PA01
gccguucaggccggcgc

SEQ ID NO: 1460517 - RNA, 14 nt, Pseudomonas aeruginosa PA01
gccguucaggcgcg

SEQ ID NO: 1460518 - RNA, 15 nt, Pseudomonas aeruginosa PA01
gccguucaggcgcgg

SEQ ID NO: 1460519 - RNA, 15 nt, Pseudomonas aeruginosa PA01
gccguucacgccugg

SEQ ID NO: 1460520 - RNA, 17 nt, Pseudomonas aeruginosa PA01
gccguucacgccuggcg

SEQ ID NO: 1460521 - RNA, 13 nt, Pseudomonas aeruginosa PA01
gccguuccagcgg

SEQ ID NO: 1460522 - RNA, 21 nt, Pseudomonas aeruginosa PA01
gccguucgaaucuucguaggu

SEQ ID NO: 1460523 - RNA, 15 nt, Pseudomonas aeruginosa PA01
gccguucgcccgcca

SEQ ID NO: 1460524 - RNA, 12 nt, Pseudomonas aeruginosa PA01
gccguucgcccu

SEQ ID NO: 1460525 - RNA, 20 nt, Pseudomonas aeruginosa PA01
gccguuccuccucgccgccg

SEQ ID NO: 1460526 - RNA, 21 nt, Pseudomonas aeruginosa PA01
gccguuccuccucgccgccga

SEQ ID NO: 1460527 - RNA, 22 nt, Pseudomonas aeruginosa PA01
gccguuccuccucgccgccgac

SEQ ID NO: 1460528 - RNA, 13 nt, Pseudomonas aeruginosa PA01
gccguucccgguc

SEQ ID NO: 1460529 - RNA, 12 nt, Pseudomonas aeruginosa PA01
gccuccagcgcc

SEQ ID NO: 1460530 - RNA, 13 nt, Pseudomonas aeruginosa PA01
gccuccagcgccg

SEQ ID NO: 1460531 - RNA, 16 nt, Pseudomonas aeruginosa PA01
gccuccagcgccgccu

SEQ ID NO: 1460532 - RNA, 19 nt, Pseudomonas aeruginosa PA01
gccuccagcgccgccucga

SEQ ID NO: 1460533 - RNA, 19 nt, Pseudomonas aeruginosa PA01
gccuccagcgccucgccga

SEQ ID NO: 1460534 - RNA, 20 nt, Pseudomonas aeruginosa PA01
gccuccagcgucugccgcug

SEQ ID NO: 1460535 - RNA, 16 nt, Pseudomonas aeruginosa PA01
gccuccacggcggccu

SEQ ID NO: 1460536 - RNA, 17 nt, Pseudomonas aeruginosa PA01
gccuccacggcggccuc

SEQ ID NO: 1460537 - RNA, 18 nt, Pseudomonas aeruginosa PA01
gccuccaccagcgccggc

SEQ ID NO: 1460538 - RNA, 19 nt, Pseudomonas aeruginosa PA01
gccuccaccagcgccggcg

SEQ ID NO: 1460539 - RNA, 22 nt, Pseudomonas aeruginosa PA01
gccucauucgcucugcgccagg

SEQ ID NO: 1460540 - RNA, 23 nt, Pseudomonas aeruginosa PA01
gccucauucgcucugcgccaggc

SEQ ID NO: 1460541 - RNA, 21 nt, Pseudomonas aeruginosa PA01
gccucaguuuucuaaccggcg

SEQ ID NO: 1460542 - RNA, 22 nt, Pseudomonas aeruginosa PA01
gccucaguuuucuaaccggcgu

SEQ ID NO: 1460543 - RNA, 12 nt, Pseudomonas aeruginosa PA01
gccuacugcugg

SEQ ID NO: 1460544 - RNA, 16 nt, Pseudomonas aeruginosa PA01
gccuacugcuggacgg

SEQ ID NO: 1460545 - RNA, 21 nt, Pseudomonas aeruginosa PA01
gccucagcgaaacucgugcuc

SEQ ID NO: 1460546 - RNA, 19 nt, Pseudomonas aeruginosa PA01
gccuacugggcguggcggc

SEQ ID NO: 1460547 - RNA, 22 nt, Pseudomonas aeruginosa PA01
gccucagcggaacuugcgccga

SEQ ID NO: 1460548 - RNA, 13 nt, Pseudomonas aeruginosa PA01
gccucagcggccu

SEQ ID NO: 1460549 - RNA, 17 nt, Pseudomonas aeruginosa PA01
gccucagcggcuggcga

SEQ ID NO: 1460550 - RNA, 12 nt, Pseudomonas aeruginosa PA01
gccucaggccgg

SEQ ID NO: 1460551 - RNA, 14 nt, Pseudomonas aeruginosa PA01
gccucaggccggga

SEQ ID NO: 1460552 - RNA, 19 nt, Pseudomonas aeruginosa PA01
gccucaggcgcugcgcggc

SEQ ID NO: 1460553 - RNA, 19 nt, Pseudomonas aeruginosa PA01
gccuaccggggcgcgggcg

SEQ ID NO: 1460554 - RNA, 21 nt, Pseudomonas aeruginosa PA01
gccguacuucagggugacguc

SEQ ID NO: 1460555 - RNA, 13 nt, Pseudomonas aeruginosa PA01
gccguagaacagc

SEQ ID NO: 1460556 - RNA, 17 nt, Pseudomonas aeruginosa PA01
gccguagaacgccagga

SEQ ID NO: 1460557 - RNA, 14 nt, Pseudomonas aeruginosa PA01
gccguagaccacca

SEQ ID NO: 1460558 - RNA, 17 nt, Pseudomonas aeruginosa PA01
gccguagaccaccagca

SEQ ID NO: 1460559 - RNA, 18 nt, Pseudomonas aeruginosa PA01
gccguagaccaccagcag

SEQ ID NO: 1460560 - RNA, 20 nt, Pseudomonas aeruginosa PA01
gccguagaccaccagcagca

SEQ ID NO: 1460561 - RNA, 17 nt, Pseudomonas aeruginosa PA01
gccguagaucaggacga

SEQ ID NO: 1460562 - RNA, 17 nt, Pseudomonas aeruginosa PA01
gccguagcaaguugucc

SEQ ID NO: 1460563 - RNA, 14 nt, Pseudomonas aeruginosa PA01
gccguagccgaacg

SEQ ID NO: 1460564 - RNA, 22 nt, Pseudomonas aeruginosa PA01
gccguagccgaacggguagagc

SEQ ID NO: 1460565 - RNA, 14 nt, Pseudomonas aeruginosa PA01
gccguagcgcaguu

SEQ ID NO: 1460566 - RNA, 23 nt, Pseudomonas aeruginosa PA01
gccguagcgcaguucgccgccga

SEQ ID NO: 1460567 - RNA, 14 nt, Pseudomonas aeruginosa PA01
gccguagccggugc

SEQ ID NO: 1460568 - RNA, 21 nt, Pseudomonas aeruginosa PA01
gccguacucauggccgcagcg

SEQ ID NO: 1460569 - RNA, 17 nt, Pseudomonas aeruginosa PA01
gccguaccagucgcccg

SEQ ID NO: 1460570 - RNA, 19 nt, Pseudomonas aeruginosa PA01
gccguaccagucgcccgcu

SEQ ID NO: 1460571 - RNA, 14 nt, Pseudomonas aeruginosa PA01
gccguacaggucgg

SEQ ID NO: 1460572 - RNA, 16 nt, Pseudomonas aeruginosa PA01
gccguacaggucggcg

SEQ ID NO: 1460573 - RNA, 22 nt, Pseudomonas aeruginosa PA01
gccguacaggucggcgccggug

SEQ ID NO: 1460574 - RNA, 16 nt, Pseudomonas aeruginosa PA01
gccguacagcaggcag

SEQ ID NO: 1460575 - RNA, 19 nt, Pseudomonas aeruginosa PA01
gccguacagcccccgccgg

SEQ ID NO: 1460576 - RNA, 22 nt, Pseudomonas aeruginosa PA01
gccguacagcccccgccggccg

SEQ ID NO: 1460577 - RNA, 14 nt, Pseudomonas aeruginosa PA01
gccgguuucgaccg

SEQ ID NO: 1460578 - RNA, 16 nt, Pseudomonas aeruginosa PA01
gccgguuucgaccggc

SEQ ID NO: 1460579 - RNA, 17 nt, Pseudomonas aeruginosa PA01
gccgguuucgaccggcg

SEQ ID NO: 1460580 - RNA, 18 nt, Pseudomonas aeruginosa PA01
gccgguuucgaccggcgc

SEQ ID NO: 1460581 - RNA, 20 nt, Pseudomonas aeruginosa PA01
gccgguuucgaccggcgcgc

SEQ ID NO: 1460582 - RNA, 17 nt, Pseudomonas aeruginosa PA01
gccgguugcggcgccgg

SEQ ID NO: 1460583 - RNA, 16 nt, Pseudomonas aeruginosa PA01
gccgguugcugcugcg

SEQ ID NO: 1460584 - RNA, 22 nt, Pseudomonas aeruginosa PA01
gccgguugcugcuugcgcgcgg

SEQ ID NO: 1460585 - RNA, 16 nt, Pseudomonas aeruginosa PA01
gccgggaugaacccgg

SEQ ID NO: 1460586 - RNA, 18 nt, Pseudomonas aeruginosa PA01
gccgggaucuccucgacg

SEQ ID NO: 1460587 - RNA, 18 nt, Pseudomonas aeruginosa PA01
gccgguuccgaaucgccu

SEQ ID NO: 1460588 - RNA, 22 nt, Pseudomonas aeruginosa PA01
gccgguuccgaaucgccuacca

SEQ ID NO: 1460589 - RNA, 16 nt, Pseudomonas aeruginosa PA01
gccgguucgcaggcca

SEQ ID NO: 1460590 - RNA, 20 nt, Pseudomonas aeruginosa PA01
gccgguucgcaggccaggcg

SEQ ID NO: 1460591 - RNA, 21 nt, Pseudomonas aeruginosa PA01
gccgggaagucguucccggcc

SEQ ID NO: 1460592 - RNA, 13 nt, Pseudomonas aeruginosa PA01
gccgggaccacgc

SEQ ID NO: 1460593 - RNA, 17 nt, Pseudomonas aeruginosa PA01
gccgggaaucgccagca

SEQ ID NO: 1460594 - RNA, 17 nt, Pseudomonas aeruginosa PA01
gccgggaaucuggccga

SEQ ID NO: 1460595 - RNA, 20 nt, Pseudomonas aeruginosa PA01
gccgggaauggagaugccga

SEQ ID NO: 1460596 - RNA, 21 nt, Pseudomonas aeruginosa PA01
gccgggaauggagaugccgaa

SEQ ID NO: 1460597 - RNA, 16 nt, Pseudomonas aeruginosa PA01
gccgggaagcgcaggc

SEQ ID NO: 1460598 - RNA, 17 nt, Pseudomonas aeruginosa PA01
gccgggaagcgcaggcc

SEQ ID NO: 1460599 - RNA, 18 nt, Pseudomonas aeruginosa PA01
gccgggaagcgcaggccg

SEQ ID NO: 1460600 - RNA, 19 nt, Pseudomonas aeruginosa PA01
gccgggaagcgcaggccgc

SEQ ID NO: 1460601 - RNA, 21 nt, Pseudomonas aeruginosa PA01
gccgggaagcgcaggccgccg

SEQ ID NO: 1460602 - RNA, 22 nt, Pseudomonas aeruginosa PA01
gccgggaagcgcaggccgccgg

SEQ ID NO: 1460603 - RNA, 18 nt, Pseudomonas aeruginosa PA01
gccgggauacagcagcca

SEQ ID NO: 1460604 - RNA, 22 nt, Pseudomonas aeruginosa PA01
gccgggauacagcagccaagga

SEQ ID NO: 1460605 - RNA, 23 nt, Pseudomonas aeruginosa PA01
gccgggaagcaccgacucgcccu

SEQ ID NO: 1460606 - RNA, 19 nt, Pseudomonas aeruginosa PA01
gccgggagcuacagcgauu

SEQ ID NO: 1460607 - RNA, 16 nt, Pseudomonas aeruginosa PA01
gccgucgacuugccga

SEQ ID NO: 1460608 - RNA, 17 nt, Pseudomonas aeruginosa PA01
gccgucgacuugccgau

SEQ ID NO: 1460609 - RNA, 15 nt, Pseudomonas aeruginosa PA01
gccgucgagcaccag

SEQ ID NO: 1460610 - RNA, 16 nt, Pseudomonas aeruginosa PA01
gccgucgagcaccagc

SEQ ID NO: 1460611 - RNA, 17 nt, Pseudomonas aeruginosa PA01
gccgucgagcaccagca

SEQ ID NO: 1460612 - RNA, 18 nt, Pseudomonas aeruginosa PA01
gccgucgagcaccagcag

SEQ ID NO: 1460613 - RNA, 22 nt, Pseudomonas aeruginosa PA01
gccgucgagcaccagcaggucg

SEQ ID NO: 1460614 - RNA, 17 nt, Pseudomonas aeruginosa PA01
gccgucgagccagccca

SEQ ID NO: 1460615 - RNA, 20 nt, Pseudomonas aeruginosa PA01
gccgucgagccagcccagcg

SEQ ID NO: 1460616 - RNA, 20 nt, Pseudomonas aeruginosa PA01
gccgucgagggcaaaggcgc

SEQ ID NO: 1460617 - RNA, 18 nt, Pseudomonas aeruginosa PA01
gccgucggccuggcgguu

SEQ ID NO: 1460618 - RNA, 14 nt, Pseudomonas aeruginosa PA01
gccgucggcgcggg

SEQ ID NO: 1460619 - RNA, 18 nt, Pseudomonas aeruginosa PA01
gccgucggcgcggggcgu

SEQ ID NO: 1460620 - RNA, 12 nt, Pseudomonas aeruginosa PA01
gccgucggcggu

SEQ ID NO: 1460621 - RNA, 14 nt, Pseudomonas aeruginosa PA01
gccgucggcgguca

SEQ ID NO: 1460622 - RNA, 11 nt, Pseudomonas aeruginosa PA01
gccgucggcgg

SEQ ID NO: 1460623 - RNA, 19 nt, Pseudomonas aeruginosa PA01
gccguccaucaggcguucg

SEQ ID NO: 1460624 - RNA, 19 nt, Pseudomonas aeruginosa PA01
gccguccaggcgcgaacgc

SEQ ID NO: 1460625 - RNA, 17 nt, Pseudomonas aeruginosa PA01
gccgucauggcgggcgu

SEQ ID NO: 1460626 - RNA, 17 nt, Pseudomonas aeruginosa PA01
gccgucccagucggcgu

SEQ ID NO: 1460627 - RNA, 19 nt, Pseudomonas aeruginosa PA01
gccgucccagucggcgucc

SEQ ID NO: 1460628 - RNA, 21 nt, Pseudomonas aeruginosa PA01
gccgucccagucggcguccgc

SEQ ID NO: 1460629 - RNA, 22 nt, Pseudomonas aeruginosa PA01
gccgucgacccgccucacccca

SEQ ID NO: 1460630 - RNA, 16 nt, Pseudomonas aeruginosa PA01
gccguagcugcgcgcc

SEQ ID NO: 1460631 - RNA, 17 nt, Pseudomonas aeruginosa PA01
gccguagggcgaauaac

SEQ ID NO: 1460632 - RNA, 20 nt, Pseudomonas aeruginosa PA01
gccguagggcgaauaacgcc

SEQ ID NO: 1460633 - RNA, 20 nt, Pseudomonas aeruginosa PA01
gccguaggcgauggccuggu

SEQ ID NO: 1460634 - RNA, 17 nt, Pseudomonas aeruginosa PA01
gccguaggugaccgccc

SEQ ID NO: 1460635 - RNA, 17 nt, Pseudomonas aeruginosa PA01
gccgucaucgcugaccu

SEQ ID NO: 1460636 - RNA, 20 nt, Pseudomonas aeruginosa PA01
gccgucaucgcugaccugga

SEQ ID NO: 1460637 - RNA, 22 nt, Pseudomonas aeruginosa PA01
gccguaguucgaaccguggcgg

SEQ ID NO: 1460638 - RNA, 14 nt, Pseudomonas aeruginosa PA01
gccgucaggcaccu

SEQ ID NO: 1460639 - RNA, 21 nt, Pseudomonas aeruginosa PA01
gccgucaggcaccucguccag

SEQ ID NO: 1460640 - RNA, 22 nt, Pseudomonas aeruginosa PA01
gccugcaccagccaguccggca

SEQ ID NO: 1460641 - RNA, 13 nt, Pseudomonas aeruginosa PA01
gccugcaacgcca

SEQ ID NO: 1460642 - RNA, 14 nt, Pseudomonas aeruginosa PA01
gccugcaacgccgc

SEQ ID NO: 1460643 - RNA, 16 nt, Pseudomonas aeruginosa PA01
gccugcaacguccucg

SEQ ID NO: 1460644 - RNA, 15 nt, Pseudomonas aeruginosa PA01
gccugcaacucgucg

SEQ ID NO: 1460645 - RNA, 24 nt, Pseudomonas aeruginosa PA01
gccugcaacucgucguccagcggc

SEQ ID NO: 1460646 - RNA, 14 nt, Pseudomonas aeruginosa PA01
gccugcaccgggcc

SEQ ID NO: 1460647 - RNA, 19 nt, Pseudomonas aeruginosa PA01
gccugcaccgggccgaccu

SEQ ID NO: 1460648 - RNA, 13 nt, Pseudomonas aeruginosa PA01
gccugcaccacgc

SEQ ID NO: 1460649 - RNA, 20 nt, Pseudomonas aeruginosa PA01
gccugcagguagcgcugcgc

SEQ ID NO: 1460650 - RNA, 20 nt, Pseudomonas aeruginosa PA01
gccugcagcgacuccagcca

SEQ ID NO: 1460651 - RNA, 21 nt, Pseudomonas aeruginosa PA01
gccugcagcgacuccagccag

SEQ ID NO: 1460652 - RNA, 14 nt, Pseudomonas aeruginosa PA01
gccugcagccuggc

SEQ ID NO: 1460653 - RNA, 15 nt, Pseudomonas aeruginosa PA01
gccugcagccuggcg

SEQ ID NO: 1460654 - RNA, 16 nt, Pseudomonas aeruginosa PA01
gccugcagccuggcgu

SEQ ID NO: 1460655 - RNA, 15 nt, Pseudomonas aeruginosa PA01
gccugcagcaggucg

SEQ ID NO: 1460656 - RNA, 23 nt, Pseudomonas aeruginosa PA01
gccugcaacagaaguugcuggcg

SEQ ID NO: 1460657 - RNA, 14 nt, Pseudomonas aeruginosa PA01
gccugcacgucggu

SEQ ID NO: 1460658 - RNA, 21 nt, Pseudomonas aeruginosa PA01
gccugcacguggaguucaccg

SEQ ID NO: 1460659 - RNA, 23 nt, Pseudomonas aeruginosa PA01
gccugacgcaagcgcucggccug

SEQ ID NO: 1460660 - RNA, 18 nt, Pseudomonas aeruginosa PA01
gccugaccgcugaugauc

SEQ ID NO: 1460661 - RNA, 13 nt, Pseudomonas aeruginosa PA01
gccugacguugcc

SEQ ID NO: 1460662 - RNA, 19 nt, Pseudomonas aeruginosa PA01
gccugacguugccgcgcgg

SEQ ID NO: 1460663 - RNA, 15 nt, Pseudomonas aeruginosa PA01
gccugagcugccgcu

SEQ ID NO: 1460664 - RNA, 16 nt, Pseudomonas aeruginosa PA01
gccugagcugccgcuu

SEQ ID NO: 1460665 - RNA, 14 nt, Pseudomonas aeruginosa PA01
gccugagcuggccc

SEQ ID NO: 1460666 - RNA, 13 nt, Pseudomonas aeruginosa PA01
gccugagcuggcu

SEQ ID NO: 1460667 - RNA, 18 nt, Pseudomonas aeruginosa PA01
gccugagcuggcugucgu

SEQ ID NO: 1460668 - RNA, 15 nt, Pseudomonas aeruginosa PA01
gccucuaugaaccgg

SEQ ID NO: 1460669 - RNA, 23 nt, Pseudomonas aeruginosa PA01
gccucuugaaaacugucggcgga

SEQ ID NO: 1460670 - RNA, 13 nt, Pseudomonas aeruginosa PA01
gccucgucgccau

SEQ ID NO: 1460671 - RNA, 18 nt, Pseudomonas aeruginosa PA01
gccucgucgccaugcggc

SEQ ID NO: 1460672 - RNA, 13 nt, Pseudomonas aeruginosa PA01
gccucgucgcccg

SEQ ID NO: 1460673 - RNA, 20 nt, Pseudomonas aeruginosa PA01
gccucgugcagcaagccgca

SEQ ID NO: 1460674 - RNA, 12 nt, Pseudomonas aeruginosa PA01
gccucgucgguc

SEQ ID NO: 1460675 - RNA, 16 nt, Pseudomonas aeruginosa PA01
gccucguucagcagca

SEQ ID NO: 1460676 - RNA, 19 nt, Pseudomonas aeruginosa PA01
gccucguggaacagcgcgu

SEQ ID NO: 1460677 - RNA, 16 nt, Pseudomonas aeruginosa PA01
gccucguucgucgccg

SEQ ID NO: 1460678 - RNA, 17 nt, Pseudomonas aeruginosa PA01
gccucguucgucgccga

SEQ ID NO: 1460679 - RNA, 21 nt, Pseudomonas aeruginosa PA01
gccucguucgucgccgacugc

SEQ ID NO: 1460680 - RNA, 23 nt, Pseudomonas aeruginosa PA01
gccucggucagguauucgccggc

SEQ ID NO: 1460681 - RNA, 17 nt, Pseudomonas aeruginosa PA01
gccucgguuuccggcca

SEQ ID NO: 1460682 - RNA, 21 nt, Pseudomonas aeruginosa PA01
gccucgguuuccggccaggcg

SEQ ID NO: 1460683 - RNA, 22 nt, Pseudomonas aeruginosa PA01
gccucgguuuccggccaggcgc

SEQ ID NO: 1460684 - RNA, 23 nt, Pseudomonas aeruginosa PA01
gccucgguuuccggccaggcgcg

SEQ ID NO: 1460685 - RNA, 20 nt, Pseudomonas aeruginosa PA01
gccucgucgacgcccuggcg

SEQ ID NO: 1460686 - RNA, 15 nt, Pseudomonas aeruginosa PA01
gccucgucgacgcuc

SEQ ID NO: 1460687 - RNA, 19 nt, Pseudomonas aeruginosa PA01
gccucgucgacgcucagca

SEQ ID NO: 1460688 - RNA, 21 nt, Pseudomonas aeruginosa PA01
gccucgucgagcaucugccgg

SEQ ID NO: 1460689 - RNA, 17 nt, Pseudomonas aeruginosa PA01
gccucgucgagcgcagc

SEQ ID NO: 1460690 - RNA, 17 nt, Pseudomonas aeruginosa PA01
gccucgucgaucucgcc

SEQ ID NO: 1460691 - RNA, 18 nt, Pseudomonas aeruginosa PA01
gccucgucgaucucgccg

SEQ ID NO: 1460692 - RNA, 20 nt, Pseudomonas aeruginosa PA01
gccucgucgaucucgccgaa

SEQ ID NO: 1460693 - RNA, 23 nt, Pseudomonas aeruginosa PA01
gccucggcguccuugggaucguc

SEQ ID NO: 1460694 - RNA, 18 nt, Pseudomonas aeruginosa PA01
gccucggcgucgcgcagg

SEQ ID NO: 1460695 - RNA, 19 nt, Pseudomonas aeruginosa PA01
gccucggcgucgcgcaggc

SEQ ID NO: 1460696 - RNA, 21 nt, Pseudomonas aeruginosa PA01
gccucgguggcccacuccaga

SEQ ID NO: 1460697 - RNA, 22 nt, Pseudomonas aeruginosa PA01
gccucggcgcaguagucgaccg

SEQ ID NO: 1460698 - RNA, 23 nt, Pseudomonas aeruginosa PA01
gccucgguagaccccggugugcg

SEQ ID NO: 1460699 - RNA, 14 nt, Pseudomonas aeruginosa PA01
gccucggcgaucgc

SEQ ID NO: 1460700 - RNA, 17 nt, Pseudomonas aeruginosa PA01
gccucggcgaucgccag

SEQ ID NO: 1460701 - RNA, 14 nt, Pseudomonas aeruginosa PA01
gccucggcgaugcc

SEQ ID NO: 1460702 - RNA, 19 nt, Pseudomonas aeruginosa PA01
gccucggcgaugccggaga

SEQ ID NO: 1460703 - RNA, 21 nt, Pseudomonas aeruginosa PA01
gccucggcgcgauccuccgcc

SEQ ID NO: 1460704 - RNA, 13 nt, Pseudomonas aeruginosa PA01
gccucggcgcgcg

SEQ ID NO: 1460705 - RNA, 22 nt, Pseudomonas aeruginosa PA01
gccucggcggcgcgaaccagca

SEQ ID NO: 1460706 - RNA, 13 nt, Pseudomonas aeruginosa PA01
gccucggcggcgg

SEQ ID NO: 1460707 - RNA, 21 nt, Pseudomonas aeruginosa PA01
gccucggcggcggccugcucg

SEQ ID NO: 1460708 - RNA, 14 nt, Pseudomonas aeruginosa PA01
gccucggcgggaga

SEQ ID NO: 1460709 - RNA, 21 nt, Pseudomonas aeruginosa PA01
gccucggcgggagagggcggc

SEQ ID NO: 1460710 - RNA, 22 nt, Pseudomonas aeruginosa PA01
gccucggcgggagagggcggcg

SEQ ID NO: 1460711 - RNA, 22 nt, Pseudomonas aeruginosa PA01
gccucggccaucgagcgcucca

SEQ ID NO: 1460712 - RNA, 19 nt, Pseudomonas aeruginosa PA01
gccucggcccuggcggcga

SEQ ID NO: 1460713 - RNA, 15 nt, Pseudomonas aeruginosa PA01
gccucggccagcgcc

SEQ ID NO: 1460714 - RNA, 17 nt, Pseudomonas aeruginosa PA01
gccucggcgaagucgcc

SEQ ID NO: 1460715 - RNA, 19 nt, Pseudomonas aeruginosa PA01
gccucggcgaagucgccgu

SEQ ID NO: 1460716 - RNA, 22 nt, Pseudomonas aeruginosa PA01
gccucggcgaagucgccgucgu

SEQ ID NO: 1460717 - RNA, 15 nt, Pseudomonas aeruginosa PA01
gccucggccuggucg

SEQ ID NO: 1460718 - RNA, 13 nt, Pseudomonas aeruginosa PA01
gccucggccucgu

SEQ ID NO: 1460719 - RNA, 15 nt, Pseudomonas aeruginosa PA01
gccucggcauccucg

SEQ ID NO: 1460720 - RNA, 14 nt, Pseudomonas aeruginosa PA01
gccucggcaucgac

SEQ ID NO: 1460721 - RNA, 16 nt, Pseudomonas aeruginosa PA01
gccucggcaucgacca

SEQ ID NO: 1460722 - RNA, 19 nt, Pseudomonas aeruginosa PA01
gccucggcaucgaccaggg

SEQ ID NO: 1460723 - RNA, 17 nt, Pseudomonas aeruginosa PA01
gccucccggcucgccga

SEQ ID NO: 1460724 - RNA, 17 nt, Pseudomonas aeruginosa PA01
gccucccgggccucucg

SEQ ID NO: 1460725 - RNA, 19 nt, Pseudomonas aeruginosa PA01
gccuccccggcccgcgccg

SEQ ID NO: 1460726 - RNA, 16 nt, Pseudomonas aeruginosa PA01
gccucccgccgcggcg

SEQ ID NO: 1460727 - RNA, 12 nt, Pseudomonas aeruginosa PA01
gccuccagcacu

SEQ ID NO: 1460728 - RNA, 18 nt, Pseudomonas aeruginosa PA01
gccuccaggaauccuccg

SEQ ID NO: 1460729 - RNA, 14 nt, Pseudomonas aeruginosa PA01
gccuccaggaccuu

SEQ ID NO: 1460730 - RNA, 18 nt, Pseudomonas aeruginosa PA01
gccuccaggaccuugucg

SEQ ID NO: 1460731 - RNA, 13 nt, Pseudomonas aeruginosa PA01
gccuccaggcgcg

SEQ ID NO: 1460732 - RNA, 14 nt, Pseudomonas aeruginosa PA01
gccuccaggcgcgc

SEQ ID NO: 1460733 - RNA, 19 nt, Pseudomonas aeruginosa PA01
gccucccaccgcgcggcac

SEQ ID NO: 1460734 - RNA, 19 nt, Pseudomonas aeruginosa PA01
gccucccagccgugggcgu

SEQ ID NO: 1460735 - RNA, 16 nt, Pseudomonas aeruginosa PA01
gccuccaggcuggccu

SEQ ID NO: 1460736 - RNA, 16 nt, Pseudomonas aeruginosa PA01
gccuuccaggcgugcc

SEQ ID NO: 1460737 - RNA, 18 nt, Pseudomonas aeruginosa PA01
gccuuccagguaguccag

SEQ ID NO: 1460738 - RNA, 21 nt, Pseudomonas aeruginosa PA01
gccuuccgcgcccaggcugcc

SEQ ID NO: 1460739 - RNA, 20 nt, Pseudomonas aeruginosa PA01
gccuucccggucgacggcgu

SEQ ID NO: 1460740 - RNA, 18 nt, Pseudomonas aeruginosa PA01
gccuucccagacguccag

SEQ ID NO: 1460741 - RNA, 20 nt, Pseudomonas aeruginosa PA01
gccuucccagauaccggcgu

SEQ ID NO: 1460742 - RNA, 20 nt, Pseudomonas aeruginosa PA01
gccuuccucggccgccaggc

SEQ ID NO: 1460743 - RNA, 18 nt, Pseudomonas aeruginosa PA01
gccugguagaucugugcg

SEQ ID NO: 1460744 - RNA, 17 nt, Pseudomonas aeruginosa PA01
gccugguaggccucgau

SEQ ID NO: 1460745 - RNA, 18 nt, Pseudomonas aeruginosa PA01
gccugguaggccucgaug

SEQ ID NO: 1460746 - RNA, 16 nt, Pseudomonas aeruginosa PA01
gccugguaggcggcga

SEQ ID NO: 1460747 - RNA, 20 nt, Pseudomonas aeruginosa PA01
gccuggucggcgcggcgcuc

SEQ ID NO: 1460748 - RNA, 13 nt, Pseudomonas aeruginosa PA01
gccuggucggggc

SEQ ID NO: 1460749 - RNA, 19 nt, Pseudomonas aeruginosa PA01
gccuguuccuccgccaggu

SEQ ID NO: 1460750 - RNA, 22 nt, Pseudomonas aeruginosa PA01
gccuggucgaaagccugccggg

SEQ ID NO: 1460751 - RNA, 22 nt, Pseudomonas aeruginosa PA01
gccuggucauccuggcccugga

SEQ ID NO: 1460752 - RNA, 14 nt, Pseudomonas aeruginosa PA01
gccugguagucgcc

SEQ ID NO: 1460753 - RNA, 22 nt, Pseudomonas aeruginosa PA01
gccuguucgcccaaggccaggu

SEQ ID NO: 1460754 - RNA, 19 nt, Pseudomonas aeruginosa PA01
gccuuggcaugaccgagca

SEQ ID NO: 1460755 - RNA, 15 nt, Pseudomonas aeruginosa PA01
gccuuggccacggca

SEQ ID NO: 1460756 - RNA, 23 nt, Pseudomonas aeruginosa PA01
gccuucugcaccuuggccacgcu

SEQ ID NO: 1460757 - RNA, 17 nt, Pseudomonas aeruginosa PA01
gccuucucgucgucgga

SEQ ID NO: 1460758 - RNA, 14 nt, Pseudomonas aeruginosa PA01
gccuugcggcgccg

SEQ ID NO: 1460759 - RNA, 15 nt, Pseudomonas aeruginosa PA01
gccuugcggcgccga

SEQ ID NO: 1460760 - RNA, 21 nt, Pseudomonas aeruginosa PA01
gccuugcggcgccgaggcccu

SEQ ID NO: 1460761 - RNA, 17 nt, Pseudomonas aeruginosa PA01
gccuugcggggcggcgc

SEQ ID NO: 1460762 - RNA, 16 nt, Pseudomonas aeruginosa PA01
gccuugcucaggucgu

SEQ ID NO: 1460763 - RNA, 17 nt, Pseudomonas aeruginosa PA01
gccuugcucaggucguc

SEQ ID NO: 1460764 - RNA, 18 nt, Pseudomonas aeruginosa PA01
gccuugcguaccagcgcg

SEQ ID NO: 1460765 - RNA, 20 nt, Pseudomonas aeruginosa PA01
gccuugcguaccagcgcgca

SEQ ID NO: 1460766 - RNA, 21 nt, Pseudomonas aeruginosa PA01
gccuugcguaccagcgcgcag

SEQ ID NO: 1460767 - RNA, 14 nt, Pseudomonas aeruginosa PA01
gccuucgccgucga

SEQ ID NO: 1460768 - RNA, 22 nt, Pseudomonas aeruginosa PA01
gccuucgccgucgagccagccc

SEQ ID NO: 1460769 - RNA, 16 nt, Pseudomonas aeruginosa PA01
gccuucgccuucggcg

SEQ ID NO: 1460770 - RNA, 24 nt, Pseudomonas aeruginosa PA01
gccuucgcccagguaggcgaugcg

SEQ ID NO: 1460771 - RNA, 17 nt, Pseudomonas aeruginosa PA01
gccuucgccgaccaggu

SEQ ID NO: 1460772 - RNA, 22 nt, Pseudomonas aeruginosa PA01
gccuucgacgguucgcgaacgg

SEQ ID NO: 1460773 - RNA, 13 nt, Pseudomonas aeruginosa PA01
gccuucggcgccg

SEQ ID NO: 1460774 - RNA, 16 nt, Pseudomonas aeruginosa PA01
gccuucggcgccggag

SEQ ID NO: 1460775 - RNA, 16 nt, Pseudomonas aeruginosa PA01
gccuucggcaggaccu

SEQ ID NO: 1460776 - RNA, 23 nt, Pseudomonas aeruginosa PA01
gccuucggcaggaccucgggcga

SEQ ID NO: 1460777 - RNA, 14 nt, Pseudomonas aeruginosa PA01
gccuucgcggccga

SEQ ID NO: 1460778 - RNA, 17 nt, Pseudomonas aeruginosa PA01
gccuucgcgggccaggc

SEQ ID NO: 1460779 - RNA, 18 nt, Pseudomonas aeruginosa PA01
gccuucgcgggccaggcc

SEQ ID NO: 1460780 - RNA, 12 nt, Pseudomonas aeruginosa PA01
gccuucguccau

SEQ ID NO: 1460781 - RNA, 20 nt, Pseudomonas aeruginosa PA01
gccuucguccaugcucgcca

SEQ ID NO: 1460782 - RNA, 16 nt, Pseudomonas aeruginosa PA01
gccuucggcggcgccu

SEQ ID NO: 1460783 - RNA, 15 nt, Pseudomonas aeruginosa PA01
gccuucggcggccgg

SEQ ID NO: 1460784 - RNA, 16 nt, Pseudomonas aeruginosa PA01
gccuucggcggccggg

SEQ ID NO: 1460785 - RNA, 15 nt, Pseudomonas aeruginosa PA01
gccuucggcgucgaa

SEQ ID NO: 1460786 - RNA, 18 nt, Pseudomonas aeruginosa PA01
gccuucggcgugcauggc

SEQ ID NO: 1460787 - RNA, 19 nt, Pseudomonas aeruginosa PA01
gccuucggcgugcauggcc

SEQ ID NO: 1460788 - RNA, 19 nt, Pseudomonas aeruginosa PA01
gccuucgggagagcccggg

SEQ ID NO: 1460789 - RNA, 22 nt, Pseudomonas aeruginosa PA01
gccuucgggagagcccgggcgc

SEQ ID NO: 1460790 - RNA, 14 nt, Pseudomonas aeruginosa PA01
gccuucgggccccg

SEQ ID NO: 1460791 - RNA, 14 nt, Pseudomonas aeruginosa PA01
gccuucgggcgccu

SEQ ID NO: 1460792 - RNA, 13 nt, Pseudomonas aeruginosa PA01
gccugcagcucgg

SEQ ID NO: 1460793 - RNA, 15 nt, Pseudomonas aeruginosa PA01
gccugccagaccgag

SEQ ID NO: 1460794 - RNA, 18 nt, Pseudomonas aeruginosa PA01
gccugccccgccggcgcu

SEQ ID NO: 1460795 - RNA, 20 nt, Pseudomonas aeruginosa PA01
gccugcuucaggucgucggg

SEQ ID NO: 1460796 - RNA, 22 nt, Pseudomonas aeruginosa PA01
gccugcuucaggucgucgggca

SEQ ID NO: 1460797 - RNA, 15 nt, Pseudomonas aeruginosa PA01
gccugcuuggcggcg

SEQ ID NO: 1460798 - RNA, 16 nt, Pseudomonas aeruginosa PA01
gccugcuuggcggcgg

SEQ ID NO: 1460799 - RNA, 18 nt, Pseudomonas aeruginosa PA01
gccugcucgaacggcgga

SEQ ID NO: 1460800 - RNA, 13 nt, Pseudomonas aeruginosa PA01
gccugcuccagcg

SEQ ID NO: 1460801 - RNA, 14 nt, Pseudomonas aeruginosa PA01
gccugcuccucggc

SEQ ID NO: 1460802 - RNA, 15 nt, Pseudomonas aeruginosa PA01
gccugcuccucggca

SEQ ID NO: 1460803 - RNA, 17 nt, Pseudomonas aeruginosa PA01
gccugcuccucggcagc

SEQ ID NO: 1460804 - RNA, 13 nt, Pseudomonas aeruginosa PA01
gccugcucagcgu

SEQ ID NO: 1460805 - RNA, 18 nt, Pseudomonas aeruginosa PA01
gccugcgucagcgaggcg

SEQ ID NO: 1460806 - RNA, 18 nt, Pseudomonas aeruginosa PA01
gccugcgucgcauccacc

SEQ ID NO: 1460807 - RNA, 21 nt, Pseudomonas aeruginosa PA01
gccugcgucgcauccaccagc

SEQ ID NO: 1460808 - RNA, 20 nt, Pseudomonas aeruginosa PA01
gccugcggguucggcgagag

SEQ ID NO: 1460809 - RNA, 21 nt, Pseudomonas aeruginosa PA01
gccugcggguucggcgagagg

SEQ ID NO: 1460810 - RNA, 13 nt, Pseudomonas aeruginosa PA01
gccugcguuucgc

SEQ ID NO: 1460811 - RNA, 16 nt, Pseudomonas aeruginosa PA01
gccugcguuucgccgg

SEQ ID NO: 1460812 - RNA, 18 nt, Pseudomonas aeruginosa PA01
gccugcguuucgccgggc

SEQ ID NO: 1460813 - RNA, 18 nt, Pseudomonas aeruginosa PA01
gccuggaugucgaagcgc

SEQ ID NO: 1460814 - RNA, 19 nt, Pseudomonas aeruginosa PA01
gccuggaugucgaagcgca

SEQ ID NO: 1460815 - RNA, 21 nt, Pseudomonas aeruginosa PA01
gccuggaugucgaagcgcagg

SEQ ID NO: 1460816 - RNA, 17 nt, Pseudomonas aeruginosa PA01
gccuggaccaggucgag

SEQ ID NO: 1460817 - RNA, 17 nt, Pseudomonas aeruginosa PA01
gccuggcuggccagcag

SEQ ID NO: 1460818 - RNA, 21 nt, Pseudomonas aeruginosa PA01
gccuggcuggccucagggcgc

SEQ ID NO: 1460819 - RNA, 13 nt, Pseudomonas aeruginosa PA01
gccuggcaggucc

SEQ ID NO: 1460820 - RNA, 17 nt, Pseudomonas aeruginosa PA01
gccuggcagguccgacg

SEQ ID NO: 1460821 - RNA, 17 nt, Pseudomonas aeruginosa PA01
gccuggcaguugcagua

SEQ ID NO: 1460822 - RNA, 19 nt, Pseudomonas aeruginosa PA01
gccugggcaagcugcacgg

SEQ ID NO: 1460823 - RNA, 22 nt, Pseudomonas aeruginosa PA01
gccugggcaagcugcacggcga

SEQ ID NO: 1460824 - RNA, 22 nt, Pseudomonas aeruginosa PA01
gccugggacggaacgucggccu

SEQ ID NO: 1460825 - RNA, 16 nt, Pseudomonas aeruginosa PA01
gccugggguagccggc

SEQ ID NO: 1460826 - RNA, 20 nt, Pseudomonas aeruginosa PA01
gccugggguagccggccgau

SEQ ID NO: 1460827 - RNA, 19 nt, Pseudomonas aeruginosa PA01
gccugggucaccagcacca

SEQ ID NO: 1460828 - RNA, 16 nt, Pseudomonas aeruginosa PA01
gccugggugaacagcg

SEQ ID NO: 1460829 - RNA, 19 nt, Pseudomonas aeruginosa PA01
gccugggcguagaguucgc

SEQ ID NO: 1460830 - RNA, 19 nt, Pseudomonas aeruginosa PA01
gccuggggcucggcuucca

SEQ ID NO: 1460831 - RNA, 23 nt, Pseudomonas aeruginosa PA01
gccugggggucuacgugauccgu

SEQ ID NO: 1460832 - RNA, 12 nt, Pseudomonas aeruginosa PA01
gccugggcgccg

SEQ ID NO: 1460833 - RNA, 17 nt, Pseudomonas aeruginosa PA01
gccugggcgccgccagc

SEQ ID NO: 1460834 - RNA, 23 nt, Pseudomonas aeruginosa PA01
gccugggccgaaggccaggccgg

SEQ ID NO: 1460835 - RNA, 13 nt, Pseudomonas aeruginosa PA01
gccugggccgccu

SEQ ID NO: 1460836 - RNA, 13 nt, Pseudomonas aeruginosa PA01
gccugggccgcga

SEQ ID NO: 1460837 - RNA, 14 nt, Pseudomonas aeruginosa PA01
gccugggccgcgcu

SEQ ID NO: 1460838 - RNA, 18 nt, Pseudomonas aeruginosa PA01
gccugggccgcgcugucg

SEQ ID NO: 1460839 - RNA, 12 nt, Pseudomonas aeruginosa PA01
gccugggccggg

SEQ ID NO: 1460840 - RNA, 16 nt, Pseudomonas aeruginosa PA01
gccuggaaggcgcugg

SEQ ID NO: 1460841 - RNA, 20 nt, Pseudomonas aeruginosa PA01
gccuggaaggcgcugggcgg

SEQ ID NO: 1460842 - RNA, 21 nt, Pseudomonas aeruginosa PA01
gccuggaaggcgcugggcggc

SEQ ID NO: 1460843 - RNA, 18 nt, Pseudomonas aeruginosa PA01
gccuggaauaccccgcgg

SEQ ID NO: 1460844 - RNA, 20 nt, Pseudomonas aeruginosa PA01
gccuggaauaccccgcggac

SEQ ID NO: 1460845 - RNA, 17 nt, Pseudomonas aeruginosa PA01
gccuggaauucaggcuu

SEQ ID NO: 1460846 - RNA, 19 nt, Pseudomonas aeruginosa PA01
gccuggaacuggucggggc

SEQ ID NO: 1460847 - RNA, 13 nt, Pseudomonas aeruginosa PA01
gccuggaacacca

SEQ ID NO: 1460848 - RNA, 16 nt, Pseudomonas aeruginosa PA01
gccuggaacaccaggc

SEQ ID NO: 1460849 - RNA, 18 nt, Pseudomonas aeruginosa PA01
gccuggaucgccuugcgc

SEQ ID NO: 1460850 - RNA, 16 nt, Pseudomonas aeruginosa PA01
gccuggaucucggcgg

SEQ ID NO: 1460851 - RNA, 19 nt, Pseudomonas aeruginosa PA01
gccuggaucucggcggcca

SEQ ID NO: 1460852 - RNA, 16 nt, Pseudomonas aeruginosa PA01
gccuggaucucugcga

SEQ ID NO: 1460853 - RNA, 16 nt, Pseudomonas aeruginosa PA01
gccuggauacgggcgc

SEQ ID NO: 1460854 - RNA, 16 nt, Pseudomonas aeruginosa PA01
gccuggaucagcgccu

SEQ ID NO: 1460855 - RNA, 17 nt, Pseudomonas aeruginosa PA01
gccuggaucagcgccuc

SEQ ID NO: 1460856 - RNA, 23 nt, Pseudomonas aeruginosa PA01
gccuggaucagcgccucgaccuc

SEQ ID NO: 1460857 - RNA, 16 nt, Pseudomonas aeruginosa PA01
gccuggagcagggcgc

SEQ ID NO: 1460858 - RNA, 18 nt, Pseudomonas aeruginosa PA01
gccuggagcagaaccgcc

SEQ ID NO: 1460859 - RNA, 19 nt, Pseudomonas aeruginosa PA01
gccuggagcagaaccgcca

SEQ ID NO: 1460860 - RNA, 19 nt, Pseudomonas aeruginosa PA01
gccuggagaaacucgcggg

SEQ ID NO: 1460861 - RNA, 22 nt, Pseudomonas aeruginosa PA01
gccuggagaaacucgcgggcgc

SEQ ID NO: 1460862 - RNA, 14 nt, Pseudomonas aeruginosa PA01
gcgaugccgauggc

SEQ ID NO: 1460863 - RNA, 12 nt, Pseudomonas aeruginosa PA01
gcgaugccgccc

SEQ ID NO: 1460864 - RNA, 14 nt, Pseudomonas aeruginosa PA01
gcgaugccgcgcca

SEQ ID NO: 1460865 - RNA, 21 nt, Pseudomonas aeruginosa PA01
gcgaugcccuuggccagcgcg

SEQ ID NO: 1460866 - RNA, 14 nt, Pseudomonas aeruginosa PA01
gcgaugcccuggcc

SEQ ID NO: 1460867 - RNA, 14 nt, Pseudomonas aeruginosa PA01
gcgaugcccuggcu

SEQ ID NO: 1460868 - RNA, 20 nt, Pseudomonas aeruginosa PA01
gcgaugcguuugucgaccug

SEQ ID NO: 1460869 - RNA, 11 nt, Pseudomonas aeruginosa PA01
gcgaugcgccg

SEQ ID NO: 1460870 - RNA, 20 nt, Pseudomonas aeruginosa PA01
gcgaugccccauccgacgcc

SEQ ID NO: 1460871 - RNA, 22 nt, Pseudomonas aeruginosa PA01
gcgaugccccauccgacgccgg

SEQ ID NO: 1460872 - RNA, 23 nt, Pseudomonas aeruginosa PA01
gcgaugccccauccgacgccggc

SEQ ID NO: 1460873 - RNA, 15 nt, Pseudomonas aeruginosa PA01
gcgaugcccaggccg

SEQ ID NO: 1460874 - RNA, 17 nt, Pseudomonas aeruginosa PA01
gcgaugcccaggccgcc

SEQ ID NO: 1460875 - RNA, 14 nt, Pseudomonas aeruginosa PA01
gcgaugaggcuguc

SEQ ID NO: 1460876 - RNA, 23 nt, Pseudomonas aeruginosa PA01
gcgaugaucggcagccguccgcc

SEQ ID NO: 1460877 - RNA, 22 nt, Pseudomonas aeruginosa PA01
gcgaugauggucaacaccagcg

SEQ ID NO: 1460878 - RNA, 13 nt, Pseudomonas aeruginosa PA01
gcgaugaugccgc

SEQ ID NO: 1460879 - RNA, 15 nt, Pseudomonas aeruginosa PA01
gcgaugaugccgccg

SEQ ID NO: 1460880 - RNA, 15 nt, Pseudomonas aeruginosa PA01
gcgaugaacggcguc

SEQ ID NO: 1460881 - RNA, 15 nt, Pseudomonas aeruginosa PA01
gcgaucuucuccgcc

SEQ ID NO: 1460882 - RNA, 16 nt, Pseudomonas aeruginosa PA01
gcgaucuucuccgccg

SEQ ID NO: 1460883 - RNA, 19 nt, Pseudomonas aeruginosa PA01
gcgaucuucuccgccgcgu

SEQ ID NO: 1460884 - RNA, 20 nt, Pseudomonas aeruginosa PA01
gcgaucuucuccgccgcgug

SEQ ID NO: 1460885 - RNA, 24 nt, Pseudomonas aeruginosa PA01
gcgaucuucuccgccgcgugcgcg

SEQ ID NO: 1460886 - RNA, 15 nt, Pseudomonas aeruginosa PA01
gcgaucuugaucgcc

SEQ ID NO: 1460887 - RNA, 20 nt, Pseudomonas aeruginosa PA01
gcgaucuucagguaggcgcg

SEQ ID NO: 1460888 - RNA, 22 nt, Pseudomonas aeruginosa PA01
gcgaucuucagguaggcgcggg

SEQ ID NO: 1460889 - RNA, 12 nt, Pseudomonas aeruginosa PA01
gcgaucugugcg

SEQ ID NO: 1460890 - RNA, 15 nt, Pseudomonas aeruginosa PA01
gcgaugaccgccccg

SEQ ID NO: 1460891 - RNA, 16 nt, Pseudomonas aeruginosa PA01
gcgaugaccgccccgg

SEQ ID NO: 1460892 - RNA, 17 nt, Pseudomonas aeruginosa PA01
gcgaugaccgccccggc

SEQ ID NO: 1460893 - RNA, 20 nt, Pseudomonas aeruginosa PA01
gcgaucuccugccgcggcga

SEQ ID NO: 1460894 - RNA, 20 nt, Pseudomonas aeruginosa PA01
gcgaucgucgagaugcugcg

SEQ ID NO: 1460895 - RNA, 16 nt, Pseudomonas aeruginosa PA01
gcgaucuccgccaggc

SEQ ID NO: 1460896 - RNA, 18 nt, Pseudomonas aeruginosa PA01
gcgaucuccgggagcauc

SEQ ID NO: 1460897 - RNA, 15 nt, Pseudomonas aeruginosa PA01
gcgaucucggcgcgg

SEQ ID NO: 1460898 - RNA, 16 nt, Pseudomonas aeruginosa PA01
gcgaucucggcgcggg

SEQ ID NO: 1460899 - RNA, 15 nt, Pseudomonas aeruginosa PA01
gcgauccaugcgcac

SEQ ID NO: 1460900 - RNA, 17 nt, Pseudomonas aeruginosa PA01
gcgaucccaggucggcg

SEQ ID NO: 1460901 - RNA, 16 nt, Pseudomonas aeruginosa PA01
gcgauccuccgccagc

SEQ ID NO: 1460902 - RNA, 15 nt, Pseudomonas aeruginosa PA01
gcgauccgcgcggca

SEQ ID NO: 1460903 - RNA, 21 nt, Pseudomonas aeruginosa PA01
gcgaucgauguuuccgacccg

SEQ ID NO: 1460904 - RNA, 16 nt, Pseudomonas aeruginosa PA01
gcgaucgagcugucca

SEQ ID NO: 1460905 - RNA, 15 nt, Pseudomonas aeruginosa PA01
gcgaucgaucggcug

SEQ ID NO: 1460906 - RNA, 17 nt, Pseudomonas aeruginosa PA01
gcgaucgaggccuaccc

SEQ ID NO: 1460907 - RNA, 14 nt, Pseudomonas aeruginosa PA01
gcgaucgaccugcc

SEQ ID NO: 1460908 - RNA, 13 nt, Pseudomonas aeruginosa PA01
gcgaucgacgccu

SEQ ID NO: 1460909 - RNA, 14 nt, Pseudomonas aeruginosa PA01
gcgauccugaccgu

SEQ ID NO: 1460910 - RNA, 23 nt, Pseudomonas aeruginosa PA01
gcgauccugaccguccuggcccu

SEQ ID NO: 1460911 - RNA, 18 nt, Pseudomonas aeruginosa PA01
gcgaucggcguccgcggc

SEQ ID NO: 1460912 - RNA, 17 nt, Pseudomonas aeruginosa PA01
gcgaucgcggccagccg

SEQ ID NO: 1460913 - RNA, 19 nt, Pseudomonas aeruginosa PA01
gcgaucgcggccagccgcu

SEQ ID NO: 1460914 - RNA, 19 nt, Pseudomonas aeruginosa PA01
gcgaucggaagaucgcccg

SEQ ID NO: 1460915 - RNA, 22 nt, Pseudomonas aeruginosa PA01
gcgaucggaagaucgcccgccu

SEQ ID NO: 1460916 - RNA, 16 nt, Pseudomonas aeruginosa PA01
gcgaucgccuggucga

SEQ ID NO: 1460917 - RNA, 14 nt, Pseudomonas aeruginosa PA01
gcgaucgccaggcg

SEQ ID NO: 1460918 - RNA, 16 nt, Pseudomonas aeruginosa PA01
gcgaucgccaggcgau

SEQ ID NO: 1460919 - RNA, 18 nt, Pseudomonas aeruginosa PA01
gcgaucgccaggcgaucc

SEQ ID NO: 1460920 - RNA, 22 nt, Pseudomonas aeruginosa PA01
gcgaucgccaggcgauccagcg

SEQ ID NO: 1460921 - RNA, 13 nt, Pseudomonas aeruginosa PA01
gcgaucgccaggu

SEQ ID NO: 1460922 - RNA, 12 nt, Pseudomonas aeruginosa PA01
gcgaucgccgcc

SEQ ID NO: 1460923 - RNA, 18 nt, Pseudomonas aeruginosa PA01
gcgaucauccagccccca

SEQ ID NO: 1460924 - RNA, 14 nt, Pseudomonas aeruginosa PA01
gcgaucaucgccac

SEQ ID NO: 1460925 - RNA, 16 nt, Pseudomonas aeruginosa PA01
gcgaucaucgccaccg

SEQ ID NO: 1460926 - RNA, 14 nt, Pseudomonas aeruginosa PA01
gcgaucagggccuc

SEQ ID NO: 1460927 - RNA, 22 nt, Pseudomonas aeruginosa PA01
gcgaucagggccucgccacgcu

SEQ ID NO: 1460928 - RNA, 16 nt, Pseudomonas aeruginosa PA01
gcgauccacagcaggu

SEQ ID NO: 1460929 - RNA, 16 nt, Pseudomonas aeruginosa PA01
gcgauccaccgccagg

SEQ ID NO: 1460930 - RNA, 14 nt, Pseudomonas aeruginosa PA01
gcgaucagcucgcg

SEQ ID NO: 1460931 - RNA, 23 nt, Pseudomonas aeruginosa PA01
gcgaucagcucgcgguaggccag

SEQ ID NO: 1460932 - RNA, 19 nt, Pseudomonas aeruginosa PA01
gcgaucaggcagcgcgcgg

SEQ ID NO: 1460933 - RNA, 21 nt, Pseudomonas aeruginosa PA01
gcgaucagcgaaauggucacc

SEQ ID NO: 1460934 - RNA, 13 nt, Pseudomonas aeruginosa PA01
gcgaggugaucga

SEQ ID NO: 1460935 - RNA, 16 nt, Pseudomonas aeruginosa PA01
gcgaucacggcgcccc

SEQ ID NO: 1460936 - RNA, 15 nt, Pseudomonas aeruginosa PA01
gcgaucacgguggua

SEQ ID NO: 1460937 - RNA, 22 nt, Pseudomonas aeruginosa PA01
gcgaucacgucguacucggcgg

SEQ ID NO: 1460938 - RNA, 23 nt, Pseudomonas aeruginosa PA01
gcgaucacgucguacucggcggg

SEQ ID NO: 1460939 - RNA, 18 nt, Pseudomonas aeruginosa PA01
gcgagguggaugaacagc

SEQ ID NO: 1460940 - RNA, 16 nt, Pseudomonas aeruginosa PA01
gcgaucacgccgcgca

SEQ ID NO: 1460941 - RNA, 19 nt, Pseudomonas aeruginosa PA01
gcgcaaucagggcugggcg

SEQ ID NO: 1460942 - RNA, 16 nt, Pseudomonas aeruginosa PA01
gcgcaauacaccgcug

SEQ ID NO: 1460943 - RNA, 21 nt, Pseudomonas aeruginosa PA01
gcgcaagucggccugcaccag

SEQ ID NO: 1460944 - RNA, 17 nt, Pseudomonas aeruginosa PA01
gcgcaagggcgccgccg

SEQ ID NO: 1460945 - RNA, 18 nt, Pseudomonas aeruginosa PA01
gcgcaagggcgccgccga

SEQ ID NO: 1460946 - RNA, 13 nt, Pseudomonas aeruginosa PA01
gcgcaaggugccg

SEQ ID NO: 1460947 - RNA, 15 nt, Pseudomonas aeruginosa PA01
gcgcacaugccgagc

SEQ ID NO: 1460948 - RNA, 20 nt, Pseudomonas aeruginosa PA01
gcgcaccacccaucugccgg

SEQ ID NO: 1460949 - RNA, 23 nt, Pseudomonas aeruginosa PA01
gcgcaccacccaucugccggcca

SEQ ID NO: 1460950 - RNA, 20 nt, Pseudomonas aeruginosa PA01
gcgcaccaccgagagcggcg

SEQ ID NO: 1460951 - RNA, 13 nt, Pseudomonas aeruginosa PA01
gcgcaccaccugc

SEQ ID NO: 1460952 - RNA, 15 nt, Pseudomonas aeruginosa PA01
gcgcaccaccuggca

SEQ ID NO: 1460953 - RNA, 17 nt, Pseudomonas aeruginosa PA01
gcgcaccaccuggcagg

SEQ ID NO: 1460954 - RNA, 17 nt, Pseudomonas aeruginosa PA01
gcgcacaggcggaaggc

SEQ ID NO: 1460955 - RNA, 19 nt, Pseudomonas aeruginosa PA01
gcgcacaucacccgguucu

SEQ ID NO: 1460956 - RNA, 20 nt, Pseudomonas aeruginosa PA01
gcgcacacggucgagacccg

SEQ ID NO: 1460957 - RNA, 13 nt, Pseudomonas aeruginosa PA01
gcgcacaacgccu

SEQ ID NO: 1460958 - RNA, 19 nt, Pseudomonas aeruginosa PA01
gcgcacaaaaaagcccgcc

SEQ ID NO: 1460959 - RNA, 22 nt, Pseudomonas aeruginosa PA01
gcgcacaaaaaagcccgccagg

SEQ ID NO: 1460960 - RNA, 23 nt, Pseudomonas aeruginosa PA01
gcgcacaaaaaagcccgccaggu

SEQ ID NO: 1460961 - RNA, 16 nt, Pseudomonas aeruginosa PA01
gcgcaacugccggucg

SEQ ID NO: 1460962 - RNA, 14 nt, Pseudomonas aeruginosa PA01
gcgcaacugcgcca

SEQ ID NO: 1460963 - RNA, 15 nt, Pseudomonas aeruginosa PA01
gcgcaacugcgccag

SEQ ID NO: 1460964 - RNA, 16 nt, Pseudomonas aeruginosa PA01
gcgcaacugcggggcg

SEQ ID NO: 1460965 - RNA, 15 nt, Pseudomonas aeruginosa PA01
gcgcaacugcucgaa

SEQ ID NO: 1460966 - RNA, 15 nt, Pseudomonas aeruginosa PA01
gcgcaacuggucgcg

SEQ ID NO: 1460967 - RNA, 18 nt, Pseudomonas aeruginosa PA01
gcgcaacuggucgcggcu

SEQ ID NO: 1460968 - RNA, 17 nt, Pseudomonas aeruginosa PA01
gcgcaacggcagcgcuu

SEQ ID NO: 1460969 - RNA, 21 nt, Pseudomonas aeruginosa PA01
gcgcaacgcgguuauccgccg

SEQ ID NO: 1460970 - RNA, 22 nt, Pseudomonas aeruginosa PA01
gcgcaacgcgguuauccgccgc

SEQ ID NO: 1460971 - RNA, 18 nt, Pseudomonas aeruginosa PA01
gcgcaagcgcccggcgaa

SEQ ID NO: 1460972 - RNA, 20 nt, Pseudomonas aeruginosa PA01
gcgcaagcgcccggcgaaca

SEQ ID NO: 1460973 - RNA, 15 nt, Pseudomonas aeruginosa PA01
gcgcaagcggcggcu

SEQ ID NO: 1460974 - RNA, 18 nt, Pseudomonas aeruginosa PA01
gcgcaagcucgucacccg

SEQ ID NO: 1460975 - RNA, 16 nt, Pseudomonas aeruginosa PA01
gcgcaaggcagcgucc

SEQ ID NO: 1460976 - RNA, 17 nt, Pseudomonas aeruginosa PA01
gcgcaaggccagcggca

SEQ ID NO: 1460977 - RNA, 19 nt, Pseudomonas aeruginosa PA01
gcgcaaggccagcggcauc

SEQ ID NO: 1460978 - RNA, 15 nt, Pseudomonas aeruginosa PA01
gcgcaaggccgaaga

SEQ ID NO: 1460979 - RNA, 23 nt, Pseudomonas aeruginosa PA01
gcgcaacaccuugcgcaccgccu

SEQ ID NO: 1460980 - RNA, 15 nt, Pseudomonas aeruginosa PA01
gcgcaacaggcgcau

SEQ ID NO: 1460981 - RNA, 17 nt, Pseudomonas aeruginosa PA01
gcgcaacaggcgcaugc

SEQ ID NO: 1460982 - RNA, 16 nt, Pseudomonas aeruginosa PA01
gcgcaaaccggcagca

SEQ ID NO: 1460983 - RNA, 21 nt, Pseudomonas aeruginosa PA01
gcgcaaccguuccagcgccuc

SEQ ID NO: 1460984 - RNA, 22 nt, Pseudomonas aeruginosa PA01
gcgcaaccugguucacggucgu

SEQ ID NO: 1460985 - RNA, 15 nt, Pseudomonas aeruginosa PA01
gcgcaacgccgacgg

SEQ ID NO: 1460986 - RNA, 14 nt, Pseudomonas aeruginosa PA01
gcgcaaccagcgcu

SEQ ID NO: 1460987 - RNA, 15 nt, Pseudomonas aeruginosa PA01
gcgcaaccagcgcuc

SEQ ID NO: 1460988 - RNA, 13 nt, Pseudomonas aeruginosa PA01
gcgauggccgcca

SEQ ID NO: 1460989 - RNA, 16 nt, Pseudomonas aeruginosa PA01
gcgauggccgccagca

SEQ ID NO: 1460990 - RNA, 13 nt, Pseudomonas aeruginosa PA01
gcgauggccgccu

SEQ ID NO: 1460991 - RNA, 21 nt, Pseudomonas aeruginosa PA01
gcgauggccgccugcagggcg

SEQ ID NO: 1460992 - RNA, 15 nt, Pseudomonas aeruginosa PA01
gcgauggccggcacc

SEQ ID NO: 1460993 - RNA, 16 nt, Pseudomonas aeruginosa PA01
gcgauggccggcggag

SEQ ID NO: 1460994 - RNA, 14 nt, Pseudomonas aeruginosa PA01
gcgauggcucgcgg

SEQ ID NO: 1460995 - RNA, 19 nt, Pseudomonas aeruginosa PA01
gcgauggcucgcggcgcuc

SEQ ID NO: 1460996 - RNA, 20 nt, Pseudomonas aeruginosa PA01
gcgauggccuggucggcgcg

SEQ ID NO: 1460997 - RNA, 14 nt, Pseudomonas aeruginosa PA01
gcgaugcugcugau

SEQ ID NO: 1460998 - RNA, 22 nt, Pseudomonas aeruginosa PA01
gcgaugcugugcagggaggcau

SEQ ID NO: 1460999 - RNA, 14 nt, Pseudomonas aeruginosa PA01
gcgauggcccagau

SEQ ID NO: 1461000 - RNA, 17 nt, Pseudomonas aeruginosa PA01
gcgauggcccagaugau

SEQ ID NO: 1461001 - RNA, 14 nt, Pseudomonas aeruginosa PA01
gcgauggcccguuc

SEQ ID NO: 1461002 - RNA, 13 nt, Pseudomonas aeruginosa PA01
gcgaugcugaccc

SEQ ID NO: 1461003 - RNA, 15 nt, Pseudomonas aeruginosa PA01
gcgaugcugacccag

SEQ ID NO: 1461004 - RNA, 16 nt, Pseudomonas aeruginosa PA01
gcgaugcucagcgccg

SEQ ID NO: 1461005 - RNA, 17 nt, Pseudomonas aeruginosa PA01
gcgaugcucagcgccgg

SEQ ID NO: 1461006 - RNA, 17 nt, Pseudomonas aeruginosa PA01
gcgauggaugcgcggca

SEQ ID NO: 1461007 - RNA, 19 nt, Pseudomonas aeruginosa PA01
gcgauguccuggaucggca

SEQ ID NO: 1461008 - RNA, 20 nt, Pseudomonas aeruginosa PA01
gcgauguccuggaucggcag

SEQ ID NO: 1461009 - RNA, 17 nt, Pseudomonas aeruginosa PA01
gcgauguccccggccag

SEQ ID NO: 1461010 - RNA, 16 nt, Pseudomonas aeruginosa PA01
gcgauguagcugccgg

SEQ ID NO: 1461011 - RNA, 16 nt, Pseudomonas aeruginosa PA01
gcgaugguaguccgcu

SEQ ID NO: 1461012 - RNA, 19 nt, Pseudomonas aeruginosa PA01
gcgaugguaguccgcugcg

SEQ ID NO: 1461013 - RNA, 16 nt, Pseudomonas aeruginosa PA01
gcgaugguauggcggu

SEQ ID NO: 1461014 - RNA, 18 nt, Pseudomonas aeruginosa PA01
gcgauggugcgcucgcgg

SEQ ID NO: 1461015 - RNA, 17 nt, Pseudomonas aeruginosa PA01
gcgauggcguccaccgc

SEQ ID NO: 1461016 - RNA, 15 nt, Pseudomonas aeruginosa PA01
gcgaugggugccgcg

SEQ ID NO: 1461017 - RNA, 19 nt, Pseudomonas aeruginosa PA01
gcgaugggugccgcgcagg

SEQ ID NO: 1461018 - RNA, 23 nt, Pseudomonas aeruginosa PA01
gcgaugggugccgcgcagguuca

SEQ ID NO: 1461019 - RNA, 16 nt, Pseudomonas aeruginosa PA01
gcgauuuugggcucag

SEQ ID NO: 1461020 - RNA, 17 nt, Pseudomonas aeruginosa PA01
gcgauuuugggcucaga

SEQ ID NO: 1461021 - RNA, 14 nt, Pseudomonas aeruginosa PA01
gcgauuuccaccgg

SEQ ID NO: 1461022 - RNA, 15 nt, Pseudomonas aeruginosa PA01
gcgauuuccaccggc

SEQ ID NO: 1461023 - RNA, 17 nt, Pseudomonas aeruginosa PA01
gcgauuguccaccggcc

SEQ ID NO: 1461024 - RNA, 15 nt, Pseudomonas aeruginosa PA01
gcgauugcagguagu

SEQ ID NO: 1461025 - RNA, 23 nt, Pseudomonas aeruginosa PA01
gcgauuggagaugcucaggcgcu

SEQ ID NO: 1461026 - RNA, 20 nt, Pseudomonas aeruginosa PA01
gcgauucguucgagcagcuc

SEQ ID NO: 1461027 - RNA, 17 nt, Pseudomonas aeruginosa PA01
gcgauguucaccgcggc

SEQ ID NO: 1461028 - RNA, 14 nt, Pseudomonas aeruginosa PA01
gcgauucagaugcg

SEQ ID NO: 1461029 - RNA, 13 nt, Pseudomonas aeruginosa PA01
gcgagcaccaugc

SEQ ID NO: 1461030 - RNA, 15 nt, Pseudomonas aeruginosa PA01
gcgagcaccaugccg

SEQ ID NO: 1461031 - RNA, 17 nt, Pseudomonas aeruginosa PA01
gcgagcaccaugccgau

SEQ ID NO: 1461032 - RNA, 19 nt, Pseudomonas aeruginosa PA01
gcgagcaccaugccgauga

SEQ ID NO: 1461033 - RNA, 21 nt, Pseudomonas aeruginosa PA01
gcgagagguucaccgaccagu

SEQ ID NO: 1461034 - RNA, 21 nt, Pseudomonas aeruginosa PA01
gcgagagcguccggcagggcc

SEQ ID NO: 1461035 - RNA, 18 nt, Pseudomonas aeruginosa PA01
gcgagaccggggaucagc

SEQ ID NO: 1461036 - RNA, 15 nt, Pseudomonas aeruginosa PA01
gcgagagcgccgacc

SEQ ID NO: 1461037 - RNA, 13 nt, Pseudomonas aeruginosa PA01
gcgagaauggcga

SEQ ID NO: 1461038 - RNA, 15 nt, Pseudomonas aeruginosa PA01
gcgagaaucgccgag

SEQ ID NO: 1461039 - RNA, 21 nt, Pseudomonas aeruginosa PA01
gcgacucggcugcaacgccgc

SEQ ID NO: 1461040 - RNA, 20 nt, Pseudomonas aeruginosa PA01
gcgacucgguaaagcccagg

SEQ ID NO: 1461041 - RNA, 20 nt, Pseudomonas aeruginosa PA01
gcgacucguagucgaucagg

SEQ ID NO: 1461042 - RNA, 15 nt, Pseudomonas aeruginosa PA01
gcgacucgcugccgg

SEQ ID NO: 1461043 - RNA, 17 nt, Pseudomonas aeruginosa PA01
gcgacucgcugccggcg

SEQ ID NO: 1461044 - RNA, 19 nt, Pseudomonas aeruginosa PA01
gcgacucgcugggcgccgg

SEQ ID NO: 1461045 - RNA, 20 nt, Pseudomonas aeruginosa PA01
gcgacucgcugggcgccggc

SEQ ID NO: 1461046 - RNA, 21 nt, Pseudomonas aeruginosa PA01
gcgacucgcugggcgccggca

SEQ ID NO: 1461047 - RNA, 22 nt, Pseudomonas aeruginosa PA01
gcgacucgcugggcgccggcag

SEQ ID NO: 1461048 - RNA, 20 nt, Pseudomonas aeruginosa PA01
gcgagaccaucuggaucagg

SEQ ID NO: 1461049 - RNA, 16 nt, Pseudomonas aeruginosa PA01
gcgagaccccggcggc

SEQ ID NO: 1461050 - RNA, 12 nt, Pseudomonas aeruginosa PA01
gcgagacgccgc

SEQ ID NO: 1461051 - RNA, 16 nt, Pseudomonas aeruginosa PA01
gcgagacgccgcccca

SEQ ID NO: 1461052 - RNA, 20 nt, Pseudomonas aeruginosa PA01
gcgagacgccgccccagccu

SEQ ID NO: 1461053 - RNA, 18 nt, Pseudomonas aeruginosa PA01
gcgagacgggcgacgccc

SEQ ID NO: 1461054 - RNA, 19 nt, Pseudomonas aeruginosa PA01
gcgagacgggcgacgccca

SEQ ID NO: 1461055 - RNA, 21 nt, Pseudomonas aeruginosa PA01
gcgagaccucgcccaucgcca

SEQ ID NO: 1461056 - RNA, 22 nt, Pseudomonas aeruginosa PA01
gcgagaccucgcccaucgccag

SEQ ID NO: 1461057 - RNA, 16 nt, Pseudomonas aeruginosa PA01
gcgacuccagccaggc

SEQ ID NO: 1461058 - RNA, 17 nt, Pseudomonas aeruginosa PA01
gcgacuccagccaggcg

SEQ ID NO: 1461059 - RNA, 16 nt, Pseudomonas aeruginosa PA01
gcgacguuuuucccgu

SEQ ID NO: 1461060 - RNA, 18 nt, Pseudomonas aeruginosa PA01
gcgacucgagcaccacca

SEQ ID NO: 1461061 - RNA, 19 nt, Pseudomonas aeruginosa PA01
gcgacucgagcaccaccac

SEQ ID NO: 1461062 - RNA, 16 nt, Pseudomonas aeruginosa PA01
gcgacucgaugcgcag

SEQ ID NO: 1461063 - RNA, 18 nt, Pseudomonas aeruginosa PA01
gcgacucgaugcgcagcu

SEQ ID NO: 1461064 - RNA, 21 nt, Pseudomonas aeruginosa PA01
gcgacucgaagcucuucgcca

SEQ ID NO: 1461065 - RNA, 18 nt, Pseudomonas aeruginosa PA01
gcgaggcccgcgccgccg

SEQ ID NO: 1461066 - RNA, 17 nt, Pseudomonas aeruginosa PA01
gcgaggauuuccucgcg

SEQ ID NO: 1461067 - RNA, 16 nt, Pseudomonas aeruginosa PA01
gcgaggcauucucgcg

SEQ ID NO: 1461068 - RNA, 13 nt, Pseudomonas aeruginosa PA01
gcgaggaucgcgc

SEQ ID NO: 1461069 - RNA, 14 nt, Pseudomonas aeruginosa PA01
gcgaggaucgcgcu

SEQ ID NO: 1461070 - RNA, 16 nt, Pseudomonas aeruginosa PA01
gcgaggaucgcgcugg

SEQ ID NO: 1461071 - RNA, 20 nt, Pseudomonas aeruginosa PA01
gcgaggaucgcucccaggcu

SEQ ID NO: 1461072 - RNA, 22 nt, Pseudomonas aeruginosa PA01
gcgaggaucgcucccaggcuca

SEQ ID NO: 1461073 - RNA, 21 nt, Pseudomonas aeruginosa PA01
gcgagcguucggaucggcccg

SEQ ID NO: 1461074 - RNA, 19 nt, Pseudomonas aeruginosa PA01
gcgagcgucgagucgcgca

SEQ ID NO: 1461075 - RNA, 17 nt, Pseudomonas aeruginosa PA01
gcgagcgggucagcagc

SEQ ID NO: 1461076 - RNA, 16 nt, Pseudomonas aeruginosa PA01
gcgagcuaucgccucc

SEQ ID NO: 1461077 - RNA, 20 nt, Pseudomonas aeruginosa PA01
gcgagcgcggcuucagagcu

SEQ ID NO: 1461078 - RNA, 16 nt, Pseudomonas aeruginosa PA01
gcgagcaccgcgcaga

SEQ ID NO: 1461079 - RNA, 15 nt, Pseudomonas aeruginosa PA01
gcgagcggucggcca

SEQ ID NO: 1461080 - RNA, 16 nt, Pseudomonas aeruginosa PA01
gcgagcggucggccau

SEQ ID NO: 1461081 - RNA, 18 nt, Pseudomonas aeruginosa PA01
gcgagcgguuauucgccc

SEQ ID NO: 1461082 - RNA, 19 nt, Pseudomonas aeruginosa PA01
gcgagcgguuauucgcccu

SEQ ID NO: 1461083 - RNA, 19 nt, Pseudomonas aeruginosa PA01
gcgagcgcuucauccugcg

SEQ ID NO: 1461084 - RNA, 18 nt, Pseudomonas aeruginosa PA01
gcgagcggcagauccgcc

SEQ ID NO: 1461085 - RNA, 15 nt, Pseudomonas aeruginosa PA01
gcgaggcgcccgccg

SEQ ID NO: 1461086 - RNA, 16 nt, Pseudomonas aeruginosa PA01
gcgaggcgcccgccgg

SEQ ID NO: 1461087 - RNA, 22 nt, Pseudomonas aeruginosa PA01
gcgaggccgcucuucugguagg

SEQ ID NO: 1461088 - RNA, 12 nt, Pseudomonas aeruginosa PA01
gcgaggccggcc

SEQ ID NO: 1461089 - RNA, 15 nt, Pseudomonas aeruginosa PA01
gcgagauugcgcuga

SEQ ID NO: 1461090 - RNA, 13 nt, Pseudomonas aeruginosa PA01
gcgaggcgcucga

SEQ ID NO: 1461091 - RNA, 15 nt, Pseudomonas aeruginosa PA01
gcgaggcgcucgacg

SEQ ID NO: 1461092 - RNA, 19 nt, Pseudomonas aeruginosa PA01
gcgaggcggucaugcgccc

SEQ ID NO: 1461093 - RNA, 21 nt, Pseudomonas aeruginosa PA01
gcgaggcguucgucgaccugc

SEQ ID NO: 1461094 - RNA, 18 nt, Pseudomonas aeruginosa PA01
gcgaggcuaacgccgagg

SEQ ID NO: 1461095 - RNA, 20 nt, Pseudomonas aeruginosa PA01
gcgagggauguuccaggccc

SEQ ID NO: 1461096 - RNA, 13 nt, Pseudomonas aeruginosa PA01
gcgagggcgcgca

SEQ ID NO: 1461097 - RNA, 20 nt, Pseudomonas aeruginosa PA01
gcgagggcggcgaccugggc

SEQ ID NO: 1461098 - RNA, 19 nt, Pseudomonas aeruginosa PA01
gcgagggcggcgcgggcgc

SEQ ID NO: 1461099 - RNA, 19 nt, Pseudomonas aeruginosa PA01
gcgagggggccucggccag

SEQ ID NO: 1461100 - RNA, 20 nt, Pseudomonas aeruginosa PA01
gcgagggggccucggccagc

SEQ ID NO: 1461101 - RNA, 20 nt, Pseudomonas aeruginosa PA01
gcgagggugaacuggccguc

SEQ ID NO: 1461102 - RNA, 21 nt, Pseudomonas aeruginosa PA01
gcgagggugaacuggccgucg

SEQ ID NO: 1461103 - RNA, 14 nt, Pseudomonas aeruginosa PA01
gcgaggguggcgcc

SEQ ID NO: 1461104 - RNA, 16 nt, Pseudomonas aeruginosa PA01
gcgaggguggcgccca

SEQ ID NO: 1461105 - RNA, 18 nt, Pseudomonas aeruginosa PA01
gcgacguccugcggguca

SEQ ID NO: 1461106 - RNA, 19 nt, Pseudomonas aeruginosa PA01
gcgacgucccuuccccgau

SEQ ID NO: 1461107 - RNA, 12 nt, Pseudomonas aeruginosa PA01
gcgacgucgccc

SEQ ID NO: 1461108 - RNA, 23 nt, Pseudomonas aeruginosa PA01
gcgacguugcaauugcaggcccg

SEQ ID NO: 1461109 - RNA, 15 nt, Pseudomonas aeruginosa PA01
gcgacguugcgcagg

SEQ ID NO: 1461110 - RNA, 24 nt, Pseudomonas aeruginosa PA01
gcgacguugcgcaggggcgcggcg

SEQ ID NO: 1461111 - RNA, 22 nt, Pseudomonas aeruginosa PA01
gcgacguucugcucgcugcccg

SEQ ID NO: 1461112 - RNA, 13 nt, Pseudomonas aeruginosa PA01
gcgacguggcagg

SEQ ID NO: 1461113 - RNA, 19 nt, Pseudomonas aeruginosa PA01
gcgacguccacugcguccu

SEQ ID NO: 1461114 - RNA, 16 nt, Pseudomonas aeruginosa PA01
gcgacgggugcgucca

SEQ ID NO: 1461115 - RNA, 21 nt, Pseudomonas aeruginosa PA01
gcgacgggugcguccauccag

SEQ ID NO: 1461116 - RNA, 16 nt, Pseudomonas aeruginosa PA01
gcgacggucaggccga

SEQ ID NO: 1461117 - RNA, 22 nt, Pseudomonas aeruginosa PA01
gcgacggucaggccgagcagcg

SEQ ID NO: 1461118 - RNA, 19 nt, Pseudomonas aeruginosa PA01
gcgacgguugauagcgcgg

SEQ ID NO: 1461119 - RNA, 20 nt, Pseudomonas aeruginosa PA01
gcgacgguugauagcgcggc

SEQ ID NO: 1461120 - RNA, 17 nt, Pseudomonas aeruginosa PA01
gcgacgggaagcgaacc

SEQ ID NO: 1461121 - RNA, 22 nt, Pseudomonas aeruginosa PA01
gcgacgggaagcgaaccaggca

SEQ ID NO: 1461122 - RNA, 15 nt, Pseudomonas aeruginosa PA01
gcgaccgucggccgg

SEQ ID NO: 1461123 - RNA, 19 nt, Pseudomonas aeruginosa PA01
gcgaccggguccugcagau

SEQ ID NO: 1461124 - RNA, 20 nt, Pseudomonas aeruginosa PA01
gcgaccgguaacuggccagg

SEQ ID NO: 1461125 - RNA, 16 nt, Pseudomonas aeruginosa PA01
gcgaccuccggcgcca

SEQ ID NO: 1461126 - RNA, 19 nt, Pseudomonas aeruginosa PA01
gcgaccucguugcaggcac

SEQ ID NO: 1461127 - RNA, 18 nt, Pseudomonas aeruginosa PA01
gcgaccugcucgaaccgg

SEQ ID NO: 1461128 - RNA, 18 nt, Pseudomonas aeruginosa PA01
gcgaccugcucgcgcacc

SEQ ID NO: 1461129 - RNA, 15 nt, Pseudomonas aeruginosa PA01
gcgaccgugaggcgc

SEQ ID NO: 1461130 - RNA, 20 nt, Pseudomonas aeruginosa PA01
gcgaccucagucgugcaggu

SEQ ID NO: 1461131 - RNA, 17 nt, Pseudomonas aeruginosa PA01
gcgacggaccgcgacaa

SEQ ID NO: 1461132 - RNA, 23 nt, Pseudomonas aeruginosa PA01
gcgacggcauuccugguccagcc

SEQ ID NO: 1461133 - RNA, 21 nt, Pseudomonas aeruginosa PA01
gcgacgcugucguggacgccg

SEQ ID NO: 1461134 - RNA, 19 nt, Pseudomonas aeruginosa PA01
gcgaccuguucgaaguucu

SEQ ID NO: 1461135 - RNA, 17 nt, Pseudomonas aeruginosa PA01
gcgaccuggcgccgaaa

SEQ ID NO: 1461136 - RNA, 18 nt, Pseudomonas aeruginosa PA01
gcgaccugggcgucgcug

SEQ ID NO: 1461137 - RNA, 19 nt, Pseudomonas aeruginosa PA01
gcgacggaaacgacaggcu

SEQ ID NO: 1461138 - RNA, 20 nt, Pseudomonas aeruginosa PA01
gcgacggaaacgacaggcug

SEQ ID NO: 1461139 - RNA, 19 nt, Pseudomonas aeruginosa PA01
gcgacggaacaagccgccu

SEQ ID NO: 1461140 - RNA, 15 nt, Pseudomonas aeruginosa PA01
gcgacggaaggugcg

SEQ ID NO: 1461141 - RNA, 18 nt, Pseudomonas aeruginosa PA01
gcgaaggccaccaucgcg

SEQ ID NO: 1461142 - RNA, 19 nt, Pseudomonas aeruginosa PA01
gcgaaggccaccaucgcgg

SEQ ID NO: 1461143 - RNA, 21 nt, Pseudomonas aeruginosa PA01
gcgaaggccaccaucgcggcg

SEQ ID NO: 1461144 - RNA, 19 nt, Pseudomonas aeruginosa PA01
gcgaaggccacgccgacgc

SEQ ID NO: 1461145 - RNA, 21 nt, Pseudomonas aeruginosa PA01
gcgaaggccacgccgacgccg

SEQ ID NO: 1461146 - RNA, 15 nt, Pseudomonas aeruginosa PA01
gcgaagcuucuucgg

SEQ ID NO: 1461147 - RNA, 13 nt, Pseudomonas aeruginosa PA01
gcgaaggcgaacc

SEQ ID NO: 1461148 - RNA, 21 nt, Pseudomonas aeruginosa PA01
gcgaaggcgaaccacaccagg

SEQ ID NO: 1461149 - RNA, 16 nt, Pseudomonas aeruginosa PA01
gcgaaggcgccuucca

SEQ ID NO: 1461150 - RNA, 17 nt, Pseudomonas aeruginosa PA01
gccuuguccgcgcgcuu

SEQ ID NO: 1461151 - RNA, 21 nt, Pseudomonas aeruginosa PA01
gccuuguagaguuugccgaac

SEQ ID NO: 1461152 - RNA, 22 nt, Pseudomonas aeruginosa PA01
gccuuguagaguuugccgaacu

SEQ ID NO: 1461153 - RNA, 17 nt, Pseudomonas aeruginosa PA01
gccuuguucaggguggc

SEQ ID NO: 1461154 - RNA, 20 nt, Pseudomonas aeruginosa PA01
gccuuguucaggguggcgac

SEQ ID NO: 1461155 - RNA, 22 nt, Pseudomonas aeruginosa PA01
gccuuguucaggguggcgaccg

SEQ ID NO: 1461156 - RNA, 17 nt, Pseudomonas aeruginosa PA01
gccuuguuccaggcguu

SEQ ID NO: 1461157 - RNA, 23 nt, Pseudomonas aeruginosa PA01
gccuuggucucgcgggcgacgaa

SEQ ID NO: 1461158 - RNA, 19 nt, Pseudomonas aeruginosa PA01
gccuugguguagccgagca

SEQ ID NO: 1461159 - RNA, 19 nt, Pseudomonas aeruginosa PA01
gcgaaguagaagcgcgcgg

SEQ ID NO: 1461160 - RNA, 21 nt, Pseudomonas aeruginosa PA01
gcgaaguagaagcgcgcggua

SEQ ID NO: 1461161 - RNA, 16 nt, Pseudomonas aeruginosa PA01
gcgaagucgccgucgu

SEQ ID NO: 1461162 - RNA, 22 nt, Pseudomonas aeruginosa PA01
gcgaagucgccgucguccgggu

SEQ ID NO: 1461163 - RNA, 17 nt, Pseudomonas aeruginosa PA01
gcgaagucggcgcgcca

SEQ ID NO: 1461164 - RNA, 23 nt, Pseudomonas aeruginosa PA01
gcgaagucggcgcgccagaagcg

SEQ ID NO: 1461165 - RNA, 14 nt, Pseudomonas aeruginosa PA01
gcgaagucugccug

SEQ ID NO: 1461166 - RNA, 22 nt, Pseudomonas aeruginosa PA01
gcgaagucugccuguccgcugc

SEQ ID NO: 1461167 - RNA, 15 nt, Pseudomonas aeruginosa PA01
gcgaaguccaccagg

SEQ ID NO: 1461168 - RNA, 16 nt, Pseudomonas aeruginosa PA01
gcgaaguccaccaggc

SEQ ID NO: 1461169 - RNA, 17 nt, Pseudomonas aeruginosa PA01
gcgaaguugaaacggcg

SEQ ID NO: 1461170 - RNA, 18 nt, Pseudomonas aeruginosa PA01
gcgaaguugaaacggcgg

SEQ ID NO: 1461171 - RNA, 15 nt, Pseudomonas aeruginosa PA01
gcgaaguugccgccg

SEQ ID NO: 1461172 - RNA, 16 nt, Pseudomonas aeruginosa PA01
gcgaaguugccgccgc

SEQ ID NO: 1461173 - RNA, 22 nt, Pseudomonas aeruginosa PA01
gcgaaguugccgccgcuggccu

SEQ ID NO: 1461174 - RNA, 24 nt, Pseudomonas aeruginosa PA01
gcgaaguugccgccgcuggccugg

SEQ ID NO: 1461175 - RNA, 14 nt, Pseudomonas aeruginosa PA01
gcgaagugcgcugc

SEQ ID NO: 1461176 - RNA, 15 nt, Pseudomonas aeruginosa PA01
gcgaauaaccauugc

SEQ ID NO: 1461177 - RNA, 14 nt, Pseudomonas aeruginosa PA01
gcgaauaaccgcau

SEQ ID NO: 1461178 - RNA, 19 nt, Pseudomonas aeruginosa PA01
gcgaauaacgccacaggcg

SEQ ID NO: 1461179 - RNA, 16 nt, Pseudomonas aeruginosa PA01
gcgaauaacgccaccg

SEQ ID NO: 1461180 - RNA, 14 nt, Pseudomonas aeruginosa PA01
gcgaauccgcggcc

SEQ ID NO: 1461181 - RNA, 16 nt, Pseudomonas aeruginosa PA01
gcgaauccgcggcccu

SEQ ID NO: 1461182 - RNA, 21 nt, Pseudomonas aeruginosa PA01
gcgaauccgcggcccugcucg

SEQ ID NO: 1461183 - RNA, 15 nt, Pseudomonas aeruginosa PA01
gcgaauccuguccgu

SEQ ID NO: 1461184 - RNA, 18 nt, Pseudomonas aeruginosa PA01
gcgaauaucgcggcgcga

SEQ ID NO: 1461185 - RNA, 16 nt, Pseudomonas aeruginosa PA01
gcgaauagggcggcgc

SEQ ID NO: 1461186 - RNA, 20 nt, Pseudomonas aeruginosa PA01
gcgaauaccagugccgcggu

SEQ ID NO: 1461187 - RNA, 17 nt, Pseudomonas aeruginosa PA01
gcgaauaccgcgcgcgc

SEQ ID NO: 1461188 - RNA, 14 nt, Pseudomonas aeruginosa PA01
gcgaauagacgccg

SEQ ID NO: 1461189 - RNA, 17 nt, Pseudomonas aeruginosa PA01
gcgaauagacgccgcug

SEQ ID NO: 1461190 - RNA, 15 nt, Pseudomonas aeruginosa PA01
gcgaauagcgccgca

SEQ ID NO: 1461191 - RNA, 16 nt, Pseudomonas aeruginosa PA01
gcgaauagcgccgcgg

SEQ ID NO: 1461192 - RNA, 20 nt, Pseudomonas aeruginosa PA01
gcgaaugcccggcagcgccg

SEQ ID NO: 1461193 - RNA, 16 nt, Pseudomonas aeruginosa PA01
gcgaauguccggcgac

SEQ ID NO: 1461194 - RNA, 16 nt, Pseudomonas aeruginosa PA01
gcgaauuuccugcugg

SEQ ID NO: 1461195 - RNA, 15 nt, Pseudomonas aeruginosa PA01
gcgaauuugaacgcu

SEQ ID NO: 1461196 - RNA, 15 nt, Pseudomonas aeruginosa PA01
gcgaauucgucgccg

SEQ ID NO: 1461197 - RNA, 14 nt, Pseudomonas aeruginosa PA01
gcgaaucgucgccg

SEQ ID NO: 1461198 - RNA, 17 nt, Pseudomonas aeruginosa PA01
gcgaaucgucgccggag

SEQ ID NO: 1461199 - RNA, 14 nt, Pseudomonas aeruginosa PA01
gcgaaugcuccggg

SEQ ID NO: 1461200 - RNA, 16 nt, Pseudomonas aeruginosa PA01
gcgaauggagggaucg

SEQ ID NO: 1461201 - RNA, 15 nt, Pseudomonas aeruginosa PA01
gcgaauggcagcagg

SEQ ID NO: 1461202 - RNA, 19 nt, Pseudomonas aeruginosa PA01
gcgaaucuucggcgcgccg

SEQ ID NO: 1461203 - RNA, 22 nt, Pseudomonas aeruginosa PA01
gcgaaucuucggcgcgccggug

SEQ ID NO: 1461204 - RNA, 16 nt, Pseudomonas aeruginosa PA01
gcgacacgugccccag

SEQ ID NO: 1461205 - RNA, 20 nt, Pseudomonas aeruginosa PA01
gcgacacgugccccaggccg

SEQ ID NO: 1461206 - RNA, 12 nt, Pseudomonas aeruginosa PA01
gcgacaacggcc

SEQ ID NO: 1461207 - RNA, 14 nt, Pseudomonas aeruginosa PA01
gcgacaucuccagg

SEQ ID NO: 1461208 - RNA, 15 nt, Pseudomonas aeruginosa PA01
gcgacaucuccaggc

SEQ ID NO: 1461209 - RNA, 14 nt, Pseudomonas aeruginosa PA01
gcgacaucggcgau

SEQ ID NO: 1461210 - RNA, 16 nt, Pseudomonas aeruginosa PA01
gcgacaucggcgaugg

SEQ ID NO: 1461211 - RNA, 18 nt, Pseudomonas aeruginosa PA01
gcgacagccgggcagccg

SEQ ID NO: 1461212 - RNA, 17 nt, Pseudomonas aeruginosa PA01
gcgacauagccggcgaa

SEQ ID NO: 1461213 - RNA, 19 nt, Pseudomonas aeruginosa PA01
gcgacauagccggcgaacc

SEQ ID NO: 1461214 - RNA, 16 nt, Pseudomonas aeruginosa PA01
gcgacauagcggcugc

SEQ ID NO: 1461215 - RNA, 21 nt, Pseudomonas aeruginosa PA01
gcgaccaguugcucgcuccga

SEQ ID NO: 1461216 - RNA, 21 nt, Pseudomonas aeruginosa PA01
gcgaccauguucaccagcgcu

SEQ ID NO: 1461217 - RNA, 17 nt, Pseudomonas aeruginosa PA01
gcgaccagggggcgaca

SEQ ID NO: 1461218 - RNA, 21 nt, Pseudomonas aeruginosa PA01
gcgaccagguccggagggccc

SEQ ID NO: 1461219 - RNA, 17 nt, Pseudomonas aeruginosa PA01
gcgaccagcccgcgcga

SEQ ID NO: 1461220 - RNA, 15 nt, Pseudomonas aeruginosa PA01
gcgaccagcgccagg

SEQ ID NO: 1461221 - RNA, 19 nt, Pseudomonas aeruginosa PA01
gcgaccagcgccaggcgcg

SEQ ID NO: 1461222 - RNA, 18 nt, Pseudomonas aeruginosa PA01
gcgaccaggacagcacgc

SEQ ID NO: 1461223 - RNA, 24 nt, Pseudomonas aeruginosa PA01
gcgaccaggacagcacgcucaggc

SEQ ID NO: 1461224 - RNA, 20 nt, Pseudomonas aeruginosa PA01
gcgaccagcgucgcgcgugc

SEQ ID NO: 1461225 - RNA, 20 nt, Pseudomonas aeruginosa PA01
gcgaccagcucgaagccgcc

SEQ ID NO: 1461226 - RNA, 21 nt, Pseudomonas aeruginosa PA01
gcgaccagcucgaagccgccg

SEQ ID NO: 1461227 - RNA, 17 nt, Pseudomonas aeruginosa PA01
gcgacccagaccugccg

SEQ ID NO: 1461228 - RNA, 18 nt, Pseudomonas aeruginosa PA01
gcgacccagaccugccgc

SEQ ID NO: 1461229 - RNA, 13 nt, Pseudomonas aeruginosa PA01
gcgaccggaugcu

SEQ ID NO: 1461230 - RNA, 17 nt, Pseudomonas aeruginosa PA01
gcgaccggaugcuccag

SEQ ID NO: 1461231 - RNA, 18 nt, Pseudomonas aeruginosa PA01
gcgaccggaugcuccagg

SEQ ID NO: 1461232 - RNA, 12 nt, Pseudomonas aeruginosa PA01
gcgaccgcugga

SEQ ID NO: 1461233 - RNA, 15 nt, Pseudomonas aeruginosa PA01
gcgaccgcuggacca

SEQ ID NO: 1461234 - RNA, 23 nt, Pseudomonas aeruginosa PA01
gcgaccgcuggaccaguucagcg

SEQ ID NO: 1461235 - RNA, 18 nt, Pseudomonas aeruginosa PA01
gcgcgacacauggucggc

SEQ ID NO: 1461236 - RNA, 22 nt, Pseudomonas aeruginosa PA01
gcgcgacagcucguggcuggcg

SEQ ID NO: 1461237 - RNA, 14 nt, Pseudomonas aeruginosa PA01
gcgcgacagcucug

SEQ ID NO: 1461238 - RNA, 22 nt, Pseudomonas aeruginosa PA01
gcgcgacagcucuggggucagu

SEQ ID NO: 1461239 - RNA, 14 nt, Pseudomonas aeruginosa PA01
gcgcgacaucggcg

SEQ ID NO: 1461240 - RNA, 15 nt, Pseudomonas aeruginosa PA01
gcgcgacaucggcga

SEQ ID NO: 1461241 - RNA, 16 nt, Pseudomonas aeruginosa PA01
gcgcgacaucggcgau

SEQ ID NO: 1461242 - RNA, 18 nt, Pseudomonas aeruginosa PA01
gcgcgacaucggcgaugg

SEQ ID NO: 1461243 - RNA, 18 nt, Pseudomonas aeruginosa PA01
gcgcgauacccuggccgg

SEQ ID NO: 1461244 - RNA, 19 nt, Pseudomonas aeruginosa PA01
gcgcgauacccuggccggc

SEQ ID NO: 1461245 - RNA, 21 nt, Pseudomonas aeruginosa PA01
gcgcgauacccuggccggccu

SEQ ID NO: 1461246 - RNA, 22 nt, Pseudomonas aeruginosa PA01
gcgcgauacccuggccggccuc

SEQ ID NO: 1461247 - RNA, 18 nt, Pseudomonas aeruginosa PA01
gcgcgaguaguaggucgg

SEQ ID NO: 1461248 - RNA, 18 nt, Pseudomonas aeruginosa PA01
gcgcgaggcguucgucga

SEQ ID NO: 1461249 - RNA, 20 nt, Pseudomonas aeruginosa PA01
gcgcgaggcguucgucgacc

SEQ ID NO: 1461250 - RNA, 14 nt, Pseudomonas aeruginosa PA01
gcgcgaggcgcagg

SEQ ID NO: 1461251 - RNA, 16 nt, Pseudomonas aeruginosa PA01
gcgcgaggcgcccgcc

SEQ ID NO: 1461252 - RNA, 20 nt, Pseudomonas aeruginosa PA01
gcgcgaggcgcccgccggcc

SEQ ID NO: 1461253 - RNA, 18 nt, Pseudomonas aeruginosa PA01
gcgcgagggggccucggc

SEQ ID NO: 1461254 - RNA, 20 nt, Pseudomonas aeruginosa PA01
gcgcgagggggccucggcca

SEQ ID NO: 1461255 - RNA, 22 nt, Pseudomonas aeruginosa PA01
gcgcgagggggccucggccagc

SEQ ID NO: 1461256 - RNA, 14 nt, Pseudomonas aeruginosa PA01
gcgcgaucggggca

SEQ ID NO: 1461257 - RNA, 22 nt, Pseudomonas aeruginosa PA01
gcgcgaucucuacuaccgccag

SEQ ID NO: 1461258 - RNA, 22 nt, Pseudomonas aeruginosa PA01
gcgcgaugccccauccgacgcc

SEQ ID NO: 1461259 - RNA, 13 nt, Pseudomonas aeruginosa PA01
gcgcgaugccgau

SEQ ID NO: 1461260 - RNA, 17 nt, Pseudomonas aeruginosa PA01
gcgcgaugaugccgccg

SEQ ID NO: 1461261 - RNA, 15 nt, Pseudomonas aeruginosa PA01
gcgcgauauccgcca

SEQ ID NO: 1461262 - RNA, 18 nt, Pseudomonas aeruginosa PA01
gcgcgauaucgcaggcca

SEQ ID NO: 1461263 - RNA, 13 nt, Pseudomonas aeruginosa PA01
gcgcgaucagccg

SEQ ID NO: 1461264 - RNA, 17 nt, Pseudomonas aeruginosa PA01
gcgcgaucagccgcucc

SEQ ID NO: 1461265 - RNA, 16 nt, Pseudomonas aeruginosa PA01
gcgcgauccgcgcggc

SEQ ID NO: 1461266 - RNA, 17 nt, Pseudomonas aeruginosa PA01
gcgcgauccgcgcggca

SEQ ID NO: 1461267 - RNA, 13 nt, Pseudomonas aeruginosa PA01
gcgcgauccuccg

SEQ ID NO: 1461268 - RNA, 18 nt, Pseudomonas aeruginosa PA01
gcgcgccaccagcguggc

SEQ ID NO: 1461269 - RNA, 20 nt, Pseudomonas aeruginosa PA01
gcgcgccaccagcguggcgc

SEQ ID NO: 1461270 - RNA, 19 nt, Pseudomonas aeruginosa PA01
gcgcgccagaagcggccga

SEQ ID NO: 1461271 - RNA, 17 nt, Pseudomonas aeruginosa PA01
gcgcgccagcaacgccu

SEQ ID NO: 1461272 - RNA, 12 nt, Pseudomonas aeruginosa PA01
gcgcgccagcac

SEQ ID NO: 1461273 - RNA, 20 nt, Pseudomonas aeruginosa PA01
gcgcgccagcacggcgcagg

SEQ ID NO: 1461274 - RNA, 13 nt, Pseudomonas aeruginosa PA01
gcgcgccagucca

SEQ ID NO: 1461275 - RNA, 17 nt, Pseudomonas aeruginosa PA01
gcgcgccaguccacgac

SEQ ID NO: 1461276 - RNA, 14 nt, Pseudomonas aeruginosa PA01
gcgcgccaggccca

SEQ ID NO: 1461277 - RNA, 17 nt, Pseudomonas aeruginosa PA01
gcgcgccaggcccacgc

SEQ ID NO: 1461278 - RNA, 12 nt, Pseudomonas aeruginosa PA01
gcgcgccaggcc

SEQ ID NO: 1461279 - RNA, 17 nt, Pseudomonas aeruginosa PA01
gcgcgcaacgcuuccag

SEQ ID NO: 1461280 - RNA, 16 nt, Pseudomonas aeruginosa PA01
gcgcgcacuuccucgg

SEQ ID NO: 1461281 - RNA, 21 nt, Pseudomonas aeruginosa PA01
gcgcgcacuuccucggcgacc

SEQ ID NO: 1461282 - RNA, 22 nt, Pseudomonas aeruginosa PA01
gcgcgcacuuccucggcgacca

SEQ ID NO: 1461283 - RNA, 19 nt, Pseudomonas aeruginosa PA01
gcgcgcagauaaggcgugc

SEQ ID NO: 1461284 - RNA, 13 nt, Pseudomonas aeruginosa PA01
gcgcgcagcaggu

SEQ ID NO: 1461285 - RNA, 19 nt, Pseudomonas aeruginosa PA01
gcgcgaacaguuccgacug

SEQ ID NO: 1461286 - RNA, 20 nt, Pseudomonas aeruginosa PA01
gcgcgaacaguuccgacugc

SEQ ID NO: 1461287 - RNA, 19 nt, Pseudomonas aeruginosa PA01
gcgcgaaagggucaggccu

SEQ ID NO: 1461288 - RNA, 20 nt, Pseudomonas aeruginosa PA01
gcgcgaaagggucaggccuu

SEQ ID NO: 1461289 - RNA, 15 nt, Pseudomonas aeruginosa PA01
gcgcgaaccagcagc

SEQ ID NO: 1461290 - RNA, 17 nt, Pseudomonas aeruginosa PA01
gcgcgaaccagcagcag

SEQ ID NO: 1461291 - RNA, 16 nt, Pseudomonas aeruginosa PA01
gcgcgaaucuucggcg

SEQ ID NO: 1461292 - RNA, 18 nt, Pseudomonas aeruginosa PA01
gcgcgaaucuucggcgcg

SEQ ID NO: 1461293 - RNA, 22 nt, Pseudomonas aeruginosa PA01
gcgcgaaucuucggcgcgccgg

SEQ ID NO: 1461294 - RNA, 17 nt, Pseudomonas aeruginosa PA01
gcgcgaaggccacgccg

SEQ ID NO: 1461295 - RNA, 20 nt, Pseudomonas aeruginosa PA01
gcgcgaaggccacgccgacg

SEQ ID NO: 1461296 - RNA, 22 nt, Pseudomonas aeruginosa PA01
gcgcgaagccaggaagcggcgg

SEQ ID NO: 1461297 - RNA, 23 nt, Pseudomonas aeruginosa PA01
gcgcgaagccaggaagcggcggu

SEQ ID NO: 1461298 - RNA, 16 nt, Pseudomonas aeruginosa PA01
gcgccuuuuucauggc

SEQ ID NO: 1461299 - RNA, 20 nt, Pseudomonas aeruginosa PA01
gcgccuuuuucauggccugg

SEQ ID NO: 1461300 - RNA, 21 nt, Pseudomonas aeruginosa PA01
gcgccuuuuucauggccuggc

SEQ ID NO: 1461301 - RNA, 22 nt, Pseudomonas aeruginosa PA01
gcgccuuuuucauggccuggcg

SEQ ID NO: 1461302 - RNA, 20 nt, Pseudomonas aeruginosa PA01
gcgccuuuuuucauccugcg

SEQ ID NO: 1461303 - RNA, 13 nt, Pseudomonas aeruginosa PA01
gcgccugggccgc

SEQ ID NO: 1461304 - RNA, 15 nt, Pseudomonas aeruginosa PA01
gcgccugggccgcga

SEQ ID NO: 1461305 - RNA, 20 nt, Pseudomonas aeruginosa PA01
gcgccuggcgcaacgccggc

SEQ ID NO: 1461306 - RNA, 22 nt, Pseudomonas aeruginosa PA01
gcgccuggcgcaacgccggcag

SEQ ID NO: 1461307 - RNA, 13 nt, Pseudomonas aeruginosa PA01
gcgccuggcgcag

SEQ ID NO: 1461308 - RNA, 12 nt, Pseudomonas aeruginosa PA01
gcgccuggcguc

SEQ ID NO: 1461309 - RNA, 13 nt, Pseudomonas aeruginosa PA01
gcgccuggcuggc

SEQ ID NO: 1461310 - RNA, 16 nt, Pseudomonas aeruginosa PA01
gcgccuggcuggccag

SEQ ID NO: 1461311 - RNA, 15 nt, Pseudomonas aeruginosa PA01
gcgccguggaucgcc

SEQ ID NO: 1461312 - RNA, 17 nt, Pseudomonas aeruginosa PA01
gcgccugagcagcgcuu

SEQ ID NO: 1461313 - RNA, 18 nt, Pseudomonas aeruginosa PA01
gcgccugagcagcgcuug

SEQ ID NO: 1461314 - RNA, 19 nt, Pseudomonas aeruginosa PA01
gcgccugcaaagaggcgcu

SEQ ID NO: 1461315 - RNA, 21 nt, Pseudomonas aeruginosa PA01
gcgccugcaaagaggcgcuca

SEQ ID NO: 1461316 - RNA, 15 nt, Pseudomonas aeruginosa PA01
gcgccugcaacgcca

SEQ ID NO: 1461317 - RNA, 19 nt, Pseudomonas aeruginosa PA01
gcgccugcaacgccagcag

SEQ ID NO: 1461318 - RNA, 19 nt, Pseudomonas aeruginosa PA01
gcgccugcucuucggcggc

SEQ ID NO: 1461319 - RNA, 22 nt, Pseudomonas aeruginosa PA01
gcgccugcucuucggcggccag

SEQ ID NO: 1461320 - RNA, 13 nt, Pseudomonas aeruginosa PA01
gcgccuggccgcg

SEQ ID NO: 1461321 - RNA, 14 nt, Pseudomonas aeruginosa PA01
gcgccuggccgucu

SEQ ID NO: 1461322 - RNA, 20 nt, Pseudomonas aeruginosa PA01
gcgccuggccgucuuccagg

SEQ ID NO: 1461323 - RNA, 23 nt, Pseudomonas aeruginosa PA01
gcgccuggccuggaacuggucgg

SEQ ID NO: 1461324 - RNA, 16 nt, Pseudomonas aeruginosa PA01
gcgccuggcccuggcg

SEQ ID NO: 1461325 - RNA, 18 nt, Pseudomonas aeruginosa PA01
gcgccuggcccuggcggu

SEQ ID NO: 1461326 - RNA, 12 nt, Pseudomonas aeruginosa PA01
gcgccuggccgc

SEQ ID NO: 1461327 - RNA, 13 nt, Pseudomonas aeruginosa PA01
gcgccuggagcag

SEQ ID NO: 1461328 - RNA, 17 nt, Pseudomonas aeruginosa PA01
gcgccuggaucagcgcc

SEQ ID NO: 1461329 - RNA, 21 nt, Pseudomonas aeruginosa PA01
gcgccuggaucagcgccucga

SEQ ID NO: 1461330 - RNA, 20 nt, Pseudomonas aeruginosa PA01
gcgccugcuucagcccggca

SEQ ID NO: 1461331 - RNA, 21 nt, Pseudomonas aeruginosa PA01
gcgccugcuuugggagcagga

SEQ ID NO: 1461332 - RNA, 19 nt, Pseudomonas aeruginosa PA01
gcgccugcaggucgaggcg

SEQ ID NO: 1461333 - RNA, 22 nt, Pseudomonas aeruginosa PA01
gcgccugcaggucgaggcgcuc

SEQ ID NO: 1461334 - RNA, 19 nt, Pseudomonas aeruginosa PA01
gcgccgccccguuggcgcg

SEQ ID NO: 1461335 - RNA, 20 nt, Pseudomonas aeruginosa PA01
gcgccgccccguuggcgcgg

SEQ ID NO: 1461336 - RNA, 18 nt, Pseudomonas aeruginosa PA01
gcgccgccgaggauagcg

SEQ ID NO: 1461337 - RNA, 16 nt, Pseudomonas aeruginosa PA01
gcgccgcccuggccgc

SEQ ID NO: 1461338 - RNA, 21 nt, Pseudomonas aeruginosa PA01
gcgccgcccggcucgccgccg

SEQ ID NO: 1461339 - RNA, 23 nt, Pseudomonas aeruginosa PA01
gcgccgcccggcucgccgccggg

SEQ ID NO: 1461340 - RNA, 17 nt, Pseudomonas aeruginosa PA01
gcgccgccgccgaccgu

SEQ ID NO: 1461341 - RNA, 20 nt, Pseudomonas aeruginosa PA01
gcgccgccgccgaccgugag

SEQ ID NO: 1461342 - RNA, 12 nt, Pseudomonas aeruginosa PA01
gcgccgccgcgg

SEQ ID NO: 1461343 - RNA, 14 nt, Pseudomonas aeruginosa PA01
gcgccgccgcggcc

SEQ ID NO: 1461344 - RNA, 15 nt, Pseudomonas aeruginosa PA01
gcgccgccgcggcca

SEQ ID NO: 1461345 - RNA, 13 nt, Pseudomonas aeruginosa PA01
gcgccgccgcugg

SEQ ID NO: 1461346 - RNA, 13 nt, Pseudomonas aeruginosa PA01
gcgccggaucggc

SEQ ID NO: 1461347 - RNA, 20 nt, Pseudomonas aeruginosa PA01
gcgccggaucggcugaccgg

SEQ ID NO: 1461348 - RNA, 21 nt, Pseudomonas aeruginosa PA01
gcgccggaucggcugaccggc

SEQ ID NO: 1461349 - RNA, 18 nt, Pseudomonas aeruginosa PA01
gcgccggcaucgccaugg

SEQ ID NO: 1461350 - RNA, 19 nt, Pseudomonas aeruginosa PA01
gcgccggcaucgccauggc

SEQ ID NO: 1461351 - RNA, 16 nt, Pseudomonas aeruginosa PA01
gcgccggcagcucggc

SEQ ID NO: 1461352 - RNA, 19 nt, Pseudomonas aeruginosa PA01
gcgccggcagcucggccga

SEQ ID NO: 1461353 - RNA, 21 nt, Pseudomonas aeruginosa PA01
gcgccggcagcucggccgagg

SEQ ID NO: 1461354 - RNA, 20 nt, Pseudomonas aeruginosa PA01
gcgccggcaggaacgcccgc

SEQ ID NO: 1461355 - RNA, 14 nt, Pseudomonas aeruginosa PA01
gcgccggcaggccu

SEQ ID NO: 1461356 - RNA, 17 nt, Pseudomonas aeruginosa PA01
gcgccggcauugccgac

SEQ ID NO: 1461357 - RNA, 17 nt, Pseudomonas aeruginosa PA01
gcgccggccauucgcug

SEQ ID NO: 1461358 - RNA, 14 nt, Pseudomonas aeruginosa PA01
gcgccggcccagca

SEQ ID NO: 1461359 - RNA, 12 nt, Pseudomonas aeruginosa PA01
gcgccggccagg

SEQ ID NO: 1461360 - RNA, 13 nt, Pseudomonas aeruginosa PA01
gcgccggccgggc

SEQ ID NO: 1461361 - RNA, 17 nt, Pseudomonas aeruginosa PA01
gcgccggccuccagcgc

SEQ ID NO: 1461362 - RNA, 20 nt, Pseudomonas aeruginosa PA01
gcgccggccuccagcgccug

SEQ ID NO: 1461363 - RNA, 13 nt, Pseudomonas aeruginosa PA01
gcgccggccucgc

SEQ ID NO: 1461364 - RNA, 21 nt, Pseudomonas aeruginosa PA01
gcgccggcgaucgccaggcga

SEQ ID NO: 1461365 - RNA, 15 nt, Pseudomonas aeruginosa PA01
gcgccggccuccagc

SEQ ID NO: 1461366 - RNA, 15 nt, Pseudomonas aeruginosa PA01
gcgccggcgcgcggc

SEQ ID NO: 1461367 - RNA, 14 nt, Pseudomonas aeruginosa PA01
gcgccggcggauca

SEQ ID NO: 1461368 - RNA, 20 nt, Pseudomonas aeruginosa PA01
gcgccggcggaucacaggcu

SEQ ID NO: 1461369 - RNA, 17 nt, Pseudomonas aeruginosa PA01
gcgccggcggaucagcc

SEQ ID NO: 1461370 - RNA, 20 nt, Pseudomonas aeruginosa PA01
gcgccggcggaucagcccgc

SEQ ID NO: 1461371 - RNA, 17 nt, Pseudomonas aeruginosa PA01
gcgccggcgcugcgagc

SEQ ID NO: 1461372 - RNA, 20 nt, Pseudomonas aeruginosa PA01
gcgccggcgcugcgagcgcu

SEQ ID NO: 1461373 - RNA, 15 nt, Pseudomonas aeruginosa PA01
gcgccggcggccggc

SEQ ID NO: 1461374 - RNA, 13 nt, Pseudomonas aeruginosa PA01
gcgccggcggccu

SEQ ID NO: 1461375 - RNA, 13 nt, Pseudomonas aeruginosa PA01
gcgccggcggcgc

SEQ ID NO: 1461376 - RNA, 14 nt, Pseudomonas aeruginosa PA01
gcgccggcggcgcg

SEQ ID NO: 1461377 - RNA, 16 nt, Pseudomonas aeruginosa PA01
gcgccggcggcgcguc

SEQ ID NO: 1461378 - RNA, 18 nt, Pseudomonas aeruginosa PA01
gcgccggcggcgcgucca

SEQ ID NO: 1461379 - RNA, 18 nt, Pseudomonas aeruginosa PA01
gcgccggcggugcggaag

SEQ ID NO: 1461380 - RNA, 16 nt, Pseudomonas aeruginosa PA01
gcgccggcucgcccag

SEQ ID NO: 1461381 - RNA, 21 nt, Pseudomonas aeruginosa PA01
gcgccggcucgcccagcaggc

SEQ ID NO: 1461382 - RNA, 16 nt, Pseudomonas aeruginosa PA01
gcgccggcucgugcga

SEQ ID NO: 1461383 - RNA, 15 nt, Pseudomonas aeruginosa PA01
gcgccggcugccgcg

SEQ ID NO: 1461384 - RNA, 16 nt, Pseudomonas aeruginosa PA01
gcgccggcuuggcuca

SEQ ID NO: 1461385 - RNA, 12 nt, Pseudomonas aeruginosa PA01
gcgccgggauca

SEQ ID NO: 1461386 - RNA, 18 nt, Pseudomonas aeruginosa PA01
gcgccgggcucagcgcgc

SEQ ID NO: 1461387 - RNA, 15 nt, Pseudomonas aeruginosa PA01
gcgccgggcugccga

SEQ ID NO: 1461388 - RNA, 17 nt, Pseudomonas aeruginosa PA01
gcgccgggcugccgaac

SEQ ID NO: 1461389 - RNA, 15 nt, Pseudomonas aeruginosa PA01
gcgccgggcuggccg

SEQ ID NO: 1461390 - RNA, 17 nt, Pseudomonas aeruginosa PA01
gcgccgggcuggccguc

SEQ ID NO: 1461391 - RNA, 18 nt, Pseudomonas aeruginosa PA01
gcgccgggcuggccgucg

SEQ ID NO: 1461392 - RNA, 17 nt, Pseudomonas aeruginosa PA01
gcgccgggccucggcaa

SEQ ID NO: 1461393 - RNA, 16 nt, Pseudomonas aeruginosa PA01
gcgccggggaucaggu

SEQ ID NO: 1461394 - RNA, 19 nt, Pseudomonas aeruginosa PA01
gcgccggggaucaggucgc

SEQ ID NO: 1461395 - RNA, 22 nt, Pseudomonas aeruginosa PA01
gcgccggggaucaggucgccgc

SEQ ID NO: 1461396 - RNA, 20 nt, Pseudomonas aeruginosa PA01
gcgccggggcagcagggcgu

SEQ ID NO: 1461397 - RNA, 14 nt, Pseudomonas aeruginosa PA01
gcgccgggucagac

SEQ ID NO: 1461398 - RNA, 14 nt, Pseudomonas aeruginosa PA01
gcgccgggugaccg

SEQ ID NO: 1461399 - RNA, 19 nt, Pseudomonas aeruginosa PA01
gcgccgggucgacaugcag

SEQ ID NO: 1461400 - RNA, 15 nt, Pseudomonas aeruginosa PA01
gcgccgggucgaccu

SEQ ID NO: 1461401 - RNA, 18 nt, Pseudomonas aeruginosa PA01
gcgccgggucgaugggcc

SEQ ID NO: 1461402 - RNA, 17 nt, Pseudomonas aeruginosa PA01
gcgccgguagcggcgca

SEQ ID NO: 1461403 - RNA, 19 nt, Pseudomonas aeruginosa PA01
gcgccgguagcggcgcacc

SEQ ID NO: 1461404 - RNA, 15 nt, Pseudomonas aeruginosa PA01
gcgccgggugccggu

SEQ ID NO: 1461405 - RNA, 16 nt, Pseudomonas aeruginosa PA01
gcgccgggugccggug

SEQ ID NO: 1461406 - RNA, 15 nt, Pseudomonas aeruginosa PA01
gcgccgguaguucgc

SEQ ID NO: 1461407 - RNA, 15 nt, Pseudomonas aeruginosa PA01
gcgccgucgaucagg

SEQ ID NO: 1461408 - RNA, 14 nt, Pseudomonas aeruginosa PA01
gcgccgucgcgacc

SEQ ID NO: 1461409 - RNA, 21 nt, Pseudomonas aeruginosa PA01
gcgccgucgcgaccuucggug

SEQ ID NO: 1461410 - RNA, 18 nt, Pseudomonas aeruginosa PA01
gcgccgucgcuggcgaug

SEQ ID NO: 1461411 - RNA, 16 nt, Pseudomonas aeruginosa PA01
gcgccggugcuggcga

SEQ ID NO: 1461412 - RNA, 16 nt, Pseudomonas aeruginosa PA01
gcgccggugaggcgca

SEQ ID NO: 1461413 - RNA, 17 nt, Pseudomonas aeruginosa PA01
gcgccggugaggcgcag

SEQ ID NO: 1461414 - RNA, 20 nt, Pseudomonas aeruginosa PA01
gcgccggugaucgagccgcc

SEQ ID NO: 1461415 - RNA, 21 nt, Pseudomonas aeruginosa PA01
gcgccggugaucgagccgccg

SEQ ID NO: 1461416 - RNA, 14 nt, Pseudomonas aeruginosa PA01
gcgccgguggccag

SEQ ID NO: 1461417 - RNA, 15 nt, Pseudomonas aeruginosa PA01
gcgccgguggccagg

SEQ ID NO: 1461418 - RNA, 22 nt, Pseudomonas aeruginosa PA01
gcgccgguggcguacccgcccu

SEQ ID NO: 1461419 - RNA, 22 nt, Pseudomonas aeruginosa PA01
gcgccgguugcgucucagcggu

SEQ ID NO: 1461420 - RNA, 16 nt, Pseudomonas aeruginosa PA01
gcgccgguugcugcug

SEQ ID NO: 1461421 - RNA, 18 nt, Pseudomonas aeruginosa PA01
gcgccgucaccagcagcc

SEQ ID NO: 1461422 - RNA, 20 nt, Pseudomonas aeruginosa PA01
gcgccgucaccagcagcccc

SEQ ID NO: 1461423 - RNA, 18 nt, Pseudomonas aeruginosa PA01
gcgccaaggccgccaggc

SEQ ID NO: 1461424 - RNA, 20 nt, Pseudomonas aeruginosa PA01
gcgccaaggccgccaggccu

SEQ ID NO: 1461425 - RNA, 19 nt, Pseudomonas aeruginosa PA01
gcgccaagguuccagcccc

SEQ ID NO: 1461426 - RNA, 21 nt, Pseudomonas aeruginosa PA01
gcgccaagguuccagccccgc

SEQ ID NO: 1461427 - RNA, 15 nt, Pseudomonas aeruginosa PA01
gcgccacccucggcu

SEQ ID NO: 1461428 - RNA, 14 nt, Pseudomonas aeruginosa PA01
gcgccaccagcgug

SEQ ID NO: 1461429 - RNA, 17 nt, Pseudomonas aeruginosa PA01
gcgccaccagcguggcg

SEQ ID NO: 1461430 - RNA, 21 nt, Pseudomonas aeruginosa PA01
gcgccaccagcguggcgcgca

SEQ ID NO: 1461431 - RNA, 20 nt, Pseudomonas aeruginosa PA01
gcgccaccagcagggccagg

SEQ ID NO: 1461432 - RNA, 21 nt, Pseudomonas aeruginosa PA01
gcgccaccagcagggccaggc

SEQ ID NO: 1461433 - RNA, 20 nt, Pseudomonas aeruginosa PA01
gcgccaccagcaugcccagc

SEQ ID NO: 1461434 - RNA, 23 nt, Pseudomonas aeruginosa PA01
gcgccaaugccuuccgacgccgc

SEQ ID NO: 1461435 - RNA, 15 nt, Pseudomonas aeruginosa PA01
gcgcauggagacggc

SEQ ID NO: 1461436 - RNA, 21 nt, Pseudomonas aeruginosa PA01
gcgcaugcugggucuccgcuc

SEQ ID NO: 1461437 - RNA, 16 nt, Pseudomonas aeruginosa PA01
gcgcaugcgccggcuu

SEQ ID NO: 1461438 - RNA, 18 nt, Pseudomonas aeruginosa PA01
gcgcaugcccagggccag

SEQ ID NO: 1461439 - RNA, 13 nt, Pseudomonas aeruginosa PA01
gcgcaugcggaag

SEQ ID NO: 1461440 - RNA, 16 nt, Pseudomonas aeruginosa PA01
gcgcauggucgcgcug

SEQ ID NO: 1461441 - RNA, 13 nt, Pseudomonas aeruginosa PA01
gcgcauggcgcuc

SEQ ID NO: 1461442 - RNA, 21 nt, Pseudomonas aeruginosa PA01
gcgcauggcgcucuucaccgu

SEQ ID NO: 1461443 - RNA, 12 nt, Pseudomonas aeruginosa PA01
gcgcauggcggc

SEQ ID NO: 1461444 - RNA, 13 nt, Pseudomonas aeruginosa PA01
gcgcauggcggcg

SEQ ID NO: 1461445 - RNA, 14 nt, Pseudomonas aeruginosa PA01
gcgcauggcggcga

SEQ ID NO: 1461446 - RNA, 18 nt, Pseudomonas aeruginosa PA01
gcgcauggcggcgaccgc

SEQ ID NO: 1461447 - RNA, 14 nt, Pseudomonas aeruginosa PA01
gcgcaugucgcgau

SEQ ID NO: 1461448 - RNA, 18 nt, Pseudomonas aeruginosa PA01
gcgcaugucgcgauugga

SEQ ID NO: 1461449 - RNA, 13 nt, Pseudomonas aeruginosa PA01
gcgcaugucgucc

SEQ ID NO: 1461450 - RNA, 19 nt, Pseudomonas aeruginosa PA01
gcgcaugucguccaggcug

SEQ ID NO: 1461451 - RNA, 19 nt, Pseudomonas aeruginosa PA01
gcgcauggcguucugcgac

SEQ ID NO: 1461452 - RNA, 14 nt, Pseudomonas aeruginosa PA01
gcgcauggcgaccu

SEQ ID NO: 1461453 - RNA, 20 nt, Pseudomonas aeruginosa PA01
gcgcaugguuaccucguugc

SEQ ID NO: 1461454 - RNA, 15 nt, Pseudomonas aeruginosa PA01
gcgcauguccagcca

SEQ ID NO: 1461455 - RNA, 22 nt, Pseudomonas aeruginosa PA01
gcgcaccagcaggcgcaaccag

SEQ ID NO: 1461456 - RNA, 13 nt, Pseudomonas aeruginosa PA01
gcgcaccaggcca

SEQ ID NO: 1461457 - RNA, 14 nt, Pseudomonas aeruginosa PA01
gcgcaccaggccag

SEQ ID NO: 1461458 - RNA, 16 nt, Pseudomonas aeruginosa PA01
gcgcaccaggccaggc

SEQ ID NO: 1461459 - RNA, 17 nt, Pseudomonas aeruginosa PA01
gcgcaccaggccaggcu

SEQ ID NO: 1461460 - RNA, 13 nt, Pseudomonas aeruginosa PA01
gcgcaccagcggg

SEQ ID NO: 1461461 - RNA, 16 nt, Pseudomonas aeruginosa PA01
gcgcaccagcgggucg

SEQ ID NO: 1461462 - RNA, 12 nt, Pseudomonas aeruginosa PA01
gcgcaccacugc

SEQ ID NO: 1461463 - RNA, 14 nt, Pseudomonas aeruginosa PA01
gcgcaccaggucgc

SEQ ID NO: 1461464 - RNA, 21 nt, Pseudomonas aeruginosa PA01
gcgcaugaaaaagccgcccac

SEQ ID NO: 1461465 - RNA, 15 nt, Pseudomonas aeruginosa PA01
gcgcaccagggccag

SEQ ID NO: 1461466 - RNA, 16 nt, Pseudomonas aeruginosa PA01
gcgcaccagggccagg

SEQ ID NO: 1461467 - RNA, 23 nt, Pseudomonas aeruginosa PA01
gcgcaccagggucgggccgcgcu

SEQ ID NO: 1461468 - RNA, 15 nt, Pseudomonas aeruginosa PA01
gcgcaugaucgccuc

SEQ ID NO: 1461469 - RNA, 21 nt, Pseudomonas aeruginosa PA01
gcgcaugaucgccucggcgcg

SEQ ID NO: 1461470 - RNA, 19 nt, Pseudomonas aeruginosa PA01
gcgcaugaggcuggccagc

SEQ ID NO: 1461471 - RNA, 15 nt, Pseudomonas aeruginosa PA01
gcgccaccgauagcg

SEQ ID NO: 1461472 - RNA, 21 nt, Pseudomonas aeruginosa PA01
gcgccaccgauagcggcgcga

SEQ ID NO: 1461473 - RNA, 22 nt, Pseudomonas aeruginosa PA01
gcgccaccgauagcggcgcgag

SEQ ID NO: 1461474 - RNA, 21 nt, Pseudomonas aeruginosa PA01
gcgccaccgauucgccggcca

SEQ ID NO: 1461475 - RNA, 19 nt, Pseudomonas aeruginosa PA01
gcgccaccgcgacgcgcug

SEQ ID NO: 1461476 - RNA, 17 nt, Pseudomonas aeruginosa PA01
gcgccaccugguucauc

SEQ ID NO: 1461477 - RNA, 15 nt, Pseudomonas aeruginosa PA01
gcgccagcggcagcg

SEQ ID NO: 1461478 - RNA, 19 nt, Pseudomonas aeruginosa PA01
gcgccagcggcagcgguuc

SEQ ID NO: 1461479 - RNA, 13 nt, Pseudomonas aeruginosa PA01
gcgccagcggccc

SEQ ID NO: 1461480 - RNA, 17 nt, Pseudomonas aeruginosa PA01
gcgccagcggcccggca

SEQ ID NO: 1461481 - RNA, 23 nt, Pseudomonas aeruginosa PA01
gcgccagcaucgcaucggcgacc

SEQ ID NO: 1461482 - RNA, 19 nt, Pseudomonas aeruginosa PA01
gcgccacgccgcugucguc

SEQ ID NO: 1461483 - RNA, 14 nt, Pseudomonas aeruginosa PA01
gcgccagcaggcga

SEQ ID NO: 1461484 - RNA, 15 nt, Pseudomonas aeruginosa PA01
gcgccagcaggcgau

SEQ ID NO: 1461485 - RNA, 16 nt, Pseudomonas aeruginosa PA01
gcgccagcaggcgcag

SEQ ID NO: 1461486 - RNA, 17 nt, Pseudomonas aeruginosa PA01
gcgccagcaggcgcagc

SEQ ID NO: 1461487 - RNA, 19 nt, Pseudomonas aeruginosa PA01
gcgccagcaggucgcgcug

SEQ ID NO: 1461488 - RNA, 17 nt, Pseudomonas aeruginosa PA01
gcgccagcagguggucg

SEQ ID NO: 1461489 - RNA, 21 nt, Pseudomonas aeruginosa PA01
gcgccagcagguggucgaugg

SEQ ID NO: 1461490 - RNA, 15 nt, Pseudomonas aeruginosa PA01
gcgccagccagcgcg

SEQ ID NO: 1461491 - RNA, 17 nt, Pseudomonas aeruginosa PA01
gcgccagccagcgcggc

SEQ ID NO: 1461492 - RNA, 19 nt, Pseudomonas aeruginosa PA01
gcgccagccagcgcggcuc

SEQ ID NO: 1461493 - RNA, 21 nt, Pseudomonas aeruginosa PA01
gcgccagccagcgcggcucgg

SEQ ID NO: 1461494 - RNA, 22 nt, Pseudomonas aeruginosa PA01
gcgccagccaggaagagcccgc

SEQ ID NO: 1461495 - RNA, 18 nt, Pseudomonas aeruginosa PA01
gcgccagggguaggagga

SEQ ID NO: 1461496 - RNA, 13 nt, Pseudomonas aeruginosa PA01
gcgccagguagcc

SEQ ID NO: 1461497 - RNA, 20 nt, Pseudomonas aeruginosa PA01
gcgccagguaguccagcggu

SEQ ID NO: 1461498 - RNA, 20 nt, Pseudomonas aeruginosa PA01
gcgccagguagugccgcccu

SEQ ID NO: 1461499 - RNA, 22 nt, Pseudomonas aeruginosa PA01
gcgccagguagugccgcccuug

SEQ ID NO: 1461500 - RNA, 18 nt, Pseudomonas aeruginosa PA01
gcgccagguuggccuggc

SEQ ID NO: 1461501 - RNA, 17 nt, Pseudomonas aeruginosa PA01
gcgccauaggccagcac

SEQ ID NO: 1461502 - RNA, 22 nt, Pseudomonas aeruginosa PA01
gcgccaggugcaggaagcgccg

SEQ ID NO: 1461503 - RNA, 24 nt, Pseudomonas aeruginosa PA01
gcgccaggugcaggaagcgccggg

SEQ ID NO: 1461504 - RNA, 15 nt, Pseudomonas aeruginosa PA01
gcgccaucaggcccu

SEQ ID NO: 1461505 - RNA, 15 nt, Pseudomonas aeruginosa PA01
gcgccaucagcgacc

SEQ ID NO: 1461506 - RNA, 21 nt, Pseudomonas aeruginosa PA01
gcgccaucgaucagcagcgcc

SEQ ID NO: 1461507 - RNA, 22 nt, Pseudomonas aeruginosa PA01
gcgccaucgaucagcagcgcca

SEQ ID NO: 1461508 - RNA, 23 nt, Pseudomonas aeruginosa PA01
gcgccaucgaucagcagcgccac

SEQ ID NO: 1461509 - RNA, 15 nt, Pseudomonas aeruginosa PA01
gcgccauccuccagc

SEQ ID NO: 1461510 - RNA, 16 nt, Pseudomonas aeruginosa PA01
gcgccauccuccagcg

SEQ ID NO: 1461511 - RNA, 19 nt, Pseudomonas aeruginosa PA01
gcgccauccuccagcgccg

SEQ ID NO: 1461512 - RNA, 20 nt, Pseudomonas aeruginosa PA01
gcgccauccuccagcgccgc

SEQ ID NO: 1461513 - RNA, 19 nt, Pseudomonas aeruginosa PA01
gcgccaggcggaacggcuc

SEQ ID NO: 1461514 - RNA, 12 nt, Pseudomonas aeruginosa PA01
gcgccaggcgca

SEQ ID NO: 1461515 - RNA, 13 nt, Pseudomonas aeruginosa PA01
gcgccaggcgcag

SEQ ID NO: 1461516 - RNA, 22 nt, Pseudomonas aeruginosa PA01
gcgccaggccuugcagcaacuc

SEQ ID NO: 1461517 - RNA, 14 nt, Pseudomonas aeruginosa PA01
gcgccaggcguucc

SEQ ID NO: 1461518 - RNA, 14 nt, Pseudomonas aeruginosa PA01
gcgccagggccggg

SEQ ID NO: 1461519 - RNA, 18 nt, Pseudomonas aeruginosa PA01
gcgccagggacgcgcagc

SEQ ID NO: 1461520 - RNA, 19 nt, Pseudomonas aeruginosa PA01
gcgccagggacgcgcagcg

SEQ ID NO: 1461521 - RNA, 20 nt, Pseudomonas aeruginosa PA01
gcgccagcucgaacagcacc

SEQ ID NO: 1461522 - RNA, 20 nt, Pseudomonas aeruginosa PA01
gcgccagcucggacaagggc

SEQ ID NO: 1461523 - RNA, 17 nt, Pseudomonas aeruginosa PA01
gcgccagcuccagcgcc

SEQ ID NO: 1461524 - RNA, 12 nt, Pseudomonas aeruginosa PA01
gcgcccggucag

SEQ ID NO: 1461525 - RNA, 18 nt, Pseudomonas aeruginosa PA01
gcgcccggcuggccaucc

SEQ ID NO: 1461526 - RNA, 21 nt, Pseudomonas aeruginosa PA01
gcgcccggcuucggcggcgcg

SEQ ID NO: 1461527 - RNA, 18 nt, Pseudomonas aeruginosa PA01
gcgcccgucgucguggcg

SEQ ID NO: 1461528 - RNA, 22 nt, Pseudomonas aeruginosa PA01
gcgcccgucgucguggcgaacc

SEQ ID NO: 1461529 - RNA, 23 nt, Pseudomonas aeruginosa PA01
gcgcccgucgucguggcgaacca

SEQ ID NO: 1461530 - RNA, 14 nt, Pseudomonas aeruginosa PA01
gcgcccucugccgg

SEQ ID NO: 1461531 - RNA, 16 nt, Pseudomonas aeruginosa PA01
gcgcccugcaggccga

SEQ ID NO: 1461532 - RNA, 18 nt, Pseudomonas aeruginosa PA01
gcgcccugcaggccgaau

SEQ ID NO: 1461533 - RNA, 14 nt, Pseudomonas aeruginosa PA01
gcgcccuggccguc

SEQ ID NO: 1461534 - RNA, 15 nt, Pseudomonas aeruginosa PA01
gcgcccuggccgucg

SEQ ID NO: 1461535 - RNA, 20 nt, Pseudomonas aeruginosa PA01
gcgcccuacgccaccugagc

SEQ ID NO: 1461536 - RNA, 21 nt, Pseudomonas aeruginosa PA01
gcgcccgugggguauuccagg

SEQ ID NO: 1461537 - RNA, 17 nt, Pseudomonas aeruginosa PA01
gcgcccucgcugagcag

SEQ ID NO: 1461538 - RNA, 13 nt, Pseudomonas aeruginosa PA01
gcgcccggcgcau

SEQ ID NO: 1461539 - RNA, 13 nt, Pseudomonas aeruginosa PA01
gcgcccggcgcca

SEQ ID NO: 1461540 - RNA, 16 nt, Pseudomonas aeruginosa PA01
gcgcccggcgccaccc

SEQ ID NO: 1461541 - RNA, 19 nt, Pseudomonas aeruginosa PA01
gcgcccggcgccaccccgc

SEQ ID NO: 1461542 - RNA, 14 nt, Pseudomonas aeruginosa PA01
gcgcccggcgccag

SEQ ID NO: 1461543 - RNA, 13 nt, Pseudomonas aeruginosa PA01
gcgcccggcgcga

SEQ ID NO: 1461544 - RNA, 15 nt, Pseudomonas aeruginosa PA01
gcgcccggcgcgacc

SEQ ID NO: 1461545 - RNA, 13 nt, Pseudomonas aeruginosa PA01
gcgcccggccagg

SEQ ID NO: 1461546 - RNA, 17 nt, Pseudomonas aeruginosa PA01
gcgcccggccaggccgc

SEQ ID NO: 1461547 - RNA, 20 nt, Pseudomonas aeruginosa PA01
gcgcccgccgcgagcgccgc

SEQ ID NO: 1461548 - RNA, 14 nt, Pseudomonas aeruginosa PA01
gcgcccgcccggca

SEQ ID NO: 1461549 - RNA, 13 nt, Pseudomonas aeruginosa PA01
gcgcccgccguca

SEQ ID NO: 1461550 - RNA, 15 nt, Pseudomonas aeruginosa PA01
gcgcccgccggccgu

SEQ ID NO: 1461551 - RNA, 13 nt, Pseudomonas aeruginosa PA01
gcgcccccuggcc

SEQ ID NO: 1461552 - RNA, 14 nt, Pseudomonas aeruginosa PA01
gcgcccccuggccg

SEQ ID NO: 1461553 - RNA, 15 nt, Pseudomonas aeruginosa PA01
gcgcccccuggccgu

SEQ ID NO: 1461554 - RNA, 14 nt, Pseudomonas aeruginosa PA01
gcgccccgggacca

SEQ ID NO: 1461555 - RNA, 14 nt, Pseudomonas aeruginosa PA01
gcgccccgggucgg

SEQ ID NO: 1461556 - RNA, 13 nt, Pseudomonas aeruginosa PA01
gcgccccggccgc

SEQ ID NO: 1461557 - RNA, 21 nt, Pseudomonas aeruginosa PA01
gcgccccggccgcgccagcca

SEQ ID NO: 1461558 - RNA, 12 nt, Pseudomonas aeruginosa PA01
gcgccccggccc

SEQ ID NO: 1461559 - RNA, 14 nt, Pseudomonas aeruginosa PA01
gcgccccggcccag

SEQ ID NO: 1461560 - RNA, 17 nt, Pseudomonas aeruginosa PA01
gcgccccggcccagccg

SEQ ID NO: 1461561 - RNA, 17 nt, Pseudomonas aeruginosa PA01
gcgccccucccagccac

SEQ ID NO: 1461562 - RNA, 18 nt, Pseudomonas aeruginosa PA01
gcgccccugcggcgccgg

SEQ ID NO: 1461563 - RNA, 18 nt, Pseudomonas aeruginosa PA01
gcgccccggucucgcgca

SEQ ID NO: 1461564 - RNA, 22 nt, Pseudomonas aeruginosa PA01
gcgccccgucccuaccagcgca

SEQ ID NO: 1461565 - RNA, 20 nt, Pseudomonas aeruginosa PA01
gcgcccgcccggaaccaccg

SEQ ID NO: 1461566 - RNA, 16 nt, Pseudomonas aeruginosa PA01
gcgccauggccgcuga

SEQ ID NO: 1461567 - RNA, 20 nt, Pseudomonas aeruginosa PA01
gcgccaugcuguugccgugg

SEQ ID NO: 1461568 - RNA, 13 nt, Pseudomonas aeruginosa PA01
gcgccaugccggc

SEQ ID NO: 1461569 - RNA, 15 nt, Pseudomonas aeruginosa PA01
gcgccaugccggcgc

SEQ ID NO: 1461570 - RNA, 17 nt, Pseudomonas aeruginosa PA01
gcgccaugccggcgccg

SEQ ID NO: 1461571 - RNA, 18 nt, Pseudomonas aeruginosa PA01
gcgccaugccggcgccga

SEQ ID NO: 1461572 - RNA, 19 nt, Pseudomonas aeruginosa PA01
gcgccaugccggcgccgau

SEQ ID NO: 1461573 - RNA, 19 nt, Pseudomonas aeruginosa PA01
gcgccaugccguucaggcc

SEQ ID NO: 1461574 - RNA, 22 nt, Pseudomonas aeruginosa PA01
gcgccaugccguucaggccggc

SEQ ID NO: 1461575 - RNA, 22 nt, Pseudomonas aeruginosa PA01
gcgccaugcaagaacgccgacc

SEQ ID NO: 1461576 - RNA, 17 nt, Pseudomonas aeruginosa PA01
gcgccaugacccgcggc

SEQ ID NO: 1461577 - RNA, 18 nt, Pseudomonas aeruginosa PA01
gcgccaugacccgcggca

SEQ ID NO: 1461578 - RNA, 22 nt, Pseudomonas aeruginosa PA01
gcgccaucgcuuuccuggccga

SEQ ID NO: 1461579 - RNA, 23 nt, Pseudomonas aeruginosa PA01
gcgccaucgcuuuccuggccgac

SEQ ID NO: 1461580 - RNA, 14 nt, Pseudomonas aeruginosa PA01
gcgccaucggcggu

SEQ ID NO: 1461581 - RNA, 15 nt, Pseudomonas aeruginosa PA01
gcgccaucuccucgc

SEQ ID NO: 1461582 - RNA, 19 nt, Pseudomonas aeruginosa PA01
gcgccaucuccucgcugau

SEQ ID NO: 1461583 - RNA, 23 nt, Pseudomonas aeruginosa PA01
gcgccgcaacgaaaaagggcggc

SEQ ID NO: 1461584 - RNA, 17 nt, Pseudomonas aeruginosa PA01
gcgccgcaaguggcggc

SEQ ID NO: 1461585 - RNA, 18 nt, Pseudomonas aeruginosa PA01
gcgccgcaaguggcggcu

SEQ ID NO: 1461586 - RNA, 13 nt, Pseudomonas aeruginosa PA01
gcgccgcagcgca

SEQ ID NO: 1461587 - RNA, 14 nt, Pseudomonas aeruginosa PA01
gcgccgcagcggcc

SEQ ID NO: 1461588 - RNA, 15 nt, Pseudomonas aeruginosa PA01
gcgccgcagcggcca

SEQ ID NO: 1461589 - RNA, 12 nt, Pseudomonas aeruginosa PA01
gcgccgccaccg

SEQ ID NO: 1461590 - RNA, 15 nt, Pseudomonas aeruginosa PA01
gcgccgccaggcccu

SEQ ID NO: 1461591 - RNA, 22 nt, Pseudomonas aeruginosa PA01
gcgccgccaggcccugggcggc

SEQ ID NO: 1461592 - RNA, 19 nt, Pseudomonas aeruginosa PA01
gcgccgccaguucgcgcag

SEQ ID NO: 1461593 - RNA, 23 nt, Pseudomonas aeruginosa PA01
gcgccgccaguucgcgcaggugc

SEQ ID NO: 1461594 - RNA, 15 nt, Pseudomonas aeruginosa PA01
gcgccgccaggcgcg

SEQ ID NO: 1461595 - RNA, 17 nt, Pseudomonas aeruginosa PA01
gcgccgccaggcgcguc

SEQ ID NO: 1461596 - RNA, 23 nt, Pseudomonas aeruginosa PA01
gcgccgccaggcgcgucuccagc

SEQ ID NO: 1461597 - RNA, 13 nt, Pseudomonas aeruginosa PA01
gcgccgccaggcg

SEQ ID NO: 1461598 - RNA, 21 nt, Pseudomonas aeruginosa PA01
gcgccgccaggcagaccaggc

SEQ ID NO: 1461599 - RNA, 22 nt, Pseudomonas aeruginosa PA01
gcgccgccaggcagaccaggcc

SEQ ID NO: 1461600 - RNA, 19 nt, Pseudomonas aeruginosa PA01
gcgccgccaggcaggccgg

SEQ ID NO: 1461601 - RNA, 14 nt, Pseudomonas aeruginosa PA01
gcgccgccaggccc

SEQ ID NO: 1461602 - RNA, 14 nt, Pseudomonas aeruginosa PA01
gcgccgccacgugc

SEQ ID NO: 1461603 - RNA, 20 nt, Pseudomonas aeruginosa PA01
gcgccgccacgugcacgccg

SEQ ID NO: 1461604 - RNA, 14 nt, Pseudomonas aeruginosa PA01
gcgccgccaggcag

SEQ ID NO: 1461605 - RNA, 13 nt, Pseudomonas aeruginosa PA01
gcgccgccagcag

SEQ ID NO: 1461606 - RNA, 15 nt, Pseudomonas aeruginosa PA01
gcgccgccagcagga

SEQ ID NO: 1461607 - RNA, 15 nt, Pseudomonas aeruginosa PA01
gcgccgccagcaggu

SEQ ID NO: 1461608 - RNA, 13 nt, Pseudomonas aeruginosa PA01
gcgccgccagcca

SEQ ID NO: 1461609 - RNA, 14 nt, Pseudomonas aeruginosa PA01
gcgccgccagccag

SEQ ID NO: 1461610 - RNA, 22 nt, Pseudomonas aeruginosa PA01
gcgccgccagccagagcagcgu

SEQ ID NO: 1461611 - RNA, 13 nt, Pseudomonas aeruginosa PA01
gcgccgaccucca

SEQ ID NO: 1461612 - RNA, 16 nt, Pseudomonas aeruginosa PA01
gcgccgaacagggcga

SEQ ID NO: 1461613 - RNA, 21 nt, Pseudomonas aeruginosa PA01
gcgccgaacaggguugggcga

SEQ ID NO: 1461614 - RNA, 17 nt, Pseudomonas aeruginosa PA01
gcgcccuucagcgccuc

SEQ ID NO: 1461615 - RNA, 14 nt, Pseudomonas aeruginosa PA01
gcgcccuucgagaa

SEQ ID NO: 1461616 - RNA, 20 nt, Pseudomonas aeruginosa PA01
gcgcccuggcucuugccgcg

SEQ ID NO: 1461617 - RNA, 21 nt, Pseudomonas aeruginosa PA01
gcgcccuggcucuugccgcga

SEQ ID NO: 1461618 - RNA, 15 nt, Pseudomonas aeruginosa PA01
gcgcccuugacccgg

SEQ ID NO: 1461619 - RNA, 21 nt, Pseudomonas aeruginosa PA01
gcgcccuucgguuucgcgcca

SEQ ID NO: 1461620 - RNA, 16 nt, Pseudomonas aeruginosa PA01
gcgccgacgccaccag

SEQ ID NO: 1461621 - RNA, 19 nt, Pseudomonas aeruginosa PA01
gcgccgacgccaccagcca

SEQ ID NO: 1461622 - RNA, 23 nt, Pseudomonas aeruginosa PA01
gcgccgacgccaccagccaggcg

SEQ ID NO: 1461623 - RNA, 18 nt, Pseudomonas aeruginosa PA01
gcgccgaggucuuggcca

SEQ ID NO: 1461624 - RNA, 20 nt, Pseudomonas aeruginosa PA01
gcgccgaggucuuggccagc

SEQ ID NO: 1461625 - RNA, 21 nt, Pseudomonas aeruginosa PA01
gcgccgaggucuuggccagcc

SEQ ID NO: 1461626 - RNA, 22 nt, Pseudomonas aeruginosa PA01
gcgccgaggucuuggccagccg

SEQ ID NO: 1461627 - RNA, 22 nt, Pseudomonas aeruginosa PA01
gcgccgaucaaugcguuccugu

SEQ ID NO: 1461628 - RNA, 14 nt, Pseudomonas aeruginosa PA01
gcgccgauccaggc

SEQ ID NO: 1461629 - RNA, 22 nt, Pseudomonas aeruginosa PA01
gcgccgauccaggcguggggcg

SEQ ID NO: 1461630 - RNA, 23 nt, Pseudomonas aeruginosa PA01
gcgccgauccaggcguggggcga

SEQ ID NO: 1461631 - RNA, 17 nt, Pseudomonas aeruginosa PA01
gcgccgaguucgccgcg

SEQ ID NO: 1461632 - RNA, 18 nt, Pseudomonas aeruginosa PA01
gcgccgaguucgccgcga

SEQ ID NO: 1461633 - RNA, 16 nt, Pseudomonas aeruginosa PA01
gcgccgaguuggccca

SEQ ID NO: 1461634 - RNA, 19 nt, Pseudomonas aeruginosa PA01
gcgcccuuguacucgaugg

SEQ ID NO: 1461635 - RNA, 20 nt, Pseudomonas aeruginosa PA01
gcggaacggcucgcgaccga

SEQ ID NO: 1461636 - RNA, 18 nt, Pseudomonas aeruginosa PA01
gcggaacggcucgcgggu

SEQ ID NO: 1461637 - RNA, 22 nt, Pseudomonas aeruginosa PA01
gcggaacucauucaucucgccg

SEQ ID NO: 1461638 - RNA, 18 nt, Pseudomonas aeruginosa PA01
gcggaacuugucgccgcu

SEQ ID NO: 1461639 - RNA, 21 nt, Pseudomonas aeruginosa PA01
gcggaacuugucgccgcugga

SEQ ID NO: 1461640 - RNA, 22 nt, Pseudomonas aeruginosa PA01
gcggaagccgucggcgaucgcc

SEQ ID NO: 1461641 - RNA, 17 nt, Pseudomonas aeruginosa PA01
gcggaagccgugcaacu

SEQ ID NO: 1461642 - RNA, 20 nt, Pseudomonas aeruginosa PA01
gcggaagcacggcucggcga

SEQ ID NO: 1461643 - RNA, 14 nt, Pseudomonas aeruginosa PA01
gcggaagcagccau

SEQ ID NO: 1461644 - RNA, 19 nt, Pseudomonas aeruginosa PA01
gcggaagcguugcucgagc

SEQ ID NO: 1461645 - RNA, 17 nt, Pseudomonas aeruginosa PA01
gcggaagcgccugcggu

SEQ ID NO: 1461646 - RNA, 23 nt, Pseudomonas aeruginosa PA01
gcggaauacguacucgucgcucu

SEQ ID NO: 1461647 - RNA, 22 nt, Pseudomonas aeruginosa PA01
gcggaauccuucgcggcggcgc

SEQ ID NO: 1461648 - RNA, 15 nt, Pseudomonas aeruginosa PA01
gcggaagucggcggg

SEQ ID NO: 1461649 - RNA, 14 nt, Pseudomonas aeruginosa PA01
gcggaagugcgccg

SEQ ID NO: 1461650 - RNA, 15 nt, Pseudomonas aeruginosa PA01
gcggaagugcgccgg

SEQ ID NO: 1461651 - RNA, 14 nt, Pseudomonas aeruginosa PA01
gcggaaggccucgg

SEQ ID NO: 1461652 - RNA, 14 nt, Pseudomonas aeruginosa PA01
gcggaaggcuuccu

SEQ ID NO: 1461653 - RNA, 16 nt, Pseudomonas aeruginosa PA01
gcggaaggcuuccugg

SEQ ID NO: 1461654 - RNA, 22 nt, Pseudomonas aeruginosa PA01
gcggaaggucagguagguggag

SEQ ID NO: 1461655 - RNA, 15 nt, Pseudomonas aeruginosa PA01
gcgcugggcggcugg

SEQ ID NO: 1461656 - RNA, 20 nt, Pseudomonas aeruginosa PA01
gcgcugggccuugagcaggc

SEQ ID NO: 1461657 - RNA, 22 nt, Pseudomonas aeruginosa PA01
gcgcugggcgagguguucccgg

SEQ ID NO: 1461658 - RNA, 15 nt, Pseudomonas aeruginosa PA01
gcgcugggcgcagcc

SEQ ID NO: 1461659 - RNA, 21 nt, Pseudomonas aeruginosa PA01
gcggaaccucuccccucgccc

SEQ ID NO: 1461660 - RNA, 15 nt, Pseudomonas aeruginosa PA01
gcggaacaucgcccg

SEQ ID NO: 1461661 - RNA, 17 nt, Pseudomonas aeruginosa PA01
gcggaacaucgcccggc

SEQ ID NO: 1461662 - RNA, 19 nt, Pseudomonas aeruginosa PA01
gcggaaccagugcgcgguc

SEQ ID NO: 1461663 - RNA, 22 nt, Pseudomonas aeruginosa PA01
gcggaaccagugcgcgguccgc

SEQ ID NO: 1461664 - RNA, 22 nt, Pseudomonas aeruginosa PA01
gcggaccucugcguucugcugc

SEQ ID NO: 1461665 - RNA, 18 nt, Pseudomonas aeruginosa PA01
gcggaccuccagccggcc

SEQ ID NO: 1461666 - RNA, 19 nt, Pseudomonas aeruginosa PA01
gcggaccuccagccggcca

SEQ ID NO: 1461667 - RNA, 12 nt, Pseudomonas aeruginosa PA01
gcggaccuccgc

SEQ ID NO: 1461668 - RNA, 17 nt, Pseudomonas aeruginosa PA01
gcggaccuccgccaggu

SEQ ID NO: 1461669 - RNA, 21 nt, Pseudomonas aeruginosa PA01
gcggacgacgaagugaccgcg

SEQ ID NO: 1461670 - RNA, 16 nt, Pseudomonas aeruginosa PA01
gcggaccuucgacggc

SEQ ID NO: 1461671 - RNA, 17 nt, Pseudomonas aeruginosa PA01
gcggaccuucgacggca

SEQ ID NO: 1461672 - RNA, 18 nt, Pseudomonas aeruginosa PA01
gcggaccuucgacggcag

SEQ ID NO: 1461673 - RNA, 20 nt, Pseudomonas aeruginosa PA01
gcggaccuugucgccgguga

SEQ ID NO: 1461674 - RNA, 18 nt, Pseudomonas aeruginosa PA01
gcggacgaggauggucag

SEQ ID NO: 1461675 - RNA, 20 nt, Pseudomonas aeruginosa PA01
gcggacgaggauggucaggc

SEQ ID NO: 1461676 - RNA, 22 nt, Pseudomonas aeruginosa PA01
gcggacgaggauggucaggccg

SEQ ID NO: 1461677 - RNA, 13 nt, Pseudomonas aeruginosa PA01
gcggacgaugguc

SEQ ID NO: 1461678 - RNA, 18 nt, Pseudomonas aeruginosa PA01
gcggacgauggucgccgc

SEQ ID NO: 1461679 - RNA, 22 nt, Pseudomonas aeruginosa PA01
gcggacgauggucgccgcgacc

SEQ ID NO: 1461680 - RNA, 20 nt, Pseudomonas aeruginosa PA01
gcggaccgaaggcaacagcc

SEQ ID NO: 1461681 - RNA, 14 nt, Pseudomonas aeruginosa PA01
gcggaccgccucga

SEQ ID NO: 1461682 - RNA, 21 nt, Pseudomonas aeruginosa PA01
gcggaccgccucgaccaucgg

SEQ ID NO: 1461683 - RNA, 16 nt, Pseudomonas aeruginosa PA01
gcggaccgggcggcgc

SEQ ID NO: 1461684 - RNA, 22 nt, Pseudomonas aeruginosa PA01
gcggaccgggcggcgcggcgca

SEQ ID NO: 1461685 - RNA, 16 nt, Pseudomonas aeruginosa PA01
gcggacccgcgccggc

SEQ ID NO: 1461686 - RNA, 17 nt, Pseudomonas aeruginosa PA01
gcggacccgcgccggca

SEQ ID NO: 1461687 - RNA, 20 nt, Pseudomonas aeruginosa PA01
gcggacccgcgccggcagcu

SEQ ID NO: 1461688 - RNA, 20 nt, Pseudomonas aeruginosa PA01
gcggaccccggccuccaggc

SEQ ID NO: 1461689 - RNA, 21 nt, Pseudomonas aeruginosa PA01
gcggaccccggccuccaggcu

SEQ ID NO: 1461690 - RNA, 20 nt, Pseudomonas aeruginosa PA01
gcggacccaguugggccagg

SEQ ID NO: 1461691 - RNA, 14 nt, Pseudomonas aeruginosa PA01
gcggacacgcaggc

SEQ ID NO: 1461692 - RNA, 17 nt, Pseudomonas aeruginosa PA01
gcggacacgcaggcgcc

SEQ ID NO: 1461693 - RNA, 19 nt, Pseudomonas aeruginosa PA01
gcggacacgcaggcgccga

SEQ ID NO: 1461694 - RNA, 16 nt, Pseudomonas aeruginosa PA01
gcggacaagcccagcu

SEQ ID NO: 1461695 - RNA, 14 nt, Pseudomonas aeruginosa PA01
gcggacaccgcggu

SEQ ID NO: 1461696 - RNA, 16 nt, Pseudomonas aeruginosa PA01
gcggacagcccgcgcu

SEQ ID NO: 1461697 - RNA, 18 nt, Pseudomonas aeruginosa PA01
gcggacagcccgcgcucg

SEQ ID NO: 1461698 - RNA, 13 nt, Pseudomonas aeruginosa PA01
gcggacauggcgc

SEQ ID NO: 1461699 - RNA, 14 nt, Pseudomonas aeruginosa PA01
gcggaccacagggc

SEQ ID NO: 1461700 - RNA, 16 nt, Pseudomonas aeruginosa PA01
gcggaccacagggcaa

SEQ ID NO: 1461701 - RNA, 23 nt, Pseudomonas aeruginosa PA01
gcggacugguaggacagggccag

SEQ ID NO: 1461702 - RNA, 22 nt, Pseudomonas aeruginosa PA01
gcggacugcucgccgccggcga

SEQ ID NO: 1461703 - RNA, 14 nt, Pseudomonas aeruginosa PA01
gcggacuaccuucg

SEQ ID NO: 1461704 - RNA, 21 nt, Pseudomonas aeruginosa PA01
gcggacuaccuucgaucaccc

SEQ ID NO: 1461705 - RNA, 18 nt, Pseudomonas aeruginosa PA01
gcggacuccggaggcgca

SEQ ID NO: 1461706 - RNA, 22 nt, Pseudomonas aeruginosa PA01
gcggacuccggaggcgcacagg

SEQ ID NO: 1461707 - RNA, 23 nt, Pseudomonas aeruginosa PA01
gcggacuccggaggcgcacaggc

SEQ ID NO: 1461708 - RNA, 17 nt, Pseudomonas aeruginosa PA01
gcggacggcacggggcg

SEQ ID NO: 1461709 - RNA, 17 nt, Pseudomonas aeruginosa PA01
gcggacgggccgcgccg

SEQ ID NO: 1461710 - RNA, 15 nt, Pseudomonas aeruginosa PA01
gcggacgcaggccga

SEQ ID NO: 1461711 - RNA, 20 nt, Pseudomonas aeruginosa PA01
gcggacgcaggccgaccucg

SEQ ID NO: 1461712 - RNA, 14 nt, Pseudomonas aeruginosa PA01
gcggacgcuggcga

SEQ ID NO: 1461713 - RNA, 15 nt, Pseudomonas aeruginosa PA01
gcggacgcuggcgau

SEQ ID NO: 1461714 - RNA, 17 nt, Pseudomonas aeruginosa PA01
gcggacgcuggcgauca

SEQ ID NO: 1461715 - RNA, 13 nt, Pseudomonas aeruginosa PA01
gcggacgccgaag

SEQ ID NO: 1461716 - RNA, 13 nt, Pseudomonas aeruginosa PA01
gcggaggcgaggu

SEQ ID NO: 1461717 - RNA, 22 nt, Pseudomonas aeruginosa PA01
gcggaggcgaggucgccggggc

SEQ ID NO: 1461718 - RNA, 21 nt, Pseudomonas aeruginosa PA01
gcggaggguaaacgcgaaugc

SEQ ID NO: 1461719 - RNA, 17 nt, Pseudomonas aeruginosa PA01
gcggagggucaggccga

SEQ ID NO: 1461720 - RNA, 19 nt, Pseudomonas aeruginosa PA01
gcggagcgucggaagcguc

SEQ ID NO: 1461721 - RNA, 14 nt, Pseudomonas aeruginosa PA01
gcggagcgucgggc

SEQ ID NO: 1461722 - RNA, 19 nt, Pseudomonas aeruginosa PA01
gcggagcuggaaauggcgg

SEQ ID NO: 1461723 - RNA, 21 nt, Pseudomonas aeruginosa PA01
gcggagcuggaaauggcgguc

SEQ ID NO: 1461724 - RNA, 22 nt, Pseudomonas aeruginosa PA01
gcggagcuggaaauggcggucg

SEQ ID NO: 1461725 - RNA, 16 nt, Pseudomonas aeruginosa PA01
gcggaggauucagcag

SEQ ID NO: 1461726 - RNA, 16 nt, Pseudomonas aeruginosa PA01
gcggagcaccgcgccu

SEQ ID NO: 1461727 - RNA, 20 nt, Pseudomonas aeruginosa PA01
gcggagcaccgcgccuucca

SEQ ID NO: 1461728 - RNA, 13 nt, Pseudomonas aeruginosa PA01
gcggagcagccuc

SEQ ID NO: 1461729 - RNA, 16 nt, Pseudomonas aeruginosa PA01
gcggagcaggcggaga

SEQ ID NO: 1461730 - RNA, 16 nt, Pseudomonas aeruginosa PA01
gcggagaauccgcucg

SEQ ID NO: 1461731 - RNA, 17 nt, Pseudomonas aeruginosa PA01
gcggagaggaucagcga

SEQ ID NO: 1461732 - RNA, 23 nt, Pseudomonas aeruginosa PA01
gcggagaggaucagcgaacccgg

SEQ ID NO: 1461733 - RNA, 14 nt, Pseudomonas aeruginosa PA01
gcggagagguggcc

SEQ ID NO: 1461734 - RNA, 17 nt, Pseudomonas aeruginosa PA01
gcggagagguggccgag

SEQ ID NO: 1461735 - RNA, 23 nt, Pseudomonas aeruginosa PA01
gcggaguagccggcggcgaacag

SEQ ID NO: 1461736 - RNA, 14 nt, Pseudomonas aeruginosa PA01
gcggagucgccggu

SEQ ID NO: 1461737 - RNA, 15 nt, Pseudomonas aeruginosa PA01
gcggagucguagcgc

SEQ ID NO: 1461738 - RNA, 19 nt, Pseudomonas aeruginosa PA01
gcggauaagcaagcgcaac

SEQ ID NO: 1461739 - RNA, 23 nt, Pseudomonas aeruginosa PA01
gcggauaagcaagcgcaacgcgg

SEQ ID NO: 1461740 - RNA, 14 nt, Pseudomonas aeruginosa PA01
gcggauaacgccac

SEQ ID NO: 1461741 - RNA, 15 nt, Pseudomonas aeruginosa PA01
gcggauaacgccagg

SEQ ID NO: 1461742 - RNA, 16 nt, Pseudomonas aeruginosa PA01
gcggauaacgccagga

SEQ ID NO: 1461743 - RNA, 14 nt, Pseudomonas aeruginosa PA01
gcggauaacgccga

SEQ ID NO: 1461744 - RNA, 14 nt, Pseudomonas aeruginosa PA01
gcggauaacgccgc

SEQ ID NO: 1461745 - RNA, 14 nt, Pseudomonas aeruginosa PA01
gcggauaacgccug

SEQ ID NO: 1461746 - RNA, 20 nt, Pseudomonas aeruginosa PA01
gcggauaccgagggugcaga

SEQ ID NO: 1461747 - RNA, 21 nt, Pseudomonas aeruginosa PA01
gcggauaacaccguuggcguu

SEQ ID NO: 1461748 - RNA, 17 nt, Pseudomonas aeruginosa PA01
gcggauaaccgcgagcg

SEQ ID NO: 1461749 - RNA, 15 nt, Pseudomonas aeruginosa PA01
gcggauacaggcgca

SEQ ID NO: 1461750 - RNA, 17 nt, Pseudomonas aeruginosa PA01
gcggauacaggcgcagc

SEQ ID NO: 1461751 - RNA, 21 nt, Pseudomonas aeruginosa PA01
gcggauacaggcgcagcagca

SEQ ID NO: 1461752 - RNA, 17 nt, Pseudomonas aeruginosa PA01
gcggauaaucgcagcgc

SEQ ID NO: 1461753 - RNA, 17 nt, Pseudomonas aeruginosa PA01
gcggauacggcaggggc

SEQ ID NO: 1461754 - RNA, 17 nt, Pseudomonas aeruginosa PA01
gcggauauagcugguca

SEQ ID NO: 1461755 - RNA, 16 nt, Pseudomonas aeruginosa PA01
gcggauaucgcgccgc

SEQ ID NO: 1461756 - RNA, 16 nt, Pseudomonas aeruginosa PA01
gcggauaucgcuggcg

SEQ ID NO: 1461757 - RNA, 20 nt, Pseudomonas aeruginosa PA01
gcggauaucgcuggcgccca

SEQ ID NO: 1461758 - RNA, 23 nt, Pseudomonas aeruginosa PA01
gcggauaucggccucggucaggu

SEQ ID NO: 1461759 - RNA, 14 nt, Pseudomonas aeruginosa PA01
gcggaucgagcagc

SEQ ID NO: 1461760 - RNA, 15 nt, Pseudomonas aeruginosa PA01
gcggaucgagcagcg

SEQ ID NO: 1461761 - RNA, 21 nt, Pseudomonas aeruginosa PA01
gcggaucgagcagcggcgcca

SEQ ID NO: 1461762 - RNA, 16 nt, Pseudomonas aeruginosa PA01
gcggaucgaucagcag

SEQ ID NO: 1461763 - RNA, 18 nt, Pseudomonas aeruginosa PA01
gcggaucgaucagcagca

SEQ ID NO: 1461764 - RNA, 19 nt, Pseudomonas aeruginosa PA01
gcggaucgaucgaucagcc

SEQ ID NO: 1461765 - RNA, 15 nt, Pseudomonas aeruginosa PA01
gcggaucgcccggcg

SEQ ID NO: 1461766 - RNA, 19 nt, Pseudomonas aeruginosa PA01
gcggaucgcccggcgcucc

SEQ ID NO: 1461767 - RNA, 13 nt, Pseudomonas aeruginosa PA01
gcggaucgccgcc

SEQ ID NO: 1461768 - RNA, 17 nt, Pseudomonas aeruginosa PA01
gcggauccccucccgcg

SEQ ID NO: 1461769 - RNA, 19 nt, Pseudomonas aeruginosa PA01
gcggauccggguggagagg

SEQ ID NO: 1461770 - RNA, 20 nt, Pseudomonas aeruginosa PA01
gcggauccggguggagaggc

SEQ ID NO: 1461771 - RNA, 16 nt, Pseudomonas aeruginosa PA01
gcggaucagcccgcug

SEQ ID NO: 1461772 - RNA, 15 nt, Pseudomonas aeruginosa PA01
gcggaucagcucgau

SEQ ID NO: 1461773 - RNA, 19 nt, Pseudomonas aeruginosa PA01
gcggaucagcucgaucagc

SEQ ID NO: 1461774 - RNA, 20 nt, Pseudomonas aeruginosa PA01
gcggaucagcucgaucagcc

SEQ ID NO: 1461775 - RNA, 17 nt, Pseudomonas aeruginosa PA01
gcggauauucgacgcgc

SEQ ID NO: 1461776 - RNA, 23 nt, Pseudomonas aeruginosa PA01
gcggauauucgacgcgcggcugc

SEQ ID NO: 1461777 - RNA, 15 nt, Pseudomonas aeruginosa PA01
gcggaucaacgccgg

SEQ ID NO: 1461778 - RNA, 21 nt, Pseudomonas aeruginosa PA01
gcggaucaacuccgccaggcg

SEQ ID NO: 1461779 - RNA, 16 nt, Pseudomonas aeruginosa PA01
gcggaucacaggcucu

SEQ ID NO: 1461780 - RNA, 13 nt, Pseudomonas aeruginosa PA01
gcggaucaccggc

SEQ ID NO: 1461781 - RNA, 20 nt, Pseudomonas aeruginosa PA01
gcggaucaccggcuggcccu

SEQ ID NO: 1461782 - RNA, 13 nt, Pseudomonas aeruginosa PA01
gcggaucaccugg

SEQ ID NO: 1461783 - RNA, 14 nt, Pseudomonas aeruginosa PA01
gcggaucaccuggc

SEQ ID NO: 1461784 - RNA, 17 nt, Pseudomonas aeruginosa PA01
gcggaucaccuggccgu

SEQ ID NO: 1461785 - RNA, 19 nt, Pseudomonas aeruginosa PA01
gcggauuacuccgccggcg

SEQ ID NO: 1461786 - RNA, 15 nt, Pseudomonas aeruginosa PA01
gcggaugucgucgca

SEQ ID NO: 1461787 - RNA, 16 nt, Pseudomonas aeruginosa PA01
gcggaugugcaggguc

SEQ ID NO: 1461788 - RNA, 14 nt, Pseudomonas aeruginosa PA01
gcggauucaggcgc

SEQ ID NO: 1461789 - RNA, 18 nt, Pseudomonas aeruginosa PA01
gcggauucaucggcggca

SEQ ID NO: 1461790 - RNA, 20 nt, Pseudomonas aeruginosa PA01
gcggauugacgauggccagc

SEQ ID NO: 1461791 - RNA, 13 nt, Pseudomonas aeruginosa PA01
gcggauggcgauc

SEQ ID NO: 1461792 - RNA, 14 nt, Pseudomonas aeruginosa PA01
gcggauggcgcggg

SEQ ID NO: 1461793 - RNA, 17 nt, Pseudomonas aeruginosa PA01
gcggaugggcgacgacg

SEQ ID NO: 1461794 - RNA, 20 nt, Pseudomonas aeruginosa PA01
gcggauguaguccagcgccg

SEQ ID NO: 1461795 - RNA, 18 nt, Pseudomonas aeruginosa PA01
gcggauggcaauggcggu

SEQ ID NO: 1461796 - RNA, 23 nt, Pseudomonas aeruginosa PA01
gcggaugcguugcucgcaccagg

SEQ ID NO: 1461797 - RNA, 22 nt, Pseudomonas aeruginosa PA01
gcggaugcccuggucggcgguc

SEQ ID NO: 1461798 - RNA, 16 nt, Pseudomonas aeruginosa PA01
gcggaugccggcgcug

SEQ ID NO: 1461799 - RNA, 16 nt, Pseudomonas aeruginosa PA01
gcggaugagccgcugg

SEQ ID NO: 1461800 - RNA, 17 nt, Pseudomonas aeruginosa PA01
gcggaugagccgcuggu

SEQ ID NO: 1461801 - RNA, 15 nt, Pseudomonas aeruginosa PA01
gcggaugacgggcga

SEQ ID NO: 1461802 - RNA, 23 nt, Pseudomonas aeruginosa PA01
gcggaucuggaauucgccgcgcg

SEQ ID NO: 1461803 - RNA, 13 nt, Pseudomonas aeruginosa PA01
gcggaucuggccc

SEQ ID NO: 1461804 - RNA, 14 nt, Pseudomonas aeruginosa PA01
gcggaucuggcccu

SEQ ID NO: 1461805 - RNA, 14 nt, Pseudomonas aeruginosa PA01
gcggaucucgucgc

SEQ ID NO: 1461806 - RNA, 16 nt, Pseudomonas aeruginosa PA01
gcggaucugcuccugc

SEQ ID NO: 1461807 - RNA, 23 nt, Pseudomonas aeruginosa PA01
gcggaucugcuccugcaggcccu

SEQ ID NO: 1461808 - RNA, 22 nt, Pseudomonas aeruginosa PA01
gcggaucucaggaccuuccgcc

SEQ ID NO: 1461809 - RNA, 23 nt, Pseudomonas aeruginosa PA01
gcggaugaacucgacuucuucgc

SEQ ID NO: 1461810 - RNA, 16 nt, Pseudomonas aeruginosa PA01
gcggaugacguucccg

SEQ ID NO: 1461811 - RNA, 18 nt, Pseudomonas aeruginosa PA01
gcggaugacguucccguc

SEQ ID NO: 1461812 - RNA, 14 nt, Pseudomonas aeruginosa PA01
gcggaucgcgccgu

SEQ ID NO: 1461813 - RNA, 16 nt, Pseudomonas aeruginosa PA01
gcggaucgcgccgucg

SEQ ID NO: 1461814 - RNA, 23 nt, Pseudomonas aeruginosa PA01
gcggaucgcgccgucgcuggcga

SEQ ID NO: 1461815 - RNA, 12 nt, Pseudomonas aeruginosa PA01
gcggaucgucgc

SEQ ID NO: 1461816 - RNA, 15 nt, Pseudomonas aeruginosa PA01
gcggaucgucgcggc

SEQ ID NO: 1461817 - RNA, 17 nt, Pseudomonas aeruginosa PA01
gcggauuugccgccgag

SEQ ID NO: 1461818 - RNA, 22 nt, Pseudomonas aeruginosa PA01
gcggauuugccgccgagggcga

SEQ ID NO: 1461819 - RNA, 18 nt, Pseudomonas aeruginosa PA01
gcggauuggccgggccga

SEQ ID NO: 1461820 - RNA, 16 nt, Pseudomonas aeruginosa PA01
gcggcaacgacggcaa

SEQ ID NO: 1461821 - RNA, 13 nt, Pseudomonas aeruginosa PA01
gcggcaaugcggc

SEQ ID NO: 1461822 - RNA, 18 nt, Pseudomonas aeruginosa PA01
gcggcaaugcggcgaugg

SEQ ID NO: 1461823 - RNA, 16 nt, Pseudomonas aeruginosa PA01
gcggcaauguccgagc

SEQ ID NO: 1461824 - RNA, 19 nt, Pseudomonas aeruginosa PA01
gcggcaauguccgagcagg

SEQ ID NO: 1461825 - RNA, 23 nt, Pseudomonas aeruginosa PA01
gcggcaauguccgagcaggucgc

SEQ ID NO: 1461826 - RNA, 16 nt, Pseudomonas aeruginosa PA01
gcggcaacgucaggcu

SEQ ID NO: 1461827 - RNA, 18 nt, Pseudomonas aeruginosa PA01
gcggcaaggcacacgccc

SEQ ID NO: 1461828 - RNA, 23 nt, Pseudomonas aeruginosa PA01
gcggcaaggcacacgcccggcac

SEQ ID NO: 1461829 - RNA, 21 nt, Pseudomonas aeruginosa PA01
gcggcaaggccaagucggccg

SEQ ID NO: 1461830 - RNA, 16 nt, Pseudomonas aeruginosa PA01
gcggcaaggcgauccc

SEQ ID NO: 1461831 - RNA, 21 nt, Pseudomonas aeruginosa PA01
gcggcacgaaccauugcggcc

SEQ ID NO: 1461832 - RNA, 22 nt, Pseudomonas aeruginosa PA01
gcggcacgaccacaucggccag

SEQ ID NO: 1461833 - RNA, 19 nt, Pseudomonas aeruginosa PA01
gcggcacggucauggccag

SEQ ID NO: 1461834 - RNA, 20 nt, Pseudomonas aeruginosa PA01
gcggcacggucauggccagc

SEQ ID NO: 1461835 - RNA, 21 nt, Pseudomonas aeruginosa PA01
gcggcacgcuccagaucgccg

SEQ ID NO: 1461836 - RNA, 19 nt, Pseudomonas aeruginosa PA01
gcggcaccucgauggcggc

SEQ ID NO: 1461837 - RNA, 20 nt, Pseudomonas aeruginosa PA01
gcggcaccucgauggcggcg

SEQ ID NO: 1461838 - RNA, 14 nt, Pseudomonas aeruginosa PA01
gcggcaccggcgac

SEQ ID NO: 1461839 - RNA, 16 nt, Pseudomonas aeruginosa PA01
gcggcaccggcgacga

SEQ ID NO: 1461840 - RNA, 20 nt, Pseudomonas aeruginosa PA01
gcggcacccucuuccgcgcu

SEQ ID NO: 1461841 - RNA, 21 nt, Pseudomonas aeruginosa PA01
gcggcacccucuuccgcgcug

SEQ ID NO: 1461842 - RNA, 23 nt, Pseudomonas aeruginosa PA01
gcggcaccgacgccgaaggacag

SEQ ID NO: 1461843 - RNA, 20 nt, Pseudomonas aeruginosa PA01
gcggcaccccuugcagccag

SEQ ID NO: 1461844 - RNA, 21 nt, Pseudomonas aeruginosa PA01
gcggcaccccuugcagccagc

SEQ ID NO: 1461845 - RNA, 22 nt, Pseudomonas aeruginosa PA01
gcggcaccccuugcagccagcc

SEQ ID NO: 1461846 - RNA, 23 nt, Pseudomonas aeruginosa PA01
gcggcaccccuugcagccagccg

SEQ ID NO: 1461847 - RNA, 15 nt, Pseudomonas aeruginosa PA01
gcggcacccggcugg

SEQ ID NO: 1461848 - RNA, 13 nt, Pseudomonas aeruginosa PA01
gcggcaccagcac

SEQ ID NO: 1461849 - RNA, 14 nt, Pseudomonas aeruginosa PA01
gcggcaccagcacg

SEQ ID NO: 1461850 - RNA, 13 nt, Pseudomonas aeruginosa PA01
gcggcaccagcca

SEQ ID NO: 1461851 - RNA, 14 nt, Pseudomonas aeruginosa PA01
gcggcacaggcggc

SEQ ID NO: 1461852 - RNA, 19 nt, Pseudomonas aeruginosa PA01
gcggcacagcguggccagc

SEQ ID NO: 1461853 - RNA, 22 nt, Pseudomonas aeruginosa PA01
gcggcacagcguggccagcgcc

SEQ ID NO: 1461854 - RNA, 23 nt, Pseudomonas aeruginosa PA01
gcggcacagcguggccagcgccc

SEQ ID NO: 1461855 - RNA, 20 nt, Pseudomonas aeruginosa PA01
gcggcagcauccguaccagg

SEQ ID NO: 1461856 - RNA, 17 nt, Pseudomonas aeruginosa PA01
gcggcagccacucggcc

SEQ ID NO: 1461857 - RNA, 18 nt, Pseudomonas aeruginosa PA01
gcggcagcacgaugaggc

SEQ ID NO: 1461858 - RNA, 20 nt, Pseudomonas aeruginosa PA01
gcggcagcacgaugaggcgu

SEQ ID NO: 1461859 - RNA, 20 nt, Pseudomonas aeruginosa PA01
gcggcagccccuugcgcucu

SEQ ID NO: 1461860 - RNA, 14 nt, Pseudomonas aeruginosa PA01
gcggcagcaccagg

SEQ ID NO: 1461861 - RNA, 15 nt, Pseudomonas aeruginosa PA01
gcggcagcaccaggc

SEQ ID NO: 1461862 - RNA, 16 nt, Pseudomonas aeruginosa PA01
gcggcagcaccaggcc

SEQ ID NO: 1461863 - RNA, 18 nt, Pseudomonas aeruginosa PA01
gcggcagcaccaggccau

SEQ ID NO: 1461864 - RNA, 18 nt, Pseudomonas aeruginosa PA01
gcggcagcaggcgggcga

SEQ ID NO: 1461865 - RNA, 14 nt, Pseudomonas aeruginosa PA01
gcggcagcaggcug

SEQ ID NO: 1461866 - RNA, 23 nt, Pseudomonas aeruginosa PA01
gcggcacuccggcauaccgcccg

SEQ ID NO: 1461867 - RNA, 15 nt, Pseudomonas aeruginosa PA01
gcggcagauccgccg

SEQ ID NO: 1461868 - RNA, 19 nt, Pseudomonas aeruginosa PA01
gcggcagauccgccgugag

SEQ ID NO: 1461869 - RNA, 17 nt, Pseudomonas aeruginosa PA01
gcggcacuucccgcccc

SEQ ID NO: 1461870 - RNA, 15 nt, Pseudomonas aeruginosa PA01
gcggcagcgccaggu

SEQ ID NO: 1461871 - RNA, 16 nt, Pseudomonas aeruginosa PA01
gcggcagccgcggcug

SEQ ID NO: 1461872 - RNA, 18 nt, Pseudomonas aeruginosa PA01
gcggcagcgucucggcug

SEQ ID NO: 1461873 - RNA, 13 nt, Pseudomonas aeruginosa PA01
gcggcagcugcgg

SEQ ID NO: 1461874 - RNA, 17 nt, Pseudomonas aeruginosa PA01
gcggcagcugcggcggc

SEQ ID NO: 1461875 - RNA, 23 nt, Pseudomonas aeruginosa PA01
gcggcagcugcggcggcaccacg

SEQ ID NO: 1461876 - RNA, 23 nt, Pseudomonas aeruginosa PA01
gcggcaggagcaugaaggucgac

SEQ ID NO: 1461877 - RNA, 17 nt, Pseudomonas aeruginosa PA01
gcggcaggagcguugcg

SEQ ID NO: 1461878 - RNA, 16 nt, Pseudomonas aeruginosa PA01
gcggcaggaucaggcu

SEQ ID NO: 1461879 - RNA, 20 nt, Pseudomonas aeruginosa PA01
gcggcaggcacgcugccagc

SEQ ID NO: 1461880 - RNA, 16 nt, Pseudomonas aeruginosa PA01
gcggcaggccacggcc

SEQ ID NO: 1461881 - RNA, 14 nt, Pseudomonas aeruginosa PA01
gcggcaggccagcu

SEQ ID NO: 1461882 - RNA, 18 nt, Pseudomonas aeruginosa PA01
gcggcaggaaauccgccg

SEQ ID NO: 1461883 - RNA, 21 nt, Pseudomonas aeruginosa PA01
gcggcaggaaauccgccgcgc

SEQ ID NO: 1461884 - RNA, 16 nt, Pseudomonas aeruginosa PA01
gcggcaggccgauguc

SEQ ID NO: 1461885 - RNA, 22 nt, Pseudomonas aeruginosa PA01
gcgcucggcgaggccggcgauc

SEQ ID NO: 1461886 - RNA, 14 nt, Pseudomonas aeruginosa PA01
gcgcucggcgacgc

SEQ ID NO: 1461887 - RNA, 21 nt, Pseudomonas aeruginosa PA01
gcgcucggcgaccuugcgcac

SEQ ID NO: 1461888 - RNA, 22 nt, Pseudomonas aeruginosa PA01
gcgcucggcgaccuugcgcacc

SEQ ID NO: 1461889 - RNA, 17 nt, Pseudomonas aeruginosa PA01
gcgcucggccgccuggc

SEQ ID NO: 1461890 - RNA, 18 nt, Pseudomonas aeruginosa PA01
gcgcucggccgccuggcg

SEQ ID NO: 1461891 - RNA, 20 nt, Pseudomonas aeruginosa PA01
gcgcucggccaguucgucga

SEQ ID NO: 1461892 - RNA, 13 nt, Pseudomonas aeruginosa PA01
gcgcucggccugc

SEQ ID NO: 1461893 - RNA, 15 nt, Pseudomonas aeruginosa PA01
gcgcucggccuggug

SEQ ID NO: 1461894 - RNA, 16 nt, Pseudomonas aeruginosa PA01
gcgcucggccuggugc

SEQ ID NO: 1461895 - RNA, 13 nt, Pseudomonas aeruginosa PA01
gcgcucggcgcuc

SEQ ID NO: 1461896 - RNA, 15 nt, Pseudomonas aeruginosa PA01
gcgcucggcuccagc

SEQ ID NO: 1461897 - RNA, 17 nt, Pseudomonas aeruginosa PA01
gcgcucggcuccagcca

SEQ ID NO: 1461898 - RNA, 22 nt, Pseudomonas aeruginosa PA01
gcgcucggcuccagccaggccc

SEQ ID NO: 1461899 - RNA, 12 nt, Pseudomonas aeruginosa PA01
gcgcucggcggc

SEQ ID NO: 1461900 - RNA, 14 nt, Pseudomonas aeruginosa PA01
gcgcucggcggccu

SEQ ID NO: 1461901 - RNA, 15 nt, Pseudomonas aeruginosa PA01
gcgcucggcggccuc

SEQ ID NO: 1461902 - RNA, 17 nt, Pseudomonas aeruginosa PA01
gcgcucggcggcgcgca

SEQ ID NO: 1461903 - RNA, 14 nt, Pseudomonas aeruginosa PA01
gcgcugaaggcggu

SEQ ID NO: 1461904 - RNA, 16 nt, Pseudomonas aeruginosa PA01
gcgcugaacaagcccu

SEQ ID NO: 1461905 - RNA, 13 nt, Pseudomonas aeruginosa PA01
gcgcugaacagcu

SEQ ID NO: 1461906 - RNA, 18 nt, Pseudomonas aeruginosa PA01
gcgcugaacagcuggcgc

SEQ ID NO: 1461907 - RNA, 18 nt, Pseudomonas aeruginosa PA01
gcgcucuucacuuccagc

SEQ ID NO: 1461908 - RNA, 16 nt, Pseudomonas aeruginosa PA01
gcgcucuucgccgcgg

SEQ ID NO: 1461909 - RNA, 16 nt, Pseudomonas aeruginosa PA01
gcgcucuggcccagcu

SEQ ID NO: 1461910 - RNA, 13 nt, Pseudomonas aeruginosa PA01
gcgcucuggcgca

SEQ ID NO: 1461911 - RNA, 16 nt, Pseudomonas aeruginosa PA01
gcgcucuggcgcauag

SEQ ID NO: 1461912 - RNA, 16 nt, Pseudomonas aeruginosa PA01
gcgcucguugcgccgc

SEQ ID NO: 1461913 - RNA, 19 nt, Pseudomonas aeruginosa PA01
gcgcucguugcgccgcucc

SEQ ID NO: 1461914 - RNA, 22 nt, Pseudomonas aeruginosa PA01
gcgcucucgaacaccaggcgcc

SEQ ID NO: 1461915 - RNA, 14 nt, Pseudomonas aeruginosa PA01
gcgcucucgccgcc

SEQ ID NO: 1461916 - RNA, 13 nt, Pseudomonas aeruginosa PA01
gcgcucucgccgg

SEQ ID NO: 1461917 - RNA, 15 nt, Pseudomonas aeruginosa PA01
gcgcucucgccggcc

SEQ ID NO: 1461918 - RNA, 18 nt, Pseudomonas aeruginosa PA01
gcgcucucgccggccugg

SEQ ID NO: 1461919 - RNA, 13 nt, Pseudomonas aeruginosa PA01
gcgcucgaucagg

SEQ ID NO: 1461920 - RNA, 14 nt, Pseudomonas aeruginosa PA01
gcgcucgagccggc

SEQ ID NO: 1461921 - RNA, 16 nt, Pseudomonas aeruginosa PA01
gcgcucgccuaccggc

SEQ ID NO: 1461922 - RNA, 21 nt, Pseudomonas aeruginosa PA01
gcgcucgccuaccggcgccgc

SEQ ID NO: 1461923 - RNA, 12 nt, Pseudomonas aeruginosa PA01
gcgcucggccag

SEQ ID NO: 1461924 - RNA, 15 nt, Pseudomonas aeruginosa PA01
gcgcucgaacgccgc

SEQ ID NO: 1461925 - RNA, 20 nt, Pseudomonas aeruginosa PA01
gcgcucggcaucgaccaugc

SEQ ID NO: 1461926 - RNA, 20 nt, Pseudomonas aeruginosa PA01
gcgcucgcugucaaucgcgc

SEQ ID NO: 1461927 - RNA, 20 nt, Pseudomonas aeruginosa PA01
gcgcucgcugucgcucagcg

SEQ ID NO: 1461928 - RNA, 19 nt, Pseudomonas aeruginosa PA01
gcgcucggaucaggcgggc

SEQ ID NO: 1461929 - RNA, 13 nt, Pseudomonas aeruginosa PA01
gcgcucgcgcugc

SEQ ID NO: 1461930 - RNA, 12 nt, Pseudomonas aeruginosa PA01
gcgcucgcgcag

SEQ ID NO: 1461931 - RNA, 13 nt, Pseudomonas aeruginosa PA01
gcgcucgcgcagc

SEQ ID NO: 1461932 - RNA, 15 nt, Pseudomonas aeruginosa PA01
gcgcucgcgcagcca

SEQ ID NO: 1461933 - RNA, 19 nt, Pseudomonas aeruginosa PA01
gcgcucgcgcagccacugg

SEQ ID NO: 1461934 - RNA, 21 nt, Pseudomonas aeruginosa PA01
gcgcugaccgcucccaggcaa

SEQ ID NO: 1461935 - RNA, 19 nt, Pseudomonas aeruginosa PA01
gcgcugcaugggcucgcgc

SEQ ID NO: 1461936 - RNA, 21 nt, Pseudomonas aeruginosa PA01
gcgcugccaaacgccgucugg

SEQ ID NO: 1461937 - RNA, 16 nt, Pseudomonas aeruginosa PA01
gcgcugccagcgccgc

SEQ ID NO: 1461938 - RNA, 18 nt, Pseudomonas aeruginosa PA01
gcgcugccagcgccgccg

SEQ ID NO: 1461939 - RNA, 21 nt, Pseudomonas aeruginosa PA01
gcgcugccagcgccgccgcgu

SEQ ID NO: 1461940 - RNA, 19 nt, Pseudomonas aeruginosa PA01
gcgcugccgcaugcagugg

SEQ ID NO: 1461941 - RNA, 15 nt, Pseudomonas aeruginosa PA01
gcgcugcccggcgcg

SEQ ID NO: 1461942 - RNA, 19 nt, Pseudomonas aeruginosa PA01
gcgcugccgaacagcaggg

SEQ ID NO: 1461943 - RNA, 16 nt, Pseudomonas aeruginosa PA01
gcgcugcucgauggcc

SEQ ID NO: 1461944 - RNA, 21 nt, Pseudomonas aeruginosa PA01
gcgcugcugccauccgcgccg

SEQ ID NO: 1461945 - RNA, 17 nt, Pseudomonas aeruginosa PA01
gcgcugcgggucauugg

SEQ ID NO: 1461946 - RNA, 16 nt, Pseudomonas aeruginosa PA01
gcgcugcgugcgccgc

SEQ ID NO: 1461947 - RNA, 18 nt, Pseudomonas aeruginosa PA01
gcgcugcgugcgccgcuc

SEQ ID NO: 1461948 - RNA, 13 nt, Pseudomonas aeruginosa PA01
gcgcuggcgccga

SEQ ID NO: 1461949 - RNA, 16 nt, Pseudomonas aeruginosa PA01
gcgcuggcgccgaugc

SEQ ID NO: 1461950 - RNA, 22 nt, Pseudomonas aeruginosa PA01
gcgcugcugguagugcuggcgc

SEQ ID NO: 1461951 - RNA, 17 nt, Pseudomonas aeruginosa PA01
gcgcuggaccuggccgg

SEQ ID NO: 1461952 - RNA, 18 nt, Pseudomonas aeruginosa PA01
gcgcuggaccuggccggc

SEQ ID NO: 1461953 - RNA, 20 nt, Pseudomonas aeruginosa PA01
gcgcuggaccuggccggcga

SEQ ID NO: 1461954 - RNA, 22 nt, Pseudomonas aeruginosa PA01
gcgcuggaccuggccggcgacc

SEQ ID NO: 1461955 - RNA, 13 nt, Pseudomonas aeruginosa PA01
gcgcuggaccaug

SEQ ID NO: 1461956 - RNA, 16 nt, Pseudomonas aeruginosa PA01
gcgcuggaccauggcc

SEQ ID NO: 1461957 - RNA, 19 nt, Pseudomonas aeruginosa PA01
gcgcuggaccauggccggc

SEQ ID NO: 1461958 - RNA, 21 nt, Pseudomonas aeruginosa PA01
gcgcuggaccauggccggcgu

SEQ ID NO: 1461959 - RNA, 19 nt, Pseudomonas aeruginosa PA01
gcgcuggacccgcaccugg

SEQ ID NO: 1461960 - RNA, 20 nt, Pseudomonas aeruginosa PA01
gcgcucaggcgcagcguccu

SEQ ID NO: 1461961 - RNA, 14 nt, Pseudomonas aeruginosa PA01
gcgcuccaacagca

SEQ ID NO: 1461962 - RNA, 15 nt, Pseudomonas aeruginosa PA01
gcgcuccaacagcag

SEQ ID NO: 1461963 - RNA, 17 nt, Pseudomonas aeruginosa PA01
gcgcuccaacagcaggu

SEQ ID NO: 1461964 - RNA, 17 nt, Pseudomonas aeruginosa PA01
gcgcuccacagcugcca

SEQ ID NO: 1461965 - RNA, 18 nt, Pseudomonas aeruginosa PA01
gcgcuccacagcugccag

SEQ ID NO: 1461966 - RNA, 14 nt, Pseudomonas aeruginosa PA01
gcgcuaucggcccg

SEQ ID NO: 1461967 - RNA, 16 nt, Pseudomonas aeruginosa PA01
gcgcuauccgccgcua

SEQ ID NO: 1461968 - RNA, 23 nt, Pseudomonas aeruginosa PA01
gcgcuauccgccguuacgccgga

SEQ ID NO: 1461969 - RNA, 23 nt, Pseudomonas aeruginosa PA01
gcgcuauccgccguuacgccggg

SEQ ID NO: 1461970 - RNA, 17 nt, Pseudomonas aeruginosa PA01
gcgcuacucaggugaug

SEQ ID NO: 1461971 - RNA, 17 nt, Pseudomonas aeruginosa PA01
gcgcuacgcucgccgac

SEQ ID NO: 1461972 - RNA, 19 nt, Pseudomonas aeruginosa PA01
gcgcuacgcucgccgacgg

SEQ ID NO: 1461973 - RNA, 19 nt, Pseudomonas aeruginosa PA01
gcgcuacggcaucaccggc

SEQ ID NO: 1461974 - RNA, 15 nt, Pseudomonas aeruginosa PA01
gcgcucgaggggcga

SEQ ID NO: 1461975 - RNA, 18 nt, Pseudomonas aeruginosa PA01
gcgcuccuccagcgccgc

SEQ ID NO: 1461976 - RNA, 17 nt, Pseudomonas aeruginosa PA01
gcgcucgaagcuccagc

SEQ ID NO: 1461977 - RNA, 20 nt, Pseudomonas aeruginosa PA01
gcgcucgaagcuccagcgug

SEQ ID NO: 1461978 - RNA, 16 nt, Pseudomonas aeruginosa PA01
gcgcuccacccaggcg

SEQ ID NO: 1461979 - RNA, 18 nt, Pseudomonas aeruginosa PA01
gcgcuccacccaggcgcc

SEQ ID NO: 1461980 - RNA, 12 nt, Pseudomonas aeruginosa PA01
gcgcuccaccgc

SEQ ID NO: 1461981 - RNA, 14 nt, Pseudomonas aeruginosa PA01
gcgcuccaccgccc

SEQ ID NO: 1461982 - RNA, 16 nt, Pseudomonas aeruginosa PA01
gcgcuccaccagggcc

SEQ ID NO: 1461983 - RNA, 17 nt, Pseudomonas aeruginosa PA01
gcgcuccaccagggccu

SEQ ID NO: 1461984 - RNA, 20 nt, Pseudomonas aeruginosa PA01
gcgcuccagaugcuggagcu

SEQ ID NO: 1461985 - RNA, 20 nt, Pseudomonas aeruginosa PA01
gcgcuccucgcgcugcccgg

SEQ ID NO: 1461986 - RNA, 22 nt, Pseudomonas aeruginosa PA01
gcgcuccucgcgcugcccggcg

SEQ ID NO: 1461987 - RNA, 16 nt, Pseudomonas aeruginosa PA01
gcgcuccucgauccgc

SEQ ID NO: 1461988 - RNA, 13 nt, Pseudomonas aeruginosa PA01
gcgcuccuggugc

SEQ ID NO: 1461989 - RNA, 17 nt, Pseudomonas aeruginosa PA01
gcgcuccuguucgucgc

SEQ ID NO: 1461990 - RNA, 16 nt, Pseudomonas aeruginosa PA01
gcgcuccuugcgccag

SEQ ID NO: 1461991 - RNA, 18 nt, Pseudomonas aeruginosa PA01
gcgcuccuugcgccaggc

SEQ ID NO: 1461992 - RNA, 19 nt, Pseudomonas aeruginosa PA01
gcgcuccuugcgccaggcc

SEQ ID NO: 1461993 - RNA, 17 nt, Pseudomonas aeruginosa PA01
gcgcuccuuggcuggcc

SEQ ID NO: 1461994 - RNA, 15 nt, Pseudomonas aeruginosa PA01
gcgcuccuuucccag

SEQ ID NO: 1461995 - RNA, 15 nt, Pseudomonas aeruginosa PA01
gcgcguccaucccug

SEQ ID NO: 1461996 - RNA, 14 nt, Pseudomonas aeruginosa PA01
gcgcgucaugccgc

SEQ ID NO: 1461997 - RNA, 17 nt, Pseudomonas aeruginosa PA01
gcgcgucaugccgccgu

SEQ ID NO: 1461998 - RNA, 15 nt, Pseudomonas aeruginosa PA01
gcgcguccagccggu

SEQ ID NO: 1461999 - RNA, 18 nt, Pseudomonas aeruginosa PA01
gcgcguccagccgguagg

SEQ ID NO: 1462000 - RNA, 20 nt, Pseudomonas aeruginosa PA01
gcgcguccagcuccaccagg

SEQ ID NO: 1462001 - RNA, 22 nt, Pseudomonas aeruginosa PA01
gcgcguccagcuccaccaggcc

SEQ ID NO: 1462002 - RNA, 22 nt, Pseudomonas aeruginosa PA01
gcgcguguacccccaccgggcc

SEQ ID NO: 1462003 - RNA, 13 nt, Pseudomonas aeruginosa PA01
gcgcgugguaucg

SEQ ID NO: 1462004 - RNA, 18 nt, Pseudomonas aeruginosa PA01
gcgcguggcuucguccag

SEQ ID NO: 1462005 - RNA, 15 nt, Pseudomonas aeruginosa PA01
gcgcguggccgccag

SEQ ID NO: 1462006 - RNA, 17 nt, Pseudomonas aeruginosa PA01
gcgcguggccgccaggg

SEQ ID NO: 1462007 - RNA, 18 nt, Pseudomonas aeruginosa PA01
gcgcguggccgccagggu

SEQ ID NO: 1462008 - RNA, 19 nt, Pseudomonas aeruginosa PA01
gcgcguggccgccaggguc

SEQ ID NO: 1462009 - RNA, 17 nt, Pseudomonas aeruginosa PA01
gcgcguugcagcgccug

SEQ ID NO: 1462010 - RNA, 18 nt, Pseudomonas aeruginosa PA01
gcgcguugcagcgccugu

SEQ ID NO: 1462011 - RNA, 14 nt, Pseudomonas aeruginosa PA01
gcgcguugcccagc

SEQ ID NO: 1462012 - RNA, 13 nt, Pseudomonas aeruginosa PA01
gcgcuacgaaggc

SEQ ID NO: 1462013 - RNA, 16 nt, Pseudomonas aeruginosa PA01
gcgcuacgaaggcgug

SEQ ID NO: 1462014 - RNA, 13 nt, Pseudomonas aeruginosa PA01
gcgcuaccgcgca

SEQ ID NO: 1462015 - RNA, 16 nt, Pseudomonas aeruginosa PA01
gcgcuaccgcgcaugg

SEQ ID NO: 1462016 - RNA, 16 nt, Pseudomonas aeruginosa PA01
gcgcguucgcgcgagg

SEQ ID NO: 1462017 - RNA, 21 nt, Pseudomonas aeruginosa PA01
gcgcguucaccccgcccuugg

SEQ ID NO: 1462018 - RNA, 17 nt, Pseudomonas aeruginosa PA01
gcgcgccauggccugga

SEQ ID NO: 1462019 - RNA, 18 nt, Pseudomonas aeruginosa PA01
gcgcgccauggccuggaa

SEQ ID NO: 1462020 - RNA, 13 nt, Pseudomonas aeruginosa PA01
gcgcgccauuccg

SEQ ID NO: 1462021 - RNA, 15 nt, Pseudomonas aeruginosa PA01
gcgcgccauuccgcg

SEQ ID NO: 1462022 - RNA, 21 nt, Pseudomonas aeruginosa PA01
gcgcgccauuccgcggcacuc

SEQ ID NO: 1462023 - RNA, 14 nt, Pseudomonas aeruginosa PA01
gcgcgcccaggcag

SEQ ID NO: 1462024 - RNA, 15 nt, Pseudomonas aeruginosa PA01
gcgcggcagguagcc

SEQ ID NO: 1462025 - RNA, 18 nt, Pseudomonas aeruginosa PA01
gcgcggcagguggcuggc

SEQ ID NO: 1462026 - RNA, 23 nt, Pseudomonas aeruginosa PA01
gcgcggcagguggcuggccauga

SEQ ID NO: 1462027 - RNA, 13 nt, Pseudomonas aeruginosa PA01
gcgcggcagugcu

SEQ ID NO: 1462028 - RNA, 21 nt, Pseudomonas aeruginosa PA01
gcgcggcagugcucgaucagg

SEQ ID NO: 1462029 - RNA, 14 nt, Pseudomonas aeruginosa PA01
gcgcgccccguccc

SEQ ID NO: 1462030 - RNA, 15 nt, Pseudomonas aeruginosa PA01
gcgcgccccgucccu

SEQ ID NO: 1462031 - RNA, 18 nt, Pseudomonas aeruginosa PA01
gcgcgcccagguccggcu

SEQ ID NO: 1462032 - RNA, 15 nt, Pseudomonas aeruginosa PA01
gcgcgcccaggccca

SEQ ID NO: 1462033 - RNA, 13 nt, Pseudomonas aeruginosa PA01
gcgcgcccccugg

SEQ ID NO: 1462034 - RNA, 16 nt, Pseudomonas aeruginosa PA01
gcgcgcccccuggccg

SEQ ID NO: 1462035 - RNA, 23 nt, Pseudomonas aeruginosa PA01
gcgcggcauagaugccggccucg

SEQ ID NO: 1462036 - RNA, 17 nt, Pseudomonas aeruginosa PA01
gcgcggcauagcgcagc

SEQ ID NO: 1462037 - RNA, 21 nt, Pseudomonas aeruginosa PA01
gcgcggccacuucguccggcc

SEQ ID NO: 1462038 - RNA, 12 nt, Pseudomonas aeruginosa PA01
gcgcggccagcg

SEQ ID NO: 1462039 - RNA, 13 nt, Pseudomonas aeruginosa PA01
gcgcggcccacca

SEQ ID NO: 1462040 - RNA, 15 nt, Pseudomonas aeruginosa PA01
gcgcggcccaccaga

SEQ ID NO: 1462041 - RNA, 16 nt, Pseudomonas aeruginosa PA01
gcgcggccagcgcggc

SEQ ID NO: 1462042 - RNA, 18 nt, Pseudomonas aeruginosa PA01
gcgcggccaguucggggu

SEQ ID NO: 1462043 - RNA, 15 nt, Pseudomonas aeruginosa PA01
gcgcggcgagggcgc

SEQ ID NO: 1462044 - RNA, 17 nt, Pseudomonas aeruginosa PA01
gcgcggcgagggcgccg

SEQ ID NO: 1462045 - RNA, 20 nt, Pseudomonas aeruginosa PA01
gcgcggcgaguugcgcgagg

SEQ ID NO: 1462046 - RNA, 13 nt, Pseudomonas aeruginosa PA01
gcgcggcgacgau

SEQ ID NO: 1462047 - RNA, 15 nt, Pseudomonas aeruginosa PA01
gcgcggcgcacugag

SEQ ID NO: 1462048 - RNA, 15 nt, Pseudomonas aeruginosa PA01
gcgcggcgcagccag

SEQ ID NO: 1462049 - RNA, 13 nt, Pseudomonas aeruginosa PA01
gcgcggcgccagc

SEQ ID NO: 1462050 - RNA, 17 nt, Pseudomonas aeruginosa PA01
gcgcggcgcaggcgaug

SEQ ID NO: 1462051 - RNA, 12 nt, Pseudomonas aeruginosa PA01
gcgcggcgccgg

SEQ ID NO: 1462052 - RNA, 13 nt, Pseudomonas aeruginosa PA01
gcgcggcgcccca

SEQ ID NO: 1462053 - RNA, 18 nt, Pseudomonas aeruginosa PA01
gcgcggcgccccaggcgc

SEQ ID NO: 1462054 - RNA, 16 nt, Pseudomonas aeruginosa PA01
gcgcggcgcuuggcga

SEQ ID NO: 1462055 - RNA, 19 nt, Pseudomonas aeruginosa PA01
gcgcggcggacaggcagcc

SEQ ID NO: 1462056 - RNA, 16 nt, Pseudomonas aeruginosa PA01
gcgcggccggccacgc

SEQ ID NO: 1462057 - RNA, 12 nt, Pseudomonas aeruginosa PA01
gcgcggccgugc

SEQ ID NO: 1462058 - RNA, 15 nt, Pseudomonas aeruginosa PA01
gcgcggccgugccuc

SEQ ID NO: 1462059 - RNA, 13 nt, Pseudomonas aeruginosa PA01
gcgcggccugcgc

SEQ ID NO: 1462060 - RNA, 15 nt, Pseudomonas aeruginosa PA01
gcgcggccugcgccg

SEQ ID NO: 1462061 - RNA, 19 nt, Pseudomonas aeruginosa PA01
gcgcggccugcgccggacc

SEQ ID NO: 1462062 - RNA, 23 nt, Pseudomonas aeruginosa PA01
gcgcggcgaagguggcgaccugg

SEQ ID NO: 1462063 - RNA, 15 nt, Pseudomonas aeruginosa PA01
gcgcggccuucagcg

SEQ ID NO: 1462064 - RNA, 19 nt, Pseudomonas aeruginosa PA01
gcgcgguuucgcagcgcuc

SEQ ID NO: 1462065 - RNA, 15 nt, Pseudomonas aeruginosa PA01
gcgcgguugccgcug

SEQ ID NO: 1462066 - RNA, 20 nt, Pseudomonas aeruginosa PA01
gcgcgguugccgcugcggcg

SEQ ID NO: 1462067 - RNA, 19 nt, Pseudomonas aeruginosa PA01
gcgcgguuauccgccggug

SEQ ID NO: 1462068 - RNA, 17 nt, Pseudomonas aeruginosa PA01
gcgcguccaccuggcgg

SEQ ID NO: 1462069 - RNA, 18 nt, Pseudomonas aeruginosa PA01
gcgcguccaccuggcggc

SEQ ID NO: 1462070 - RNA, 19 nt, Pseudomonas aeruginosa PA01
gcgcguccaccuggcggcu

SEQ ID NO: 1462071 - RNA, 19 nt, Pseudomonas aeruginosa PA01
gcgcgguaggugaugcggc

SEQ ID NO: 1462072 - RNA, 22 nt, Pseudomonas aeruginosa PA01
gcgcgguaggugaugcggcccu

SEQ ID NO: 1462073 - RNA, 14 nt, Pseudomonas aeruginosa PA01
gcgcggucaccagg

SEQ ID NO: 1462074 - RNA, 15 nt, Pseudomonas aeruginosa PA01
gcgcggucaccaggg

SEQ ID NO: 1462075 - RNA, 21 nt, Pseudomonas aeruginosa PA01
gcgcggucaccagggucacgc

SEQ ID NO: 1462076 - RNA, 22 nt, Pseudomonas aeruginosa PA01
gcgcggucaccagggucacgcc

SEQ ID NO: 1462077 - RNA, 23 nt, Pseudomonas aeruginosa PA01
gcgcggucacccauucgaugccg

SEQ ID NO: 1462078 - RNA, 17 nt, Pseudomonas aeruginosa PA01
gcgcggggcgaggucgg

SEQ ID NO: 1462079 - RNA, 19 nt, Pseudomonas aeruginosa PA01
gcgcggggcgaggucggcc

SEQ ID NO: 1462080 - RNA, 14 nt, Pseudomonas aeruginosa PA01
gcgcggggcgcgcu

SEQ ID NO: 1462081 - RNA, 12 nt, Pseudomonas aeruginosa PA01
gcgcgguggugg

SEQ ID NO: 1462082 - RNA, 16 nt, Pseudomonas aeruginosa PA01
gcgcggucccuggauc

SEQ ID NO: 1462083 - RNA, 15 nt, Pseudomonas aeruginosa PA01
gcgcgguccgcgugg

SEQ ID NO: 1462084 - RNA, 19 nt, Pseudomonas aeruginosa PA01
gcgcggucgagcagcgccg

SEQ ID NO: 1462085 - RNA, 20 nt, Pseudomonas aeruginosa PA01
gcgcggucgagcucggccag

SEQ ID NO: 1462086 - RNA, 21 nt, Pseudomonas aeruginosa PA01
gcgcggucgagcucggccagg

SEQ ID NO: 1462087 - RNA, 16 nt, Pseudomonas aeruginosa PA01
gcgcgguaucccugga

SEQ ID NO: 1462088 - RNA, 17 nt, Pseudomonas aeruginosa PA01
gcgcgguaucccuggaa

SEQ ID NO: 1462089 - RNA, 21 nt, Pseudomonas aeruginosa PA01
gcgcggcguggccggcgacca

SEQ ID NO: 1462090 - RNA, 14 nt, Pseudomonas aeruginosa PA01
gcgcggcgucggcg

SEQ ID NO: 1462091 - RNA, 16 nt, Pseudomonas aeruginosa PA01
gcgcggcgucggcgaa

SEQ ID NO: 1462092 - RNA, 13 nt, Pseudomonas aeruginosa PA01
gcgcggcguucau

SEQ ID NO: 1462093 - RNA, 15 nt, Pseudomonas aeruginosa PA01
gcgcggcguucgccc

SEQ ID NO: 1462094 - RNA, 14 nt, Pseudomonas aeruginosa PA01
gcgcggcgucgacc

SEQ ID NO: 1462095 - RNA, 21 nt, Pseudomonas aeruginosa PA01
gcgcggcgucgaccacggccu

SEQ ID NO: 1462096 - RNA, 14 nt, Pseudomonas aeruginosa PA01
gcgcggcggugcag

SEQ ID NO: 1462097 - RNA, 20 nt, Pseudomonas aeruginosa PA01
gcgcggcuacccucucccca

SEQ ID NO: 1462098 - RNA, 22 nt, Pseudomonas aeruginosa PA01
gcgcggcuacccucuccccaac

SEQ ID NO: 1462099 - RNA, 18 nt, Pseudomonas aeruginosa PA01
gcgcgggccuucaggcug

SEQ ID NO: 1462100 - RNA, 22 nt, Pseudomonas aeruginosa PA01
gcgcgggccuucgccuucggcg

SEQ ID NO: 1462101 - RNA, 13 nt, Pseudomonas aeruginosa PA01
gcgcgggccggcg

SEQ ID NO: 1462102 - RNA, 13 nt, Pseudomonas aeruginosa PA01
gcgcgggcuggcc

SEQ ID NO: 1462103 - RNA, 13 nt, Pseudomonas aeruginosa PA01
gcgcggggccccg

SEQ ID NO: 1462104 - RNA, 22 nt, Pseudomonas aeruginosa PA01
gcgcggggcccggcuccagccg

SEQ ID NO: 1462105 - RNA, 15 nt, Pseudomonas aeruginosa PA01
gcgcgggcgcgcgcc

SEQ ID NO: 1462106 - RNA, 17 nt, Pseudomonas aeruginosa PA01
gcgcgggcggcggcgcg

SEQ ID NO: 1462107 - RNA, 18 nt, Pseudomonas aeruginosa PA01
gcgcgggcggcggcgcgg

SEQ ID NO: 1462108 - RNA, 14 nt, Pseudomonas aeruginosa PA01
gcgcgggcgccgau

SEQ ID NO: 1462109 - RNA, 13 nt, Pseudomonas aeruginosa PA01
gcgcggcguacca

SEQ ID NO: 1462110 - RNA, 17 nt, Pseudomonas aeruginosa PA01
gcgcggcguaccagccg

SEQ ID NO: 1462111 - RNA, 17 nt, Pseudomonas aeruginosa PA01
gcgcggcguaccuucga

SEQ ID NO: 1462112 - RNA, 15 nt, Pseudomonas aeruginosa PA01
gcgcggcggguggcg

SEQ ID NO: 1462113 - RNA, 16 nt, Pseudomonas aeruginosa PA01
gcgcggcggguggcgc

SEQ ID NO: 1462114 - RNA, 15 nt, Pseudomonas aeruginosa PA01
gcgcggcggcggcca

SEQ ID NO: 1462115 - RNA, 17 nt, Pseudomonas aeruginosa PA01
gcgcggcggcggccagc

SEQ ID NO: 1462116 - RNA, 17 nt, Pseudomonas aeruginosa PA01
gcgcggcggcggccgca

SEQ ID NO: 1462117 - RNA, 13 nt, Pseudomonas aeruginosa PA01
gcgcggcggcgcg

SEQ ID NO: 1462118 - RNA, 15 nt, Pseudomonas aeruginosa PA01
gcgcggcggcgcgga

SEQ ID NO: 1462119 - RNA, 20 nt, Pseudomonas aeruginosa PA01
gcgcggcgcguuccgggucg

SEQ ID NO: 1462120 - RNA, 15 nt, Pseudomonas aeruginosa PA01
gcgcggcgcuccagg

SEQ ID NO: 1462121 - RNA, 13 nt, Pseudomonas aeruginosa PA01
gcgguacagcccc

SEQ ID NO: 1462122 - RNA, 15 nt, Pseudomonas aeruginosa PA01
gcgguacagccccca

SEQ ID NO: 1462123 - RNA, 18 nt, Pseudomonas aeruginosa PA01
gcgguacagcccccaggc

SEQ ID NO: 1462124 - RNA, 15 nt, Pseudomonas aeruginosa PA01
gcgguaccagcagcg

SEQ ID NO: 1462125 - RNA, 16 nt, Pseudomonas aeruginosa PA01
gcgguaccagcagcgc

SEQ ID NO: 1462126 - RNA, 20 nt, Pseudomonas aeruginosa PA01
gcgguaccagcagcgccgaa

SEQ ID NO: 1462127 - RNA, 14 nt, Pseudomonas aeruginosa PA01
gcgguaccagcgca

SEQ ID NO: 1462128 - RNA, 15 nt, Pseudomonas aeruginosa PA01
gcgguaccagcgcac

SEQ ID NO: 1462129 - RNA, 19 nt, Pseudomonas aeruginosa PA01
gcgguaccagcgcaccagg

SEQ ID NO: 1462130 - RNA, 22 nt, Pseudomonas aeruginosa PA01
gcgguaccagcgcaccaggguc

SEQ ID NO: 1462131 - RNA, 19 nt, Pseudomonas aeruginosa PA01
gcgguacgcccuccagcac

SEQ ID NO: 1462132 - RNA, 23 nt, Pseudomonas aeruginosa PA01
gcgguacuccggguugaccgcca

SEQ ID NO: 1462133 - RNA, 16 nt, Pseudomonas aeruginosa PA01
gcgguaccgggccagg

SEQ ID NO: 1462134 - RNA, 15 nt, Pseudomonas aeruginosa PA01
gcgguacgccgcgcu

SEQ ID NO: 1462135 - RNA, 16 nt, Pseudomonas aeruginosa PA01
gcgguacgcugcaugu

SEQ ID NO: 1462136 - RNA, 15 nt, Pseudomonas aeruginosa PA01
gcgguagcgccgcgc

SEQ ID NO: 1462137 - RNA, 17 nt, Pseudomonas aeruginosa PA01
gcgguacccgccggcca

SEQ ID NO: 1462138 - RNA, 12 nt, Pseudomonas aeruginosa PA01
gcgguagccgag

SEQ ID NO: 1462139 - RNA, 17 nt, Pseudomonas aeruginosa PA01
gcgguagcgggccagca

SEQ ID NO: 1462140 - RNA, 15 nt, Pseudomonas aeruginosa PA01
gcgguagcuccaggc

SEQ ID NO: 1462141 - RNA, 16 nt, Pseudomonas aeruginosa PA01
gcgguagcuccaggcc

SEQ ID NO: 1462142 - RNA, 17 nt, Pseudomonas aeruginosa PA01
gcgguagcuccaggccg

SEQ ID NO: 1462143 - RNA, 18 nt, Pseudomonas aeruginosa PA01
gcgguagcuccaggccga

SEQ ID NO: 1462144 - RNA, 21 nt, Pseudomonas aeruginosa PA01
gcgguagcuccaggccgaaga

SEQ ID NO: 1462145 - RNA, 15 nt, Pseudomonas aeruginosa PA01
gcgguagcugcgcag

SEQ ID NO: 1462146 - RNA, 21 nt, Pseudomonas aeruginosa PA01
gcgguagcugcgcagggcgcc

SEQ ID NO: 1462147 - RNA, 13 nt, Pseudomonas aeruginosa PA01
gcgguagaacagg

SEQ ID NO: 1462148 - RNA, 18 nt, Pseudomonas aeruginosa PA01
gcgguagacauucagcag

SEQ ID NO: 1462149 - RNA, 13 nt, Pseudomonas aeruginosa PA01
gcgguagggaucg

SEQ ID NO: 1462150 - RNA, 19 nt, Pseudomonas aeruginosa PA01
gcgguagggaucgucgcca

SEQ ID NO: 1462151 - RNA, 21 nt, Pseudomonas aeruginosa PA01
gcgguagggaucgucgccaag

SEQ ID NO: 1462152 - RNA, 13 nt, Pseudomonas aeruginosa PA01
gcgguaggucagc

SEQ ID NO: 1462153 - RNA, 16 nt, Pseudomonas aeruginosa PA01
gcgguaggugagcgac

SEQ ID NO: 1462154 - RNA, 13 nt, Pseudomonas aeruginosa PA01
gcgguaggugaug

SEQ ID NO: 1462155 - RNA, 14 nt, Pseudomonas aeruginosa PA01
gcgguagcgcgaag

SEQ ID NO: 1462156 - RNA, 19 nt, Pseudomonas aeruginosa PA01
gcgguagcgcgaaggcgcc

SEQ ID NO: 1462157 - RNA, 14 nt, Pseudomonas aeruginosa PA01
gcgguaggccagcu

SEQ ID NO: 1462158 - RNA, 13 nt, Pseudomonas aeruginosa PA01
gcgguaggcgcgu

SEQ ID NO: 1462159 - RNA, 23 nt, Pseudomonas aeruginosa PA01
gcgguaguaggguucgccgacgu

SEQ ID NO: 1462160 - RNA, 17 nt, Pseudomonas aeruginosa PA01
gcgguagucgcugcugg

SEQ ID NO: 1462161 - RNA, 15 nt, Pseudomonas aeruginosa PA01
gcgguagugggcgag

SEQ ID NO: 1462162 - RNA, 20 nt, Pseudomonas aeruginosa PA01
gcggucgauguccugggcca

SEQ ID NO: 1462163 - RNA, 21 nt, Pseudomonas aeruginosa PA01
gcggucgauguccugggccac

SEQ ID NO: 1462164 - RNA, 17 nt, Pseudomonas aeruginosa PA01
gcggucgaugucgcggc

SEQ ID NO: 1462165 - RNA, 14 nt, Pseudomonas aeruginosa PA01
gcggucccuggauc

SEQ ID NO: 1462166 - RNA, 20 nt, Pseudomonas aeruginosa PA01
gcggucccuucgugggccug

SEQ ID NO: 1462167 - RNA, 24 nt, Pseudomonas aeruginosa PA01
gcggucccuucgugggccugcucg

SEQ ID NO: 1462168 - RNA, 14 nt, Pseudomonas aeruginosa PA01
gcggucgccgccgg

SEQ ID NO: 1462169 - RNA, 17 nt, Pseudomonas aeruginosa PA01
gcggucgccgccggcga

SEQ ID NO: 1462170 - RNA, 18 nt, Pseudomonas aeruginosa PA01
gcggucgccgccggcgaa

SEQ ID NO: 1462171 - RNA, 22 nt, Pseudomonas aeruginosa PA01
gcggucgccgccggcgaacagc

SEQ ID NO: 1462172 - RNA, 13 nt, Pseudomonas aeruginosa PA01
gcggucgccgaac

SEQ ID NO: 1462173 - RNA, 16 nt, Pseudomonas aeruginosa PA01
gcggucgccgaacagc

SEQ ID NO: 1462174 - RNA, 17 nt, Pseudomonas aeruginosa PA01
gcggucgccgaacagcc

SEQ ID NO: 1462175 - RNA, 14 nt, Pseudomonas aeruginosa PA01
gcggucgccggcgc

SEQ ID NO: 1462176 - RNA, 15 nt, Pseudomonas aeruginosa PA01
gcggucgcgaucugc

SEQ ID NO: 1462177 - RNA, 13 nt, Pseudomonas aeruginosa PA01
gcgguccagccag

SEQ ID NO: 1462178 - RNA, 15 nt, Pseudomonas aeruginosa PA01
gcgguccagcgagcg

SEQ ID NO: 1462179 - RNA, 18 nt, Pseudomonas aeruginosa PA01
gcgguccagcgagcgggc

SEQ ID NO: 1462180 - RNA, 20 nt, Pseudomonas aeruginosa PA01
gcgguccagcgagcgggcga

SEQ ID NO: 1462181 - RNA, 23 nt, Pseudomonas aeruginosa PA01
gcggucccagaccagcagcggca

SEQ ID NO: 1462182 - RNA, 16 nt, Pseudomonas aeruginosa PA01
gcggucccaucagcag

SEQ ID NO: 1462183 - RNA, 14 nt, Pseudomonas aeruginosa PA01
gcgguccaggggcc

SEQ ID NO: 1462184 - RNA, 20 nt, Pseudomonas aeruginosa PA01
gcgguccaggggccgaugcc

SEQ ID NO: 1462185 - RNA, 16 nt, Pseudomonas aeruginosa PA01
gcgguccaucccuucg

SEQ ID NO: 1462186 - RNA, 15 nt, Pseudomonas aeruginosa PA01
gcgguaugccgcagg

SEQ ID NO: 1462187 - RNA, 16 nt, Pseudomonas aeruginosa PA01
gcgguaugccgcaggc

SEQ ID NO: 1462188 - RNA, 13 nt, Pseudomonas aeruginosa PA01
gcgguaugccgga

SEQ ID NO: 1462189 - RNA, 22 nt, Pseudomonas aeruginosa PA01
gcgguauucuccagcaggcucu

SEQ ID NO: 1462190 - RNA, 13 nt, Pseudomonas aeruginosa PA01
gcggugccgcgca

SEQ ID NO: 1462191 - RNA, 15 nt, Pseudomonas aeruginosa PA01
gcggugggcuccagc

SEQ ID NO: 1462192 - RNA, 15 nt, Pseudomonas aeruginosa PA01
gcgguggggccgccg

SEQ ID NO: 1462193 - RNA, 16 nt, Pseudomonas aeruginosa PA01
gcgguggggccgccga

SEQ ID NO: 1462194 - RNA, 17 nt, Pseudomonas aeruginosa PA01
gcgguggggccgccgau

SEQ ID NO: 1462195 - RNA, 19 nt, Pseudomonas aeruginosa PA01
gcggugggucacggugacg

SEQ ID NO: 1462196 - RNA, 19 nt, Pseudomonas aeruginosa PA01
gcgguguuuccgucguggc

SEQ ID NO: 1462197 - RNA, 20 nt, Pseudomonas aeruginosa PA01
gcgguguuuccgucguggcg

SEQ ID NO: 1462198 - RNA, 15 nt, Pseudomonas aeruginosa PA01
gcgguuagccggcga

SEQ ID NO: 1462199 - RNA, 18 nt, Pseudomonas aeruginosa PA01
gcgguuagccggcgauca

SEQ ID NO: 1462200 - RNA, 21 nt, Pseudomonas aeruginosa PA01
gcgguuauccgccgccgggcu

SEQ ID NO: 1462201 - RNA, 15 nt, Pseudomonas aeruginosa PA01
gcgguuauccgccgg

SEQ ID NO: 1462202 - RNA, 21 nt, Pseudomonas aeruginosa PA01
gcgguuauucgccccagcggu

SEQ ID NO: 1462203 - RNA, 20 nt, Pseudomonas aeruginosa PA01
gcgguuauucgcccuaccgc

SEQ ID NO: 1462204 - RNA, 14 nt, Pseudomonas aeruginosa PA01
gcggucggaucgga

SEQ ID NO: 1462205 - RNA, 17 nt, Pseudomonas aeruginosa PA01
gcggucgcggaccucca

SEQ ID NO: 1462206 - RNA, 18 nt, Pseudomonas aeruginosa PA01
gcggugaaaccggcaagc

SEQ ID NO: 1462207 - RNA, 20 nt, Pseudomonas aeruginosa PA01
gcggucuucgcguuggcggu

SEQ ID NO: 1462208 - RNA, 22 nt, Pseudomonas aeruginosa PA01
gcggucuucgcguuggcggugc

SEQ ID NO: 1462209 - RNA, 20 nt, Pseudomonas aeruginosa PA01
gcggucggaaagcagggcga

SEQ ID NO: 1462210 - RNA, 22 nt, Pseudomonas aeruginosa PA01
gcggucuucaucaccuugcccg

SEQ ID NO: 1462211 - RNA, 22 nt, Pseudomonas aeruginosa PA01
gcggucuucccguaaggccagg

SEQ ID NO: 1462212 - RNA, 17 nt, Pseudomonas aeruginosa PA01
gcggucuuccgccgacu

SEQ ID NO: 1462213 - RNA, 22 nt, Pseudomonas aeruginosa PA01
gcggucuuccgccgacugcaac

SEQ ID NO: 1462214 - RNA, 15 nt, Pseudomonas aeruginosa PA01
gcggugaccagcggc

SEQ ID NO: 1462215 - RNA, 13 nt, Pseudomonas aeruginosa PA01
gcgggugcgcagg

SEQ ID NO: 1462216 - RNA, 15 nt, Pseudomonas aeruginosa PA01
gcgggugcgcaggcu

SEQ ID NO: 1462217 - RNA, 16 nt, Pseudomonas aeruginosa PA01
gcgggugcgcaggcug

SEQ ID NO: 1462218 - RNA, 17 nt, Pseudomonas aeruginosa PA01
gcgggugcgcaggcugc

SEQ ID NO: 1462219 - RNA, 16 nt, Pseudomonas aeruginosa PA01
gcgggucuugcgcagg

SEQ ID NO: 1462220 - RNA, 16 nt, Pseudomonas aeruginosa PA01
gcgggucuucaggccg

SEQ ID NO: 1462221 - RNA, 21 nt, Pseudomonas aeruginosa PA01
gcgggucgucgaagcgcagca

SEQ ID NO: 1462222 - RNA, 17 nt, Pseudomonas aeruginosa PA01
gcgggucugcucgcgcu

SEQ ID NO: 1462223 - RNA, 19 nt, Pseudomonas aeruginosa PA01
gcgggucugcucggcgccc

SEQ ID NO: 1462224 - RNA, 19 nt, Pseudomonas aeruginosa PA01
gcgggucguacaccgcgcg

SEQ ID NO: 1462225 - RNA, 13 nt, Pseudomonas aeruginosa PA01
gcgggucggcgga

SEQ ID NO: 1462226 - RNA, 17 nt, Pseudomonas aeruginosa PA01
gcgggucauagucggug

SEQ ID NO: 1462227 - RNA, 19 nt, Pseudomonas aeruginosa PA01
gcgggucaucggcccgacg

SEQ ID NO: 1462228 - RNA, 22 nt, Pseudomonas aeruginosa PA01
gcgggucagcagcaccgcgagc

SEQ ID NO: 1462229 - RNA, 19 nt, Pseudomonas aeruginosa PA01
gcggguccuggguggcgac

SEQ ID NO: 1462230 - RNA, 13 nt, Pseudomonas aeruginosa PA01
gcggguccgcguc

SEQ ID NO: 1462231 - RNA, 22 nt, Pseudomonas aeruginosa PA01
gcggguccgcgucacggacccg

SEQ ID NO: 1462232 - RNA, 15 nt, Pseudomonas aeruginosa PA01
gcgggucgcggcugg

SEQ ID NO: 1462233 - RNA, 19 nt, Pseudomonas aeruginosa PA01
gcgggucgcggcuggccgc

SEQ ID NO: 1462234 - RNA, 17 nt, Pseudomonas aeruginosa PA01
gcgggucgaucaggcgc

SEQ ID NO: 1462235 - RNA, 18 nt, Pseudomonas aeruginosa PA01
gcgggucgaucaggcgca

SEQ ID NO: 1462236 - RNA, 16 nt, Pseudomonas aeruginosa PA01
gcgggucgagccaggc

SEQ ID NO: 1462237 - RNA, 16 nt, Pseudomonas aeruginosa PA01
gcgggucgaggccgaa

SEQ ID NO: 1462238 - RNA, 17 nt, Pseudomonas aeruginosa PA01
gcgggucgaggccgaaa

SEQ ID NO: 1462239 - RNA, 19 nt, Pseudomonas aeruginosa PA01
gcgggucucgaucagcgcc

SEQ ID NO: 1462240 - RNA, 20 nt, Pseudomonas aeruginosa PA01
gcgggucucgaucagcgccg

SEQ ID NO: 1462241 - RNA, 22 nt, Pseudomonas aeruginosa PA01
gcgggucucgaucagcgccggg

SEQ ID NO: 1462242 - RNA, 14 nt, Pseudomonas aeruginosa PA01
gcggguugcccggc

SEQ ID NO: 1462243 - RNA, 16 nt, Pseudomonas aeruginosa PA01
gcggguuggucggcac

SEQ ID NO: 1462244 - RNA, 20 nt, Pseudomonas aeruginosa PA01
gcggguuggucggcaccagg

SEQ ID NO: 1462245 - RNA, 22 nt, Pseudomonas aeruginosa PA01
gcggguuuuuuuaugccucggc

SEQ ID NO: 1462246 - RNA, 14 nt, Pseudomonas aeruginosa PA01
gcgggugcguggug

SEQ ID NO: 1462247 - RNA, 23 nt, Pseudomonas aeruginosa PA01
gcgggugcguggugcauccgccg

SEQ ID NO: 1462248 - RNA, 15 nt, Pseudomonas aeruginosa PA01
gcggguggucgccgc

SEQ ID NO: 1462249 - RNA, 21 nt, Pseudomonas aeruginosa PA01
gcggguggucgccgcccacgc

SEQ ID NO: 1462250 - RNA, 23 nt, Pseudomonas aeruginosa PA01
gcggguggucuugcgcaggcggu

SEQ ID NO: 1462251 - RNA, 16 nt, Pseudomonas aeruginosa PA01
gcgggugucgcgacgg

SEQ ID NO: 1462252 - RNA, 18 nt, Pseudomonas aeruginosa PA01
gcgggugucgcgacggug

SEQ ID NO: 1462253 - RNA, 20 nt, Pseudomonas aeruginosa PA01
gcggguguggggaaaucggu

SEQ ID NO: 1462254 - RNA, 18 nt, Pseudomonas aeruginosa PA01
gcggguuacuucgccgau

SEQ ID NO: 1462255 - RNA, 15 nt, Pseudomonas aeruginosa PA01
gcggguucgugccag

SEQ ID NO: 1462256 - RNA, 19 nt, Pseudomonas aeruginosa PA01
gcggguucgagucccgucc

SEQ ID NO: 1462257 - RNA, 21 nt, Pseudomonas aeruginosa PA01
gcggguucgagucccguccgc

SEQ ID NO: 1462258 - RNA, 15 nt, Pseudomonas aeruginosa PA01
gcggguucggcgaga

SEQ ID NO: 1462259 - RNA, 13 nt, Pseudomonas aeruginosa PA01
gcggguucggcgu

SEQ ID NO: 1462260 - RNA, 20 nt, Pseudomonas aeruginosa PA01
gcggguucccugcgccucga

SEQ ID NO: 1462261 - RNA, 23 nt, Pseudomonas aeruginosa PA01
gcggguucccugcgccucgaccu

SEQ ID NO: 1462262 - RNA, 19 nt, Pseudomonas aeruginosa PA01
gcggguuccucacggcgca

SEQ ID NO: 1462263 - RNA, 23 nt, Pseudomonas aeruginosa PA01
gcggguuccucacggcgcagccg

SEQ ID NO: 1462264 - RNA, 18 nt, Pseudomonas aeruginosa PA01
gcggguucgagucccguc

SEQ ID NO: 1462265 - RNA, 15 nt, Pseudomonas aeruginosa PA01
gcggguucagucggc

SEQ ID NO: 1462266 - RNA, 23 nt, Pseudomonas aeruginosa PA01
gcggguucagucggccaggcgcc

SEQ ID NO: 1462267 - RNA, 14 nt, Pseudomonas aeruginosa PA01
gcggggucgcgccg

SEQ ID NO: 1462268 - RNA, 15 nt, Pseudomonas aeruginosa PA01
gcggggucgcgccgg

SEQ ID NO: 1462269 - RNA, 17 nt, Pseudomonas aeruginosa PA01
gcggggucgcgccggug

SEQ ID NO: 1462270 - RNA, 18 nt, Pseudomonas aeruginosa PA01
gcggggucgcgccggugg

SEQ ID NO: 1462271 - RNA, 14 nt, Pseudomonas aeruginosa PA01
gcggggucgggcag

SEQ ID NO: 1462272 - RNA, 19 nt, Pseudomonas aeruginosa PA01
gcgggguagggguggccag

SEQ ID NO: 1462273 - RNA, 22 nt, Pseudomonas aeruginosa PA01
gcgggguagggguggccaggcg

SEQ ID NO: 1462274 - RNA, 24 nt, Pseudomonas aeruginosa PA01
gcgggguagggguggccaggcgca

SEQ ID NO: 1462275 - RNA, 18 nt, Pseudomonas aeruginosa PA01
gcgggguggcgcggacga

SEQ ID NO: 1462276 - RNA, 22 nt, Pseudomonas aeruginosa PA01
gcggggugagcaguucgucgau

SEQ ID NO: 1462277 - RNA, 22 nt, Pseudomonas aeruginosa PA01
gcggggucuggccggcgaucag

SEQ ID NO: 1462278 - RNA, 15 nt, Pseudomonas aeruginosa PA01
gcggggcgcgcugcg

SEQ ID NO: 1462279 - RNA, 15 nt, Pseudomonas aeruginosa PA01
gcggggcgcucgccc

SEQ ID NO: 1462280 - RNA, 17 nt, Pseudomonas aeruginosa PA01
gcggggcuuuccgucuc

SEQ ID NO: 1462281 - RNA, 22 nt, Pseudomonas aeruginosa PA01
gcggggcuuuuuuaugcgcagc

SEQ ID NO: 1462282 - RNA, 23 nt, Pseudomonas aeruginosa PA01
gcggggcuuuuuuucgccugcga

SEQ ID NO: 1462283 - RNA, 18 nt, Pseudomonas aeruginosa PA01
gcggggcguucuuuuucg

SEQ ID NO: 1462284 - RNA, 21 nt, Pseudomonas aeruginosa PA01
gcggggcguucuuuuucgcag

SEQ ID NO: 1462285 - RNA, 22 nt, Pseudomonas aeruginosa PA01
gcggguauccgccgggccgccu

SEQ ID NO: 1462286 - RNA, 19 nt, Pseudomonas aeruginosa PA01
gcgggucaccaccgggaug

SEQ ID NO: 1462287 - RNA, 18 nt, Pseudomonas aeruginosa PA01
gcgggucaccagcgccgg

SEQ ID NO: 1462288 - RNA, 16 nt, Pseudomonas aeruginosa PA01
gcgggucaccagcggg

SEQ ID NO: 1462289 - RNA, 14 nt, Pseudomonas aeruginosa PA01
gcgggucacgccga

SEQ ID NO: 1462290 - RNA, 15 nt, Pseudomonas aeruginosa PA01
gcgggucacgccgaa

SEQ ID NO: 1462291 - RNA, 16 nt, Pseudomonas aeruginosa PA01
gcgggucacgccgaag

SEQ ID NO: 1462292 - RNA, 23 nt, Pseudomonas aeruginosa PA01
gcgggucacgccgagggcgcggc

SEQ ID NO: 1462293 - RNA, 18 nt, Pseudomonas aeruginosa PA01
gcgggucagaccacgaag

SEQ ID NO: 1462294 - RNA, 20 nt, Pseudomonas aeruginosa PA01
gcggguaucgaucucgaucg

SEQ ID NO: 1462295 - RNA, 19 nt, Pseudomonas aeruginosa PA01
gcggguaguguuugcgcag

SEQ ID NO: 1462296 - RNA, 20 nt, Pseudomonas aeruginosa PA01
gcggguaguguuugcgcagg

SEQ ID NO: 1462297 - RNA, 16 nt, Pseudomonas aeruginosa PA01
gcggguauugcagacg

SEQ ID NO: 1462298 - RNA, 21 nt, Pseudomonas aeruginosa PA01
gcggguaaagcgcccgcgcau

SEQ ID NO: 1462299 - RNA, 14 nt, Pseudomonas aeruginosa PA01
gcgggcgucggcgu

SEQ ID NO: 1462300 - RNA, 15 nt, Pseudomonas aeruginosa PA01
gcgggcgucggcguc

SEQ ID NO: 1462301 - RNA, 15 nt, Pseudomonas aeruginosa PA01
gcgggcgucgucggg

SEQ ID NO: 1462302 - RNA, 21 nt, Pseudomonas aeruginosa PA01
gcgggccaucagguccaccag

SEQ ID NO: 1462303 - RNA, 15 nt, Pseudomonas aeruginosa PA01
gcgggccaggcggua

SEQ ID NO: 1462304 - RNA, 22 nt, Pseudomonas aeruginosa PA01
gcgggcgugcuccagcaccgug

SEQ ID NO: 1462305 - RNA, 17 nt, Pseudomonas aeruginosa PA01
gcgggcguuggccugga

SEQ ID NO: 1462306 - RNA, 15 nt, Pseudomonas aeruginosa PA01
gcgggcguugcgcgc

SEQ ID NO: 1462307 - RNA, 23 nt, Pseudomonas aeruginosa PA01
gcgggccaggcccuuggucaggc

SEQ ID NO: 1462308 - RNA, 14 nt, Pseudomonas aeruginosa PA01
gcgggccaggccga

SEQ ID NO: 1462309 - RNA, 17 nt, Pseudomonas aeruginosa PA01
gcgggccaggccgagcg

SEQ ID NO: 1462310 - RNA, 21 nt, Pseudomonas aeruginosa PA01
gcgggccaggccgagcgugcg

SEQ ID NO: 1462311 - RNA, 14 nt, Pseudomonas aeruginosa PA01
gcgggccagccguu

SEQ ID NO: 1462312 - RNA, 12 nt, Pseudomonas aeruginosa PA01
gcgggccagcag

SEQ ID NO: 1462313 - RNA, 21 nt, Pseudomonas aeruginosa PA01
gcggggcccggcuccagccgg

SEQ ID NO: 1462314 - RNA, 15 nt, Pseudomonas aeruginosa PA01
gcggggauggcgggc

SEQ ID NO: 1462315 - RNA, 16 nt, Pseudomonas aeruginosa PA01
gcggggaugaccgucc

SEQ ID NO: 1462316 - RNA, 20 nt, Pseudomonas aeruginosa PA01
gcggggcgcaccgccucgac

SEQ ID NO: 1462317 - RNA, 22 nt, Pseudomonas aeruginosa PA01
gcggggcgcaccgccucgaccc

SEQ ID NO: 1462318 - RNA, 21 nt, Pseudomonas aeruginosa PA01
gcgggcuaccaggaagcucgg

SEQ ID NO: 1462319 - RNA, 15 nt, Pseudomonas aeruginosa PA01
gcgggcuccgccgcc

SEQ ID NO: 1462320 - RNA, 16 nt, Pseudomonas aeruginosa PA01
gcgggcuccgccgccg

SEQ ID NO: 1462321 - RNA, 17 nt, Pseudomonas aeruginosa PA01
gcgggcuccgccgccgu

SEQ ID NO: 1462322 - RNA, 15 nt, Pseudomonas aeruginosa PA01
gcgggaacgaugccg

SEQ ID NO: 1462323 - RNA, 18 nt, Pseudomonas aeruginosa PA01
gcgggaacgaugccgcag

SEQ ID NO: 1462324 - RNA, 19 nt, Pseudomonas aeruginosa PA01
gcgggaacgaugccgcagg

SEQ ID NO: 1462325 - RNA, 18 nt, Pseudomonas aeruginosa PA01
gcggcuuuuuucauggcg

SEQ ID NO: 1462326 - RNA, 20 nt, Pseudomonas aeruginosa PA01
gcggcuuuuuucauggcggu

SEQ ID NO: 1462327 - RNA, 21 nt, Pseudomonas aeruginosa PA01
gcggcuuuuuucauggcgguc

SEQ ID NO: 1462328 - RNA, 21 nt, Pseudomonas aeruginosa PA01
gcggcuuucgguuugcgccga

SEQ ID NO: 1462329 - RNA, 17 nt, Pseudomonas aeruginosa PA01
gcgggaucgacgccgcu

SEQ ID NO: 1462330 - RNA, 21 nt, Pseudomonas aeruginosa PA01
gcgggaucgacgccgcuggcg

SEQ ID NO: 1462331 - RNA, 21 nt, Pseudomonas aeruginosa PA01
gcgggaucgaguaagugccga

SEQ ID NO: 1462332 - RNA, 21 nt, Pseudomonas aeruginosa PA01
gcgggaucuucuaccuggcgc

SEQ ID NO: 1462333 - RNA, 22 nt, Pseudomonas aeruginosa PA01
gcgggcaaccgcggcggccuca

SEQ ID NO: 1462334 - RNA, 16 nt, Pseudomonas aeruginosa PA01
gcgggauguacgccag

SEQ ID NO: 1462335 - RNA, 17 nt, Pseudomonas aeruginosa PA01
gcgggauguacgccagg

SEQ ID NO: 1462336 - RNA, 16 nt, Pseudomonas aeruginosa PA01
gcgggaugugcaccag

SEQ ID NO: 1462337 - RNA, 17 nt, Pseudomonas aeruginosa PA01
gcgggaugugcaccagc

SEQ ID NO: 1462338 - RNA, 19 nt, Pseudomonas aeruginosa PA01
gcgggauugucgccgccga

SEQ ID NO: 1462339 - RNA, 15 nt, Pseudomonas aeruginosa PA01
gcgggcaccgccagc

SEQ ID NO: 1462340 - RNA, 18 nt, Pseudomonas aeruginosa PA01
gcgggcaccgccagcccg

SEQ ID NO: 1462341 - RNA, 12 nt, Pseudomonas aeruginosa PA01
gcggcuggcagg

SEQ ID NO: 1462342 - RNA, 13 nt, Pseudomonas aeruginosa PA01
gcggcuggcaggu

SEQ ID NO: 1462343 - RNA, 15 nt, Pseudomonas aeruginosa PA01
gcggcuggcaggugc

SEQ ID NO: 1462344 - RNA, 16 nt, Pseudomonas aeruginosa PA01
gcggcuggcaggugcc

SEQ ID NO: 1462345 - RNA, 13 nt, Pseudomonas aeruginosa PA01
gcggcuggccgcg

SEQ ID NO: 1462346 - RNA, 16 nt, Pseudomonas aeruginosa PA01
gcggcuggccgccucg

SEQ ID NO: 1462347 - RNA, 22 nt, Pseudomonas aeruginosa PA01
gcggcuggccgccucgcgccgc

SEQ ID NO: 1462348 - RNA, 16 nt, Pseudomonas aeruginosa PA01
gcggcuggccgccugg

SEQ ID NO: 1462349 - RNA, 14 nt, Pseudomonas aeruginosa PA01
gcggcuggccgucg

SEQ ID NO: 1462350 - RNA, 19 nt, Pseudomonas aeruginosa PA01
gcggcuggccgucgacccg

SEQ ID NO: 1462351 - RNA, 14 nt, Pseudomonas aeruginosa PA01
gcggcuggcugaag

SEQ ID NO: 1462352 - RNA, 18 nt, Pseudomonas aeruginosa PA01
gcggcuggcugaagccgg

SEQ ID NO: 1462353 - RNA, 19 nt, Pseudomonas aeruginosa PA01
gcggcuggcugaagccggg

SEQ ID NO: 1462354 - RNA, 13 nt, Pseudomonas aeruginosa PA01
gcggcuggcugcc

SEQ ID NO: 1462355 - RNA, 14 nt, Pseudomonas aeruginosa PA01
gcggcuggcgcagg

SEQ ID NO: 1462356 - RNA, 17 nt, Pseudomonas aeruginosa PA01
gcggcuggcgcaggacc

SEQ ID NO: 1462357 - RNA, 22 nt, Pseudomonas aeruginosa PA01
gcggcuggcgcgaucggggcag

SEQ ID NO: 1462358 - RNA, 13 nt, Pseudomonas aeruginosa PA01
gcggcuggcgcgc

SEQ ID NO: 1462359 - RNA, 15 nt, Pseudomonas aeruginosa PA01
gcggcuggcgcgcgc

SEQ ID NO: 1462360 - RNA, 13 nt, Pseudomonas aeruginosa PA01
gcggcugccggug

SEQ ID NO: 1462361 - RNA, 15 nt, Pseudomonas aeruginosa PA01
gcggcugccgaggcu

SEQ ID NO: 1462362 - RNA, 14 nt, Pseudomonas aeruginosa PA01
gcggcugcgcgccg

SEQ ID NO: 1462363 - RNA, 15 nt, Pseudomonas aeruginosa PA01
gcggcugcgcgccgg

SEQ ID NO: 1462364 - RNA, 18 nt, Pseudomonas aeruginosa PA01
gcggcugcgcgccggguc

SEQ ID NO: 1462365 - RNA, 15 nt, Pseudomonas aeruginosa PA01
gcggcugcugcgccu

SEQ ID NO: 1462366 - RNA, 18 nt, Pseudomonas aeruginosa PA01
gcggcugcugcgccuggc

SEQ ID NO: 1462367 - RNA, 21 nt, Pseudomonas aeruginosa PA01
gcggcugcugcgccuggccgc

SEQ ID NO: 1462368 - RNA, 19 nt, Pseudomonas aeruginosa PA01
gcggcugcgguaggugaug

SEQ ID NO: 1462369 - RNA, 17 nt, Pseudomonas aeruginosa PA01
gcggcuguagccacggc

SEQ ID NO: 1462370 - RNA, 21 nt, Pseudomonas aeruginosa PA01
gcggcuguagcggaucaggcc

SEQ ID NO: 1462371 - RNA, 22 nt, Pseudomonas aeruginosa PA01
gcggcuguagcggaucaggccc

SEQ ID NO: 1462372 - RNA, 14 nt, Pseudomonas aeruginosa PA01
gcggcuggcgaacc

SEQ ID NO: 1462373 - RNA, 12 nt, Pseudomonas aeruginosa PA01
gcggcuucagcc

SEQ ID NO: 1462374 - RNA, 15 nt, Pseudomonas aeruginosa PA01
gcggcuucagccaga

SEQ ID NO: 1462375 - RNA, 20 nt, Pseudomonas aeruginosa PA01
gcggcuucagccagaccggc

SEQ ID NO: 1462376 - RNA, 17 nt, Pseudomonas aeruginosa PA01
gcggcuuguccuggcgc

SEQ ID NO: 1462377 - RNA, 20 nt, Pseudomonas aeruginosa PA01
gcggcuucagagcuggacga

SEQ ID NO: 1462378 - RNA, 15 nt, Pseudomonas aeruginosa PA01
gcggcggugcgccgg

SEQ ID NO: 1462379 - RNA, 19 nt, Pseudomonas aeruginosa PA01
gcggcgguuggagcgagcg

SEQ ID NO: 1462380 - RNA, 17 nt, Pseudomonas aeruginosa PA01
gcggcggucccagacca

SEQ ID NO: 1462381 - RNA, 18 nt, Pseudomonas aeruginosa PA01
gcggcggucccagaccag

SEQ ID NO: 1462382 - RNA, 19 nt, Pseudomonas aeruginosa PA01
gcggcggucccagaccagc

SEQ ID NO: 1462383 - RNA, 20 nt, Pseudomonas aeruginosa PA01
gcggcggucccagaccagca

SEQ ID NO: 1462384 - RNA, 22 nt, Pseudomonas aeruginosa PA01
gcggcggucccagaccagcagc

SEQ ID NO: 1462385 - RNA, 17 nt, Pseudomonas aeruginosa PA01
gcggcggucaucgcgcc

SEQ ID NO: 1462386 - RNA, 21 nt, Pseudomonas aeruginosa PA01
gcggcggucaucgcgccgccg

SEQ ID NO: 1462387 - RNA, 15 nt, Pseudomonas aeruginosa PA01
gcggcggacgcaggc

SEQ ID NO: 1462388 - RNA, 14 nt, Pseudomonas aeruginosa PA01
gcggcggaggccua

SEQ ID NO: 1462389 - RNA, 14 nt, Pseudomonas aeruginosa PA01
gcggcgguagccga

SEQ ID NO: 1462390 - RNA, 15 nt, Pseudomonas aeruginosa PA01
gcggcgguagccgag

SEQ ID NO: 1462391 - RNA, 14 nt, Pseudomonas aeruginosa PA01
gcggcggaugccgg

SEQ ID NO: 1462392 - RNA, 17 nt, Pseudomonas aeruginosa PA01
gcggcgguagcuccagg

SEQ ID NO: 1462393 - RNA, 23 nt, Pseudomonas aeruginosa PA01
gcggcgguagcuccaggccgaag

SEQ ID NO: 1462394 - RNA, 21 nt, Pseudomonas aeruginosa PA01
gcggcggaacuugucgccgcu

SEQ ID NO: 1462395 - RNA, 21 nt, Pseudomonas aeruginosa PA01
gcggcggaagaauaccgccag

SEQ ID NO: 1462396 - RNA, 22 nt, Pseudomonas aeruginosa PA01
gcggcggaagaauaccgccagc

SEQ ID NO: 1462397 - RNA, 14 nt, Pseudomonas aeruginosa PA01
gcggcggaaggcgg

SEQ ID NO: 1462398 - RNA, 17 nt, Pseudomonas aeruginosa PA01
gcggcggaaggcggcgu

SEQ ID NO: 1462399 - RNA, 19 nt, Pseudomonas aeruginosa PA01
gcggcggacaggcagccgg

SEQ ID NO: 1462400 - RNA, 22 nt, Pseudomonas aeruginosa PA01
gcggcggacaggcagccggcca

SEQ ID NO: 1462401 - RNA, 14 nt, Pseudomonas aeruginosa PA01
gcggcggaccuccg

SEQ ID NO: 1462402 - RNA, 20 nt, Pseudomonas aeruginosa PA01
gcggcggaccuccgccaggu

SEQ ID NO: 1462403 - RNA, 15 nt, Pseudomonas aeruginosa PA01
gcggcggacgacgaa

SEQ ID NO: 1462404 - RNA, 16 nt, Pseudomonas aeruginosa PA01
gcggcggacgacgaag

SEQ ID NO: 1462405 - RNA, 17 nt, Pseudomonas aeruginosa PA01
gcggcggagucguagcg

SEQ ID NO: 1462406 - RNA, 19 nt, Pseudomonas aeruginosa PA01
gcggcggauaaccgcgagc

SEQ ID NO: 1462407 - RNA, 22 nt, Pseudomonas aeruginosa PA01
gcggcggauaaccgcgagcggu

SEQ ID NO: 1462408 - RNA, 14 nt, Pseudomonas aeruginosa PA01
gcggcggauaacgc

SEQ ID NO: 1462409 - RNA, 17 nt, Pseudomonas aeruginosa PA01
gcggcggauaacgccug

SEQ ID NO: 1462410 - RNA, 20 nt, Pseudomonas aeruginosa PA01
gcggcggauacaggcgcagc

SEQ ID NO: 1462411 - RNA, 22 nt, Pseudomonas aeruginosa PA01
gcggcggauacaggcgcagcag

SEQ ID NO: 1462412 - RNA, 13 nt, Pseudomonas aeruginosa PA01
gcggcgucgucgc

SEQ ID NO: 1462413 - RNA, 15 nt, Pseudomonas aeruginosa PA01
gcggcuacccucucc

SEQ ID NO: 1462414 - RNA, 16 nt, Pseudomonas aeruginosa PA01
gcggcuacccucuccc

SEQ ID NO: 1462415 - RNA, 13 nt, Pseudomonas aeruginosa PA01
gcggcgucggcga

SEQ ID NO: 1462416 - RNA, 16 nt, Pseudomonas aeruginosa PA01
gcggcgucggcgaagc

SEQ ID NO: 1462417 - RNA, 16 nt, Pseudomonas aeruginosa PA01
gcggcuaucgaugauc

SEQ ID NO: 1462418 - RNA, 16 nt, Pseudomonas aeruginosa PA01
gcggcuacucgcccga

SEQ ID NO: 1462419 - RNA, 20 nt, Pseudomonas aeruginosa PA01
gcggcuccagccgcugcagg

SEQ ID NO: 1462420 - RNA, 20 nt, Pseudomonas aeruginosa PA01
gcggcugcagggccagggag

SEQ ID NO: 1462421 - RNA, 15 nt, Pseudomonas aeruginosa PA01
gcggcugaucggccg

SEQ ID NO: 1462422 - RNA, 14 nt, Pseudomonas aeruginosa PA01
gcggcugaugccgc

SEQ ID NO: 1462423 - RNA, 23 nt, Pseudomonas aeruginosa PA01
gcggcucccuuuuuucaugggca

SEQ ID NO: 1462424 - RNA, 15 nt, Pseudomonas aeruginosa PA01
gcggcucuggcgcag

SEQ ID NO: 1462425 - RNA, 16 nt, Pseudomonas aeruginosa PA01
gcggcucuggcgcagg

SEQ ID NO: 1462426 - RNA, 13 nt, Pseudomonas aeruginosa PA01
gcggcucugguca

SEQ ID NO: 1462427 - RNA, 18 nt, Pseudomonas aeruginosa PA01
gcggcucuuuccggguca

SEQ ID NO: 1462428 - RNA, 17 nt, Pseudomonas aeruginosa PA01
gcggcugaaggccgaac

SEQ ID NO: 1462429 - RNA, 20 nt, Pseudomonas aeruginosa PA01
gcggcugaaggugagauggu

SEQ ID NO: 1462430 - RNA, 21 nt, Pseudomonas aeruginosa PA01
gcggcugaaggugagaugguc

SEQ ID NO: 1462431 - RNA, 19 nt, Pseudomonas aeruginosa PA01
gcggcgaccugcggcaagu

SEQ ID NO: 1462432 - RNA, 12 nt, Pseudomonas aeruginosa PA01
gcggcgaccugg

SEQ ID NO: 1462433 - RNA, 14 nt, Pseudomonas aeruginosa PA01
gcggcgaccugggc

SEQ ID NO: 1462434 - RNA, 20 nt, Pseudomonas aeruginosa PA01
gcggcgaccugggcgucgcu

SEQ ID NO: 1462435 - RNA, 17 nt, Pseudomonas aeruginosa PA01
gcggcgacgaagcccag

SEQ ID NO: 1462436 - RNA, 18 nt, Pseudomonas aeruginosa PA01
gcggcgacgaagcccagg

SEQ ID NO: 1462437 - RNA, 20 nt, Pseudomonas aeruginosa PA01
gcggcgacgaagcccaggcu

SEQ ID NO: 1462438 - RNA, 18 nt, Pseudomonas aeruginosa PA01
gcggcgacgaagguaucg

SEQ ID NO: 1462439 - RNA, 17 nt, Pseudomonas aeruginosa PA01
gcggcgacgaaggucgg

SEQ ID NO: 1462440 - RNA, 18 nt, Pseudomonas aeruginosa PA01
gcggcgacgaaggucggc

SEQ ID NO: 1462441 - RNA, 19 nt, Pseudomonas aeruginosa PA01
gcggcgacgaaggucggcg

SEQ ID NO: 1462442 - RNA, 16 nt, Pseudomonas aeruginosa PA01
gcggcgaccggccuca

SEQ ID NO: 1462443 - RNA, 23 nt, Pseudomonas aeruginosa PA01
gcggcgaccgcaucguuggcgcc

SEQ ID NO: 1462444 - RNA, 15 nt, Pseudomonas aeruginosa PA01
gcggcgaccauccag

SEQ ID NO: 1462445 - RNA, 22 nt, Pseudomonas aeruginosa PA01
gcggcgaccauccagccugcgc

SEQ ID NO: 1462446 - RNA, 23 nt, Pseudomonas aeruginosa PA01
gcggcgaccauccagccugcgcu

SEQ ID NO: 1462447 - RNA, 24 nt, Pseudomonas aeruginosa PA01
gcggcgaccauguucaccagcgcu

SEQ ID NO: 1462448 - RNA, 13 nt, Pseudomonas aeruginosa PA01
gcggcgacggcuc

SEQ ID NO: 1462449 - RNA, 23 nt, Pseudomonas aeruginosa PA01
gcggcgagcaucucggccaggcc

SEQ ID NO: 1462450 - RNA, 18 nt, Pseudomonas aeruginosa PA01
gcggcgauaggcgcgcaa

SEQ ID NO: 1462451 - RNA, 16 nt, Pseudomonas aeruginosa PA01
gcggcgaguugcgcga

SEQ ID NO: 1462452 - RNA, 15 nt, Pseudomonas aeruginosa PA01
gcggcgaggugaucg

SEQ ID NO: 1462453 - RNA, 14 nt, Pseudomonas aeruginosa PA01
gcggcgagguugcc

SEQ ID NO: 1462454 - RNA, 21 nt, Pseudomonas aeruginosa PA01
gcggcgagguugcccacggcc

SEQ ID NO: 1462455 - RNA, 23 nt, Pseudomonas aeruginosa PA01
gcggcgagguugcccacggccag

SEQ ID NO: 1462456 - RNA, 19 nt, Pseudomonas aeruginosa PA01
gcggcgagaucuucaggcc

SEQ ID NO: 1462457 - RNA, 14 nt, Pseudomonas aeruginosa PA01
gcggcgagcggguc

SEQ ID NO: 1462458 - RNA, 17 nt, Pseudomonas aeruginosa PA01
gcggcgaggccgaccuu

SEQ ID NO: 1462459 - RNA, 17 nt, Pseudomonas aeruginosa PA01
gcggcgagcagcggcgc

SEQ ID NO: 1462460 - RNA, 23 nt, Pseudomonas aeruginosa PA01
gcggcgagcaggcgaacagggcc

SEQ ID NO: 1462461 - RNA, 14 nt, Pseudomonas aeruginosa PA01
gcggcgagcgccgc

SEQ ID NO: 1462462 - RNA, 14 nt, Pseudomonas aeruginosa PA01
gcggcgagccgcga

SEQ ID NO: 1462463 - RNA, 15 nt, Pseudomonas aeruginosa PA01
gcggcgaagcgcagg

SEQ ID NO: 1462464 - RNA, 17 nt, Pseudomonas aeruginosa PA01
gcggcgaagcgcaggcu

SEQ ID NO: 1462465 - RNA, 19 nt, Pseudomonas aeruginosa PA01
gcggcgaagcguugcagcg

SEQ ID NO: 1462466 - RNA, 15 nt, Pseudomonas aeruginosa PA01
gcggcgaagggcgcu

SEQ ID NO: 1462467 - RNA, 22 nt, Pseudomonas aeruginosa PA01
gcggcgaagguggcgaccuggu

SEQ ID NO: 1462468 - RNA, 13 nt, Pseudomonas aeruginosa PA01
gcggcgaaggccg

SEQ ID NO: 1462469 - RNA, 15 nt, Pseudomonas aeruginosa PA01
gcggcgaacggaccg

SEQ ID NO: 1462470 - RNA, 16 nt, Pseudomonas aeruginosa PA01
gcggcgacaccgccag

SEQ ID NO: 1462471 - RNA, 17 nt, Pseudomonas aeruginosa PA01
gcggcgacaccgccagc

SEQ ID NO: 1462472 - RNA, 19 nt, Pseudomonas aeruginosa PA01
gcggcgacaccgccagcac

SEQ ID NO: 1462473 - RNA, 20 nt, Pseudomonas aeruginosa PA01
gcggcgacaccgccagcacc

SEQ ID NO: 1462474 - RNA, 24 nt, Pseudomonas aeruginosa PA01
gcggcgacaccgccagcaccuggc

SEQ ID NO: 1462475 - RNA, 14 nt, Pseudomonas aeruginosa PA01
gcggcgacagcacc

SEQ ID NO: 1462476 - RNA, 16 nt, Pseudomonas aeruginosa PA01
gcggcgaacaucaucc

SEQ ID NO: 1462477 - RNA, 22 nt, Pseudomonas aeruginosa PA01
gcggcgaacccucggugcggcc

SEQ ID NO: 1462478 - RNA, 23 nt, Pseudomonas aeruginosa PA01
gcggcgaacccucggugcggccg

SEQ ID NO: 1462479 - RNA, 21 nt, Pseudomonas aeruginosa PA01
gcggcaggugguaagcgagca

SEQ ID NO: 1462480 - RNA, 14 nt, Pseudomonas aeruginosa PA01
gcggcaggguacgg

SEQ ID NO: 1462481 - RNA, 20 nt, Pseudomonas aeruginosa PA01
gcggcaggguggcgcaugag

SEQ ID NO: 1462482 - RNA, 21 nt, Pseudomonas aeruginosa PA01
gcggcaggucguugacgaucu

SEQ ID NO: 1462483 - RNA, 12 nt, Pseudomonas aeruginosa PA01
gcggcaggucgg

SEQ ID NO: 1462484 - RNA, 15 nt, Pseudomonas aeruginosa PA01
gcggcagggcggcga

SEQ ID NO: 1462485 - RNA, 17 nt, Pseudomonas aeruginosa PA01
gcggcaggcggcggcgu

SEQ ID NO: 1462486 - RNA, 23 nt, Pseudomonas aeruginosa PA01
gcggcaggcggcggcguuggccg

SEQ ID NO: 1462487 - RNA, 15 nt, Pseudomonas aeruginosa PA01
gcggcaggcugcgcc

SEQ ID NO: 1462488 - RNA, 16 nt, Pseudomonas aeruginosa PA01
gcggcaggcugcgccg

SEQ ID NO: 1462489 - RNA, 13 nt, Pseudomonas aeruginosa PA01
gcggcagguagcc

SEQ ID NO: 1462490 - RNA, 12 nt, Pseudomonas aeruginosa PA01
gcggcaggccgc

SEQ ID NO: 1462491 - RNA, 15 nt, Pseudomonas aeruginosa PA01
gcggcaggcgcauca

SEQ ID NO: 1462492 - RNA, 12 nt, Pseudomonas aeruginosa PA01
gcggcaggcgcc

SEQ ID NO: 1462493 - RNA, 16 nt, Pseudomonas aeruginosa PA01
gcggcaggcgccggcc

SEQ ID NO: 1462494 - RNA, 20 nt, Pseudomonas aeruginosa PA01
gcggcaggcgccggccgggc

SEQ ID NO: 1462495 - RNA, 21 nt, Pseudomonas aeruginosa PA01
gcggcgccgaacagggcgagc

SEQ ID NO: 1462496 - RNA, 18 nt, Pseudomonas aeruginosa PA01
gcggcgccaccgcgacgc

SEQ ID NO: 1462497 - RNA, 19 nt, Pseudomonas aeruginosa PA01
gcggcgccaccgcgacgcg

SEQ ID NO: 1462498 - RNA, 14 nt, Pseudomonas aeruginosa PA01
gcggcgcaucggcg

SEQ ID NO: 1462499 - RNA, 15 nt, Pseudomonas aeruginosa PA01
gcggcgcaucggcgg

SEQ ID NO: 1462500 - RNA, 18 nt, Pseudomonas aeruginosa PA01
gcggcgcaucggcggaua

SEQ ID NO: 1462501 - RNA, 17 nt, Pseudomonas aeruginosa PA01
gcggcgcaggcggaucg

SEQ ID NO: 1462502 - RNA, 17 nt, Pseudomonas aeruginosa PA01
gcggcgcaggcugucgg

SEQ ID NO: 1462503 - RNA, 20 nt, Pseudomonas aeruginosa PA01
gcggcgcaggcugucggcca

SEQ ID NO: 1462504 - RNA, 21 nt, Pseudomonas aeruginosa PA01
gcggcgcaggcugucggccag

SEQ ID NO: 1462505 - RNA, 14 nt, Pseudomonas aeruginosa PA01
gcggcgaugucggc

SEQ ID NO: 1462506 - RNA, 15 nt, Pseudomonas aeruginosa PA01
gcggcgaugucggcc

SEQ ID NO: 1462507 - RNA, 16 nt, Pseudomonas aeruginosa PA01
gcggcgaugucggccu

SEQ ID NO: 1462508 - RNA, 18 nt, Pseudomonas aeruginosa PA01
gcggcgaugucggccugc

SEQ ID NO: 1462509 - RNA, 14 nt, Pseudomonas aeruginosa PA01
gcggcgaucgccug

SEQ ID NO: 1462510 - RNA, 16 nt, Pseudomonas aeruginosa PA01
gcggcgaucgccuggu

SEQ ID NO: 1462511 - RNA, 15 nt, Pseudomonas aeruginosa PA01
gcggcgauggccgcc

SEQ ID NO: 1462512 - RNA, 16 nt, Pseudomonas aeruginosa PA01
gcggcgauggccgcca

SEQ ID NO: 1462513 - RNA, 17 nt, Pseudomonas aeruginosa PA01
gcggcgauggccgccag

SEQ ID NO: 1462514 - RNA, 18 nt, Pseudomonas aeruginosa PA01
gcggcgauggccgccagc

SEQ ID NO: 1462515 - RNA, 20 nt, Pseudomonas aeruginosa PA01
gcggcgauggccgccagcag

SEQ ID NO: 1462516 - RNA, 20 nt, Pseudomonas aeruginosa PA01
gcggcgauggcguccaccgc

SEQ ID NO: 1462517 - RNA, 15 nt, Pseudomonas aeruginosa PA01
gcggcgaucuucucc

SEQ ID NO: 1462518 - RNA, 18 nt, Pseudomonas aeruginosa PA01
gcggcgaucuucuccgcc

SEQ ID NO: 1462519 - RNA, 19 nt, Pseudomonas aeruginosa PA01
gcggcgaucuucuccgccg

SEQ ID NO: 1462520 - RNA, 13 nt, Pseudomonas aeruginosa PA01
gcggcgauggacu

SEQ ID NO: 1462521 - RNA, 18 nt, Pseudomonas aeruginosa PA01
gcggcgcucagucgagca

SEQ ID NO: 1462522 - RNA, 13 nt, Pseudomonas aeruginosa PA01
gcggcgcuccagg

SEQ ID NO: 1462523 - RNA, 14 nt, Pseudomonas aeruginosa PA01
gcggcgcuccaggc

SEQ ID NO: 1462524 - RNA, 22 nt, Pseudomonas aeruginosa PA01
gcggcgcgagaugaagcgccgc

SEQ ID NO: 1462525 - RNA, 21 nt, Pseudomonas aeruginosa PA01
gcggcgccuagacccugggcc

SEQ ID NO: 1462526 - RNA, 17 nt, Pseudomonas aeruginosa PA01
gcggcgcgaaccagcag

SEQ ID NO: 1462527 - RNA, 18 nt, Pseudomonas aeruginosa PA01
gcggcgcgaaccagcagc

SEQ ID NO: 1462528 - RNA, 21 nt, Pseudomonas aeruginosa PA01
gcggcgcgaaccagcagcagg

SEQ ID NO: 1462529 - RNA, 12 nt, Pseudomonas aeruginosa PA01
gcggcgccugcu

SEQ ID NO: 1462530 - RNA, 11 nt, Pseudomonas aeruginosa PA01
gcggcgccugg

SEQ ID NO: 1462531 - RNA, 15 nt, Pseudomonas aeruginosa PA01
gcggcgccuggagca

SEQ ID NO: 1462532 - RNA, 22 nt, Pseudomonas aeruginosa PA01
gcggcgcugaggaucagccagc

SEQ ID NO: 1462533 - RNA, 23 nt, Pseudomonas aeruginosa PA01
gcggcgcugaggaucagccagcc

SEQ ID NO: 1462534 - RNA, 13 nt, Pseudomonas aeruginosa PA01
gcggcgccgguga

SEQ ID NO: 1462535 - RNA, 14 nt, Pseudomonas aeruginosa PA01
gcggcgccggugag

SEQ ID NO: 1462536 - RNA, 12 nt, Pseudomonas aeruginosa PA01
gcggcgccgguu

SEQ ID NO: 1462537 - RNA, 20 nt, Pseudomonas aeruginosa PA01
gcggcgccgguugcugcugg

SEQ ID NO: 1462538 - RNA, 16 nt, Pseudomonas aeruginosa PA01
gcggcgccuucgccgg

SEQ ID NO: 1462539 - RNA, 16 nt, Pseudomonas aeruginosa PA01
gcggcgccuugcgguc

SEQ ID NO: 1462540 - RNA, 16 nt, Pseudomonas aeruginosa PA01
gcggcgccgaggcccu

SEQ ID NO: 1462541 - RNA, 19 nt, Pseudomonas aeruginosa PA01
gcgugcaguacuuggccag

SEQ ID NO: 1462542 - RNA, 22 nt, Pseudomonas aeruginosa PA01
gcgugcaguacuuggccagcag

SEQ ID NO: 1462543 - RNA, 14 nt, Pseudomonas aeruginosa PA01
gcgugccagcaccu

SEQ ID NO: 1462544 - RNA, 23 nt, Pseudomonas aeruginosa PA01
gcgugccaggagcuugccgaaga

SEQ ID NO: 1462545 - RNA, 14 nt, Pseudomonas aeruginosa PA01
gcgugcauggccgg

SEQ ID NO: 1462546 - RNA, 21 nt, Pseudomonas aeruginosa PA01
gcgugccagggcuucccaggc

SEQ ID NO: 1462547 - RNA, 24 nt, Pseudomonas aeruginosa PA01
gcgugccagggcuucccaggccag

SEQ ID NO: 1462548 - RNA, 22 nt, Pseudomonas aeruginosa PA01
gcgugccccguggcgggccagc

SEQ ID NO: 1462549 - RNA, 16 nt, Pseudomonas aeruginosa PA01
gcgugcucggcgaucu

SEQ ID NO: 1462550 - RNA, 21 nt, Pseudomonas aeruginosa PA01
gcgugcucggcgaucucgccc

SEQ ID NO: 1462551 - RNA, 17 nt, Pseudomonas aeruginosa PA01
gcgugcuccgugucggc

SEQ ID NO: 1462552 - RNA, 13 nt, Pseudomonas aeruginosa PA01
gcgugcuccagca

SEQ ID NO: 1462553 - RNA, 18 nt, Pseudomonas aeruginosa PA01
gcgugcuccagcaccgug

SEQ ID NO: 1462554 - RNA, 17 nt, Pseudomonas aeruginosa PA01
gcgugcguugcgcggca

SEQ ID NO: 1462555 - RNA, 13 nt, Pseudomonas aeruginosa PA01
gcgugcccgcugc

SEQ ID NO: 1462556 - RNA, 20 nt, Pseudomonas aeruginosa PA01
gcguggccggcgaccagcuc

SEQ ID NO: 1462557 - RNA, 13 nt, Pseudomonas aeruginosa PA01
gcguggcgaugcc

SEQ ID NO: 1462558 - RNA, 15 nt, Pseudomonas aeruginosa PA01
gcguggcgaacgccc

SEQ ID NO: 1462559 - RNA, 18 nt, Pseudomonas aeruginosa PA01
gcgugcuuggcgaggcgc

SEQ ID NO: 1462560 - RNA, 20 nt, Pseudomonas aeruginosa PA01
gcgugcuuggcgaggcgcgc

SEQ ID NO: 1462561 - RNA, 15 nt, Pseudomonas aeruginosa PA01
gcguggcccggcgcg

SEQ ID NO: 1462562 - RNA, 17 nt, Pseudomonas aeruginosa PA01
gcguggcccggcgcggc

SEQ ID NO: 1462563 - RNA, 22 nt, Pseudomonas aeruginosa PA01
gcgugcuggugccgaucagccc

SEQ ID NO: 1462564 - RNA, 23 nt, Pseudomonas aeruginosa PA01
gcgugcagaccaggguacgacug

SEQ ID NO: 1462565 - RNA, 12 nt, Pseudomonas aeruginosa PA01
gcgugcaggccg

SEQ ID NO: 1462566 - RNA, 15 nt, Pseudomonas aeruginosa PA01
gcgugcaggccgccg

SEQ ID NO: 1462567 - RNA, 16 nt, Pseudomonas aeruginosa PA01
gcgugcaggccgccga

SEQ ID NO: 1462568 - RNA, 13 nt, Pseudomonas aeruginosa PA01
gcgugcaccagca

SEQ ID NO: 1462569 - RNA, 21 nt, Pseudomonas aeruginosa PA01
gcgucugcagcuugcgcgcca

SEQ ID NO: 1462570 - RNA, 17 nt, Pseudomonas aeruginosa PA01
gcgucuccugccgccga

SEQ ID NO: 1462571 - RNA, 21 nt, Pseudomonas aeruginosa PA01
gcgucuccagcucggcgaucc

SEQ ID NO: 1462572 - RNA, 23 nt, Pseudomonas aeruginosa PA01
gcgucuccaugcgggagagcgcc

SEQ ID NO: 1462573 - RNA, 13 nt, Pseudomonas aeruginosa PA01
gcgucucggcugc

SEQ ID NO: 1462574 - RNA, 19 nt, Pseudomonas aeruginosa PA01
gcgucucggcugccgccag

SEQ ID NO: 1462575 - RNA, 19 nt, Pseudomonas aeruginosa PA01
gcguuaccggcagguggcc

SEQ ID NO: 1462576 - RNA, 18 nt, Pseudomonas aeruginosa PA01
gcguuaccguccgcgccg

SEQ ID NO: 1462577 - RNA, 19 nt, Pseudomonas aeruginosa PA01
gcguuaccguccgcgccgc

SEQ ID NO: 1462578 - RNA, 21 nt, Pseudomonas aeruginosa PA01
gcguuaccguccgcgccgcgc

SEQ ID NO: 1462579 - RNA, 16 nt, Pseudomonas aeruginosa PA01
gcguucgcuccagucg

SEQ ID NO: 1462580 - RNA, 21 nt, Pseudomonas aeruginosa PA01
gcguucgcuccgggcccgugc

SEQ ID NO: 1462581 - RNA, 15 nt, Pseudomonas aeruginosa PA01
gcguucgcgcgaggc

SEQ ID NO: 1462582 - RNA, 16 nt, Pseudomonas aeruginosa PA01
gcguucgcgcgaggcg

SEQ ID NO: 1462583 - RNA, 18 nt, Pseudomonas aeruginosa PA01
gcguucgcgggcgccgug

SEQ ID NO: 1462584 - RNA, 20 nt, Pseudomonas aeruginosa PA01
gcguucccacucgcgacugc

SEQ ID NO: 1462585 - RNA, 19 nt, Pseudomonas aeruginosa PA01
gcguucaucgucggcagcc

SEQ ID NO: 1462586 - RNA, 13 nt, Pseudomonas aeruginosa PA01
gcguucgccgggu

SEQ ID NO: 1462587 - RNA, 15 nt, Pseudomonas aeruginosa PA01
gcguucagucccgcg

SEQ ID NO: 1462588 - RNA, 19 nt, Pseudomonas aeruginosa PA01
gcguucagucccgcggcgc

SEQ ID NO: 1462589 - RNA, 13 nt, Pseudomonas aeruginosa PA01
gcguuccagcgcu

SEQ ID NO: 1462590 - RNA, 14 nt, Pseudomonas aeruginosa PA01
gcguuccagcuccg

SEQ ID NO: 1462591 - RNA, 15 nt, Pseudomonas aeruginosa PA01
gcguuccagggcgaa

SEQ ID NO: 1462592 - RNA, 17 nt, Pseudomonas aeruginosa PA01
gcguuccaggucgcugc

SEQ ID NO: 1462593 - RNA, 17 nt, Pseudomonas aeruginosa PA01
gcguuccaccaggcguc

SEQ ID NO: 1462594 - RNA, 22 nt, Pseudomonas aeruginosa PA01
gcguuccacgaaaaagcccggc

SEQ ID NO: 1462595 - RNA, 19 nt, Pseudomonas aeruginosa PA01
gcguuccagcaacggcuug

SEQ ID NO: 1462596 - RNA, 16 nt, Pseudomonas aeruginosa PA01
gcgugggcgccggcgc

SEQ ID NO: 1462597 - RNA, 17 nt, Pseudomonas aeruginosa PA01
gcgugggcgccggcgcg

SEQ ID NO: 1462598 - RNA, 12 nt, Pseudomonas aeruginosa PA01
gcgugggccggc

SEQ ID NO: 1462599 - RNA, 16 nt, Pseudomonas aeruginosa PA01
gcgugggccggcaugc

SEQ ID NO: 1462600 - RNA, 17 nt, Pseudomonas aeruginosa PA01
gcgugggcggccggcca

SEQ ID NO: 1462601 - RNA, 20 nt, Pseudomonas aeruginosa PA01
gcgugggcggccggccaggu

SEQ ID NO: 1462602 - RNA, 18 nt, Pseudomonas aeruginosa PA01
gcgugggcggucggcgag

SEQ ID NO: 1462603 - RNA, 18 nt, Pseudomonas aeruginosa PA01
gcgugggcuucgccgccg

SEQ ID NO: 1462604 - RNA, 15 nt, Pseudomonas aeruginosa PA01
gcgugggccaccauc

SEQ ID NO: 1462605 - RNA, 16 nt, Pseudomonas aeruginosa PA01
gcgugggccaccauca

SEQ ID NO: 1462606 - RNA, 22 nt, Pseudomonas aeruginosa PA01
gcgugggccaccaucagguaga

SEQ ID NO: 1462607 - RNA, 18 nt, Pseudomonas aeruginosa PA01
gcgugggccagcccagaa

SEQ ID NO: 1462608 - RNA, 23 nt, Pseudomonas aeruginosa PA01
gcgugggccagcccagaacagca

SEQ ID NO: 1462609 - RNA, 13 nt, Pseudomonas aeruginosa PA01
gcgugggccaggg

SEQ ID NO: 1462610 - RNA, 13 nt, Pseudomonas aeruginosa PA01
gcguggcggacaa

SEQ ID NO: 1462611 - RNA, 18 nt, Pseudomonas aeruginosa PA01
gcguggcggacaacccgg

SEQ ID NO: 1462612 - RNA, 23 nt, Pseudomonas aeruginosa PA01
gcguggcggacaacccggcgcug

SEQ ID NO: 1462613 - RNA, 18 nt, Pseudomonas aeruginosa PA01
gcguggcgcgcaucggug

SEQ ID NO: 1462614 - RNA, 15 nt, Pseudomonas aeruginosa PA01
gcguggcggucaggg

SEQ ID NO: 1462615 - RNA, 15 nt, Pseudomonas aeruginosa PA01
gcguggcggccgccg

SEQ ID NO: 1462616 - RNA, 17 nt, Pseudomonas aeruginosa PA01
gcguggcggccgccggc

SEQ ID NO: 1462617 - RNA, 20 nt, Pseudomonas aeruginosa PA01
gcguggcggccgccggcgcc

SEQ ID NO: 1462618 - RNA, 15 nt, Pseudomonas aeruginosa PA01
gcguggcgugcucgg

SEQ ID NO: 1462619 - RNA, 14 nt, Pseudomonas aeruginosa PA01
gcguggcugccgga

SEQ ID NO: 1462620 - RNA, 18 nt, Pseudomonas aeruginosa PA01
gcguggcuucguccagcg

SEQ ID NO: 1462621 - RNA, 20 nt, Pseudomonas aeruginosa PA01
gcguggcuucguccagcgag

SEQ ID NO: 1462622 - RNA, 14 nt, Pseudomonas aeruginosa PA01
gcguggcuuggccc

SEQ ID NO: 1462623 - RNA, 16 nt, Pseudomonas aeruginosa PA01
gcguggugcauccgcc

SEQ ID NO: 1462624 - RNA, 19 nt, Pseudomonas aeruginosa PA01
gcguggucggcggccucgg

SEQ ID NO: 1462625 - RNA, 21 nt, Pseudomonas aeruginosa PA01
gcguggucuccgugcuggccg

SEQ ID NO: 1462626 - RNA, 22 nt, Pseudomonas aeruginosa PA01
gcguggucuccgugcuggccgg

SEQ ID NO: 1462627 - RNA, 13 nt, Pseudomonas aeruginosa PA01
gcguggucugccc

SEQ ID NO: 1462628 - RNA, 16 nt, Pseudomonas aeruginosa PA01
gcguggugcugcaugu

SEQ ID NO: 1462629 - RNA, 21 nt, Pseudomonas aeruginosa PA01
gcgugguggcggggaacagca

SEQ ID NO: 1462630 - RNA, 17 nt, Pseudomonas aeruginosa PA01
gcgugguaccgcugcgu

SEQ ID NO: 1462631 - RNA, 16 nt, Pseudomonas aeruginosa PA01
gcguggguagccgccc

SEQ ID NO: 1462632 - RNA, 18 nt, Pseudomonas aeruginosa PA01
gcguggguagccgcccac

SEQ ID NO: 1462633 - RNA, 23 nt, Pseudomonas aeruginosa PA01
gcguggguagccgcccaccgcgg

SEQ ID NO: 1462634 - RNA, 19 nt, Pseudomonas aeruginosa PA01
gcgugguaucggcgcucac

SEQ ID NO: 1462635 - RNA, 21 nt, Pseudomonas aeruginosa PA01
gcguccguaaugcaacccgcc

SEQ ID NO: 1462636 - RNA, 19 nt, Pseudomonas aeruginosa PA01
gcguccgggugccccaggc

SEQ ID NO: 1462637 - RNA, 13 nt, Pseudomonas aeruginosa PA01
gcguccgcggccu

SEQ ID NO: 1462638 - RNA, 16 nt, Pseudomonas aeruginosa PA01
gcguccgcggccugcu

SEQ ID NO: 1462639 - RNA, 14 nt, Pseudomonas aeruginosa PA01
gcguccgccgccgu

SEQ ID NO: 1462640 - RNA, 15 nt, Pseudomonas aeruginosa PA01
gcguccggccagccu

SEQ ID NO: 1462641 - RNA, 15 nt, Pseudomonas aeruginosa PA01
gcguccgcuggccug

SEQ ID NO: 1462642 - RNA, 21 nt, Pseudomonas aeruginosa PA01
gcguccgcaguucgccccgcc

SEQ ID NO: 1462643 - RNA, 13 nt, Pseudomonas aeruginosa PA01
gcguccgcgcagg

SEQ ID NO: 1462644 - RNA, 17 nt, Pseudomonas aeruginosa PA01
gcguccgcgcaggcggu

SEQ ID NO: 1462645 - RNA, 21 nt, Pseudomonas aeruginosa PA01
gcguccgaugucguugcgcag

SEQ ID NO: 1462646 - RNA, 15 nt, Pseudomonas aeruginosa PA01
gcgguuucgcagcgc

SEQ ID NO: 1462647 - RNA, 14 nt, Pseudomonas aeruginosa PA01
gcgguuucgccgag

SEQ ID NO: 1462648 - RNA, 15 nt, Pseudomonas aeruginosa PA01
gcgguuucgucgaag

SEQ ID NO: 1462649 - RNA, 22 nt, Pseudomonas aeruginosa PA01
gcgguuguugaugcccaccaac

SEQ ID NO: 1462650 - RNA, 17 nt, Pseudomonas aeruginosa PA01
gcgguuuuccugccccg

SEQ ID NO: 1462651 - RNA, 20 nt, Pseudomonas aeruginosa PA01
gcgguuucuucgccuugccc

SEQ ID NO: 1462652 - RNA, 18 nt, Pseudomonas aeruginosa PA01
gcgguugaaacugcgcag

SEQ ID NO: 1462653 - RNA, 19 nt, Pseudomonas aeruginosa PA01
gcgguugaaacugcgcagg

SEQ ID NO: 1462654 - RNA, 21 nt, Pseudomonas aeruginosa PA01
gcgguugaaacugcgcaggcu

SEQ ID NO: 1462655 - RNA, 23 nt, Pseudomonas aeruginosa PA01
gcgguugaaacugcgcaggcugg

SEQ ID NO: 1462656 - RNA, 12 nt, Pseudomonas aeruginosa PA01
gcgguucggcac

SEQ ID NO: 1462657 - RNA, 22 nt, Pseudomonas aeruginosa PA01
gcgguuccacucccaugccagg

SEQ ID NO: 1462658 - RNA, 14 nt, Pseudomonas aeruginosa PA01
gcgguucgaggacu

SEQ ID NO: 1462659 - RNA, 16 nt, Pseudomonas aeruginosa PA01
gcgguucgaucccguc

SEQ ID NO: 1462660 - RNA, 15 nt, Pseudomonas aeruginosa PA01
gcguccuccuggagg

SEQ ID NO: 1462661 - RNA, 19 nt, Pseudomonas aeruginosa PA01
gcguccuccuggaggacgc

SEQ ID NO: 1462662 - RNA, 18 nt, Pseudomonas aeruginosa PA01
gcguccuggcgaguggcg

SEQ ID NO: 1462663 - RNA, 20 nt, Pseudomonas aeruginosa PA01
gcguccugcucccuggcgga

SEQ ID NO: 1462664 - RNA, 22 nt, Pseudomonas aeruginosa PA01
gcguccugcccuccugcucgau

SEQ ID NO: 1462665 - RNA, 14 nt, Pseudomonas aeruginosa PA01
gcguccuucggcgc

SEQ ID NO: 1462666 - RNA, 15 nt, Pseudomonas aeruginosa PA01
gcguccuucggcgcu

SEQ ID NO: 1462667 - RNA, 17 nt, Pseudomonas aeruginosa PA01
gcguccuucggcgcucu

SEQ ID NO: 1462668 - RNA, 20 nt, Pseudomonas aeruginosa PA01
gcguccuugggaucgucgaa

SEQ ID NO: 1462669 - RNA, 15 nt, Pseudomonas aeruginosa PA01
gcgucgaacagcgag

SEQ ID NO: 1462670 - RNA, 15 nt, Pseudomonas aeruginosa PA01
gcgucgaacaccggc

SEQ ID NO: 1462671 - RNA, 20 nt, Pseudomonas aeruginosa PA01
gcgucgaacaccggcgccgc

SEQ ID NO: 1462672 - RNA, 22 nt, Pseudomonas aeruginosa PA01
gcgucgaacaccggcgccgccu

SEQ ID NO: 1462673 - RNA, 21 nt, Pseudomonas aeruginosa PA01
gcgucgaccgccugccagacc

SEQ ID NO: 1462674 - RNA, 16 nt, Pseudomonas aeruginosa PA01
gcgucgaagccggauu

SEQ ID NO: 1462675 - RNA, 21 nt, Pseudomonas aeruginosa PA01
gcgucgaagccggauucgcgc

SEQ ID NO: 1462676 - RNA, 19 nt, Pseudomonas aeruginosa PA01
gcgucgaagcugucggccc

SEQ ID NO: 1462677 - RNA, 16 nt, Pseudomonas aeruginosa PA01
gcgucgaaggccucgu

SEQ ID NO: 1462678 - RNA, 17 nt, Pseudomonas aeruginosa PA01
gcgucgaaggccucguc

SEQ ID NO: 1462679 - RNA, 13 nt, Pseudomonas aeruginosa PA01
gcgucgaaggcgg

SEQ ID NO: 1462680 - RNA, 21 nt, Pseudomonas aeruginosa PA01
gcguccuugaguucccagacc

SEQ ID NO: 1462681 - RNA, 15 nt, Pseudomonas aeruginosa PA01
gcgucgaaggcggcg

SEQ ID NO: 1462682 - RNA, 18 nt, Pseudomonas aeruginosa PA01
gcgucgaaggcggcgcgg

SEQ ID NO: 1462683 - RNA, 21 nt, Pseudomonas aeruginosa PA01
gcgucgaaggcggcgcggcgg

SEQ ID NO: 1462684 - RNA, 16 nt, Pseudomonas aeruginosa PA01
gcgucgaccacggccu

SEQ ID NO: 1462685 - RNA, 19 nt, Pseudomonas aeruginosa PA01
gcgucgacgccgaagccgc

SEQ ID NO: 1462686 - RNA, 16 nt, Pseudomonas aeruginosa PA01
gcgucgagcuggcgca

SEQ ID NO: 1462687 - RNA, 21 nt, Pseudomonas aeruginosa PA01
gcgucgagcuggcgcaggccu

SEQ ID NO: 1462688 - RNA, 17 nt, Pseudomonas aeruginosa PA01
gcgucgaguaccgcugc

SEQ ID NO: 1462689 - RNA, 19 nt, Pseudomonas aeruginosa PA01
gcgucgaguaccgcugcgg

SEQ ID NO: 1462690 - RNA, 23 nt, Pseudomonas aeruginosa PA01
gcgucgaguaccgcugcggccgg

SEQ ID NO: 1462691 - RNA, 16 nt, Pseudomonas aeruginosa PA01
gcgucgagucgcgcag

SEQ ID NO: 1462692 - RNA, 17 nt, Pseudomonas aeruginosa PA01
gcgucgaucaggcgggc

SEQ ID NO: 1462693 - RNA, 17 nt, Pseudomonas aeruginosa PA01
gcgucgaugaucccgau

SEQ ID NO: 1462694 - RNA, 20 nt, Pseudomonas aeruginosa PA01
gcgucgaucaucugcugcag

SEQ ID NO: 1462695 - RNA, 21 nt, Pseudomonas aeruginosa PA01
gcgucgaucaucugcugcagc

SEQ ID NO: 1462696 - RNA, 14 nt, Pseudomonas aeruginosa PA01
gcgucgaucccgau

SEQ ID NO: 1462697 - RNA, 13 nt, Pseudomonas aeruginosa PA01
gcgucgaucccgg

SEQ ID NO: 1462698 - RNA, 23 nt, Pseudomonas aeruginosa PA01
gcgucgaugucgaacaacccgcc

SEQ ID NO: 1462699 - RNA, 14 nt, Pseudomonas aeruginosa PA01
gcgucgaugcgccu

SEQ ID NO: 1462700 - RNA, 22 nt, Pseudomonas aeruginosa PA01
gcgucgaugcgccucagcggcc

SEQ ID NO: 1462701 - RNA, 17 nt, Pseudomonas aeruginosa PA01
gcgucgcaccaggugcu

SEQ ID NO: 1462702 - RNA, 16 nt, Pseudomonas aeruginosa PA01
gcgucgcacccggccc

SEQ ID NO: 1462703 - RNA, 21 nt, Pseudomonas aeruginosa PA01
gcgucgcagagacgcagcgcu

SEQ ID NO: 1462704 - RNA, 17 nt, Pseudomonas aeruginosa PA01
gcgucgccaacgcgccg

SEQ ID NO: 1462705 - RNA, 14 nt, Pseudomonas aeruginosa PA01
gcgucgcauccacc

SEQ ID NO: 1462706 - RNA, 16 nt, Pseudomonas aeruginosa PA01
gcgucgcauccaccag

SEQ ID NO: 1462707 - RNA, 12 nt, Pseudomonas aeruginosa PA01
gcgucgccaggc

SEQ ID NO: 1462708 - RNA, 14 nt, Pseudomonas aeruginosa PA01
gcgucgccaggccg

SEQ ID NO: 1462709 - RNA, 18 nt, Pseudomonas aeruginosa PA01
gcgucgccaggccguaga

SEQ ID NO: 1462710 - RNA, 24 nt, Pseudomonas aeruginosa PA01
gcgucggcgcuuugcugcacgcug

SEQ ID NO: 1462711 - RNA, 19 nt, Pseudomonas aeruginosa PA01
gcgucggcgcgggcgccga

SEQ ID NO: 1462712 - RNA, 15 nt, Pseudomonas aeruginosa PA01
gcgucggcuggucga

SEQ ID NO: 1462713 - RNA, 19 nt, Pseudomonas aeruginosa PA01
gcgucggcuucgcccaugg

SEQ ID NO: 1462714 - RNA, 20 nt, Pseudomonas aeruginosa PA01
gcgucggcuucgcccauggc

SEQ ID NO: 1462715 - RNA, 22 nt, Pseudomonas aeruginosa PA01
gcgucggcuucgcccauggcac

SEQ ID NO: 1462716 - RNA, 14 nt, Pseudomonas aeruginosa PA01
gcgucgucgcugcg

SEQ ID NO: 1462717 - RNA, 19 nt, Pseudomonas aeruginosa PA01
gcgucguccugcgcggcga

SEQ ID NO: 1462718 - RNA, 17 nt, Pseudomonas aeruginosa PA01
gcgucgucgaggcuguc

SEQ ID NO: 1462719 - RNA, 18 nt, Pseudomonas aeruginosa PA01
gcgucgucggggugccgc

SEQ ID NO: 1462720 - RNA, 14 nt, Pseudomonas aeruginosa PA01
gcgucgugcgccgg

SEQ ID NO: 1462721 - RNA, 17 nt, Pseudomonas aeruginosa PA01
gcgucgugcgccggccu

SEQ ID NO: 1462722 - RNA, 14 nt, Pseudomonas aeruginosa PA01
gcgucgcgcggcca

SEQ ID NO: 1462723 - RNA, 18 nt, Pseudomonas aeruginosa PA01
gcgucgcgcggccagcgu

SEQ ID NO: 1462724 - RNA, 14 nt, Pseudomonas aeruginosa PA01
gcgucgcgcgucca

SEQ ID NO: 1462725 - RNA, 18 nt, Pseudomonas aeruginosa PA01
gcgucgcgcguccagccg

SEQ ID NO: 1462726 - RNA, 20 nt, Pseudomonas aeruginosa PA01
gcgucgcggagaauccgcuc

SEQ ID NO: 1462727 - RNA, 24 nt, Pseudomonas aeruginosa PA01
gcgucgcggagaauccgcucggug

SEQ ID NO: 1462728 - RNA, 16 nt, Pseudomonas aeruginosa PA01
gcgucgcgccagcacc

SEQ ID NO: 1462729 - RNA, 15 nt, Pseudomonas aeruginosa PA01
gcgucgcgcgcggca

SEQ ID NO: 1462730 - RNA, 22 nt, Pseudomonas aeruginosa PA01
gcgucgcgccgcccggcucgcc

SEQ ID NO: 1462731 - RNA, 15 nt, Pseudomonas aeruginosa PA01
gcgucgcccaggccg

SEQ ID NO: 1462732 - RNA, 16 nt, Pseudomonas aeruginosa PA01
gcgucgcccaggccgc

SEQ ID NO: 1462733 - RNA, 17 nt, Pseudomonas aeruginosa PA01
gcgucgcccaggccgcu

SEQ ID NO: 1462734 - RNA, 23 nt, Pseudomonas aeruginosa PA01
gcgucgcccaggccgcuggcggc

SEQ ID NO: 1462735 - RNA, 23 nt, Pseudomonas aeruginosa PA01
gcgucggaagcgucagccgcggc

SEQ ID NO: 1462736 - RNA, 14 nt, Pseudomonas aeruginosa PA01
gcgucgcugccgcc

SEQ ID NO: 1462737 - RNA, 15 nt, Pseudomonas aeruginosa PA01
gcgucgcugccgccg

SEQ ID NO: 1462738 - RNA, 18 nt, Pseudomonas aeruginosa PA01
gcgucgcugccgccgcgc

SEQ ID NO: 1462739 - RNA, 23 nt, Pseudomonas aeruginosa PA01
gcgucgcugccgccgcgcccggc

SEQ ID NO: 1462740 - RNA, 14 nt, Pseudomonas aeruginosa PA01
gcgucgcugccgcu

SEQ ID NO: 1462741 - RNA, 18 nt, Pseudomonas aeruginosa PA01
gcucagucgguagagcag

SEQ ID NO: 1462742 - RNA, 15 nt, Pseudomonas aeruginosa PA01
gcucagucgaccguc

SEQ ID NO: 1462743 - RNA, 16 nt, Pseudomonas aeruginosa PA01
gcucagucgaccgucg

SEQ ID NO: 1462744 - RNA, 13 nt, Pseudomonas aeruginosa PA01
gcucagucgagca

SEQ ID NO: 1462745 - RNA, 21 nt, Pseudomonas aeruginosa PA01
gcucagucgagcaugucgcug

SEQ ID NO: 1462746 - RNA, 15 nt, Pseudomonas aeruginosa PA01
gcucauccugcccgu

SEQ ID NO: 1462747 - RNA, 23 nt, Pseudomonas aeruginosa PA01
gcucaucucguugagggucagcg

SEQ ID NO: 1462748 - RNA, 16 nt, Pseudomonas aeruginosa PA01
gcucaugagauccgcc

SEQ ID NO: 1462749 - RNA, 19 nt, Pseudomonas aeruginosa PA01
gcucaugagauccgccagc

SEQ ID NO: 1462750 - RNA, 22 nt, Pseudomonas aeruginosa PA01
gcucaugagauccgccagcaga

SEQ ID NO: 1462751 - RNA, 15 nt, Pseudomonas aeruginosa PA01
gcucaugccuugucg

SEQ ID NO: 1462752 - RNA, 16 nt, Pseudomonas aeruginosa PA01
gcucauggcauggcca

SEQ ID NO: 1462753 - RNA, 13 nt, Pseudomonas aeruginosa PA01
gcucauggccagg

SEQ ID NO: 1462754 - RNA, 21 nt, Pseudomonas aeruginosa PA01
gcucauggccaggucagccac

SEQ ID NO: 1462755 - RNA, 21 nt, Pseudomonas aeruginosa PA01
gcucauguucaguucggcgga

SEQ ID NO: 1462756 - RNA, 17 nt, Pseudomonas aeruginosa PA01
gcucaugggcgaugcgc

SEQ ID NO: 1462757 - RNA, 17 nt, Pseudomonas aeruginosa PA01
gcucauggagcaacagc

SEQ ID NO: 1462758 - RNA, 22 nt, Pseudomonas aeruginosa PA01
gcucauggagcaacagcgucgc

SEQ ID NO: 1462759 - RNA, 16 nt, Pseudomonas aeruginosa PA01
gcuccaaugcaccugc

SEQ ID NO: 1462760 - RNA, 18 nt, Pseudomonas aeruginosa PA01
gcuccaaugcaccugcgc

SEQ ID NO: 1462761 - RNA, 20 nt, Pseudomonas aeruginosa PA01
gcuccaaugcaccugcgccc

SEQ ID NO: 1462762 - RNA, 19 nt, Pseudomonas aeruginosa PA01
gcuccacagcugccagccc

SEQ ID NO: 1462763 - RNA, 20 nt, Pseudomonas aeruginosa PA01
gcuccacagcugccagcccc

SEQ ID NO: 1462764 - RNA, 15 nt, Pseudomonas aeruginosa PA01
gcuccaacagcaggu

SEQ ID NO: 1462765 - RNA, 16 nt, Pseudomonas aeruginosa PA01
gcuccaacagcaggua

SEQ ID NO: 1462766 - RNA, 22 nt, Pseudomonas aeruginosa PA01
gcuccaacaggcauugccgucc

SEQ ID NO: 1462767 - RNA, 17 nt, Pseudomonas aeruginosa PA01
gcuccaacgcaggcgca

SEQ ID NO: 1462768 - RNA, 15 nt, Pseudomonas aeruginosa PA01
gcuccacccaggcgc

SEQ ID NO: 1462769 - RNA, 20 nt, Pseudomonas aeruginosa PA01
gcuccacccaggcgccgauc

SEQ ID NO: 1462770 - RNA, 19 nt, Pseudomonas aeruginosa PA01
gcuccacccgcagccgcgu

SEQ ID NO: 1462771 - RNA, 19 nt, Pseudomonas aeruginosa PA01
gcuccaccgauggcgcgcu

SEQ ID NO: 1462772 - RNA, 22 nt, Pseudomonas aeruginosa PA01
gcuccaccgcccccggcgccac

SEQ ID NO: 1462773 - RNA, 14 nt, Pseudomonas aeruginosa PA01
gcuccaccgcgcuc

SEQ ID NO: 1462774 - RNA, 14 nt, Pseudomonas aeruginosa PA01
gcuccaccaggcca

SEQ ID NO: 1462775 - RNA, 21 nt, Pseudomonas aeruginosa PA01
gcuccagcaccagcacgcccu

SEQ ID NO: 1462776 - RNA, 18 nt, Pseudomonas aeruginosa PA01
gcuccagcaccggcggcg

SEQ ID NO: 1462777 - RNA, 19 nt, Pseudomonas aeruginosa PA01
gcuccagcaccggcggcgc

SEQ ID NO: 1462778 - RNA, 18 nt, Pseudomonas aeruginosa PA01
gcuccagaugcuggagcu

SEQ ID NO: 1462779 - RNA, 15 nt, Pseudomonas aeruginosa PA01
gcuccacgucggccc

SEQ ID NO: 1462780 - RNA, 17 nt, Pseudomonas aeruginosa PA01
gcuccacugcuuggcca

SEQ ID NO: 1462781 - RNA, 21 nt, Pseudomonas aeruginosa PA01
gcuccacugcuuggccaggcg

SEQ ID NO: 1462782 - RNA, 22 nt, Pseudomonas aeruginosa PA01
gcuccacugcuuggccaggcgc

SEQ ID NO: 1462783 - RNA, 17 nt, Pseudomonas aeruginosa PA01
gcuccagcaccguggcg

SEQ ID NO: 1462784 - RNA, 20 nt, Pseudomonas aeruginosa PA01
gcuccagcaccguggcgcca

SEQ ID NO: 1462785 - RNA, 16 nt, Pseudomonas aeruginosa PA01
gcuccagcagggccag

SEQ ID NO: 1462786 - RNA, 20 nt, Pseudomonas aeruginosa PA01
gcuccagcagggccagcgcc

SEQ ID NO: 1462787 - RNA, 22 nt, Pseudomonas aeruginosa PA01
gcuccagcagggccagcgccug

SEQ ID NO: 1462788 - RNA, 14 nt, Pseudomonas aeruginosa PA01
gcuccagccaggcc

SEQ ID NO: 1462789 - RNA, 15 nt, Pseudomonas aeruginosa PA01
gcuccagccaggccc

SEQ ID NO: 1462790 - RNA, 16 nt, Pseudomonas aeruginosa PA01
gcuccagccaggcccg

SEQ ID NO: 1462791 - RNA, 14 nt, Pseudomonas aeruginosa PA01
gcuccagcccggcu

SEQ ID NO: 1462792 - RNA, 17 nt, Pseudomonas aeruginosa PA01
gcuccagcccggcucgg

SEQ ID NO: 1462793 - RNA, 21 nt, Pseudomonas aeruginosa PA01
gcuccagcagucgcacagcca

SEQ ID NO: 1462794 - RNA, 18 nt, Pseudomonas aeruginosa PA01
gcuccagcaguucgucgc

SEQ ID NO: 1462795 - RNA, 13 nt, Pseudomonas aeruginosa PA01
gcuccagccggca

SEQ ID NO: 1462796 - RNA, 15 nt, Pseudomonas aeruginosa PA01
gcuccagccggcaag

SEQ ID NO: 1462797 - RNA, 13 nt, Pseudomonas aeruginosa PA01
gcuccagccgggc

SEQ ID NO: 1462798 - RNA, 21 nt, Pseudomonas aeruginosa PA01
gcuccagccgggcuccgccgc

SEQ ID NO: 1462799 - RNA, 23 nt, Pseudomonas aeruginosa PA01
gcuccagccgggcuccgccgcga

SEQ ID NO: 1462800 - RNA, 16 nt, Pseudomonas aeruginosa PA01
gcuccagcuugucguc

SEQ ID NO: 1462801 - RNA, 20 nt, Pseudomonas aeruginosa PA01
gcuccagcuugucgucggcc

SEQ ID NO: 1462802 - RNA, 22 nt, Pseudomonas aeruginosa PA01
gcuccagcuugucgucggccuu

SEQ ID NO: 1462803 - RNA, 13 nt, Pseudomonas aeruginosa PA01
gcuccaggccgcg

SEQ ID NO: 1462804 - RNA, 15 nt, Pseudomonas aeruginosa PA01
gcuccaggcccggca

SEQ ID NO: 1462805 - RNA, 12 nt, Pseudomonas aeruginosa PA01
gcuccaggccgc

SEQ ID NO: 1462806 - RNA, 19 nt, Pseudomonas aeruginosa PA01
gcuccagcuccuccagcag

SEQ ID NO: 1462807 - RNA, 12 nt, Pseudomonas aeruginosa PA01
gcuccagcgccu

SEQ ID NO: 1462808 - RNA, 18 nt, Pseudomonas aeruginosa PA01
gcuccagcgugcccgcug

SEQ ID NO: 1462809 - RNA, 19 nt, Pseudomonas aeruginosa PA01
gcuccagcgggaaggucgg

SEQ ID NO: 1462810 - RNA, 20 nt, Pseudomonas aeruginosa PA01
gcuccagcggaaucgcgccc

SEQ ID NO: 1462811 - RNA, 20 nt, Pseudomonas aeruginosa PA01
gcuccagcggcagcucggcg

SEQ ID NO: 1462812 - RNA, 19 nt, Pseudomonas aeruginosa PA01
gcucagcgcgcucggccug

SEQ ID NO: 1462813 - RNA, 15 nt, Pseudomonas aeruginosa PA01
gcucagcaucagcga

SEQ ID NO: 1462814 - RNA, 14 nt, Pseudomonas aeruginosa PA01
gcucagcgcgccga

SEQ ID NO: 1462815 - RNA, 14 nt, Pseudomonas aeruginosa PA01
gcucagccgcgccg

SEQ ID NO: 1462816 - RNA, 15 nt, Pseudomonas aeruginosa PA01
gcucagccgcuggcg

SEQ ID NO: 1462817 - RNA, 19 nt, Pseudomonas aeruginosa PA01
gcucagccgcuggcgucga

SEQ ID NO: 1462818 - RNA, 24 nt, Pseudomonas aeruginosa PA01
gcucagccgaccaccuucaggcug

SEQ ID NO: 1462819 - RNA, 19 nt, Pseudomonas aeruginosa PA01
gcucagccgaggucgccgc

SEQ ID NO: 1462820 - RNA, 20 nt, Pseudomonas aeruginosa PA01
gcucagccgaggucgccgcc

SEQ ID NO: 1462821 - RNA, 14 nt, Pseudomonas aeruginosa PA01
gcucagcgggccga

SEQ ID NO: 1462822 - RNA, 13 nt, Pseudomonas aeruginosa PA01
gcucagcgccggc

SEQ ID NO: 1462823 - RNA, 12 nt, Pseudomonas aeruginosa PA01
gcucagcgcgcg

SEQ ID NO: 1462824 - RNA, 15 nt, Pseudomonas aeruginosa PA01
gcucagcuccaggcc

SEQ ID NO: 1462825 - RNA, 16 nt, Pseudomonas aeruginosa PA01
gcucagcuccaggccg

SEQ ID NO: 1462826 - RNA, 17 nt, Pseudomonas aeruginosa PA01
gcucagcuccaggccgc

SEQ ID NO: 1462827 - RNA, 20 nt, Pseudomonas aeruginosa PA01
gcucagcguccucagccuca

SEQ ID NO: 1462828 - RNA, 17 nt, Pseudomonas aeruginosa PA01
gcucagcgcggcggcgg

SEQ ID NO: 1462829 - RNA, 18 nt, Pseudomonas aeruginosa PA01
gcucagcgcggcggcggc

SEQ ID NO: 1462830 - RNA, 19 nt, Pseudomonas aeruginosa PA01
gcucagcgcggcggcggcc

SEQ ID NO: 1462831 - RNA, 16 nt, Pseudomonas aeruginosa PA01
gcucagcgcuucucgg

SEQ ID NO: 1462832 - RNA, 20 nt, Pseudomonas aeruginosa PA01
gcucagcucggcgaugccgc

SEQ ID NO: 1462833 - RNA, 23 nt, Pseudomonas aeruginosa PA01
gcucagcucggcgaugccgccgg

SEQ ID NO: 1462834 - RNA, 21 nt, Pseudomonas aeruginosa PA01
gcucagcucucccgaggcgau

SEQ ID NO: 1462835 - RNA, 14 nt, Pseudomonas aeruginosa PA01
gcucaggcacucga

SEQ ID NO: 1462836 - RNA, 23 nt, Pseudomonas aeruginosa PA01
gcucaggcacucgaugaacagcg

SEQ ID NO: 1462837 - RNA, 13 nt, Pseudomonas aeruginosa PA01
gcucaggccgggc

SEQ ID NO: 1462838 - RNA, 18 nt, Pseudomonas aeruginosa PA01
gcucaggcgaaccuggag

SEQ ID NO: 1462839 - RNA, 17 nt, Pseudomonas aeruginosa PA01
gcucaggcgcagcgucc

SEQ ID NO: 1462840 - RNA, 19 nt, Pseudomonas aeruginosa PA01
gcucaggcgcaguaacgcc

SEQ ID NO: 1462841 - RNA, 15 nt, Pseudomonas aeruginosa PA01
gcucagggucucgcg

SEQ ID NO: 1462842 - RNA, 18 nt, Pseudomonas aeruginosa PA01
gcucagggucucgcgggc

SEQ ID NO: 1462843 - RNA, 19 nt, Pseudomonas aeruginosa PA01
gcucagggucucgcgggcg

SEQ ID NO: 1462844 - RNA, 17 nt, Pseudomonas aeruginosa PA01
gcucagggccgcgccga

SEQ ID NO: 1462845 - RNA, 11 nt, Pseudomonas aeruginosa PA01
gcucaggucga

SEQ ID NO: 1462846 - RNA, 16 nt, Pseudomonas aeruginosa PA01
gcucaggucgucgagg

SEQ ID NO: 1462847 - RNA, 19 nt, Pseudomonas aeruginosa PA01
gcucaggcgcugcuggugg

SEQ ID NO: 1462848 - RNA, 14 nt, Pseudomonas aeruginosa PA01
gcucagggaaugga

SEQ ID NO: 1462849 - RNA, 18 nt, Pseudomonas aeruginosa PA01
gcucagggacaccccguc

SEQ ID NO: 1462850 - RNA, 13 nt, Pseudomonas aeruginosa PA01
gcucacggccgaa

SEQ ID NO: 1462851 - RNA, 15 nt, Pseudomonas aeruginosa PA01
gcucacggccgaaca

SEQ ID NO: 1462852 - RNA, 23 nt, Pseudomonas aeruginosa PA01
gcucacgcucgacauugcugccg

SEQ ID NO: 1462853 - RNA, 20 nt, Pseudomonas aeruginosa PA01
gcucacgcaccucgucgagc

SEQ ID NO: 1462854 - RNA, 16 nt, Pseudomonas aeruginosa PA01
gcucacgccccagcgc

SEQ ID NO: 1462855 - RNA, 19 nt, Pseudomonas aeruginosa PA01
gcucaccgcauagucgcga

SEQ ID NO: 1462856 - RNA, 22 nt, Pseudomonas aeruginosa PA01
gcucaccgccaccccgccggcg

SEQ ID NO: 1462857 - RNA, 23 nt, Pseudomonas aeruginosa PA01
gcucaccgccaccccgccggcgu

SEQ ID NO: 1462858 - RNA, 17 nt, Pseudomonas aeruginosa PA01
gcucacguagcccccgc

SEQ ID NO: 1462859 - RNA, 21 nt, Pseudomonas aeruginosa PA01
gcucacguagcccccgccgcu

SEQ ID NO: 1462860 - RNA, 20 nt, Pseudomonas aeruginosa PA01
gcucacucccguccagcgcu

SEQ ID NO: 1462861 - RNA, 18 nt, Pseudomonas aeruginosa PA01
gcucagaagucccagcga

SEQ ID NO: 1462862 - RNA, 21 nt, Pseudomonas aeruginosa PA01
gcucagaaauccaccuugccg

SEQ ID NO: 1462863 - RNA, 18 nt, Pseudomonas aeruginosa PA01
gcucagaacagcggcagc

SEQ ID NO: 1462864 - RNA, 22 nt, Pseudomonas aeruginosa PA01
gcucacugcgagcaccaugccg

SEQ ID NO: 1462865 - RNA, 16 nt, Pseudomonas aeruginosa PA01
gcucagcacggcgacg

SEQ ID NO: 1462866 - RNA, 20 nt, Pseudomonas aeruginosa PA01
gcucagauuaucugcgacug

SEQ ID NO: 1462867 - RNA, 14 nt, Pseudomonas aeruginosa PA01
gcucagcacccugg

SEQ ID NO: 1462868 - RNA, 16 nt, Pseudomonas aeruginosa PA01
gcucagcacccuggcc

SEQ ID NO: 1462869 - RNA, 18 nt, Pseudomonas aeruginosa PA01
gcucagcacccuggccac

SEQ ID NO: 1462870 - RNA, 23 nt, Pseudomonas aeruginosa PA01
gcucagcaccuugugcugccugc

SEQ ID NO: 1462871 - RNA, 15 nt, Pseudomonas aeruginosa PA01
gcucagcaggucgcg

SEQ ID NO: 1462872 - RNA, 15 nt, Pseudomonas aeruginosa PA01
gcucagcccaggcgc

SEQ ID NO: 1462873 - RNA, 16 nt, Pseudomonas aeruginosa PA01
gcucagcccaggcgcc

SEQ ID NO: 1462874 - RNA, 17 nt, Pseudomonas aeruginosa PA01
gcucagcccaggcgccg

SEQ ID NO: 1462875 - RNA, 19 nt, Pseudomonas aeruginosa PA01
gcucagccccgaucgccuc

SEQ ID NO: 1462876 - RNA, 16 nt, Pseudomonas aeruginosa PA01
gcuacggaaggucgcc

SEQ ID NO: 1462877 - RNA, 16 nt, Pseudomonas aeruginosa PA01
gcuaccgucggccugc

SEQ ID NO: 1462878 - RNA, 13 nt, Pseudomonas aeruginosa PA01
gcuacgaaccgag

SEQ ID NO: 1462879 - RNA, 18 nt, Pseudomonas aeruginosa PA01
gcuacgaaccgagcgguc

SEQ ID NO: 1462880 - RNA, 19 nt, Pseudomonas aeruginosa PA01
gcuacgaaggcgugccgcu

SEQ ID NO: 1462881 - RNA, 20 nt, Pseudomonas aeruginosa PA01
gcuacgaaggcgugccgcug

SEQ ID NO: 1462882 - RNA, 17 nt, Pseudomonas aeruginosa PA01
gcuagcccgucggcgac

SEQ ID NO: 1462883 - RNA, 17 nt, Pseudomonas aeruginosa PA01
gcuagcgcauggcgacc

SEQ ID NO: 1462884 - RNA, 21 nt, Pseudomonas aeruginosa PA01
gcuagcgcauggcgaccuggu

SEQ ID NO: 1462885 - RNA, 12 nt, Pseudomonas aeruginosa PA01
gcuacucgcccg

SEQ ID NO: 1462886 - RNA, 15 nt, Pseudomonas aeruginosa PA01
gcuacugcgcgggca

SEQ ID NO: 1462887 - RNA, 21 nt, Pseudomonas aeruginosa PA01
gcguugcauguccucggcgcc

SEQ ID NO: 1462888 - RNA, 15 nt, Pseudomonas aeruginosa PA01
gcuacccaggugguc

SEQ ID NO: 1462889 - RNA, 16 nt, Pseudomonas aeruginosa PA01
gcguugcagugcgccg

SEQ ID NO: 1462890 - RNA, 17 nt, Pseudomonas aeruginosa PA01
gcguugcagugcgccgc

SEQ ID NO: 1462891 - RNA, 15 nt, Pseudomonas aeruginosa PA01
gcuacccgcagggcu

SEQ ID NO: 1462892 - RNA, 15 nt, Pseudomonas aeruginosa PA01
gcuacccgcgccuuc

SEQ ID NO: 1462893 - RNA, 18 nt, Pseudomonas aeruginosa PA01
gcuaccgcgcauggcggc

SEQ ID NO: 1462894 - RNA, 19 nt, Pseudomonas aeruginosa PA01
gcuaccgcgcauggcggcg

SEQ ID NO: 1462895 - RNA, 21 nt, Pseudomonas aeruginosa PA01
gcuacccucaggggugcagcc

SEQ ID NO: 1462896 - RNA, 15 nt, Pseudomonas aeruginosa PA01
gcuaccgacaggacc

SEQ ID NO: 1462897 - RNA, 22 nt, Pseudomonas aeruginosa PA01
gcuaccgcaucgccaccgcgga

SEQ ID NO: 1462898 - RNA, 14 nt, Pseudomonas aeruginosa PA01
gcguucggcgcugg

SEQ ID NO: 1462899 - RNA, 16 nt, Pseudomonas aeruginosa PA01
gcguucggcgcuggcg

SEQ ID NO: 1462900 - RNA, 20 nt, Pseudomonas aeruginosa PA01
gcguucggggcccuccaggc

SEQ ID NO: 1462901 - RNA, 16 nt, Pseudomonas aeruginosa PA01
gcguucggucaggcug

SEQ ID NO: 1462902 - RNA, 15 nt, Pseudomonas aeruginosa PA01
gcguucggcgaugcc

SEQ ID NO: 1462903 - RNA, 22 nt, Pseudomonas aeruginosa PA01
gcguucggcgaugucgcgggca

SEQ ID NO: 1462904 - RNA, 11 nt, Pseudomonas aeruginosa PA01
gcguucgucgg

SEQ ID NO: 1462905 - RNA, 12 nt, Pseudomonas aeruginosa PA01
gcguucgucggc

SEQ ID NO: 1462906 - RNA, 12 nt, Pseudomonas aeruginosa PA01
gcguugcaggcg

SEQ ID NO: 1462907 - RNA, 15 nt, Pseudomonas aeruginosa PA01
gcguugcagcgccug

SEQ ID NO: 1462908 - RNA, 12 nt, Pseudomonas aeruginosa PA01
gcguugauccgg

SEQ ID NO: 1462909 - RNA, 18 nt, Pseudomonas aeruginosa PA01
gcucaaccgaacaggcga

SEQ ID NO: 1462910 - RNA, 20 nt, Pseudomonas aeruginosa PA01
gcucaacggcgugccgggca

SEQ ID NO: 1462911 - RNA, 13 nt, Pseudomonas aeruginosa PA01
gcuauggcggggc

SEQ ID NO: 1462912 - RNA, 21 nt, Pseudomonas aeruginosa PA01
gcuaugggcaccgcgccggcg

SEQ ID NO: 1462913 - RNA, 20 nt, Pseudomonas aeruginosa PA01
gcuauucugauugcguaacg

SEQ ID NO: 1462914 - RNA, 13 nt, Pseudomonas aeruginosa PA01
gcuauucccgccg

SEQ ID NO: 1462915 - RNA, 18 nt, Pseudomonas aeruginosa PA01
gcuauucccgccgcuccg

SEQ ID NO: 1462916 - RNA, 15 nt, Pseudomonas aeruginosa PA01
gcucaauccggcugg

SEQ ID NO: 1462917 - RNA, 16 nt, Pseudomonas aeruginosa PA01
gcucaagggcuggcag

SEQ ID NO: 1462918 - RNA, 15 nt, Pseudomonas aeruginosa PA01
gcucaacgccucgcg

SEQ ID NO: 1462919 - RNA, 20 nt, Pseudomonas aeruginosa PA01
gcucaacugguuggccgccu

SEQ ID NO: 1462920 - RNA, 22 nt, Pseudomonas aeruginosa PA01
gcucaacugguuggccgccugg

SEQ ID NO: 1462921 - RNA, 23 nt, Pseudomonas aeruginosa PA01
gcucaacugguuggccgccuggc

SEQ ID NO: 1462922 - RNA, 15 nt, Pseudomonas aeruginosa PA01
gcucaccaccaccgc

SEQ ID NO: 1462923 - RNA, 19 nt, Pseudomonas aeruginosa PA01
gcucaccaccaccgcgccg

SEQ ID NO: 1462924 - RNA, 20 nt, Pseudomonas aeruginosa PA01
gcucaccaccaccgcgccga

SEQ ID NO: 1462925 - RNA, 16 nt, Pseudomonas aeruginosa PA01
gcucacccacauggcg

SEQ ID NO: 1462926 - RNA, 19 nt, Pseudomonas aeruginosa PA01
gcucacccacauggcgguc

SEQ ID NO: 1462927 - RNA, 20 nt, Pseudomonas aeruginosa PA01
gcucacccacauggcggucc

SEQ ID NO: 1462928 - RNA, 17 nt, Pseudomonas aeruginosa PA01
gcucaccaggcccgccg

SEQ ID NO: 1462929 - RNA, 14 nt, Pseudomonas aeruginosa PA01
gcucacccuguccc

SEQ ID NO: 1462930 - RNA, 15 nt, Pseudomonas aeruginosa PA01
gcuaugcgccgggcc

SEQ ID NO: 1462931 - RNA, 16 nt, Pseudomonas aeruginosa PA01
gcuaugcgccguuacg

SEQ ID NO: 1462932 - RNA, 17 nt, Pseudomonas aeruginosa PA01
gcuaugcagcagguagu

SEQ ID NO: 1462933 - RNA, 23 nt, Pseudomonas aeruginosa PA01
gcuaucgcuggcgcagccgcugc

SEQ ID NO: 1462934 - RNA, 23 nt, Pseudomonas aeruginosa PA01
gcuaucgggcagggcagccgccg

SEQ ID NO: 1462935 - RNA, 14 nt, Pseudomonas aeruginosa PA01
gcuaucgccgccgc

SEQ ID NO: 1462936 - RNA, 19 nt, Pseudomonas aeruginosa PA01
gcuauccuccaggccgccg

SEQ ID NO: 1462937 - RNA, 23 nt, Pseudomonas aeruginosa PA01
gcuauccuccaggccgccggcga

SEQ ID NO: 1462938 - RNA, 20 nt, Pseudomonas aeruginosa PA01
gcuaucgaucacugccuggc

SEQ ID NO: 1462939 - RNA, 20 nt, Pseudomonas aeruginosa PA01
gcuaucccccggccgaugga

SEQ ID NO: 1462940 - RNA, 16 nt, Pseudomonas aeruginosa PA01
gcuauccgccgcuacu

SEQ ID NO: 1462941 - RNA, 17 nt, Pseudomonas aeruginosa PA01
gcuauccaccgucgcgg

SEQ ID NO: 1462942 - RNA, 20 nt, Pseudomonas aeruginosa PA01
gcuauccaccgucgcgguca

SEQ ID NO: 1462943 - RNA, 19 nt, Pseudomonas aeruginosa PA01
gcuaggcuggaagccgcgc

SEQ ID NO: 1462944 - RNA, 20 nt, Pseudomonas aeruginosa PA01
gcuagguuuccccguggcgc

SEQ ID NO: 1462945 - RNA, 21 nt, Pseudomonas aeruginosa PA01
gcuagguuuccccguggcgcc

SEQ ID NO: 1462946 - RNA, 13 nt, Pseudomonas aeruginosa PA01
gcuagggcgcccu

SEQ ID NO: 1462947 - RNA, 19 nt, Pseudomonas aeruginosa PA01
gcuagucuuccugcacgcu

SEQ ID NO: 1462948 - RNA, 22 nt, Pseudomonas aeruginosa PA01
gcuagucuuccugcacgcugcg

SEQ ID NO: 1462949 - RNA, 20 nt, Pseudomonas aeruginosa PA01
gcucuuucguuucagcgcca

SEQ ID NO: 1462950 - RNA, 22 nt, Pseudomonas aeruginosa PA01
gcugaaagcgauagccggggcc

SEQ ID NO: 1462951 - RNA, 17 nt, Pseudomonas aeruginosa PA01
gcugaaaaacgccuggg

SEQ ID NO: 1462952 - RNA, 20 nt, Pseudomonas aeruginosa PA01
gcugaaaaacgccugggcgu

SEQ ID NO: 1462953 - RNA, 19 nt, Pseudomonas aeruginosa PA01
gcucuucgauugucuccag

SEQ ID NO: 1462954 - RNA, 17 nt, Pseudomonas aeruginosa PA01
gcugaagcgccgcggcc

SEQ ID NO: 1462955 - RNA, 13 nt, Pseudomonas aeruginosa PA01
gcugaaggcggug

SEQ ID NO: 1462956 - RNA, 16 nt, Pseudomonas aeruginosa PA01
gcugaaggugagaugg

SEQ ID NO: 1462957 - RNA, 14 nt, Pseudomonas aeruginosa PA01
gcugaagcggccgc

SEQ ID NO: 1462958 - RNA, 16 nt, Pseudomonas aeruginosa PA01
gcugaagcggccgccg

SEQ ID NO: 1462959 - RNA, 17 nt, Pseudomonas aeruginosa PA01
gcugaagcggccgccga

SEQ ID NO: 1462960 - RNA, 17 nt, Pseudomonas aeruginosa PA01
gcugaagcccaggcguc

SEQ ID NO: 1462961 - RNA, 21 nt, Pseudomonas aeruginosa PA01
gcugaagcccaggcgucgcgc

SEQ ID NO: 1462962 - RNA, 20 nt, Pseudomonas aeruginosa PA01
gcugaagccccagcccaggg

SEQ ID NO: 1462963 - RNA, 19 nt, Pseudomonas aeruginosa PA01
gcugaauaccacguggccg

SEQ ID NO: 1462964 - RNA, 17 nt, Pseudomonas aeruginosa PA01
gcugaagugggucgccg

SEQ ID NO: 1462965 - RNA, 13 nt, Pseudomonas aeruginosa PA01
gcugacgccggca

SEQ ID NO: 1462966 - RNA, 15 nt, Pseudomonas aeruginosa PA01
gcugacgccggcacc

SEQ ID NO: 1462967 - RNA, 22 nt, Pseudomonas aeruginosa PA01
gcugacgccauucaggcggauc

SEQ ID NO: 1462968 - RNA, 22 nt, Pseudomonas aeruginosa PA01
gcugacgucgacgcagcgcgcg

SEQ ID NO: 1462969 - RNA, 16 nt, Pseudomonas aeruginosa PA01
gcugacggcguggcgg

SEQ ID NO: 1462970 - RNA, 18 nt, Pseudomonas aeruginosa PA01
gcugacggucugccagcu

SEQ ID NO: 1462971 - RNA, 20 nt, Pseudomonas aeruginosa PA01
gcugacggucugccagcucu

SEQ ID NO: 1462972 - RNA, 13 nt, Pseudomonas aeruginosa PA01
gcugacgcuggcg

SEQ ID NO: 1462973 - RNA, 18 nt, Pseudomonas aeruginosa PA01
gcugacgcuggcgaaggc

SEQ ID NO: 1462974 - RNA, 20 nt, Pseudomonas aeruginosa PA01
gcugacggcaaggaccugcu

SEQ ID NO: 1462975 - RNA, 16 nt, Pseudomonas aeruginosa PA01
gcugcaacauggcguc

SEQ ID NO: 1462976 - RNA, 21 nt, Pseudomonas aeruginosa PA01
gcugcaacauggcgucggcga

SEQ ID NO: 1462977 - RNA, 14 nt, Pseudomonas aeruginosa PA01
gcugaucgcgcaga

SEQ ID NO: 1462978 - RNA, 23 nt, Pseudomonas aeruginosa PA01
gcugaggauguagccggcuuccu

SEQ ID NO: 1462979 - RNA, 15 nt, Pseudomonas aeruginosa PA01
gcugaucggccgcca

SEQ ID NO: 1462980 - RNA, 17 nt, Pseudomonas aeruginosa PA01
gcugaucggcgcgccgg

SEQ ID NO: 1462981 - RNA, 18 nt, Pseudomonas aeruginosa PA01
gcugaucggcgcgccggc

SEQ ID NO: 1462982 - RNA, 13 nt, Pseudomonas aeruginosa PA01
gcugagcgccagg

SEQ ID NO: 1462983 - RNA, 14 nt, Pseudomonas aeruginosa PA01
gcugagcgccaggc

SEQ ID NO: 1462984 - RNA, 16 nt, Pseudomonas aeruginosa PA01
gcugagcggcuggugg

SEQ ID NO: 1462985 - RNA, 14 nt, Pseudomonas aeruginosa PA01
gcugaucaucagca

SEQ ID NO: 1462986 - RNA, 20 nt, Pseudomonas aeruginosa PA01
gcugaucaucagcaggguca

SEQ ID NO: 1462987 - RNA, 22 nt, Pseudomonas aeruginosa PA01
gcugaucaucagcagggucagg

SEQ ID NO: 1462988 - RNA, 16 nt, Pseudomonas aeruginosa PA01
gcugagcgccucgauc

SEQ ID NO: 1462989 - RNA, 22 nt, Pseudomonas aeruginosa PA01
gcugaucaggaggaucgccagg

SEQ ID NO: 1462990 - RNA, 18 nt, Pseudomonas aeruginosa PA01
gcugaggaucacgauggc

SEQ ID NO: 1462991 - RNA, 20 nt, Pseudomonas aeruginosa PA01
gcugaggaucacgauggccg

SEQ ID NO: 1462992 - RNA, 14 nt, Pseudomonas aeruginosa PA01
gcugaggaucagcc

SEQ ID NO: 1462993 - RNA, 23 nt, Pseudomonas aeruginosa PA01
gcugaggccgacgaacagccaga

SEQ ID NO: 1462994 - RNA, 14 nt, Pseudomonas aeruginosa PA01
gcugaucagcaccc

SEQ ID NO: 1462995 - RNA, 12 nt, Pseudomonas aeruginosa PA01
gcugaucagccc

SEQ ID NO: 1462996 - RNA, 15 nt, Pseudomonas aeruginosa PA01
gcugaucagcccgcu

SEQ ID NO: 1462997 - RNA, 19 nt, Pseudomonas aeruginosa PA01
gcugaucagcccgcugagg

SEQ ID NO: 1462998 - RNA, 13 nt, Pseudomonas aeruginosa PA01
gcugccagcgccg

SEQ ID NO: 1462999 - RNA, 13 nt, Pseudomonas aeruginosa PA01
gcugccagcaggc

SEQ ID NO: 1463000 - RNA, 16 nt, Pseudomonas aeruginosa PA01
gcugccagcaggccga

SEQ ID NO: 1463001 - RNA, 18 nt, Pseudomonas aeruginosa PA01
gcugccagcaggccgagc

SEQ ID NO: 1463002 - RNA, 18 nt, Pseudomonas aeruginosa PA01
gcugccagcauaaccccu

SEQ ID NO: 1463003 - RNA, 23 nt, Pseudomonas aeruginosa PA01
gcugccagcauaaccccuuugcc

SEQ ID NO: 1463004 - RNA, 21 nt, Pseudomonas aeruginosa PA01
gcugccccacaggcccugcag

SEQ ID NO: 1463005 - RNA, 16 nt, Pseudomonas aeruginosa PA01
gcugccagcgccgccg

SEQ ID NO: 1463006 - RNA, 20 nt, Pseudomonas aeruginosa PA01
gcugccagcgccgccgcgug

SEQ ID NO: 1463007 - RNA, 23 nt, Pseudomonas aeruginosa PA01
gcugcccggcgcgacgcuccagg

SEQ ID NO: 1463008 - RNA, 19 nt, Pseudomonas aeruginosa PA01
gcugcccggcauaggcgcc

SEQ ID NO: 1463009 - RNA, 22 nt, Pseudomonas aeruginosa PA01
gcugcccggcauaggcgccagc

SEQ ID NO: 1463010 - RNA, 14 nt, Pseudomonas aeruginosa PA01
gcugcccgacggcu

SEQ ID NO: 1463011 - RNA, 14 nt, Pseudomonas aeruginosa PA01
gcugccagcgccgc

SEQ ID NO: 1463012 - RNA, 22 nt, Pseudomonas aeruginosa PA01
gcugccgagaaucugcccggcc

SEQ ID NO: 1463013 - RNA, 17 nt, Pseudomonas aeruginosa PA01
gcugccgagcuuccagc

SEQ ID NO: 1463014 - RNA, 21 nt, Pseudomonas aeruginosa PA01
gcugccgaggcugaucugccg

SEQ ID NO: 1463015 - RNA, 18 nt, Pseudomonas aeruginosa PA01
gcugccgcucuggcugcu

SEQ ID NO: 1463016 - RNA, 22 nt, Pseudomonas aeruginosa PA01
gcugccgcucuggcugcuggcg

SEQ ID NO: 1463017 - RNA, 15 nt, Pseudomonas aeruginosa PA01
gcugcccuggcgcgc

SEQ ID NO: 1463018 - RNA, 16 nt, Pseudomonas aeruginosa PA01
gcugcccuggcgcgcg

SEQ ID NO: 1463019 - RNA, 20 nt, Pseudomonas aeruginosa PA01
gcugccgaagggaaacacca

SEQ ID NO: 1463020 - RNA, 23 nt, Pseudomonas aeruginosa PA01
gcugccgaagaucgacaggccgc

SEQ ID NO: 1463021 - RNA, 19 nt, Pseudomonas aeruginosa PA01
gcugccgaagccuucgucg

SEQ ID NO: 1463022 - RNA, 21 nt, Pseudomonas aeruginosa PA01
gcugccgaagccuucgucgau

SEQ ID NO: 1463023 - RNA, 21 nt, Pseudomonas aeruginosa PA01
gcugcccucgaccagguccgg

SEQ ID NO: 1463024 - RNA, 23 nt, Pseudomonas aeruginosa PA01
gcugcccucgacgauauccacgc

SEQ ID NO: 1463025 - RNA, 22 nt, Pseudomonas aeruginosa PA01
gcugcaaccgauauggcuggcg

SEQ ID NO: 1463026 - RNA, 15 nt, Pseudomonas aeruginosa PA01
gcugcaacgccggcc

SEQ ID NO: 1463027 - RNA, 16 nt, Pseudomonas aeruginosa PA01
gcugcaacgccggccc

SEQ ID NO: 1463028 - RNA, 15 nt, Pseudomonas aeruginosa PA01
gcugcaccgcgcgga

SEQ ID NO: 1463029 - RNA, 17 nt, Pseudomonas aeruginosa PA01
gcugcacgcacgcgccu

SEQ ID NO: 1463030 - RNA, 19 nt, Pseudomonas aeruginosa PA01
gcugcacgcacgcgccugc

SEQ ID NO: 1463031 - RNA, 21 nt, Pseudomonas aeruginosa PA01
gcugcacggagugggccgcgu

SEQ ID NO: 1463032 - RNA, 16 nt, Pseudomonas aeruginosa PA01
gcugcaucggcgcgcc

SEQ ID NO: 1463033 - RNA, 17 nt, Pseudomonas aeruginosa PA01
gcugcaucggcgcgccg

SEQ ID NO: 1463034 - RNA, 13 nt, Pseudomonas aeruginosa PA01
gcugcaucggcuc

SEQ ID NO: 1463035 - RNA, 23 nt, Pseudomonas aeruginosa PA01
gcugcaugcggaacaccgccugg

SEQ ID NO: 1463036 - RNA, 16 nt, Pseudomonas aeruginosa PA01
gcugcaugccgggguc

SEQ ID NO: 1463037 - RNA, 22 nt, Pseudomonas aeruginosa PA01
gcugcauggggauggucgagag

SEQ ID NO: 1463038 - RNA, 13 nt, Pseudomonas aeruginosa PA01
gcugcauguccgc

SEQ ID NO: 1463039 - RNA, 17 nt, Pseudomonas aeruginosa PA01
gcugcauguccgccagu

SEQ ID NO: 1463040 - RNA, 18 nt, Pseudomonas aeruginosa PA01
gcugcaugugccaggccu

SEQ ID NO: 1463041 - RNA, 15 nt, Pseudomonas aeruginosa PA01
gcugcagggcggcgc

SEQ ID NO: 1463042 - RNA, 13 nt, Pseudomonas aeruginosa PA01
gcugcagggccag

SEQ ID NO: 1463043 - RNA, 13 nt, Pseudomonas aeruginosa PA01
gcugcagguggcg

SEQ ID NO: 1463044 - RNA, 12 nt, Pseudomonas aeruginosa PA01
gcugcaggccga

SEQ ID NO: 1463045 - RNA, 14 nt, Pseudomonas aeruginosa PA01
gcugcaggccgaga

SEQ ID NO: 1463046 - RNA, 20 nt, Pseudomonas aeruginosa PA01
gcugcaggccgagaccgcag

SEQ ID NO: 1463047 - RNA, 14 nt, Pseudomonas aeruginosa PA01
gcucggccgccagc

SEQ ID NO: 1463048 - RNA, 17 nt, Pseudomonas aeruginosa PA01
gcucggccgccuggcgu

SEQ ID NO: 1463049 - RNA, 20 nt, Pseudomonas aeruginosa PA01
gcucggccgccuggcgugcc

SEQ ID NO: 1463050 - RNA, 13 nt, Pseudomonas aeruginosa PA01
gcucggccgcucg

SEQ ID NO: 1463051 - RNA, 12 nt, Pseudomonas aeruginosa PA01
gcucggccggca

SEQ ID NO: 1463052 - RNA, 23 nt, Pseudomonas aeruginosa PA01
gcucggccugaucaucugggcca

SEQ ID NO: 1463053 - RNA, 18 nt, Pseudomonas aeruginosa PA01
gcucggccugcugcgccg

SEQ ID NO: 1463054 - RNA, 21 nt, Pseudomonas aeruginosa PA01
gcucggccugcugcgccggca

SEQ ID NO: 1463055 - RNA, 17 nt, Pseudomonas aeruginosa PA01
gcucggccuggaucgcc

SEQ ID NO: 1463056 - RNA, 12 nt, Pseudomonas aeruginosa PA01
gcucggccuggu

SEQ ID NO: 1463057 - RNA, 15 nt, Pseudomonas aeruginosa PA01
gcucggccugguccg

SEQ ID NO: 1463058 - RNA, 22 nt, Pseudomonas aeruginosa PA01
gcucggccuggugcaccuggcg

SEQ ID NO: 1463059 - RNA, 21 nt, Pseudomonas aeruginosa PA01
gcucggcauucgacccgccga

SEQ ID NO: 1463060 - RNA, 23 nt, Pseudomonas aeruginosa PA01
gcucggcauucgacccgccgacc

SEQ ID NO: 1463061 - RNA, 12 nt, Pseudomonas aeruginosa PA01
gcucggacgaca

SEQ ID NO: 1463062 - RNA, 21 nt, Pseudomonas aeruginosa PA01
gcucggcgacauagccggcga

SEQ ID NO: 1463063 - RNA, 12 nt, Pseudomonas aeruginosa PA01
gcucggcgagcc

SEQ ID NO: 1463064 - RNA, 17 nt, Pseudomonas aeruginosa PA01
gcucggcgagccgccgg

SEQ ID NO: 1463065 - RNA, 19 nt, Pseudomonas aeruginosa PA01
gcucggcgagccgccgggc

SEQ ID NO: 1463066 - RNA, 18 nt, Pseudomonas aeruginosa PA01
gcucggccuuguccggca

SEQ ID NO: 1463067 - RNA, 21 nt, Pseudomonas aeruginosa PA01
gcucggccuuguccggcacca

SEQ ID NO: 1463068 - RNA, 22 nt, Pseudomonas aeruginosa PA01
gcucggcgaccuugcgcaccag

SEQ ID NO: 1463069 - RNA, 15 nt, Pseudomonas aeruginosa PA01
gcucggcacgcagca

SEQ ID NO: 1463070 - RNA, 18 nt, Pseudomonas aeruginosa PA01
gcucggcacgcagcagcu

SEQ ID NO: 1463071 - RNA, 17 nt, Pseudomonas aeruginosa PA01
gcucggcacgcguggcg

SEQ ID NO: 1463072 - RNA, 22 nt, Pseudomonas aeruginosa PA01
gcucggaucaggcgggcuccgc

SEQ ID NO: 1463073 - RNA, 15 nt, Pseudomonas aeruginosa PA01
gcucggauuccagcg

SEQ ID NO: 1463074 - RNA, 16 nt, Pseudomonas aeruginosa PA01
gcucggauuccagcgc

SEQ ID NO: 1463075 - RNA, 20 nt, Pseudomonas aeruginosa PA01
gcucggauuccagcgcggug

SEQ ID NO: 1463076 - RNA, 16 nt, Pseudomonas aeruginosa PA01
gcucggcaagcgaacc

SEQ ID NO: 1463077 - RNA, 17 nt, Pseudomonas aeruginosa PA01
gcucggcaagcgaaccg

SEQ ID NO: 1463078 - RNA, 14 nt, Pseudomonas aeruginosa PA01
gcuccaggcgggug

SEQ ID NO: 1463079 - RNA, 17 nt, Pseudomonas aeruginosa PA01
gcuccagggagcgcucg

SEQ ID NO: 1463080 - RNA, 18 nt, Pseudomonas aeruginosa PA01
gcuccagggagcgcucgc

SEQ ID NO: 1463081 - RNA, 23 nt, Pseudomonas aeruginosa PA01
gcuccagggagcgcucgcgcagc

SEQ ID NO: 1463082 - RNA, 15 nt, Pseudomonas aeruginosa PA01
gcuccagggcgcuga

SEQ ID NO: 1463083 - RNA, 18 nt, Pseudomonas aeruginosa PA01
gcuccagggcgcugacca

SEQ ID NO: 1463084 - RNA, 20 nt, Pseudomonas aeruginosa PA01
gcuccagggcugccaccgag

SEQ ID NO: 1463085 - RNA, 21 nt, Pseudomonas aeruginosa PA01
gcuccaguucguugaccacgc

SEQ ID NO: 1463086 - RNA, 16 nt, Pseudomonas aeruginosa PA01
gcuccagucggggcag

SEQ ID NO: 1463087 - RNA, 17 nt, Pseudomonas aeruginosa PA01
gcuccagucggggcagg

SEQ ID NO: 1463088 - RNA, 21 nt, Pseudomonas aeruginosa PA01
gcuccagucggggcaggcgca

SEQ ID NO: 1463089 - RNA, 18 nt, Pseudomonas aeruginosa PA01
gcuccaggugcacggcca

SEQ ID NO: 1463090 - RNA, 18 nt, Pseudomonas aeruginosa PA01
gcuccagguucggcgcca

SEQ ID NO: 1463091 - RNA, 20 nt, Pseudomonas aeruginosa PA01
gcuccagguucggcgccagc

SEQ ID NO: 1463092 - RNA, 15 nt, Pseudomonas aeruginosa PA01
gcucggcuccagcca

SEQ ID NO: 1463093 - RNA, 16 nt, Pseudomonas aeruginosa PA01
gcucggcuccagccag

SEQ ID NO: 1463094 - RNA, 22 nt, Pseudomonas aeruginosa PA01
gcucggcuccaggaccggcagg

SEQ ID NO: 1463095 - RNA, 15 nt, Pseudomonas aeruginosa PA01
gcucggcgucgucga

SEQ ID NO: 1463096 - RNA, 16 nt, Pseudomonas aeruginosa PA01
gcucggcgucgucgau

SEQ ID NO: 1463097 - RNA, 17 nt, Pseudomonas aeruginosa PA01
gcucggcgucgucgauc

SEQ ID NO: 1463098 - RNA, 12 nt, Pseudomonas aeruginosa PA01
gcucggcgucca

SEQ ID NO: 1463099 - RNA, 18 nt, Pseudomonas aeruginosa PA01
gcucggcgggcugccgcg

SEQ ID NO: 1463100 - RNA, 19 nt, Pseudomonas aeruginosa PA01
gcucggcggugaccggauc

SEQ ID NO: 1463101 - RNA, 18 nt, Pseudomonas aeruginosa PA01
gcucggcguagccggcga

SEQ ID NO: 1463102 - RNA, 20 nt, Pseudomonas aeruginosa PA01
gcucggcguagccggcgauc

SEQ ID NO: 1463103 - RNA, 18 nt, Pseudomonas aeruginosa PA01
gcucggcguagcgcuggg

SEQ ID NO: 1463104 - RNA, 18 nt, Pseudomonas aeruginosa PA01
gcucggcggccucgcggg

SEQ ID NO: 1463105 - RNA, 14 nt, Pseudomonas aeruginosa PA01
gcucggcggcgcgc

SEQ ID NO: 1463106 - RNA, 15 nt, Pseudomonas aeruginosa PA01
gcucggcggcgcgca

SEQ ID NO: 1463107 - RNA, 16 nt, Pseudomonas aeruginosa PA01
gcucggcggcgcgcag

SEQ ID NO: 1463108 - RNA, 21 nt, Pseudomonas aeruginosa PA01
gcucggcggccauugccgcgg

SEQ ID NO: 1463109 - RNA, 22 nt, Pseudomonas aeruginosa PA01
gcucggcggcaggcugcgccgc

SEQ ID NO: 1463110 - RNA, 13 nt, Pseudomonas aeruginosa PA01
gcucggcgcucgg

SEQ ID NO: 1463111 - RNA, 16 nt, Pseudomonas aeruginosa PA01
gcucggcuucgcguug

SEQ ID NO: 1463112 - RNA, 19 nt, Pseudomonas aeruginosa PA01
gcucggcugcuugccggug

SEQ ID NO: 1463113 - RNA, 12 nt, Pseudomonas aeruginosa PA01
gcucgggcgcgg

SEQ ID NO: 1463114 - RNA, 13 nt, Pseudomonas aeruginosa PA01
gcucgggcgcgga

SEQ ID NO: 1463115 - RNA, 17 nt, Pseudomonas aeruginosa PA01
gcucgggcugccgcaga

SEQ ID NO: 1463116 - RNA, 23 nt, Pseudomonas aeruginosa PA01
gcucgggcgucuccugccgccga

SEQ ID NO: 1463117 - RNA, 17 nt, Pseudomonas aeruginosa PA01
gcucggggcaucggcca

SEQ ID NO: 1463118 - RNA, 20 nt, Pseudomonas aeruginosa PA01
gcucggggaacacgcgcugg

SEQ ID NO: 1463119 - RNA, 22 nt, Pseudomonas aeruginosa PA01
gcucggggaacacgcgcuggag

SEQ ID NO: 1463120 - RNA, 23 nt, Pseudomonas aeruginosa PA01
gcucggguaauccacgcugugcg

SEQ ID NO: 1463121 - RNA, 17 nt, Pseudomonas aeruginosa PA01
gcucggggucgucgcug

SEQ ID NO: 1463122 - RNA, 16 nt, Pseudomonas aeruginosa PA01
gcucggggugcgcggc

SEQ ID NO: 1463123 - RNA, 18 nt, Pseudomonas aeruginosa PA01
gcucggggugcgcggcga

SEQ ID NO: 1463124 - RNA, 19 nt, Pseudomonas aeruginosa PA01
gcucuucggcggccagcgg

SEQ ID NO: 1463125 - RNA, 20 nt, Pseudomonas aeruginosa PA01
gcucuugauacccaccggcu

SEQ ID NO: 1463126 - RNA, 17 nt, Pseudomonas aeruginosa PA01
gcucuucugguaggcca

SEQ ID NO: 1463127 - RNA, 15 nt, Pseudomonas aeruginosa PA01
gcucuucgccgcggc

SEQ ID NO: 1463128 - RNA, 23 nt, Pseudomonas aeruginosa PA01
gcucugguucggcgucuucggcg

SEQ ID NO: 1463129 - RNA, 17 nt, Pseudomonas aeruginosa PA01
gcucugguagccgcagu

SEQ ID NO: 1463130 - RNA, 20 nt, Pseudomonas aeruginosa PA01
gcucugguagccgcagucca

SEQ ID NO: 1463131 - RNA, 18 nt, Pseudomonas aeruginosa PA01
gcucuggaugcggcgcug

SEQ ID NO: 1463132 - RNA, 17 nt, Pseudomonas aeruginosa PA01
gcucuguuucgggucgc

SEQ ID NO: 1463133 - RNA, 22 nt, Pseudomonas aeruginosa PA01
gcucuucacauggugggcgccg

SEQ ID NO: 1463134 - RNA, 23 nt, Pseudomonas aeruginosa PA01
gcucuucacauggugggcgccgc

SEQ ID NO: 1463135 - RNA, 16 nt, Pseudomonas aeruginosa PA01
gcucuucagcacgccc

SEQ ID NO: 1463136 - RNA, 20 nt, Pseudomonas aeruginosa PA01
gcucugcucggccagcgcca

SEQ ID NO: 1463137 - RNA, 13 nt, Pseudomonas aeruginosa PA01
gcucugcuccagc

SEQ ID NO: 1463138 - RNA, 16 nt, Pseudomonas aeruginosa PA01
gcucugcuccagcaau

SEQ ID NO: 1463139 - RNA, 22 nt, Pseudomonas aeruginosa PA01
gcucugcuccagcaaugccagc

SEQ ID NO: 1463140 - RNA, 14 nt, Pseudomonas aeruginosa PA01
gcucuggccgcgcu

SEQ ID NO: 1463141 - RNA, 17 nt, Pseudomonas aeruginosa PA01
gcucuggccgcgcucca

SEQ ID NO: 1463142 - RNA, 23 nt, Pseudomonas aeruginosa PA01
gcucuggccguucuccaggucga

SEQ ID NO: 1463143 - RNA, 17 nt, Pseudomonas aeruginosa PA01
gcucuggcgcagggaga

SEQ ID NO: 1463144 - RNA, 17 nt, Pseudomonas aeruginosa PA01
gcucuggcugcuggcga

SEQ ID NO: 1463145 - RNA, 13 nt, Pseudomonas aeruginosa PA01
gcucucgcgcagc

SEQ ID NO: 1463146 - RNA, 16 nt, Pseudomonas aeruginosa PA01
gcucucgcgcagcagg

SEQ ID NO: 1463147 - RNA, 20 nt, Pseudomonas aeruginosa PA01
gcucugccagaaggccugcg

SEQ ID NO: 1463148 - RNA, 17 nt, Pseudomonas aeruginosa PA01
gcucugccggugugccg

SEQ ID NO: 1463149 - RNA, 23 nt, Pseudomonas aeruginosa PA01
gcucugcgacuggaugcagccga

SEQ ID NO: 1463150 - RNA, 17 nt, Pseudomonas aeruginosa PA01
gcucugcgaucagggcc

SEQ ID NO: 1463151 - RNA, 19 nt, Pseudomonas aeruginosa PA01
gcucugcacaaacucaggg

SEQ ID NO: 1463152 - RNA, 13 nt, Pseudomonas aeruginosa PA01
gcucugcuggcca

SEQ ID NO: 1463153 - RNA, 14 nt, Pseudomonas aeruginosa PA01
gcucugcuggccgc

SEQ ID NO: 1463154 - RNA, 16 nt, Pseudomonas aeruginosa PA01
gcucugcuggccgccc

SEQ ID NO: 1463155 - RNA, 14 nt, Pseudomonas aeruginosa PA01
gcucugcuggcugu

SEQ ID NO: 1463156 - RNA, 13 nt, Pseudomonas aeruginosa PA01
gcucugcgccagg

SEQ ID NO: 1463157 - RNA, 13 nt, Pseudomonas aeruginosa PA01
gcucugcgccgcg

SEQ ID NO: 1463158 - RNA, 15 nt, Pseudomonas aeruginosa PA01
gcucugcgccgcggc

SEQ ID NO: 1463159 - RNA, 13 nt, Pseudomonas aeruginosa PA01
gcucgguuccagc

SEQ ID NO: 1463160 - RNA, 14 nt, Pseudomonas aeruginosa PA01
gcucgguuccagcu

SEQ ID NO: 1463161 - RNA, 19 nt, Pseudomonas aeruginosa PA01
gcucgguugccaggccggc

SEQ ID NO: 1463162 - RNA, 20 nt, Pseudomonas aeruginosa PA01
gcucgguugccaggccggcg

SEQ ID NO: 1463163 - RNA, 22 nt, Pseudomonas aeruginosa PA01
gcucgguggcaugguguccggc

SEQ ID NO: 1463164 - RNA, 20 nt, Pseudomonas aeruginosa PA01
gcucggugugaucaccagcc

SEQ ID NO: 1463165 - RNA, 15 nt, Pseudomonas aeruginosa PA01
gcucggugagcaggc

SEQ ID NO: 1463166 - RNA, 21 nt, Pseudomonas aeruginosa PA01
gcucggugaggaacuugucga

SEQ ID NO: 1463167 - RNA, 23 nt, Pseudomonas aeruginosa PA01
gcucggucucgaucggcccgggc

SEQ ID NO: 1463168 - RNA, 19 nt, Pseudomonas aeruginosa PA01
gcucggucgcgcgggugcg

SEQ ID NO: 1463169 - RNA, 17 nt, Pseudomonas aeruginosa PA01
gcucggucagcggcgca

SEQ ID NO: 1463170 - RNA, 21 nt, Pseudomonas aeruginosa PA01
gcucggucgagccccacgucg

SEQ ID NO: 1463171 - RNA, 21 nt, Pseudomonas aeruginosa PA01
gcucguccauguugcggccca

SEQ ID NO: 1463172 - RNA, 21 nt, Pseudomonas aeruginosa PA01
gcucgucgagcugcucggcgg

SEQ ID NO: 1463173 - RNA, 21 nt, Pseudomonas aeruginosa PA01
gcucgucaucguccagcucgg

SEQ ID NO: 1463174 - RNA, 22 nt, Pseudomonas aeruginosa PA01
gcucgucaucguccagcucggc

SEQ ID NO: 1463175 - RNA, 18 nt, Pseudomonas aeruginosa PA01
gcucgucauggcgcacgc

SEQ ID NO: 1463176 - RNA, 13 nt, Pseudomonas aeruginosa PA01
gcucguccaggcc

SEQ ID NO: 1463177 - RNA, 18 nt, Pseudomonas aeruginosa PA01
gcucguagccggcgcggc

SEQ ID NO: 1463178 - RNA, 15 nt, Pseudomonas aeruginosa PA01
gcucgucacccgcgc

SEQ ID NO: 1463179 - RNA, 13 nt, Pseudomonas aeruginosa PA01
gcuggcagggcgc

SEQ ID NO: 1463180 - RNA, 15 nt, Pseudomonas aeruginosa PA01
gcuggcaggugccgc

SEQ ID NO: 1463181 - RNA, 18 nt, Pseudomonas aeruginosa PA01
gcuggcagguugcacggc

SEQ ID NO: 1463182 - RNA, 21 nt, Pseudomonas aeruginosa PA01
gcuggcauacacaugcaggcu

SEQ ID NO: 1463183 - RNA, 13 nt, Pseudomonas aeruginosa PA01
gcuggcaucggug

SEQ ID NO: 1463184 - RNA, 19 nt, Pseudomonas aeruginosa PA01
gcuggcagaacgcgucgac

SEQ ID NO: 1463185 - RNA, 14 nt, Pseudomonas aeruginosa PA01
gcuggcaccggcca

SEQ ID NO: 1463186 - RNA, 17 nt, Pseudomonas aeruginosa PA01
gcuggcaccggccaggc

SEQ ID NO: 1463187 - RNA, 19 nt, Pseudomonas aeruginosa PA01
gcuggcaacggcgggccgc

SEQ ID NO: 1463188 - RNA, 16 nt, Pseudomonas aeruginosa PA01
gcuggauggggcugau

SEQ ID NO: 1463189 - RNA, 18 nt, Pseudomonas aeruginosa PA01
gcuggauuucgccgagug

SEQ ID NO: 1463190 - RNA, 20 nt, Pseudomonas aeruginosa PA01
gcuggaucugguggaacagc

SEQ ID NO: 1463191 - RNA, 20 nt, Pseudomonas aeruginosa PA01
gcuggaugcccuccugggcc

SEQ ID NO: 1463192 - RNA, 22 nt, Pseudomonas aeruginosa PA01
gcuggaugcccuccugggccug

SEQ ID NO: 1463193 - RNA, 15 nt, Pseudomonas aeruginosa PA01
gcuggaugccgacca

SEQ ID NO: 1463194 - RNA, 15 nt, Pseudomonas aeruginosa PA01
gcuggaugucggcga

SEQ ID NO: 1463195 - RNA, 18 nt, Pseudomonas aeruginosa PA01
gcuggauccgugccaggc

SEQ ID NO: 1463196 - RNA, 19 nt, Pseudomonas aeruginosa PA01
gcuggauccgugccaggcg

SEQ ID NO: 1463197 - RNA, 20 nt, Pseudomonas aeruginosa PA01
gcuggauccgugccaggcgc

SEQ ID NO: 1463198 - RNA, 16 nt, Pseudomonas aeruginosa PA01
gcuggauccucgccuc

SEQ ID NO: 1463199 - RNA, 22 nt, Pseudomonas aeruginosa PA01
gcuggauccucgccucgcgcca

SEQ ID NO: 1463200 - RNA, 23 nt, Pseudomonas aeruginosa PA01
gcuggauccucgccucgcgccag

SEQ ID NO: 1463201 - RNA, 19 nt, Pseudomonas aeruginosa PA01
gcuggauagaguacucggc

SEQ ID NO: 1463202 - RNA, 20 nt, Pseudomonas aeruginosa PA01
gcuggauagaguacucggcu

SEQ ID NO: 1463203 - RNA, 21 nt, Pseudomonas aeruginosa PA01
gcuggauagaguacucggcua

SEQ ID NO: 1463204 - RNA, 20 nt, Pseudomonas aeruginosa PA01
gcuggaguaucgcccuggcc

SEQ ID NO: 1463205 - RNA, 21 nt, Pseudomonas aeruginosa PA01
gcuggaguaucgcccuggccu

SEQ ID NO: 1463206 - RNA, 18 nt, Pseudomonas aeruginosa PA01
gcuggacgugcaggauca

SEQ ID NO: 1463207 - RNA, 22 nt, Pseudomonas aeruginosa PA01
gcuggacgugcaggaucaccug

SEQ ID NO: 1463208 - RNA, 15 nt, Pseudomonas aeruginosa PA01
gcuggacucgcgcca

SEQ ID NO: 1463209 - RNA, 19 nt, Pseudomonas aeruginosa PA01
gcuggacuucggucucguc

SEQ ID NO: 1463210 - RNA, 15 nt, Pseudomonas aeruginosa PA01
gcuggagcugcgcgc

SEQ ID NO: 1463211 - RNA, 13 nt, Pseudomonas aeruginosa PA01
gcuggagcgcugc

SEQ ID NO: 1463212 - RNA, 15 nt, Pseudomonas aeruginosa PA01
gcuggagcgcugcgg

SEQ ID NO: 1463213 - RNA, 16 nt, Pseudomonas aeruginosa PA01
gcuggagcagcagcgc

SEQ ID NO: 1463214 - RNA, 18 nt, Pseudomonas aeruginosa PA01
gcuggagcagcagcgccg

SEQ ID NO: 1463215 - RNA, 19 nt, Pseudomonas aeruginosa PA01
gcuggagcagcagcgccgc

SEQ ID NO: 1463216 - RNA, 14 nt, Pseudomonas aeruginosa PA01
gcuggcccuccauc

SEQ ID NO: 1463217 - RNA, 16 nt, Pseudomonas aeruginosa PA01
gcuggccgagcgccgc

SEQ ID NO: 1463218 - RNA, 17 nt, Pseudomonas aeruginosa PA01
gcuggccgagcugccgc

SEQ ID NO: 1463219 - RNA, 17 nt, Pseudomonas aeruginosa PA01
gcuggccgagggcgcgc

SEQ ID NO: 1463220 - RNA, 19 nt, Pseudomonas aeruginosa PA01
gcuggccgagggcgcgcag

SEQ ID NO: 1463221 - RNA, 22 nt, Pseudomonas aeruginosa PA01
gcuggccgcggugggcuccagc

SEQ ID NO: 1463222 - RNA, 12 nt, Pseudomonas aeruginosa PA01
gcuggccgcgca

SEQ ID NO: 1463223 - RNA, 14 nt, Pseudomonas aeruginosa PA01
gcuggccgcgcagg

SEQ ID NO: 1463224 - RNA, 13 nt, Pseudomonas aeruginosa PA01
gcuggccgcgcga

SEQ ID NO: 1463225 - RNA, 17 nt, Pseudomonas aeruginosa PA01
gcuggccgcccuugcgg

SEQ ID NO: 1463226 - RNA, 16 nt, Pseudomonas aeruginosa PA01
gcuggccgccuggccg

SEQ ID NO: 1463227 - RNA, 20 nt, Pseudomonas aeruginosa PA01
gcuggccgccuggccggcca

SEQ ID NO: 1463228 - RNA, 15 nt, Pseudomonas aeruginosa PA01
gcuggccgccucgcg

SEQ ID NO: 1463229 - RNA, 17 nt, Pseudomonas aeruginosa PA01
gcuggccgccucgcgcc

SEQ ID NO: 1463230 - RNA, 22 nt, Pseudomonas aeruginosa PA01
gcuggccaguuccaugucgcug

SEQ ID NO: 1463231 - RNA, 19 nt, Pseudomonas aeruginosa PA01
gcuggccaguugcgcuccg

SEQ ID NO: 1463232 - RNA, 20 nt, Pseudomonas aeruginosa PA01
gcuggccaguugcgcuccgg

SEQ ID NO: 1463233 - RNA, 21 nt, Pseudomonas aeruginosa PA01
gcuggccaguugcgcuccggu

SEQ ID NO: 1463234 - RNA, 21 nt, Pseudomonas aeruginosa PA01
gcuggccauccauaucggcca

SEQ ID NO: 1463235 - RNA, 14 nt, Pseudomonas aeruginosa PA01
gcuggccauccgcc

SEQ ID NO: 1463236 - RNA, 18 nt, Pseudomonas aeruginosa PA01
gcuggcccaacagcggug

SEQ ID NO: 1463237 - RNA, 19 nt, Pseudomonas aeruginosa PA01
gcuggccaugauccggugc

SEQ ID NO: 1463238 - RNA, 19 nt, Pseudomonas aeruginosa PA01
gcuggcccaguugcccggc

SEQ ID NO: 1463239 - RNA, 21 nt, Pseudomonas aeruginosa PA01
gcuggcccaguugcccggccu

SEQ ID NO: 1463240 - RNA, 13 nt, Pseudomonas aeruginosa PA01
gcuggccagcaau

SEQ ID NO: 1463241 - RNA, 18 nt, Pseudomonas aeruginosa PA01
gcuggccagcaauacccg

SEQ ID NO: 1463242 - RNA, 12 nt, Pseudomonas aeruginosa PA01
gcuggccagcag

SEQ ID NO: 1463243 - RNA, 15 nt, Pseudomonas aeruginosa PA01
gcuggccagcaggcu

SEQ ID NO: 1463244 - RNA, 22 nt, Pseudomonas aeruginosa PA01
gcuggccagcaggcuggcggca

SEQ ID NO: 1463245 - RNA, 13 nt, Pseudomonas aeruginosa PA01
gcuggccagcccu

SEQ ID NO: 1463246 - RNA, 16 nt, Pseudomonas aeruginosa PA01
gcuggccagcccuggu

SEQ ID NO: 1463247 - RNA, 17 nt, Pseudomonas aeruginosa PA01
gcuggccaccagcaccu

SEQ ID NO: 1463248 - RNA, 13 nt, Pseudomonas aeruginosa PA01
gcuggccaccgcc

SEQ ID NO: 1463249 - RNA, 14 nt, Pseudomonas aeruginosa PA01
gcuggccaccgcca

SEQ ID NO: 1463250 - RNA, 16 nt, Pseudomonas aeruginosa PA01
gcuggccaccgccagg

SEQ ID NO: 1463251 - RNA, 17 nt, Pseudomonas aeruginosa PA01
gcuggccaccgccagga

SEQ ID NO: 1463252 - RNA, 22 nt, Pseudomonas aeruginosa PA01
gcuggccaccgccaggaccucg

SEQ ID NO: 1463253 - RNA, 23 nt, Pseudomonas aeruginosa PA01
gcuggccaccgccaggaccucga

SEQ ID NO: 1463254 - RNA, 17 nt, Pseudomonas aeruginosa PA01
gcuggccaccgggauca

SEQ ID NO: 1463255 - RNA, 22 nt, Pseudomonas aeruginosa PA01
gcuggccaccgggaucagcggc

SEQ ID NO: 1463256 - RNA, 15 nt, Pseudomonas aeruginosa PA01
gcuggaacggccagg

SEQ ID NO: 1463257 - RNA, 15 nt, Pseudomonas aeruginosa PA01
gcuggaagccgcgcu

SEQ ID NO: 1463258 - RNA, 20 nt, Pseudomonas aeruginosa PA01
gcuggaagccgcgcucgcgg

SEQ ID NO: 1463259 - RNA, 13 nt, Pseudomonas aeruginosa PA01
gcuggaagucgcc

SEQ ID NO: 1463260 - RNA, 15 nt, Pseudomonas aeruginosa PA01
gcuggaagucgcccu

SEQ ID NO: 1463261 - RNA, 17 nt, Pseudomonas aeruginosa PA01
gcuggaagucgcccugc

SEQ ID NO: 1463262 - RNA, 16 nt, Pseudomonas aeruginosa PA01
gcuggaaccggccggc

SEQ ID NO: 1463263 - RNA, 15 nt, Pseudomonas aeruginosa PA01
gcuggaaaacgccac

SEQ ID NO: 1463264 - RNA, 15 nt, Pseudomonas aeruginosa PA01
gcuggaaauggcggu

SEQ ID NO: 1463265 - RNA, 19 nt, Pseudomonas aeruginosa PA01
gcuggaaauggcggucgcc

SEQ ID NO: 1463266 - RNA, 22 nt, Pseudomonas aeruginosa PA01
gcuggaaauggcggucgccgac

SEQ ID NO: 1463267 - RNA, 14 nt, Pseudomonas aeruginosa PA01
gcuggacgaaccag

SEQ ID NO: 1463268 - RNA, 15 nt, Pseudomonas aeruginosa PA01
gcuggacgacgcugg

SEQ ID NO: 1463269 - RNA, 17 nt, Pseudomonas aeruginosa PA01
gcuggaccuccuggcgc

SEQ ID NO: 1463270 - RNA, 15 nt, Pseudomonas aeruginosa PA01
gcuggacccgcaccu

SEQ ID NO: 1463271 - RNA, 18 nt, Pseudomonas aeruginosa PA01
gcuggacccgcaccugga

SEQ ID NO: 1463272 - RNA, 13 nt, Pseudomonas aeruginosa PA01
gcuggacaggcgc

SEQ ID NO: 1463273 - RNA, 14 nt, Pseudomonas aeruginosa PA01
gcuggacaggcgca

SEQ ID NO: 1463274 - RNA, 15 nt, Pseudomonas aeruginosa PA01
gcuggacaggcgcag

SEQ ID NO: 1463275 - RNA, 16 nt, Pseudomonas aeruginosa PA01
gcuggaccaccguggc

SEQ ID NO: 1463276 - RNA, 19 nt, Pseudomonas aeruginosa PA01
gcuggaccaccguggcgcc

SEQ ID NO: 1463277 - RNA, 20 nt, Pseudomonas aeruginosa PA01
gcuggaccaccguggcgccg

SEQ ID NO: 1463278 - RNA, 18 nt, Pseudomonas aeruginosa PA01
gcuggaccaggcggccgg

SEQ ID NO: 1463279 - RNA, 19 nt, Pseudomonas aeruginosa PA01
gcuggaccaggcggccggu

SEQ ID NO: 1463280 - RNA, 19 nt, Pseudomonas aeruginosa PA01
gcuggaccaguucagcgcg

SEQ ID NO: 1463281 - RNA, 20 nt, Pseudomonas aeruginosa PA01
gcugcugguagugcuggcgc

SEQ ID NO: 1463282 - RNA, 12 nt, Pseudomonas aeruginosa PA01
gcugcuguccag

SEQ ID NO: 1463283 - RNA, 14 nt, Pseudomonas aeruginosa PA01
gcugcuguccagcg

SEQ ID NO: 1463284 - RNA, 16 nt, Pseudomonas aeruginosa PA01
gcugcuguccagcgcu

SEQ ID NO: 1463285 - RNA, 12 nt, Pseudomonas aeruginosa PA01
gcugcugggcgg

SEQ ID NO: 1463286 - RNA, 15 nt, Pseudomonas aeruginosa PA01
gcugcugggcggcga

SEQ ID NO: 1463287 - RNA, 20 nt, Pseudomonas aeruginosa PA01
gcugcuggggaacugggcga

SEQ ID NO: 1463288 - RNA, 14 nt, Pseudomonas aeruginosa PA01
gcugcugggugaug

SEQ ID NO: 1463289 - RNA, 12 nt, Pseudomonas aeruginosa PA01
gcugcuggcgcc

SEQ ID NO: 1463290 - RNA, 17 nt, Pseudomonas aeruginosa PA01
gcugcuggcgccgcugg

SEQ ID NO: 1463291 - RNA, 20 nt, Pseudomonas aeruginosa PA01
gcugcuggcgccgcuggcgu

SEQ ID NO: 1463292 - RNA, 15 nt, Pseudomonas aeruginosa PA01
gcugcuugcgcgcgg

SEQ ID NO: 1463293 - RNA, 14 nt, Pseudomonas aeruginosa PA01
gcugcuugccgcuc

SEQ ID NO: 1463294 - RNA, 15 nt, Pseudomonas aeruginosa PA01
gcugcuugccgcuca

SEQ ID NO: 1463295 - RNA, 16 nt, Pseudomonas aeruginosa PA01
gcugcuugccggugcc

SEQ ID NO: 1463296 - RNA, 13 nt, Pseudomonas aeruginosa PA01
gcugcuucggcag

SEQ ID NO: 1463297 - RNA, 16 nt, Pseudomonas aeruginosa PA01
gcugcuucggcagccu

SEQ ID NO: 1463298 - RNA, 15 nt, Pseudomonas aeruginosa PA01
gcugccggccagggu

SEQ ID NO: 1463299 - RNA, 12 nt, Pseudomonas aeruginosa PA01
gcugccggcccu

SEQ ID NO: 1463300 - RNA, 17 nt, Pseudomonas aeruginosa PA01
gcugccggcccucgcga

SEQ ID NO: 1463301 - RNA, 11 nt, Pseudomonas aeruginosa PA01
gcugccggcau

SEQ ID NO: 1463302 - RNA, 16 nt, Pseudomonas aeruginosa PA01
gcugcggcuucgcgug

SEQ ID NO: 1463303 - RNA, 15 nt, Pseudomonas aeruginosa PA01
gcugcgggcgccgcc

SEQ ID NO: 1463304 - RNA, 14 nt, Pseudomonas aeruginosa PA01
gcugcgggcgcugc

SEQ ID NO: 1463305 - RNA, 13 nt, Pseudomonas aeruginosa PA01
gcugcggggccgg

SEQ ID NO: 1463306 - RNA, 18 nt, Pseudomonas aeruginosa PA01
gcugcggggccggacgcg

SEQ ID NO: 1463307 - RNA, 14 nt, Pseudomonas aeruginosa PA01
gcugcggggccugc

SEQ ID NO: 1463308 - RNA, 15 nt, Pseudomonas aeruginosa PA01
gcugcggggccugcu

SEQ ID NO: 1463309 - RNA, 13 nt, Pseudomonas aeruginosa PA01
gcugcucgauggc

SEQ ID NO: 1463310 - RNA, 15 nt, Pseudomonas aeruginosa PA01
gcugcucgaccgccu

SEQ ID NO: 1463311 - RNA, 17 nt, Pseudomonas aeruginosa PA01
gcugcucgaccgccugc

SEQ ID NO: 1463312 - RNA, 17 nt, Pseudomonas aeruginosa PA01
gcugcucgacggcacca

SEQ ID NO: 1463313 - RNA, 22 nt, Pseudomonas aeruginosa PA01
gcugcucgacggcaccagcgcg

SEQ ID NO: 1463314 - RNA, 15 nt, Pseudomonas aeruginosa PA01
gcugcuccggaucgc

SEQ ID NO: 1463315 - RNA, 17 nt, Pseudomonas aeruginosa PA01
gcugcuccggaucgcgc

SEQ ID NO: 1463316 - RNA, 21 nt, Pseudomonas aeruginosa PA01
gcugcuccaucaguugcgcgc

SEQ ID NO: 1463317 - RNA, 22 nt, Pseudomonas aeruginosa PA01
gcugcuccaucaguugcgcgcg

SEQ ID NO: 1463318 - RNA, 23 nt, Pseudomonas aeruginosa PA01
gcugcuccaucaguugcgcgcgg

SEQ ID NO: 1463319 - RNA, 16 nt, Pseudomonas aeruginosa PA01
gcugcucaugccguug

SEQ ID NO: 1463320 - RNA, 20 nt, Pseudomonas aeruginosa PA01
gcugcucagggccgcgccga

SEQ ID NO: 1463321 - RNA, 21 nt, Pseudomonas aeruginosa PA01
gcugcucagggccgcgccgag

SEQ ID NO: 1463322 - RNA, 17 nt, Pseudomonas aeruginosa PA01
gcugcgguaccagcgca

SEQ ID NO: 1463323 - RNA, 21 nt, Pseudomonas aeruginosa PA01
gcugcgguaccagcgcaccag

SEQ ID NO: 1463324 - RNA, 18 nt, Pseudomonas aeruginosa PA01
gcugggcgaccuucagcg

SEQ ID NO: 1463325 - RNA, 23 nt, Pseudomonas aeruginosa PA01
gcugggccuuguucaggguggcg

SEQ ID NO: 1463326 - RNA, 16 nt, Pseudomonas aeruginosa PA01
gcugggcgccggcagg

SEQ ID NO: 1463327 - RNA, 19 nt, Pseudomonas aeruginosa PA01
gcugggcgccggcaggccu

SEQ ID NO: 1463328 - RNA, 12 nt, Pseudomonas aeruginosa PA01
gcugggcgcccu

SEQ ID NO: 1463329 - RNA, 13 nt, Pseudomonas aeruginosa PA01
gcugggcgccgau

SEQ ID NO: 1463330 - RNA, 18 nt, Pseudomonas aeruginosa PA01
gcugggcggcgaggccga

SEQ ID NO: 1463331 - RNA, 15 nt, Pseudomonas aeruginosa PA01
gcuggcggcucggcu

SEQ ID NO: 1463332 - RNA, 24 nt, Pseudomonas aeruginosa PA01
gcuggcggcucggcugcuugccgg

SEQ ID NO: 1463333 - RNA, 19 nt, Pseudomonas aeruginosa PA01
gcuggcgcgucgcugccgc

SEQ ID NO: 1463334 - RNA, 21 nt, Pseudomonas aeruginosa PA01
gcuggcgcgucgcugccgccg

SEQ ID NO: 1463335 - RNA, 15 nt, Pseudomonas aeruginosa PA01
gcuggcgcgauccgc

SEQ ID NO: 1463336 - RNA, 13 nt, Pseudomonas aeruginosa PA01
gcuggcgcgccuc

SEQ ID NO: 1463337 - RNA, 19 nt, Pseudomonas aeruginosa PA01
gcuggcgcgcgcgcugcca

SEQ ID NO: 1463338 - RNA, 20 nt, Pseudomonas aeruginosa PA01
gcuggcgccgucaucgcuga

SEQ ID NO: 1463339 - RNA, 15 nt, Pseudomonas aeruginosa PA01
gcuggcgccgcuggc

SEQ ID NO: 1463340 - RNA, 24 nt, Pseudomonas aeruginosa PA01
gcuggcgcccaacgucuucaggcg

SEQ ID NO: 1463341 - RNA, 14 nt, Pseudomonas aeruginosa PA01
gcuggcgucgaccg

SEQ ID NO: 1463342 - RNA, 16 nt, Pseudomonas aeruginosa PA01
gcuggcgucgaccgcc

SEQ ID NO: 1463343 - RNA, 20 nt, Pseudomonas aeruginosa PA01
gcuggcgucgaccgccugcc

SEQ ID NO: 1463344 - RNA, 19 nt, Pseudomonas aeruginosa PA01
gcuggcggggucgcgccgg

SEQ ID NO: 1463345 - RNA, 13 nt, Pseudomonas aeruginosa PA01
gcuggcguaccuc

SEQ ID NO: 1463346 - RNA, 20 nt, Pseudomonas aeruginosa PA01
gcuggcguaccucgccaggc

SEQ ID NO: 1463347 - RNA, 21 nt, Pseudomonas aeruginosa PA01
gcuggcguaccucgccaggcu

SEQ ID NO: 1463348 - RNA, 15 nt, Pseudomonas aeruginosa PA01
gcuggcgccgaugcu

SEQ ID NO: 1463349 - RNA, 14 nt, Pseudomonas aeruginosa PA01
gcuggcgcaggccu

SEQ ID NO: 1463350 - RNA, 23 nt, Pseudomonas aeruginosa PA01
gcuggcgcaggccuucgacuucg

SEQ ID NO: 1463351 - RNA, 18 nt, Pseudomonas aeruginosa PA01
gcuggcgcaacugcgcca

SEQ ID NO: 1463352 - RNA, 19 nt, Pseudomonas aeruginosa PA01
gcuggcgcaacugcgccag

SEQ ID NO: 1463353 - RNA, 20 nt, Pseudomonas aeruginosa PA01
gcuggcgcaacugcgccagc

SEQ ID NO: 1463354 - RNA, 22 nt, Pseudomonas aeruginosa PA01
gcuggcgcaauacaccgcugcg

SEQ ID NO: 1463355 - RNA, 18 nt, Pseudomonas aeruginosa PA01
gcuggcgcagccaggcga

SEQ ID NO: 1463356 - RNA, 14 nt, Pseudomonas aeruginosa PA01
gcuggcgcagccgc

SEQ ID NO: 1463357 - RNA, 21 nt, Pseudomonas aeruginosa PA01
gcuggcgcagccgcugcugca

SEQ ID NO: 1463358 - RNA, 17 nt, Pseudomonas aeruginosa PA01
gcuggcgaggacgccgg

SEQ ID NO: 1463359 - RNA, 20 nt, Pseudomonas aeruginosa PA01
gcuggcgaggacgccgggcu

SEQ ID NO: 1463360 - RNA, 20 nt, Pseudomonas aeruginosa PA01
gcuggcgaggauuuccucgc

SEQ ID NO: 1463361 - RNA, 16 nt, Pseudomonas aeruginosa PA01
gcuggcgaucaccagg

SEQ ID NO: 1463362 - RNA, 18 nt, Pseudomonas aeruginosa PA01
gcuggcgaucaugccuuc

SEQ ID NO: 1463363 - RNA, 22 nt, Pseudomonas aeruginosa PA01
gcuggcgaucaugccuucgauc

SEQ ID NO: 1463364 - RNA, 19 nt, Pseudomonas aeruginosa PA01
gcuggcgaucgaccugccg

SEQ ID NO: 1463365 - RNA, 16 nt, Pseudomonas aeruginosa PA01
gcuggcgaucucggcg

SEQ ID NO: 1463366 - RNA, 21 nt, Pseudomonas aeruginosa PA01
gcuggcgaucucggcgcgggc

SEQ ID NO: 1463367 - RNA, 16 nt, Pseudomonas aeruginosa PA01
gcuggcgaucaucgcg

SEQ ID NO: 1463368 - RNA, 15 nt, Pseudomonas aeruginosa PA01
gcuggcgagcgucga

SEQ ID NO: 1463369 - RNA, 22 nt, Pseudomonas aeruginosa PA01
gcuggcgaggaacacccagaag

SEQ ID NO: 1463370 - RNA, 18 nt, Pseudomonas aeruginosa PA01
gcuggcgauuuccucgcu

SEQ ID NO: 1463371 - RNA, 17 nt, Pseudomonas aeruginosa PA01
gcuggcgaugcugaccc

SEQ ID NO: 1463372 - RNA, 22 nt, Pseudomonas aeruginosa PA01
gcuggcgauguagcugccggcg

SEQ ID NO: 1463373 - RNA, 14 nt, Pseudomonas aeruginosa PA01
gcuggccggcagca

SEQ ID NO: 1463374 - RNA, 13 nt, Pseudomonas aeruginosa PA01
gcuggccggucug

SEQ ID NO: 1463375 - RNA, 23 nt, Pseudomonas aeruginosa PA01
gcuggccggucugcuuguccuuc

SEQ ID NO: 1463376 - RNA, 18 nt, Pseudomonas aeruginosa PA01
gcuggccggugccgcccu

SEQ ID NO: 1463377 - RNA, 19 nt, Pseudomonas aeruginosa PA01
gcuggccggugccgcccug

SEQ ID NO: 1463378 - RNA, 23 nt, Pseudomonas aeruginosa PA01
gcuggccgucgacccgccucacc

SEQ ID NO: 1463379 - RNA, 22 nt, Pseudomonas aeruginosa PA01
gcuggccgucgaggucggcgau

SEQ ID NO: 1463380 - RNA, 14 nt, Pseudomonas aeruginosa PA01
gcuggccucggcga

SEQ ID NO: 1463381 - RNA, 15 nt, Pseudomonas aeruginosa PA01
gcuggccucggcgau

SEQ ID NO: 1463382 - RNA, 16 nt, Pseudomonas aeruginosa PA01
gcuggccucggcgauc

SEQ ID NO: 1463383 - RNA, 18 nt, Pseudomonas aeruginosa PA01
gcuggccucggcgaucgc

SEQ ID NO: 1463384 - RNA, 20 nt, Pseudomonas aeruginosa PA01
gcuggccucagggcgcgaag

SEQ ID NO: 1463385 - RNA, 18 nt, Pseudomonas aeruginosa PA01
gcuggccuucgucggcuu

SEQ ID NO: 1463386 - RNA, 17 nt, Pseudomonas aeruginosa PA01
gcuggcgaaccagucca

SEQ ID NO: 1463387 - RNA, 21 nt, Pseudomonas aeruginosa PA01
gcuggcgaaccaguccagcac

SEQ ID NO: 1463388 - RNA, 22 nt, Pseudomonas aeruginosa PA01
gcuggcgaaccaguccagcacg

SEQ ID NO: 1463389 - RNA, 23 nt, Pseudomonas aeruginosa PA01
gcuggcgaacggcuggucggcuu

SEQ ID NO: 1463390 - RNA, 18 nt, Pseudomonas aeruginosa PA01
gcuggcgaagcuggggcu

SEQ ID NO: 1463391 - RNA, 19 nt, Pseudomonas aeruginosa PA01
gcuggcgaauauccucguc

SEQ ID NO: 1463392 - RNA, 22 nt, Pseudomonas aeruginosa PA01
gcuggcgaauauccucgucgau

SEQ ID NO: 1463393 - RNA, 14 nt, Pseudomonas aeruginosa PA01
gcuggccugcagca

SEQ ID NO: 1463394 - RNA, 16 nt, Pseudomonas aeruginosa PA01
gcuggccugcagcagg

SEQ ID NO: 1463395 - RNA, 14 nt, Pseudomonas aeruginosa PA01
gcuggccuggccac

SEQ ID NO: 1463396 - RNA, 19 nt, Pseudomonas aeruginosa PA01
gcuggccuggccacccuug

SEQ ID NO: 1463397 - RNA, 18 nt, Pseudomonas aeruginosa PA01
gcuggccugggacggcgu

SEQ ID NO: 1463398 - RNA, 21 nt, Pseudomonas aeruginosa PA01
gcuggccugggguagccggcc

SEQ ID NO: 1463399 - RNA, 23 nt, Pseudomonas aeruginosa PA01
gcuggccugggguagccggccga

SEQ ID NO: 1463400 - RNA, 18 nt, Pseudomonas aeruginosa PA01
gcuggccuuggccaugcc

SEQ ID NO: 1463401 - RNA, 23 nt, Pseudomonas aeruginosa PA01
gcuggucgacguaggcggcgagg

SEQ ID NO: 1463402 - RNA, 18 nt, Pseudomonas aeruginosa PA01
gcuggucguagcagcgga

SEQ ID NO: 1463403 - RNA, 16 nt, Pseudomonas aeruginosa PA01
gcuggucguaggcgcg

SEQ ID NO: 1463404 - RNA, 17 nt, Pseudomonas aeruginosa PA01
gcuggucguaggcgcgg

SEQ ID NO: 1463405 - RNA, 14 nt, Pseudomonas aeruginosa PA01
gcugguccuggcgc

SEQ ID NO: 1463406 - RNA, 21 nt, Pseudomonas aeruginosa PA01
gcuggguacgguuggccagcg

SEQ ID NO: 1463407 - RNA, 20 nt, Pseudomonas aeruginosa PA01
gcugggucacguggccgccc

SEQ ID NO: 1463408 - RNA, 17 nt, Pseudomonas aeruginosa PA01
gcugggguugcggcgcc

SEQ ID NO: 1463409 - RNA, 19 nt, Pseudomonas aeruginosa PA01
gcugggguugcggcgcccg

SEQ ID NO: 1463410 - RNA, 17 nt, Pseudomonas aeruginosa PA01
gcuggggaacugggcga

SEQ ID NO: 1463411 - RNA, 23 nt, Pseudomonas aeruginosa PA01
gcuggggacggaagcauggccgg

SEQ ID NO: 1463412 - RNA, 20 nt, Pseudomonas aeruginosa PA01
gcugggcgucgaacaccggc

SEQ ID NO: 1463413 - RNA, 21 nt, Pseudomonas aeruginosa PA01
gcuggggcuguugcugggcua

SEQ ID NO: 1463414 - RNA, 14 nt, Pseudomonas aeruginosa PA01
gcuggggccggccu

SEQ ID NO: 1463415 - RNA, 13 nt, Pseudomonas aeruginosa PA01
gcuggugaucgac

SEQ ID NO: 1463416 - RNA, 18 nt, Pseudomonas aeruginosa PA01
gcuggugaugccgcggac

SEQ ID NO: 1463417 - RNA, 17 nt, Pseudomonas aeruginosa PA01
gcuggugaugucgcggc

SEQ ID NO: 1463418 - RNA, 13 nt, Pseudomonas aeruginosa PA01
gcuggugccgacg

SEQ ID NO: 1463419 - RNA, 14 nt, Pseudomonas aeruginosa PA01
gcuggugccgacgc

SEQ ID NO: 1463420 - RNA, 17 nt, Pseudomonas aeruginosa PA01
gcuggugccgaucagcc

SEQ ID NO: 1463421 - RNA, 23 nt, Pseudomonas aeruginosa PA01
gcuggugccgaucagcccgucgg

SEQ ID NO: 1463422 - RNA, 15 nt, Pseudomonas aeruginosa PA01
gcuggugcggccgau

SEQ ID NO: 1463423 - RNA, 17 nt, Pseudomonas aeruginosa PA01
gcuggugcggccgauga

SEQ ID NO: 1463424 - RNA, 14 nt, Pseudomonas aeruginosa PA01
gcuguaggcgagca

SEQ ID NO: 1463425 - RNA, 20 nt, Pseudomonas aeruginosa PA01
gcuguaggcgagcagcggca

SEQ ID NO: 1463426 - RNA, 20 nt, Pseudomonas aeruginosa PA01
gcuguagcucugcuggcugu

SEQ ID NO: 1463427 - RNA, 17 nt, Pseudomonas aeruginosa PA01
gcugguggacgucgucg

SEQ ID NO: 1463428 - RNA, 17 nt, Pseudomonas aeruginosa PA01
gcuguagcggcucgccg

SEQ ID NO: 1463429 - RNA, 21 nt, Pseudomonas aeruginosa PA01
gcuguagcggcuugcagucga

SEQ ID NO: 1463430 - RNA, 14 nt, Pseudomonas aeruginosa PA01
gcugugcggcagca

SEQ ID NO: 1463431 - RNA, 14 nt, Pseudomonas aeruginosa PA01
gcugugcgccaggc

SEQ ID NO: 1463432 - RNA, 15 nt, Pseudomonas aeruginosa PA01
gcugugcgccaggcc

SEQ ID NO: 1463433 - RNA, 16 nt, Pseudomonas aeruginosa PA01
gcugugcaucugcgac

SEQ ID NO: 1463434 - RNA, 20 nt, Pseudomonas aeruginosa PA01
gcugugccauuccugggccc

SEQ ID NO: 1463435 - RNA, 18 nt, Pseudomonas aeruginosa PA01
gcugugaggugggcgcgc

SEQ ID NO: 1463436 - RNA, 17 nt, Pseudomonas aeruginosa PA01
gcugucgucggcgcggc

SEQ ID NO: 1463437 - RNA, 18 nt, Pseudomonas aeruginosa PA01
gcugucgucuucggccag

SEQ ID NO: 1463438 - RNA, 21 nt, Pseudomonas aeruginosa PA01
gcugucguaguccugggccgg

SEQ ID NO: 1463439 - RNA, 16 nt, Pseudomonas aeruginosa PA01
gcugucguccagcggg

SEQ ID NO: 1463440 - RNA, 18 nt, Pseudomonas aeruginosa PA01
gcugucuaucccgugccg

SEQ ID NO: 1463441 - RNA, 22 nt, Pseudomonas aeruginosa PA01
gcugucuaucccgugccgggcc

SEQ ID NO: 1463442 - RNA, 16 nt, Pseudomonas aeruginosa PA01
gcugucguggacgccg

SEQ ID NO: 1463443 - RNA, 20 nt, Pseudomonas aeruginosa PA01
gcugucguggacgccgguga

SEQ ID NO: 1463444 - RNA, 17 nt, Pseudomonas aeruginosa PA01
gcuguaggugcccggcg

SEQ ID NO: 1463445 - RNA, 19 nt, Pseudomonas aeruginosa PA01
gcuguaguugacgucgccg

SEQ ID NO: 1463446 - RNA, 20 nt, Pseudomonas aeruginosa PA01
gcuguaguugacgucgccga

SEQ ID NO: 1463447 - RNA, 23 nt, Pseudomonas aeruginosa PA01
gcuguaguugacgucgccgaugc

SEQ ID NO: 1463448 - RNA, 14 nt, Pseudomonas aeruginosa PA01
gcuguagggacagg

SEQ ID NO: 1463449 - RNA, 16 nt, Pseudomonas aeruginosa PA01
gcuguccacgccgaag

SEQ ID NO: 1463450 - RNA, 23 nt, Pseudomonas aeruginosa PA01
gcuguccacgccgaagucggcga

SEQ ID NO: 1463451 - RNA, 13 nt, Pseudomonas aeruginosa PA01
gcugucagcgccc

SEQ ID NO: 1463452 - RNA, 17 nt, Pseudomonas aeruginosa PA01
gcugucagcgcccggcu

SEQ ID NO: 1463453 - RNA, 23 nt, Pseudomonas aeruginosa PA01
gcugucagggcuugcgcgccacc

SEQ ID NO: 1463454 - RNA, 22 nt, Pseudomonas aeruginosa PA01
gcugucgcguucccacucgcga

SEQ ID NO: 1463455 - RNA, 12 nt, Pseudomonas aeruginosa PA01
gcuguccagcag

SEQ ID NO: 1463456 - RNA, 19 nt, Pseudomonas aeruginosa PA01
gcuguccagcaggcguucc

SEQ ID NO: 1463457 - RNA, 20 nt, Pseudomonas aeruginosa PA01
gcugucgcggacccgcgccg

SEQ ID NO: 1463458 - RNA, 23 nt, Pseudomonas aeruginosa PA01
gcugucgcggacccgcgccggca

SEQ ID NO: 1463459 - RNA, 19 nt, Pseudomonas aeruginosa PA01
gcugucggccagccccugc

SEQ ID NO: 1463460 - RNA, 20 nt, Pseudomonas aeruginosa PA01
gcugucggccagccccugcg

SEQ ID NO: 1463461 - RNA, 22 nt, Pseudomonas aeruginosa PA01
gcugucggccagccccugcgga

SEQ ID NO: 1463462 - RNA, 13 nt, Pseudomonas aeruginosa PA01
gcugucggcccgc

SEQ ID NO: 1463463 - RNA, 17 nt, Pseudomonas aeruginosa PA01
gcugucggcccgcgcca

SEQ ID NO: 1463464 - RNA, 16 nt, Pseudomonas aeruginosa PA01
ggaugaccaggcugau

SEQ ID NO: 1463465 - RNA, 19 nt, Pseudomonas aeruginosa PA01
ggaugcagauccagcggca

SEQ ID NO: 1463466 - RNA, 20 nt, Pseudomonas aeruginosa PA01
ggaugcagauccagcggcag

SEQ ID NO: 1463467 - RNA, 19 nt, Pseudomonas aeruginosa PA01
ggaugaucagggcaccgcc

SEQ ID NO: 1463468 - RNA, 20 nt, Pseudomonas aeruginosa PA01
ggaugaucagggcaccgccg

SEQ ID NO: 1463469 - RNA, 18 nt, Pseudomonas aeruginosa PA01
ggaucuguuucaacuccc

SEQ ID NO: 1463470 - RNA, 15 nt, Pseudomonas aeruginosa PA01
ggaucuugcgcccgg

SEQ ID NO: 1463471 - RNA, 17 nt, Pseudomonas aeruginosa PA01
ggaucuugcgcccggcg

SEQ ID NO: 1463472 - RNA, 21 nt, Pseudomonas aeruginosa PA01
ggaucuugcgcccggcgcgac

SEQ ID NO: 1463473 - RNA, 22 nt, Pseudomonas aeruginosa PA01
ggaucuugcgcccggcgcgacc

SEQ ID NO: 1463474 - RNA, 16 nt, Pseudomonas aeruginosa PA01
ggaucugcuccugcag

SEQ ID NO: 1463475 - RNA, 13 nt, Pseudomonas aeruginosa PA01
ggaucgucgcggc

SEQ ID NO: 1463476 - RNA, 18 nt, Pseudomonas aeruginosa PA01
ggaucuaaggggcggcuc

SEQ ID NO: 1463477 - RNA, 19 nt, Pseudomonas aeruginosa PA01
ggaucucccguaccagcgc

SEQ ID NO: 1463478 - RNA, 21 nt, Pseudomonas aeruginosa PA01
ggaucuccgaguccugcugcg

SEQ ID NO: 1463479 - RNA, 18 nt, Pseudomonas aeruginosa PA01
ggaucuccucggccaacg

SEQ ID NO: 1463480 - RNA, 14 nt, Pseudomonas aeruginosa PA01
ggaucucgucgccg

SEQ ID NO: 1463481 - RNA, 15 nt, Pseudomonas aeruginosa PA01
ggaucucggcggcca

SEQ ID NO: 1463482 - RNA, 23 nt, Pseudomonas aeruginosa PA01
ggaucggggaagggacgucgcca

SEQ ID NO: 1463483 - RNA, 18 nt, Pseudomonas aeruginosa PA01
ggaucggcugaccggcau

SEQ ID NO: 1463484 - RNA, 13 nt, Pseudomonas aeruginosa PA01
ggaucggcggugc

SEQ ID NO: 1463485 - RNA, 19 nt, Pseudomonas aeruginosa PA01
ggaucggcggugccaugga

SEQ ID NO: 1463486 - RNA, 21 nt, Pseudomonas aeruginosa PA01
ggaucggcguguucaggugcu

SEQ ID NO: 1463487 - RNA, 15 nt, Pseudomonas aeruginosa PA01
ggaucguaggcgcgc

SEQ ID NO: 1463488 - RNA, 20 nt, Pseudomonas aeruginosa PA01
ggaucgucgaagcucggcgc

SEQ ID NO: 1463489 - RNA, 16 nt, Pseudomonas aeruginosa PA01
ggaucgucgccaagcc

SEQ ID NO: 1463490 - RNA, 15 nt, Pseudomonas aeruginosa PA01
ggauggcgaagccga

SEQ ID NO: 1463491 - RNA, 17 nt, Pseudomonas aeruginosa PA01
ggauggccggcgcggcg

SEQ ID NO: 1463492 - RNA, 12 nt, Pseudomonas aeruginosa PA01
ggauggcgcggg

SEQ ID NO: 1463493 - RNA, 13 nt, Pseudomonas aeruginosa PA01
ggauggcgcgguc

SEQ ID NO: 1463494 - RNA, 21 nt, Pseudomonas aeruginosa PA01
ggaugggaacgaguugggcga

SEQ ID NO: 1463495 - RNA, 13 nt, Pseudomonas aeruginosa PA01
ggaugggcgagcu

SEQ ID NO: 1463496 - RNA, 14 nt, Pseudomonas aeruginosa PA01
ggauggacagcuug

SEQ ID NO: 1463497 - RNA, 16 nt, Pseudomonas aeruginosa PA01
ggauggcaauggcggu

SEQ ID NO: 1463498 - RNA, 11 nt, Pseudomonas aeruginosa PA01
ggauggccagc

SEQ ID NO: 1463499 - RNA, 12 nt, Pseudomonas aeruginosa PA01
ggaugcuguccc

SEQ ID NO: 1463500 - RNA, 13 nt, Pseudomonas aeruginosa PA01
ggaugcuccgcgc

SEQ ID NO: 1463501 - RNA, 15 nt, Pseudomonas aeruginosa PA01
ggaugcguugcucgc

SEQ ID NO: 1463502 - RNA, 16 nt, Pseudomonas aeruginosa PA01
ggaugcucaccgcgcu

SEQ ID NO: 1463503 - RNA, 12 nt, Pseudomonas aeruginosa PA01
ggaugccggugc

SEQ ID NO: 1463504 - RNA, 18 nt, Pseudomonas aeruginosa PA01
ggaugccgguggcgccca

SEQ ID NO: 1463505 - RNA, 19 nt, Pseudomonas aeruginosa PA01
ggaugccgguggcgcccag

SEQ ID NO: 1463506 - RNA, 13 nt, Pseudomonas aeruginosa PA01
ggaugccgggcga

SEQ ID NO: 1463507 - RNA, 10 nt, Pseudomonas aeruginosa PA01
ggaugccggc

SEQ ID NO: 1463508 - RNA, 14 nt, Pseudomonas aeruginosa PA01
ggaugcgccagcgg

SEQ ID NO: 1463509 - RNA, 14 nt, Pseudomonas aeruginosa PA01
ggaugcccuggucg

SEQ ID NO: 1463510 - RNA, 17 nt, Pseudomonas aeruginosa PA01
ggaugcccuccugggcc

SEQ ID NO: 1463511 - RNA, 17 nt, Pseudomonas aeruginosa PA01
ggaugcccugcucuucc

SEQ ID NO: 1463512 - RNA, 16 nt, Pseudomonas aeruginosa PA01
ggaugccgcgagccag

SEQ ID NO: 1463513 - RNA, 23 nt, Pseudomonas aeruginosa PA01
ggaugccgcacaggcuggccaga

SEQ ID NO: 1463514 - RNA, 15 nt, Pseudomonas aeruginosa PA01
ggaugccgccggcau

SEQ ID NO: 1463515 - RNA, 16 nt, Pseudomonas aeruginosa PA01
ggaugccgccggcauc

SEQ ID NO: 1463516 - RNA, 15 nt, Pseudomonas aeruginosa PA01
ggaugcagucggcac

SEQ ID NO: 1463517 - RNA, 13 nt, Pseudomonas aeruginosa PA01
ggaugcaguucgu

SEQ ID NO: 1463518 - RNA, 18 nt, Pseudomonas aeruginosa PA01
ggaugcaguugagucgcg

SEQ ID NO: 1463519 - RNA, 22 nt, Pseudomonas aeruginosa PA01
ggauagcguccagcucgucgug

SEQ ID NO: 1463520 - RNA, 19 nt, Pseudomonas aeruginosa PA01
ggauaugccgcucagcgga

SEQ ID NO: 1463521 - RNA, 21 nt, Pseudomonas aeruginosa PA01
ggaucaacuccgccaggcgcu

SEQ ID NO: 1463522 - RNA, 22 nt, Pseudomonas aeruginosa PA01
ggaucaacuccgccaggcgcuc

SEQ ID NO: 1463523 - RNA, 14 nt, Pseudomonas aeruginosa PA01
ggauaucgcgccgc

SEQ ID NO: 1463524 - RNA, 16 nt, Pseudomonas aeruginosa PA01
ggauaucgcuggcgcc

SEQ ID NO: 1463525 - RNA, 17 nt, Pseudomonas aeruginosa PA01
ggauauccagguucgcg

SEQ ID NO: 1463526 - RNA, 20 nt, Pseudomonas aeruginosa PA01
ggauaucaccuccuguucgc

SEQ ID NO: 1463527 - RNA, 17 nt, Pseudomonas aeruginosa PA01
ggaucacaggcucuucu

SEQ ID NO: 1463528 - RNA, 21 nt, Pseudomonas aeruginosa PA01
ggaucacaucgcccggcagca

SEQ ID NO: 1463529 - RNA, 15 nt, Pseudomonas aeruginosa PA01
ggaucaccgcggcgc

SEQ ID NO: 1463530 - RNA, 18 nt, Pseudomonas aeruginosa PA01
ggaucaccgcggcgcuga

SEQ ID NO: 1463531 - RNA, 13 nt, Pseudomonas aeruginosa PA01
ggaucaccggcug

SEQ ID NO: 1463532 - RNA, 17 nt, Pseudomonas aeruginosa PA01
ggaucacgauggccggc

SEQ ID NO: 1463533 - RNA, 18 nt, Pseudomonas aeruginosa PA01
ggaucacgauggccggca

SEQ ID NO: 1463534 - RNA, 18 nt, Pseudomonas aeruginosa PA01
ggaucacgcagcaggcga

SEQ ID NO: 1463535 - RNA, 18 nt, Pseudomonas aeruginosa PA01
ggaucagccagccggcga

SEQ ID NO: 1463536 - RNA, 20 nt, Pseudomonas aeruginosa PA01
ggaucacucgccgccguccu

SEQ ID NO: 1463537 - RNA, 13 nt, Pseudomonas aeruginosa PA01
ggauccaggugcg

SEQ ID NO: 1463538 - RNA, 23 nt, Pseudomonas aeruginosa PA01
ggauccccucccgcgccagcgcc

SEQ ID NO: 1463539 - RNA, 15 nt, Pseudomonas aeruginosa PA01
ggaucaucugaccuu

SEQ ID NO: 1463540 - RNA, 22 nt, Pseudomonas aeruginosa PA01
ggaucauccgcaccauccgccg

SEQ ID NO: 1463541 - RNA, 23 nt, Pseudomonas aeruginosa PA01
ggaucagguugaagagcagcacc

SEQ ID NO: 1463542 - RNA, 18 nt, Pseudomonas aeruginosa PA01
ggaucagucaggaucggc

SEQ ID NO: 1463543 - RNA, 17 nt, Pseudomonas aeruginosa PA01
ggaucagucgcugcucg

SEQ ID NO: 1463544 - RNA, 20 nt, Pseudomonas aeruginosa PA01
ggaucaggcgggcuccgccg

SEQ ID NO: 1463545 - RNA, 22 nt, Pseudomonas aeruginosa PA01
ggaucaggcucgagccgaacuc

SEQ ID NO: 1463546 - RNA, 23 nt, Pseudomonas aeruginosa PA01
ggaucaggcugggguugcggcgc

SEQ ID NO: 1463547 - RNA, 16 nt, Pseudomonas aeruginosa PA01
ggaucaggucgccagc

SEQ ID NO: 1463548 - RNA, 22 nt, Pseudomonas aeruginosa PA01
ggaucaggucgccgcugaauac

SEQ ID NO: 1463549 - RNA, 13 nt, Pseudomonas aeruginosa PA01
ggaucagcggcgg

SEQ ID NO: 1463550 - RNA, 16 nt, Pseudomonas aeruginosa PA01
ggaucagcggcggggc

SEQ ID NO: 1463551 - RNA, 23 nt, Pseudomonas aeruginosa PA01
ggaucagcgcauaggccugggcg

SEQ ID NO: 1463552 - RNA, 15 nt, Pseudomonas aeruginosa PA01
ggaucgccuccacca

SEQ ID NO: 1463553 - RNA, 20 nt, Pseudomonas aeruginosa PA01
ggaucgccuccaccagcgcc

SEQ ID NO: 1463554 - RNA, 17 nt, Pseudomonas aeruginosa PA01
ggaucgccuccggcacg

SEQ ID NO: 1463555 - RNA, 15 nt, Pseudomonas aeruginosa PA01
ggaucgcccuggcgc

SEQ ID NO: 1463556 - RNA, 18 nt, Pseudomonas aeruginosa PA01
ggaucgcccuggcgccag

SEQ ID NO: 1463557 - RNA, 23 nt, Pseudomonas aeruginosa PA01
ggaucgcccuggcgccagcguug

SEQ ID NO: 1463558 - RNA, 16 nt, Pseudomonas aeruginosa PA01
ggaucgccaggcugau

SEQ ID NO: 1463559 - RNA, 16 nt, Pseudomonas aeruginosa PA01
ggaucgcgcggcuggc

SEQ ID NO: 1463560 - RNA, 20 nt, Pseudomonas aeruginosa PA01
ggaucgcgcggcuggcugcc

SEQ ID NO: 1463561 - RNA, 23 nt, Pseudomonas aeruginosa PA01
ggaucggagagacccgccagcgg

SEQ ID NO: 1463562 - RNA, 13 nt, Pseudomonas aeruginosa PA01
ggaucggauagcc

SEQ ID NO: 1463563 - RNA, 23 nt, Pseudomonas aeruginosa PA01
ggaucgcggcguaggcgcgccaa

SEQ ID NO: 1463564 - RNA, 18 nt, Pseudomonas aeruginosa PA01
ggaucgcucccaggcuca

SEQ ID NO: 1463565 - RNA, 19 nt, Pseudomonas aeruginosa PA01
ggaucgcgucgcaggcgau

SEQ ID NO: 1463566 - RNA, 14 nt, Pseudomonas aeruginosa PA01
ggaucggcccuucg

SEQ ID NO: 1463567 - RNA, 15 nt, Pseudomonas aeruginosa PA01
ggaucggcagcucgc

SEQ ID NO: 1463568 - RNA, 17 nt, Pseudomonas aeruginosa PA01
ggaucggcauggccacg

SEQ ID NO: 1463569 - RNA, 16 nt, Pseudomonas aeruginosa PA01
ggaucggcgcggucgg

SEQ ID NO: 1463570 - RNA, 14 nt, Pseudomonas aeruginosa PA01
ggaucggccucgcg

SEQ ID NO: 1463571 - RNA, 19 nt, Pseudomonas aeruginosa PA01
ggaucggccucgcggcgcu

SEQ ID NO: 1463572 - RNA, 13 nt, Pseudomonas aeruginosa PA01
ggaucggcgauca

SEQ ID NO: 1463573 - RNA, 23 nt, Pseudomonas aeruginosa PA01
ggauccuggaagaauggcguggc

SEQ ID NO: 1463574 - RNA, 14 nt, Pseudomonas aeruginosa PA01
ggaucgacagcagc

SEQ ID NO: 1463575 - RNA, 13 nt, Pseudomonas aeruginosa PA01
ggaucgacgccgc

SEQ ID NO: 1463576 - RNA, 21 nt, Pseudomonas aeruginosa PA01
ggauccgugccaggcgcucgc

SEQ ID NO: 1463577 - RNA, 15 nt, Pseudomonas aeruginosa PA01
ggaucgaacuggcca

SEQ ID NO: 1463578 - RNA, 17 nt, Pseudomonas aeruginosa PA01
ggaucgaacuggccagc

SEQ ID NO: 1463579 - RNA, 20 nt, Pseudomonas aeruginosa PA01
ggaucgaacuggccagcacc

SEQ ID NO: 1463580 - RNA, 20 nt, Pseudomonas aeruginosa PA01
ggauccggacuggauucggc

SEQ ID NO: 1463581 - RNA, 19 nt, Pseudomonas aeruginosa PA01
ggaucgccacgccggcgcu

SEQ ID NO: 1463582 - RNA, 20 nt, Pseudomonas aeruginosa PA01
ggaucgccacgccggcgcuc

SEQ ID NO: 1463583 - RNA, 23 nt, Pseudomonas aeruginosa PA01
ggaucgccagcaauugccgcugc

SEQ ID NO: 1463584 - RNA, 16 nt, Pseudomonas aeruginosa PA01
ggaucgccaggacgcu

SEQ ID NO: 1463585 - RNA, 22 nt, Pseudomonas aeruginosa PA01
ggaucgaggaauuccggcagcg

SEQ ID NO: 1463586 - RNA, 17 nt, Pseudomonas aeruginosa PA01
ggaucgagcccuggucg

SEQ ID NO: 1463587 - RNA, 18 nt, Pseudomonas aeruginosa PA01
ggaucgaucagcagcacc

SEQ ID NO: 1463588 - RNA, 16 nt, Pseudomonas aeruginosa PA01
ggaucgaucucgucgg

SEQ ID NO: 1463589 - RNA, 22 nt, Pseudomonas aeruginosa PA01
ggaucgaucucgucggcggggc

SEQ ID NO: 1463590 - RNA, 13 nt, Pseudomonas aeruginosa PA01
ggaggacgaugga

SEQ ID NO: 1463591 - RNA, 18 nt, Pseudomonas aeruginosa PA01
ggaggaugccgaucaccg

SEQ ID NO: 1463592 - RNA, 16 nt, Pseudomonas aeruginosa PA01
ggaggauucgccagcc

SEQ ID NO: 1463593 - RNA, 13 nt, Pseudomonas aeruginosa PA01
ggaggccagcagc

SEQ ID NO: 1463594 - RNA, 12 nt, Pseudomonas aeruginosa PA01
ggaggcccagau

SEQ ID NO: 1463595 - RNA, 14 nt, Pseudomonas aeruginosa PA01
ggaggccgccucga

SEQ ID NO: 1463596 - RNA, 12 nt, Pseudomonas aeruginosa PA01
ggaggccuucgc

SEQ ID NO: 1463597 - RNA, 13 nt, Pseudomonas aeruginosa PA01
ggaggccguggug

SEQ ID NO: 1463598 - RNA, 17 nt, Pseudomonas aeruginosa PA01
ggagcguuguucuucga

SEQ ID NO: 1463599 - RNA, 15 nt, Pseudomonas aeruginosa PA01
ggagcguccaccagc

SEQ ID NO: 1463600 - RNA, 18 nt, Pseudomonas aeruginosa PA01
ggagcguccaccagcgcc

SEQ ID NO: 1463601 - RNA, 22 nt, Pseudomonas aeruginosa PA01
ggaggaaacccaugcccgcccc

SEQ ID NO: 1463602 - RNA, 17 nt, Pseudomonas aeruginosa PA01
ggaggaaauacagcacc

SEQ ID NO: 1463603 - RNA, 14 nt, Pseudomonas aeruginosa PA01
ggagcuugccggcg

SEQ ID NO: 1463604 - RNA, 23 nt, Pseudomonas aeruginosa PA01
ggagcuggaaauggcggucgccg

SEQ ID NO: 1463605 - RNA, 22 nt, Pseudomonas aeruginosa PA01
ggagucguagcgcgcggcgagc

SEQ ID NO: 1463606 - RNA, 14 nt, Pseudomonas aeruginosa PA01
ggagugaugccgau

SEQ ID NO: 1463607 - RNA, 16 nt, Pseudomonas aeruginosa PA01
ggagugaggccgagcc

SEQ ID NO: 1463608 - RNA, 13 nt, Pseudomonas aeruginosa PA01
ggaguccgccagc

SEQ ID NO: 1463609 - RNA, 17 nt, Pseudomonas aeruginosa PA01
ggaguccaggcgggcca

SEQ ID NO: 1463610 - RNA, 17 nt, Pseudomonas aeruginosa PA01
ggaggcgccgcgccagg

SEQ ID NO: 1463611 - RNA, 22 nt, Pseudomonas aeruginosa PA01
ggagggaucgcgcggcuggcug

SEQ ID NO: 1463612 - RNA, 15 nt, Pseudomonas aeruginosa PA01
ggaggugcggcggug

SEQ ID NO: 1463613 - RNA, 13 nt, Pseudomonas aeruginosa PA01
ggauaaacggcau

SEQ ID NO: 1463614 - RNA, 13 nt, Pseudomonas aeruginosa PA01
ggauaaccgcguu

SEQ ID NO: 1463615 - RNA, 18 nt, Pseudomonas aeruginosa PA01
ggaguucgacccaugccg

SEQ ID NO: 1463616 - RNA, 16 nt, Pseudomonas aeruginosa PA01
ggaguuccgcgcaacc

SEQ ID NO: 1463617 - RNA, 14 nt, Pseudomonas aeruginosa PA01
ggagugggccgcgu

SEQ ID NO: 1463618 - RNA, 12 nt, Pseudomonas aeruginosa PA01
ggauaacgccug

SEQ ID NO: 1463619 - RNA, 21 nt, Pseudomonas aeruginosa PA01
ggauaacgcuacccucagggg

SEQ ID NO: 1463620 - RNA, 17 nt, Pseudomonas aeruginosa PA01
ggauaacggcagccgcg

SEQ ID NO: 1463621 - RNA, 12 nt, Pseudomonas aeruginosa PA01
ggauaagccgcg

SEQ ID NO: 1463622 - RNA, 17 nt, Pseudomonas aeruginosa PA01
ggauacaugcugcucag

SEQ ID NO: 1463623 - RNA, 15 nt, Pseudomonas aeruginosa PA01
ggauacaccagguug

SEQ ID NO: 1463624 - RNA, 21 nt, Pseudomonas aeruginosa PA01
ggauacaccagguuggccagu

SEQ ID NO: 1463625 - RNA, 13 nt, Pseudomonas aeruginosa PA01
ggauacagcagcc

SEQ ID NO: 1463626 - RNA, 19 nt, Pseudomonas aeruginosa PA01
ggauacucaugcaggcguc

SEQ ID NO: 1463627 - RNA, 13 nt, Pseudomonas aeruginosa PA01
ggauagccggcgc

SEQ ID NO: 1463628 - RNA, 17 nt, Pseudomonas aeruginosa PA01
ggauacgggcgccaggg

SEQ ID NO: 1463629 - RNA, 21 nt, Pseudomonas aeruginosa PA01
ggauaccagaucaccaccacc

SEQ ID NO: 1463630 - RNA, 19 nt, Pseudomonas aeruginosa PA01
ggauaccgcacggccguca

SEQ ID NO: 1463631 - RNA, 20 nt, Pseudomonas aeruginosa PA01
ggauaccggccaucagcacc

SEQ ID NO: 1463632 - RNA, 14 nt, Pseudomonas aeruginosa PA01
ggagcggccgugca

SEQ ID NO: 1463633 - RNA, 19 nt, Pseudomonas aeruginosa PA01
ggagcggccugagcugccg

SEQ ID NO: 1463634 - RNA, 13 nt, Pseudomonas aeruginosa PA01
ggagcgggcgccg

SEQ ID NO: 1463635 - RNA, 16 nt, Pseudomonas aeruginosa PA01
ggagcgccaucagcga

SEQ ID NO: 1463636 - RNA, 18 nt, Pseudomonas aeruginosa PA01
ggagcgccaucagcgacc

SEQ ID NO: 1463637 - RNA, 20 nt, Pseudomonas aeruginosa PA01
ggagcgccaucagcgaccag

SEQ ID NO: 1463638 - RNA, 23 nt, Pseudomonas aeruginosa PA01
ggagcgccgcgcagcgcggcgcu

SEQ ID NO: 1463639 - RNA, 13 nt, Pseudomonas aeruginosa PA01
ggagcgccggcgc

SEQ ID NO: 1463640 - RNA, 24 nt, Pseudomonas aeruginosa PA01
ggagcgccucgaaggccucgguca

SEQ ID NO: 1463641 - RNA, 16 nt, Pseudomonas aeruginosa PA01
ggagcgcgaaagcgcc

SEQ ID NO: 1463642 - RNA, 17 nt, Pseudomonas aeruginosa PA01
ggagcgcgaaagcgccc

SEQ ID NO: 1463643 - RNA, 22 nt, Pseudomonas aeruginosa PA01
ggagcgcgacuuggacagcguc

SEQ ID NO: 1463644 - RNA, 23 nt, Pseudomonas aeruginosa PA01
ggagcgacaccaugcuccgccug

SEQ ID NO: 1463645 - RNA, 19 nt, Pseudomonas aeruginosa PA01
ggagcgaccggauggcuca

SEQ ID NO: 1463646 - RNA, 14 nt, Pseudomonas aeruginosa PA01
ggagcgccagcacc

SEQ ID NO: 1463647 - RNA, 14 nt, Pseudomonas aeruginosa PA01
ggagccgucgccgg

SEQ ID NO: 1463648 - RNA, 15 nt, Pseudomonas aeruginosa PA01
ggagccgucggcucc

SEQ ID NO: 1463649 - RNA, 19 nt, Pseudomonas aeruginosa PA01
ggagccggugccggcggcg

SEQ ID NO: 1463650 - RNA, 16 nt, Pseudomonas aeruginosa PA01
ggagccguagggcgca

SEQ ID NO: 1463651 - RNA, 12 nt, Pseudomonas aeruginosa PA01
ggagccgccgga

SEQ ID NO: 1463652 - RNA, 14 nt, Pseudomonas aeruginosa PA01
ggagccggccaggc

SEQ ID NO: 1463653 - RNA, 15 nt, Pseudomonas aeruginosa PA01
ggagcagcagcgccg

SEQ ID NO: 1463654 - RNA, 11 nt, Pseudomonas aeruginosa PA01
ggagccaggcg

SEQ ID NO: 1463655 - RNA, 14 nt, Pseudomonas aeruginosa PA01
ggagccaacgcccg

SEQ ID NO: 1463656 - RNA, 15 nt, Pseudomonas aeruginosa PA01
ggagccaacgcccgg

SEQ ID NO: 1463657 - RNA, 14 nt, Pseudomonas aeruginosa PA01
ggagcaugucuucg

SEQ ID NO: 1463658 - RNA, 16 nt, Pseudomonas aeruginosa PA01
ggagcacugggaaucg

SEQ ID NO: 1463659 - RNA, 16 nt, Pseudomonas aeruginosa PA01
ggagcagaaccgccag

SEQ ID NO: 1463660 - RNA, 16 nt, Pseudomonas aeruginosa PA01
ggagcaggccaugggu

SEQ ID NO: 1463661 - RNA, 15 nt, Pseudomonas aeruginosa PA01
ggagcaucggcgcgg

SEQ ID NO: 1463662 - RNA, 14 nt, Pseudomonas aeruginosa PA01
ggagcaucuggccc

SEQ ID NO: 1463663 - RNA, 14 nt, Pseudomonas aeruginosa PA01
ggacgccucgucgg

SEQ ID NO: 1463664 - RNA, 16 nt, Pseudomonas aeruginosa PA01
ggacgccguagcggcc

SEQ ID NO: 1463665 - RNA, 15 nt, Pseudomonas aeruginosa PA01
ggacgccgccgguca

SEQ ID NO: 1463666 - RNA, 23 nt, Pseudomonas aeruginosa PA01
ggacgacaucucguccucgggga

SEQ ID NO: 1463667 - RNA, 20 nt, Pseudomonas aeruginosa PA01
ggacgacgaagugaccgcgc

SEQ ID NO: 1463668 - RNA, 17 nt, Pseudomonas aeruginosa PA01
ggacgagcuuuccugcu

SEQ ID NO: 1463669 - RNA, 22 nt, Pseudomonas aeruginosa PA01
ggacgagcuuuccugcugagca

SEQ ID NO: 1463670 - RNA, 17 nt, Pseudomonas aeruginosa PA01
ggacgaggaaggcgcgc

SEQ ID NO: 1463671 - RNA, 21 nt, Pseudomonas aeruginosa PA01
ggacgaggaaggcgcgcacca

SEQ ID NO: 1463672 - RNA, 15 nt, Pseudomonas aeruginosa PA01
ggacgacgcuggccu

SEQ ID NO: 1463673 - RNA, 17 nt, Pseudomonas aeruginosa PA01
ggacgacgcuggccugc

SEQ ID NO: 1463674 - RNA, 13 nt, Pseudomonas aeruginosa PA01
ggagaggcgugcu

SEQ ID NO: 1463675 - RNA, 23 nt, Pseudomonas aeruginosa PA01
ggagaggggcuacuucgccgggu

SEQ ID NO: 1463676 - RNA, 16 nt, Pseudomonas aeruginosa PA01
ggagagggucagcagg

SEQ ID NO: 1463677 - RNA, 17 nt, Pseudomonas aeruginosa PA01
ggacgcgacugcugcug

SEQ ID NO: 1463678 - RNA, 21 nt, Pseudomonas aeruginosa PA01
ggagauguagucgacgccggu

SEQ ID NO: 1463679 - RNA, 20 nt, Pseudomonas aeruginosa PA01
ggagauguccaucagccgcg

SEQ ID NO: 1463680 - RNA, 14 nt, Pseudomonas aeruginosa PA01
ggagcaccgcgccu

SEQ ID NO: 1463681 - RNA, 14 nt, Pseudomonas aeruginosa PA01
ggagcaacagcguc

SEQ ID NO: 1463682 - RNA, 16 nt, Pseudomonas aeruginosa PA01
ggagaucagcggaccg

SEQ ID NO: 1463683 - RNA, 15 nt, Pseudomonas aeruginosa PA01
ggagaggaucagcga

SEQ ID NO: 1463684 - RNA, 16 nt, Pseudomonas aeruginosa PA01
ggagaucgccgcgccg

SEQ ID NO: 1463685 - RNA, 20 nt, Pseudomonas aeruginosa PA01
ggacagcuugacccguugcg

SEQ ID NO: 1463686 - RNA, 22 nt, Pseudomonas aeruginosa PA01
ggacagcucgcgggacagcuug

SEQ ID NO: 1463687 - RNA, 17 nt, Pseudomonas aeruginosa PA01
ggacagcgugcggcccu

SEQ ID NO: 1463688 - RNA, 14 nt, Pseudomonas aeruginosa PA01
ggacaggcagccgg

SEQ ID NO: 1463689 - RNA, 16 nt, Pseudomonas aeruginosa PA01
ggacaggccacccgcc

SEQ ID NO: 1463690 - RNA, 17 nt, Pseudomonas aeruginosa PA01
ggacaggccacccgccu

SEQ ID NO: 1463691 - RNA, 12 nt, Pseudomonas aeruginosa PA01
ggacaggccgac

SEQ ID NO: 1463692 - RNA, 16 nt, Pseudomonas aeruginosa PA01
ggacaugucgagggcc

SEQ ID NO: 1463693 - RNA, 15 nt, Pseudomonas aeruginosa PA01
ggaccaacgggcugc

SEQ ID NO: 1463694 - RNA, 21 nt, Pseudomonas aeruginosa PA01
ggaccaacgggcugccagcau

SEQ ID NO: 1463695 - RNA, 13 nt, Pseudomonas aeruginosa PA01
ggacagcaggcug

SEQ ID NO: 1463696 - RNA, 14 nt, Pseudomonas aeruginosa PA01
ggacagcagggucg

SEQ ID NO: 1463697 - RNA, 11 nt, Pseudomonas aeruginosa PA01
ggacaccccga

SEQ ID NO: 1463698 - RNA, 17 nt, Pseudomonas aeruginosa PA01
ggacaccgaugccgaag

SEQ ID NO: 1463699 - RNA, 22 nt, Pseudomonas aeruginosa PA01
ggacaccucccgggccagcucc

SEQ ID NO: 1463700 - RNA, 14 nt, Pseudomonas aeruginosa PA01
ggaccgcaaccggu

SEQ ID NO: 1463701 - RNA, 17 nt, Pseudomonas aeruginosa PA01
ggaccgcaccuggugga

SEQ ID NO: 1463702 - RNA, 16 nt, Pseudomonas aeruginosa PA01
ggaccgagaccgacgc

SEQ ID NO: 1463703 - RNA, 21 nt, Pseudomonas aeruginosa PA01
ggaccgaaggcaacagcccgc

SEQ ID NO: 1463704 - RNA, 21 nt, Pseudomonas aeruginosa PA01
ggacccguugccgaccgagca

SEQ ID NO: 1463705 - RNA, 22 nt, Pseudomonas aeruginosa PA01
ggaccgccucgaccaucggcgg

SEQ ID NO: 1463706 - RNA, 16 nt, Pseudomonas aeruginosa PA01
ggaccgccauggcgcu

SEQ ID NO: 1463707 - RNA, 13 nt, Pseudomonas aeruginosa PA01
ggaccagcgccgc

SEQ ID NO: 1463708 - RNA, 12 nt, Pseudomonas aeruginosa PA01
ggaccagcgccg

SEQ ID NO: 1463709 - RNA, 21 nt, Pseudomonas aeruginosa PA01
ggaccagccguccgcgggcga

SEQ ID NO: 1463710 - RNA, 18 nt, Pseudomonas aeruginosa PA01
ggaccacgcucaggucgg

SEQ ID NO: 1463711 - RNA, 12 nt, Pseudomonas aeruginosa PA01
ggaccaccccgg

SEQ ID NO: 1463712 - RNA, 15 nt, Pseudomonas aeruginosa PA01
ggacgaaaaccgcag

SEQ ID NO: 1463713 - RNA, 20 nt, Pseudomonas aeruginosa PA01
ggaccugucggcucgcgccg

SEQ ID NO: 1463714 - RNA, 21 nt, Pseudomonas aeruginosa PA01
ggaccugagaucagcgcccgg

SEQ ID NO: 1463715 - RNA, 23 nt, Pseudomonas aeruginosa PA01
ggaccuucagauacuccagcagc

SEQ ID NO: 1463716 - RNA, 14 nt, Pseudomonas aeruginosa PA01
ggaccuuccgccag

SEQ ID NO: 1463717 - RNA, 15 nt, Pseudomonas aeruginosa PA01
ggaccuuccgccagc

SEQ ID NO: 1463718 - RNA, 19 nt, Pseudomonas aeruginosa PA01
ggaccuugccccaggugcu

SEQ ID NO: 1463719 - RNA, 22 nt, Pseudomonas aeruginosa PA01
ggacgaaacgguagcccgcggc

SEQ ID NO: 1463720 - RNA, 19 nt, Pseudomonas aeruginosa PA01
ggacgaaggccuccucgua

SEQ ID NO: 1463721 - RNA, 17 nt, Pseudomonas aeruginosa PA01
ggacgaagucgccggca

SEQ ID NO: 1463722 - RNA, 18 nt, Pseudomonas aeruginosa PA01
ggacgaagucgccggcau

SEQ ID NO: 1463723 - RNA, 13 nt, Pseudomonas aeruginosa PA01
ggaccucgggcga

SEQ ID NO: 1463724 - RNA, 20 nt, Pseudomonas aeruginosa PA01
ggaccucggguuuggcgccc

SEQ ID NO: 1463725 - RNA, 12 nt, Pseudomonas aeruginosa PA01
ggaccuccgcca

SEQ ID NO: 1463726 - RNA, 13 nt, Pseudomonas aeruginosa PA01
ggaccuccgccag

SEQ ID NO: 1463727 - RNA, 15 nt, Pseudomonas aeruginosa PA01
ggaccuccgccagga

SEQ ID NO: 1463728 - RNA, 17 nt, Pseudomonas aeruginosa PA01
ggaccuccgccaggacc

SEQ ID NO: 1463729 - RNA, 18 nt, Pseudomonas aeruginosa PA01
ggaccuccgccaggaccu

SEQ ID NO: 1463730 - RNA, 16 nt, Pseudomonas aeruginosa PA01
ggaccucucucgcugc

SEQ ID NO: 1463731 - RNA, 17 nt, Pseudomonas aeruginosa PA01
ggaccucucucgcugcg

SEQ ID NO: 1463732 - RNA, 14 nt, Pseudomonas aeruginosa PA01
ggaccuccugcaca

SEQ ID NO: 1463733 - RNA, 19 nt, Pseudomonas aeruginosa PA01
ggaccucgaagcuggccag

SEQ ID NO: 1463734 - RNA, 20 nt, Pseudomonas aeruginosa PA01
ggaccuggcugaggcguucc

SEQ ID NO: 1463735 - RNA, 12 nt, Pseudomonas aeruginosa PA01
ggaccgugguga

SEQ ID NO: 1463736 - RNA, 23 nt, Pseudomonas aeruginosa PA01
gcuuuuuucauucauggcgccac

SEQ ID NO: 1463737 - RNA, 21 nt, Pseudomonas aeruginosa PA01
gcuuuuuucguugcgccugcu

SEQ ID NO: 1463738 - RNA, 23 nt, Pseudomonas aeruginosa PA01
ggaaaaaaaagcccgcacgaggc

SEQ ID NO: 1463739 - RNA, 18 nt, Pseudomonas aeruginosa PA01
ggaaaaaacgccggucau

SEQ ID NO: 1463740 - RNA, 15 nt, Pseudomonas aeruginosa PA01
ggaaccgcggcgccc

SEQ ID NO: 1463741 - RNA, 17 nt, Pseudomonas aeruginosa PA01
ggaaccgcggcgcccuc

SEQ ID NO: 1463742 - RNA, 24 nt, Pseudomonas aeruginosa PA01
ggaaccggccauuacgccgagcau

SEQ ID NO: 1463743 - RNA, 13 nt, Pseudomonas aeruginosa PA01
ggaaccggccggc

SEQ ID NO: 1463744 - RNA, 14 nt, Pseudomonas aeruginosa PA01
ggaaccggccggca

SEQ ID NO: 1463745 - RNA, 16 nt, Pseudomonas aeruginosa PA01
ggaaccgacgcgcagg

SEQ ID NO: 1463746 - RNA, 14 nt, Pseudomonas aeruginosa PA01
ggaacgcaggggca

SEQ ID NO: 1463747 - RNA, 16 nt, Pseudomonas aeruginosa PA01
ggaacgcccgcggcag

SEQ ID NO: 1463748 - RNA, 20 nt, Pseudomonas aeruginosa PA01
ggaacgcccgcggcagcagc

SEQ ID NO: 1463749 - RNA, 15 nt, Pseudomonas aeruginosa PA01
ggaacgcccuuguag

SEQ ID NO: 1463750 - RNA, 15 nt, Pseudomonas aeruginosa PA01
ggaacgccgacaggc

SEQ ID NO: 1463751 - RNA, 19 nt, Pseudomonas aeruginosa PA01
ggaacgaugccgcaggcau

SEQ ID NO: 1463752 - RNA, 20 nt, Pseudomonas aeruginosa PA01
ggaaccggguagaggguauu

SEQ ID NO: 1463753 - RNA, 17 nt, Pseudomonas aeruginosa PA01
ggaacgggacgccuggc

SEQ ID NO: 1463754 - RNA, 17 nt, Pseudomonas aeruginosa PA01
ggaacucgaucagcgcg

SEQ ID NO: 1463755 - RNA, 16 nt, Pseudomonas aeruginosa PA01
ggaacgugcggccugc

SEQ ID NO: 1463756 - RNA, 13 nt, Pseudomonas aeruginosa PA01
ggaaucugcgcca

SEQ ID NO: 1463757 - RNA, 15 nt, Pseudomonas aeruginosa PA01
ggaaucugcgccagg

SEQ ID NO: 1463758 - RNA, 13 nt, Pseudomonas aeruginosa PA01
ggaaucgcgcccu

SEQ ID NO: 1463759 - RNA, 18 nt, Pseudomonas aeruginosa PA01
ggacaagcgucgccggcc

SEQ ID NO: 1463760 - RNA, 14 nt, Pseudomonas aeruginosa PA01
ggacaacgacagcc

SEQ ID NO: 1463761 - RNA, 12 nt, Pseudomonas aeruginosa PA01
ggacaacaggcc

SEQ ID NO: 1463762 - RNA, 15 nt, Pseudomonas aeruginosa PA01
ggacaacaggccggg

SEQ ID NO: 1463763 - RNA, 17 nt, Pseudomonas aeruginosa PA01
ggacaacccggcgcugg

SEQ ID NO: 1463764 - RNA, 18 nt, Pseudomonas aeruginosa PA01
ggacaacccggcgcuggc

SEQ ID NO: 1463765 - RNA, 23 nt, Pseudomonas aeruginosa PA01
ggacaacccggcgcuggccgcgc

SEQ ID NO: 1463766 - RNA, 19 nt, Pseudomonas aeruginosa PA01
ggaagguccuugggccagg

SEQ ID NO: 1463767 - RNA, 14 nt, Pseudomonas aeruginosa PA01
ggaaggucucgccg

SEQ ID NO: 1463768 - RNA, 17 nt, Pseudomonas aeruginosa PA01
ggaaggucucgccgccg

SEQ ID NO: 1463769 - RNA, 23 nt, Pseudomonas aeruginosa PA01
ggaaggucaccgaaaggcucuug

SEQ ID NO: 1463770 - RNA, 22 nt, Pseudomonas aeruginosa PA01
ggaaggucagguagguggaggc

SEQ ID NO: 1463771 - RNA, 13 nt, Pseudomonas aeruginosa PA01
ggaaggcggcguc

SEQ ID NO: 1463772 - RNA, 14 nt, Pseudomonas aeruginosa PA01
ggaaggcggcgucg

SEQ ID NO: 1463773 - RNA, 14 nt, Pseudomonas aeruginosa PA01
ggaaggcgucgccg

SEQ ID NO: 1463774 - RNA, 17 nt, Pseudomonas aeruginosa PA01
ggaagggacgucgccag

SEQ ID NO: 1463775 - RNA, 13 nt, Pseudomonas aeruginosa PA01
ggaagggaucgac

SEQ ID NO: 1463776 - RNA, 13 nt, Pseudomonas aeruginosa PA01
ggaaggccgcgcc

SEQ ID NO: 1463777 - RNA, 12 nt, Pseudomonas aeruginosa PA01
ggaaggccugga

SEQ ID NO: 1463778 - RNA, 12 nt, Pseudomonas aeruginosa PA01
ggaaggcgacga

SEQ ID NO: 1463779 - RNA, 17 nt, Pseudomonas aeruginosa PA01
ggaaggcgcuggcgcug

SEQ ID NO: 1463780 - RNA, 11 nt, Pseudomonas aeruginosa PA01
ggaaggcgcgc

SEQ ID NO: 1463781 - RNA, 14 nt, Pseudomonas aeruginosa PA01
ggaaggccagcagg

SEQ ID NO: 1463782 - RNA, 14 nt, Pseudomonas aeruginosa PA01
ggaaggccaggucg

SEQ ID NO: 1463783 - RNA, 16 nt, Pseudomonas aeruginosa PA01
ggaaggccaggucgcc

SEQ ID NO: 1463784 - RNA, 13 nt, Pseudomonas aeruginosa PA01
ggaaggaucgagc

SEQ ID NO: 1463785 - RNA, 17 nt, Pseudomonas aeruginosa PA01
ggaauccuccgccagcg

SEQ ID NO: 1463786 - RNA, 18 nt, Pseudomonas aeruginosa PA01
ggaauccuccgccagcgu

SEQ ID NO: 1463787 - RNA, 20 nt, Pseudomonas aeruginosa PA01
ggaaucgacccagccgcacg

SEQ ID NO: 1463788 - RNA, 13 nt, Pseudomonas aeruginosa PA01
ggaaguaucggcg

SEQ ID NO: 1463789 - RNA, 22 nt, Pseudomonas aeruginosa PA01
ggaaguauugcuccacccgcag

SEQ ID NO: 1463790 - RNA, 21 nt, Pseudomonas aeruginosa PA01
gcuguuucuccaguucggcga

SEQ ID NO: 1463791 - RNA, 15 nt, Pseudomonas aeruginosa PA01
gcuguuugcggcgca

SEQ ID NO: 1463792 - RNA, 19 nt, Pseudomonas aeruginosa PA01
gcuguuugcggcgcaggcg

SEQ ID NO: 1463793 - RNA, 19 nt, Pseudomonas aeruginosa PA01
gcuugacccguugcgccuc

SEQ ID NO: 1463794 - RNA, 14 nt, Pseudomonas aeruginosa PA01
gcugugcgucgagg

SEQ ID NO: 1463795 - RNA, 24 nt, Pseudomonas aeruginosa PA01
gcugugcguuucguugcggaacgc

SEQ ID NO: 1463796 - RNA, 13 nt, Pseudomonas aeruginosa PA01
gcuguugccgcug

SEQ ID NO: 1463797 - RNA, 15 nt, Pseudomonas aeruginosa PA01
gcuguugccgcugca

SEQ ID NO: 1463798 - RNA, 21 nt, Pseudomonas aeruginosa PA01
gcuguugccguggcggcgcgc

SEQ ID NO: 1463799 - RNA, 22 nt, Pseudomonas aeruginosa PA01
gcuguugccguggcggcgcgcg

SEQ ID NO: 1463800 - RNA, 22 nt, Pseudomonas aeruginosa PA01
gcuguugccguucugugcggcg

SEQ ID NO: 1463801 - RNA, 17 nt, Pseudomonas aeruginosa PA01
gcuguuggccugggcga

SEQ ID NO: 1463802 - RNA, 23 nt, Pseudomonas aeruginosa PA01
gcuugaucgagcccuugcgcggc

SEQ ID NO: 1463803 - RNA, 20 nt, Pseudomonas aeruginosa PA01
gcuugaucgagucgccggcg

SEQ ID NO: 1463804 - RNA, 15 nt, Pseudomonas aeruginosa PA01
gcuugaucgccagcc

SEQ ID NO: 1463805 - RNA, 15 nt, Pseudomonas aeruginosa PA01
gcuugaucacgccga

SEQ ID NO: 1463806 - RNA, 17 nt, Pseudomonas aeruginosa PA01
gcuugagguaggccagc

SEQ ID NO: 1463807 - RNA, 21 nt, Pseudomonas aeruginosa PA01
gcuugagguaggccagcccca

SEQ ID NO: 1463808 - RNA, 23 nt, Pseudomonas aeruginosa PA01
gcuugagguaggccagccccaga

SEQ ID NO: 1463809 - RNA, 16 nt, Pseudomonas aeruginosa PA01
gcuugagcagccaggc

SEQ ID NO: 1463810 - RNA, 14 nt, Pseudomonas aeruginosa PA01
gcuugagccccggc

SEQ ID NO: 1463811 - RNA, 16 nt, Pseudomonas aeruginosa PA01
gcuugagucgcaggcu

SEQ ID NO: 1463812 - RNA, 16 nt, Pseudomonas aeruginosa PA01
gcuugacgaaggcggc

SEQ ID NO: 1463813 - RNA, 17 nt, Pseudomonas aeruginosa PA01
gcuugacgaaggcggca

SEQ ID NO: 1463814 - RNA, 20 nt, Pseudomonas aeruginosa PA01
gcuugacgacugcacgcaga

SEQ ID NO: 1463815 - RNA, 17 nt, Pseudomonas aeruginosa PA01
gcuugaccuugccgccg

SEQ ID NO: 1463816 - RNA, 18 nt, Pseudomonas aeruginosa PA01
gcuugaccuugccgccgg

SEQ ID NO: 1463817 - RNA, 18 nt, Pseudomonas aeruginosa PA01
gcuugaccgccgccgccu

SEQ ID NO: 1463818 - RNA, 15 nt, Pseudomonas aeruginosa PA01
gcuugaccgccgccu

SEQ ID NO: 1463819 - RNA, 15 nt, Pseudomonas aeruginosa PA01
gcuugcccagguagu

SEQ ID NO: 1463820 - RNA, 21 nt, Pseudomonas aeruginosa PA01
gcuugcccaucuucagcauca

SEQ ID NO: 1463821 - RNA, 22 nt, Pseudomonas aeruginosa PA01
gcuugcccaucuucagcaucag

SEQ ID NO: 1463822 - RNA, 18 nt, Pseudomonas aeruginosa PA01
gcuugccgagcugggcgu

SEQ ID NO: 1463823 - RNA, 15 nt, Pseudomonas aeruginosa PA01
gcuugccgaugucgc

SEQ ID NO: 1463824 - RNA, 19 nt, Pseudomonas aeruginosa PA01
gcuugccgaugucgccggc

SEQ ID NO: 1463825 - RNA, 21 nt, Pseudomonas aeruginosa PA01
gcuugccgaugucgccggcau

SEQ ID NO: 1463826 - RNA, 18 nt, Pseudomonas aeruginosa PA01
gcuugccgcgcccggcca

SEQ ID NO: 1463827 - RNA, 15 nt, Pseudomonas aeruginosa PA01
gcuugcacaccuggu

SEQ ID NO: 1463828 - RNA, 21 nt, Pseudomonas aeruginosa PA01
gcuugauguaggacaggccga

SEQ ID NO: 1463829 - RNA, 17 nt, Pseudomonas aeruginosa PA01
gcuugccacugcgcgcc

SEQ ID NO: 1463830 - RNA, 16 nt, Pseudomonas aeruginosa PA01
gcuugccagccgcuuc

SEQ ID NO: 1463831 - RNA, 15 nt, Pseudomonas aeruginosa PA01
gcuugcgcagcaucu

SEQ ID NO: 1463832 - RNA, 23 nt, Pseudomonas aeruginosa PA01
gcuugcgaccgagaugcugccga

SEQ ID NO: 1463833 - RNA, 18 nt, Pseudomonas aeruginosa PA01
gcuugccuuccugggcgu

SEQ ID NO: 1463834 - RNA, 16 nt, Pseudomonas aeruginosa PA01
gcuugccuuccaggcu

SEQ ID NO: 1463835 - RNA, 18 nt, Pseudomonas aeruginosa PA01
gcuugccguuggcgucgc

SEQ ID NO: 1463836 - RNA, 20 nt, Pseudomonas aeruginosa PA01
gcuugccguuggcgucgcgc

SEQ ID NO: 1463837 - RNA, 14 nt, Pseudomonas aeruginosa PA01
gcuugccgucggug

SEQ ID NO: 1463838 - RNA, 14 nt, Pseudomonas aeruginosa PA01
gcuugccgcugcgc

SEQ ID NO: 1463839 - RNA, 15 nt, Pseudomonas aeruginosa PA01
gcuugccguccagcg

SEQ ID NO: 1463840 - RNA, 19 nt, Pseudomonas aeruginosa PA01
gcuugccggccgccagcag

SEQ ID NO: 1463841 - RNA, 13 nt, Pseudomonas aeruginosa PA01
gcuugccggcgac

SEQ ID NO: 1463842 - RNA, 15 nt, Pseudomonas aeruginosa PA01
gcuugccggcgacgc

SEQ ID NO: 1463843 - RNA, 12 nt, Pseudomonas aeruginosa PA01
gcuugccggcgc

SEQ ID NO: 1463844 - RNA, 14 nt, Pseudomonas aeruginosa PA01
gcuugccggcgccu

SEQ ID NO: 1463845 - RNA, 13 nt, Pseudomonas aeruginosa PA01
gcuugccggcggc

SEQ ID NO: 1463846 - RNA, 17 nt, Pseudomonas aeruginosa PA01
gcuugcgcgccaccagc

SEQ ID NO: 1463847 - RNA, 19 nt, Pseudomonas aeruginosa PA01
gcuugcgcgccaccagcgu

SEQ ID NO: 1463848 - RNA, 17 nt, Pseudomonas aeruginosa PA01
gcuugcgccgccucgcg

SEQ ID NO: 1463849 - RNA, 15 nt, Pseudomonas aeruginosa PA01
gcuugcgcgccaggg

SEQ ID NO: 1463850 - RNA, 21 nt, Pseudomonas aeruginosa PA01
gcuugcgcgccgccgccgcgg

SEQ ID NO: 1463851 - RNA, 14 nt, Pseudomonas aeruginosa PA01
gcuuucagcgccgc

SEQ ID NO: 1463852 - RNA, 15 nt, Pseudomonas aeruginosa PA01
gcuuucaggcgcucg

SEQ ID NO: 1463853 - RNA, 20 nt, Pseudomonas aeruginosa PA01
gcuuuccaccgccagcaccc

SEQ ID NO: 1463854 - RNA, 19 nt, Pseudomonas aeruginosa PA01
gcuuuccagcaggcgcucg

SEQ ID NO: 1463855 - RNA, 20 nt, Pseudomonas aeruginosa PA01
gcuuuccagcaggcgcucgc

SEQ ID NO: 1463856 - RNA, 21 nt, Pseudomonas aeruginosa PA01
gcuuuccagcaggcgcucgcu

SEQ ID NO: 1463857 - RNA, 20 nt, Pseudomonas aeruginosa PA01
gcuuuccagcccggcguggg

SEQ ID NO: 1463858 - RNA, 15 nt, Pseudomonas aeruginosa PA01
gcuuguccuggcgca

SEQ ID NO: 1463859 - RNA, 19 nt, Pseudomonas aeruginosa PA01
gcuuguccuuccagcucuc

SEQ ID NO: 1463860 - RNA, 15 nt, Pseudomonas aeruginosa PA01
gcuuguccuucggcc

SEQ ID NO: 1463861 - RNA, 15 nt, Pseudomonas aeruginosa PA01
gcuuguccgccggaa

SEQ ID NO: 1463862 - RNA, 17 nt, Pseudomonas aeruginosa PA01
gcuuuucauuaccggcg

SEQ ID NO: 1463863 - RNA, 15 nt, Pseudomonas aeruginosa PA01
gcuuuuccggcgccg

SEQ ID NO: 1463864 - RNA, 22 nt, Pseudomonas aeruginosa PA01
gcuuuccagggcaaacagcucc

SEQ ID NO: 1463865 - RNA, 16 nt, Pseudomonas aeruginosa PA01
gcuuuuuuaugcgcag

SEQ ID NO: 1463866 - RNA, 11 nt, Pseudomonas aeruginosa PA01
gcuuggcccug

SEQ ID NO: 1463867 - RNA, 15 nt, Pseudomonas aeruginosa PA01
gcuuggccagcgcgg

SEQ ID NO: 1463868 - RNA, 14 nt, Pseudomonas aeruginosa PA01
gcuuggcccugcgc

SEQ ID NO: 1463869 - RNA, 15 nt, Pseudomonas aeruginosa PA01
gcuuggcccuggccu

SEQ ID NO: 1463870 - RNA, 16 nt, Pseudomonas aeruginosa PA01
gcuuggcccuggccuu

SEQ ID NO: 1463871 - RNA, 12 nt, Pseudomonas aeruginosa PA01
gcuuggccaggc

SEQ ID NO: 1463872 - RNA, 13 nt, Pseudomonas aeruginosa PA01
gcuuggccaggcg

SEQ ID NO: 1463873 - RNA, 14 nt, Pseudomonas aeruginosa PA01
gcuuggccaggcgc

SEQ ID NO: 1463874 - RNA, 17 nt, Pseudomonas aeruginosa PA01
gcuuggccaggcgcuug

SEQ ID NO: 1463875 - RNA, 15 nt, Pseudomonas aeruginosa PA01
gcuuggccaggucgc

SEQ ID NO: 1463876 - RNA, 20 nt, Pseudomonas aeruginosa PA01
gcuuggccaggucgucgcgc

SEQ ID NO: 1463877 - RNA, 20 nt, Pseudomonas aeruginosa PA01
gcuuggccauggcgcuugcg

SEQ ID NO: 1463878 - RNA, 20 nt, Pseudomonas aeruginosa PA01
gcuuggccacuccgggcugg

SEQ ID NO: 1463879 - RNA, 19 nt, Pseudomonas aeruginosa PA01
gcuugcggucauccgccgg

SEQ ID NO: 1463880 - RNA, 17 nt, Pseudomonas aeruginosa PA01
gcuugcgguuauccgcc

SEQ ID NO: 1463881 - RNA, 14 nt, Pseudomonas aeruginosa PA01
gcuugcgggcgcgc

SEQ ID NO: 1463882 - RNA, 14 nt, Pseudomonas aeruginosa PA01
gcuugcgcuggccg

SEQ ID NO: 1463883 - RNA, 22 nt, Pseudomonas aeruginosa PA01
gcuugcucuccacuaccgccga

SEQ ID NO: 1463884 - RNA, 14 nt, Pseudomonas aeruginosa PA01
gcuugcguucgcuc

SEQ ID NO: 1463885 - RNA, 17 nt, Pseudomonas aeruginosa PA01
gcuugcgucccuuggcg

SEQ ID NO: 1463886 - RNA, 14 nt, Pseudomonas aeruginosa PA01
gcuugcucgaugcc

SEQ ID NO: 1463887 - RNA, 23 nt, Pseudomonas aeruginosa PA01
gcuugcuggcguucucggccagg

SEQ ID NO: 1463888 - RNA, 18 nt, Pseudomonas aeruginosa PA01
gcuuggcggucagcgacu

SEQ ID NO: 1463889 - RNA, 20 nt, Pseudomonas aeruginosa PA01
gcuuggcggucagcgacugg

SEQ ID NO: 1463890 - RNA, 16 nt, Pseudomonas aeruginosa PA01
gcuugggauggccagc

SEQ ID NO: 1463891 - RNA, 18 nt, Pseudomonas aeruginosa PA01
gcuugggcgccucgccgc

SEQ ID NO: 1463892 - RNA, 17 nt, Pseudomonas aeruginosa PA01
gcuuggcgcgcuggcag

SEQ ID NO: 1463893 - RNA, 16 nt, Pseudomonas aeruginosa PA01
gcuuggcgaggcgcgc

SEQ ID NO: 1463894 - RNA, 19 nt, Pseudomonas aeruginosa PA01
gcuuggcgaucacggcgcc

SEQ ID NO: 1463895 - RNA, 21 nt, Pseudomonas aeruginosa PA01
gcuuggucgggauggcgaagc

SEQ ID NO: 1463896 - RNA, 14 nt, Pseudomonas aeruginosa PA01
gcuuggucgggcgc

SEQ ID NO: 1463897 - RNA, 15 nt, Pseudomonas aeruginosa PA01
gcuuggucgggcgcc

SEQ ID NO: 1463898 - RNA, 22 nt, Pseudomonas aeruginosa PA01
gcuuggucgggcgccgcgccuu

SEQ ID NO: 1463899 - RNA, 21 nt, Pseudomonas aeruginosa PA01
gcuuguaguagcgcccgacga

SEQ ID NO: 1463900 - RNA, 22 nt, Pseudomonas aeruginosa PA01
gcuuguccacgccauaggcggc

SEQ ID NO: 1463901 - RNA, 15 nt, Pseudomonas aeruginosa PA01
gcuuguccagggcgc

SEQ ID NO: 1463902 - RNA, 16 nt, Pseudomonas aeruginosa PA01
gcuuguccagggcgcc

SEQ ID NO: 1463903 - RNA, 18 nt, Pseudomonas aeruginosa PA01
gcuuguagcagccgcagg

SEQ ID NO: 1463904 - RNA, 15 nt, Pseudomonas aeruginosa PA01
gcuuguagcccaggg

SEQ ID NO: 1463905 - RNA, 21 nt, Pseudomonas aeruginosa PA01
gcuuguagcccaggggcacgu

SEQ ID NO: 1463906 - RNA, 22 nt, Pseudomonas aeruginosa PA01
ugaaucgccucccuggcgacgu

SEQ ID NO: 1463907 - RNA, 13 nt, Pseudomonas aeruginosa PA01
ugaauugcugcca

SEQ ID NO: 1463908 - RNA, 15 nt, Pseudomonas aeruginosa PA01
ugacauucgacagca

SEQ ID NO: 1463909 - RNA, 17 nt, Pseudomonas aeruginosa PA01
ugacauucgacagcagg

SEQ ID NO: 1463910 - RNA, 15 nt, Pseudomonas aeruginosa PA01
ugaccagagccgccg

SEQ ID NO: 1463911 - RNA, 14 nt, Pseudomonas aeruginosa PA01
ugaccagcauggcg

SEQ ID NO: 1463912 - RNA, 18 nt, Pseudomonas aeruginosa PA01
ugaccagcccggcggcgg

SEQ ID NO: 1463913 - RNA, 15 nt, Pseudomonas aeruginosa PA01
ugaccagcggcccgg

SEQ ID NO: 1463914 - RNA, 19 nt, Pseudomonas aeruginosa PA01
ugaccaggguggcggcggc

SEQ ID NO: 1463915 - RNA, 20 nt, Pseudomonas aeruginosa PA01
ugaccacgcagagcggcagg

SEQ ID NO: 1463916 - RNA, 20 nt, Pseudomonas aeruginosa PA01
ugaccaccuugauccgcgac

SEQ ID NO: 1463917 - RNA, 21 nt, Pseudomonas aeruginosa PA01
ugaccaccuugauccgcgacg

SEQ ID NO: 1463918 - RNA, 14 nt, Pseudomonas aeruginosa PA01
ugaacucgcccggc

SEQ ID NO: 1463919 - RNA, 18 nt, Pseudomonas aeruginosa PA01
ugaacucgcccggcucgg

SEQ ID NO: 1463920 - RNA, 19 nt, Pseudomonas aeruginosa PA01
ugaacuggaugucgcuggc

SEQ ID NO: 1463921 - RNA, 14 nt, Pseudomonas aeruginosa PA01
ugaacgcgcccggc

SEQ ID NO: 1463922 - RNA, 16 nt, Pseudomonas aeruginosa PA01
ugaacgcgcccggcca

SEQ ID NO: 1463923 - RNA, 19 nt, Pseudomonas aeruginosa PA01
ugaacgcgcggaccuucga

SEQ ID NO: 1463924 - RNA, 19 nt, Pseudomonas aeruginosa PA01
ugaacggcgucacgccgau

SEQ ID NO: 1463925 - RNA, 20 nt, Pseudomonas aeruginosa PA01
ugaagcacaccuccagcggc

SEQ ID NO: 1463926 - RNA, 15 nt, Pseudomonas aeruginosa PA01
ugaagaagcugccgg

SEQ ID NO: 1463927 - RNA, 19 nt, Pseudomonas aeruginosa PA01
ugaagauauaacgcgagcc

SEQ ID NO: 1463928 - RNA, 12 nt, Pseudomonas aeruginosa PA01
ugaagcccacca

SEQ ID NO: 1463929 - RNA, 21 nt, Pseudomonas aeruginosa PA01
ugaagccgccgcccagcagca

SEQ ID NO: 1463930 - RNA, 18 nt, Pseudomonas aeruginosa PA01
ugaagcccaggcgcucgg

SEQ ID NO: 1463931 - RNA, 18 nt, Pseudomonas aeruginosa PA01
ugaagccccuggcgcugg

SEQ ID NO: 1463932 - RNA, 19 nt, Pseudomonas aeruginosa PA01
ugaagcccgcggcaucggc

SEQ ID NO: 1463933 - RNA, 14 nt, Pseudomonas aeruginosa PA01
ugaagagcagcacc

SEQ ID NO: 1463934 - RNA, 22 nt, Pseudomonas aeruginosa PA01
ugaagagcagcaccacggcgau

SEQ ID NO: 1463935 - RNA, 21 nt, Pseudomonas aeruginosa PA01
ugaagacccggcguucgccgg

SEQ ID NO: 1463936 - RNA, 15 nt, Pseudomonas aeruginosa PA01
ugaagacccugcaca

SEQ ID NO: 1463937 - RNA, 15 nt, Pseudomonas aeruginosa PA01
ugaagcgcaggcggc

SEQ ID NO: 1463938 - RNA, 18 nt, Pseudomonas aeruginosa PA01
ugaagcgcaggcggcugg

SEQ ID NO: 1463939 - RNA, 14 nt, Pseudomonas aeruginosa PA01
ugaagcgccgcggc

SEQ ID NO: 1463940 - RNA, 20 nt, Pseudomonas aeruginosa PA01
ugaagcgccgcggcccggcg

SEQ ID NO: 1463941 - RNA, 22 nt, Pseudomonas aeruginosa PA01
ugaagcgccgcggcccggcgcu

SEQ ID NO: 1463942 - RNA, 23 nt, Pseudomonas aeruginosa PA01
ugaagcgcggcggcgcggagauc

SEQ ID NO: 1463943 - RNA, 13 nt, Pseudomonas aeruginosa PA01
ugaagcgcugcug

SEQ ID NO: 1463944 - RNA, 17 nt, Pseudomonas aeruginosa PA01
ugaagcgcugcugggcg

SEQ ID NO: 1463945 - RNA, 12 nt, Pseudomonas aeruginosa PA01
ugaagcggccgu

SEQ ID NO: 1463946 - RNA, 17 nt, Pseudomonas aeruginosa PA01
ugaaggaaaccggccag

SEQ ID NO: 1463947 - RNA, 13 nt, Pseudomonas aeruginosa PA01
ugaaggucgccgc

SEQ ID NO: 1463948 - RNA, 15 nt, Pseudomonas aeruginosa PA01
ugaaggucgccgcgc

SEQ ID NO: 1463949 - RNA, 15 nt, Pseudomonas aeruginosa PA01
ugaaggccgacaccu

SEQ ID NO: 1463950 - RNA, 20 nt, Pseudomonas aeruginosa PA01
ugaaggcgcugagcgccucg

SEQ ID NO: 1463951 - RNA, 22 nt, Pseudomonas aeruginosa PA01
ugaaguacuggucgcgcgcggc

SEQ ID NO: 1463952 - RNA, 16 nt, Pseudomonas aeruginosa PA01
ugaaguagccgccggg

SEQ ID NO: 1463953 - RNA, 21 nt, Pseudomonas aeruginosa PA01
ugaauaccaccgggccgucgg

SEQ ID NO: 1463954 - RNA, 15 nt, Pseudomonas aeruginosa PA01
ugaaaaacgccggcg

SEQ ID NO: 1463955 - RNA, 14 nt, Pseudomonas aeruginosa PA01
ugaaaacggcgccc

SEQ ID NO: 1463956 - RNA, 16 nt, Pseudomonas aeruginosa PA01
ucuuccggcucgccgc

SEQ ID NO: 1463957 - RNA, 12 nt, Pseudomonas aeruginosa PA01
ucuuccggagcc

SEQ ID NO: 1463958 - RNA, 22 nt, Pseudomonas aeruginosa PA01
ucuucgaaggucugcccguggc

SEQ ID NO: 1463959 - RNA, 22 nt, Pseudomonas aeruginosa PA01
ucuuccuugcugaagcccaggc

SEQ ID NO: 1463960 - RNA, 21 nt, Pseudomonas aeruginosa PA01
ucuuccuggaccuccgccagg

SEQ ID NO: 1463961 - RNA, 13 nt, Pseudomonas aeruginosa PA01
ucuuccuggccgg

SEQ ID NO: 1463962 - RNA, 14 nt, Pseudomonas aeruginosa PA01
ucuuccuggccggg

SEQ ID NO: 1463963 - RNA, 23 nt, Pseudomonas aeruginosa PA01
ucuuccuggccgggaaccagcau

SEQ ID NO: 1463964 - RNA, 17 nt, Pseudomonas aeruginosa PA01
ucuuccccuaccggcaa

SEQ ID NO: 1463965 - RNA, 18 nt, Pseudomonas aeruginosa PA01
ucuucccagaccccggcg

SEQ ID NO: 1463966 - RNA, 13 nt, Pseudomonas aeruginosa PA01
ucuguucggccag

SEQ ID NO: 1463967 - RNA, 14 nt, Pseudomonas aeruginosa PA01
ucuguuccucggcg

SEQ ID NO: 1463968 - RNA, 14 nt, Pseudomonas aeruginosa PA01
ucuguucgaccagu

SEQ ID NO: 1463969 - RNA, 23 nt, Pseudomonas aeruginosa PA01
ucuugcaggcucacgcguucggc

SEQ ID NO: 1463970 - RNA, 17 nt, Pseudomonas aeruginosa PA01
ucuucugguaggccagc

SEQ ID NO: 1463971 - RNA, 14 nt, Pseudomonas aeruginosa PA01
aauacggcuccggc

SEQ ID NO: 1463972 - RNA, 13 nt, Pseudomonas aeruginosa PA01
ucuggucgccgac

SEQ ID NO: 1463973 - RNA, 18 nt, Pseudomonas aeruginosa PA01
ucuggggugaggccgagc

SEQ ID NO: 1463974 - RNA, 16 nt, Pseudomonas aeruginosa PA01
ucugguagcugcggcc

SEQ ID NO: 1463975 - RNA, 18 nt, Pseudomonas aeruginosa PA01
ucugguagcugcggccga

SEQ ID NO: 1463976 - RNA, 23 nt, Pseudomonas aeruginosa PA01
ucugcggacuaccuucgaucacc

SEQ ID NO: 1463977 - RNA, 17 nt, Pseudomonas aeruginosa PA01
ucucgacccgcucgagg

SEQ ID NO: 1463978 - RNA, 22 nt, Pseudomonas aeruginosa PA01
ucucgaacucgaaggccagcuc

SEQ ID NO: 1463979 - RNA, 16 nt, Pseudomonas aeruginosa PA01
ucucgaagaccagcgg

SEQ ID NO: 1463980 - RNA, 22 nt, Pseudomonas aeruginosa PA01
ucucgaagccgaggcuuuccag

SEQ ID NO: 1463981 - RNA, 19 nt, Pseudomonas aeruginosa PA01
ucucgaacagcuccuccag

SEQ ID NO: 1463982 - RNA, 13 nt, Pseudomonas aeruginosa PA01
ucugcucggcgcc

SEQ ID NO: 1463983 - RNA, 12 nt, Pseudomonas aeruginosa PA01
ucugcucggccu

SEQ ID NO: 1463984 - RNA, 13 nt, Pseudomonas aeruginosa PA01
ucugcucggcgau

SEQ ID NO: 1463985 - RNA, 14 nt, Pseudomonas aeruginosa PA01
ucugcucggcgaug

SEQ ID NO: 1463986 - RNA, 13 nt, Pseudomonas aeruginosa PA01
ucugcuccagcaa

SEQ ID NO: 1463987 - RNA, 20 nt, Pseudomonas aeruginosa PA01
ucugggaguuccgcgcaacc

SEQ ID NO: 1463988 - RNA, 19 nt, Pseudomonas aeruginosa PA01
ucugggccaugaccucggc

SEQ ID NO: 1463989 - RNA, 17 nt, Pseudomonas aeruginosa PA01
ucuggcugucgccgauc

SEQ ID NO: 1463990 - RNA, 14 nt, Pseudomonas aeruginosa PA01
ucuggcugcccagg

SEQ ID NO: 1463991 - RNA, 19 nt, Pseudomonas aeruginosa PA01
ucuggcugaucaguucgga

SEQ ID NO: 1463992 - RNA, 17 nt, Pseudomonas aeruginosa PA01
ucuggcugcgcgccacc

SEQ ID NO: 1463993 - RNA, 13 nt, Pseudomonas aeruginosa PA01
ucguccggagccg

SEQ ID NO: 1463994 - RNA, 20 nt, Pseudomonas aeruginosa PA01
ucguccggccgcccgagccg

SEQ ID NO: 1463995 - RNA, 18 nt, Pseudomonas aeruginosa PA01
ucguccuccucgaucacc

SEQ ID NO: 1463996 - RNA, 19 nt, Pseudomonas aeruginosa PA01
ucguccuccucgaucaccc

SEQ ID NO: 1463997 - RNA, 21 nt, Pseudomonas aeruginosa PA01
ucguccucgaaagccgccgcc

SEQ ID NO: 1463998 - RNA, 18 nt, Pseudomonas aeruginosa PA01
ucguccucggcguagccg

SEQ ID NO: 1463999 - RNA, 20 nt, Pseudomonas aeruginosa PA01
ucguccucggcguagccggc

SEQ ID NO: 1464000 - RNA, 18 nt, Pseudomonas aeruginosa PA01
ucguccucggcguagugc

SEQ ID NO: 1464001 - RNA, 17 nt, Pseudomonas aeruginosa PA01
ucguccucggggaagcg

SEQ ID NO: 1464002 - RNA, 19 nt, Pseudomonas aeruginosa PA01
ucgucauggcgcacgccgc

SEQ ID NO: 1464003 - RNA, 23 nt, Pseudomonas aeruginosa PA01
ucgucccaugaccgucagccagg

SEQ ID NO: 1464004 - RNA, 17 nt, Pseudomonas aeruginosa PA01
ucguacaccgcgcggca

SEQ ID NO: 1464005 - RNA, 21 nt, Pseudomonas aeruginosa PA01
ucguacucggcggggcgcagc

SEQ ID NO: 1464006 - RNA, 19 nt, Pseudomonas aeruginosa PA01
ucguagaacuuuaggucug

SEQ ID NO: 1464007 - RNA, 17 nt, Pseudomonas aeruginosa PA01
ucguacuucagcgucac

SEQ ID NO: 1464008 - RNA, 15 nt, Pseudomonas aeruginosa PA01
ucguagacgcccgga

SEQ ID NO: 1464009 - RNA, 21 nt, Pseudomonas aeruginosa PA01
ucguagacgcgcacgucaccg

SEQ ID NO: 1464010 - RNA, 13 nt, Pseudomonas aeruginosa PA01
ucgucacccgcgc

SEQ ID NO: 1464011 - RNA, 17 nt, Pseudomonas aeruginosa PA01
ucgucgcuauagcggau

SEQ ID NO: 1464012 - RNA, 19 nt, Pseudomonas aeruginosa PA01
ucgucggacuugaugaccg

SEQ ID NO: 1464013 - RNA, 19 nt, Pseudomonas aeruginosa PA01
ucgucggacuugcggccca

SEQ ID NO: 1464014 - RNA, 15 nt, Pseudomonas aeruginosa PA01
ucgucgcuuccggcg

SEQ ID NO: 1464015 - RNA, 16 nt, Pseudomonas aeruginosa PA01
ucgucgcuuccggcgc

SEQ ID NO: 1464016 - RNA, 18 nt, Pseudomonas aeruginosa PA01
ucgucgcuuccggcgcca

SEQ ID NO: 1464017 - RNA, 19 nt, Pseudomonas aeruginosa PA01
ucgucgccggaggggcggc

SEQ ID NO: 1464018 - RNA, 15 nt, Pseudomonas aeruginosa PA01
ucgucgccgcccggc

SEQ ID NO: 1464019 - RNA, 18 nt, Pseudomonas aeruginosa PA01
ucgucgccgccgaggcgc

SEQ ID NO: 1464020 - RNA, 12 nt, Pseudomonas aeruginosa PA01
ucgucgcggcgc

SEQ ID NO: 1464021 - RNA, 13 nt, Pseudomonas aeruginosa PA01
ucgucgcgccagg

SEQ ID NO: 1464022 - RNA, 14 nt, Pseudomonas aeruginosa PA01
ucgucgcgccaggc

SEQ ID NO: 1464023 - RNA, 15 nt, Pseudomonas aeruginosa PA01
ucgucgcgccaggcg

SEQ ID NO: 1464024 - RNA, 14 nt, Pseudomonas aeruginosa PA01
ucgucgcgcagcuc

SEQ ID NO: 1464025 - RNA, 19 nt, Pseudomonas aeruginosa PA01
ucgucgaggguggcgccga

SEQ ID NO: 1464026 - RNA, 22 nt, Pseudomonas aeruginosa PA01
ucgucgaggguugucaccggca

SEQ ID NO: 1464027 - RNA, 12 nt, Pseudomonas aeruginosa PA01
ucgucgccgacc

SEQ ID NO: 1464028 - RNA, 17 nt, Pseudomonas aeruginosa PA01
ucgucgaucagguccug

SEQ ID NO: 1464029 - RNA, 23 nt, Pseudomonas aeruginosa PA01
ucgucgaucagguccuggccgaa

SEQ ID NO: 1464030 - RNA, 15 nt, Pseudomonas aeruginosa PA01
ucgucauuggccgaa

SEQ ID NO: 1464031 - RNA, 14 nt, Pseudomonas aeruginosa PA01
ucgucgagaugcug

SEQ ID NO: 1464032 - RNA, 16 nt, Pseudomonas aeruginosa PA01
ucgucgagcagcgcgc

SEQ ID NO: 1464033 - RNA, 19 nt, Pseudomonas aeruginosa PA01
ucgucgagcagcgcgcggc

SEQ ID NO: 1464034 - RNA, 14 nt, Pseudomonas aeruginosa PA01
ucguccugcgcggc

SEQ ID NO: 1464035 - RNA, 15 nt, Pseudomonas aeruginosa PA01
ucguccugcgcggcg

SEQ ID NO: 1464036 - RNA, 24 nt, Pseudomonas aeruginosa PA01
ucguccugcggauucaucggcggc

SEQ ID NO: 1464037 - RNA, 14 nt, Pseudomonas aeruginosa PA01
ucggugaccaccag

SEQ ID NO: 1464038 - RNA, 15 nt, Pseudomonas aeruginosa PA01
ucggugaccaccagg

SEQ ID NO: 1464039 - RNA, 16 nt, Pseudomonas aeruginosa PA01
ucggugaccaccaggc

SEQ ID NO: 1464040 - RNA, 17 nt, Pseudomonas aeruginosa PA01
ucggugaagcgcggcgg

SEQ ID NO: 1464041 - RNA, 19 nt, Pseudomonas aeruginosa PA01
ucgguagccggccaaccac

SEQ ID NO: 1464042 - RNA, 16 nt, Pseudomonas aeruginosa PA01
ucggucucguccggcg

SEQ ID NO: 1464043 - RNA, 16 nt, Pseudomonas aeruginosa PA01
ucggguuuggcgcccg

SEQ ID NO: 1464044 - RNA, 17 nt, Pseudomonas aeruginosa PA01
ucggguugaucgacgcc

SEQ ID NO: 1464045 - RNA, 18 nt, Pseudomonas aeruginosa PA01
ucggcuguuucaggccgg

SEQ ID NO: 1464046 - RNA, 21 nt, Pseudomonas aeruginosa PA01
ucggcugcgucguuggccggc

SEQ ID NO: 1464047 - RNA, 19 nt, Pseudomonas aeruginosa PA01
ucggcuggaccuccuggcg

SEQ ID NO: 1464048 - RNA, 11 nt, Pseudomonas aeruginosa PA01
ucggcuggccg

SEQ ID NO: 1464049 - RNA, 14 nt, Pseudomonas aeruginosa PA01
ucggcuggccgagg

SEQ ID NO: 1464050 - RNA, 15 nt, Pseudomonas aeruginosa PA01
ucggcugcaacgccg

SEQ ID NO: 1464051 - RNA, 18 nt, Pseudomonas aeruginosa PA01
ucggcugcaacgccggcc

SEQ ID NO: 1464052 - RNA, 18 nt, Pseudomonas aeruginosa PA01
ucggcugcaacuuccacu

SEQ ID NO: 1464053 - RNA, 23 nt, Pseudomonas aeruginosa PA01
ucggcugcccaagggccugggcg

SEQ ID NO: 1464054 - RNA, 19 nt, Pseudomonas aeruginosa PA01
ucggcucagccgaccaccu

SEQ ID NO: 1464055 - RNA, 16 nt, Pseudomonas aeruginosa PA01
ucggcuccaggaccgg

SEQ ID NO: 1464056 - RNA, 21 nt, Pseudomonas aeruginosa PA01
ucggcuccaggaccggcaggu

SEQ ID NO: 1464057 - RNA, 14 nt, Pseudomonas aeruginosa PA01
ucggcucgcgccgg

SEQ ID NO: 1464058 - RNA, 15 nt, Pseudomonas aeruginosa PA01
ucggcucgcgccggc

SEQ ID NO: 1464059 - RNA, 16 nt, Pseudomonas aeruginosa PA01
ucggcucgcgccggcg

SEQ ID NO: 1464060 - RNA, 13 nt, Pseudomonas aeruginosa PA01
ucggcucggcaag

SEQ ID NO: 1464061 - RNA, 23 nt, Pseudomonas aeruginosa PA01
ucggcuccgcucaaccgaacagg

SEQ ID NO: 1464062 - RNA, 17 nt, Pseudomonas aeruginosa PA01
ucggcucgguuccagcu

SEQ ID NO: 1464063 - RNA, 13 nt, Pseudomonas aeruginosa PA01
ucggcugaccggc

SEQ ID NO: 1464064 - RNA, 18 nt, Pseudomonas aeruginosa PA01
ucggugauaccgccggcg

SEQ ID NO: 1464065 - RNA, 22 nt, Pseudomonas aeruginosa PA01
ucggugauaccgccggcggcga

SEQ ID NO: 1464066 - RNA, 17 nt, Pseudomonas aeruginosa PA01
ucggugccgcccggcgc

SEQ ID NO: 1464067 - RNA, 12 nt, Pseudomonas aeruginosa PA01
ucggugccgccc

SEQ ID NO: 1464068 - RNA, 15 nt, Pseudomonas aeruginosa PA01
ucggugccgccggcg

SEQ ID NO: 1464069 - RNA, 22 nt, Pseudomonas aeruginosa PA01
ucggugccuucccagccgaggc

SEQ ID NO: 1464070 - RNA, 19 nt, Pseudomonas aeruginosa PA01
ucggugcgguuggagcgga

SEQ ID NO: 1464071 - RNA, 14 nt, Pseudomonas aeruginosa PA01
ucggugcucaggcg

SEQ ID NO: 1464072 - RNA, 16 nt, Pseudomonas aeruginosa PA01
ucggugcucaggcggc

SEQ ID NO: 1464073 - RNA, 20 nt, Pseudomonas aeruginosa PA01
ucggugcucaggcggccgaa

SEQ ID NO: 1464074 - RNA, 14 nt, Pseudomonas aeruginosa PA01
ucggugcggccgag

SEQ ID NO: 1464075 - RNA, 15 nt, Pseudomonas aeruginosa PA01
ucggugcggccgagg

SEQ ID NO: 1464076 - RNA, 21 nt, Pseudomonas aeruginosa PA01
ucgguggcaugguguccggcg

SEQ ID NO: 1464077 - RNA, 16 nt, Pseudomonas aeruginosa PA01
ucgguggcgaccagga

SEQ ID NO: 1464078 - RNA, 13 nt, Pseudomonas aeruginosa PA01
ucgguggcggcga

SEQ ID NO: 1464079 - RNA, 15 nt, Pseudomonas aeruginosa PA01
ucgucggcgaccuug

SEQ ID NO: 1464080 - RNA, 17 nt, Pseudomonas aeruginosa PA01
ucgucggcgaccuuguc

SEQ ID NO: 1464081 - RNA, 13 nt, Pseudomonas aeruginosa PA01
ucgucggcgacgc

SEQ ID NO: 1464082 - RNA, 20 nt, Pseudomonas aeruginosa PA01
ucgugccaggcggcagccgc

SEQ ID NO: 1464083 - RNA, 23 nt, Pseudomonas aeruginosa PA01
ucgugccaggcggcagccgcggc

SEQ ID NO: 1464084 - RNA, 18 nt, Pseudomonas aeruginosa PA01
ucgugcagguagccgcgc

SEQ ID NO: 1464085 - RNA, 17 nt, Pseudomonas aeruginosa PA01
ucgugcagguguucggc

SEQ ID NO: 1464086 - RNA, 20 nt, Pseudomonas aeruginosa PA01
ucgugcagguguucggcggc

SEQ ID NO: 1464087 - RNA, 20 nt, Pseudomonas aeruginosa PA01
ucgugcagcaagccgcagcg

SEQ ID NO: 1464088 - RNA, 22 nt, Pseudomonas aeruginosa PA01
ucgugcagcaagccgcagcgcc

SEQ ID NO: 1464089 - RNA, 22 nt, Pseudomonas aeruginosa PA01
ucgugcagcccggucacgccgg

SEQ ID NO: 1464090 - RNA, 13 nt, Pseudomonas aeruginosa PA01
ucguguugcagca

SEQ ID NO: 1464091 - RNA, 22 nt, Pseudomonas aeruginosa PA01
ucgugcuuggugucggccgcca

SEQ ID NO: 1464092 - RNA, 17 nt, Pseudomonas aeruginosa PA01
ucguggaacagcgcguc

SEQ ID NO: 1464093 - RNA, 19 nt, Pseudomonas aeruginosa PA01
ucguggaacagcgcgucgc

SEQ ID NO: 1464094 - RNA, 17 nt, Pseudomonas aeruginosa PA01
ucguggacauacaggcg

SEQ ID NO: 1464095 - RNA, 21 nt, Pseudomonas aeruginosa PA01
ucguggacccgugcgccccag

SEQ ID NO: 1464096 - RNA, 13 nt, Pseudomonas aeruginosa PA01
ucgugcgccggcc

SEQ ID NO: 1464097 - RNA, 14 nt, Pseudomonas aeruginosa PA01
ucgugccuccagcc

SEQ ID NO: 1464098 - RNA, 20 nt, Pseudomonas aeruginosa PA01
ucguuggcgaaguucccgcc

SEQ ID NO: 1464099 - RNA, 16 nt, Pseudomonas aeruginosa PA01
ucguuguacuggccga

SEQ ID NO: 1464100 - RNA, 17 nt, Pseudomonas aeruginosa PA01
ucguuguacuggccgaa

SEQ ID NO: 1464101 - RNA, 14 nt, Pseudomonas aeruginosa PA01
ucguuucccggcgc

SEQ ID NO: 1464102 - RNA, 13 nt, Pseudomonas aeruginosa PA01
ucguugccgcgcu

SEQ ID NO: 1464103 - RNA, 14 nt, Pseudomonas aeruginosa PA01
ucguugcgccggcc

SEQ ID NO: 1464104 - RNA, 13 nt, Pseudomonas aeruginosa PA01
ucguugcgcgcca

SEQ ID NO: 1464105 - RNA, 21 nt, Pseudomonas aeruginosa PA01
ucguugcgcgccagcgccacg

SEQ ID NO: 1464106 - RNA, 19 nt, Pseudomonas aeruginosa PA01
ucguugcgcuaucggcccg

SEQ ID NO: 1464107 - RNA, 17 nt, Pseudomonas aeruginosa PA01
ucguugcggaacgcggc

SEQ ID NO: 1464108 - RNA, 21 nt, Pseudomonas aeruginosa PA01
ucguugcgaugggugccgcgc

SEQ ID NO: 1464109 - RNA, 15 nt, Pseudomonas aeruginosa PA01
ucguuggcggccagc

SEQ ID NO: 1464110 - RNA, 17 nt, Pseudomonas aeruginosa PA01
ucguuggccaggcgcga

SEQ ID NO: 1464111 - RNA, 22 nt, Pseudomonas aeruginosa PA01
ucguucagcccacccccggccc

SEQ ID NO: 1464112 - RNA, 16 nt, Pseudomonas aeruginosa PA01
ucguugacggugcugu

SEQ ID NO: 1464113 - RNA, 13 nt, Pseudomonas aeruginosa PA01
ucguugcaggcac

SEQ ID NO: 1464114 - RNA, 18 nt, Pseudomonas aeruginosa PA01
ucguugagggucagcgac

SEQ ID NO: 1464115 - RNA, 18 nt, Pseudomonas aeruginosa PA01
ucguucgucgccgacugc

SEQ ID NO: 1464116 - RNA, 16 nt, Pseudomonas aeruginosa PA01
ucuagcgccccggccg

SEQ ID NO: 1464117 - RNA, 17 nt, Pseudomonas aeruginosa PA01
ucuacgccuugcggcgc

SEQ ID NO: 1464118 - RNA, 12 nt, Pseudomonas aeruginosa PA01
ucuacuucggcu

SEQ ID NO: 1464119 - RNA, 18 nt, Pseudomonas aeruginosa PA01
ucuccaggucggucggcg

SEQ ID NO: 1464120 - RNA, 17 nt, Pseudomonas aeruginosa PA01
ucuccaguucggcgaug

SEQ ID NO: 1464121 - RNA, 16 nt, Pseudomonas aeruginosa PA01
ucuccuccucggcggc

SEQ ID NO: 1464122 - RNA, 16 nt, Pseudomonas aeruginosa PA01
ucuccucgacggcggg

SEQ ID NO: 1464123 - RNA, 13 nt, Pseudomonas aeruginosa PA01
ucuccucgcgcag

SEQ ID NO: 1464124 - RNA, 13 nt, Pseudomonas aeruginosa PA01
ucuccucggccaa

SEQ ID NO: 1464125 - RNA, 15 nt, Pseudomonas aeruginosa PA01
ucuaugaaccggggc

SEQ ID NO: 1464126 - RNA, 18 nt, Pseudomonas aeruginosa PA01
ucuccacccguucgccgg

SEQ ID NO: 1464127 - RNA, 22 nt, Pseudomonas aeruginosa PA01
ucuccacccguucgccggccuc

SEQ ID NO: 1464128 - RNA, 22 nt, Pseudomonas aeruginosa PA01
ucuccaccggaucgcccuggcg

SEQ ID NO: 1464129 - RNA, 17 nt, Pseudomonas aeruginosa PA01
ucuccacuaccgccgag

SEQ ID NO: 1464130 - RNA, 14 nt, Pseudomonas aeruginosa PA01
ucuccagcucggcg

SEQ ID NO: 1464131 - RNA, 20 nt, Pseudomonas aeruginosa PA01
ucuccaggaccaguucgccg

SEQ ID NO: 1464132 - RNA, 21 nt, Pseudomonas aeruginosa PA01
ucuccaggaccaguucgccgc

SEQ ID NO: 1464133 - RNA, 17 nt, Pseudomonas aeruginosa PA01
ucuccaggccgcucacc

SEQ ID NO: 1464134 - RNA, 22 nt, Pseudomonas aeruginosa PA01
ucuccaggccgcucaccgccac

SEQ ID NO: 1464135 - RNA, 15 nt, Pseudomonas aeruginosa PA01
ucuccaggcgcgccg

SEQ ID NO: 1464136 - RNA, 21 nt, Pseudomonas aeruginosa PA01
ucuccagcagggucgccuggg

SEQ ID NO: 1464137 - RNA, 19 nt, Pseudomonas aeruginosa PA01
ucuaucugcguaacguuac

SEQ ID NO: 1464138 - RNA, 21 nt, Pseudomonas aeruginosa PA01
ucuaguggccuaggacaccgc

SEQ ID NO: 1464139 - RNA, 16 nt, Pseudomonas aeruginosa PA01
ugccgcagaucaucgc

SEQ ID NO: 1464140 - RNA, 20 nt, Pseudomonas aeruginosa PA01
ugccgcagacgcccugaggc

SEQ ID NO: 1464141 - RNA, 12 nt, Pseudomonas aeruginosa PA01
ugccgcagcagc

SEQ ID NO: 1464142 - RNA, 15 nt, Pseudomonas aeruginosa PA01
ugccgcagcagcggc

SEQ ID NO: 1464143 - RNA, 20 nt, Pseudomonas aeruginosa PA01
ugccgcaggcgggcgccauc

SEQ ID NO: 1464144 - RNA, 19 nt, Pseudomonas aeruginosa PA01
ugccgcaggccgcggccga

SEQ ID NO: 1464145 - RNA, 18 nt, Pseudomonas aeruginosa PA01
ugccgcaguagaugccgc

SEQ ID NO: 1464146 - RNA, 18 nt, Pseudomonas aeruginosa PA01
ugccgcaugcaguggaag

SEQ ID NO: 1464147 - RNA, 13 nt, Pseudomonas aeruginosa PA01
ugccgcccagcac

SEQ ID NO: 1464148 - RNA, 17 nt, Pseudomonas aeruginosa PA01
ugccgcccagcaccgag

SEQ ID NO: 1464149 - RNA, 15 nt, Pseudomonas aeruginosa PA01
ugccgccagcgcggc

SEQ ID NO: 1464150 - RNA, 14 nt, Pseudomonas aeruginosa PA01
ugccgccagucggc

SEQ ID NO: 1464151 - RNA, 21 nt, Pseudomonas aeruginosa PA01
ugccgccauagagugcccagg

SEQ ID NO: 1464152 - RNA, 16 nt, Pseudomonas aeruginosa PA01
ugccgccaucgccucg

SEQ ID NO: 1464153 - RNA, 18 nt, Pseudomonas aeruginosa PA01
ugccgccaucgccucgcc

SEQ ID NO: 1464154 - RNA, 20 nt, Pseudomonas aeruginosa PA01
ugccgccaucgccucgccgg

SEQ ID NO: 1464155 - RNA, 21 nt, Pseudomonas aeruginosa PA01
ugccgccaucgccucgccggc

SEQ ID NO: 1464156 - RNA, 14 nt, Pseudomonas aeruginosa PA01
ugccgcccggccag

SEQ ID NO: 1464157 - RNA, 15 nt, Pseudomonas aeruginosa PA01
ugccgcccggccagg

SEQ ID NO: 1464158 - RNA, 15 nt, Pseudomonas aeruginosa PA01
ugccgcccggcgcca

SEQ ID NO: 1464159 - RNA, 16 nt, Pseudomonas aeruginosa PA01
ugccgcccggcgccac

SEQ ID NO: 1464160 - RNA, 18 nt, Pseudomonas aeruginosa PA01
ugccgcccgcucaagggc

SEQ ID NO: 1464161 - RNA, 12 nt, Pseudomonas aeruginosa PA01
ugccgccgaagc

SEQ ID NO: 1464162 - RNA, 17 nt, Pseudomonas aeruginosa PA01
ugccgcccuccaucagc

SEQ ID NO: 1464163 - RNA, 11 nt, Pseudomonas aeruginosa PA01
ugccgcccugc

SEQ ID NO: 1464164 - RNA, 17 nt, Pseudomonas aeruginosa PA01
ugccgcccugcggcagg

SEQ ID NO: 1464165 - RNA, 22 nt, Pseudomonas aeruginosa PA01
ugccgccggucuucacgccuug

SEQ ID NO: 1464166 - RNA, 23 nt, Pseudomonas aeruginosa PA01
ugccgccgucgcggccaucggcg

SEQ ID NO: 1464167 - RNA, 20 nt, Pseudomonas aeruginosa PA01
ugccgccgguucgcaggcca

SEQ ID NO: 1464168 - RNA, 12 nt, Pseudomonas aeruginosa PA01
ugccgccguaga

SEQ ID NO: 1464169 - RNA, 18 nt, Pseudomonas aeruginosa PA01
ugccgcgagccagccgug

SEQ ID NO: 1464170 - RNA, 18 nt, Pseudomonas aeruginosa PA01
ugccgcgagcuuggcccu

SEQ ID NO: 1464171 - RNA, 20 nt, Pseudomonas aeruginosa PA01
ugccgccuucgcgggccagg

SEQ ID NO: 1464172 - RNA, 19 nt, Pseudomonas aeruginosa PA01
ugccgccugcgucagcgag

SEQ ID NO: 1464173 - RNA, 20 nt, Pseudomonas aeruginosa PA01
ugccgcgcaccaccgagagc

SEQ ID NO: 1464174 - RNA, 12 nt, Pseudomonas aeruginosa PA01
ugccgccgggca

SEQ ID NO: 1464175 - RNA, 21 nt, Pseudomonas aeruginosa PA01
ugccgccggggcgcaggucgc

SEQ ID NO: 1464176 - RNA, 15 nt, Pseudomonas aeruginosa PA01
ugccgccggcgccgc

SEQ ID NO: 1464177 - RNA, 16 nt, Pseudomonas aeruginosa PA01
ugccgccggcgccgcc

SEQ ID NO: 1464178 - RNA, 21 nt, Pseudomonas aeruginosa PA01
ugccgccggcgccgccgggga

SEQ ID NO: 1464179 - RNA, 14 nt, Pseudomonas aeruginosa PA01
ugccgccggcgccg

SEQ ID NO: 1464180 - RNA, 12 nt, Pseudomonas aeruginosa PA01
ugccgccggcau

SEQ ID NO: 1464181 - RNA, 14 nt, Pseudomonas aeruginosa PA01
ugccgccggccacc

SEQ ID NO: 1464182 - RNA, 15 nt, Pseudomonas aeruginosa PA01
ugccgccggccacca

SEQ ID NO: 1464183 - RNA, 13 nt, Pseudomonas aeruginosa PA01
ugccgccgcuggc

SEQ ID NO: 1464184 - RNA, 15 nt, Pseudomonas aeruginosa PA01
ugccgccgcuggccu

SEQ ID NO: 1464185 - RNA, 17 nt, Pseudomonas aeruginosa PA01
ugccgccgcgcugcagg

SEQ ID NO: 1464186 - RNA, 15 nt, Pseudomonas aeruginosa PA01
ugccgccgcgcccgg

SEQ ID NO: 1464187 - RNA, 17 nt, Pseudomonas aeruginosa PA01
ugccgccgcgcccggcg

SEQ ID NO: 1464188 - RNA, 18 nt, Pseudomonas aeruginosa PA01
ugccgccgcagagccagc

SEQ ID NO: 1464189 - RNA, 22 nt, Pseudomonas aeruginosa PA01
ugccgccgcagagccagccgca

SEQ ID NO: 1464190 - RNA, 17 nt, Pseudomonas aeruginosa PA01
ugccgccgaucagcgcg

SEQ ID NO: 1464191 - RNA, 18 nt, Pseudomonas aeruginosa PA01
ugccgaugugcacgcuga

SEQ ID NO: 1464192 - RNA, 20 nt, Pseudomonas aeruginosa PA01
ugccgcaccgccucgaucag

SEQ ID NO: 1464193 - RNA, 21 nt, Pseudomonas aeruginosa PA01
ugccgaugccgccgaccucgg

SEQ ID NO: 1464194 - RNA, 17 nt, Pseudomonas aeruginosa PA01
ugccgauggugauacgc

SEQ ID NO: 1464195 - RNA, 11 nt, Pseudomonas aeruginosa PA01
ugccgaugucg

SEQ ID NO: 1464196 - RNA, 15 nt, Pseudomonas aeruginosa PA01
ugccgauggcgccgc

SEQ ID NO: 1464197 - RNA, 16 nt, Pseudomonas aeruginosa PA01
ugccgauggcgccgcc

SEQ ID NO: 1464198 - RNA, 17 nt, Pseudomonas aeruginosa PA01
ugccgauggcgccgccg

SEQ ID NO: 1464199 - RNA, 16 nt, Pseudomonas aeruginosa PA01
ugccgaucaugcucgg

SEQ ID NO: 1464200 - RNA, 16 nt, Pseudomonas aeruginosa PA01
ugccgaucgccgcgcg

SEQ ID NO: 1464201 - RNA, 17 nt, Pseudomonas aeruginosa PA01
ugccgaucaggcugaag

SEQ ID NO: 1464202 - RNA, 20 nt, Pseudomonas aeruginosa PA01
ugccgaucucgcccaguacc

SEQ ID NO: 1464203 - RNA, 23 nt, Pseudomonas aeruginosa PA01
ugccgaucucgcccaguaccgcc

SEQ ID NO: 1464204 - RNA, 17 nt, Pseudomonas aeruginosa PA01
ugccgaggaagucggcg

SEQ ID NO: 1464205 - RNA, 18 nt, Pseudomonas aeruginosa PA01
ugccgaggaagucggcgg

SEQ ID NO: 1464206 - RNA, 23 nt, Pseudomonas aeruginosa PA01
ugccgaggaagucggcggccgcc

SEQ ID NO: 1464207 - RNA, 22 nt, Pseudomonas aeruginosa PA01
ugccgaucagccauuggccgac

SEQ ID NO: 1464208 - RNA, 17 nt, Pseudomonas aeruginosa PA01
ugccgaucagcccgucg

SEQ ID NO: 1464209 - RNA, 17 nt, Pseudomonas aeruginosa PA01
ugccgaggcggccguag

SEQ ID NO: 1464210 - RNA, 18 nt, Pseudomonas aeruginosa PA01
ugccgagcagggucacgc

SEQ ID NO: 1464211 - RNA, 21 nt, Pseudomonas aeruginosa PA01
ugccgagcagggucacgccga

SEQ ID NO: 1464212 - RNA, 19 nt, Pseudomonas aeruginosa PA01
ugccgagcaucagcgacug

SEQ ID NO: 1464213 - RNA, 12 nt, Pseudomonas aeruginosa PA01
ugccgaauccgc

SEQ ID NO: 1464214 - RNA, 20 nt, Pseudomonas aeruginosa PA01
ugccgacuuccucgauggug

SEQ ID NO: 1464215 - RNA, 14 nt, Pseudomonas aeruginosa PA01
ugcccgugcgcugc

SEQ ID NO: 1464216 - RNA, 12 nt, Pseudomonas aeruginosa PA01
ugcccucgcgcu

SEQ ID NO: 1464217 - RNA, 20 nt, Pseudomonas aeruginosa PA01
ugcccucgcggacgcuggcg

SEQ ID NO: 1464218 - RNA, 21 nt, Pseudomonas aeruginosa PA01
ugcccucgcggacgcuggcga

SEQ ID NO: 1464219 - RNA, 21 nt, Pseudomonas aeruginosa PA01
ugcccucguugauuccgccgg

SEQ ID NO: 1464220 - RNA, 13 nt, Pseudomonas aeruginosa PA01
ugcccuccugggc

SEQ ID NO: 1464221 - RNA, 21 nt, Pseudomonas aeruginosa PA01
ugcccucgaccagguccggca

SEQ ID NO: 1464222 - RNA, 13 nt, Pseudomonas aeruginosa PA01
ugcccucgcagcc

SEQ ID NO: 1464223 - RNA, 13 nt, Pseudomonas aeruginosa PA01
ugccgaaggcgug

SEQ ID NO: 1464224 - RNA, 20 nt, Pseudomonas aeruginosa PA01
ugccgaaggcgugggcgccg

SEQ ID NO: 1464225 - RNA, 22 nt, Pseudomonas aeruginosa PA01
ugccgaaggcgugggcgccggc

SEQ ID NO: 1464226 - RNA, 23 nt, Pseudomonas aeruginosa PA01
ugccgaaggcgugggcgccggcg

SEQ ID NO: 1464227 - RNA, 20 nt, Pseudomonas aeruginosa PA01
ugccgaagggaaacaccagg

SEQ ID NO: 1464228 - RNA, 21 nt, Pseudomonas aeruginosa PA01
ugccgaagggaaacaccaggc

SEQ ID NO: 1464229 - RNA, 21 nt, Pseudomonas aeruginosa PA01
ugccgaagcccgauccguagg

SEQ ID NO: 1464230 - RNA, 20 nt, Pseudomonas aeruginosa PA01
ugcccucggcgcccgccugc

SEQ ID NO: 1464231 - RNA, 15 nt, Pseudomonas aeruginosa PA01
ugccgaagaccacca

SEQ ID NO: 1464232 - RNA, 16 nt, Pseudomonas aeruginosa PA01
ugccgaagaccaccau

SEQ ID NO: 1464233 - RNA, 18 nt, Pseudomonas aeruginosa PA01
ugccccgggcgccggguc

SEQ ID NO: 1464234 - RNA, 20 nt, Pseudomonas aeruginosa PA01
ugccccucguggcgcgaucc

SEQ ID NO: 1464235 - RNA, 17 nt, Pseudomonas aeruginosa PA01
ugccccgugcaccgagg

SEQ ID NO: 1464236 - RNA, 22 nt, Pseudomonas aeruginosa PA01
ugccccgugcaccgaggcgcgc

SEQ ID NO: 1464237 - RNA, 17 nt, Pseudomonas aeruginosa PA01
ugccccguggcgggcca

SEQ ID NO: 1464238 - RNA, 20 nt, Pseudomonas aeruginosa PA01
ugccccguggcgggccagca

SEQ ID NO: 1464239 - RNA, 16 nt, Pseudomonas aeruginosa PA01
ugccccucacaccacc

SEQ ID NO: 1464240 - RNA, 19 nt, Pseudomonas aeruginosa PA01
ugcccgaccgguuccagcg

SEQ ID NO: 1464241 - RNA, 23 nt, Pseudomonas aeruginosa PA01
ugcccgaccgguuccagcggccg

SEQ ID NO: 1464242 - RNA, 15 nt, Pseudomonas aeruginosa PA01
ugccccuggcucagg

SEQ ID NO: 1464243 - RNA, 18 nt, Pseudomonas aeruginosa PA01
ugcccgagaagccggggc

SEQ ID NO: 1464244 - RNA, 20 nt, Pseudomonas aeruginosa PA01
ugcccgucuagcgcaggcgg

SEQ ID NO: 1464245 - RNA, 14 nt, Pseudomonas aeruginosa PA01
ugcaugccggccgu

SEQ ID NO: 1464246 - RNA, 18 nt, Pseudomonas aeruginosa PA01
ugcaugcuuuugaacacc

SEQ ID NO: 1464247 - RNA, 21 nt, Pseudomonas aeruginosa PA01
ugcaugcuuuugaacaccagc

SEQ ID NO: 1464248 - RNA, 17 nt, Pseudomonas aeruginosa PA01
ugcaugccgggguccgc

SEQ ID NO: 1464249 - RNA, 20 nt, Pseudomonas aeruginosa PA01
ugcaugccgggguccgccgg

SEQ ID NO: 1464250 - RNA, 16 nt, Pseudomonas aeruginosa PA01
ugcaugaaggcgcuga

SEQ ID NO: 1464251 - RNA, 21 nt, Pseudomonas aeruginosa PA01
ugcaugaaggcgcugagcgcc

SEQ ID NO: 1464252 - RNA, 17 nt, Pseudomonas aeruginosa PA01
ugcaugagugucgccau

SEQ ID NO: 1464253 - RNA, 18 nt, Pseudomonas aeruginosa PA01
ugcaugucaccgauugcg

SEQ ID NO: 1464254 - RNA, 20 nt, Pseudomonas aeruginosa PA01
ugcaugucaccgauugcgcc

SEQ ID NO: 1464255 - RNA, 14 nt, Pseudomonas aeruginosa PA01
ugcaugugccaggc

SEQ ID NO: 1464256 - RNA, 16 nt, Pseudomonas aeruginosa PA01
ugcaugggcucgcgcg

SEQ ID NO: 1464257 - RNA, 21 nt, Pseudomonas aeruginosa PA01
ugcauguagcgcuccucgcgc

SEQ ID NO: 1464258 - RNA, 15 nt, Pseudomonas aeruginosa PA01
ugcaucugcgccggg

SEQ ID NO: 1464259 - RNA, 16 nt, Pseudomonas aeruginosa PA01
ugcaucugcgccggga

SEQ ID NO: 1464260 - RNA, 17 nt, Pseudomonas aeruginosa PA01
ugcaucggccgccaggc

SEQ ID NO: 1464261 - RNA, 23 nt, Pseudomonas aeruginosa PA01
ugcaucggccgggauacagcagc

SEQ ID NO: 1464262 - RNA, 13 nt, Pseudomonas aeruginosa PA01
ugcaucggcgcgc

SEQ ID NO: 1464263 - RNA, 13 nt, Pseudomonas aeruginosa PA01
ugccaauccgggc

SEQ ID NO: 1464264 - RNA, 19 nt, Pseudomonas aeruginosa PA01
ugcauuuuucaugcggccg

SEQ ID NO: 1464265 - RNA, 16 nt, Pseudomonas aeruginosa PA01
ugcauuuccuggacgu

SEQ ID NO: 1464266 - RNA, 23 nt, Pseudomonas aeruginosa PA01
ugcaguaccugcucacggccgaa

SEQ ID NO: 1464267 - RNA, 15 nt, Pseudomonas aeruginosa PA01
ugcagguucaccgcc

SEQ ID NO: 1464268 - RNA, 19 nt, Pseudomonas aeruginosa PA01
ugcagguucaccgccucgg

SEQ ID NO: 1464269 - RNA, 17 nt, Pseudomonas aeruginosa PA01
ugcaguacuuggccagc

SEQ ID NO: 1464270 - RNA, 14 nt, Pseudomonas aeruginosa PA01
ugcagguggcgcuc

SEQ ID NO: 1464271 - RNA, 19 nt, Pseudomonas aeruginosa PA01
ugcagguggcgcucacgcu

SEQ ID NO: 1464272 - RNA, 15 nt, Pseudomonas aeruginosa PA01
ugcagguggcguugc

SEQ ID NO: 1464273 - RNA, 15 nt, Pseudomonas aeruginosa PA01
ugcagguguucggcg

SEQ ID NO: 1464274 - RNA, 18 nt, Pseudomonas aeruginosa PA01
ugcagguguucggcggcg

SEQ ID NO: 1464275 - RNA, 16 nt, Pseudomonas aeruginosa PA01
ugcagguaguccagcc

SEQ ID NO: 1464276 - RNA, 18 nt, Pseudomonas aeruginosa PA01
ugcagguaguccagccag

SEQ ID NO: 1464277 - RNA, 16 nt, Pseudomonas aeruginosa PA01
ugcagggugcguacgg

SEQ ID NO: 1464278 - RNA, 12 nt, Pseudomonas aeruginosa PA01
ugcagguccggg

SEQ ID NO: 1464279 - RNA, 18 nt, Pseudomonas aeruginosa PA01
ugcagggaaggcgcgcuc

SEQ ID NO: 1464280 - RNA, 15 nt, Pseudomonas aeruginosa PA01
ugcaggucgaggcgc

SEQ ID NO: 1464281 - RNA, 14 nt, Pseudomonas aeruginosa PA01
ugcagucgcggaag

SEQ ID NO: 1464282 - RNA, 18 nt, Pseudomonas aeruginosa PA01
ugcagucgcggaagcggc

SEQ ID NO: 1464283 - RNA, 15 nt, Pseudomonas aeruginosa PA01
ugcagucccgccagg

SEQ ID NO: 1464284 - RNA, 12 nt, Pseudomonas aeruginosa PA01
ugcagugcgccg

SEQ ID NO: 1464285 - RNA, 18 nt, Pseudomonas aeruginosa PA01
ugcagugcgccgcagcgc

SEQ ID NO: 1464286 - RNA, 21 nt, Pseudomonas aeruginosa PA01
ugcaucacguacggcgccucg

SEQ ID NO: 1464287 - RNA, 21 nt, Pseudomonas aeruginosa PA01
ugcauccuuuuuccgaccuuu

SEQ ID NO: 1464288 - RNA, 15 nt, Pseudomonas aeruginosa PA01
ugcauccgccgcaga

SEQ ID NO: 1464289 - RNA, 14 nt, Pseudomonas aeruginosa PA01
ugcaggccgcgcga

SEQ ID NO: 1464290 - RNA, 23 nt, Pseudomonas aeruginosa PA01
ugcaggccgcgcgauggccggcg

SEQ ID NO: 1464291 - RNA, 13 nt, Pseudomonas aeruginosa PA01
ugcaggccgccga

SEQ ID NO: 1464292 - RNA, 13 nt, Pseudomonas aeruginosa PA01
ugcaggccggcga

SEQ ID NO: 1464293 - RNA, 17 nt, Pseudomonas aeruginosa PA01
ugcaggccggcgagcca

SEQ ID NO: 1464294 - RNA, 14 nt, Pseudomonas aeruginosa PA01
ugcaggcgcccugg

SEQ ID NO: 1464295 - RNA, 22 nt, Pseudomonas aeruginosa PA01
ugcaggcgcccuggccgucggc

SEQ ID NO: 1464296 - RNA, 13 nt, Pseudomonas aeruginosa PA01
ugcagggcguagu

SEQ ID NO: 1464297 - RNA, 13 nt, Pseudomonas aeruginosa PA01
ugcagggcgucca

SEQ ID NO: 1464298 - RNA, 23 nt, Pseudomonas aeruginosa PA01
ugcagggcguccaguagcgccug

SEQ ID NO: 1464299 - RNA, 18 nt, Pseudomonas aeruginosa PA01
ugcagguagccgcgccgg

SEQ ID NO: 1464300 - RNA, 20 nt, Pseudomonas aeruginosa PA01
ugcagguagccgcgccggcc

SEQ ID NO: 1464301 - RNA, 23 nt, Pseudomonas aeruginosa PA01
ugcagguagccgcgccggccguc

SEQ ID NO: 1464302 - RNA, 15 nt, Pseudomonas aeruginosa PA01
ugcagguagcgcugc

SEQ ID NO: 1464303 - RNA, 20 nt, Pseudomonas aeruginosa PA01
ugcagguagcugcuccagcc

SEQ ID NO: 1464304 - RNA, 13 nt, Pseudomonas aeruginosa PA01
ugcagggccgcca

SEQ ID NO: 1464305 - RNA, 15 nt, Pseudomonas aeruginosa PA01
ugcagggccgccagc

SEQ ID NO: 1464306 - RNA, 15 nt, Pseudomonas aeruginosa PA01
ugcagggccgcggcg

SEQ ID NO: 1464307 - RNA, 15 nt, Pseudomonas aeruginosa PA01
ugcaggcgucggucc

SEQ ID NO: 1464308 - RNA, 19 nt, Pseudomonas aeruginosa PA01
ugcaggcucucgcgcagca

SEQ ID NO: 1464309 - RNA, 20 nt, Pseudomonas aeruginosa PA01
ugcaggcucucgcgcagcag

SEQ ID NO: 1464310 - RNA, 21 nt, Pseudomonas aeruginosa PA01
ugcaggcucucgcgcagcagg

SEQ ID NO: 1464311 - RNA, 18 nt, Pseudomonas aeruginosa PA01
ugcaggcucgacaggucg

SEQ ID NO: 1464312 - RNA, 22 nt, Pseudomonas aeruginosa PA01
ugcccaccugaacgcgcccggc

SEQ ID NO: 1464313 - RNA, 20 nt, Pseudomonas aeruginosa PA01
ugccccacaggcccugcagc

SEQ ID NO: 1464314 - RNA, 13 nt, Pseudomonas aeruginosa PA01
ugccccaggccga

SEQ ID NO: 1464315 - RNA, 23 nt, Pseudomonas aeruginosa PA01
ugccccacuuccggcccggccag

SEQ ID NO: 1464316 - RNA, 20 nt, Pseudomonas aeruginosa PA01
ugccccagcaucgccggcag

SEQ ID NO: 1464317 - RNA, 13 nt, Pseudomonas aeruginosa PA01
ugcccaccaacgg

SEQ ID NO: 1464318 - RNA, 14 nt, Pseudomonas aeruginosa PA01
ugcccaccaccagg

SEQ ID NO: 1464319 - RNA, 17 nt, Pseudomonas aeruginosa PA01
ugcccaccaccaggacc

SEQ ID NO: 1464320 - RNA, 23 nt, Pseudomonas aeruginosa PA01
ugcccaccgaauccuugaucacc

SEQ ID NO: 1464321 - RNA, 17 nt, Pseudomonas aeruginosa PA01
ugcccaccagcgucgcc

SEQ ID NO: 1464322 - RNA, 20 nt, Pseudomonas aeruginosa PA01
ugcccaccagcgucgccagg

SEQ ID NO: 1464323 - RNA, 14 nt, Pseudomonas aeruginosa PA01
ugcccaagggccug

SEQ ID NO: 1464324 - RNA, 14 nt, Pseudomonas aeruginosa PA01
ugccaucaggccgc

SEQ ID NO: 1464325 - RNA, 22 nt, Pseudomonas aeruginosa PA01
ugccaucaggccgcggcccugc

SEQ ID NO: 1464326 - RNA, 13 nt, Pseudomonas aeruginosa PA01
ugccauacagcgc

SEQ ID NO: 1464327 - RNA, 14 nt, Pseudomonas aeruginosa PA01
ugccauagccgacg

SEQ ID NO: 1464328 - RNA, 15 nt, Pseudomonas aeruginosa PA01
ugccaggagcuugcc

SEQ ID NO: 1464329 - RNA, 14 nt, Pseudomonas aeruginosa PA01
ugccaggagcacgc

SEQ ID NO: 1464330 - RNA, 16 nt, Pseudomonas aeruginosa PA01
ugccaggagcacgccg

SEQ ID NO: 1464331 - RNA, 15 nt, Pseudomonas aeruginosa PA01
ugccacccggcgccc

SEQ ID NO: 1464332 - RNA, 13 nt, Pseudomonas aeruginosa PA01
ugccaccgcucga

SEQ ID NO: 1464333 - RNA, 20 nt, Pseudomonas aeruginosa PA01
ugccacagguggaucgcggc

SEQ ID NO: 1464334 - RNA, 17 nt, Pseudomonas aeruginosa PA01
ugccagugccucgcgcg

SEQ ID NO: 1464335 - RNA, 19 nt, Pseudomonas aeruginosa PA01
ugccaggcucgccgccagc

SEQ ID NO: 1464336 - RNA, 18 nt, Pseudomonas aeruginosa PA01
ugccagggcggucggcca

SEQ ID NO: 1464337 - RNA, 20 nt, Pseudomonas aeruginosa PA01
ugccagggcggucggccagg

SEQ ID NO: 1464338 - RNA, 12 nt, Pseudomonas aeruginosa PA01
ugccaggccggc

SEQ ID NO: 1464339 - RNA, 13 nt, Pseudomonas aeruginosa PA01
ugccaggccggcg

SEQ ID NO: 1464340 - RNA, 14 nt, Pseudomonas aeruginosa PA01
ugccaggccggcgc

SEQ ID NO: 1464341 - RNA, 15 nt, Pseudomonas aeruginosa PA01
ugccaggcgcucgcg

SEQ ID NO: 1464342 - RNA, 18 nt, Pseudomonas aeruginosa PA01
ugccaggcggcagccgcg

SEQ ID NO: 1464343 - RNA, 21 nt, Pseudomonas aeruginosa PA01
ugccaggcggggauggcgggc

SEQ ID NO: 1464344 - RNA, 20 nt, Pseudomonas aeruginosa PA01
ugagcacccgggcgaccugc

SEQ ID NO: 1464345 - RNA, 13 nt, Pseudomonas aeruginosa PA01
ugagcaccggcag

SEQ ID NO: 1464346 - RNA, 16 nt, Pseudomonas aeruginosa PA01
ugagcaccucgaccug

SEQ ID NO: 1464347 - RNA, 15 nt, Pseudomonas aeruginosa PA01
ugagcaguugcgggc

SEQ ID NO: 1464348 - RNA, 20 nt, Pseudomonas aeruginosa PA01
ugagcaguugcgggcgcagg

SEQ ID NO: 1464349 - RNA, 20 nt, Pseudomonas aeruginosa PA01
ugagcaggccgacggcgcgc

SEQ ID NO: 1464350 - RNA, 15 nt, Pseudomonas aeruginosa PA01
ugagcacgguccgcg

SEQ ID NO: 1464351 - RNA, 19 nt, Pseudomonas aeruginosa PA01
ugagcacgguccgcgaacc

SEQ ID NO: 1464352 - RNA, 13 nt, Pseudomonas aeruginosa PA01
ugagcagggcguc

SEQ ID NO: 1464353 - RNA, 20 nt, Pseudomonas aeruginosa PA01
ugagcaggguguugaucacc

SEQ ID NO: 1464354 - RNA, 21 nt, Pseudomonas aeruginosa PA01
ugagcaggguguugaucaccg

SEQ ID NO: 1464355 - RNA, 16 nt, Pseudomonas aeruginosa PA01
ugacccagagccgcuc

SEQ ID NO: 1464356 - RNA, 22 nt, Pseudomonas aeruginosa PA01
ugacccgccccugcuccucgcc

SEQ ID NO: 1464357 - RNA, 15 nt, Pseudomonas aeruginosa PA01
ugacccgacugcagc

SEQ ID NO: 1464358 - RNA, 15 nt, Pseudomonas aeruginosa PA01
ugaccagucccggcu

SEQ ID NO: 1464359 - RNA, 19 nt, Pseudomonas aeruginosa PA01
ugaccaucuuuuccugcug

SEQ ID NO: 1464360 - RNA, 20 nt, Pseudomonas aeruginosa PA01
ugaccauaggcuugcgccga

SEQ ID NO: 1464361 - RNA, 21 nt, Pseudomonas aeruginosa PA01
ugaccauaggcuugcgccgaa

SEQ ID NO: 1464362 - RNA, 23 nt, Pseudomonas aeruginosa PA01
ugaccauaggcuugcgccgaagg

SEQ ID NO: 1464363 - RNA, 17 nt, Pseudomonas aeruginosa PA01
ugacccacuccggcagg

SEQ ID NO: 1464364 - RNA, 15 nt, Pseudomonas aeruginosa PA01
ugaccauggugaugc

SEQ ID NO: 1464365 - RNA, 17 nt, Pseudomonas aeruginosa PA01
ugaccauggugaugcgc

SEQ ID NO: 1464366 - RNA, 20 nt, Pseudomonas aeruginosa PA01
ugaccauggugaugcgcaug

SEQ ID NO: 1464367 - RNA, 15 nt, Pseudomonas aeruginosa PA01
ugaccccggcgaugc

SEQ ID NO: 1464368 - RNA, 15 nt, Pseudomonas aeruginosa PA01
ugacccgcucgccgg

SEQ ID NO: 1464369 - RNA, 17 nt, Pseudomonas aeruginosa PA01
ugacugcaaucgaccau

SEQ ID NO: 1464370 - RNA, 22 nt, Pseudomonas aeruginosa PA01
ugauagagcacgcccauggaga

SEQ ID NO: 1464371 - RNA, 23 nt, Pseudomonas aeruginosa PA01
ugauacggcucuugaaacuggga

SEQ ID NO: 1464372 - RNA, 19 nt, Pseudomonas aeruginosa PA01
ugaucagcccuucgcgcuc

SEQ ID NO: 1464373 - RNA, 17 nt, Pseudomonas aeruginosa PA01
ugagguucaugccgcga

SEQ ID NO: 1464374 - RNA, 13 nt, Pseudomonas aeruginosa PA01
ugagguugccgcc

SEQ ID NO: 1464375 - RNA, 14 nt, Pseudomonas aeruginosa PA01
ugagguugccgccg

SEQ ID NO: 1464376 - RNA, 17 nt, Pseudomonas aeruginosa PA01
ugagguugcgauugucc

SEQ ID NO: 1464377 - RNA, 15 nt, Pseudomonas aeruginosa PA01
ugagguuggccacgu

SEQ ID NO: 1464378 - RNA, 12 nt, Pseudomonas aeruginosa PA01
ugagguucaggc

SEQ ID NO: 1464379 - RNA, 17 nt, Pseudomonas aeruginosa PA01
ugaggugggcgcgccgc

SEQ ID NO: 1464380 - RNA, 22 nt, Pseudomonas aeruginosa PA01
ugagguagagcacgccgucgcg

SEQ ID NO: 1464381 - RNA, 19 nt, Pseudomonas aeruginosa PA01
ugaggguguucagcggcgc

SEQ ID NO: 1464382 - RNA, 18 nt, Pseudomonas aeruginosa PA01
ugaggguguugcgaugga

SEQ ID NO: 1464383 - RNA, 14 nt, Pseudomonas aeruginosa PA01
ugagggucagcuug

SEQ ID NO: 1464384 - RNA, 15 nt, Pseudomonas aeruginosa PA01
ugagggucgcgccga

SEQ ID NO: 1464385 - RNA, 18 nt, Pseudomonas aeruginosa PA01
ugagggucgcgccgacga

SEQ ID NO: 1464386 - RNA, 15 nt, Pseudomonas aeruginosa PA01
ugaguagcuggcgca

SEQ ID NO: 1464387 - RNA, 16 nt, Pseudomonas aeruginosa PA01
ugagcugaucgcgaau

SEQ ID NO: 1464388 - RNA, 16 nt, Pseudomonas aeruginosa PA01
ugagcugggcaggcug

SEQ ID NO: 1464389 - RNA, 15 nt, Pseudomonas aeruginosa PA01
ugagcugccgcuucg

SEQ ID NO: 1464390 - RNA, 22 nt, Pseudomonas aeruginosa PA01
ugagcuggcccaguugcccggc

SEQ ID NO: 1464391 - RNA, 11 nt, Pseudomonas aeruginosa PA01
ugagcuggccg

SEQ ID NO: 1464392 - RNA, 12 nt, Pseudomonas aeruginosa PA01
ugagcuggccga

SEQ ID NO: 1464393 - RNA, 17 nt, Pseudomonas aeruginosa PA01
ugagcuggccgagcgac

SEQ ID NO: 1464394 - RNA, 17 nt, Pseudomonas aeruginosa PA01
ugaggggaaucgccguc

SEQ ID NO: 1464395 - RNA, 21 nt, Pseudomonas aeruginosa PA01
ugaggggaaucgccgucaccg

SEQ ID NO: 1464396 - RNA, 17 nt, Pseudomonas aeruginosa PA01
ugagggucagaccagcc

SEQ ID NO: 1464397 - RNA, 21 nt, Pseudomonas aeruginosa PA01
ugaggcguuccaguucggccg

SEQ ID NO: 1464398 - RNA, 15 nt, Pseudomonas aeruginosa PA01
ugagggcacggccag

SEQ ID NO: 1464399 - RNA, 22 nt, Pseudomonas aeruginosa PA01
ugaggcguggggaagacggcca

SEQ ID NO: 1464400 - RNA, 17 nt, Pseudomonas aeruginosa PA01
ugagccccggcgucggc

SEQ ID NO: 1464401 - RNA, 18 nt, Pseudomonas aeruginosa PA01
ugagccccggcgucggcg

SEQ ID NO: 1464402 - RNA, 18 nt, Pseudomonas aeruginosa PA01
ugagccucuaaggaaaaa

SEQ ID NO: 1464403 - RNA, 14 nt, Pseudomonas aeruginosa PA01
ugagcggcgcccug

SEQ ID NO: 1464404 - RNA, 15 nt, Pseudomonas aeruginosa PA01
ugagcggcgcccugg

SEQ ID NO: 1464405 - RNA, 18 nt, Pseudomonas aeruginosa PA01
ugagcggaucgucgcggc

SEQ ID NO: 1464406 - RNA, 21 nt, Pseudomonas aeruginosa PA01
ugagcggaucgucgcggcgcg

SEQ ID NO: 1464407 - RNA, 22 nt, Pseudomonas aeruginosa PA01
ugcaaagcggcgacgccacccg

SEQ ID NO: 1464408 - RNA, 22 nt, Pseudomonas aeruginosa PA01
ugcaaacgggcaucgucgaagg

SEQ ID NO: 1464409 - RNA, 16 nt, Pseudomonas aeruginosa PA01
ugcaacaccuggcgcu

SEQ ID NO: 1464410 - RNA, 18 nt, Pseudomonas aeruginosa PA01
ugcaacaccuggcgcucg

SEQ ID NO: 1464411 - RNA, 20 nt, Pseudomonas aeruginosa PA01
ugcaacaccuggcgcucgcc

SEQ ID NO: 1464412 - RNA, 13 nt, Pseudomonas aeruginosa PA01
ugcaacgccagca

SEQ ID NO: 1464413 - RNA, 13 nt, Pseudomonas aeruginosa PA01
ugcaacgcccgcg

SEQ ID NO: 1464414 - RNA, 17 nt, Pseudomonas aeruginosa PA01
ugcaacgcccgcgagcc

SEQ ID NO: 1464415 - RNA, 13 nt, Pseudomonas aeruginosa PA01
ugcaacgccggcc

SEQ ID NO: 1464416 - RNA, 17 nt, Pseudomonas aeruginosa PA01
ugcaacgcggcgucagg

SEQ ID NO: 1464417 - RNA, 18 nt, Pseudomonas aeruginosa PA01
ugcaacacguagcgcagg

SEQ ID NO: 1464418 - RNA, 23 nt, Pseudomonas aeruginosa PA01
ugcaacacguagcgcaggucgcu

SEQ ID NO: 1464419 - RNA, 14 nt, Pseudomonas aeruginosa PA01
ugcaacagcgcggc

SEQ ID NO: 1464420 - RNA, 21 nt, Pseudomonas aeruginosa PA01
ugcaacaguggguaggccagg

SEQ ID NO: 1464421 - RNA, 14 nt, Pseudomonas aeruginosa PA01
ugcaacccgccgcu

SEQ ID NO: 1464422 - RNA, 16 nt, Pseudomonas aeruginosa PA01
ugcaacuccgccuguc

SEQ ID NO: 1464423 - RNA, 19 nt, Pseudomonas aeruginosa PA01
ugcaacucgucguccagcg

SEQ ID NO: 1464424 - RNA, 16 nt, Pseudomonas aeruginosa PA01
ugcaacugacggcgga

SEQ ID NO: 1464425 - RNA, 15 nt, Pseudomonas aeruginosa PA01
ugcacaacgggugcu

SEQ ID NO: 1464426 - RNA, 20 nt, Pseudomonas aeruginosa PA01
ugcaauucgucggccugcuc

SEQ ID NO: 1464427 - RNA, 16 nt, Pseudomonas aeruginosa PA01
ugcaauugcaggcccg

SEQ ID NO: 1464428 - RNA, 21 nt, Pseudomonas aeruginosa PA01
ugcaauugcaggcccggccgc

SEQ ID NO: 1464429 - RNA, 19 nt, Pseudomonas aeruginosa PA01
ugcaauccgugcgccgggc

SEQ ID NO: 1464430 - RNA, 19 nt, Pseudomonas aeruginosa PA01
ugcaauggggcggccggcg

SEQ ID NO: 1464431 - RNA, 19 nt, Pseudomonas aeruginosa PA01
ugcacagccauagcgccgg

SEQ ID NO: 1464432 - RNA, 23 nt, Pseudomonas aeruginosa PA01
ugcacagccauagcgccggcacc

SEQ ID NO: 1464433 - RNA, 17 nt, Pseudomonas aeruginosa PA01
ugcacagguugacgaug

SEQ ID NO: 1464434 - RNA, 16 nt, Pseudomonas aeruginosa PA01
ugcaccgcggcgcgga

SEQ ID NO: 1464435 - RNA, 17 nt, Pseudomonas aeruginosa PA01
ugcacccuuggcgcagg

SEQ ID NO: 1464436 - RNA, 14 nt, Pseudomonas aeruginosa PA01
ugcaccgugcgcgc

SEQ ID NO: 1464437 - RNA, 16 nt, Pseudomonas aeruginosa PA01
ugcaccgugcgcgcgg

SEQ ID NO: 1464438 - RNA, 18 nt, Pseudomonas aeruginosa PA01
ugcaccgaggcgcgccga

SEQ ID NO: 1464439 - RNA, 19 nt, Pseudomonas aeruginosa PA01
ugcaccgcuugccagccgc

SEQ ID NO: 1464440 - RNA, 22 nt, Pseudomonas aeruginosa PA01
ugauccgcguggcgugcucggc

SEQ ID NO: 1464441 - RNA, 23 nt, Pseudomonas aeruginosa PA01
ugauccgcguggcgugcucggcg

SEQ ID NO: 1464442 - RNA, 21 nt, Pseudomonas aeruginosa PA01
ugauccgcguuaccguccgcg

SEQ ID NO: 1464443 - RNA, 15 nt, Pseudomonas aeruginosa PA01
ugauccgcuccagcg

SEQ ID NO: 1464444 - RNA, 19 nt, Pseudomonas aeruginosa PA01
ugauccgcuccagcgccuc

SEQ ID NO: 1464445 - RNA, 21 nt, Pseudomonas aeruginosa PA01
ugauccgcuccagcgccucga

SEQ ID NO: 1464446 - RNA, 19 nt, Pseudomonas aeruginosa PA01
ugauccgcucgaucccggc

SEQ ID NO: 1464447 - RNA, 18 nt, Pseudomonas aeruginosa PA01
ugaucccggaggcggcga

SEQ ID NO: 1464448 - RNA, 21 nt, Pseudomonas aeruginosa PA01
ugauccgcacccgcgacucga

SEQ ID NO: 1464449 - RNA, 17 nt, Pseudomonas aeruginosa PA01
ugauccacuugccgccg

SEQ ID NO: 1464450 - RNA, 21 nt, Pseudomonas aeruginosa PA01
ugauccaggucgaucagcagc

SEQ ID NO: 1464451 - RNA, 24 nt, Pseudomonas aeruginosa PA01
ugauccaggucgaucagcagcagc

SEQ ID NO: 1464452 - RNA, 16 nt, Pseudomonas aeruginosa PA01
ugaucaggccgagcac

SEQ ID NO: 1464453 - RNA, 19 nt, Pseudomonas aeruginosa PA01
ugaucagguucggcagcgc

SEQ ID NO: 1464454 - RNA, 16 nt, Pseudomonas aeruginosa PA01
ugaucagguugccggc

SEQ ID NO: 1464455 - RNA, 16 nt, Pseudomonas aeruginosa PA01
ugaucaguaccggcag

SEQ ID NO: 1464456 - RNA, 21 nt, Pseudomonas aeruginosa PA01
ugaucaguaccggcagcgccg

SEQ ID NO: 1464457 - RNA, 18 nt, Pseudomonas aeruginosa PA01
ugaucagucgucguccag

SEQ ID NO: 1464458 - RNA, 21 nt, Pseudomonas aeruginosa PA01
ugaucaggaggaucgccagga

SEQ ID NO: 1464459 - RNA, 20 nt, Pseudomonas aeruginosa PA01
ugaucagcggccgagcaggc

SEQ ID NO: 1464460 - RNA, 16 nt, Pseudomonas aeruginosa PA01
ugaucagcuccgccuc

SEQ ID NO: 1464461 - RNA, 16 nt, Pseudomonas aeruginosa PA01
ugaucaggucggccgc

SEQ ID NO: 1464462 - RNA, 21 nt, Pseudomonas aeruginosa PA01
ugaucauccaggacaccccga

SEQ ID NO: 1464463 - RNA, 21 nt, Pseudomonas aeruginosa PA01
ugaucaucguccugccggugc

SEQ ID NO: 1464464 - RNA, 13 nt, Pseudomonas aeruginosa PA01
ugaugccgaggcg

SEQ ID NO: 1464465 - RNA, 15 nt, Pseudomonas aeruginosa PA01
ugaugccgaggcggc

SEQ ID NO: 1464466 - RNA, 23 nt, Pseudomonas aeruginosa PA01
ugaugccgccguugacgaucagg

SEQ ID NO: 1464467 - RNA, 14 nt, Pseudomonas aeruginosa PA01
ugaugccgcggcga

SEQ ID NO: 1464468 - RNA, 15 nt, Pseudomonas aeruginosa PA01
ugaugcccagcggcg

SEQ ID NO: 1464469 - RNA, 16 nt, Pseudomonas aeruginosa PA01
ugaugcccagcggcgc

SEQ ID NO: 1464470 - RNA, 20 nt, Pseudomonas aeruginosa PA01
ugaugaucaggucggccgcc

SEQ ID NO: 1464471 - RNA, 24 nt, Pseudomonas aeruginosa PA01
ugauccugggcgccagccgccauc

SEQ ID NO: 1464472 - RNA, 22 nt, Pseudomonas aeruginosa PA01
ugauccgguugauuuccgcacc

SEQ ID NO: 1464473 - RNA, 15 nt, Pseudomonas aeruginosa PA01
ugauguugcgccaga

SEQ ID NO: 1464474 - RNA, 19 nt, Pseudomonas aeruginosa PA01
ugauguugcggucgauguc

SEQ ID NO: 1464475 - RNA, 23 nt, Pseudomonas aeruginosa PA01
ugauucguccggagccgggcaac

SEQ ID NO: 1464476 - RNA, 22 nt, Pseudomonas aeruginosa PA01
ugauugcugaaagcgauagccg

SEQ ID NO: 1464477 - RNA, 13 nt, Pseudomonas aeruginosa PA01
ucccacaggccgg

SEQ ID NO: 1464478 - RNA, 15 nt, Pseudomonas aeruginosa PA01
ucccaacuggucuug

SEQ ID NO: 1464479 - RNA, 24 nt, Pseudomonas aeruginosa PA01
ucccaacuggucuugccgauggcg

SEQ ID NO: 1464480 - RNA, 22 nt, Pseudomonas aeruginosa PA01
uccccuaccggcaaggcgcuga

SEQ ID NO: 1464481 - RNA, 13 nt, Pseudomonas aeruginosa PA01
uccccucacggcg

SEQ ID NO: 1464482 - RNA, 14 nt, Pseudomonas aeruginosa PA01
uccccucacggcgc

SEQ ID NO: 1464483 - RNA, 17 nt, Pseudomonas aeruginosa PA01
uccccucacggcgcgag

SEQ ID NO: 1464484 - RNA, 16 nt, Pseudomonas aeruginosa PA01
uccccucaggcgccgc

SEQ ID NO: 1464485 - RNA, 17 nt, Pseudomonas aeruginosa PA01
uccccucccgcgccagc

SEQ ID NO: 1464486 - RNA, 18 nt, Pseudomonas aeruginosa PA01
uccccucccgcgccagcg

SEQ ID NO: 1464487 - RNA, 18 nt, Pseudomonas aeruginosa PA01
uccccugccgaaccgccu

SEQ ID NO: 1464488 - RNA, 22 nt, Pseudomonas aeruginosa PA01
uccccugccgaaccgccucaga

SEQ ID NO: 1464489 - RNA, 13 nt, Pseudomonas aeruginosa PA01
ucccgacgcccuc

SEQ ID NO: 1464490 - RNA, 20 nt, Pseudomonas aeruginosa PA01
ucccgacgcccuccagcacc

SEQ ID NO: 1464491 - RNA, 12 nt, Pseudomonas aeruginosa PA01
ucccgagcaccg

SEQ ID NO: 1464492 - RNA, 14 nt, Pseudomonas aeruginosa PA01
ucccgagcaccggc

SEQ ID NO: 1464493 - RNA, 23 nt, Pseudomonas aeruginosa PA01
ucccgagcaccggccucaagcaa

SEQ ID NO: 1464494 - RNA, 20 nt, Pseudomonas aeruginosa PA01
uccccuggaaugccggccgg

SEQ ID NO: 1464495 - RNA, 19 nt, Pseudomonas aeruginosa PA01
ucccgaucucgguuuccag

SEQ ID NO: 1464496 - RNA, 18 nt, Pseudomonas aeruginosa PA01
ucccgaggcgaucgccgc

SEQ ID NO: 1464497 - RNA, 22 nt, Pseudomonas aeruginosa PA01
ucccgaggcgaucgccgcggcg

SEQ ID NO: 1464498 - RNA, 14 nt, Pseudomonas aeruginosa PA01
ucccgaggguggcg

SEQ ID NO: 1464499 - RNA, 19 nt, Pseudomonas aeruginosa PA01
ucccgaggguggcgcuggc

SEQ ID NO: 1464500 - RNA, 13 nt, Pseudomonas aeruginosa PA01
ucccgcaccggcg

SEQ ID NO: 1464501 - RNA, 14 nt, Pseudomonas aeruginosa PA01
ucccgcaccggcgc

SEQ ID NO: 1464502 - RNA, 15 nt, Pseudomonas aeruginosa PA01
ucccgcaccggcgcg

SEQ ID NO: 1464503 - RNA, 18 nt, Pseudomonas aeruginosa PA01
ucccgcaccggcgcgccg

SEQ ID NO: 1464504 - RNA, 23 nt, Pseudomonas aeruginosa PA01
ucccgcaccggcgcgccggacag

SEQ ID NO: 1464505 - RNA, 21 nt, Pseudomonas aeruginosa PA01
ucccgcagcgaucagcaccag

SEQ ID NO: 1464506 - RNA, 22 nt, Pseudomonas aeruginosa PA01
ucccgcagcgaucagcaccagc

SEQ ID NO: 1464507 - RNA, 22 nt, Pseudomonas aeruginosa PA01
ucccgcagauagggcaucagcc

SEQ ID NO: 1464508 - RNA, 21 nt, Pseudomonas aeruginosa PA01
ucccgcaguagcucgccgagg

SEQ ID NO: 1464509 - RNA, 13 nt, Pseudomonas aeruginosa PA01
ucccgcaggcgcu

SEQ ID NO: 1464510 - RNA, 14 nt, Pseudomonas aeruginosa PA01
ucccggccuggcgc

SEQ ID NO: 1464511 - RNA, 21 nt, Pseudomonas aeruginosa PA01
ucccggccuggugacccggac

SEQ ID NO: 1464512 - RNA, 14 nt, Pseudomonas aeruginosa PA01
ucccggcgcagagc

SEQ ID NO: 1464513 - RNA, 12 nt, Pseudomonas aeruginosa PA01
ucccggcgcggc

SEQ ID NO: 1464514 - RNA, 13 nt, Pseudomonas aeruginosa PA01
ucccggcgcggcc

SEQ ID NO: 1464515 - RNA, 13 nt, Pseudomonas aeruginosa PA01
ucccggcggcgac

SEQ ID NO: 1464516 - RNA, 15 nt, Pseudomonas aeruginosa PA01
ucccggcgguuucgc

SEQ ID NO: 1464517 - RNA, 14 nt, Pseudomonas aeruginosa PA01
ucccgggccagcuc

SEQ ID NO: 1464518 - RNA, 17 nt, Pseudomonas aeruginosa PA01
ucccgggaaaccaccag

SEQ ID NO: 1464519 - RNA, 15 nt, Pseudomonas aeruginosa PA01
ucccggcucgccgac

SEQ ID NO: 1464520 - RNA, 14 nt, Pseudomonas aeruginosa PA01
ucccggcucggcac

SEQ ID NO: 1464521 - RNA, 15 nt, Pseudomonas aeruginosa PA01
uccgccgccguggcu

SEQ ID NO: 1464522 - RNA, 18 nt, Pseudomonas aeruginosa PA01
uccgcccaguucgccggc

SEQ ID NO: 1464523 - RNA, 19 nt, Pseudomonas aeruginosa PA01
uccgcccaguucgccggcc

SEQ ID NO: 1464524 - RNA, 20 nt, Pseudomonas aeruginosa PA01
uccgcccaguucgccggcca

SEQ ID NO: 1464525 - RNA, 15 nt, Pseudomonas aeruginosa PA01
uccgccagguccagg

SEQ ID NO: 1464526 - RNA, 16 nt, Pseudomonas aeruginosa PA01
uccgccagguccaggc

SEQ ID NO: 1464527 - RNA, 17 nt, Pseudomonas aeruginosa PA01
uccgccagguccaggcu

SEQ ID NO: 1464528 - RNA, 13 nt, Pseudomonas aeruginosa PA01
uccgccaggaccu

SEQ ID NO: 1464529 - RNA, 15 nt, Pseudomonas aeruginosa PA01
uccgccaggccgcgc

SEQ ID NO: 1464530 - RNA, 16 nt, Pseudomonas aeruginosa PA01
uccgccaggccgcgca

SEQ ID NO: 1464531 - RNA, 19 nt, Pseudomonas aeruginosa PA01
uccgccaggcgcagccagc

SEQ ID NO: 1464532 - RNA, 21 nt, Pseudomonas aeruginosa PA01
uccgccaggcgcagccagcac

SEQ ID NO: 1464533 - RNA, 13 nt, Pseudomonas aeruginosa PA01
uccgccaggcgcu

SEQ ID NO: 1464534 - RNA, 15 nt, Pseudomonas aeruginosa PA01
uccgcaucggccgac

SEQ ID NO: 1464535 - RNA, 16 nt, Pseudomonas aeruginosa PA01
uccgcaucggccgaca

SEQ ID NO: 1464536 - RNA, 17 nt, Pseudomonas aeruginosa PA01
uccgcaucggccgacag

SEQ ID NO: 1464537 - RNA, 15 nt, Pseudomonas aeruginosa PA01
uccgccaccacggcg

SEQ ID NO: 1464538 - RNA, 18 nt, Pseudomonas aeruginosa PA01
uccgccaccacggcgaag

SEQ ID NO: 1464539 - RNA, 22 nt, Pseudomonas aeruginosa PA01
uccgccacuucaagcuggcgca

SEQ ID NO: 1464540 - RNA, 16 nt, Pseudomonas aeruginosa PA01
uccgccaccagccagu

SEQ ID NO: 1464541 - RNA, 22 nt, Pseudomonas aeruginosa PA01
uccgccaccagccagucgagac

SEQ ID NO: 1464542 - RNA, 17 nt, Pseudomonas aeruginosa PA01
uccgccacccgcuccgg

SEQ ID NO: 1464543 - RNA, 18 nt, Pseudomonas aeruginosa PA01
uccgccacccgcuccggc

SEQ ID NO: 1464544 - RNA, 15 nt, Pseudomonas aeruginosa PA01
uccgccagcaccacc

SEQ ID NO: 1464545 - RNA, 17 nt, Pseudomonas aeruginosa PA01
uccgccagcaccacccg

SEQ ID NO: 1464546 - RNA, 16 nt, Pseudomonas aeruginosa PA01
uccgccagcaggcgcg

SEQ ID NO: 1464547 - RNA, 13 nt, Pseudomonas aeruginosa PA01
uccgccagccagc

SEQ ID NO: 1464548 - RNA, 15 nt, Pseudomonas aeruginosa PA01
uccgcagccuuggca

SEQ ID NO: 1464549 - RNA, 14 nt, Pseudomonas aeruginosa PA01
uccgcaguugaggc

SEQ ID NO: 1464550 - RNA, 22 nt, Pseudomonas aeruginosa PA01
uccgcaguucgccccgccgcca

SEQ ID NO: 1464551 - RNA, 12 nt, Pseudomonas aeruginosa PA01
uccgcacccgcg

SEQ ID NO: 1464552 - RNA, 21 nt, Pseudomonas aeruginosa PA01
uccgaggcggauuugccgccg

SEQ ID NO: 1464553 - RNA, 21 nt, Pseudomonas aeruginosa PA01
uccgagggaggaggcgccggg

SEQ ID NO: 1464554 - RNA, 14 nt, Pseudomonas aeruginosa PA01
uccgagggccgcgc

SEQ ID NO: 1464555 - RNA, 21 nt, Pseudomonas aeruginosa PA01
uccgagggccgcgccgaccca

SEQ ID NO: 1464556 - RNA, 23 nt, Pseudomonas aeruginosa PA01
uccgagcaggucgcggaacucga

SEQ ID NO: 1464557 - RNA, 20 nt, Pseudomonas aeruginosa PA01
uccgacaaggagcgcgagcg

SEQ ID NO: 1464558 - RNA, 17 nt, Pseudomonas aeruginosa PA01
uccgacaaucagcggcg

SEQ ID NO: 1464559 - RNA, 22 nt, Pseudomonas aeruginosa PA01
uccgacggaaauaggcgucguc

SEQ ID NO: 1464560 - RNA, 14 nt, Pseudomonas aeruginosa PA01
uccgacgccgcguc

SEQ ID NO: 1464561 - RNA, 21 nt, Pseudomonas aeruginosa PA01
uccgacucuccgcgccgcggc

SEQ ID NO: 1464562 - RNA, 18 nt, Pseudomonas aeruginosa PA01
uccgacccggccgaccag

SEQ ID NO: 1464563 - RNA, 19 nt, Pseudomonas aeruginosa PA01
uccgaccggggaguucgac

SEQ ID NO: 1464564 - RNA, 16 nt, Pseudomonas aeruginosa PA01
uccgaccuggggcggc

SEQ ID NO: 1464565 - RNA, 14 nt, Pseudomonas aeruginosa PA01
uccgcgccacggau

SEQ ID NO: 1464566 - RNA, 20 nt, Pseudomonas aeruginosa PA01
uccgcgcaccuugcuggaca

SEQ ID NO: 1464567 - RNA, 23 nt, Pseudomonas aeruginosa PA01
uccgcgcacggaucgcgcugggc

SEQ ID NO: 1464568 - RNA, 16 nt, Pseudomonas aeruginosa PA01
uccgcgcccggcuggc

SEQ ID NO: 1464569 - RNA, 21 nt, Pseudomonas aeruginosa PA01
uccgcgcccggcuggccaucc

SEQ ID NO: 1464570 - RNA, 15 nt, Pseudomonas aeruginosa PA01
uccgcgccaugccgg

SEQ ID NO: 1464571 - RNA, 16 nt, Pseudomonas aeruginosa PA01
uccgcgccaugccggc

SEQ ID NO: 1464572 - RNA, 17 nt, Pseudomonas aeruginosa PA01
uccgcgccaugccggcg

SEQ ID NO: 1464573 - RNA, 12 nt, Pseudomonas aeruginosa PA01
uccgcgcccagg

SEQ ID NO: 1464574 - RNA, 18 nt, Pseudomonas aeruginosa PA01
uccgcgcccaggcgcacc

SEQ ID NO: 1464575 - RNA, 22 nt, Pseudomonas aeruginosa PA01
uccgcgcccaggcugccggcca

SEQ ID NO: 1464576 - RNA, 13 nt, Pseudomonas aeruginosa PA01
uccgcgccgcgcg

SEQ ID NO: 1464577 - RNA, 18 nt, Pseudomonas aeruginosa PA01
uccgcgccgcgucgccgc

SEQ ID NO: 1464578 - RNA, 14 nt, Pseudomonas aeruginosa PA01
uccgcuuccgccca

SEQ ID NO: 1464579 - RNA, 19 nt, Pseudomonas aeruginosa PA01
uccggaggcgcacaggcgg

SEQ ID NO: 1464580 - RNA, 18 nt, Pseudomonas aeruginosa PA01
uccggaguucgcccgccc

SEQ ID NO: 1464581 - RNA, 14 nt, Pseudomonas aeruginosa PA01
uccggaacgccugc

SEQ ID NO: 1464582 - RNA, 15 nt, Pseudomonas aeruginosa PA01
uccgccggccggggc

SEQ ID NO: 1464583 - RNA, 16 nt, Pseudomonas aeruginosa PA01
uccgccggccggggcg

SEQ ID NO: 1464584 - RNA, 18 nt, Pseudomonas aeruginosa PA01
uccgccgcuaucgccgcc

SEQ ID NO: 1464585 - RNA, 21 nt, Pseudomonas aeruginosa PA01
uccgccgcuaucgccgccgca

SEQ ID NO: 1464586 - RNA, 18 nt, Pseudomonas aeruginosa PA01
uccgccgcucccggcuug

SEQ ID NO: 1464587 - RNA, 19 nt, Pseudomonas aeruginosa PA01
uccgccgcuuccgccggcg

SEQ ID NO: 1464588 - RNA, 18 nt, Pseudomonas aeruginosa PA01
uccgccgcgccucgucgc

SEQ ID NO: 1464589 - RNA, 19 nt, Pseudomonas aeruginosa PA01
uccgccgcgccucgucgcg

SEQ ID NO: 1464590 - RNA, 22 nt, Pseudomonas aeruginosa PA01
uccgccgcgggacgccgcagga

SEQ ID NO: 1464591 - RNA, 19 nt, Pseudomonas aeruginosa PA01
uccgccgcgugcgcgcccu

SEQ ID NO: 1464592 - RNA, 20 nt, Pseudomonas aeruginosa PA01
uccgccggcugugcagggca

SEQ ID NO: 1464593 - RNA, 13 nt, Pseudomonas aeruginosa PA01
uccgccggcgccg

SEQ ID NO: 1464594 - RNA, 15 nt, Pseudomonas aeruginosa PA01
uccgccggcgccgcc

SEQ ID NO: 1464595 - RNA, 17 nt, Pseudomonas aeruginosa PA01
uccgccggcgccgccuc

SEQ ID NO: 1464596 - RNA, 21 nt, Pseudomonas aeruginosa PA01
uccgccggcgcgucccugggc

SEQ ID NO: 1464597 - RNA, 22 nt, Pseudomonas aeruginosa PA01
uccgccggcgcgucccugggcg

SEQ ID NO: 1464598 - RNA, 19 nt, Pseudomonas aeruginosa PA01
uccgcgauguccccggcca

SEQ ID NO: 1464599 - RNA, 23 nt, Pseudomonas aeruginosa PA01
uccgcgauguccccggccagcag

SEQ ID NO: 1464600 - RNA, 21 nt, Pseudomonas aeruginosa PA01
uccgcgaggcauucucgcgac

SEQ ID NO: 1464601 - RNA, 22 nt, Pseudomonas aeruginosa PA01
uccgcgaggcauucucgcgacc

SEQ ID NO: 1464602 - RNA, 17 nt, Pseudomonas aeruginosa PA01
uccgcgacguccacugc

SEQ ID NO: 1464603 - RNA, 18 nt, Pseudomonas aeruginosa PA01
uccgcgacggaccgcgac

SEQ ID NO: 1464604 - RNA, 18 nt, Pseudomonas aeruginosa PA01
uccggcgagcacggcgaa

SEQ ID NO: 1464605 - RNA, 17 nt, Pseudomonas aeruginosa PA01
uccggcagcacccgcac

SEQ ID NO: 1464606 - RNA, 19 nt, Pseudomonas aeruginosa PA01
uccggauacaugcugcuca

SEQ ID NO: 1464607 - RNA, 22 nt, Pseudomonas aeruginosa PA01
uccggcagcagggucagcagcg

SEQ ID NO: 1464608 - RNA, 19 nt, Pseudomonas aeruginosa PA01
uccggcagccagccgccga

SEQ ID NO: 1464609 - RNA, 14 nt, Pseudomonas aeruginosa PA01
uccggcagcgccuu

SEQ ID NO: 1464610 - RNA, 14 nt, Pseudomonas aeruginosa PA01
uccggcagggccuc

SEQ ID NO: 1464611 - RNA, 18 nt, Pseudomonas aeruginosa PA01
uccggcagguucagcagg

SEQ ID NO: 1464612 - RNA, 18 nt, Pseudomonas aeruginosa PA01
uccggcauaccgcccguc

SEQ ID NO: 1464613 - RNA, 13 nt, Pseudomonas aeruginosa PA01
uccggcaggcuca

SEQ ID NO: 1464614 - RNA, 17 nt, Pseudomonas aeruginosa PA01
uccggcgcagcccagcc

SEQ ID NO: 1464615 - RNA, 13 nt, Pseudomonas aeruginosa PA01
uccggcgccggca

SEQ ID NO: 1464616 - RNA, 16 nt, Pseudomonas aeruginosa PA01
uccggcgccggcagga

SEQ ID NO: 1464617 - RNA, 14 nt, Pseudomonas aeruginosa PA01
uccggcgccgggcu

SEQ ID NO: 1464618 - RNA, 19 nt, Pseudomonas aeruginosa PA01
uccggcuugccgaugucgc

SEQ ID NO: 1464619 - RNA, 21 nt, Pseudomonas aeruginosa PA01
uccggcuugguucgcgcgcug

SEQ ID NO: 1464620 - RNA, 19 nt, Pseudomonas aeruginosa PA01
uccggcuggcgccggugca

SEQ ID NO: 1464621 - RNA, 15 nt, Pseudomonas aeruginosa PA01
uccggcugucgacgc

SEQ ID NO: 1464622 - RNA, 19 nt, Pseudomonas aeruginosa PA01
uccggcugucgacgcagcc

SEQ ID NO: 1464623 - RNA, 13 nt, Pseudomonas aeruginosa PA01
uccggcucgccgc

SEQ ID NO: 1464624 - RNA, 14 nt, Pseudomonas aeruginosa PA01
uccggcugcgcgga

SEQ ID NO: 1464625 - RNA, 20 nt, Pseudomonas aeruginosa PA01
uccggcgccaggcccucggc

SEQ ID NO: 1464626 - RNA, 15 nt, Pseudomonas aeruginosa PA01
uccuccucgcucugc

SEQ ID NO: 1464627 - RNA, 17 nt, Pseudomonas aeruginosa PA01
uccucgaaagccgccgc

SEQ ID NO: 1464628 - RNA, 23 nt, Pseudomonas aeruginosa PA01
uccucgaaagccgccgccgcgcc

SEQ ID NO: 1464629 - RNA, 14 nt, Pseudomonas aeruginosa PA01
uccuccucgccgcc

SEQ ID NO: 1464630 - RNA, 22 nt, Pseudomonas aeruginosa PA01
uccuccauuagcgucgcgcggc

SEQ ID NO: 1464631 - RNA, 13 nt, Pseudomonas aeruginosa PA01
uccuccgcgccca

SEQ ID NO: 1464632 - RNA, 15 nt, Pseudomonas aeruginosa PA01
uccuccgcgcccagg

SEQ ID NO: 1464633 - RNA, 19 nt, Pseudomonas aeruginosa PA01
uccucgaugauccgcucga

SEQ ID NO: 1464634 - RNA, 21 nt, Pseudomonas aeruginosa PA01
uccucgaugaaugcgcagguc

SEQ ID NO: 1464635 - RNA, 20 nt, Pseudomonas aeruginosa PA01
uccucgacauggaucaccgc

SEQ ID NO: 1464636 - RNA, 15 nt, Pseudomonas aeruginosa PA01
uccguuguggcggcg

SEQ ID NO: 1464637 - RNA, 14 nt, Pseudomonas aeruginosa PA01
uccguugcgcagca

SEQ ID NO: 1464638 - RNA, 15 nt, Pseudomonas aeruginosa PA01
uccuacaucuuggca

SEQ ID NO: 1464639 - RNA, 18 nt, Pseudomonas aeruginosa PA01
uccuccaccgcuccggcg

SEQ ID NO: 1464640 - RNA, 21 nt, Pseudomonas aeruginosa PA01
uccuccaccgcuccggcgccg

SEQ ID NO: 1464641 - RNA, 19 nt, Pseudomonas aeruginosa PA01
uccuccagagugcgcagca

SEQ ID NO: 1464642 - RNA, 13 nt, Pseudomonas aeruginosa PA01
uccuccagccggc

SEQ ID NO: 1464643 - RNA, 16 nt, Pseudomonas aeruginosa PA01
uccuccagccggcgac

SEQ ID NO: 1464644 - RNA, 17 nt, Pseudomonas aeruginosa PA01
uccuccagccggcgacg

SEQ ID NO: 1464645 - RNA, 18 nt, Pseudomonas aeruginosa PA01
uccuccagcgccgccagg

SEQ ID NO: 1464646 - RNA, 15 nt, Pseudomonas aeruginosa PA01
uccuccagcguggcg

SEQ ID NO: 1464647 - RNA, 15 nt, Pseudomonas aeruginosa PA01
uccuccaggaccagg

SEQ ID NO: 1464648 - RNA, 17 nt, Pseudomonas aeruginosa PA01
uccguugaacucggcgc

SEQ ID NO: 1464649 - RNA, 15 nt, Pseudomonas aeruginosa PA01
uccguucggcgccca

SEQ ID NO: 1464650 - RNA, 15 nt, Pseudomonas aeruginosa PA01
uccgugcgccgggcu

SEQ ID NO: 1464651 - RNA, 16 nt, Pseudomonas aeruginosa PA01
uccgugcgcugcgcgu

SEQ ID NO: 1464652 - RNA, 19 nt, Pseudomonas aeruginosa PA01
uccgugcggaaaccgcggc

SEQ ID NO: 1464653 - RNA, 13 nt, Pseudomonas aeruginosa PA01
uccgugcuggccg

SEQ ID NO: 1464654 - RNA, 15 nt, Pseudomonas aeruginosa PA01
uccgugcuggccggc

SEQ ID NO: 1464655 - RNA, 16 nt, Pseudomonas aeruginosa PA01
uccgugcuggccggca

SEQ ID NO: 1464656 - RNA, 22 nt, Pseudomonas aeruginosa PA01
uccgucgcgaagaccggccggc

SEQ ID NO: 1464657 - RNA, 18 nt, Pseudomonas aeruginosa PA01
uccgucgucaccucggcg

SEQ ID NO: 1464658 - RNA, 19 nt, Pseudomonas aeruginosa PA01
uccgucucaggcgccaggc

SEQ ID NO: 1464659 - RNA, 15 nt, Pseudomonas aeruginosa PA01
uccgucuccagcaac

SEQ ID NO: 1464660 - RNA, 18 nt, Pseudomonas aeruginosa PA01
uccgugccaggcgcucgc

SEQ ID NO: 1464661 - RNA, 13 nt, Pseudomonas aeruginosa PA01
uccgggcuggcca

SEQ ID NO: 1464662 - RNA, 16 nt, Pseudomonas aeruginosa PA01
uccgggcuggccacca

SEQ ID NO: 1464663 - RNA, 16 nt, Pseudomonas aeruginosa PA01
uccgggcuccaccagu

SEQ ID NO: 1464664 - RNA, 14 nt, Pseudomonas aeruginosa PA01
uccgggcguaacgg

SEQ ID NO: 1464665 - RNA, 13 nt, Pseudomonas aeruginosa PA01
uccggggacgcug

SEQ ID NO: 1464666 - RNA, 19 nt, Pseudomonas aeruginosa PA01
uccgggcgguacaggcgca

SEQ ID NO: 1464667 - RNA, 22 nt, Pseudomonas aeruginosa PA01
uccgggcccaggcuggcggcca

SEQ ID NO: 1464668 - RNA, 16 nt, Pseudomonas aeruginosa PA01
uccgggaaauuucgcg

SEQ ID NO: 1464669 - RNA, 14 nt, Pseudomonas aeruginosa PA01
uccgggaaggccug

SEQ ID NO: 1464670 - RNA, 17 nt, Pseudomonas aeruginosa PA01
uccgggaaguccgggcg

SEQ ID NO: 1464671 - RNA, 21 nt, Pseudomonas aeruginosa PA01
uccgggaaguccgggcgcggc

SEQ ID NO: 1464672 - RNA, 20 nt, Pseudomonas aeruginosa PA01
ucgagcagggucgcgagcag

SEQ ID NO: 1464673 - RNA, 18 nt, Pseudomonas aeruginosa PA01
ucgagcagcgcgcggcuc

SEQ ID NO: 1464674 - RNA, 14 nt, Pseudomonas aeruginosa PA01
ucgagcagcggcgc

SEQ ID NO: 1464675 - RNA, 16 nt, Pseudomonas aeruginosa PA01
ucgagcacggcgcugg

SEQ ID NO: 1464676 - RNA, 16 nt, Pseudomonas aeruginosa PA01
ucgagcgcagcgacac

SEQ ID NO: 1464677 - RNA, 14 nt, Pseudomonas aeruginosa PA01
ucgagccuggccag

SEQ ID NO: 1464678 - RNA, 17 nt, Pseudomonas aeruginosa PA01
ucgagccuggccaggcg

SEQ ID NO: 1464679 - RNA, 13 nt, Pseudomonas aeruginosa PA01
ucgagcaccaggc

SEQ ID NO: 1464680 - RNA, 15 nt, Pseudomonas aeruginosa PA01
ucgagcaccaggcgg

SEQ ID NO: 1464681 - RNA, 17 nt, Pseudomonas aeruginosa PA01
ucgacggcgggagcggc

SEQ ID NO: 1464682 - RNA, 15 nt, Pseudomonas aeruginosa PA01
ucgacggcggccgcc

SEQ ID NO: 1464683 - RNA, 12 nt, Pseudomonas aeruginosa PA01
ucgacggcgauc

SEQ ID NO: 1464684 - RNA, 12 nt, Pseudomonas aeruginosa PA01
ucgacgccgcug

SEQ ID NO: 1464685 - RNA, 18 nt, Pseudomonas aeruginosa PA01
ucgaggcgggcgucggcg

SEQ ID NO: 1464686 - RNA, 15 nt, Pseudomonas aeruginosa PA01
ucgaggcgccgacca

SEQ ID NO: 1464687 - RNA, 19 nt, Pseudomonas aeruginosa PA01
ucgaggcgccgaccacgac

SEQ ID NO: 1464688 - RNA, 17 nt, Pseudomonas aeruginosa PA01
ucgaggcgcuccaccgc

SEQ ID NO: 1464689 - RNA, 13 nt, Pseudomonas aeruginosa PA01
ucgaggccucguc

SEQ ID NO: 1464690 - RNA, 16 nt, Pseudomonas aeruginosa PA01
ucgaggcugccgaagc

SEQ ID NO: 1464691 - RNA, 23 nt, Pseudomonas aeruginosa PA01
ucgagggaggucgcacgcagcgc

SEQ ID NO: 1464692 - RNA, 17 nt, Pseudomonas aeruginosa PA01
ucgagggguaaggcaug

SEQ ID NO: 1464693 - RNA, 22 nt, Pseudomonas aeruginosa PA01
ucgagggguaaggcaugcccag

SEQ ID NO: 1464694 - RNA, 20 nt, Pseudomonas aeruginosa PA01
ucgagggcgaccgccaggcg

SEQ ID NO: 1464695 - RNA, 21 nt, Pseudomonas aeruginosa PA01
ucgagggcguccuugcccggc

SEQ ID NO: 1464696 - RNA, 22 nt, Pseudomonas aeruginosa PA01
ucgagggcguccuugcccggcg

SEQ ID NO: 1464697 - RNA, 23 nt, Pseudomonas aeruginosa PA01
ucgaggccaggaucgucggcccg

SEQ ID NO: 1464698 - RNA, 17 nt, Pseudomonas aeruginosa PA01
ucgaggccaggccgagc

SEQ ID NO: 1464699 - RNA, 13 nt, Pseudomonas aeruginosa PA01
ucgaggccauccc

SEQ ID NO: 1464700 - RNA, 17 nt, Pseudomonas aeruginosa PA01
ucgaggcccucggcggc

SEQ ID NO: 1464701 - RNA, 20 nt, Pseudomonas aeruginosa PA01
ucgaggccgagccggcaucc

SEQ ID NO: 1464702 - RNA, 15 nt, Pseudomonas aeruginosa PA01
ucgaggccgcccagc

SEQ ID NO: 1464703 - RNA, 12 nt, Pseudomonas aeruginosa PA01
ucgaggccgcgg

SEQ ID NO: 1464704 - RNA, 15 nt, Pseudomonas aeruginosa PA01
ucgaggccgcggagc

SEQ ID NO: 1464705 - RNA, 18 nt, Pseudomonas aeruginosa PA01
ucgaggccggcaugcagg

SEQ ID NO: 1464706 - RNA, 13 nt, Pseudomonas aeruginosa PA01
ucgaggaugaucg

SEQ ID NO: 1464707 - RNA, 18 nt, Pseudomonas aeruginosa PA01
ucgagcggcggccgucgc

SEQ ID NO: 1464708 - RNA, 16 nt, Pseudomonas aeruginosa PA01
ucgagcgcuccaccgc

SEQ ID NO: 1464709 - RNA, 19 nt, Pseudomonas aeruginosa PA01
ucgagcgcuccaccgcgcu

SEQ ID NO: 1464710 - RNA, 15 nt, Pseudomonas aeruginosa PA01
ucgaucacuucaccu

SEQ ID NO: 1464711 - RNA, 14 nt, Pseudomonas aeruginosa PA01
ucgaucaccaccac

SEQ ID NO: 1464712 - RNA, 21 nt, Pseudomonas aeruginosa PA01
ucgaucacccgcgaggccggc

SEQ ID NO: 1464713 - RNA, 20 nt, Pseudomonas aeruginosa PA01
ucgaucaccgcaucgaaggc

SEQ ID NO: 1464714 - RNA, 14 nt, Pseudomonas aeruginosa PA01
ucgaucagcagcac

SEQ ID NO: 1464715 - RNA, 15 nt, Pseudomonas aeruginosa PA01
ucgaucagcagcagc

SEQ ID NO: 1464716 - RNA, 18 nt, Pseudomonas aeruginosa PA01
ucgaucagcagcagcgcc

SEQ ID NO: 1464717 - RNA, 14 nt, Pseudomonas aeruginosa PA01
ucgagggucugcug

SEQ ID NO: 1464718 - RNA, 16 nt, Pseudomonas aeruginosa PA01
ucgauauccagcggca

SEQ ID NO: 1464719 - RNA, 18 nt, Pseudomonas aeruginosa PA01
ucgauauccagcggcagc

SEQ ID NO: 1464720 - RNA, 18 nt, Pseudomonas aeruginosa PA01
ucgauauagcccugggcg

SEQ ID NO: 1464721 - RNA, 17 nt, Pseudomonas aeruginosa PA01
ucgaugcucauccugcc

SEQ ID NO: 1464722 - RNA, 23 nt, Pseudomonas aeruginosa PA01
ucgauggcgaagcgcuugcccag

SEQ ID NO: 1464723 - RNA, 18 nt, Pseudomonas aeruginosa PA01
ucgauggcggccgccauu

SEQ ID NO: 1464724 - RNA, 23 nt, Pseudomonas aeruginosa PA01
ucgaugggccguaggugaccgcc

SEQ ID NO: 1464725 - RNA, 20 nt, Pseudomonas aeruginosa PA01
ucgaugccaucgaggccagg

SEQ ID NO: 1464726 - RNA, 19 nt, Pseudomonas aeruginosa PA01
ucgaugcccucgcggcggc

SEQ ID NO: 1464727 - RNA, 17 nt, Pseudomonas aeruginosa PA01
ucgaugccgcgcgccug

SEQ ID NO: 1464728 - RNA, 14 nt, Pseudomonas aeruginosa PA01
ucgaugcgcgcggc

SEQ ID NO: 1464729 - RNA, 15 nt, Pseudomonas aeruginosa PA01
ucgaugcgcgcggcg

SEQ ID NO: 1464730 - RNA, 15 nt, Pseudomonas aeruginosa PA01
ucgaugccuucggcg

SEQ ID NO: 1464731 - RNA, 17 nt, Pseudomonas aeruginosa PA01
ucgaugccuucggcggc

SEQ ID NO: 1464732 - RNA, 13 nt, Pseudomonas aeruginosa PA01
ucgaugcgccuca

SEQ ID NO: 1464733 - RNA, 16 nt, Pseudomonas aeruginosa PA01
ucgaugcgccucagcg

SEQ ID NO: 1464734 - RNA, 18 nt, Pseudomonas aeruginosa PA01
ucgaugcgccucagcggc

SEQ ID NO: 1464735 - RNA, 17 nt, Pseudomonas aeruginosa PA01
ucgaucagugcaucggc

SEQ ID NO: 1464736 - RNA, 18 nt, Pseudomonas aeruginosa PA01
ucgaugagcaugccgcag

SEQ ID NO: 1464737 - RNA, 18 nt, Pseudomonas aeruginosa PA01
ucgaucaucgccagcggc

SEQ ID NO: 1464738 - RNA, 16 nt, Pseudomonas aeruginosa PA01
ucgaucaggcgcaugc

SEQ ID NO: 1464739 - RNA, 20 nt, Pseudomonas aeruginosa PA01
ucgaucaggcgggcgucguc

SEQ ID NO: 1464740 - RNA, 21 nt, Pseudomonas aeruginosa PA01
ucgaucagguagucgcccggc

SEQ ID NO: 1464741 - RNA, 22 nt, Pseudomonas aeruginosa PA01
ucgaucagcgccgggugaccgu

SEQ ID NO: 1464742 - RNA, 16 nt, Pseudomonas aeruginosa PA01
ucgaucagcgcgcgga

SEQ ID NO: 1464743 - RNA, 14 nt, Pseudomonas aeruginosa PA01
ucgaucagcgcggc

SEQ ID NO: 1464744 - RNA, 14 nt, Pseudomonas aeruginosa PA01
ucgaucagcgccgg

SEQ ID NO: 1464745 - RNA, 23 nt, Pseudomonas aeruginosa PA01
ucgaucagcgagcuucgccgcgc

SEQ ID NO: 1464746 - RNA, 13 nt, Pseudomonas aeruginosa PA01
ucgaucagccggc

SEQ ID NO: 1464747 - RNA, 16 nt, Pseudomonas aeruginosa PA01
ucgaugagcuucgccg

SEQ ID NO: 1464748 - RNA, 15 nt, Pseudomonas aeruginosa PA01
ucgaugaugaucgcc

SEQ ID NO: 1464749 - RNA, 20 nt, Pseudomonas aeruginosa PA01
ucgaugauccacuugccgcc

SEQ ID NO: 1464750 - RNA, 21 nt, Pseudomonas aeruginosa PA01
ucgaugauccacuugccgccg

SEQ ID NO: 1464751 - RNA, 23 nt, Pseudomonas aeruginosa PA01
ucgaugcccagccagggccgcga

SEQ ID NO: 1464752 - RNA, 20 nt, Pseudomonas aeruginosa PA01
ucgaugcccgccagcaggcg

SEQ ID NO: 1464753 - RNA, 12 nt, Pseudomonas aeruginosa PA01
ucgauuccuguc

SEQ ID NO: 1464754 - RNA, 13 nt, Pseudomonas aeruginosa PA01
ucgauggucagga

SEQ ID NO: 1464755 - RNA, 19 nt, Pseudomonas aeruginosa PA01
ucgauggucuugaucccag

SEQ ID NO: 1464756 - RNA, 22 nt, Pseudomonas aeruginosa PA01
ucgauggucuugaucccaggga

SEQ ID NO: 1464757 - RNA, 18 nt, Pseudomonas aeruginosa PA01
ucgauggugaacgccagg

SEQ ID NO: 1464758 - RNA, 15 nt, Pseudomonas aeruginosa PA01
ucgauggugaucacg

SEQ ID NO: 1464759 - RNA, 21 nt, Pseudomonas aeruginosa PA01
ucgauggugaucacgucggcg

SEQ ID NO: 1464760 - RNA, 18 nt, Pseudomonas aeruginosa PA01
ucgauguaggccucggcc

SEQ ID NO: 1464761 - RNA, 19 nt, Pseudomonas aeruginosa PA01
ucgaugucguggucgccgu

SEQ ID NO: 1464762 - RNA, 18 nt, Pseudomonas aeruginosa PA01
ucgcaagauuaucagcaa

SEQ ID NO: 1464763 - RNA, 16 nt, Pseudomonas aeruginosa PA01
ucgcaaagcgagcgcc

SEQ ID NO: 1464764 - RNA, 17 nt, Pseudomonas aeruginosa PA01
ucgcaacgcuguccgcc

SEQ ID NO: 1464765 - RNA, 14 nt, Pseudomonas aeruginosa PA01
ucgcaaagcucgcg

SEQ ID NO: 1464766 - RNA, 18 nt, Pseudomonas aeruginosa PA01
ucgcaaagcucgcgcaag

SEQ ID NO: 1464767 - RNA, 12 nt, Pseudomonas aeruginosa PA01
ucgcaauggcgg

SEQ ID NO: 1464768 - RNA, 13 nt, Pseudomonas aeruginosa PA01
ucgcaauggcgga

SEQ ID NO: 1464769 - RNA, 16 nt, Pseudomonas aeruginosa PA01
ucgcacagccaggggc

SEQ ID NO: 1464770 - RNA, 21 nt, Pseudomonas aeruginosa PA01
ucgcaauugaucauccaggac

SEQ ID NO: 1464771 - RNA, 17 nt, Pseudomonas aeruginosa PA01
ucgcaccagccggccgc

SEQ ID NO: 1464772 - RNA, 19 nt, Pseudomonas aeruginosa PA01
ucgcaccagccggccgcgu

SEQ ID NO: 1464773 - RNA, 20 nt, Pseudomonas aeruginosa PA01
ucgcaccagccggccgcguc

SEQ ID NO: 1464774 - RNA, 23 nt, Pseudomonas aeruginosa PA01
ucgcacccggcccauggcgacgc

SEQ ID NO: 1464775 - RNA, 22 nt, Pseudomonas aeruginosa PA01
ucgaaagccgccgccgcgccgg

SEQ ID NO: 1464776 - RNA, 16 nt, Pseudomonas aeruginosa PA01
ucgaacaacccgccag

SEQ ID NO: 1464777 - RNA, 13 nt, Pseudomonas aeruginosa PA01
ucgaaaucgccca

SEQ ID NO: 1464778 - RNA, 16 nt, Pseudomonas aeruginosa PA01
ucgaaacgcuggcggc

SEQ ID NO: 1464779 - RNA, 20 nt, Pseudomonas aeruginosa PA01
ucgaaacgggcgcucuggcc

SEQ ID NO: 1464780 - RNA, 13 nt, Pseudomonas aeruginosa PA01
ucgaaacgaagcu

SEQ ID NO: 1464781 - RNA, 16 nt, Pseudomonas aeruginosa PA01
uccuucgagccuggcc

SEQ ID NO: 1464782 - RNA, 21 nt, Pseudomonas aeruginosa PA01
uccuucggcgcauagccaccg

SEQ ID NO: 1464783 - RNA, 23 nt, Pseudomonas aeruginosa PA01
uccucggccauaccuccagccag

SEQ ID NO: 1464784 - RNA, 20 nt, Pseudomonas aeruginosa PA01
uccuguucgcgcgccucgcg

SEQ ID NO: 1464785 - RNA, 23 nt, Pseudomonas aeruginosa PA01
uccucggagagcagccaagccac

SEQ ID NO: 1464786 - RNA, 14 nt, Pseudomonas aeruginosa PA01
uccucgcucugcgc

SEQ ID NO: 1464787 - RNA, 18 nt, Pseudomonas aeruginosa PA01
uccucgcgcugcccggcg

SEQ ID NO: 1464788 - RNA, 23 nt, Pseudomonas aeruginosa PA01
uccucgcggaagcguugcucgag

SEQ ID NO: 1464789 - RNA, 16 nt, Pseudomonas aeruginosa PA01
uccucgcgacaccggg

SEQ ID NO: 1464790 - RNA, 17 nt, Pseudomonas aeruginosa PA01
uccucgcgcaccgcggc

SEQ ID NO: 1464791 - RNA, 11 nt, Pseudomonas aeruginosa PA01
uccucgccgcu

SEQ ID NO: 1464792 - RNA, 14 nt, Pseudomonas aeruginosa PA01
uccucgccgcuggc

SEQ ID NO: 1464793 - RNA, 17 nt, Pseudomonas aeruginosa PA01
uccucgccccgccggga

SEQ ID NO: 1464794 - RNA, 18 nt, Pseudomonas aeruginosa PA01
uccucgccccgccgggag

SEQ ID NO: 1464795 - RNA, 19 nt, Pseudomonas aeruginosa PA01
ucgaacaccaggcgccagg

SEQ ID NO: 1464796 - RNA, 16 nt, Pseudomonas aeruginosa PA01
ucgaacaccggcgagc

SEQ ID NO: 1464797 - RNA, 21 nt, Pseudomonas aeruginosa PA01
ucgaacgccgcccgucgcgcc

SEQ ID NO: 1464798 - RNA, 23 nt, Pseudomonas aeruginosa PA01
ucgaacgccgcccgucgcgccgg

SEQ ID NO: 1464799 - RNA, 19 nt, Pseudomonas aeruginosa PA01
ucgaagaaggcucaccggu

SEQ ID NO: 1464800 - RNA, 19 nt, Pseudomonas aeruginosa PA01
ucgaagaaugccuucaccg

SEQ ID NO: 1464801 - RNA, 21 nt, Pseudomonas aeruginosa PA01
ucgaagaaugccuucaccggc

SEQ ID NO: 1464802 - RNA, 18 nt, Pseudomonas aeruginosa PA01
ucgaagaaaaggcccggc

SEQ ID NO: 1464803 - RNA, 14 nt, Pseudomonas aeruginosa PA01
ucgaacgugcgcgc

SEQ ID NO: 1464804 - RNA, 19 nt, Pseudomonas aeruginosa PA01
ucgaacugaccaccaggaa

SEQ ID NO: 1464805 - RNA, 24 nt, Pseudomonas aeruginosa PA01
ucgaacugcaugucgcugagcggc

SEQ ID NO: 1464806 - RNA, 16 nt, Pseudomonas aeruginosa PA01
ucgaaguccugcagga

SEQ ID NO: 1464807 - RNA, 18 nt, Pseudomonas aeruginosa PA01
ucgaagccgagcugccgg

SEQ ID NO: 1464808 - RNA, 21 nt, Pseudomonas aeruginosa PA01
ucgaagccgagcugccgggcg

SEQ ID NO: 1464809 - RNA, 23 nt, Pseudomonas aeruginosa PA01
ucgaagccgaggcuuuccagcag

SEQ ID NO: 1464810 - RNA, 14 nt, Pseudomonas aeruginosa PA01
ucgaagucgaacuu

SEQ ID NO: 1464811 - RNA, 19 nt, Pseudomonas aeruginosa PA01
ucgaagucguugaagcggc

SEQ ID NO: 1464812 - RNA, 18 nt, Pseudomonas aeruginosa PA01
ucgaaguucuccagcaag

SEQ ID NO: 1464813 - RNA, 13 nt, Pseudomonas aeruginosa PA01
ucgaaucaagcaa

SEQ ID NO: 1464814 - RNA, 19 nt, Pseudomonas aeruginosa PA01
ucgaaugcuguuccucguc

SEQ ID NO: 1464815 - RNA, 21 nt, Pseudomonas aeruginosa PA01
ucgaauggaguuuccgcgagg

SEQ ID NO: 1464816 - RNA, 13 nt, Pseudomonas aeruginosa PA01
ucgaauggcgccg

SEQ ID NO: 1464817 - RNA, 19 nt, Pseudomonas aeruginosa PA01
ucgaauggcgccggccaga

SEQ ID NO: 1464818 - RNA, 15 nt, Pseudomonas aeruginosa PA01
ucgaagacccccugc

SEQ ID NO: 1464819 - RNA, 13 nt, Pseudomonas aeruginosa PA01
ucgaagcaauacc

SEQ ID NO: 1464820 - RNA, 14 nt, Pseudomonas aeruginosa PA01
ucgaagcccaucga

SEQ ID NO: 1464821 - RNA, 14 nt, Pseudomonas aeruginosa PA01
ucgaagccgccgcc

SEQ ID NO: 1464822 - RNA, 15 nt, Pseudomonas aeruginosa PA01
ucgaagccgccgccg

SEQ ID NO: 1464823 - RNA, 16 nt, Pseudomonas aeruginosa PA01
ucgaagccgccgccga

SEQ ID NO: 1464824 - RNA, 17 nt, Pseudomonas aeruginosa PA01
ucgaagccgccgccgag

SEQ ID NO: 1464825 - RNA, 18 nt, Pseudomonas aeruginosa PA01
ucgaagccgccgccgaga

SEQ ID NO: 1464826 - RNA, 23 nt, Pseudomonas aeruginosa PA01
ucgacaaggagacucagcgcgac

SEQ ID NO: 1464827 - RNA, 24 nt, Pseudomonas aeruginosa PA01
ucgaauuggacagcaggcugccga

SEQ ID NO: 1464828 - RNA, 13 nt, Pseudomonas aeruginosa PA01
ucgacaggucggc

SEQ ID NO: 1464829 - RNA, 14 nt, Pseudomonas aeruginosa PA01
ucgacaggccgccg

SEQ ID NO: 1464830 - RNA, 16 nt, Pseudomonas aeruginosa PA01
ucgacagcagcgccag

SEQ ID NO: 1464831 - RNA, 21 nt, Pseudomonas aeruginosa PA01
ucgacagcgucguaguggcgc

SEQ ID NO: 1464832 - RNA, 23 nt, Pseudomonas aeruginosa PA01
ucgacaccccggucaggccgauc

SEQ ID NO: 1464833 - RNA, 13 nt, Pseudomonas aeruginosa PA01
ucgaccgcgccgg

SEQ ID NO: 1464834 - RNA, 15 nt, Pseudomonas aeruginosa PA01
ucgaccgcgccggcg

SEQ ID NO: 1464835 - RNA, 15 nt, Pseudomonas aeruginosa PA01
ucgaccgccugccag

SEQ ID NO: 1464836 - RNA, 18 nt, Pseudomonas aeruginosa PA01
ucgaccgccugccagacc

SEQ ID NO: 1464837 - RNA, 13 nt, Pseudomonas aeruginosa PA01
ucgacccuggcgc

SEQ ID NO: 1464838 - RNA, 20 nt, Pseudomonas aeruginosa PA01
ucgacccuggcgccgaccuc

SEQ ID NO: 1464839 - RNA, 21 nt, Pseudomonas aeruginosa PA01
ucgacauagcgcagcaccggc

SEQ ID NO: 1464840 - RNA, 13 nt, Pseudomonas aeruginosa PA01
ucgacccgcccgc

SEQ ID NO: 1464841 - RNA, 15 nt, Pseudomonas aeruginosa PA01
ucgacccgcccgccg

SEQ ID NO: 1464842 - RNA, 19 nt, Pseudomonas aeruginosa PA01
ucgacccgccgaccagcac

SEQ ID NO: 1464843 - RNA, 19 nt, Pseudomonas aeruginosa PA01
ucgacccgguacagccaac

SEQ ID NO: 1464844 - RNA, 21 nt, Pseudomonas aeruginosa PA01
ucgacgcagggcggcgccugg

SEQ ID NO: 1464845 - RNA, 13 nt, Pseudomonas aeruginosa PA01
ucgacgccagcgg

SEQ ID NO: 1464846 - RNA, 18 nt, Pseudomonas aeruginosa PA01
ucgacgccagcggcgauc

SEQ ID NO: 1464847 - RNA, 13 nt, Pseudomonas aeruginosa PA01
ucgacgccagcuc

SEQ ID NO: 1464848 - RNA, 18 nt, Pseudomonas aeruginosa PA01
ucgacgccagcucggccg

SEQ ID NO: 1464849 - RNA, 21 nt, Pseudomonas aeruginosa PA01
ucgacgccagcucggccggca

SEQ ID NO: 1464850 - RNA, 23 nt, Pseudomonas aeruginosa PA01
ucgacgccagcucggccggcagg

SEQ ID NO: 1464851 - RNA, 22 nt, Pseudomonas aeruginosa PA01
ucgacgaagggcucagcccagg

SEQ ID NO: 1464852 - RNA, 16 nt, Pseudomonas aeruginosa PA01
ucgacgaacucgacgc

SEQ ID NO: 1464853 - RNA, 18 nt, Pseudomonas aeruginosa PA01
ucgacgaacucgacgcgc

SEQ ID NO: 1464854 - RNA, 20 nt, Pseudomonas aeruginosa PA01
ucgacgaacucgacgcgcca

SEQ ID NO: 1464855 - RNA, 17 nt, Pseudomonas aeruginosa PA01
ucgacgaacaggaagcg

SEQ ID NO: 1464856 - RNA, 21 nt, Pseudomonas aeruginosa PA01
ucgacgaacaggaagcgcggg

SEQ ID NO: 1464857 - RNA, 15 nt, Pseudomonas aeruginosa PA01
ucgacgccgccgagc

SEQ ID NO: 1464858 - RNA, 16 nt, Pseudomonas aeruginosa PA01
ucgacgccgccgagca

SEQ ID NO: 1464859 - RNA, 18 nt, Pseudomonas aeruginosa PA01
ucgacgccgccgagcaug

SEQ ID NO: 1464860 - RNA, 17 nt, Pseudomonas aeruginosa PA01
ucgacgccgcuggcggc

SEQ ID NO: 1464861 - RNA, 19 nt, Pseudomonas aeruginosa PA01
ucgacgccgcuggcggcgc

SEQ ID NO: 1464862 - RNA, 22 nt, Pseudomonas aeruginosa PA01
ucgacgccgcuggcggcgcuca

SEQ ID NO: 1464863 - RNA, 13 nt, Pseudomonas aeruginosa PA01
ucgacgccuucgu

SEQ ID NO: 1464864 - RNA, 21 nt, Pseudomonas aeruginosa PA01
ucgacgccuucguggccgcgg

SEQ ID NO: 1464865 - RNA, 18 nt, Pseudomonas aeruginosa PA01
ucgacgccuugcccggcg

SEQ ID NO: 1464866 - RNA, 15 nt, Pseudomonas aeruginosa PA01
ucgacgcccgcuugc

SEQ ID NO: 1464867 - RNA, 17 nt, Pseudomonas aeruginosa PA01
ucgacgcccugggcgac

SEQ ID NO: 1464868 - RNA, 15 nt, Pseudomonas aeruginosa PA01
ucgacgcccucggcg

SEQ ID NO: 1464869 - RNA, 19 nt, Pseudomonas aeruginosa PA01
ucgacgccgagccagccgc

SEQ ID NO: 1464870 - RNA, 23 nt, Pseudomonas aeruginosa PA01
ucgacgccgagccagccgcggau

SEQ ID NO: 1464871 - RNA, 15 nt, Pseudomonas aeruginosa PA01
ucgacgccgaagccg

SEQ ID NO: 1464872 - RNA, 14 nt, Pseudomonas aeruginosa PA01
ucgaccucggccgc

SEQ ID NO: 1464873 - RNA, 20 nt, Pseudomonas aeruginosa PA01
ucgaccugcggggcggauga

SEQ ID NO: 1464874 - RNA, 20 nt, Pseudomonas aeruginosa PA01
ucgacgaaauaaugcggcgc

SEQ ID NO: 1464875 - RNA, 20 nt, Pseudomonas aeruginosa PA01
ucgaccuugcccucggcgcc

SEQ ID NO: 1464876 - RNA, 22 nt, Pseudomonas aeruginosa PA01
ucgaccuugcccucggcgcccg

SEQ ID NO: 1464877 - RNA, 16 nt, Pseudomonas aeruginosa PA01
ucgaccuugccgacgc

SEQ ID NO: 1464878 - RNA, 22 nt, Pseudomonas aeruginosa PA01
ucgaccuugccgacgccgcggc

SEQ ID NO: 1464879 - RNA, 13 nt, Pseudomonas aeruginosa PA01
ucgaccgucgcca

SEQ ID NO: 1464880 - RNA, 17 nt, Pseudomonas aeruginosa PA01
ucgaccgucgccacgcu

SEQ ID NO: 1464881 - RNA, 21 nt, Pseudomonas aeruginosa PA01
ucgccgaacuccgagcaggac

SEQ ID NO: 1464882 - RNA, 16 nt, Pseudomonas aeruginosa PA01
ucgccgaagacgccug

SEQ ID NO: 1464883 - RNA, 21 nt, Pseudomonas aeruginosa PA01
ucgccgaagauccgcuccagg

SEQ ID NO: 1464884 - RNA, 23 nt, Pseudomonas aeruginosa PA01
ucgccgaagauccgcuccaggcu

SEQ ID NO: 1464885 - RNA, 18 nt, Pseudomonas aeruginosa PA01
ucgccgaaauagcgcgcc

SEQ ID NO: 1464886 - RNA, 19 nt, Pseudomonas aeruginosa PA01
ucgccgaaauagcgcgccc

SEQ ID NO: 1464887 - RNA, 18 nt, Pseudomonas aeruginosa PA01
ucgccgaaagcacgcgca

SEQ ID NO: 1464888 - RNA, 22 nt, Pseudomonas aeruginosa PA01
ucgccgaaaaauucagcgcagc

SEQ ID NO: 1464889 - RNA, 22 nt, Pseudomonas aeruginosa PA01
ucgccgaaaagaagccccgcag

SEQ ID NO: 1464890 - RNA, 15 nt, Pseudomonas aeruginosa PA01
ucgcccuugaccagu

SEQ ID NO: 1464891 - RNA, 21 nt, Pseudomonas aeruginosa PA01
ucgcccuugaccagucccggc

SEQ ID NO: 1464892 - RNA, 19 nt, Pseudomonas aeruginosa PA01
ucgccgaccagcuugggca

SEQ ID NO: 1464893 - RNA, 23 nt, Pseudomonas aeruginosa PA01
ucgccgacacgugugucgacacc

SEQ ID NO: 1464894 - RNA, 15 nt, Pseudomonas aeruginosa PA01
ucgccgagcgccgcc

SEQ ID NO: 1464895 - RNA, 16 nt, Pseudomonas aeruginosa PA01
ucgccgagcgccgcca

SEQ ID NO: 1464896 - RNA, 18 nt, Pseudomonas aeruginosa PA01
ucgccgagcgccgccagg

SEQ ID NO: 1464897 - RNA, 19 nt, Pseudomonas aeruginosa PA01
ucgccgagcgccgccaggc

SEQ ID NO: 1464898 - RNA, 21 nt, Pseudomonas aeruginosa PA01
ucgccgagcgccgccaggcag

SEQ ID NO: 1464899 - RNA, 22 nt, Pseudomonas aeruginosa PA01
ucgccgaaggugcaggccgcgc

SEQ ID NO: 1464900 - RNA, 12 nt, Pseudomonas aeruginosa PA01
ucgccgacaggu

SEQ ID NO: 1464901 - RNA, 20 nt, Pseudomonas aeruginosa PA01
ucgccgacaggucggccggc

SEQ ID NO: 1464902 - RNA, 19 nt, Pseudomonas aeruginosa PA01
ucgcccggcucgcccaugc

SEQ ID NO: 1464903 - RNA, 12 nt, Pseudomonas aeruginosa PA01
ucgcccggcuug

SEQ ID NO: 1464904 - RNA, 14 nt, Pseudomonas aeruginosa PA01
ucgcccgcugcgcu

SEQ ID NO: 1464905 - RNA, 17 nt, Pseudomonas aeruginosa PA01
ucgcccgcugcgcugcc

SEQ ID NO: 1464906 - RNA, 14 nt, Pseudomonas aeruginosa PA01
ucgcccgcggcggc

SEQ ID NO: 1464907 - RNA, 19 nt, Pseudomonas aeruginosa PA01
ucgcccgcggcggcgacgc

SEQ ID NO: 1464908 - RNA, 20 nt, Pseudomonas aeruginosa PA01
ucgcccagugguuccaggag

SEQ ID NO: 1464909 - RNA, 18 nt, Pseudomonas aeruginosa PA01
ucgcccagggccagcggg

SEQ ID NO: 1464910 - RNA, 20 nt, Pseudomonas aeruginosa PA01
ucgcccagggcguggucggc

SEQ ID NO: 1464911 - RNA, 20 nt, Pseudomonas aeruginosa PA01
ucgcccaggugcgccgagcg

SEQ ID NO: 1464912 - RNA, 15 nt, Pseudomonas aeruginosa PA01
ucgcccaucgccagg

SEQ ID NO: 1464913 - RNA, 13 nt, Pseudomonas aeruginosa PA01
ucgcccaucugcg

SEQ ID NO: 1464914 - RNA, 22 nt, Pseudomonas aeruginosa PA01
ucgcccgcaguuccucgccgcu

SEQ ID NO: 1464915 - RNA, 23 nt, Pseudomonas aeruginosa PA01
ucgcccgcaguuccucgccgcug

SEQ ID NO: 1464916 - RNA, 15 nt, Pseudomonas aeruginosa PA01
ucgcccaugcgcggc

SEQ ID NO: 1464917 - RNA, 18 nt, Pseudomonas aeruginosa PA01
ucgcccaguaccacgcag

SEQ ID NO: 1464918 - RNA, 21 nt, Pseudomonas aeruginosa PA01
ucgcccgccccauugcguagg

SEQ ID NO: 1464919 - RNA, 14 nt, Pseudomonas aeruginosa PA01
ucgcccgccgccug

SEQ ID NO: 1464920 - RNA, 12 nt, Pseudomonas aeruginosa PA01
ucgcccgccggc

SEQ ID NO: 1464921 - RNA, 14 nt, Pseudomonas aeruginosa PA01
ucgcacucuuccug

SEQ ID NO: 1464922 - RNA, 19 nt, Pseudomonas aeruginosa PA01
ucgcagaacgcggaaaccu

SEQ ID NO: 1464923 - RNA, 19 nt, Pseudomonas aeruginosa PA01
ucgcaccuguuccagcaac

SEQ ID NO: 1464924 - RNA, 20 nt, Pseudomonas aeruginosa PA01
ucgcaccgggaggcgccgcg

SEQ ID NO: 1464925 - RNA, 23 nt, Pseudomonas aeruginosa PA01
ucgcaccgggaggcgccgcgcca

SEQ ID NO: 1464926 - RNA, 16 nt, Pseudomonas aeruginosa PA01
ucgcacgcagcgccgc

SEQ ID NO: 1464927 - RNA, 12 nt, Pseudomonas aeruginosa PA01
ucgcacggcggg

SEQ ID NO: 1464928 - RNA, 14 nt, Pseudomonas aeruginosa PA01
ucgcacggcgggac

SEQ ID NO: 1464929 - RNA, 20 nt, Pseudomonas aeruginosa PA01
ucgcacggucguccugcgga

SEQ ID NO: 1464930 - RNA, 23 nt, Pseudomonas aeruginosa PA01
ucgcacggucguccugcggauuc

SEQ ID NO: 1464931 - RNA, 19 nt, Pseudomonas aeruginosa PA01
ucgccagggggaucgcgaa

SEQ ID NO: 1464932 - RNA, 20 nt, Pseudomonas aeruginosa PA01
ucgccagggggaucgcgaag

SEQ ID NO: 1464933 - RNA, 14 nt, Pseudomonas aeruginosa PA01
ucgccagggaggcg

SEQ ID NO: 1464934 - RNA, 18 nt, Pseudomonas aeruginosa PA01
ucgccagggaggcgauuc

SEQ ID NO: 1464935 - RNA, 12 nt, Pseudomonas aeruginosa PA01
ucgcagagacgc

SEQ ID NO: 1464936 - RNA, 17 nt, Pseudomonas aeruginosa PA01
ucgcagagacgcagcgc

SEQ ID NO: 1464937 - RNA, 17 nt, Pseudomonas aeruginosa PA01
ucgcagagaucggcggc

SEQ ID NO: 1464938 - RNA, 20 nt, Pseudomonas aeruginosa PA01
ucgcagagaucggcggcgcg

SEQ ID NO: 1464939 - RNA, 15 nt, Pseudomonas aeruginosa PA01
ucgcagagcgccagc

SEQ ID NO: 1464940 - RNA, 15 nt, Pseudomonas aeruginosa PA01
ucgcagagggcgaug

SEQ ID NO: 1464941 - RNA, 16 nt, Pseudomonas aeruginosa PA01
ucgcagagggcgaugc

SEQ ID NO: 1464942 - RNA, 13 nt, Pseudomonas aeruginosa PA01
ucgcccagcgccu

SEQ ID NO: 1464943 - RNA, 14 nt, Pseudomonas aeruginosa PA01
ucgcccagcgccug

SEQ ID NO: 1464944 - RNA, 17 nt, Pseudomonas aeruginosa PA01
ucgcccaggccgcuggc

SEQ ID NO: 1464945 - RNA, 14 nt, Pseudomonas aeruginosa PA01
ucgcccagcucgcc

SEQ ID NO: 1464946 - RNA, 15 nt, Pseudomonas aeruginosa PA01
ucgcccagcucgccg

SEQ ID NO: 1464947 - RNA, 16 nt, Pseudomonas aeruginosa PA01
ucgcccagcucgccgc

SEQ ID NO: 1464948 - RNA, 17 nt, Pseudomonas aeruginosa PA01
ucgcccagcucgccgcu

SEQ ID NO: 1464949 - RNA, 17 nt, Pseudomonas aeruginosa PA01
ucgccaguuccgugucg

SEQ ID NO: 1464950 - RNA, 22 nt, Pseudomonas aeruginosa PA01
ucgccaguucucgcagcaggcg

SEQ ID NO: 1464951 - RNA, 18 nt, Pseudomonas aeruginosa PA01
ucgccauaggaugccgag

SEQ ID NO: 1464952 - RNA, 18 nt, Pseudomonas aeruginosa PA01
ucgccaugcccgucgacc

SEQ ID NO: 1464953 - RNA, 16 nt, Pseudomonas aeruginosa PA01
ucgcccagcaggcgcg

SEQ ID NO: 1464954 - RNA, 14 nt, Pseudomonas aeruginosa PA01
ucgccaugcggcag

SEQ ID NO: 1464955 - RNA, 17 nt, Pseudomonas aeruginosa PA01
ucgccauccuggucgcg

SEQ ID NO: 1464956 - RNA, 12 nt, Pseudomonas aeruginosa PA01
ucgccgcgccgu

SEQ ID NO: 1464957 - RNA, 14 nt, Pseudomonas aeruginosa PA01
ucgccgcgccgccg

SEQ ID NO: 1464958 - RNA, 15 nt, Pseudomonas aeruginosa PA01
ucgccgcgccgccga

SEQ ID NO: 1464959 - RNA, 17 nt, Pseudomonas aeruginosa PA01
ucgccgcgccgccgagg

SEQ ID NO: 1464960 - RNA, 13 nt, Pseudomonas aeruginosa PA01
ucgccgcgccgcc

SEQ ID NO: 1464961 - RNA, 24 nt, Pseudomonas aeruginosa PA01
ucgccgcggaaaacgccgcgaagc

SEQ ID NO: 1464962 - RNA, 24 nt, Pseudomonas aeruginosa PA01
ucgccggagucguagcgcgcggcg

SEQ ID NO: 1464963 - RNA, 12 nt, Pseudomonas aeruginosa PA01
ucgccggagggg

SEQ ID NO: 1464964 - RNA, 19 nt, Pseudomonas aeruginosa PA01
ucgccggaggggcggccgc

SEQ ID NO: 1464965 - RNA, 20 nt, Pseudomonas aeruginosa PA01
ucgccggaggggcggccgcc

SEQ ID NO: 1464966 - RNA, 13 nt, Pseudomonas aeruginosa PA01
ucgccgcgcgcca

SEQ ID NO: 1464967 - RNA, 19 nt, Pseudomonas aeruginosa PA01
ucgccgcggacggccggcu

SEQ ID NO: 1464968 - RNA, 11 nt, Pseudomonas aeruginosa PA01
ucgccgcggcg

SEQ ID NO: 1464969 - RNA, 22 nt, Pseudomonas aeruginosa PA01
ucgccgcggcgaagcgcucgac

SEQ ID NO: 1464970 - RNA, 19 nt, Pseudomonas aeruginosa PA01
ucgccggcauuggcacccu

SEQ ID NO: 1464971 - RNA, 12 nt, Pseudomonas aeruginosa PA01
ucgccggccagg

SEQ ID NO: 1464972 - RNA, 19 nt, Pseudomonas aeruginosa PA01
ucgccggccagguagcggc

SEQ ID NO: 1464973 - RNA, 14 nt, Pseudomonas aeruginosa PA01
ucgccggccaggug

SEQ ID NO: 1464974 - RNA, 12 nt, Pseudomonas aeruginosa PA01
ucgccggccagu

SEQ ID NO: 1464975 - RNA, 12 nt, Pseudomonas aeruginosa PA01
ucgccggcagcg

SEQ ID NO: 1464976 - RNA, 13 nt, Pseudomonas aeruginosa PA01
ucgccggcagcgc

SEQ ID NO: 1464977 - RNA, 19 nt, Pseudomonas aeruginosa PA01
ucgccggcagcgccgcgcg

SEQ ID NO: 1464978 - RNA, 22 nt, Pseudomonas aeruginosa PA01
ucgccgggaaacagggcgacgc

SEQ ID NO: 1464979 - RNA, 13 nt, Pseudomonas aeruginosa PA01
ucgccgggaaucg

SEQ ID NO: 1464980 - RNA, 20 nt, Pseudomonas aeruginosa PA01
ucgccgggaaucgccagcag

SEQ ID NO: 1464981 - RNA, 15 nt, Pseudomonas aeruginosa PA01
ucgccggcccgcgcg

SEQ ID NO: 1464982 - RNA, 17 nt, Pseudomonas aeruginosa PA01
ucgccggcccgcgcggc

SEQ ID NO: 1464983 - RNA, 23 nt, Pseudomonas aeruginosa PA01
ucgccggccaguuggugcacgcg

SEQ ID NO: 1464984 - RNA, 23 nt, Pseudomonas aeruginosa PA01
ucgccggguggaacgaggcgacc

SEQ ID NO: 1464985 - RNA, 17 nt, Pseudomonas aeruginosa PA01
ucgccggguugccgcug

SEQ ID NO: 1464986 - RNA, 20 nt, Pseudomonas aeruginosa PA01
ucgccggguugccgcuggcc

SEQ ID NO: 1464987 - RNA, 20 nt, Pseudomonas aeruginosa PA01
ucgccggguuguccaggcga

SEQ ID NO: 1464988 - RNA, 19 nt, Pseudomonas aeruginosa PA01
ucgccgagguugcugcggc

SEQ ID NO: 1464989 - RNA, 15 nt, Pseudomonas aeruginosa PA01
ucgccgaggcggaag

SEQ ID NO: 1464990 - RNA, 22 nt, Pseudomonas aeruginosa PA01
ucgccgaugcgguagucgcugc

SEQ ID NO: 1464991 - RNA, 17 nt, Pseudomonas aeruginosa PA01
ucgccgaucuccuccgc

SEQ ID NO: 1464992 - RNA, 16 nt, Pseudomonas aeruginosa PA01
ucgccgcaccggcgau

SEQ ID NO: 1464993 - RNA, 23 nt, Pseudomonas aeruginosa PA01
ucgccgcaccggcgauggccggc

SEQ ID NO: 1464994 - RNA, 17 nt, Pseudomonas aeruginosa PA01
ucgccgcacaccgcgcg

SEQ ID NO: 1464995 - RNA, 18 nt, Pseudomonas aeruginosa PA01
ucgccgcacaccgcgcgc

SEQ ID NO: 1464996 - RNA, 18 nt, Pseudomonas aeruginosa PA01
ucgccgaugcgccgacgc

SEQ ID NO: 1464997 - RNA, 19 nt, Pseudomonas aeruginosa PA01
ucgccgaugcgccgacgcc

SEQ ID NO: 1464998 - RNA, 14 nt, Pseudomonas aeruginosa PA01
ucgccgccagcuac

SEQ ID NO: 1464999 - RNA, 20 nt, Pseudomonas aeruginosa PA01
ucgccgccagcuaccggcag

SEQ ID NO: 1465000 - RNA, 19 nt, Pseudomonas aeruginosa PA01
ucgccgccaggcagaccug

SEQ ID NO: 1465001 - RNA, 20 nt, Pseudomonas aeruginosa PA01
ucgccgccaggcagaccugc

SEQ ID NO: 1465002 - RNA, 19 nt, Pseudomonas aeruginosa PA01
ucgccgccaguucggccau

SEQ ID NO: 1465003 - RNA, 23 nt, Pseudomonas aeruginosa PA01
ucgccgccaguucggccaucagc

SEQ ID NO: 1465004 - RNA, 13 nt, Pseudomonas aeruginosa PA01
ucgccgccggcca

SEQ ID NO: 1465005 - RNA, 19 nt, Pseudomonas aeruginosa PA01
ucgccgccggccagccgcg

SEQ ID NO: 1465006 - RNA, 20 nt, Pseudomonas aeruginosa PA01
ucgccgccggccagccgcgc

SEQ ID NO: 1465007 - RNA, 14 nt, Pseudomonas aeruginosa PA01
ucgccgccgggcgc

SEQ ID NO: 1465008 - RNA, 15 nt, Pseudomonas aeruginosa PA01
ucgccgccgggcgcg

SEQ ID NO: 1465009 - RNA, 20 nt, Pseudomonas aeruginosa PA01
ucgccgccgggcgcgcgccu

SEQ ID NO: 1465010 - RNA, 22 nt, Pseudomonas aeruginosa PA01
ucgccgccgggcgcgcgccuca

SEQ ID NO: 1465011 - RNA, 17 nt, Pseudomonas aeruginosa PA01
ucgccgccagcgccggc

SEQ ID NO: 1465012 - RNA, 12 nt, Pseudomonas aeruginosa PA01
ucgccgccggcg

SEQ ID NO: 1465013 - RNA, 14 nt, Pseudomonas aeruginosa PA01
ucgccgccggcgaa

SEQ ID NO: 1465014 - RNA, 23 nt, Pseudomonas aeruginosa PA01
ucgccgccguccuguuucugcug

SEQ ID NO: 1465015 - RNA, 17 nt, Pseudomonas aeruginosa PA01
ucgccgccuucggcagg

SEQ ID NO: 1465016 - RNA, 18 nt, Pseudomonas aeruginosa PA01
ucgccgcgagcaccaugc

SEQ ID NO: 1465017 - RNA, 12 nt, Pseudomonas aeruginosa PA01
ucgcgcagggca

SEQ ID NO: 1465018 - RNA, 20 nt, Pseudomonas aeruginosa PA01
ucgcgcagggcagcgcgaua

SEQ ID NO: 1465019 - RNA, 17 nt, Pseudomonas aeruginosa PA01
ucgcgcagcuccucggc

SEQ ID NO: 1465020 - RNA, 14 nt, Pseudomonas aeruginosa PA01
ucgcgcagcucggc

SEQ ID NO: 1465021 - RNA, 20 nt, Pseudomonas aeruginosa PA01
ucgcgcagcucggccaacug

SEQ ID NO: 1465022 - RNA, 13 nt, Pseudomonas aeruginosa PA01
ucgcgcaggcgcu

SEQ ID NO: 1465023 - RNA, 17 nt, Pseudomonas aeruginosa PA01
ucgcgcaggcgcuggcg

SEQ ID NO: 1465024 - RNA, 19 nt, Pseudomonas aeruginosa PA01
ucgcgcaggcgcuggcggg

SEQ ID NO: 1465025 - RNA, 20 nt, Pseudomonas aeruginosa PA01
ucgcgcaggcgggcggcguc

SEQ ID NO: 1465026 - RNA, 14 nt, Pseudomonas aeruginosa PA01
ucgcgcaguucguc

SEQ ID NO: 1465027 - RNA, 19 nt, Pseudomonas aeruginosa PA01
ucgcgcaguucgucuucca

SEQ ID NO: 1465028 - RNA, 22 nt, Pseudomonas aeruginosa PA01
ucgcgcaguucgucuuccagcg

SEQ ID NO: 1465029 - RNA, 22 nt, Pseudomonas aeruginosa PA01
ucgcgcaggugcuuggcaccgc

SEQ ID NO: 1465030 - RNA, 15 nt, Pseudomonas aeruginosa PA01
ucgcgcagggccagg

SEQ ID NO: 1465031 - RNA, 20 nt, Pseudomonas aeruginosa PA01
ucgcgcagggccagggcggc

SEQ ID NO: 1465032 - RNA, 16 nt, Pseudomonas aeruginosa PA01
ucgcgcagcgccucca

SEQ ID NO: 1465033 - RNA, 21 nt, Pseudomonas aeruginosa PA01
ucgcgcacgcuguagaccagc

SEQ ID NO: 1465034 - RNA, 12 nt, Pseudomonas aeruginosa PA01
ucgcgcagcggc

SEQ ID NO: 1465035 - RNA, 15 nt, Pseudomonas aeruginosa PA01
ucgcgcagcggcgga

SEQ ID NO: 1465036 - RNA, 13 nt, Pseudomonas aeruginosa PA01
ucgcgcagcggcu

SEQ ID NO: 1465037 - RNA, 13 nt, Pseudomonas aeruginosa PA01
ucgcgcaccuggc

SEQ ID NO: 1465038 - RNA, 14 nt, Pseudomonas aeruginosa PA01
ucgcgcaccuggcg

SEQ ID NO: 1465039 - RNA, 20 nt, Pseudomonas aeruginosa PA01
ucgcgcaccuggcggucgcc

SEQ ID NO: 1465040 - RNA, 22 nt, Pseudomonas aeruginosa PA01
ucgcgcaccuggcggucgccgc

SEQ ID NO: 1465041 - RNA, 15 nt, Pseudomonas aeruginosa PA01
ucgcgcaccgcggcg

SEQ ID NO: 1465042 - RNA, 19 nt, Pseudomonas aeruginosa PA01
ucgcgcaccgcggcgagcc

SEQ ID NO: 1465043 - RNA, 23 nt, Pseudomonas aeruginosa PA01
ucgcgcacgaggauuuccgcgcc

SEQ ID NO: 1465044 - RNA, 22 nt, Pseudomonas aeruginosa PA01
ucgcgcgggugcggcuggcgcg

SEQ ID NO: 1465045 - RNA, 19 nt, Pseudomonas aeruginosa PA01
ucgcgcgugccccguggcg

SEQ ID NO: 1465046 - RNA, 22 nt, Pseudomonas aeruginosa PA01
ucgcgcgugccccguggcgggc

SEQ ID NO: 1465047 - RNA, 12 nt, Pseudomonas aeruginosa PA01
ucgcgcguggcc

SEQ ID NO: 1465048 - RNA, 16 nt, Pseudomonas aeruginosa PA01
ucgcgccgucgcuggc

SEQ ID NO: 1465049 - RNA, 14 nt, Pseudomonas aeruginosa PA01
ucgcgccgagcugg

SEQ ID NO: 1465050 - RNA, 13 nt, Pseudomonas aeruginosa PA01
ucgcgccgacgac

SEQ ID NO: 1465051 - RNA, 18 nt, Pseudomonas aeruginosa PA01
ucgcgcaucgcggacacc

SEQ ID NO: 1465052 - RNA, 15 nt, Pseudomonas aeruginosa PA01
ucgcgcaugaucgcc

SEQ ID NO: 1465053 - RNA, 22 nt, Pseudomonas aeruginosa PA01
ucgcgccgcccggcucgccgcc

SEQ ID NO: 1465054 - RNA, 14 nt, Pseudomonas aeruginosa PA01
ucgcgccgcgccag

SEQ ID NO: 1465055 - RNA, 20 nt, Pseudomonas aeruginosa PA01
ucgcgccgcgccagcaggcg

SEQ ID NO: 1465056 - RNA, 23 nt, Pseudomonas aeruginosa PA01
ucgccgguaaugaaaagccccgc

SEQ ID NO: 1465057 - RNA, 19 nt, Pseudomonas aeruginosa PA01
ucgccggucaggcugcggc

SEQ ID NO: 1465058 - RNA, 15 nt, Pseudomonas aeruginosa PA01
ucgccgggucgccgc

SEQ ID NO: 1465059 - RNA, 16 nt, Pseudomonas aeruginosa PA01
ucgccgggucgccgca

SEQ ID NO: 1465060 - RNA, 14 nt, Pseudomonas aeruginosa PA01
ucgccgucaccgcg

SEQ ID NO: 1465061 - RNA, 15 nt, Pseudomonas aeruginosa PA01
ucgccgucagacgcg

SEQ ID NO: 1465062 - RNA, 16 nt, Pseudomonas aeruginosa PA01
ucgccguacagcaggc

SEQ ID NO: 1465063 - RNA, 17 nt, Pseudomonas aeruginosa PA01
ucgccguacagcaggca

SEQ ID NO: 1465064 - RNA, 20 nt, Pseudomonas aeruginosa PA01
ucgccggugaggaugcggau

SEQ ID NO: 1465065 - RNA, 22 nt, Pseudomonas aeruginosa PA01
ucgccggugaggaugcggaugu

SEQ ID NO: 1465066 - RNA, 17 nt, Pseudomonas aeruginosa PA01
ucgcgacugccgucggc

SEQ ID NO: 1465067 - RNA, 18 nt, Pseudomonas aeruginosa PA01
ucgcgacugccgucggcg

SEQ ID NO: 1465068 - RNA, 17 nt, Pseudomonas aeruginosa PA01
ucgcgagguuccgcggc

SEQ ID NO: 1465069 - RNA, 18 nt, Pseudomonas aeruginosa PA01
ucgcgagguuccgcggcg

SEQ ID NO: 1465070 - RNA, 20 nt, Pseudomonas aeruginosa PA01
ucgcgagguuccgcggcgac

SEQ ID NO: 1465071 - RNA, 20 nt, Pseudomonas aeruginosa PA01
ucgcgagauggcgucgaucc

SEQ ID NO: 1465072 - RNA, 21 nt, Pseudomonas aeruginosa PA01
ucgcgagauggcgucgauccc

SEQ ID NO: 1465073 - RNA, 13 nt, Pseudomonas aeruginosa PA01
ucgcgagcagggc

SEQ ID NO: 1465074 - RNA, 18 nt, Pseudomonas aeruginosa PA01
ucgcgagcagggcgaugc

SEQ ID NO: 1465075 - RNA, 12 nt, Pseudomonas aeruginosa PA01
ucgcgacgguga

SEQ ID NO: 1465076 - RNA, 16 nt, Pseudomonas aeruginosa PA01
ucgcgcacaugccgag

SEQ ID NO: 1465077 - RNA, 18 nt, Pseudomonas aeruginosa PA01
ucgcgcacaugccgagcg

SEQ ID NO: 1465078 - RNA, 19 nt, Pseudomonas aeruginosa PA01
ucgcgcacaugccgagcga

SEQ ID NO: 1465079 - RNA, 17 nt, Pseudomonas aeruginosa PA01
ucgcgauagacgccggc

SEQ ID NO: 1465080 - RNA, 14 nt, Pseudomonas aeruginosa PA01
ucgcgcaccgcggc

SEQ ID NO: 1465081 - RNA, 17 nt, Pseudomonas aeruginosa PA01
ucgcgcaccgcggccag

SEQ ID NO: 1465082 - RNA, 18 nt, Pseudomonas aeruginosa PA01
ucgcgcaccgcggccagu

SEQ ID NO: 1465083 - RNA, 12 nt, Pseudomonas aeruginosa PA01
ucgcggcggcag

SEQ ID NO: 1465084 - RNA, 20 nt, Pseudomonas aeruginosa PA01
ucgcggcgcuuguagcccag

SEQ ID NO: 1465085 - RNA, 12 nt, Pseudomonas aeruginosa PA01
ucgcggcgcgag

SEQ ID NO: 1465086 - RNA, 20 nt, Pseudomonas aeruginosa PA01
ucgcggcuuucuuccagcac

SEQ ID NO: 1465087 - RNA, 16 nt, Pseudomonas aeruginosa PA01
ucgcggcugcgcgccg

SEQ ID NO: 1465088 - RNA, 21 nt, Pseudomonas aeruginosa PA01
ucgcggcugcgcgccgggucg

SEQ ID NO: 1465089 - RNA, 14 nt, Pseudomonas aeruginosa PA01
ucgcggcuggccgc

SEQ ID NO: 1465090 - RNA, 16 nt, Pseudomonas aeruginosa PA01
ucgcggcucuggcgca

SEQ ID NO: 1465091 - RNA, 12 nt, Pseudomonas aeruginosa PA01
ucgcggcugaag

SEQ ID NO: 1465092 - RNA, 14 nt, Pseudomonas aeruginosa PA01
ucgcggcugaaggc

SEQ ID NO: 1465093 - RNA, 12 nt, Pseudomonas aeruginosa PA01
ucgcggcguagg

SEQ ID NO: 1465094 - RNA, 17 nt, Pseudomonas aeruginosa PA01
ucgcggcguaggcgcgc

SEQ ID NO: 1465095 - RNA, 19 nt, Pseudomonas aeruginosa PA01
ucgcggccucuucgucggc

SEQ ID NO: 1465096 - RNA, 21 nt, Pseudomonas aeruginosa PA01
ucgcggccucuucgucggcga

SEQ ID NO: 1465097 - RNA, 22 nt, Pseudomonas aeruginosa PA01
ucgcggccucuucgucggcgaa

SEQ ID NO: 1465098 - RNA, 17 nt, Pseudomonas aeruginosa PA01
ucgcggccaucggcgaa

SEQ ID NO: 1465099 - RNA, 15 nt, Pseudomonas aeruginosa PA01
ucgcggauguucacc

SEQ ID NO: 1465100 - RNA, 14 nt, Pseudomonas aeruginosa PA01
ucgcggcaggcggc

SEQ ID NO: 1465101 - RNA, 17 nt, Pseudomonas aeruginosa PA01
ucgcggaaguaggcggc

SEQ ID NO: 1465102 - RNA, 14 nt, Pseudomonas aeruginosa PA01
ucgcggaagucggc

SEQ ID NO: 1465103 - RNA, 21 nt, Pseudomonas aeruginosa PA01
ucgcggaagucggcggguccg

SEQ ID NO: 1465104 - RNA, 16 nt, Pseudomonas aeruginosa PA01
ucgcgcugguugccca

SEQ ID NO: 1465105 - RNA, 18 nt, Pseudomonas aeruginosa PA01
ucgcgcugguugcccagg

SEQ ID NO: 1465106 - RNA, 15 nt, Pseudomonas aeruginosa PA01
ucgcgcuucucgacg

SEQ ID NO: 1465107 - RNA, 19 nt, Pseudomonas aeruginosa PA01
ucgcgcuucucgacguagg

SEQ ID NO: 1465108 - RNA, 18 nt, Pseudomonas aeruginosa PA01
ucgcgcuuguugaucacc

SEQ ID NO: 1465109 - RNA, 15 nt, Pseudomonas aeruginosa PA01
ucgcggagcuggaaa

SEQ ID NO: 1465110 - RNA, 17 nt, Pseudomonas aeruginosa PA01
ucgcggaucucaggacc

SEQ ID NO: 1465111 - RNA, 18 nt, Pseudomonas aeruginosa PA01
ucgcggaccucgggcagc

SEQ ID NO: 1465112 - RNA, 14 nt, Pseudomonas aeruginosa PA01
ucgcggacgccgaa

SEQ ID NO: 1465113 - RNA, 18 nt, Pseudomonas aeruginosa PA01
ucgcggacgcuggcgauc

SEQ ID NO: 1465114 - RNA, 14 nt, Pseudomonas aeruginosa PA01
ucgcggaccagcuc

SEQ ID NO: 1465115 - RNA, 15 nt, Pseudomonas aeruginosa PA01
ucgcggaccagcucc

SEQ ID NO: 1465116 - RNA, 21 nt, Pseudomonas aeruginosa PA01
ucgcggacuccggaggcgcac

SEQ ID NO: 1465117 - RNA, 24 nt, Pseudomonas aeruginosa PA01
ucgcggacuccggaggcgcacagg

SEQ ID NO: 1465118 - RNA, 20 nt, Pseudomonas aeruginosa PA01
ucgcggagaauccgcucggu

SEQ ID NO: 1465119 - RNA, 14 nt, Pseudomonas aeruginosa PA01
ucgcggaccuccag

SEQ ID NO: 1465120 - RNA, 17 nt, Pseudomonas aeruginosa PA01
ucgcggaccuccagccg

SEQ ID NO: 1465121 - RNA, 17 nt, Pseudomonas aeruginosa PA01
ucgcgcucagcgcgagg

SEQ ID NO: 1465122 - RNA, 13 nt, Pseudomonas aeruginosa PA01
ucgcgcucaggcg

SEQ ID NO: 1465123 - RNA, 15 nt, Pseudomonas aeruginosa PA01
ucgcgcucaggcgca

SEQ ID NO: 1465124 - RNA, 20 nt, Pseudomonas aeruginosa PA01
ucgcgcucaggcgcagcguc

SEQ ID NO: 1465125 - RNA, 14 nt, Pseudomonas aeruginosa PA01
ucgcgcuccaggcc

SEQ ID NO: 1465126 - RNA, 14 nt, Pseudomonas aeruginosa PA01
ucgcgcucggcgag

SEQ ID NO: 1465127 - RNA, 16 nt, Pseudomonas aeruginosa PA01
ucgcgcucggcggccu

SEQ ID NO: 1465128 - RNA, 14 nt, Pseudomonas aeruginosa PA01
ucgcgcuggacccg

SEQ ID NO: 1465129 - RNA, 22 nt, Pseudomonas aeruginosa PA01
ucgcgcuggacccgcaccugga

SEQ ID NO: 1465130 - RNA, 13 nt, Pseudomonas aeruginosa PA01
ucgcgcuggaccu

SEQ ID NO: 1465131 - RNA, 14 nt, Pseudomonas aeruginosa PA01
ucgcgcuggaccug

SEQ ID NO: 1465132 - RNA, 23 nt, Pseudomonas aeruginosa PA01
ucgcgcuggaccuggccggcgac

SEQ ID NO: 1465133 - RNA, 13 nt, Pseudomonas aeruginosa PA01
ucgcgcuggccag

SEQ ID NO: 1465134 - RNA, 13 nt, Pseudomonas aeruginosa PA01
ucgcgcucuggcc

SEQ ID NO: 1465135 - RNA, 14 nt, Pseudomonas aeruginosa PA01
ucgcgcugcccggc

SEQ ID NO: 1465136 - RNA, 15 nt, Pseudomonas aeruginosa PA01
ucgcgcugcccggcg

SEQ ID NO: 1465137 - RNA, 19 nt, Pseudomonas aeruginosa PA01
ucgcgcugcccggcgcgac

SEQ ID NO: 1465138 - RNA, 18 nt, Pseudomonas aeruginosa PA01
ucggaaagcagggcgaug

SEQ ID NO: 1465139 - RNA, 19 nt, Pseudomonas aeruginosa PA01
ucggaaagcagggcgaugg

SEQ ID NO: 1465140 - RNA, 21 nt, Pseudomonas aeruginosa PA01
ucggaaagcagggcgauggcc

SEQ ID NO: 1465141 - RNA, 16 nt, Pseudomonas aeruginosa PA01
ucgcuguccuccagcg

SEQ ID NO: 1465142 - RNA, 16 nt, Pseudomonas aeruginosa PA01
ucgcugucgucggcgc

SEQ ID NO: 1465143 - RNA, 13 nt, Pseudomonas aeruginosa PA01
ucgcugucgccga

SEQ ID NO: 1465144 - RNA, 13 nt, Pseudomonas aeruginosa PA01
ucggaagaucgcc

SEQ ID NO: 1465145 - RNA, 18 nt, Pseudomonas aeruginosa PA01
ucggaagaucgcccgccu

SEQ ID NO: 1465146 - RNA, 16 nt, Pseudomonas aeruginosa PA01
ucggacaagggccaga

SEQ ID NO: 1465147 - RNA, 20 nt, Pseudomonas aeruginosa PA01
ucggagugaggccgagccga

SEQ ID NO: 1465148 - RNA, 16 nt, Pseudomonas aeruginosa PA01
ucggagugcaugccgg

SEQ ID NO: 1465149 - RNA, 21 nt, Pseudomonas aeruginosa PA01
ucggauacggcaggguagcca

SEQ ID NO: 1465150 - RNA, 22 nt, Pseudomonas aeruginosa PA01
ucggauaccagaucaccaccac

SEQ ID NO: 1465151 - RNA, 12 nt, Pseudomonas aeruginosa PA01
ucggauccggac

SEQ ID NO: 1465152 - RNA, 21 nt, Pseudomonas aeruginosa PA01
ucggagauagccuccuccggc

SEQ ID NO: 1465153 - RNA, 22 nt, Pseudomonas aeruginosa PA01
ucggagagcagccaagccacca

SEQ ID NO: 1465154 - RNA, 17 nt, Pseudomonas aeruginosa PA01
ucgcugcccucgaccag

SEQ ID NO: 1465155 - RNA, 16 nt, Pseudomonas aeruginosa PA01
ucgcugccgccgcaga

SEQ ID NO: 1465156 - RNA, 12 nt, Pseudomonas aeruginosa PA01
ucgcugccgccg

SEQ ID NO: 1465157 - RNA, 21 nt, Pseudomonas aeruginosa PA01
ucgcugagcaguugcgggcgc

SEQ ID NO: 1465158 - RNA, 22 nt, Pseudomonas aeruginosa PA01
ucgcugagcaguugcgggcgca

SEQ ID NO: 1465159 - RNA, 19 nt, Pseudomonas aeruginosa PA01
ucgcugacuuccaucagcu

SEQ ID NO: 1465160 - RNA, 20 nt, Pseudomonas aeruginosa PA01
ucgcuggcaccggccaggcg

SEQ ID NO: 1465161 - RNA, 12 nt, Pseudomonas aeruginosa PA01
ucgcuggccagc

SEQ ID NO: 1465162 - RNA, 22 nt, Pseudomonas aeruginosa PA01
ucgcuggccugggguagccggc

SEQ ID NO: 1465163 - RNA, 13 nt, Pseudomonas aeruginosa PA01
ucgcuggcgaugu

SEQ ID NO: 1465164 - RNA, 18 nt, Pseudomonas aeruginosa PA01
ucgcuggcgcagccgcug

SEQ ID NO: 1465165 - RNA, 15 nt, Pseudomonas aeruginosa PA01
ucgcugggcgccucg

SEQ ID NO: 1465166 - RNA, 18 nt, Pseudomonas aeruginosa PA01
ucgcugggcgccucgucg

SEQ ID NO: 1465167 - RNA, 13 nt, Pseudomonas aeruginosa PA01
ucgcuggcggaga

SEQ ID NO: 1465168 - RNA, 16 nt, Pseudomonas aeruginosa PA01
ucgcuggcgucgaccg

SEQ ID NO: 1465169 - RNA, 18 nt, Pseudomonas aeruginosa PA01
ucgcuggcgucgaccgcc

SEQ ID NO: 1465170 - RNA, 20 nt, Pseudomonas aeruginosa PA01
ucgcuguagcggcucgccga

SEQ ID NO: 1465171 - RNA, 21 nt, Pseudomonas aeruginosa PA01
ucgcugaccggccgcagcagg

SEQ ID NO: 1465172 - RNA, 18 nt, Pseudomonas aeruginosa PA01
ucgcugaccagcccggcg

SEQ ID NO: 1465173 - RNA, 20 nt, Pseudomonas aeruginosa PA01
ucgcugaccagcccggcggc

SEQ ID NO: 1465174 - RNA, 22 nt, Pseudomonas aeruginosa PA01
ucgcugaccagcccggcggcgg

SEQ ID NO: 1465175 - RNA, 21 nt, Pseudomonas aeruginosa PA01
ucgcugacccaggcuucggcg

SEQ ID NO: 1465176 - RNA, 19 nt, Pseudomonas aeruginosa PA01
ucgcggggcuuuccgucuc

SEQ ID NO: 1465177 - RNA, 21 nt, Pseudomonas aeruginosa PA01
ucgcggggcuuuucauuaccg

SEQ ID NO: 1465178 - RNA, 17 nt, Pseudomonas aeruginosa PA01
ucgcgggcuaccaggaa

SEQ ID NO: 1465179 - RNA, 13 nt, Pseudomonas aeruginosa PA01
ucgcgggcgaugg

SEQ ID NO: 1465180 - RNA, 17 nt, Pseudomonas aeruginosa PA01
ucgcgggcgacgugggc

SEQ ID NO: 1465181 - RNA, 18 nt, Pseudomonas aeruginosa PA01
ucgcgggccaggccgagc

SEQ ID NO: 1465182 - RNA, 19 nt, Pseudomonas aeruginosa PA01
ucgcgggccaggccgagcg

SEQ ID NO: 1465183 - RNA, 13 nt, Pseudomonas aeruginosa PA01
ucgcgggccgccu

SEQ ID NO: 1465184 - RNA, 14 nt, Pseudomonas aeruginosa PA01
ucgcgggccgcggc

SEQ ID NO: 1465185 - RNA, 14 nt, Pseudomonas aeruginosa PA01
ucgcgggccugggc

SEQ ID NO: 1465186 - RNA, 15 nt, Pseudomonas aeruginosa PA01
ucgcgggccugggca

SEQ ID NO: 1465187 - RNA, 17 nt, Pseudomonas aeruginosa PA01
ucgcgggccugggcauc

SEQ ID NO: 1465188 - RNA, 16 nt, Pseudomonas aeruginosa PA01
ucggcaguggugaucc

SEQ ID NO: 1465189 - RNA, 15 nt, Pseudomonas aeruginosa PA01
ucggcagucgccgca

SEQ ID NO: 1465190 - RNA, 14 nt, Pseudomonas aeruginosa PA01
ucggcaucgcguag

SEQ ID NO: 1465191 - RNA, 15 nt, Pseudomonas aeruginosa PA01
ucggcaucgcguagg

SEQ ID NO: 1465192 - RNA, 20 nt, Pseudomonas aeruginosa PA01
ucggcauccaguucguucug

SEQ ID NO: 1465193 - RNA, 15 nt, Pseudomonas aeruginosa PA01
ucggcauccggcagg

SEQ ID NO: 1465194 - RNA, 20 nt, Pseudomonas aeruginosa PA01
ucggcaucgaccagggccgg

SEQ ID NO: 1465195 - RNA, 23 nt, Pseudomonas aeruginosa PA01
ucggcaucgaccagggccggguc

SEQ ID NO: 1465196 - RNA, 19 nt, Pseudomonas aeruginosa PA01
ucggcaggcugcaucggcu

SEQ ID NO: 1465197 - RNA, 13 nt, Pseudomonas aeruginosa PA01
ucggcaggcuggc

SEQ ID NO: 1465198 - RNA, 19 nt, Pseudomonas aeruginosa PA01
ucggcagcucgcuaugcag

SEQ ID NO: 1465199 - RNA, 23 nt, Pseudomonas aeruginosa PA01
ucggcagcucgcuaugcagcagg

SEQ ID NO: 1465200 - RNA, 16 nt, Pseudomonas aeruginosa PA01
ucggcaguacgcucug

SEQ ID NO: 1465201 - RNA, 17 nt, Pseudomonas aeruginosa PA01
ucggcagggcgcccgcc

SEQ ID NO: 1465202 - RNA, 19 nt, Pseudomonas aeruginosa PA01
ucggcagggcgcccgcccg

SEQ ID NO: 1465203 - RNA, 22 nt, Pseudomonas aeruginosa PA01
ucggcagggcgcccgcccggca

SEQ ID NO: 1465204 - RNA, 15 nt, Pseudomonas aeruginosa PA01
ucggcagggcgccga

SEQ ID NO: 1465205 - RNA, 20 nt, Pseudomonas aeruginosa PA01
ucggcagggcgccgaccagc

SEQ ID NO: 1465206 - RNA, 16 nt, Pseudomonas aeruginosa PA01
ucggcagccguccgcc

SEQ ID NO: 1465207 - RNA, 18 nt, Pseudomonas aeruginosa PA01
ucggcagccguccgccca

SEQ ID NO: 1465208 - RNA, 23 nt, Pseudomonas aeruginosa PA01
ucggcagccaucgcauagccggc

SEQ ID NO: 1465209 - RNA, 19 nt, Pseudomonas aeruginosa PA01
ucggcagcagcuugccggc

SEQ ID NO: 1465210 - RNA, 15 nt, Pseudomonas aeruginosa PA01
ucggcagcaucagcc

SEQ ID NO: 1465211 - RNA, 18 nt, Pseudomonas aeruginosa PA01
ucggcagcaucagccgcg

SEQ ID NO: 1465212 - RNA, 18 nt, Pseudomonas aeruginosa PA01
ucggcagcgucgagcugg

SEQ ID NO: 1465213 - RNA, 22 nt, Pseudomonas aeruginosa PA01
ucggcagcgucgagcuggcgca

SEQ ID NO: 1465214 - RNA, 13 nt, Pseudomonas aeruginosa PA01
ucggcagcgcugg

SEQ ID NO: 1465215 - RNA, 15 nt, Pseudomonas aeruginosa PA01
ucggcagcgcuggcg

SEQ ID NO: 1465216 - RNA, 21 nt, Pseudomonas aeruginosa PA01
ucggcagcgcuggcgaucacc

SEQ ID NO: 1465217 - RNA, 12 nt, Pseudomonas aeruginosa PA01
ucggcagcgccu

SEQ ID NO: 1465218 - RNA, 19 nt, Pseudomonas aeruginosa PA01
ucggcagcgccucggcggc

SEQ ID NO: 1465219 - RNA, 20 nt, Pseudomonas aeruginosa PA01
ucggcagcgccucggcggcg

SEQ ID NO: 1465220 - RNA, 15 nt, Pseudomonas aeruginosa PA01
ucggaugcagcgcuu

SEQ ID NO: 1465221 - RNA, 16 nt, Pseudomonas aeruginosa PA01
ucggaugcagcgcuug

SEQ ID NO: 1465222 - RNA, 15 nt, Pseudomonas aeruginosa PA01
ucggaugccgcacag

SEQ ID NO: 1465223 - RNA, 18 nt, Pseudomonas aeruginosa PA01
ucggcccgacgccgcccg

SEQ ID NO: 1465224 - RNA, 20 nt, Pseudomonas aeruginosa PA01
ucggcccgacgccgcccggc

SEQ ID NO: 1465225 - RNA, 15 nt, Pseudomonas aeruginosa PA01
ucggccccggccagg

SEQ ID NO: 1465226 - RNA, 16 nt, Pseudomonas aeruginosa PA01
ucggccccaccuggcg

SEQ ID NO: 1465227 - RNA, 18 nt, Pseudomonas aeruginosa PA01
ucggccccaccuggcgac

SEQ ID NO: 1465228 - RNA, 17 nt, Pseudomonas aeruginosa PA01
ucggccccaggaaggag

SEQ ID NO: 1465229 - RNA, 20 nt, Pseudomonas aeruginosa PA01
ucggcccgcaugaacgccuc

SEQ ID NO: 1465230 - RNA, 12 nt, Pseudomonas aeruginosa PA01
ucggcccgcugg

SEQ ID NO: 1465231 - RNA, 17 nt, Pseudomonas aeruginosa PA01
ucggcccggagaccgug

SEQ ID NO: 1465232 - RNA, 20 nt, Pseudomonas aeruginosa PA01
ucggcccggagaccgugccg

SEQ ID NO: 1465233 - RNA, 19 nt, Pseudomonas aeruginosa PA01
ucggccgggauacagcagc

SEQ ID NO: 1465234 - RNA, 22 nt, Pseudomonas aeruginosa PA01
ucggccggggucaggccgaggc

SEQ ID NO: 1465235 - RNA, 23 nt, Pseudomonas aeruginosa PA01
ucggccggggucaggccgaggcg

SEQ ID NO: 1465236 - RNA, 13 nt, Pseudomonas aeruginosa PA01
ucggccggcagcu

SEQ ID NO: 1465237 - RNA, 19 nt, Pseudomonas aeruginosa PA01
ucggccggcagcuccggcg

SEQ ID NO: 1465238 - RNA, 20 nt, Pseudomonas aeruginosa PA01
ucggcccgggcgccaccgcg

SEQ ID NO: 1465239 - RNA, 13 nt, Pseudomonas aeruginosa PA01
ucggccgcugccg

SEQ ID NO: 1465240 - RNA, 12 nt, Pseudomonas aeruginosa PA01
ucggcccagcag

SEQ ID NO: 1465241 - RNA, 24 nt, Pseudomonas aeruginosa PA01
ucggcccaugaaaaagcccggccu

SEQ ID NO: 1465242 - RNA, 16 nt, Pseudomonas aeruginosa PA01
ucggccaugccggcca

SEQ ID NO: 1465243 - RNA, 17 nt, Pseudomonas aeruginosa PA01
ucggccauggccgagcc

SEQ ID NO: 1465244 - RNA, 13 nt, Pseudomonas aeruginosa PA01
ucggccauggcau

SEQ ID NO: 1465245 - RNA, 13 nt, Pseudomonas aeruginosa PA01
ucggccagcggca

SEQ ID NO: 1465246 - RNA, 14 nt, Pseudomonas aeruginosa PA01
ucggccaucgccgu

SEQ ID NO: 1465247 - RNA, 15 nt, Pseudomonas aeruginosa PA01
ucggccagcgcggcg

SEQ ID NO: 1465248 - RNA, 17 nt, Pseudomonas aeruginosa PA01
ucggccagcgcggcgcg

SEQ ID NO: 1465249 - RNA, 15 nt, Pseudomonas aeruginosa PA01
ucggccagcgccgcc

SEQ ID NO: 1465250 - RNA, 16 nt, Pseudomonas aeruginosa PA01
ucggccagcgccgccg

SEQ ID NO: 1465251 - RNA, 12 nt, Pseudomonas aeruginosa PA01
ucggccagcgcg

SEQ ID NO: 1465252 - RNA, 13 nt, Pseudomonas aeruginosa PA01
ucggccagccagg

SEQ ID NO: 1465253 - RNA, 16 nt, Pseudomonas aeruginosa PA01
ucggccagccagggca

SEQ ID NO: 1465254 - RNA, 20 nt, Pseudomonas aeruginosa PA01
ucggccagccagggcagcag

SEQ ID NO: 1465255 - RNA, 12 nt, Pseudomonas aeruginosa PA01
ucggccagccag

SEQ ID NO: 1465256 - RNA, 16 nt, Pseudomonas aeruginosa PA01
ucggccagccccugcg

SEQ ID NO: 1465257 - RNA, 15 nt, Pseudomonas aeruginosa PA01
ucggcgggcaccgcc

SEQ ID NO: 1465258 - RNA, 19 nt, Pseudomonas aeruginosa PA01
ucggcgggcaccgccagcc

SEQ ID NO: 1465259 - RNA, 21 nt, Pseudomonas aeruginosa PA01
ucggcgggcaccgccagcccg

SEQ ID NO: 1465260 - RNA, 17 nt, Pseudomonas aeruginosa PA01
ucggcgggaucgacgcc

SEQ ID NO: 1465261 - RNA, 18 nt, Pseudomonas aeruginosa PA01
ucggcgggaacgccgggc

SEQ ID NO: 1465262 - RNA, 19 nt, Pseudomonas aeruginosa PA01
ucggcgggaacgccgggca

SEQ ID NO: 1465263 - RNA, 15 nt, Pseudomonas aeruginosa PA01
ucggcggcgugcagg

SEQ ID NO: 1465264 - RNA, 14 nt, Pseudomonas aeruginosa PA01
ucggcggccucggc

SEQ ID NO: 1465265 - RNA, 18 nt, Pseudomonas aeruginosa PA01
ucggcggcgccuucgccg

SEQ ID NO: 1465266 - RNA, 21 nt, Pseudomonas aeruginosa PA01
ucggcggcgccuucgccggaa

SEQ ID NO: 1465267 - RNA, 15 nt, Pseudomonas aeruginosa PA01
ucggcggcgagcgcc

SEQ ID NO: 1465268 - RNA, 22 nt, Pseudomonas aeruginosa PA01
ucggcggcgagcgccgcggcga

SEQ ID NO: 1465269 - RNA, 19 nt, Pseudomonas aeruginosa PA01
ucggcggcgccggugaggc

SEQ ID NO: 1465270 - RNA, 22 nt, Pseudomonas aeruginosa PA01
ucggcggcgccggugaggcgca

SEQ ID NO: 1465271 - RNA, 21 nt, Pseudomonas aeruginosa PA01
ucggcggcgguucgccgagcg

SEQ ID NO: 1465272 - RNA, 13 nt, Pseudomonas aeruginosa PA01
ucggcggcgcgca

SEQ ID NO: 1465273 - RNA, 16 nt, Pseudomonas aeruginosa PA01
ucggcggcgcgcagcg

SEQ ID NO: 1465274 - RNA, 15 nt, Pseudomonas aeruginosa PA01
ucggcggcgcggcgu

SEQ ID NO: 1465275 - RNA, 19 nt, Pseudomonas aeruginosa PA01
ucggcgguggggccgccga

SEQ ID NO: 1465276 - RNA, 23 nt, Pseudomonas aeruginosa PA01
ucggcguagugcuggguggaggc

SEQ ID NO: 1465277 - RNA, 14 nt, Pseudomonas aeruginosa PA01
ucggcguagccggc

SEQ ID NO: 1465278 - RNA, 16 nt, Pseudomonas aeruginosa PA01
ucggcguagccggcca

SEQ ID NO: 1465279 - RNA, 17 nt, Pseudomonas aeruginosa PA01
ucggcguagccggccag

SEQ ID NO: 1465280 - RNA, 19 nt, Pseudomonas aeruginosa PA01
ucggcguagccggcgaucc

SEQ ID NO: 1465281 - RNA, 15 nt, Pseudomonas aeruginosa PA01
ucggcggugaccgga

SEQ ID NO: 1465282 - RNA, 18 nt, Pseudomonas aeruginosa PA01
ucggcgggugugguccgc

SEQ ID NO: 1465283 - RNA, 13 nt, Pseudomonas aeruginosa PA01
ucggcggucaggu

SEQ ID NO: 1465284 - RNA, 18 nt, Pseudomonas aeruginosa PA01
ucggcggucucgaacgcc

SEQ ID NO: 1465285 - RNA, 13 nt, Pseudomonas aeruginosa PA01
ucggcgguccagg

SEQ ID NO: 1465286 - RNA, 20 nt, Pseudomonas aeruginosa PA01
ucggcggggcgcaccgccuc

SEQ ID NO: 1465287 - RNA, 23 nt, Pseudomonas aeruginosa PA01
ucggcggggcgcaccgccucgac

SEQ ID NO: 1465288 - RNA, 18 nt, Pseudomonas aeruginosa PA01
ucggcggggcgcagcagg

SEQ ID NO: 1465289 - RNA, 19 nt, Pseudomonas aeruginosa PA01
ucggcggggcgcagcagga

SEQ ID NO: 1465290 - RNA, 23 nt, Pseudomonas aeruginosa PA01
ucggcggggcuuuuuuucgccug

SEQ ID NO: 1465291 - RNA, 15 nt, Pseudomonas aeruginosa PA01
ucggcgugccgggcc

SEQ ID NO: 1465292 - RNA, 23 nt, Pseudomonas aeruginosa PA01
ucggcgugcugggucuccuccuc

SEQ ID NO: 1465293 - RNA, 17 nt, Pseudomonas aeruginosa PA01
ucggcgucuucggcggc

SEQ ID NO: 1465294 - RNA, 18 nt, Pseudomonas aeruginosa PA01
ucggcgugcauggccggg

SEQ ID NO: 1465295 - RNA, 20 nt, Pseudomonas aeruginosa PA01
ucggcgugcauggccgggcc

SEQ ID NO: 1465296 - RNA, 17 nt, Pseudomonas aeruginosa PA01
ucggcguucaccgcgca

SEQ ID NO: 1465297 - RNA, 17 nt, Pseudomonas aeruginosa PA01
ucggcuccagcaccagc

SEQ ID NO: 1465298 - RNA, 19 nt, Pseudomonas aeruginosa PA01
ucggcuccagcaccagcac

SEQ ID NO: 1465299 - RNA, 23 nt, Pseudomonas aeruginosa PA01
ucggcuccagcaccagcacgccc

SEQ ID NO: 1465300 - RNA, 15 nt, Pseudomonas aeruginosa PA01
ucggcuccagccagg

SEQ ID NO: 1465301 - RNA, 22 nt, Pseudomonas aeruginosa PA01
ucggcguugcugaucgcuccgc

SEQ ID NO: 1465302 - RNA, 17 nt, Pseudomonas aeruginosa PA01
ucggcguuguccaggcu

SEQ ID NO: 1465303 - RNA, 22 nt, Pseudomonas aeruginosa PA01
ucggcguuuagcgcccgacggc

SEQ ID NO: 1465304 - RNA, 15 nt, Pseudomonas aeruginosa PA01
ucggcuaaccgccuu

SEQ ID NO: 1465305 - RNA, 18 nt, Pseudomonas aeruginosa PA01
ucggcuaaccgccuucgc

SEQ ID NO: 1465306 - RNA, 22 nt, Pseudomonas aeruginosa PA01
ucggcguaggccaguucgcuga

SEQ ID NO: 1465307 - RNA, 15 nt, Pseudomonas aeruginosa PA01
ucggcguccauggcg

SEQ ID NO: 1465308 - RNA, 13 nt, Pseudomonas aeruginosa PA01
ucggcgucgaagu

SEQ ID NO: 1465309 - RNA, 15 nt, Pseudomonas aeruginosa PA01
ucggcguccagcagg

SEQ ID NO: 1465310 - RNA, 14 nt, Pseudomonas aeruginosa PA01
ucggcguccgcggc

SEQ ID NO: 1465311 - RNA, 15 nt, Pseudomonas aeruginosa PA01
ucggcguccgcggcc

SEQ ID NO: 1465312 - RNA, 18 nt, Pseudomonas aeruginosa PA01
ucggcguccgcggccugc

SEQ ID NO: 1465313 - RNA, 24 nt, Pseudomonas aeruginosa PA01
ucggcgucgaaguuggaaggaucg

SEQ ID NO: 1465314 - RNA, 21 nt, Pseudomonas aeruginosa PA01
ucggcgucgggcagggcaucc

SEQ ID NO: 1465315 - RNA, 15 nt, Pseudomonas aeruginosa PA01
ucggcgucgcgcagg

SEQ ID NO: 1465316 - RNA, 19 nt, Pseudomonas aeruginosa PA01
ucggcgucuggggugaggc

SEQ ID NO: 1465317 - RNA, 19 nt, Pseudomonas aeruginosa PA01
ucggcggccgggucgaggu

SEQ ID NO: 1465318 - RNA, 15 nt, Pseudomonas aeruginosa PA01
ucggcggccgccuug

SEQ ID NO: 1465319 - RNA, 12 nt, Pseudomonas aeruginosa PA01
ucggcggccucg

SEQ ID NO: 1465320 - RNA, 13 nt, Pseudomonas aeruginosa PA01
ucggcggccucgc

SEQ ID NO: 1465321 - RNA, 14 nt, Pseudomonas aeruginosa PA01
ucggcggccucgcg

SEQ ID NO: 1465322 - RNA, 14 nt, Pseudomonas aeruginosa PA01
ucggcggcagcugc

SEQ ID NO: 1465323 - RNA, 15 nt, Pseudomonas aeruginosa PA01
ucggcggcagcugcg

SEQ ID NO: 1465324 - RNA, 14 nt, Pseudomonas aeruginosa PA01
ucggcggcaggccg

SEQ ID NO: 1465325 - RNA, 18 nt, Pseudomonas aeruginosa PA01
ucggcggcaggcgcauca

SEQ ID NO: 1465326 - RNA, 23 nt, Pseudomonas aeruginosa PA01
ucggcggcaggcugcgccgcugc

SEQ ID NO: 1465327 - RNA, 21 nt, Pseudomonas aeruginosa PA01
ucggcggauaaacggcaugca

SEQ ID NO: 1465328 - RNA, 14 nt, Pseudomonas aeruginosa PA01
ucggcggauaacgc

SEQ ID NO: 1465329 - RNA, 17 nt, Pseudomonas aeruginosa PA01
ucggcggauaacgccgc

SEQ ID NO: 1465330 - RNA, 18 nt, Pseudomonas aeruginosa PA01
ucggcggauaacgccggu

SEQ ID NO: 1465331 - RNA, 23 nt, Pseudomonas aeruginosa PA01
ucggcggauaacgcuacccucag

SEQ ID NO: 1465332 - RNA, 17 nt, Pseudomonas aeruginosa PA01
ucggcggccaggcgcuc

SEQ ID NO: 1465333 - RNA, 15 nt, Pseudomonas aeruginosa PA01
ucggcggccaggcgg

SEQ ID NO: 1465334 - RNA, 17 nt, Pseudomonas aeruginosa PA01
ucggcggccauugccgc

SEQ ID NO: 1465335 - RNA, 21 nt, Pseudomonas aeruginosa PA01
ucggcggccauugccgcgggc

SEQ ID NO: 1465336 - RNA, 12 nt, Pseudomonas aeruginosa PA01
ucggcggccagc

SEQ ID NO: 1465337 - RNA, 13 nt, Pseudomonas aeruginosa PA01
ucggcgcuggcca

SEQ ID NO: 1465338 - RNA, 19 nt, Pseudomonas aeruginosa PA01
ucggcgcuggccagguagg

SEQ ID NO: 1465339 - RNA, 18 nt, Pseudomonas aeruginosa PA01
ucggcgcugccggccagg

SEQ ID NO: 1465340 - RNA, 18 nt, Pseudomonas aeruginosa PA01
ucggcgcugaccucgaug

SEQ ID NO: 1465341 - RNA, 22 nt, Pseudomonas aeruginosa PA01
ucggcgcugaccucgauggcgu

SEQ ID NO: 1465342 - RNA, 19 nt, Pseudomonas aeruginosa PA01
ucggcgcucggcuccagcc

SEQ ID NO: 1465343 - RNA, 22 nt, Pseudomonas aeruginosa PA01
ucggcgcucuucagcacgccca

SEQ ID NO: 1465344 - RNA, 22 nt, Pseudomonas aeruginosa PA01
ucggcgcuggcgcggaugucgg

SEQ ID NO: 1465345 - RNA, 19 nt, Pseudomonas aeruginosa PA01
ucggcgcugucgccguugg

SEQ ID NO: 1465346 - RNA, 13 nt, Pseudomonas aeruginosa PA01
ucggcgccgagca

SEQ ID NO: 1465347 - RNA, 23 nt, Pseudomonas aeruginosa PA01
ucggcgcggggcccggcuccagc

SEQ ID NO: 1465348 - RNA, 17 nt, Pseudomonas aeruginosa PA01
ucggcgcggggcguucc

SEQ ID NO: 1465349 - RNA, 23 nt, Pseudomonas aeruginosa PA01
ucggcgcggguucgugccaggcg

SEQ ID NO: 1465350 - RNA, 16 nt, Pseudomonas aeruginosa PA01
ucggcgcccagguagg

SEQ ID NO: 1465351 - RNA, 22 nt, Pseudomonas aeruginosa PA01
ucggcgcccagguaggagaggg

SEQ ID NO: 1465352 - RNA, 12 nt, Pseudomonas aeruginosa PA01
ucggcgagcagg

SEQ ID NO: 1465353 - RNA, 23 nt, Pseudomonas aeruginosa PA01
ucggcgagcagguagaccgccuc

SEQ ID NO: 1465354 - RNA, 14 nt, Pseudomonas aeruginosa PA01
ucggcgagccggcg

SEQ ID NO: 1465355 - RNA, 15 nt, Pseudomonas aeruginosa PA01
ucggcgagccggcgc

SEQ ID NO: 1465356 - RNA, 23 nt, Pseudomonas aeruginosa PA01
ucggcgaggaucagucgcugcuc

SEQ ID NO: 1465357 - RNA, 15 nt, Pseudomonas aeruginosa PA01
ucggcgaggaucgcc

SEQ ID NO: 1465358 - RNA, 18 nt, Pseudomonas aeruginosa PA01
ucggcgaggaucgccagc

SEQ ID NO: 1465359 - RNA, 14 nt, Pseudomonas aeruginosa PA01
ucggcgaggccggc

SEQ ID NO: 1465360 - RNA, 15 nt, Pseudomonas aeruginosa PA01
ucggcgaggccggcg

SEQ ID NO: 1465361 - RNA, 19 nt, Pseudomonas aeruginosa PA01
ucggcgaggccggcgauca

SEQ ID NO: 1465362 - RNA, 23 nt, Pseudomonas aeruginosa PA01
ucggcgaucacccggcgaagcuc

SEQ ID NO: 1465363 - RNA, 17 nt, Pseudomonas aeruginosa PA01
ucggcgaguuggccgaa

SEQ ID NO: 1465364 - RNA, 15 nt, Pseudomonas aeruginosa PA01
ucggcgcccgccugc

SEQ ID NO: 1465365 - RNA, 13 nt, Pseudomonas aeruginosa PA01
ucggcgccauagg

SEQ ID NO: 1465366 - RNA, 19 nt, Pseudomonas aeruginosa PA01
ucggcgcccagcaccacag

SEQ ID NO: 1465367 - RNA, 20 nt, Pseudomonas aeruginosa PA01
ucggcgcccaaugcaucggc

SEQ ID NO: 1465368 - RNA, 14 nt, Pseudomonas aeruginosa PA01
ucggcgaucgccag

SEQ ID NO: 1465369 - RNA, 21 nt, Pseudomonas aeruginosa PA01
ucggcgccagcucggacaagg

SEQ ID NO: 1465370 - RNA, 15 nt, Pseudomonas aeruginosa PA01
ucggcgaucaggccg

SEQ ID NO: 1465371 - RNA, 21 nt, Pseudomonas aeruginosa PA01
ucggcgaucaggccgaugcgc

SEQ ID NO: 1465372 - RNA, 17 nt, Pseudomonas aeruginosa PA01
ucggcgaucagcgggcg

SEQ ID NO: 1465373 - RNA, 13 nt, Pseudomonas aeruginosa PA01
ucggccuggcagu

SEQ ID NO: 1465374 - RNA, 13 nt, Pseudomonas aeruginosa PA01
ucggccuggcgca

SEQ ID NO: 1465375 - RNA, 21 nt, Pseudomonas aeruginosa PA01
ucggccugcucgaacggcgga

SEQ ID NO: 1465376 - RNA, 19 nt, Pseudomonas aeruginosa PA01
ucggccugcugcgccggca

SEQ ID NO: 1465377 - RNA, 18 nt, Pseudomonas aeruginosa PA01
ucggccugcugcucgacc

SEQ ID NO: 1465378 - RNA, 15 nt, Pseudomonas aeruginosa PA01
ucggccugcaacacc

SEQ ID NO: 1465379 - RNA, 16 nt, Pseudomonas aeruginosa PA01
ucggccucgucgagca

SEQ ID NO: 1465380 - RNA, 14 nt, Pseudomonas aeruginosa PA01
ucggccucggcguc

SEQ ID NO: 1465381 - RNA, 21 nt, Pseudomonas aeruginosa PA01
ucggccugcagccuggcgucg

SEQ ID NO: 1465382 - RNA, 23 nt, Pseudomonas aeruginosa PA01
ucggccucgaucucguccucggc

SEQ ID NO: 1465383 - RNA, 14 nt, Pseudomonas aeruginosa PA01
ucggccucgcggcg

SEQ ID NO: 1465384 - RNA, 19 nt, Pseudomonas aeruginosa PA01
ucggccucgcggcgcucga

SEQ ID NO: 1465385 - RNA, 19 nt, Pseudomonas aeruginosa PA01
uaggagaugcagcgucgcg

SEQ ID NO: 1465386 - RNA, 15 nt, Pseudomonas aeruginosa PA01
uaggagccgucgccg

SEQ ID NO: 1465387 - RNA, 19 nt, Pseudomonas aeruginosa PA01
uaggacagggccaggccga

SEQ ID NO: 1465388 - RNA, 18 nt, Pseudomonas aeruginosa PA01
uaggccgcuuccggcccg

SEQ ID NO: 1465389 - RNA, 17 nt, Pseudomonas aeruginosa PA01
uaggccacuucccggcg

SEQ ID NO: 1465390 - RNA, 21 nt, Pseudomonas aeruginosa PA01
uaggccagcagggucucgcug

SEQ ID NO: 1465391 - RNA, 13 nt, Pseudomonas aeruginosa PA01
uaggccaggcaga

SEQ ID NO: 1465392 - RNA, 18 nt, Pseudomonas aeruginosa PA01
uaggccaugaucaucgcc

SEQ ID NO: 1465393 - RNA, 23 nt, Pseudomonas aeruginosa PA01
uaggccaugaucaucgccugcug

SEQ ID NO: 1465394 - RNA, 21 nt, Pseudomonas aeruginosa PA01
uaggccggcgugcccauccgc

SEQ ID NO: 1465395 - RNA, 16 nt, Pseudomonas aeruginosa PA01
uaggccgucgcugccg

SEQ ID NO: 1465396 - RNA, 21 nt, Pseudomonas aeruginosa PA01
uaggccucgaugaucgccggg

SEQ ID NO: 1465397 - RNA, 22 nt, Pseudomonas aeruginosa PA01
uaggcgaacacgucggcgcgca

SEQ ID NO: 1465398 - RNA, 13 nt, Pseudomonas aeruginosa PA01
uaggccuggccgc

SEQ ID NO: 1465399 - RNA, 16 nt, Pseudomonas aeruginosa PA01
uaggccuggccgccca

SEQ ID NO: 1465400 - RNA, 16 nt, Pseudomonas aeruginosa PA01
uaggcgagcagcggca

SEQ ID NO: 1465401 - RNA, 18 nt, Pseudomonas aeruginosa PA01
uaggcgagcagcggcacg

SEQ ID NO: 1465402 - RNA, 12 nt, Pseudomonas aeruginosa PA01
uaggcgacccgg

SEQ ID NO: 1465403 - RNA, 16 nt, Pseudomonas aeruginosa PA01
uaggcgaagcggcucg

SEQ ID NO: 1465404 - RNA, 16 nt, Pseudomonas aeruginosa PA01
uaggcgcugccguaga

SEQ ID NO: 1465405 - RNA, 13 nt, Pseudomonas aeruginosa PA01
uaggcgcaccagg

SEQ ID NO: 1465406 - RNA, 14 nt, Pseudomonas aeruginosa PA01
uaggcgccggcgcg

SEQ ID NO: 1465407 - RNA, 18 nt, Pseudomonas aeruginosa PA01
uaggcgccggcgcgcggc

SEQ ID NO: 1465408 - RNA, 19 nt, Pseudomonas aeruginosa PA01
uaggcgccggcgcgcggcg

SEQ ID NO: 1465409 - RNA, 21 nt, Pseudomonas aeruginosa PA01
uaggcgccggcgcgcggcggg

SEQ ID NO: 1465410 - RNA, 23 nt, Pseudomonas aeruginosa PA01
uaggcgcgcaacgcuuccagcac

SEQ ID NO: 1465411 - RNA, 23 nt, Pseudomonas aeruginosa PA01
uaggcgcgccaaggccgccaggc

SEQ ID NO: 1465412 - RNA, 14 nt, Pseudomonas aeruginosa PA01
uaggcuugcgccga

SEQ ID NO: 1465413 - RNA, 21 nt, Pseudomonas aeruginosa PA01
uaggcggugcguucgcgggcg

SEQ ID NO: 1465414 - RNA, 22 nt, Pseudomonas aeruginosa PA01
uaggcgguggccacgucgcccc

SEQ ID NO: 1465415 - RNA, 16 nt, Pseudomonas aeruginosa PA01
uaggcgguggcgauca

SEQ ID NO: 1465416 - RNA, 14 nt, Pseudomonas aeruginosa PA01
uaggcggccagccu

SEQ ID NO: 1465417 - RNA, 16 nt, Pseudomonas aeruginosa PA01
aaguugccgccagcgc

SEQ ID NO: 1465418 - RNA, 14 nt, Pseudomonas aeruginosa PA01
uagcugcagcgccc

SEQ ID NO: 1465419 - RNA, 17 nt, Pseudomonas aeruginosa PA01
uagcugagcaggccgac

SEQ ID NO: 1465420 - RNA, 21 nt, Pseudomonas aeruginosa PA01
uagcugagcaggccgacggcg

SEQ ID NO: 1465421 - RNA, 16 nt, Pseudomonas aeruginosa PA01
uagcguugcaggcagu

SEQ ID NO: 1465422 - RNA, 23 nt, Pseudomonas aeruginosa PA01
uagcggaccccggccuccaggcu

SEQ ID NO: 1465423 - RNA, 14 nt, Pseudomonas aeruginosa PA01
uagcgcugcgccag

SEQ ID NO: 1465424 - RNA, 14 nt, Pseudomonas aeruginosa PA01
uagcgcugcgcccg

SEQ ID NO: 1465425 - RNA, 22 nt, Pseudomonas aeruginosa PA01
uagcgcucgccuaccggcgccg

SEQ ID NO: 1465426 - RNA, 23 nt, Pseudomonas aeruginosa PA01
uagcgcucgauagcguccaggug

SEQ ID NO: 1465427 - RNA, 19 nt, Pseudomonas aeruginosa PA01
uagcgacccuucaacggcg

SEQ ID NO: 1465428 - RNA, 14 nt, Pseudomonas aeruginosa PA01
uagcgcuccagcuc

SEQ ID NO: 1465429 - RNA, 20 nt, Pseudomonas aeruginosa PA01
uagcgcuccagcuccuccag

SEQ ID NO: 1465430 - RNA, 21 nt, Pseudomonas aeruginosa PA01
uagcgcuccagcuccuccagc

SEQ ID NO: 1465431 - RNA, 17 nt, Pseudomonas aeruginosa PA01
uagcgcuccucgcgcug

SEQ ID NO: 1465432 - RNA, 17 nt, Pseudomonas aeruginosa PA01
uagcguugacgcaguuc

SEQ ID NO: 1465433 - RNA, 21 nt, Pseudomonas aeruginosa PA01
uagcgcuucaucaggcugcug

SEQ ID NO: 1465434 - RNA, 16 nt, Pseudomonas aeruginosa PA01
uagcggaucaggccca

SEQ ID NO: 1465435 - RNA, 18 nt, Pseudomonas aeruginosa PA01
uagcagccauagcaauac

SEQ ID NO: 1465436 - RNA, 19 nt, Pseudomonas aeruginosa PA01
uagcacauggucuucccag

SEQ ID NO: 1465437 - RNA, 19 nt, Pseudomonas aeruginosa PA01
uagccgaacuccgccagca

SEQ ID NO: 1465438 - RNA, 15 nt, Pseudomonas aeruginosa PA01
uagccgacgaaggcg

SEQ ID NO: 1465439 - RNA, 18 nt, Pseudomonas aeruginosa PA01
uagccgaggcggccgagg

SEQ ID NO: 1465440 - RNA, 21 nt, Pseudomonas aeruginosa PA01
uagccgaggcggccgagggcg

SEQ ID NO: 1465441 - RNA, 20 nt, Pseudomonas aeruginosa PA01
uagccgaucaacgcggccag

SEQ ID NO: 1465442 - RNA, 18 nt, Pseudomonas aeruginosa PA01
uagccgaccaggccgauc

SEQ ID NO: 1465443 - RNA, 16 nt, Pseudomonas aeruginosa PA01
uagcccugggcgccgc

SEQ ID NO: 1465444 - RNA, 13 nt, Pseudomonas aeruginosa PA01
uagcccgucggcg

SEQ ID NO: 1465445 - RNA, 18 nt, Pseudomonas aeruginosa PA01
uagcagauaucgugcagg

SEQ ID NO: 1465446 - RNA, 21 nt, Pseudomonas aeruginosa PA01
uagccugcggccagcgccagg

SEQ ID NO: 1465447 - RNA, 14 nt, Pseudomonas aeruginosa PA01
uagccucccgccgc

SEQ ID NO: 1465448 - RNA, 15 nt, Pseudomonas aeruginosa PA01
uagccucccgccgcg

SEQ ID NO: 1465449 - RNA, 18 nt, Pseudomonas aeruginosa PA01
uagccucccgccgcggcg

SEQ ID NO: 1465450 - RNA, 11 nt, Pseudomonas aeruginosa PA01
uagcgcgccug

SEQ ID NO: 1465451 - RNA, 17 nt, Pseudomonas aeruginosa PA01
uagcgcgcggcgagccg

SEQ ID NO: 1465452 - RNA, 18 nt, Pseudomonas aeruginosa PA01
uagccgucgaacagcagc

SEQ ID NO: 1465453 - RNA, 21 nt, Pseudomonas aeruginosa PA01
uagccgucguagcgcagcggc

SEQ ID NO: 1465454 - RNA, 13 nt, Pseudomonas aeruginosa PA01
uagccgugcagca

SEQ ID NO: 1465455 - RNA, 15 nt, Pseudomonas aeruginosa PA01
uagccgugcagcagc

SEQ ID NO: 1465456 - RNA, 16 nt, Pseudomonas aeruginosa PA01
uagccgugcagcagcg

SEQ ID NO: 1465457 - RNA, 18 nt, Pseudomonas aeruginosa PA01
uagccgcaguccagggcg

SEQ ID NO: 1465458 - RNA, 13 nt, Pseudomonas aeruginosa PA01
uagacgccggcga

SEQ ID NO: 1465459 - RNA, 22 nt, Pseudomonas aeruginosa PA01
uagacgccucccaccgcgcggc

SEQ ID NO: 1465460 - RNA, 18 nt, Pseudomonas aeruginosa PA01
uagacgcgcacgucaccg

SEQ ID NO: 1465461 - RNA, 16 nt, Pseudomonas aeruginosa PA01
uagaccaucgccggcg

SEQ ID NO: 1465462 - RNA, 15 nt, Pseudomonas aeruginosa PA01
uagaccaucugccag

SEQ ID NO: 1465463 - RNA, 15 nt, Pseudomonas aeruginosa PA01
uagaccaccagcagg

SEQ ID NO: 1465464 - RNA, 18 nt, Pseudomonas aeruginosa PA01
uagaccaccgugcgcacc

SEQ ID NO: 1465465 - RNA, 17 nt, Pseudomonas aeruginosa PA01
uagaccacgcaggccag

SEQ ID NO: 1465466 - RNA, 22 nt, Pseudomonas aeruginosa PA01
uacugcuucaugaagucagcca

SEQ ID NO: 1465467 - RNA, 16 nt, Pseudomonas aeruginosa PA01
uacuugacggcgccga

SEQ ID NO: 1465468 - RNA, 20 nt, Pseudomonas aeruginosa PA01
uacgucuucgauggcggccg

SEQ ID NO: 1465469 - RNA, 13 nt, Pseudomonas aeruginosa PA01
uacguagcgcggu

SEQ ID NO: 1465470 - RNA, 21 nt, Pseudomonas aeruginosa PA01
uacgugggggauuuccucguc

SEQ ID NO: 1465471 - RNA, 15 nt, Pseudomonas aeruginosa PA01
uacugcacgcccagg

SEQ ID NO: 1465472 - RNA, 18 nt, Pseudomonas aeruginosa PA01
uacugccgcuaucgcugg

SEQ ID NO: 1465473 - RNA, 19 nt, Pseudomonas aeruginosa PA01
uacugccgcuaucgcuggc

SEQ ID NO: 1465474 - RNA, 16 nt, Pseudomonas aeruginosa PA01
uacgcaucugcucgag

SEQ ID NO: 1465475 - RNA, 13 nt, Pseudomonas aeruginosa PA01
uacgcgcagcggu

SEQ ID NO: 1465476 - RNA, 20 nt, Pseudomonas aeruginosa PA01
uacgguacaguucaggcugg

SEQ ID NO: 1465477 - RNA, 18 nt, Pseudomonas aeruginosa PA01
uacggcggggucgggcag

SEQ ID NO: 1465478 - RNA, 14 nt, Pseudomonas aeruginosa PA01
uacgggcgccaggg

SEQ ID NO: 1465479 - RNA, 19 nt, Pseudomonas aeruginosa PA01
uacggccccaggcugccca

SEQ ID NO: 1465480 - RNA, 13 nt, Pseudomonas aeruginosa PA01
uacgcucggccaa

SEQ ID NO: 1465481 - RNA, 13 nt, Pseudomonas aeruginosa PA01
uacgcucggcguc

SEQ ID NO: 1465482 - RNA, 22 nt, Pseudomonas aeruginosa PA01
uacggcaggguagccacgccgg

SEQ ID NO: 1465483 - RNA, 14 nt, Pseudomonas aeruginosa PA01
uaccagcgcaccag

SEQ ID NO: 1465484 - RNA, 13 nt, Pseudomonas aeruginosa PA01
uaccaggaccagc

SEQ ID NO: 1465485 - RNA, 14 nt, Pseudomonas aeruginosa PA01
uaccaggaccagcg

SEQ ID NO: 1465486 - RNA, 18 nt, Pseudomonas aeruginosa PA01
uaccagcuugucgccuuc

SEQ ID NO: 1465487 - RNA, 21 nt, Pseudomonas aeruginosa PA01
uaccagcuugucgccuuccuc

SEQ ID NO: 1465488 - RNA, 18 nt, Pseudomonas aeruginosa PA01
uaccagaagccggccggg

SEQ ID NO: 1465489 - RNA, 14 nt, Pseudomonas aeruginosa PA01
uaccagaccgcagc

SEQ ID NO: 1465490 - RNA, 17 nt, Pseudomonas aeruginosa PA01
uaccagaccgcagccgg

SEQ ID NO: 1465491 - RNA, 23 nt, Pseudomonas aeruginosa PA01
uacgaaggcgugccgcuggccga

SEQ ID NO: 1465492 - RNA, 12 nt, Pseudomonas aeruginosa PA01
uacgcacgcugg

SEQ ID NO: 1465493 - RNA, 11 nt, Pseudomonas aeruginosa PA01
uacgcaccggc

SEQ ID NO: 1465494 - RNA, 22 nt, Pseudomonas aeruginosa PA01
uacgaugcuggcaacggcgggc

SEQ ID NO: 1465495 - RNA, 24 nt, Pseudomonas aeruginosa PA01
ucaacugcuuaccuugccggugcg

SEQ ID NO: 1465496 - RNA, 16 nt, Pseudomonas aeruginosa PA01
ucaacuggucgcagcc

SEQ ID NO: 1465497 - RNA, 22 nt, Pseudomonas aeruginosa PA01
ucaacugguuggccgccuggcg

SEQ ID NO: 1465498 - RNA, 17 nt, Pseudomonas aeruginosa PA01
ucaacgaagucgcgagg

SEQ ID NO: 1465499 - RNA, 16 nt, Pseudomonas aeruginosa PA01
ucaacuccgccaggcg

SEQ ID NO: 1465500 - RNA, 15 nt, Pseudomonas aeruginosa PA01
ucaaccgcuggucgg

SEQ ID NO: 1465501 - RNA, 17 nt, Pseudomonas aeruginosa PA01
ucaaccgcuggucggca

SEQ ID NO: 1465502 - RNA, 20 nt, Pseudomonas aeruginosa PA01
ucaacccuugcucccgccgc

SEQ ID NO: 1465503 - RNA, 18 nt, Pseudomonas aeruginosa PA01
ucaacccaccgaccacca

SEQ ID NO: 1465504 - RNA, 19 nt, Pseudomonas aeruginosa PA01
uauugcuccacccgcagcc

SEQ ID NO: 1465505 - RNA, 20 nt, Pseudomonas aeruginosa PA01
ucaaaggaaucuucggcgcc

SEQ ID NO: 1465506 - RNA, 18 nt, Pseudomonas aeruginosa PA01
ucaagggccaggaaaucg

SEQ ID NO: 1465507 - RNA, 22 nt, Pseudomonas aeruginosa PA01
ucaagcaacggcgaaucgucga

SEQ ID NO: 1465508 - RNA, 19 nt, Pseudomonas aeruginosa PA01
ucaagacggcccgcagauc

SEQ ID NO: 1465509 - RNA, 23 nt, Pseudomonas aeruginosa PA01
ucaagcggguauugcagacgcug

SEQ ID NO: 1465510 - RNA, 20 nt, Pseudomonas aeruginosa PA01
ucaaggcagaaaaacccagc

SEQ ID NO: 1465511 - RNA, 21 nt, Pseudomonas aeruginosa PA01
ucaauucgcggacgccgaagc

SEQ ID NO: 1465512 - RNA, 14 nt, Pseudomonas aeruginosa PA01
ucaaugacggggau

SEQ ID NO: 1465513 - RNA, 17 nt, Pseudomonas aeruginosa PA01
uaucggggccaggucgg

SEQ ID NO: 1465514 - RNA, 21 nt, Pseudomonas aeruginosa PA01
uaucgggcagggcagccgccg

SEQ ID NO: 1465515 - RNA, 15 nt, Pseudomonas aeruginosa PA01
uauccgccgccgggc

SEQ ID NO: 1465516 - RNA, 20 nt, Pseudomonas aeruginosa PA01
uauccgccgcuacugcgcgg

SEQ ID NO: 1465517 - RNA, 21 nt, Pseudomonas aeruginosa PA01
uauccgccggccggggcgcgc

SEQ ID NO: 1465518 - RNA, 21 nt, Pseudomonas aeruginosa PA01
uauccccccacccgucccgcg

SEQ ID NO: 1465519 - RNA, 15 nt, Pseudomonas aeruginosa PA01
uauccaugucagcgg

SEQ ID NO: 1465520 - RNA, 15 nt, Pseudomonas aeruginosa PA01
uaucccgccgccgcg

SEQ ID NO: 1465521 - RNA, 15 nt, Pseudomonas aeruginosa PA01
uaucccggcugagcg

SEQ ID NO: 1465522 - RNA, 22 nt, Pseudomonas aeruginosa PA01
uaucccggcugagcgccaggcg

SEQ ID NO: 1465523 - RNA, 15 nt, Pseudomonas aeruginosa PA01
uaucccgugccgggc

SEQ ID NO: 1465524 - RNA, 14 nt, Pseudomonas aeruginosa PA01
uagggagcgacacc

SEQ ID NO: 1465525 - RNA, 22 nt, Pseudomonas aeruginosa PA01
uagggcaucgccgacaggucgg

SEQ ID NO: 1465526 - RNA, 19 nt, Pseudomonas aeruginosa PA01
uagggccgguucggauccg

SEQ ID NO: 1465527 - RNA, 14 nt, Pseudomonas aeruginosa PA01
uagggcuucgccca

SEQ ID NO: 1465528 - RNA, 23 nt, Pseudomonas aeruginosa PA01
uaggggcagaccuggugggcggc

SEQ ID NO: 1465529 - RNA, 21 nt, Pseudomonas aeruginosa PA01
uagggcgaacaaccgcucgcg

SEQ ID NO: 1465530 - RNA, 23 nt, Pseudomonas aeruginosa PA01
uagggcgaacaacgccgccggcg

SEQ ID NO: 1465531 - RNA, 20 nt, Pseudomonas aeruginosa PA01
uagggcgaauaaccgcugcg

SEQ ID NO: 1465532 - RNA, 23 nt, Pseudomonas aeruginosa PA01
uagggcgaauaacgccaccggcg

SEQ ID NO: 1465533 - RNA, 21 nt, Pseudomonas aeruginosa PA01
uagggcgaauaacgccgcagg

SEQ ID NO: 1465534 - RNA, 22 nt, Pseudomonas aeruginosa PA01
uagggcgaauaucgcggcgcga

SEQ ID NO: 1465535 - RNA, 24 nt, Pseudomonas aeruginosa PA01
uaggucagcgguaugccgcaggca

SEQ ID NO: 1465536 - RNA, 13 nt, Pseudomonas aeruginosa PA01
uaggucaccgcgc

SEQ ID NO: 1465537 - RNA, 18 nt, Pseudomonas aeruginosa PA01
uagguccaggcgucggcg

SEQ ID NO: 1465538 - RNA, 19 nt, Pseudomonas aeruginosa PA01
uaugccgcaggcaguggcg

SEQ ID NO: 1465539 - RNA, 21 nt, Pseudomonas aeruginosa PA01
uaucgucgggacgcaugcgcg

SEQ ID NO: 1465540 - RNA, 20 nt, Pseudomonas aeruginosa PA01
ucacguugaacacaucgacc

SEQ ID NO: 1465541 - RNA, 15 nt, Pseudomonas aeruginosa PA01
ucagagucgcaccgg

SEQ ID NO: 1465542 - RNA, 16 nt, Pseudomonas aeruginosa PA01
ucagagucgcaccggg

SEQ ID NO: 1465543 - RNA, 22 nt, Pseudomonas aeruginosa PA01
ucacgucguacucggcggggcg

SEQ ID NO: 1465544 - RNA, 19 nt, Pseudomonas aeruginosa PA01
ucacggguguuucggccgc

SEQ ID NO: 1465545 - RNA, 21 nt, Pseudomonas aeruginosa PA01
ucacggguguuucggccgcug

SEQ ID NO: 1465546 - RNA, 16 nt, Pseudomonas aeruginosa PA01
ucacggucgcaggggc

SEQ ID NO: 1465547 - RNA, 17 nt, Pseudomonas aeruginosa PA01
ucacgcugcucgcagcc

SEQ ID NO: 1465548 - RNA, 13 nt, Pseudomonas aeruginosa PA01
ucacggacccgcu

SEQ ID NO: 1465549 - RNA, 15 nt, Pseudomonas aeruginosa PA01
ucacggcauccuggc

SEQ ID NO: 1465550 - RNA, 16 nt, Pseudomonas aeruginosa PA01
ucacggaugccgggcg

SEQ ID NO: 1465551 - RNA, 19 nt, Pseudomonas aeruginosa PA01
ucacggcgaaaccggccag

SEQ ID NO: 1465552 - RNA, 15 nt, Pseudomonas aeruginosa PA01
ucacggcgcagccgc

SEQ ID NO: 1465553 - RNA, 17 nt, Pseudomonas aeruginosa PA01
ucacggcgugccgcagg

SEQ ID NO: 1465554 - RNA, 17 nt, Pseudomonas aeruginosa PA01
ucacggcggauaaccgc

SEQ ID NO: 1465555 - RNA, 20 nt, Pseudomonas aeruginosa PA01
ucacggcggauaaccgcgag

SEQ ID NO: 1465556 - RNA, 21 nt, Pseudomonas aeruginosa PA01
ucacggcggauaaccgcgagc

SEQ ID NO: 1465557 - RNA, 19 nt, Pseudomonas aeruginosa PA01
ucaccgcauagucgcgaug

SEQ ID NO: 1465558 - RNA, 15 nt, Pseudomonas aeruginosa PA01
ucaccgcggccuugg

SEQ ID NO: 1465559 - RNA, 22 nt, Pseudomonas aeruginosa PA01
ucaccgcggcgcugaaggcggu

SEQ ID NO: 1465560 - RNA, 21 nt, Pseudomonas aeruginosa PA01
ucaccgcggugugcuugucca

SEQ ID NO: 1465561 - RNA, 17 nt, Pseudomonas aeruginosa PA01
ucaccgauugcgcccuc

SEQ ID NO: 1465562 - RNA, 19 nt, Pseudomonas aeruginosa PA01
ucaccgccaccccgccggc

SEQ ID NO: 1465563 - RNA, 11 nt, Pseudomonas aeruginosa PA01
ucaccgccagc

SEQ ID NO: 1465564 - RNA, 23 nt, Pseudomonas aeruginosa PA01
ucaccgcaucgaaggcgccggca

SEQ ID NO: 1465565 - RNA, 19 nt, Pseudomonas aeruginosa PA01
ucaccgccaaggccucggc

SEQ ID NO: 1465566 - RNA, 20 nt, Pseudomonas aeruginosa PA01
ucaccgccaaggccucggca

SEQ ID NO: 1465567 - RNA, 18 nt, Pseudomonas aeruginosa PA01
ucaccgcguucugcggac

SEQ ID NO: 1465568 - RNA, 22 nt, Pseudomonas aeruginosa PA01
ucaccgcguccauccccgccuc

SEQ ID NO: 1465569 - RNA, 21 nt, Pseudomonas aeruginosa PA01
ucaccggaaaaauccucgccu

SEQ ID NO: 1465570 - RNA, 11 nt, Pseudomonas aeruginosa PA01
ucaccgcucgc

SEQ ID NO: 1465571 - RNA, 20 nt, Pseudomonas aeruginosa PA01
ucaccggaucgaugcccggc

SEQ ID NO: 1465572 - RNA, 14 nt, Pseudomonas aeruginosa PA01
ucaccggcagcagc

SEQ ID NO: 1465573 - RNA, 15 nt, Pseudomonas aeruginosa PA01
ucaccggcagcagcg

SEQ ID NO: 1465574 - RNA, 13 nt, Pseudomonas aeruginosa PA01
ucaccucggcgcc

SEQ ID NO: 1465575 - RNA, 22 nt, Pseudomonas aeruginosa PA01
ucaccggacggcugaggcuggc

SEQ ID NO: 1465576 - RNA, 12 nt, Pseudomonas aeruginosa PA01
ucaccgaccagu

SEQ ID NO: 1465577 - RNA, 23 nt, Pseudomonas aeruginosa PA01
ucacgcagcaggcgacggucagg

SEQ ID NO: 1465578 - RNA, 22 nt, Pseudomonas aeruginosa PA01
ucacgcaguacagcugcaccgc

SEQ ID NO: 1465579 - RNA, 16 nt, Pseudomonas aeruginosa PA01
ucacgccccagcgcau

SEQ ID NO: 1465580 - RNA, 15 nt, Pseudomonas aeruginosa PA01
ucacgcaggcgcugg

SEQ ID NO: 1465581 - RNA, 16 nt, Pseudomonas aeruginosa PA01
ucacgcaggcgcuggc

SEQ ID NO: 1465582 - RNA, 19 nt, Pseudomonas aeruginosa PA01
ucacgcaagugcccugggc

SEQ ID NO: 1465583 - RNA, 21 nt, Pseudomonas aeruginosa PA01
ucacgcaccucgucgagcagc

SEQ ID NO: 1465584 - RNA, 17 nt, Pseudomonas aeruginosa PA01
ucacgcuuuccggcuug

SEQ ID NO: 1465585 - RNA, 20 nt, Pseudomonas aeruginosa PA01
ucacggaacggguccuuggc

SEQ ID NO: 1465586 - RNA, 17 nt, Pseudomonas aeruginosa PA01
ucacgcguucggcgaug

SEQ ID NO: 1465587 - RNA, 24 nt, Pseudomonas aeruginosa PA01
ucacgcguugcgagggcucgggcg

SEQ ID NO: 1465588 - RNA, 14 nt, Pseudomonas aeruginosa PA01
ucacgcucggcaug

SEQ ID NO: 1465589 - RNA, 20 nt, Pseudomonas aeruginosa PA01
ucaccuugcggaacccgcgc

SEQ ID NO: 1465590 - RNA, 20 nt, Pseudomonas aeruginosa PA01
ucaccuucucguagcgcucg

SEQ ID NO: 1465591 - RNA, 14 nt, Pseudomonas aeruginosa PA01
ucacgauggccggc

SEQ ID NO: 1465592 - RNA, 16 nt, Pseudomonas aeruginosa PA01
ucaccuuccucgcgcc

SEQ ID NO: 1465593 - RNA, 21 nt, Pseudomonas aeruginosa PA01
ucaccuucgcccucagcagcg

SEQ ID NO: 1465594 - RNA, 17 nt, Pseudomonas aeruginosa PA01
ucaggaccuuccgccag

SEQ ID NO: 1465595 - RNA, 21 nt, Pseudomonas aeruginosa PA01
ucaggaccuuccgccagcagg

SEQ ID NO: 1465596 - RNA, 18 nt, Pseudomonas aeruginosa PA01
ucaggacguccuggccga

SEQ ID NO: 1465597 - RNA, 15 nt, Pseudomonas aeruginosa PA01
ucaggagcgccgcgc

SEQ ID NO: 1465598 - RNA, 14 nt, Pseudomonas aeruginosa PA01
ucaggaggaucgcc

SEQ ID NO: 1465599 - RNA, 16 nt, Pseudomonas aeruginosa PA01
ucaggaggaucgccag

SEQ ID NO: 1465600 - RNA, 21 nt, Pseudomonas aeruginosa PA01
ucaggacgagcguccgccgcc

SEQ ID NO: 1465601 - RNA, 22 nt, Pseudomonas aeruginosa PA01
ucaggacgagcguccgccgccg

SEQ ID NO: 1465602 - RNA, 15 nt, Pseudomonas aeruginosa PA01
ucaggacgcuacgcu

SEQ ID NO: 1465603 - RNA, 19 nt, Pseudomonas aeruginosa PA01
ucaggacgcuacgcucggg

SEQ ID NO: 1465604 - RNA, 15 nt, Pseudomonas aeruginosa PA01
ucaggaucggcgccc

SEQ ID NO: 1465605 - RNA, 20 nt, Pseudomonas aeruginosa PA01
ucaggaguuucaucucggcg

SEQ ID NO: 1465606 - RNA, 21 nt, Pseudomonas aeruginosa PA01
ucaggaguuucaucucggcgc

SEQ ID NO: 1465607 - RNA, 23 nt, Pseudomonas aeruginosa PA01
ucaggaucacaucgcccggcagc

SEQ ID NO: 1465608 - RNA, 15 nt, Pseudomonas aeruginosa PA01
ucaggauagccggcg

SEQ ID NO: 1465609 - RNA, 21 nt, Pseudomonas aeruginosa PA01
ucaggauguggccgucgcgcc

SEQ ID NO: 1465610 - RNA, 19 nt, Pseudomonas aeruginosa PA01
ucaggcagcgaucgccgcc

SEQ ID NO: 1465611 - RNA, 20 nt, Pseudomonas aeruginosa PA01
ucaggcagcgaucgccgcca

SEQ ID NO: 1465612 - RNA, 19 nt, Pseudomonas aeruginosa PA01
ucaggcagcgcgcggccag

SEQ ID NO: 1465613 - RNA, 16 nt, Pseudomonas aeruginosa PA01
ucagcuggcgcgccuc

SEQ ID NO: 1465614 - RNA, 22 nt, Pseudomonas aeruginosa PA01
ucagcuggauagaguacucggc

SEQ ID NO: 1465615 - RNA, 21 nt, Pseudomonas aeruginosa PA01
ucagcucggcguagcgcuggg

SEQ ID NO: 1465616 - RNA, 13 nt, Pseudomonas aeruginosa PA01
ucagcucggcgau

SEQ ID NO: 1465617 - RNA, 22 nt, Pseudomonas aeruginosa PA01
ucagcucggcgaugccgccggg

SEQ ID NO: 1465618 - RNA, 17 nt, Pseudomonas aeruginosa PA01
ucagcucguugcccggc

SEQ ID NO: 1465619 - RNA, 19 nt, Pseudomonas aeruginosa PA01
ucaggaagguccaggccca

SEQ ID NO: 1465620 - RNA, 18 nt, Pseudomonas aeruginosa PA01
ucaggaaggucucgccgc

SEQ ID NO: 1465621 - RNA, 19 nt, Pseudomonas aeruginosa PA01
ucagcuuguggucguggcg

SEQ ID NO: 1465622 - RNA, 14 nt, Pseudomonas aeruginosa PA01
ucagcuuggccuug

SEQ ID NO: 1465623 - RNA, 19 nt, Pseudomonas aeruginosa PA01
ucagcggaagcccagcagg

SEQ ID NO: 1465624 - RNA, 19 nt, Pseudomonas aeruginosa PA01
ucagcggacaaccgccgua

SEQ ID NO: 1465625 - RNA, 21 nt, Pseudomonas aeruginosa PA01
ucagcggacaaccgccguagc

SEQ ID NO: 1465626 - RNA, 12 nt, Pseudomonas aeruginosa PA01
ucagcggaccgg

SEQ ID NO: 1465627 - RNA, 21 nt, Pseudomonas aeruginosa PA01
ucagcgcuucggcuccagcac

SEQ ID NO: 1465628 - RNA, 17 nt, Pseudomonas aeruginosa PA01
ucagcgcuucucggcag

SEQ ID NO: 1465629 - RNA, 23 nt, Pseudomonas aeruginosa PA01
ucagcgcuugcuggcgcgauccg

SEQ ID NO: 1465630 - RNA, 14 nt, Pseudomonas aeruginosa PA01
ucagcgcggcggcg

SEQ ID NO: 1465631 - RNA, 16 nt, Pseudomonas aeruginosa PA01
ucagcgcggcggcggc

SEQ ID NO: 1465632 - RNA, 21 nt, Pseudomonas aeruginosa PA01
ucagcgguggcguugucggca

SEQ ID NO: 1465633 - RNA, 17 nt, Pseudomonas aeruginosa PA01
ucagcgcggugagcagg

SEQ ID NO: 1465634 - RNA, 17 nt, Pseudomonas aeruginosa PA01
ucagcggguagcugcug

SEQ ID NO: 1465635 - RNA, 20 nt, Pseudomonas aeruginosa PA01
ucagcgggucgagccaggcg

SEQ ID NO: 1465636 - RNA, 17 nt, Pseudomonas aeruginosa PA01
ucagcuccacgucggcc

SEQ ID NO: 1465637 - RNA, 19 nt, Pseudomonas aeruginosa PA01
ucagcuccacgucggcccg

SEQ ID NO: 1465638 - RNA, 15 nt, Pseudomonas aeruginosa PA01
ucagcuccaggccgc

SEQ ID NO: 1465639 - RNA, 14 nt, Pseudomonas aeruginosa PA01
ucagaugcgguagg

SEQ ID NO: 1465640 - RNA, 19 nt, Pseudomonas aeruginosa PA01
ucagaugcgguaggugcuc

SEQ ID NO: 1465641 - RNA, 15 nt, Pseudomonas aeruginosa PA01
ucagcaucaggucgg

SEQ ID NO: 1465642 - RNA, 18 nt, Pseudomonas aeruginosa PA01
ucagccauuggccgacgc

SEQ ID NO: 1465643 - RNA, 19 nt, Pseudomonas aeruginosa PA01
ucagccauuggccgacgcc

SEQ ID NO: 1465644 - RNA, 21 nt, Pseudomonas aeruginosa PA01
ucagccauuggccgacgccgc

SEQ ID NO: 1465645 - RNA, 17 nt, Pseudomonas aeruginosa PA01
ucagcccacccccggcc

SEQ ID NO: 1465646 - RNA, 18 nt, Pseudomonas aeruginosa PA01
ucagcccacccccggccc

SEQ ID NO: 1465647 - RNA, 14 nt, Pseudomonas aeruginosa PA01
ucagccagccggcg

SEQ ID NO: 1465648 - RNA, 16 nt, Pseudomonas aeruginosa PA01
ucagccagccggcgaa

SEQ ID NO: 1465649 - RNA, 13 nt, Pseudomonas aeruginosa PA01
ucagccagccgag

SEQ ID NO: 1465650 - RNA, 15 nt, Pseudomonas aeruginosa PA01
ucagccagccgagca

SEQ ID NO: 1465651 - RNA, 17 nt, Pseudomonas aeruginosa PA01
ucagccagccgagcaac

SEQ ID NO: 1465652 - RNA, 14 nt, Pseudomonas aeruginosa PA01
ucagccagaccggc

SEQ ID NO: 1465653 - RNA, 19 nt, Pseudomonas aeruginosa PA01
ucagccagaccggcagcgc

SEQ ID NO: 1465654 - RNA, 21 nt, Pseudomonas aeruginosa PA01
ucagccagaccggcagcgccg

SEQ ID NO: 1465655 - RNA, 22 nt, Pseudomonas aeruginosa PA01
ucagccagaccggcagcgccgc

SEQ ID NO: 1465656 - RNA, 18 nt, Pseudomonas aeruginosa PA01
ucagcauggggcggcacg

SEQ ID NO: 1465657 - RNA, 18 nt, Pseudomonas aeruginosa PA01
ucagccacggacgcgcag

SEQ ID NO: 1465658 - RNA, 19 nt, Pseudomonas aeruginosa PA01
ucagccacggacgcgcagg

SEQ ID NO: 1465659 - RNA, 19 nt, Pseudomonas aeruginosa PA01
ucagcgagagcuguccggc

SEQ ID NO: 1465660 - RNA, 21 nt, Pseudomonas aeruginosa PA01
ucagcgagagcuguccggcgc

SEQ ID NO: 1465661 - RNA, 14 nt, Pseudomonas aeruginosa PA01
ucagcgccgcucgg

SEQ ID NO: 1465662 - RNA, 18 nt, Pseudomonas aeruginosa PA01
ucagcgccgcucggcgag

SEQ ID NO: 1465663 - RNA, 20 nt, Pseudomonas aeruginosa PA01
ucagcgccgcucggcgagcc

SEQ ID NO: 1465664 - RNA, 16 nt, Pseudomonas aeruginosa PA01
ucagcgagcuaucgcc

SEQ ID NO: 1465665 - RNA, 18 nt, Pseudomonas aeruginosa PA01
ucagcgagcuucgccgcg

SEQ ID NO: 1465666 - RNA, 22 nt, Pseudomonas aeruginosa PA01
ucagcgagcuucgccgcgcaag

SEQ ID NO: 1465667 - RNA, 20 nt, Pseudomonas aeruginosa PA01
ucagcgccuugaccucgacg

SEQ ID NO: 1465668 - RNA, 22 nt, Pseudomonas aeruginosa PA01
ucagcgccuugaccucgacgcc

SEQ ID NO: 1465669 - RNA, 13 nt, Pseudomonas aeruginosa PA01
ucagcgcgacagg

SEQ ID NO: 1465670 - RNA, 18 nt, Pseudomonas aeruginosa PA01
ucagcgcgacaggcuggc

SEQ ID NO: 1465671 - RNA, 19 nt, Pseudomonas aeruginosa PA01
ucagcgccgcuucuucccg

SEQ ID NO: 1465672 - RNA, 13 nt, Pseudomonas aeruginosa PA01
ucagcgccgggug

SEQ ID NO: 1465673 - RNA, 17 nt, Pseudomonas aeruginosa PA01
ucagcgccgggugaccg

SEQ ID NO: 1465674 - RNA, 17 nt, Pseudomonas aeruginosa PA01
ucagcgccgguagcggc

SEQ ID NO: 1465675 - RNA, 16 nt, Pseudomonas aeruginosa PA01
ucagcgccucgaccuc

SEQ ID NO: 1465676 - RNA, 19 nt, Pseudomonas aeruginosa PA01
ucagcgccucgaccucggc

SEQ ID NO: 1465677 - RNA, 22 nt, Pseudomonas aeruginosa PA01
ucagcgccucgaccucggccgc

SEQ ID NO: 1465678 - RNA, 15 nt, Pseudomonas aeruginosa PA01
ucagcgccucgcggg

SEQ ID NO: 1465679 - RNA, 13 nt, Pseudomonas aeruginosa PA01
ucagcgccucggc

SEQ ID NO: 1465680 - RNA, 15 nt, Pseudomonas aeruginosa PA01
ucagcgcgccagcac

SEQ ID NO: 1465681 - RNA, 14 nt, Pseudomonas aeruginosa PA01
ucagcccgccggcg

SEQ ID NO: 1465682 - RNA, 18 nt, Pseudomonas aeruginosa PA01
ucagcccgccggcgaugc

SEQ ID NO: 1465683 - RNA, 15 nt, Pseudomonas aeruginosa PA01
ucagcccgccgugcg

SEQ ID NO: 1465684 - RNA, 23 nt, Pseudomonas aeruginosa PA01
ucagcccgccgugcgcuccgcca

SEQ ID NO: 1465685 - RNA, 20 nt, Pseudomonas aeruginosa PA01
ucagccccgaucgccucggc

SEQ ID NO: 1465686 - RNA, 16 nt, Pseudomonas aeruginosa PA01
ucagccccucgccauu

SEQ ID NO: 1465687 - RNA, 16 nt, Pseudomonas aeruginosa PA01
ucagcccacgcgccug

SEQ ID NO: 1465688 - RNA, 17 nt, Pseudomonas aeruginosa PA01
ucagcgaaauggucacc

SEQ ID NO: 1465689 - RNA, 17 nt, Pseudomonas aeruginosa PA01
ucagccucacccugcug

SEQ ID NO: 1465690 - RNA, 13 nt, Pseudomonas aeruginosa PA01
ucagccuggccag

SEQ ID NO: 1465691 - RNA, 14 nt, Pseudomonas aeruginosa PA01
ucagccuggccagc

SEQ ID NO: 1465692 - RNA, 18 nt, Pseudomonas aeruginosa PA01
ucagccuggccagcgucg

SEQ ID NO: 1465693 - RNA, 20 nt, Pseudomonas aeruginosa PA01
ucagccuggggugcagcagg

SEQ ID NO: 1465694 - RNA, 21 nt, Pseudomonas aeruginosa PA01
ucagccuggucauccuggccc

SEQ ID NO: 1465695 - RNA, 21 nt, Pseudomonas aeruginosa PA01
ucagccugucacucaggcaug

SEQ ID NO: 1465696 - RNA, 21 nt, Pseudomonas aeruginosa PA01
uccagcaaugccagcgccacg

SEQ ID NO: 1465697 - RNA, 20 nt, Pseudomonas aeruginosa PA01
uccagcaacccaugccgcaa

SEQ ID NO: 1465698 - RNA, 14 nt, Pseudomonas aeruginosa PA01
uccagcaacgccgc

SEQ ID NO: 1465699 - RNA, 20 nt, Pseudomonas aeruginosa PA01
uccagcaacgccgcccccag

SEQ ID NO: 1465700 - RNA, 15 nt, Pseudomonas aeruginosa PA01
uccagcaacgccucg

SEQ ID NO: 1465701 - RNA, 15 nt, Pseudomonas aeruginosa PA01
uccagcacccaggua

SEQ ID NO: 1465702 - RNA, 20 nt, Pseudomonas aeruginosa PA01
uccagcaccgccuggcgcaa

SEQ ID NO: 1465703 - RNA, 21 nt, Pseudomonas aeruginosa PA01
uccagcaccgcuuucaccagg

SEQ ID NO: 1465704 - RNA, 15 nt, Pseudomonas aeruginosa PA01
uccagcacgcuggcg

SEQ ID NO: 1465705 - RNA, 17 nt, Pseudomonas aeruginosa PA01
uccagcacgcuggcgag

SEQ ID NO: 1465706 - RNA, 21 nt, Pseudomonas aeruginosa PA01
uccagcacgcuggcgaggacg

SEQ ID NO: 1465707 - RNA, 19 nt, Pseudomonas aeruginosa PA01
uccagacucuccaggucgg

SEQ ID NO: 1465708 - RNA, 22 nt, Pseudomonas aeruginosa PA01
uccagaggaacaguucggcgag

SEQ ID NO: 1465709 - RNA, 14 nt, Pseudomonas aeruginosa PA01
uccagaguccaugc

SEQ ID NO: 1465710 - RNA, 12 nt, Pseudomonas aeruginosa PA01
uccagaccucga

SEQ ID NO: 1465711 - RNA, 22 nt, Pseudomonas aeruginosa PA01
uccagaugaaacugcccggcuc

SEQ ID NO: 1465712 - RNA, 22 nt, Pseudomonas aeruginosa PA01
uccagccccgcgauugcagcuc

SEQ ID NO: 1465713 - RNA, 19 nt, Pseudomonas aeruginosa PA01
uccagcacggugaaccagg

SEQ ID NO: 1465714 - RNA, 15 nt, Pseudomonas aeruginosa PA01
uccagcagcacccgg

SEQ ID NO: 1465715 - RNA, 18 nt, Pseudomonas aeruginosa PA01
uccagcagcacccggacc

SEQ ID NO: 1465716 - RNA, 12 nt, Pseudomonas aeruginosa PA01
uccagccgcccu

SEQ ID NO: 1465717 - RNA, 23 nt, Pseudomonas aeruginosa PA01
uccagcccuggaaaggccucggc

SEQ ID NO: 1465718 - RNA, 16 nt, Pseudomonas aeruginosa PA01
uccagcccggcucggc

SEQ ID NO: 1465719 - RNA, 18 nt, Pseudomonas aeruginosa PA01
uccagccgcugcagggcg

SEQ ID NO: 1465720 - RNA, 20 nt, Pseudomonas aeruginosa PA01
uccagccggcauccagcauc

SEQ ID NO: 1465721 - RNA, 12 nt, Pseudomonas aeruginosa PA01
uccagccggggc

SEQ ID NO: 1465722 - RNA, 18 nt, Pseudomonas aeruginosa PA01
uccagaacgccgcgcacc

SEQ ID NO: 1465723 - RNA, 20 nt, Pseudomonas aeruginosa PA01
uccagaacgccgcgcaccuc

SEQ ID NO: 1465724 - RNA, 15 nt, Pseudomonas aeruginosa PA01
uccacuugcgccggc

SEQ ID NO: 1465725 - RNA, 15 nt, Pseudomonas aeruginosa PA01
uccagacauccgggu

SEQ ID NO: 1465726 - RNA, 18 nt, Pseudomonas aeruginosa PA01
uccacuggcccacggcgc

SEQ ID NO: 1465727 - RNA, 13 nt, Pseudomonas aeruginosa PA01
uccacuccaggcg

SEQ ID NO: 1465728 - RNA, 19 nt, Pseudomonas aeruginosa PA01
uccacuccggcagcacccg

SEQ ID NO: 1465729 - RNA, 17 nt, Pseudomonas aeruginosa PA01
uccacucgccgaccagc

SEQ ID NO: 1465730 - RNA, 18 nt, Pseudomonas aeruginosa PA01
uccacguugagcaucacc

SEQ ID NO: 1465731 - RNA, 18 nt, Pseudomonas aeruginosa PA01
uccacguugcaguccagg

SEQ ID NO: 1465732 - RNA, 17 nt, Pseudomonas aeruginosa PA01
uccacgucgccgaccag

SEQ ID NO: 1465733 - RNA, 19 nt, Pseudomonas aeruginosa PA01
uccacgucgccgaccaggc

SEQ ID NO: 1465734 - RNA, 19 nt, Pseudomonas aeruginosa PA01
uccacagcgugcagaccag

SEQ ID NO: 1465735 - RNA, 15 nt, Pseudomonas aeruginosa PA01
uccacagcugccagc

SEQ ID NO: 1465736 - RNA, 19 nt, Pseudomonas aeruginosa PA01
uccacagggucggcaggac

SEQ ID NO: 1465737 - RNA, 18 nt, Pseudomonas aeruginosa PA01
uccaggucgaucagcagc

SEQ ID NO: 1465738 - RNA, 19 nt, Pseudomonas aeruginosa PA01
uccaggucggcggcacgcu

SEQ ID NO: 1465739 - RNA, 23 nt, Pseudomonas aeruginosa PA01
uccagcuccgucuguucggccag

SEQ ID NO: 1465740 - RNA, 13 nt, Pseudomonas aeruginosa PA01
uccagcguggcgg

SEQ ID NO: 1465741 - RNA, 16 nt, Pseudomonas aeruginosa PA01
uccagcguguggcgaa

SEQ ID NO: 1465742 - RNA, 19 nt, Pseudomonas aeruginosa PA01
uccagcgucugccgcuggc

SEQ ID NO: 1465743 - RNA, 21 nt, Pseudomonas aeruginosa PA01
uccagcgucugccgcuggcgg

SEQ ID NO: 1465744 - RNA, 22 nt, Pseudomonas aeruginosa PA01
uccagcgucugccgcuggcggc

SEQ ID NO: 1465745 - RNA, 15 nt, Pseudomonas aeruginosa PA01
uccagcggcucgcug

SEQ ID NO: 1465746 - RNA, 21 nt, Pseudomonas aeruginosa PA01
uccagcggcuuguccuggcgc

SEQ ID NO: 1465747 - RNA, 18 nt, Pseudomonas aeruginosa PA01
uccagcgggcccauggcg

SEQ ID NO: 1465748 - RNA, 16 nt, Pseudomonas aeruginosa PA01
uccagcggccgcgagc

SEQ ID NO: 1465749 - RNA, 16 nt, Pseudomonas aeruginosa PA01
uccagcggccacggcg

SEQ ID NO: 1465750 - RNA, 12 nt, Pseudomonas aeruginosa PA01
uccagcggcggg

SEQ ID NO: 1465751 - RNA, 19 nt, Pseudomonas aeruginosa PA01
uccagcggcacuucccgcc

SEQ ID NO: 1465752 - RNA, 20 nt, Pseudomonas aeruginosa PA01
uccagcggcagcucggcgac

SEQ ID NO: 1465753 - RNA, 21 nt, Pseudomonas aeruginosa PA01
uccagcgagaacuugccggcg

SEQ ID NO: 1465754 - RNA, 21 nt, Pseudomonas aeruginosa PA01
uccagguucgcguggcccggc

SEQ ID NO: 1465755 - RNA, 14 nt, Pseudomonas aeruginosa PA01
uccagguucggcgc

SEQ ID NO: 1465756 - RNA, 17 nt, Pseudomonas aeruginosa PA01
uccagguucggcgccag

SEQ ID NO: 1465757 - RNA, 23 nt, Pseudomonas aeruginosa PA01
uccagucggggcaggcgcaggcg

SEQ ID NO: 1465758 - RNA, 17 nt, Pseudomonas aeruginosa PA01
uccaguagcgccugguu

SEQ ID NO: 1465759 - RNA, 14 nt, Pseudomonas aeruginosa PA01
uccaguagcggaag

SEQ ID NO: 1465760 - RNA, 16 nt, Pseudomonas aeruginosa PA01
uccaguucggccgcgg

SEQ ID NO: 1465761 - RNA, 14 nt, Pseudomonas aeruginosa PA01
uccaguucggcgau

SEQ ID NO: 1465762 - RNA, 16 nt, Pseudomonas aeruginosa PA01
uccagugccucccggc

SEQ ID NO: 1465763 - RNA, 19 nt, Pseudomonas aeruginosa PA01
uccagugccucccggccau

SEQ ID NO: 1465764 - RNA, 14 nt, Pseudomonas aeruginosa PA01
uccaguuccucgcg

SEQ ID NO: 1465765 - RNA, 18 nt, Pseudomonas aeruginosa PA01
uccaguucguugaccacg

SEQ ID NO: 1465766 - RNA, 16 nt, Pseudomonas aeruginosa PA01
uccaugaaugccuuga

SEQ ID NO: 1465767 - RNA, 15 nt, Pseudomonas aeruginosa PA01
uccaucucgcggcgg

SEQ ID NO: 1465768 - RNA, 21 nt, Pseudomonas aeruginosa PA01
uccaugcgcaccaggucgcgc

SEQ ID NO: 1465769 - RNA, 21 nt, Pseudomonas aeruginosa PA01
uccauggaccgagaccgacgc

SEQ ID NO: 1465770 - RNA, 14 nt, Pseudomonas aeruginosa PA01
uccauggcggcgau

SEQ ID NO: 1465771 - RNA, 15 nt, Pseudomonas aeruginosa PA01
uccaugucgcuggcc

SEQ ID NO: 1465772 - RNA, 12 nt, Pseudomonas aeruginosa PA01
uccaucgccgcg

SEQ ID NO: 1465773 - RNA, 16 nt, Pseudomonas aeruginosa PA01
uccaucgccgcggcga

SEQ ID NO: 1465774 - RNA, 17 nt, Pseudomonas aeruginosa PA01
uccauccagucuucgcc

SEQ ID NO: 1465775 - RNA, 18 nt, Pseudomonas aeruginosa PA01
uccauccagucuucgccg

SEQ ID NO: 1465776 - RNA, 22 nt, Pseudomonas aeruginosa PA01
uccauccccgccucgaccagcg

SEQ ID NO: 1465777 - RNA, 23 nt, Pseudomonas aeruginosa PA01
uccaucccuucgugcuggcggau

SEQ ID NO: 1465778 - RNA, 16 nt, Pseudomonas aeruginosa PA01
uccaucaguugcgcgc

SEQ ID NO: 1465779 - RNA, 22 nt, Pseudomonas aeruginosa PA01
uccauaguagagaugcaccggc

SEQ ID NO: 1465780 - RNA, 17 nt, Pseudomonas aeruginosa PA01
ucaguucugggcggcca

SEQ ID NO: 1465781 - RNA, 19 nt, Pseudomonas aeruginosa PA01
ucaggccaaagccgcaauc

SEQ ID NO: 1465782 - RNA, 20 nt, Pseudomonas aeruginosa PA01
ucaggccaaagccgcaaucc

SEQ ID NO: 1465783 - RNA, 20 nt, Pseudomonas aeruginosa PA01
ucaggcauccccggaccagg

SEQ ID NO: 1465784 - RNA, 18 nt, Pseudomonas aeruginosa PA01
ucaguucggccagcggca

SEQ ID NO: 1465785 - RNA, 22 nt, Pseudomonas aeruginosa PA01
ucaguucgugccaggcgacauc

SEQ ID NO: 1465786 - RNA, 19 nt, Pseudomonas aeruginosa PA01
ucaggcacucgaugaacag

SEQ ID NO: 1465787 - RNA, 23 nt, Pseudomonas aeruginosa PA01
ucauccugcgcgccucuuccugg

SEQ ID NO: 1465788 - RNA, 15 nt, Pseudomonas aeruginosa PA01
ucaucgagcggcggc

SEQ ID NO: 1465789 - RNA, 19 nt, Pseudomonas aeruginosa PA01
ucaucgagcggcggccguc

SEQ ID NO: 1465790 - RNA, 19 nt, Pseudomonas aeruginosa PA01
ucaucucagcaacccgcuc

SEQ ID NO: 1465791 - RNA, 21 nt, Pseudomonas aeruginosa PA01
ucaucgcacggucguccugcg

SEQ ID NO: 1465792 - RNA, 13 nt, Pseudomonas aeruginosa PA01
ucaucaggaucag

SEQ ID NO: 1465793 - RNA, 17 nt, Pseudomonas aeruginosa PA01
ucauguucaguucggcg

SEQ ID NO: 1465794 - RNA, 16 nt, Pseudomonas aeruginosa PA01
ucauguagagcaggcu

SEQ ID NO: 1465795 - RNA, 14 nt, Pseudomonas aeruginosa PA01
ucauggugccgagc

SEQ ID NO: 1465796 - RNA, 17 nt, Pseudomonas aeruginosa PA01
ucauggugaagcccacc

SEQ ID NO: 1465797 - RNA, 22 nt, Pseudomonas aeruginosa PA01
ucaucugggccaucgccggccc

SEQ ID NO: 1465798 - RNA, 15 nt, Pseudomonas aeruginosa PA01
ucaucucggcgcagg

SEQ ID NO: 1465799 - RNA, 15 nt, Pseudomonas aeruginosa PA01
ucaucucgccgucgg

SEQ ID NO: 1465800 - RNA, 17 nt, Pseudomonas aeruginosa PA01
ucaucucgccgucggcg

SEQ ID NO: 1465801 - RNA, 20 nt, Pseudomonas aeruginosa PA01
uccaagagagcgccagcgag

SEQ ID NO: 1465802 - RNA, 19 nt, Pseudomonas aeruginosa PA01
ucauuuucgcgcucagcgc

SEQ ID NO: 1465803 - RNA, 17 nt, Pseudomonas aeruginosa PA01
uccaaggugcugccgau

SEQ ID NO: 1465804 - RNA, 15 nt, Pseudomonas aeruginosa PA01
ucauucggccagcgc

SEQ ID NO: 1465805 - RNA, 16 nt, Pseudomonas aeruginosa PA01
ucauugcgccgccggc

SEQ ID NO: 1465806 - RNA, 15 nt, Pseudomonas aeruginosa PA01
uaaccauugcgcggg

SEQ ID NO: 1465807 - RNA, 19 nt, Pseudomonas aeruginosa PA01
uaacgccugucgcuccggc

SEQ ID NO: 1465808 - RNA, 14 nt, Pseudomonas aeruginosa PA01
uaagugccgaccac

SEQ ID NO: 1465809 - RNA, 14 nt, Pseudomonas aeruginosa PA01
uaaggccaggcucg

SEQ ID NO: 1465810 - RNA, 23 nt, Pseudomonas aeruginosa PA01
uaaggcgugcaguacuuggccag

SEQ ID NO: 1465811 - RNA, 15 nt, Pseudomonas aeruginosa PA01
uaacguuacgcagau

SEQ ID NO: 1465812 - RNA, 17 nt, Pseudomonas aeruginosa PA01
uacaacggcaucggcca

SEQ ID NO: 1465813 - RNA, 20 nt, Pseudomonas aeruginosa PA01
uacaccaggccggcggccga

SEQ ID NO: 1465814 - RNA, 22 nt, Pseudomonas aeruginosa PA01
uacaccgcaucgaagcgcacca

SEQ ID NO: 1465815 - RNA, 17 nt, Pseudomonas aeruginosa PA01
uacacgccguuguugac

SEQ ID NO: 1465816 - RNA, 15 nt, Pseudomonas aeruginosa PA01
uacaggccccaggcg

SEQ ID NO: 1465817 - RNA, 22 nt, Pseudomonas aeruginosa PA01
uacagcucgcugucgccgagca

SEQ ID NO: 1465818 - RNA, 15 nt, Pseudomonas aeruginosa PA01
uacagcucggcgccc

SEQ ID NO: 1465819 - RNA, 19 nt, Pseudomonas aeruginosa PA01
uacagcucggcgcccuggc

SEQ ID NO: 1465820 - RNA, 15 nt, Pseudomonas aeruginosa PA01
uacaggucggcgccg

SEQ ID NO: 1465821 - RNA, 13 nt, Pseudomonas aeruginosa PA01
uacaggcgcgccu

SEQ ID NO: 1465822 - RNA, 15 nt, Pseudomonas aeruginosa PA01
uacaggcgcaccugg

SEQ ID NO: 1465823 - RNA, 12 nt, Pseudomonas aeruginosa PA01
uacagcgccacg

SEQ ID NO: 1465824 - RNA, 23 nt, Pseudomonas aeruginosa PA01
uacagcgaggcccgcgccgccgg

SEQ ID NO: 1465825 - RNA, 16 nt, Pseudomonas aeruginosa PA01
uacagcccccccagca

SEQ ID NO: 1465826 - RNA, 16 nt, Pseudomonas aeruginosa PA01
uacagcccccgccggc

SEQ ID NO: 1465827 - RNA, 15 nt, Pseudomonas aeruginosa PA01
uacagcacccaggcg

SEQ ID NO: 1465828 - RNA, 20 nt, Pseudomonas aeruginosa PA01
uacagcaggagcgccaucag

SEQ ID NO: 1465829 - RNA, 13 nt, Pseudomonas aeruginosa PA01
uaccacguccaga

SEQ ID NO: 1465830 - RNA, 18 nt, Pseudomonas aeruginosa PA01
uaccacguggccggcgcg

SEQ ID NO: 1465831 - RNA, 14 nt, Pseudomonas aeruginosa PA01
uaccacgcagccac

SEQ ID NO: 1465832 - RNA, 16 nt, Pseudomonas aeruginosa PA01
uaccaccgggccgucg

SEQ ID NO: 1465833 - RNA, 23 nt, Pseudomonas aeruginosa PA01
uaccaauuuuaauuuugcuacca

SEQ ID NO: 1465834 - RNA, 16 nt, Pseudomonas aeruginosa PA01
uacaucgggauaccgg

SEQ ID NO: 1465835 - RNA, 19 nt, Pseudomonas aeruginosa PA01
uacaucgggauaccggcca

SEQ ID NO: 1465836 - RNA, 23 nt, Pseudomonas aeruginosa PA01
uacaugcugcucaguugcaccug

SEQ ID NO: 1465837 - RNA, 19 nt, Pseudomonas aeruginosa PA01
uacaugacgaagcgcaccg

SEQ ID NO: 1465838 - RNA, 14 nt, Pseudomonas aeruginosa PA01
guugcacagcgccc

SEQ ID NO: 1465839 - RNA, 14 nt, Pseudomonas aeruginosa PA01
guugaugccgaggc

SEQ ID NO: 1465840 - RNA, 15 nt, Pseudomonas aeruginosa PA01
guugauucaggcggc

SEQ ID NO: 1465841 - RNA, 14 nt, Pseudomonas aeruginosa PA01
guugauuccgccgg

SEQ ID NO: 1465842 - RNA, 19 nt, Pseudomonas aeruginosa PA01
guugaugucgucgaacgac

SEQ ID NO: 1465843 - RNA, 17 nt, Pseudomonas aeruginosa PA01
guugcaguccaggccgu

SEQ ID NO: 1465844 - RNA, 24 nt, Pseudomonas aeruginosa PA01
guugcaguaccugcucacggccga

SEQ ID NO: 1465845 - RNA, 16 nt, Pseudomonas aeruginosa PA01
guugcaggccagcgcc

SEQ ID NO: 1465846 - RNA, 17 nt, Pseudomonas aeruginosa PA01
guugcaggccagcgcca

SEQ ID NO: 1465847 - RNA, 12 nt, Pseudomonas aeruginosa PA01
guugcaggccgg

SEQ ID NO: 1465848 - RNA, 14 nt, Pseudomonas aeruginosa PA01
guugcagcgccugu

SEQ ID NO: 1465849 - RNA, 14 nt, Pseudomonas aeruginosa PA01
guugcagcaccccc

SEQ ID NO: 1465850 - RNA, 19 nt, Pseudomonas aeruginosa PA01
guugcagcacccccagcag

SEQ ID NO: 1465851 - RNA, 21 nt, Pseudomonas aeruginosa PA01
guugcagcacccccagcaggc

SEQ ID NO: 1465852 - RNA, 15 nt, Pseudomonas aeruginosa PA01
guugcagccaccagc

SEQ ID NO: 1465853 - RNA, 22 nt, Pseudomonas aeruginosa PA01
guugaguugcaggccggcgagc

SEQ ID NO: 1465854 - RNA, 20 nt, Pseudomonas aeruginosa PA01
guugauacgguuugaggcgu

SEQ ID NO: 1465855 - RNA, 22 nt, Pseudomonas aeruginosa PA01
guugaucaccaccggcuggcgg

SEQ ID NO: 1465856 - RNA, 20 nt, Pseudomonas aeruginosa PA01
guugaucagguucggcagcg

SEQ ID NO: 1465857 - RNA, 14 nt, Pseudomonas aeruginosa PA01
guugauccgcgugg

SEQ ID NO: 1465858 - RNA, 17 nt, Pseudomonas aeruginosa PA01
guugaucggcaacgagc

SEQ ID NO: 1465859 - RNA, 20 nt, Pseudomonas aeruginosa PA01
guugaugaagccgcgaccgg

SEQ ID NO: 1465860 - RNA, 17 nt, Pseudomonas aeruginosa PA01
guugaucggcguggcgg

SEQ ID NO: 1465861 - RNA, 16 nt, Pseudomonas aeruginosa PA01
guugaucgacgccagc

SEQ ID NO: 1465862 - RNA, 15 nt, Pseudomonas aeruginosa PA01
guugaucgccgcgcc

SEQ ID NO: 1465863 - RNA, 16 nt, Pseudomonas aeruginosa PA01
guugaucgccgcgccg

SEQ ID NO: 1465864 - RNA, 17 nt, Pseudomonas aeruginosa PA01
guugaucgccgcgccgc

SEQ ID NO: 1465865 - RNA, 20 nt, Pseudomonas aeruginosa PA01
guugaucgccgcgccgccga

SEQ ID NO: 1465866 - RNA, 21 nt, Pseudomonas aeruginosa PA01
guugaucgccgcgccgccgag

SEQ ID NO: 1465867 - RNA, 22 nt, Pseudomonas aeruginosa PA01
guugaucgccgcgccgccgagg

SEQ ID NO: 1465868 - RNA, 16 nt, Pseudomonas aeruginosa PA01
guucuugucgaccagc

SEQ ID NO: 1465869 - RNA, 14 nt, Pseudomonas aeruginosa PA01
guucuugccgcugu

SEQ ID NO: 1465870 - RNA, 16 nt, Pseudomonas aeruginosa PA01
guucuucguuccaucg

SEQ ID NO: 1465871 - RNA, 21 nt, Pseudomonas aeruginosa PA01
guugaacgucucggcgaacga

SEQ ID NO: 1465872 - RNA, 19 nt, Pseudomonas aeruginosa PA01
guucgaaguucuccagcaa

SEQ ID NO: 1465873 - RNA, 20 nt, Pseudomonas aeruginosa PA01
guucgaaguucuccagcaag

SEQ ID NO: 1465874 - RNA, 21 nt, Pseudomonas aeruginosa PA01
guucgaaguucuccagcaagc

SEQ ID NO: 1465875 - RNA, 21 nt, Pseudomonas aeruginosa PA01
guuccuggcgcgcggccgcgu
